United States Patent 11,332,783 (SAMPLE ANALYSIS, PRESENCE DETERMINATION OF A TARGET SEQUENCE) - sequence listing, part 20

SEQ ID NO: 392962 - DNA, 140 bp, Artificial Sequence
  Synthetic
atggccgactcccaagtacgggaggtctggtcgagttgaggatgatgacatctgtctcattttccccccagttgtatgtggggacgccgagcctgtcggtggtgcctaccactacaggacggagacccagcatggcgtat

SEQ ID NO: 392963 - DNA, 140 bp, Artificial Sequence
  Synthetic
atacgccatgctgggtctccagataaaatcaagtgtccatgtcaggttcctgcccccgagttcttcactgaggtggatggcgtcagaattcatcgccacgcgcctgagtgtaagcccttgcgtacttgggagtcggccat

SEQ ID NO: 392964 - DNA, 140 bp, Artificial Sequence
  Synthetic
atggccgactcccaagtacgcaagggcttacactcaggcgcgtggcgatgaattctgacgccatccacctcagtgaagaactcgggggcaggaacctgacatggacacttgattttatctggagacccagcatggcgtat

SEQ ID NO: 392965 - DNA, 140 bp, Artificial Sequence
  Synthetic
aggccctggctgctgatatggccaggggatcacccccctcgttagccagctcctctgctagtcagctttccgcgccatccttgaaagccacatgtaccgcccaccacagttcccctggccgaccttttgggacagcggtg

SEQ ID NO: 392966 - DNA, 140 bp, Artificial Sequence
  Synthetic
caccgctgtcccaaaaggtcggccaggggaactgtggtgggcggtacatgtggctttcaaggatggcgcggaaagctgactagcagaggagctggctaacgaggggggtgatcccctggccatatcagcagccagggcct

SEQ ID NO: 392967 - DNA, 140 bp, Artificial Sequence
  Synthetic
atacgccatgctgggtctccggggcgctgatacggccgcttgcggtgacatcatcgccggccttcctgtctcagctaggcgtgggaaccttctgtttctgggccccgctgatgacgtcaacgtacttgggagtcggccat

SEQ ID NO: 392968 - DNA, 140 bp, Artificial Sequence
  Synthetic
atggccgactcccaagtacgttgacgtcatcagcggggcccagaaacagaaggttcccacgcctagctgagacaggaaggccggcgatgatgtcaccgcaagcggccgtatcagcgccccggagacccagcatggcgtat

SEQ ID NO: 392969 - DNA, 140 bp, Artificial Sequence
  Synthetic
atacgccatgctgggtctcccgaagaggacagggaggtttctgttccagcagagattttgcggcctgctaaaaaattcccgccggccatacccatctgggcccggccagactacaacccgcgtacttgggagtcggccat

SEQ ID NO: 392970 - DNA, 140 bp, Artificial Sequence
  Synthetic
atggccgactcccaagtacgcgggttgtagtctggccgggcccagatgggtatggccggcgggaattttttagcaggccgcaaaatctctgctggaacagaaacctccctgtcctcttcgggagacccagcatggcgtat

SEQ ID NO: 392971 - DNA, 140 bp, Artificial Sequence
  Synthetic
atacgccatgctgggtctccggaagaagaagacggtcgtactctccgagtccaccgtttcagaagccttggcggacctggcggcaaagtccttcggctgcccggagtcggaacccgattccgtacttgggagtcggccat

SEQ ID NO: 392972 - DNA, 140 bp, Artificial Sequence
  Synthetic
atggccgactcccaagtacggaatcgggttccgactccgggcagccgaaggactttgccgccaggtccgccaaggcttctgaaacggtggactcggagagtacgaccgtcttcttcttccggagacccagcatggcgtat

SEQ ID NO: 392973 - DNA, 140 bp, Artificial Sequence
  Synthetic
aggccctggctgctgatatggaaccagtcgtcttctcccgaatggagaccaagctcatcacgtggggggcagacaccgccgcgtgcggtgacatcatcaacggcttgcccgtctccgcccgaccttttgggacagcggtg

SEQ ID NO: 392974 - DNA, 140 bp, Artificial Sequence
  Synthetic
caccgctgtcccaaaaggtcgggcggagacgggcaagccgttgatgatgtcaccgcacgcggcggtgtctgccccccacgtgatgagcttggtctccattcgggagaagacgactggttccatatcagcagccagggcct

SEQ ID NO: 392975 - DNA, 140 bp, Artificial Sequence
  Synthetic
atacgccatgctgggtctccgaaggggagcccggcgatccagaccttacatcagactcttggtccactgtcagtggatcggaggatgtagtatgttgctcaatgtcatattcatggacagcgtacttgggagtcggccat

SEQ ID NO: 392976 - DNA, 140 bp, Artificial Sequence
  Synthetic
atggccgactcccaagtacgctgtccatgaatatgacattgagcaacatactacatcctccgatccactgacagtggaccaagagtctgatgtaaggtctggatcgccgggctccccttcggagacccagcatggcgtat

SEQ ID NO: 392977 - DNA, 140 bp, Artificial Sequence
  Synthetic
aggccctggctgctgatatgcagtggatcggaggatgtagtatgttgctcaatgtcatattcatggacaggggcgctcataacacctattgcagcggaggagtccaagctgcctattaacgaccttttgggacagcggtg

SEQ ID NO: 392978 - DNA, 140 bp, Artificial Sequence
  Synthetic
caccgctgtcccaaaaggtcgttaataggcagcttggactcctccgctgcaataggtgttatgagcgcccctgtccatgaatatgacattgagcaacatactacatcctccgatccactgcatatcagcagccagggcct

SEQ ID NO: 392979 - DNA, 140 bp, Artificial Sequence
  Synthetic
atacgccatgctgggtctccaaatgaggttttttctgtcaacccccaaaagggcggccgaaaacccgcgcgtctcatcgtatacccggatctgggagttcgggtgtgcgagaagagagcgcgtacttgggagtcggccat

SEQ ID NO: 392980 - DNA, 140 bp, Artificial Sequence
  Synthetic
atggccgactcccaagtacgcgctctcttctcgcacacccgaactcccagatccgggtatacgatgagacgcgcgggttttcggccgcccttttgggggttgacagaaaaaacctcatttggagacccagcatggcgtat

SEQ ID NO: 392981 - DNA, 140 bp, Artificial Sequence
  Synthetic
aggccctggctgctgatatgtgaactcatctggatttaccaaagtgtgcggagcgcctccttgtgtcatcggaggggtgggcaacaacaccttgcactgccccactgactgcttccgcaagaccttttgggacagcggtg

SEQ ID NO: 392982 - DNA, 140 bp, Artificial Sequence
  Synthetic
caccgctgtcccaaaaggtcttgcggaagcagtcagtggggcagtgcaaggtgttgttgcccacccctccgatgacacaaggaggcgctccgcacactttggtaaatccagatgagttcacatatcagcagccagggcct

SEQ ID NO: 392983 - DNA, 140 bp, Artificial Sequence
  Synthetic
atacgccatgctgggtctccgggtatcgcaggtgccgcgcgagcggcgtgttcaccacaagcttcgggaacacactgacgtgcttcctcaaggctacagcggctgctaaagccgccggcccgtacttgggagtcggccat

SEQ ID NO: 392984 - DNA, 140 bp, Artificial Sequence
  Synthetic
atggccgactcccaagtacgggccggcggctttagcagccgctgtagccttgaggaagcacgtcagtgtgttcccgaagcttgtggtgaacacgccgctcgcgcggcacctgcgatacccggagacccagcatggcgtat

SEQ ID NO: 392985 - DNA, 140 bp, Artificial Sequence
  Synthetic
aggccctggctgctgatatggcatccggaagccacatactctcggtgtggctccggtccctggatcacgcccaggtgcctggtccactatccttataggctttggcattatccttgtaccgaccttttgggacagcggtg

SEQ ID NO: 392986 - DNA, 140 bp, Artificial Sequence
  Synthetic
caccgctgtcccaaaaggtcggtacaaggataatgccaaagcctataaggatagtggaccaggcacctgggcgtgatccagggaccggagccacaccgagagtatgtggcttccggatgccatatcagcagccagggcct

SEQ ID NO: 392987 - DNA, 140 bp, Artificial Sequence
  Synthetic
atacgccatgctgggtctccttgatgacccacttcttctcagtactccaaacccaggaggcccttgaaaaagcactcgacttcgatatgtacggagtcacatactctatcactccgctggcgtacttgggagtcggccat

SEQ ID NO: 392988 - DNA, 140 bp, Artificial Sequence
  Synthetic
atggccgactcccaagtacgccagcggagtgatagagtatgtgactccgtacatatcgaagtcgagtgctttttcaagggcctcctgggtttggagtactgagaagaagtgggtcatcaaggagacccagcatggcgtat

SEQ ID NO: 392989 - DNA, 140 bp, Artificial Sequence
  Synthetic
aggccctggctgctgatatgttgcaagtgtggatcccccccctcaacgttcgggggggccgcgacgccatcatcctcctcacgtgcgcggtccacccagagctaatcttttccatcaccagaccttttgggacagcggtg

SEQ ID NO: 392990 - DNA, 140 bp, Artificial Sequence
  Synthetic
caccgctgtcccaaaaggtctggtgatggaaaagattagctctgggtggaccgcgcacgtgaggaggatgatggcgtcgcggcccccccgaacgttgaggggggggatccacacttgcaacatatcagcagccagggcct

SEQ ID NO: 392991 - DNA, 140 bp, Artificial Sequence
  Synthetic
aggccctggctgctgatatgccagtggataagctcggagtgcaccactccatgctccggttcctggttaagggacatctgggactggatatgcgaggtgctgagcgactttaagacctgggaccttttgggacagcggtg

SEQ ID NO: 392992 - DNA, 140 bp, Artificial Sequence
  Synthetic
caccgctgtcccaaaaggtcccaggtcttaaagtcgctcagcacctcgcatatccagtcccagatgtcccttaaccaggaaccggagcatggagtggtgcactccgagcttatccactggcatatcagcagccagggcct

SEQ ID NO: 392993 - DNA, 140 bp, Artificial Sequence
  Synthetic
atacgccatgctgggtctcccgtgctttcagcttcgatgtaggagggcgtggatatgtcctgcgggtaaatagctgcgccgatggtttctacaaagatcgttatgtttatcggcactttgcgtacttgggagtcggccat

SEQ ID NO: 392994 - DNA, 140 bp, Artificial Sequence
  Synthetic
atggccgactcccaagtacgcaaagtgccgataaacataacgatctttgtagaaaccatcggcgcagctatttacccgcaggacatatccacgccctcctacatcgaagctgaaagcacgggagacccagcatggcgtat

SEQ ID NO: 392995 - DNA, 140 bp, Artificial Sequence
  Synthetic
aggccctggctgctgatatgggagtcctggcgggcctggcctactattccatggtggggaactgggctaaggttttgattgtgatgctactctttgccggcgttgacgggcaaacctatagaccttttgggacagcggtg

SEQ ID NO: 392996 - DNA, 140 bp, Artificial Sequence
  Synthetic
caccgctgtcccaaaaggtctataggtttgcccgtcaacgccggcaaagagtagcatcacaatcaaaaccttagcccagttccccaccatggaatagtaggccaggcccgccaggactcccatatcagcagccagggcct

SEQ ID NO: 392997 - DNA, 140 bp, Artificial Sequence
  Synthetic
atacgccatgctgggtctccgcacatcaacaggactgccctgaactgcaacgactccctcaacactggatttcttgccgcgctgttctacacacacaagttcaactcatccagagccgagcgtacttgggagtcggccat

SEQ ID NO: 392998 - DNA, 140 bp, Artificial Sequence
  Synthetic
atggccgactcccaagtacgctcggctctggatgagttgaacttgtgtgtgtagaacagcgcggcaagaaatccagtgttgagggagtcgttgcagttcagggcagtcctgttgatgtgcggagacccagcatggcgtat

SEQ ID NO: 392999 - DNA, 140 bp, Artificial Sequence
  Synthetic
atacgccatgctgggtctccagcgtattggccagctgccgcttcatcgacgagttcgatcagggatggggccccatcacttacaccgagcgtaacagttcggaccagaggccttattgctcgtacttgggagtcggccat

SEQ ID NO: 393000 - DNA, 140 bp, Artificial Sequence
  Synthetic
atggccgactcccaagtacgagcaataaggcctctggtccgaactgttacgctcggtgtaagtgatggggccccatccctgatcgaactcgtcgatgaagcggcagctggccaatacgctggagacccagcatggcgtat

SEQ ID NO: 393001 - DNA, 140 bp, Artificial Sequence
  Synthetic
aggccctggctgctgatatgcaaatgatccccggcggaggtctcgcaatttgggtaaggtcatcgataccctcacgtgcggcttcgccgacctcatgggatacatcccgctcgtaggcgcgaccttttgggacagcggtg

SEQ ID NO: 393002 - DNA, 140 bp, Artificial Sequence
  Synthetic
caccgctgtcccaaaaggtcgcgcctacgagcgggatgtatcccatgaggtcggcgaagccgcacgtgagggtatcgatgaccttacccaaattgcgagacctccgccggggatcatttgcatatcagcagccagggcct

SEQ ID NO: 393003 - DNA, 140 bp, Artificial Sequence
  Synthetic
aggccctggctgctgatatgcccccttctgtggccagctcctcggctagccagctgtccgctccatctctcaaggcaacttgcaccaccaaccatgactcccctgacgccgagctcataggaccttttgggacagcggtg

SEQ ID NO: 393004 - DNA, 140 bp, Artificial Sequence
  Synthetic
caccgctgtcccaaaaggtcctatgagctcggcgtcaggggagtcatggttggtggtgcaagttgccttgagagatggagcggacagctggctagccgaggagctggccacagaagggggcatatcagcagccagggcct

SEQ ID NO: 393005 - DNA, 140 bp, Artificial Sequence
  Synthetic
aggccctggctgctgatatgccaagtggcccatctacacgcccccaccggcagcggcaagagcaccaaggtgccggctgcatatgcagcccaagggtacaaggtactcgtcctgaacccggaccttttgggacagcggtg

SEQ ID NO: 393006 - DNA, 140 bp, Artificial Sequence
  Synthetic
caccgctgtcccaaaaggtccgggttcaggacgagtaccttgtacccttgggctgcatatgcagccggcaccttggtgctcttgccgctgccggtgggggcgtgtagatgggccacttggcatatcagcagccagggcct

SEQ ID NO: 393007 - DNA, 140 bp, Artificial Sequence
  Synthetic
atacgccatgctgggtctccgcattatcacaacacctcgggcatctatcacatcactaatgactgccccaattccagcatagtctttgaggcagaccatcatattctgcacctcccagggcgtacttgggagtcggccat

SEQ ID NO: 393008 - DNA, 140 bp, Artificial Sequence
  Synthetic
atggccgactcccaagtacgccctgggaggtgcagaatatgatggtctgcctcaaagactatgctggaattggggcagtcattagtgatgtgatagatgcccgaggtgttgtgataatgcggagacccagcatggcgtat

SEQ ID NO: 393009 - DNA, 140 bp, Artificial Sequence
  Synthetic
aggccctggctgctgatatgggcgtcatgtggatttgatggtgggcactgccacgctgtgctccgcactctacgttggagatctgtgcggaggcatcttcttagtgggtcagatgttcacgaccttttgggacagcggtg

SEQ ID NO: 393010 - DNA, 140 bp, Artificial Sequence
  Synthetic
caccgctgtcccaaaaggtcgtgaacatctgacccactaagaagatgcctccgcacagatctccaacgtagagtgcggagcacagcgtggcagtgcccaccatcaaatccacatgacgcccatatcagcagccagggcct

SEQ ID NO: 393011 - DNA, 140 bp, Artificial Sequence
  Synthetic
atacgccatgctgggtctcctggagccccaccaccgctctggtcctagcacaaatcatgagactacccagcgctctagttgacatgctcgtgggcggtcactggggcgtcctggccggcacgtacttgggagtcggccat

SEQ ID NO: 393012 - DNA, 140 bp, Artificial Sequence
  Synthetic
atggccgactcccaagtacgtgccggccaggacgccccagtgaccgcccacgagcatgtcaactagagcgctgggtagtctcatgatttgtgctaggaccagagcggtggtggggctccaggagacccagcatggcgtat

SEQ ID NO: 393013 - DNA, 140 bp, Artificial Sequence
  Synthetic
atacgccatgctgggtctccgccggcccgaagggcccggtgatacagatgtacaccaatgtggacaaagacttggtggggtggccctgtccacccggcgctcggtcactggttccatgcacgtacttgggagtcggccat

SEQ ID NO: 393014 - DNA, 140 bp, Artificial Sequence
  Synthetic
atggccgactcccaagtacgtgcatggaaccagtgaccgagcgccgggtggacagggccaccccaccaagtctttgtccacattggtgtacatctgtatcaccgggcccttcgggccggcggagacccagcatggcgtat

SEQ ID NO: 393015 - DNA, 140 bp, Artificial Sequence
  Synthetic
atacgccatgctgggtctcccggcagcaccattcacgggattgctaacctctttaccccggggtctaagcagaacctccagcttatcaacaccaatgggagctggcacatcaacaggacacgtacttgggagtcggccat

SEQ ID NO: 393016 - DNA, 140 bp, Artificial Sequence
  Synthetic
atggccgactcccaagtacgtgtcctgttgatgtgccagctcccattggtgttgataagctggaggttctgcttagaccccggggtaaagaggttagcaatcccgtgaatggtgctgccgggagacccagcatggcgtat

SEQ ID NO: 393017 - DNA, 140 bp, Artificial Sequence
  Synthetic
atacgccatgctgggtctccgcaaacgcctcgacgaccttgcgcaaggctggggcaagctcggggccgctaacatcacaggctcctctgatgatagaccttactgctggcactacgcgcccgtacttgggagtcggccat

SEQ ID NO: 393018 - DNA, 140 bp, Artificial Sequence
  Synthetic
atggccgactcccaagtacgggcgcgtagtgccagcagtaaggtctatcatcagaggagcctgtgatgttagcggccccgagcttgccccagccttgcgcaaggtcgtcgaggcgtttgcggagacccagcatggcgtat

SEQ ID NO: 393019 - DNA, 140 bp, Artificial Sequence
  Synthetic
atacgccatgctgggtctccgaggcgcacttgcatatgtggatcccccccctcaacgttcggggaggccgcgatgccatcatcctcctcgcatgtgcggcccatccagagctgatctttgcgtacttgggagtcggccat

SEQ ID NO: 393020 - DNA, 140 bp, Artificial Sequence
  Synthetic
atggccgactcccaagtacgcaaagatcagctctggatgggccgcacatgcgaggaggatgatggcatcgcggcctccccgaacgttgaggggggggatccacatatgcaagtgcgcctcggagacccagcatggcgtat

SEQ ID NO: 393021 - DNA, 140 bp, Artificial Sequence
  Synthetic
atacgccatgctgggtctcccctacgtacagctggggggcaaacgagacagatgtcttcatccttaactcgaccaggcctccacgaggcgcatggttcgggtgtacgtggatgaatggcacgtacttgggagtcggccat

SEQ ID NO: 393022 - DNA, 140 bp, Artificial Sequence
  Synthetic
atggccgactcccaagtacgtgccattcatccacgtacacccgaaccatgcgcctcgtggaggcctggtcgagttaaggatgaagacatctgtctcgtttgccccccagctgtacgtaggggagacccagcatggcgtat

SEQ ID NO: 393023 - DNA, 140 bp, Artificial Sequence
  Synthetic
aggccctggctgctgatatgatgtggaagtgtctcatacggctaaagcctacgctgcacgggccaacgcccctgctgtataggctaggagccgtccaaaacgaggtcatcctcacacaccgaccttttgggacagcggtg

SEQ ID NO: 393024 - DNA, 140 bp, Artificial Sequence
  Synthetic
caccgctgtcccaaaaggtcggtgtgtgaggatgacctcgttttggacggctcctagcctatacagcaggggcgttggcccgtgcagcgtaggctttagccgtatgagacacttccacatcatatcagcagccagggcct

SEQ ID NO: 393025 - DNA, 140 bp, Artificial Sequence
  Synthetic
atacgccatgctgggtctccgttgccaatcagagctggagctgccccaccgattgcttcaggaaacacccagaaacaacctacaccaaatgtggttcaggcccctggctcacgccgcggtcgtacttgggagtcggccat

SEQ ID NO: 393026 - DNA, 140 bp, Artificial Sequence
  Synthetic
atggccgactcccaagtacgaccgcggcgtgagccaggggcctgaaccacatttggtgtaggttgtttctgggtgtttcctgaagcaatcggtggggcagctccagctctgattggcaacggagacccagcatggcgtat

SEQ ID NO: 393027 - DNA, 140 bp, Artificial Sequence
  Synthetic
atacgccatgctgggtctccagaggcagcatgcaattggaccaggggagaaccttgcgggttggagcacagggaccgcgcagaactgtcgcccttgctcttgtccaccacccagtggcagcgtacttgggagtcggccat

SEQ ID NO: 393028 - DNA, 140 bp, Artificial Sequence
  Synthetic
atggccgactcccaagtacgctgccactgggtggtggacaagagcaagggcgacagttctgcgcggtccctgtgctccaacccgcaaggttctcccctggtccaattgcatgctgcctctggagacccagcatggcgtat

SEQ ID NO: 393029 - DNA, 140 bp, Artificial Sequence
  Synthetic
atacgccatgctgggtctcccatcaataggacggccttgaactgcaacgacagcctccagaccggctggatagcagggcttctctaccataacaagttcaactcttcaggctgtcccgagcgtacttgggagtcggccat

SEQ ID NO: 393030 - DNA, 140 bp, Artificial Sequence
  Synthetic
atggccgactcccaagtacgctcgggacagcctgaagagttgaacttgttatggtagagaagccctgctatccagccggtctggaggctgtcgttgcagttcaaggccgtcctattgatgggagacccagcatggcgtat

SEQ ID NO: 393031 - DNA, 140 bp, Artificial Sequence
  Synthetic
atacgccatgctgggtctccccgtggtggtgtcttgggccctcaagtgggagtatgttgtgctagccttcctgctactagcagacgccagagtctgtgcatgtctttggatgatgctgctcgtacttgggagtcggccat

SEQ ID NO: 393032 - DNA, 140 bp, Artificial Sequence
  Synthetic
atggccgactcccaagtacgagcagcatcatccaaagacatgcacagactctggcgtctgctagtagcaggaaggctagcacaacatactcccacttgagggcccaagacaccaccacggggagacccagcatggcgtat

SEQ ID NO: 393033 - DNA, 140 bp, Artificial Sequence
  Synthetic
aggccctggctgctgatatgccggtatattgcttcactcccagtcccgtggtggtgggaacgaccgacaagtcgggcgcgcctacctacaactggggtgaaaatgaaacggacgtcttcggaccttttgggacagcggtg

SEQ ID NO: 393034 - DNA, 140 bp, Artificial Sequence
  Synthetic
caccgctgtcccaaaaggtccgaagacgtccgtttcattttcaccccagttgtaggtaggcgcgcccgacttgtcggtcgttcccaccaccacgggactgggagtgaagcaatataccggcatatcagcagccagggcct

SEQ ID NO: 393035 - DNA, 140 bp, Artificial Sequence
  Synthetic
  misc_feature (42)..(42): n is a, c, g, or t
  misc_feature (81)..(81): n is a, c, g, or t
atacgccatgctgggtctccaatcagttatctgaaggggtcntcgggaggtccaattctgtgcccatcaggccacgccgtnggcttgtttagggctgccgtgtgcacgcggggtgtggcgcgtacttgggagtcggccat

SEQ ID NO: 393036 - DNA, 140 bp, Artificial Sequence
  Synthetic
  misc_feature (60)..(60): n is a, c, g, or t
  misc_feature (99)..(99): n is a, c, g, or t
atggccgactcccaagtacgcgccacaccccgcgtgcacacggcagccctaaacaagccnacggcgtggcctgatgggcacagaattggacctcccgangaccccttcagataactgattggagacccagcatggcgtat

SEQ ID NO: 393037 - DNA, 140 bp, Artificial Sequence
  Synthetic
atacgccatgctgggtctccgtggtgtggtacataaagggccgagccccagccgcagccgcgtatgcggcttgcggaatgtggcctttgctcctcctgctcctcgcgttgcccgaacgggcgtacttgggagtcggccat

SEQ ID NO: 393038 - DNA, 140 bp, Artificial Sequence
  Synthetic
atggccgactcccaagtacgcccgttcgggcaacgcgaggagcaggaggagcaaaggccacattccgcaagccgcatacgcggctgcggctggggctcggccctttatgtaccacaccacggagacccagcatggcgtat

SEQ ID NO: 393039 - DNA, 140 bp, Artificial Sequence
  Synthetic
atacgccatgctgggtctccccttgccatgtggtggttgcaatacttcatagctagagtggaggccgcgctgcatgtttatgcgccatcattcgagccacgtggcccccgggactctgtacgtacttgggagtcggccat

SEQ ID NO: 393040 - DNA, 140 bp, Artificial Sequence
  Synthetic
atggccgactcccaagtacgtacagagtcccgggggccacgtggctcgaatgatggcgcataaacatgcagcgcggcctccactctagctatgaagtattgcaaccaccacatggcaaggggagacccagcatggcgtat

SEQ ID NO: 393041 - DNA, 140 bp, Artificial Sequence
  Synthetic
atacgccatgctgggtctccatacatcctggcccttttggggcccctctacatacttcaggcttcgctgctgcgcgtgccttactttgtgagggcccacgcgttactcaaaatctgcagccgtacttgggagtcggccat

SEQ ID NO: 393042 - DNA, 140 bp, Artificial Sequence
  Synthetic
atggccgactcccaagtacggctgcagattttgagtaacgcgtgggccctcacaaagtaaggcacgcgcagcagcgaagcctgaagtatgtagaggggccccaaaagggccaggatgtatggagacccagcatggcgtat

SEQ ID NO: 393043 - DNA, 140 bp, Artificial Sequence
  Synthetic
aggccctggctgctgatatgtggggagatccccttctatggcaaagccatccccatcgaggtcatcaaggggggaaggcatctcatcttctgccattccaagaagaagtgtgacgagctcgaccttttgggacagcggtg

SEQ ID NO: 393044 - DNA, 140 bp, Artificial Sequence
  Synthetic
caccgctgtcccaaaaggtcgagctcgtcacacttcttcttggaatggcagaagatgagatgccttccccccttgatgacctcgatggggatggctttgccatagaaggggatctccccacatatcagcagccagggcct

SEQ ID NO: 393045 - DNA, 140 bp, Artificial Sequence
  Synthetic
atacgccatgctgggtctccgcaatgagatcttgcttggcccggctgacactgaggtgtcgggggggtggaggcttctcgcccccattaccgcctatgcgcagcaaactcgaggcttgttcgtacttgggagtcggccat

SEQ ID NO: 393046 - DNA, 140 bp, Artificial Sequence
  Synthetic
atggccgactcccaagtacgaacaagcctcgagtttgctgcgcataggcggtaatgggggcgagaagcctccacccccccgacacctcagtgtcagccgggccaagcaagatctcattgcggagacccagcatggcgtat

SEQ ID NO: 393047 - DNA, 140 bp, Artificial Sequence
  Synthetic
atacgccatgctgggtctccgtgaatggcgtgatgtggactgtgtaccatggagcaggcagcaagacccttagcggccccaaaggaccagtcaaccaaatgtacaccaatgttgatcaagcgtacttgggagtcggccat

SEQ ID NO: 393048 - DNA, 140 bp, Artificial Sequence
  Synthetic
atggccgactcccaagtacgcttgatcaacattggtgtacatttggttgactggtcctttggggccgctaagggtcttgctgcctgctccatggtacacagtccacatcacgccattcacggagacccagcatggcgtat

SEQ ID NO: 393049 - DNA, 140 bp, Artificial Sequence
  Synthetic
atacgccatgctgggtctccgcctgtacgtaggaggggagacacccggggcgccctattaagcccccggccaatatccacccttaaaggctcttctggtggtccactgttatgcccctcgcgtacttgggagtcggccat

SEQ ID NO: 393050 - DNA, 140 bp, Artificial Sequence
  Synthetic
atggccgactcccaagtacgcgaggggcataacagtggaccaccagaagagcctttaagggtggatattggccgggggcttaatagggcgccccgggtgtctcccctcctacgtacaggcggagacccagcatggcgtat

SEQ ID NO: 393051 - DNA, 140 bp, Artificial Sequence
  Synthetic
atacgccatgctgggtctccagatagggcatttgcatgccccaactggcagcggcaagagcaccaaggtccctgcagcctatgcggctcaggggtataaggttttggtgctcaacccatccgtacttgggagtcggccat

SEQ ID NO: 393052 - DNA, 140 bp, Artificial Sequence
  Synthetic
atggccgactcccaagtacggatgggttgagcaccaaaaccttatacccctgagccgcataggctgcagggaccttggtgctcttgccgctgccagttggggcatgcaaatgccctatctggagacccagcatggcgtat

SEQ ID NO: 393053 - DNA, 140 bp, Artificial Sequence
  Synthetic
aggccctggctgctgatatgtgcgcctcaccgtgctcgcgactgctactccgccagggtcagtgactacacctcattccaacatagaggaggtcgccctgccaacaacgggggaaataccgaccttttgggacagcggtg

SEQ ID NO: 393054 - DNA, 140 bp, Artificial Sequence
  Synthetic
caccgctgtcccaaaaggtcggtatttcccccgttgttggcagggcgacctcctctatgttggaatgaggtgtagtcactgaccctggcggagtagcagtcgcgagcacggtgaggcgcacatatcagcagccagggcct

SEQ ID NO: 393055 - DNA, 140 bp, Artificial Sequence
  Synthetic
aggccctggctgctgatatggagccgcttcgagcggaggaggatgagagggaggtgtccgttccggcggagatcctgcgaaaatccaggaaatttccccgggcgatgcccgtatgggcacgaccttttgggacagcggtg

SEQ ID NO: 393056 - DNA, 140 bp, Artificial Sequence
  Synthetic
caccgctgtcccaaaaggtcgtgcccatacgggcatcgcccggggaaatttcctggattttcgcaggatctccgccggaacggacacctccctctcatcctcctccgctcgaagcggctccatatcagcagccagggcct

SEQ ID NO: 393057 - DNA, 140 bp, Artificial Sequence
  Synthetic
atacgccatgctgggtctcccaactgtttaccttctctcccaggcgccactggacgacgcaaggctgcaattgttctatctatcccggccatataacgggtcaccgcatggcatgggatacgtacttgggagtcggccat

SEQ ID NO: 393058 - DNA, 140 bp, Artificial Sequence
  Synthetic
atggccgactcccaagtacgtatcccatgccatgcggtgacccgttatatggccgggatagatagaacaattgcagccttgcgtcgtccagtggcgcctgggagagaaggtaaacagttgggagacccagcatggcgtat

SEQ ID NO: 393059 - DNA, 140 bp, Artificial Sequence
  Synthetic
aggccctggctgctgatatgaatcagagtgccatacttcgtgcgcgctcaagggctcattcgtgcatgcttgctggtgcggaaggtcgctgggggccattatgtccaaatggctctcatggaccttttgggacagcggtg

SEQ ID NO: 393060 - DNA, 140 bp, Artificial Sequence
  Synthetic
caccgctgtcccaaaaggtccatgagagccatttggacataatggcccccagcgaccttccgcaccagcaagcatgcacgaatgagcccttgagcgcgcacgaagtatggcactctgattcatatcagcagccagggcct

SEQ ID NO: 393061 - DNA, 140 bp, Artificial Sequence
  Synthetic
aggccctggctgctgatatgcttaacaacaccaggccaccgctgggcaattggtttggttgtacttggatgaactcaactggattcaccaaagtgtgcggagcgcccccttgtgtcatcggaccttttgggacagcggtg

SEQ ID NO: 393062 - DNA, 140 bp, Artificial Sequence
  Synthetic
caccgctgtcccaaaaggtccgatgacacaagggggcgctccgcacactttggtgaatccagttgagttcatccaagtacaaccaaaccaattgcccagcggtggcctggtgttgttaagcatatcagcagccagggcct

SEQ ID NO: 393063 - DNA, 140 bp, Artificial Sequence
  Synthetic
  misc_feature (35)..(35): n is a, c, g, or t
  misc_feature (41)..(41): n is a, c, g, or t
  misc_feature (80)..(80): n is a, c, g, or t
  misc_feature (98)..(98): n is a, c, g, or t
atacgccatgctgggtctccataacatactccacntatggnaaatttctggcagacggggggtgctccggcggagcgtangatgtcatcatatgtgangagtgccattcccaggacgctacgtacttgggagtcggccat

SEQ ID NO: 393064 - DNA, 140 bp, Artificial Sequence
  Synthetic
  misc_feature (43)..(43): n is a, c, g, or t
  misc_feature (61)..(61): n is a, c, g, or t
  misc_feature (100)..(100): n is a, c, g, or t
  misc_feature (106)..(106): n is a, c, g, or t
atggccgactcccaagtacgtagcgtcctgggaatggcactcntcacatatgatgacatcntacgctccgccggagcaccccccgtctgccagaaatttnccatangtggagtatgttatggagacccagcatggcgtat

SEQ ID NO: 393065 - DNA, 140 bp, Artificial Sequence
  Synthetic
aggccctggctgctgatatgtcctggcgggccttgcttactattccatggtggggaactgggctaaggttctaattgtgatgttactctttgccggcgtcgacggggagacctacgtaacgaccttttgggacagcggtg

SEQ ID NO: 393066 - DNA, 140 bp, Artificial Sequence
  Synthetic
caccgctgtcccaaaaggtcgttacgtaggtctccccgtcgacgccggcaaagagtaacatcacaattagaaccttagcccagttccccaccatggaatagtaagcaaggcccgccaggacatatcagcagccagggcct

SEQ ID NO: 393067 - DNA, 140 bp, Artificial Sequence
  Synthetic
aggccctggctgctgatatgctcctctacaggttgggggcggtacagaatgaagtgacactcacccatcctataaccaaatacatcatggcctgcatgtcagcagaccttgaagtggtgagaccttttgggacagcggtg

SEQ ID NO: 393068 - DNA, 140 bp, Artificial Sequence
  Synthetic
caccgctgtcccaaaaggtctcaccacttcaaggtctgctgacatgcaggccatgatgtatttggttataggatgggtgagtgtcacttcattctgtaccgcccccaacctgtagaggagcatatcagcagccagggcct

SEQ ID NO: 393069 - DNA, 140 bp, Artificial Sequence
  Synthetic
atacgccatgctgggtctccccaacccgccatcatcccagaccgagaggtgctctaccagcagtttgacgaaatggaggaatgttctaaacatcttccactagtcgagcacggactgcaacgtacttgggagtcggccat

SEQ ID NO: 393070 - DNA, 140 bp, Artificial Sequence
  Synthetic
atggccgactcccaagtacgttgcagtccgtgctcgactagtggaagatgtttagaacattcctccatttcgtcaaactgctggtagagcacctctcggtctgggatgatggcgggttggggagacccagcatggcgtat

SEQ ID NO: 393071 - DNA, 140 bp, Artificial Sequence
  Synthetic
atacgccatgctgggtctccacggcttctacggcttttgtcgttagcggtctcgcgggggccgcggttggcagcgtcggcttgggaagagtcctggtcgacattctcgccggctacggcgcgtacttgggagtcggccat

SEQ ID NO: 393072 - DNA, 140 bp, Artificial Sequence
  Synthetic
atggccgactcccaagtacgcgccgtagccggcgagaatgtcgaccaggactcttcccaagccgacgctgccaaccgcggcccccgcgagaccgctaacgacaaaagccgtagaagccgtggagacccagcatggcgtat

SEQ ID NO: 393073 - DNA, 140 bp, Artificial Sequence
  Synthetic
aggccctggctgctgatatgccaatcccggctgcgtcccagttggacttgtccggctggttcgttgctggttacagcgggggagacatatatcacagcgtgtctcgtgcccgaccccgctgaccttttgggacagcggtg

SEQ ID NO: 393074 - DNA, 140 bp, Artificial Sequence
  Synthetic
caccgctgtcccaaaaggtcagcggggtcgggcacgagacacgctgtgatatatgtctcccccgctgtaaccagcaacgaaccagccggacaagtccaactgggacgcagccgggattggcatatcagcagccagggcct

SEQ ID NO: 393075 - DNA, 140 bp, Artificial Sequence
  Synthetic
aggccctggctgctgatatgggttcatgttgtgcctactcctactttctgtaggggtaggcatctacctgctccccaaccgatgaacggggagctaaacactccaggccaataggccatcgaccttttgggacagcggtg

SEQ ID NO: 393076 - DNA, 140 bp, Artificial Sequence
  Synthetic
caccgctgtcccaaaaggtcgatggcctattggcctggagtgtttagctccccgttcatcggttggggagcaggtagatgcctacccctacagaaagtaggagtaggcacaacatgaacccatatcagcagccagggcct

SEQ ID NO: 393077 - DNA, 140 bp, Artificial Sequence
  Synthetic
aggccctggctgctgatatgtctgtaggggtaggcatctacctgctccccaaccgatgaacggggagctaaacactccaggccaataggccatcctgtttttttttttttttttttttttgaccttttgggacagcggtg

SEQ ID NO: 393078 - DNA, 140 bp, Artificial Sequence
  Synthetic
caccgctgtcccaaaaggtcaaaaaaaaaaaaaaaaaaaaaaacaggatggcctattggcctggagtgtttagctccccgttcatcggttggggagcaggtagatgcctacccctacagacatatcagcagccagggcct

SEQ ID NO: 393079 - DNA, 140 bp, Artificial Sequence
  Synthetic
atacgccatgctgggtctcccagctggcacatcaataggactgccttgaactgcaacgactccctccaaactggattcgttgcctcgctgttctacgcacacaggttcaactcatctggacgtacttgggagtcggccat

SEQ ID NO: 393080 - DNA, 140 bp, Artificial Sequence
  Synthetic
atggccgactcccaagtacgtccagatgagttgaacctgtgtgcgtagaacagcgaggcaacgaatccagtttggagggagtcgttgcagttcaaggcagtcctattgatgtgccagctgggagacccagcatggcgtat

SEQ ID NO: 393081 - DNA, 140 bp, Artificial Sequence
  Synthetic
atacgccatgctgggtctcccctttttctcctgtcaaaaggggtataagggggaatggcggggggacggggtaatgcataccacctgcccttgcggtgcggagcttgccggccacatcaacgtacttgggagtcggccat

SEQ ID NO: 393082 - DNA, 140 bp, Artificial Sequence
  Synthetic
atggccgactcccaagtacgttgatgtggccggcaagctccgcaccgcaagggcaggtggtatgcattaccccgtccccccgccattcccccttataccccttttgacaggagaaaaaggggagacccagcatggcgtat

SEQ ID NO: 393083 - DNA, 140 bp, Artificial Sequence
  Synthetic
atacgccatgctgggtctccccagcgccaaactactcgtttgcgctttggagggtgtccgccgaggagtatgtgcaggttcgcagagtgggtgatttccattacatcactggcgtgacaccgtacttgggagtcggccat

SEQ ID NO: 393084 - DNA, 140 bp, Artificial Sequence
  Synthetic
atggccgactcccaagtacggtgtcacgccagtgatgtaatggaaatcacccactctgcgaacctgcacatactcctcggcggacaccctccaaagcgcaaacgagtagtttggcgctggggagacccagcatggcgtat

SEQ ID NO: 393085 - DNA, 140 bp, Artificial Sequence
  Synthetic
aggccctggctgctgatatgaagataaaatcaagtgtccatgccaggttcctgcccccgagttcttcaccgaggtggatggtgtcagacttcaccgccatgcgcctgtgtgcaagcccttgaccttttgggacagcggtg

SEQ ID NO: 393086 - DNA, 140 bp, Artificial Sequence
  Synthetic
caccgctgtcccaaaaggtcaagggcttgcacacaggcgcatggcggtgaagtctgacaccatccacctcggtgaagaactcgggggcaggaacctggcatggacacttgattttatcttcatatcagcagccagggcct

SEQ ID NO: 393087 - DNA, 140 bp, Artificial Sequence
  Synthetic
aggccctggctgctgatatggcttccaggtggcccacctgcatgctcccacaggcagcggcaagagcaccaaggtcccggctgcatacgcagctcagggctacaaggtgctagtgctcaagaccttttgggacagcggtg

SEQ ID NO: 393088 - DNA, 140 bp, Artificial Sequence
  Synthetic
caccgctgtcccaaaaggtcttgagcactagcaccttgtagccctgagctgcgtatgcagccgggaccttggtgctcttgccgctgcctgtgggagcatgcaggtgggccacctggaagccatatcagcagccagggcct

SEQ ID NO: 393089 - DNA, 140 bp, Artificial Sequence
  Synthetic
atacgccatgctgggtctccatgcttacagacccatcccacatcaccgcggagactgcaagacgcaggctgggcaggggatcacccccctcgctagccagctcctctgctagtcagctttcgtacttgggagtcggccat

SEQ ID NO: 393090 - DNA, 140 bp, Artificial Sequence
  Synthetic
atggccgactcccaagtacgaaagctgactagcagaggagctggctagcgaggggggtgatcccctgcccagcctgcgtcttgcagtctccgcggtgatgtgggatgggtctgtaagcatggagacccagcatggcgtat

SEQ ID NO: 393091 - DNA, 140 bp, Artificial Sequence
  Synthetic
atacgccatgctgggtctccccgcgccatccttgaaagccacatgtcccgcccaccacagctcccctggccaggacctcattgaagccaatcttctatggggtgccaatgctaccagggtcgtacttgggagtcggccat

SEQ ID NO: 393092 - DNA, 140 bp, Artificial Sequence
  Synthetic
atggccgactcccaagtacgaccctggtagcattggcaccccatagaagattggcttcaatgaggtcctggccaggggagctgtggtgggcgggacatgtggctttcaaggatggcgcggggagacccagcatggcgtat

SEQ ID NO: 393093 - DNA, 140 bp, Artificial Sequence
  Synthetic
atacgccatgctgggtctccaagaagttcccgccggccataccaatctgggcccggccagactacaacccgcctctggttgagtcgtggaaacaaccggattacgaacccccggttgtgccgtacttgggagtcggccat

SEQ ID NO: 393094 - DNA, 140 bp, Artificial Sequence
  Synthetic
atggccgactcccaagtacggcacaaccgggggttcgtaatccggttgtttccacgactcaaccagaggcgggttgtagtctggccgggcccagattggtatggccggcgggaacttcttggagacccagcatggcgtat

SEQ ID NO: 393095 - DNA, 140 bp, Artificial Sequence
  Synthetic
atacgccatgctgggtctccggcggacttggcggcaaagtcctttggccgcccggagtcggaacccgattccggggcaggcttcaccacaccaactgagacttctgattccagccccatccgtacttgggagtcggccat

SEQ ID NO: 393096 - DNA, 140 bp, Artificial Sequence
  Synthetic
atggccgactcccaagtacggatggggctggaatcagaagtctcagttggtgtggtgaagcctgccccggaatcgggttccgactccgggcggccaaaggactttgccgccaagtccgccggagacccagcatggcgtat

SEQ ID NO: 393097 - DNA, 140 bp, Artificial Sequence
  Synthetic
aggccctggctgctgatatgacgtgtccgtcatcccgaccagcggcgatgttgtcgtcgtggcaactgatgctctcatgaccggctttaccggcgacttcgactcggtgatagactgcaagaccttttgggacagcggtg

SEQ ID NO: 393098 - DNA, 140 bp, Artificial Sequence
  Synthetic
caccgctgtcccaaaaggtcttgcagtctatcaccgagtcgaagtcgccggtaaagccggtcatgagagcatcagttgccacgacgacaacatcgccgctggtcgggatgacggacacgtcatatcagcagccagggcct

SEQ ID NO: 393099 - DNA, 140 bp, Artificial Sequence
  Synthetic
atacgccatgctgggtctcctcacttatgctgagccccctgactcagaccagaggccctactgttggcactacccgcctaagccgtgtggtgttgtgccagcggcgcaggtgtgtggtcccgtacttgggagtcggccat

SEQ ID NO: 393100 - DNA, 140 bp, Artificial Sequence
  Synthetic
atggccgactcccaagtacgggaccacacacctgcgccgctggcacaacaccacacggcttaggcgggtagtgccaacagtagggcctctggtctgagtcagggggctcagcataagtgaggagacccagcatggcgtat

SEQ ID NO: 393101 - DNA, 140 bp, Artificial Sequence
  Synthetic
atacgccatgctgggtctccccccctgagcaactcactactgcgacaccataacatggtgtacgccacgacctccaagtcagccaccacccggcaaaagaaggtcaccttcgaccgcatacgtacttgggagtcggccat

SEQ ID NO: 393102 - DNA, 140 bp, Artificial Sequence
  Synthetic
atggccgactcccaagtacgtatgcggtcgaaggtgaccttcttttgccgggtggtggctgacttggaggtcgtggcgtacaccatgttatggtgtcgcagtagtgagttgctcagggggggagacccagcatggcgtat

SEQ ID NO: 393103 - DNA, 140 bp, Artificial Sequence
  Synthetic
aggccctggctgctgatatgtaggtgcttggtcgactatccatacaggctttggcattacccctgcactgtcaacttttccatcttcaaggtcaggatgtatgtggggggcgtggagcacgaccttttgggacagcggtg

SEQ ID NO: 393104 - DNA, 140 bp, Artificial Sequence
  Synthetic
caccgctgtcccaaaaggtcgtgctccacgccccccacatacatcctgaccttgaagatggaaaagttgacagtgcaggggtaatgccaaagcctgtatggatagtcgaccaagcacctacatatcagcagccagggcct

SEQ ID NO: 393105 - DNA, 140 bp, Artificial Sequence
  Synthetic
atacgccatgctgggtctccggttttctttttttttttcccttttcccctttttttttttttttccccccccctttttgggggggccccctttttaagggggggcccccctttttcccaacgtacttgggagtcggccat

SEQ ID NO: 393106 - DNA, 140 bp, Artificial Sequence
  Synthetic
atggccgactcccaagtacgttgggaaaaaggggggcccccccttaaaaagggggcccccccaaaaagggggggggaaaaaaaaaaaaaaaggggaaaagggaaaaaaaaaaagaaaaccggagacccagcatggcgtat

SEQ ID NO: 393107 - DNA, 140 bp, Artificial Sequence
  Synthetic
atacgccatgctgggtctccttcttgtaggtctggtgctcttgaccttgtcaccacactataaaaggctcctcgctaggctcatatggtggttacaatatttcatcaccagagctgaggccgtacttgggagtcggccat

SEQ ID NO: 393108 - DNA, 140 bp, Artificial Sequence
  Synthetic
atggccgactcccaagtacggcctcagctctggtgatgaaatattgtaaccaccatatgagcctagcgaggagccttttatagtgtggtgacaaggtcaagagcaccagacctacaagaaggagacccagcatggcgtat

SEQ ID NO: 393109 - DNA, 140 bp, Artificial Sequence
  Synthetic
atacgccatgctgggtctccgcacggatactctccacacgaactcaatcgggtggcagcaaccctcagaaaacttggggtgcccccattgagagcgtggagacatcgggcccgagcagtccgtacttgggagtcggccat

SEQ ID NO: 393110 - DNA, 140 bp, Artificial Sequence
  Synthetic
atggccgactcccaagtacggactgctcgggcccgatgtctccacgctctcaatgggggcaccccaagttttctgagggttgctgccacccgattgagttcgtgtggagagtatccgtgcggagacccagcatggcgtat

SEQ ID NO: 393111 - DNA, 140 bp, Artificial Sequence
  Synthetic
  misc_feature (109)..(109): n is a, c, g, or t
aggccctggctgctgatatgaacttggggtgcccccattgagagcgtggagacatcgggcccgagcagtccgcgccaagctcatcgcccagggaggtagagccagaatntgtggcatatagaccttttgggacagcggtg

SEQ ID NO: 393112 - DNA, 140 bp, Artificial Sequence
  Synthetic
  misc_feature (32)..(32): n is a, c, g, or t
caccgctgtcccaaaaggtctatatgccacanattctggctctacctccctgggcgatgagcttggcgcggactgctcgggcccgatgtctccacgctctcaatgggggcaccccaagttcatatcagcagccagggcct

SEQ ID NO: 393113 - DNA, 140 bp, Artificial Sequence
  Synthetic
  misc_feature (59)..(59): n is a, c, g, or t
atacgccatgctgggtctcccgcgccaagctcatcgcccagggaggtagagccagaatntgtggcatatatctctttaactgggcgacaaaaaccaaagccagactcactccattgcccgcgtacttgggagtcggccat

SEQ ID NO: 393114 - DNA, 140 bp, Artificial Sequence
  Synthetic
  misc_feature (82)..(82): n is a, c, g, or t
atggccgactcccaagtacgcgggcaatggagtgagtctggctttggtttttgtcgcccagttaaagagatatatgccacanattctggctctacctccctgggcgatgagcttggcgcgggagacccagcatggcgtat

SEQ ID NO: 393115 - DNA, 140 bp, Artificial Sequence
  Synthetic
aggccctggctgctgatatgcgcctactattccatggtggggaactgggctaaggtcttgattgtgatgctactctttgccggcgttgacgggactacctacgtgtcagtggggcatgcagaccttttgggacagcggtg

SEQ ID NO: 393116 - DNA, 140 bp, Artificial Sequence
  Synthetic
caccgctgtcccaaaaggtctgcatgccccactgacacgtaggtagtcccgtcaacgccggcaaagagtagcatcacaatcaagaccttagcccagttccccaccatggaatagtaggcgcatatcagcagccagggcct

SEQ ID NO: 393117 - DNA, 140 bp, Artificial Sequence
  Synthetic
atacgccatgctgggtctccccctgaattgcaacgagtccatcaacactgggttctttgccgcgctgttctacgtaaagaagttcaactcgtctggatgctcagagcgcatggctagctgcgtacttgggagtcggccat

SEQ ID NO: 393118 - DNA, 140 bp, Artificial Sequence
  Synthetic
atggccgactcccaagtacgcagctagccatgcgctctgagcatccagacgagttgaacttctttacgtagaacagcgcggcaaagaacccagtgttgatggactcgttgcaattcagggggagacccagcatggcgtat

SEQ ID NO: 393119 - DNA, 140 bp, Artificial Sequence
  Synthetic
  misc_feature (84)..(84): n is a, c, g, or t
atacgccatgctgggtctccacccccacggtggccgcgccatacgtcggtgctccacttgagtccatgcggcgtcatgtggacntgatggtgggcgctgccacattgtgctccgcactttcgtacttgggagtcggccat

SEQ ID NO: 393120 - DNA, 140 bp, Artificial Sequence
  Synthetic
  misc_feature (57)..(57): n is a, c, g, or t
atggccgactcccaagtacgaaagtgcggagcacaatgtggcagcgcccaccatcangtccacatgacgccgcatggactcaagtggagcaccgacgtatggcgcggccaccgtgggggtggagacccagcatggcgtat

SEQ ID NO: 393121 - DNA, 140 bp, Artificial Sequence
  Synthetic
aggccctggctgctgatatgctcctgtgcctccgcctcggaagaagcggacggtggtcctcaccgaatcgaccgtatctactgccttggccgagcttgccactaaaagctttggcagctcgaccttttgggacagcggtg

SEQ ID NO: 393122 - DNA, 140 bp, Artificial Sequence
  Synthetic
caccgctgtcccaaaaggtcgagctgccaaagcttttagtggcaagctcggccaaggcagtagatacggtcgattcggtgaggaccaccgtccgcttcttccgaggcggaggcacaggagcatatcagcagccagggcct

SEQ ID NO: 393123 - DNA, 140 bp, Artificial Sequence
  Synthetic
aggccctggctgctgatatgactatgcggtctccggtctttacggataattcatctcccccggccgtaccgcagacattccaagtggcccatctacacgctcccactggcagcggcaagagaccttttgggacagcggtg

SEQ ID NO: 393124 - DNA, 140 bp, Artificial Sequence
  Synthetic
caccgctgtcccaaaaggtctcttgccgctgccagtgggagcgtgtagatgggccacttggaatgtctgcggtacggccgggggagatgaattatccgtaaagaccggagaccgcatagtcatatcagcagccagggcct

SEQ ID NO: 393125 - DNA, 140 bp, Artificial Sequence
  Synthetic
  misc_feature (93)..(93): n is a, c, g, or t
atacgccatgctgggtctccctcgggccatatcacaggtcatagaatggcgtgggacatgatgatgaactggagccctaccaccgctctggtnatggcacaactcatgaggatacccgcccgtacttgggagtcggccat

SEQ ID NO: 393126 - DNA, 140 bp, Artificial Sequence
  Synthetic
  misc_feature (48)..(48): n is a, c, g, or t
atggccgactcccaagtacgggcgggtatcctcatgagttgtgccatnaccagagcggtggtagggctccagttcatcatcatgtcccacgccattctatgacctgtgatatggcccgagggagacccagcatggcgtat

SEQ ID NO: 393127 - DNA, 140 bp, Artificial Sequence
  Synthetic
aggccctggctgctgatatgcctgttcctttaccaccctaccagctctgtccactggtttgatccacctccatcagaacatcgtggacgtgcaatacctgtacggtgtagggtcagcagtgaccttttgggacagcggtg

SEQ ID NO: 393128 - DNA, 140 bp, Artificial Sequence
  Synthetic
caccgctgtcccaaaaggtcactgctgaccctacaccgtacaggtattgcacgtccacgatgttctgatggaggtggatcaaaccagtggacagagctggtagggtggtaaaggaacaggcatatcagcagccagggcct

SEQ ID NO: 393129 - DNA, 140 bp, Artificial Sequence
  Synthetic
  misc_feature (23)..(23): n is a, c, g, or t
  misc_feature (61)..(61): n is a, c, g, or t
atacgccatgctgggtctcctcntctttgccggggtcgacgcgaacacgcagatcactggnggcgccgctggcgccaccacccgcgggctcacctccctcttcagcccggggtctcggcacgtacttgggagtcggccat

SEQ ID NO: 393130 - DNA, 140 bp, Artificial Sequence
  Synthetic
  misc_feature (80)..(80): n is a, c, g, or t
  misc_feature (118)..(118): n is a, c, g, or t
atggccgactcccaagtacgtgccgagaccccgggctgaagagggaggtgagcccgcgggtggtggcgccagcggcgccnccagtgatctgcgtgttcgcgtcgaccccggcaaagangaggagacccagcatggcgtat

SEQ ID NO: 393131 - DNA, 140 bp, Artificial Sequence
  Synthetic
  misc_feature (95)..(95): n is a, c, g, or t
atacgccatgctgggtctcctaccgccataaattcaacagctccgggtgtccagagaggctctccagctgcagacgcctcgacacattctcgcanggatggggcaagcttggggtcgctacgtacttgggagtcggccat

SEQ ID NO: 393132 - DNA, 140 bp, Artificial Sequence
  Synthetic
  misc_feature (46)..(46): n is a, c, g, or t
atggccgactcccaagtacgtagcgaccccaagcttgccccatccntgcgagaatgtgtcgaggcgtctgcagctggagagcctctctggacacccggagctgttgaatttatggcggtaggagacccagcatggcgtat

SEQ ID NO: 393133 - DNA, 140 bp, Artificial Sequence
  Synthetic
atacgccatgctgggtctcctttcacgccgagtcctgtggtggtaggcaccaccgacaagctcggcgtccctacatacaactggggggacaacgagacagacgtgctcatccttaactcgcgtacttgggagtcggccat

SEQ ID NO: 393134 - DNA, 140 bp, Artificial Sequence
  Synthetic
atggccgactcccaagtacgcgagttaaggatgagcacgtctgtctcgttgtccccccagttgtatgtagggacgccgagcttgtcggtggtgcctaccaccacaggactcggcgtgaaaggagacccagcatggcgtat

SEQ ID NO: 393135 - DNA, 140 bp, Artificial Sequence
  Synthetic
aggccctggctgctgatatgatatggtggttacaatattttatcaccagggtcgaggcgtgcttgcaagtgtgggtcccccctctcaacgtccgggggggccgcgatgccatcatcctccgaccttttgggacagcggtg

SEQ ID NO: 393136 - DNA, 140 bp, Artificial Sequence
  Synthetic
caccgctgtcccaaaaggtcggaggatgatggcatcgcggcccccccggacgttgagaggggggacccacacttgcaagcacgcctcgaccctggtgataaaatattgtaaccaccatatcatatcagcagccagggcct

SEQ ID NO: 393137 - DNA, 140 bp, Artificial Sequence
  Synthetic
  misc_feature (60)..(60): n is a, c, g, or t
  misc_feature (98)..(98): n is a, c, g, or t
atacgccatgctgggtctccccgccaatcagagctggagctgtcccaccgattgcttcanaaaacacccagaaacaacctacaccaagtgtggctcangtccctggctcacgccacggtgcgtacttgggagtcggccat

SEQ ID NO: 393138 - DNA, 140 bp, Artificial Sequence
  Synthetic
  misc_feature (43)..(43): n is a, c, g, or t
  misc_feature (81)..(81): n is a, c, g, or t
atggccgactcccaagtacgcaccgtggcgtgagccagggacntgagccacacttggtgtaggttgtttctgggtgttttntgaagcaatcggtgggacagctccagctctgattggcggggagacccagcatggcgtat

SEQ ID NO: 393139 - DNA, 140 bp, Artificial Sequence
  Synthetic
atacgccatgctgggtctccttgcgcccatcacggcctactcccaacagacgcggggcctatttggctgcatcgtcactagtctcacaggtcgggacaagaaccaggtcgaaggggaggccgtacttgggagtcggccat

SEQ ID NO: 393140 - DNA, 140 bp, Artificial Sequence
  Synthetic
atggccgactcccaagtacggcctccccttcgacctggttcttgtcccgacctgtgagactagtgacgatgcagccaaataggccccgcgtctgttgggagtaggccgtgatgggcgcaaggagacccagcatggcgtat

SEQ ID NO: 393141 - DNA, 140 bp, Artificial Sequence
  Synthetic
  misc_feature (118)..(118): n is a, c, g, or t
atacgccatgctgggtctcctggtgtggtacataaagggacgaggcccagctgcagccgcatacgcggcttgcggaatgtggcccttgctcctcctgctcctcgcgttgcccgaacgngccgtacttgggagtcggccat

SEQ ID NO: 393142 - DNA, 140 bp, Artificial Sequence
  Synthetic
  misc_feature (23)..(23): n is a, c, g, or t
atggccgactcccaagtacggcncgttcgggcaacgcgaggagcaggaggagcaagggccacattccgcaagccgcgtatgcggctgcagctgggcctcgtccctttatgtaccacaccaggagacccagcatggcgtat

SEQ ID NO: 393143 - DNA, 140 bp, Artificial Sequence
  Synthetic
aggccctggctgctgatatggcagctcggacctttacttggtcacgaggcatgctgatgtcattccggtgcgccggcggggcgacagcagggggagtctactttcccccaggcccgtctcgaccttttgggacagcggtg

SEQ ID NO: 393144 - DNA, 140 bp, Artificial Sequence
  Synthetic
caccgctgtcccaaaaggtcgagacgggcctgggggaaagtagactccccctgctgtcgccccgccggcgcaccggaatgacatcagcatgcctcgtgaccaagtaaaggtccgagctgccatatcagcagccagggcct

SEQ ID NO: 393145 - DNA, 140 bp, Artificial Sequence
  Synthetic
aggccctggctgctgatatgtcggacggccttgaactgcaacgctagccttgacgccggctggatagcagggcttttctattaccacaaattcaactctacgggctgtcccgagaggttggaccttttgggacagcggtg

SEQ ID NO: 393146 - DNA, 140 bp, Artificial Sequence
  Synthetic
caccgctgtcccaaaaggtccaacctctcgggacagcccgtagagttgaatttgtggtaatagaaaagccctgctatccagccggcgtcaaggctagcgttgcagttcaaggccgtccgacatatcagcagccagggcct

SEQ ID NO: 393147 - DNA, 140 bp, Artificial Sequence
  Synthetic
atacgccatgctgggtctccatgtgcatgtggtggtcacaatacttcatagctagagtggaggctgcgctgcatgtctatgttccatcattcgagccgcgtggctcacgggacgctttgacgtacttgggagtcggccat

SEQ ID NO: 393148 - DNA, 140 bp, Artificial Sequence
  Synthetic
atggccgactcccaagtacgtcaaagcgtcccgtgagccacgcggctcgaatgatggaacatagacatgcagcgcagcctccactctagctatgaagtattgtgaccaccacatgcacatggagacccagcatggcgtat

SEQ ID NO: 393149 - DNA, 140 bp, Artificial Sequence
  Synthetic
aggccctggctgctgatatgctgtgggcatcttccgggctgctgtgtgcacccggggggttgcgaaggcggtggacttcatacccgttgagtctatggaaactaccatgcggtctccggtgaccttttgggacagcggtg

SEQ ID NO: 393150 - DNA, 140 bp, Artificial Sequence
  Synthetic
caccgctgtcccaaaaggtcaccggagaccgcatggtagtttccatagactcaacgggtatgaagtccaccgccttcgcaaccccccgggtgcacacagcagcccggaagatgcccacagcatatcagcagccagggcct

SEQ ID NO: 393151 - DNA, 140 bp, Artificial Sequence
  Synthetic
atacgccatgctgggtctccgcgtgtgccttactttgtgagggctcaagcgctacttaagatctgcagcttggtaagaggggtcacgcatggcagatactgccaaatgatgctactgaaacgtacttgggagtcggccat

SEQ ID NO: 393152 - DNA, 140 bp, Artificial Sequence
  Synthetic
atggccgactcccaagtacgtttcagtagcatcatttggcagtatctgccatgcgtgacccctcttaccaagctgcagatcttaagtagcgcttgagccctcacaaagtaaggcacacgcggagacccagcatggcgtat

SEQ ID NO: 393153 - DNA, 140 bp, Artificial Sequence
  Synthetic
aggccctggctgctgatatgggcttctcgcccccattaccgcctacgcgcagcaaactcgaggcttgtttagcaccatcgtgacgagcctcaccggcagggataccaatgagaactgtgggaccttttgggacagcggtg

SEQ ID NO: 393154 - DNA, 140 bp, Artificial Sequence
  Synthetic
caccgctgtcccaaaaggtcccacagttctcattggtatccctgccggtgaggctcgtcacgatggtgctaaacaagcctcgagtttgctgcgcgtaggcggtaatgggggcgagaagcccatatcagcagccagggcct

SEQ ID NO: 393155 - DNA, 140 bp, Artificial Sequence
  Synthetic
aggccctggctgctgatatgttctgccattccaagaagaagtgtgatgagctcgctgcaaagctgtcggccctcggggtcaatgctgtagcgtactaccggggccttgatgtgtccgtcagaccttttgggacagcggtg

SEQ ID NO: 393156 - DNA, 140 bp, Artificial Sequence
  Synthetic
caccgctgtcccaaaaggtctgacggacacatcaaggccccggtagtacgctacagcattgaccccgagggccgacagctttgcagcgagctcatcacacttcttcttggaatggcagaacatatcagcagccagggcct

SEQ ID NO: 393157 - DNA, 140 bp, Artificial Sequence
  Synthetic
aggccctggctgctgatatgctaccatgtcaccaatgattgccccaattcgagtattgtgtacgagaccacagatgccatcttgcacgctccggggtgtgttccttgcgttcgcgagggtgaccttttgggacagcggtg

SEQ ID NO: 393158 - DNA, 140 bp, Artificial Sequence
  Synthetic
caccgctgtcccaaaaggtcaccctcgcgaacgcaaggaacacaccccggagcgtgcaagatggcatctgtggtctcgtacacaatactcgaattggggcaatcattggtgacatggtagcatatcagcagccagggcct

SEQ ID NO: 393159 - DNA, 140 bp, Artificial Sequence
  Synthetic
atacgccatgctgggtctcccttgcggcgcatcagacttgtacctcgttacaaggcatgcagacatcgtgccagtacgtaggaggggagacacgcggggtgcccttctaaaccccaggcccgtacttgggagtcggccat

SEQ ID NO: 393160 - DNA, 140 bp, Artificial Sequence
  Synthetic
atggccgactcccaagtacgggcctggggtttagaagggcaccccgcgtgtctcccctcctacgtactggcacgatgtctgcatgccttgtaacgaggtacaagtctgatgcgccgcaagggagacccagcatggcgtat

SEQ ID NO: 393161 - DNA, 140 bp, Artificial Sequence
  Synthetic
atacgccatgctgggtctccaaagccgtggactttgtgccggtcgagtctcttgaaaccaccatgagatccccggtcttttctgacaattcaacgcctcctgctgtgccccagacatacccgtacttgggagtcggccat

SEQ ID NO: 393162 - DNA, 140 bp, Artificial Sequence
  Synthetic
atggccgactcccaagtacgggtatgtctggggcacagcaggaggcgttgaattgtcagaaaagaccggggatctcatggtggtttcaagagactcgaccggcacaaagtccacggctttggagacccagcatggcgtat

SEQ ID NO: 393163 - DNA, 140 bp, Artificial Sequence
  Synthetic
aggccctggctgctgatatgactgggcgaaggtcgtgctagtgctgctgctattcgccggcgtcgacgcggaaacccacgtcaccgggggaagcgtcgctcacaccgcgtctacatttacgaccttttgggacagcggtg

SEQ ID NO: 393164 - DNA, 140 bp, Artificial Sequence
  Synthetic
caccgctgtcccaaaaggtcgtaaatgtagacgcggtgtgagcgacgcttcccccggtgacgtgggtttccgcgtcgacgccggcgaatagcagcagcactagcacgaccttcgcccagtcatatcagcagccagggcct

SEQ ID NO: 393165 - DNA, 140 bp, Artificial Sequence
  Synthetic
atacgccatgctgggtctccactgtgtcctccgccttggcggagctcgctacaaagaccttcgctagctccgaatcatcggccgtcgacagcggcacggcgaccgccccacctggccacccgtacttgggagtcggccat

SEQ ID NO: 393166 - DNA, 140 bp, Artificial Sequence
  Synthetic
atggccgactcccaagtacgggtggccaggtggggcggtcgccgtgccgctgtcgacggccgatgattcggagctagcgaaggtctttgtagcgagctccgccaaggcggaggacacagtggagacccagcatggcgtat

SEQ ID NO: 393167 - DNA, 140 bp, Artificial Sequence
  Synthetic
aggccctggctgctgatatgcgggactgggcgcacaacggcctgcgagatctggccgtagctgtggagccagtcgtcttctcccagatggagaccaagctcatcacgtggggggcagacagaccttttgggacagcggtg

SEQ ID NO: 393168 - DNA, 140 bp, Artificial Sequence
  Synthetic
caccgctgtcccaaaaggtctgtctgccccccacgtgatgagcttggtctccatctgggagaagacgactggctccacagctacggccagatctcgcaggccgttgtgcgcccagtcccgcatatcagcagccagggcct

SEQ ID NO: 393169 - DNA, 140 bp, Artificial Sequence
  Synthetic
atacgccatgctgggtctccctaatattctgtcattccaagaaaaagtgcgatgagctggccaaaaacctgtctgctctcggactcaatgcagtggcctattacagggggctggacgtgtcgtacttgggagtcggccat

SEQ ID NO: 393170 - DNA, 140 bp, Artificial Sequence
  Synthetic
atggccgactcccaagtacgacacgtccagccccctgtaataggccactgcattgagtccgagagcagacaggtttttggccagctcatcgcactttttcttggaatgacagaatattagggagacccagcatggcgtat

SEQ ID NO: 393171 - DNA, 140 bp, Artificial Sequence
  Synthetic
atacgccatgctgggtctcctgtcatacagactgttgacttcagtttggaccctactttctcaatagagaccacaactgtcccccaggacgcggtttcccgctctcagcggagaggccgccgtacttgggagtcggccat

SEQ ID NO: 393172 - DNA, 140 bp, Artificial Sequence
  Synthetic
atggccgactcccaagtacggcggcctctccgctgagagcgggaaaccgcgtcctgggggacagttgtggtctctattgagaaagtagggtccaaactgaagtcaacagtctgtatgacaggagacccagcatggcgtat

SEQ ID NO: 393173 - DNA, 140 bp, Artificial Sequence
  Synthetic
atacgccatgctgggtctccggtgtgcttggtatgaactgacaccggctgaaacaacaaccaggctgagagcttacttcaacacaccaggcctccctgtctgccaagaccatcttgagttcgtacttgggagtcggccat

SEQ ID NO: 393174 - DNA, 140 bp, Artificial Sequence
  Synthetic
atggccgactcccaagtacgaactcaagatggtcttggcagacagggaggcctggtgtgttgaagtaagctctcagcctggttgttgtttcagccggtgtcagttcataccaagcacaccggagacccagcatggcgtat

SEQ ID NO: 393175 - DNA, 140 bp, Artificial Sequence
  Synthetic
  misc_feature (91)..(91): n is a, c, g, or t
atacgccatgctgggtctccctcagactaagcaggcgggggacaactatccatacctggtagcttatcaggccacagtttgcgcgagggcncttgcgcccccgcccagctgggacactatcgtacttgggagtcggccat

SEQ ID NO: 393176 - DNA, 140 bp, Artificial Sequence
  Synthetic
  misc_feature (50)..(50): n is a, c, g, or t
atggccgactcccaagtacgatagtgtcccagctgggcgggggcgcaagngccctcgcgcaaactgtggcctgataagctaccaggtatggatagttgtcccccgcctgcttagtctgagggagacccagcatggcgtat

SEQ ID NO: 393177 - DNA, 140 bp, Artificial Sequence
  Synthetic
atacgccatgctgggtctccccttttcaacatcttgggagggtgggtggcctcccagatcgctacccccacggcttctacggcttttgtcgtcagcggtctcgcgggggctgcggttggccgtacttgggagtcggccat

SEQ ID NO: 393178 - DNA, 140 bp, Artificial Sequence
  Synthetic
atggccgactcccaagtacggccaaccgcagcccccgcgagaccgctgacgacaaaagccgtagaagccgtgggggtagcgatctgggaggccacccaccctcccaagatgttgaaaaggggagacccagcatggcgtat

SEQ ID NO: 393179 - DNA, 140 bp, Artificial Sequence
  Synthetic
atacgccatgctgggtctccacctgcggcaagtacctcttcaactgggcagtaaggaccaagcttagactcactccaattccggccgcgtctcagctggacttgtccggctggttcgttgcgtacttgggagtcggccat

SEQ ID NO: 393180 - DNA, 140 bp, Artificial Sequence
  Synthetic
atggccgactcccaagtacgcaacgaaccagccggacaagtccagctgagacgcggccggaattggagtgagtctaagcttggtccttactgcccagttgaagaggtacttgccgcaggtggagacccagcatggcgtat

SEQ ID NO: 393181 - DNA, 140 bp, Artificial Sequence
  Synthetic
atacgccatgctgggtctccgctgctcgcgtgacagccatactctcatctttaactgtgacatccctcctaagacgactgcacaagtggatcaatgaagactgtcccactccgtgtgactcgtacttgggagtcggccat

SEQ ID NO: 393182 - DNA, 140 bp, Artificial Sequence
  Synthetic
atggccgactcccaagtacgagtcacacggagtgggacagtcttcattgatccacttgtgcagtcgtcttaggagggatgtcacagttaaagatgagagtatggctgtcacgcgagcagcggagacccagcatggcgtat

SEQ ID NO: 393183 - DNA, 140 bp, Artificial Sequence
  Synthetic
aggccctggctgctgatatgctttttctcctgtcaaaaggggtataagggggaatggcggggggacggggtgatgcataccatctgcccttgcggtgctgagctcgccggccacatcaaggaccttttgggacagcggtg

SEQ ID NO: 393184 - DNA, 140 bp, Artificial Sequence
  Synthetic
caccgctgtcccaaaaggtccttgatgtggccggcgagctcagcaccgcaagggcagatggtatgcatcaccccgtccccccgccattcccccttataccccttttgacaggagaaaaagcatatcagcagccagggcct

SEQ ID NO: 393185 - DNA, 140 bp, Artificial Sequence
  Synthetic
atacgccatgctgggtctcccagcgccaaactacacgtttgcgctatggagggtgtccgccgaggaatatgtgcaggtccgcaaagtgggtgacttccattatgtcaccggtgtgacacacgtacttgggagtcggccat

SEQ ID NO: 393186 - DNA, 140 bp, Artificial Sequence
  Synthetic
atggccgactcccaagtacgtgtgtcacaccggtgacataatggaagtcacccactttgcggacctgcacatattcctcggcggacaccctccatagcgcaaacgtgtagtttggcgctgggagacccagcatggcgtat

SEQ ID NO: 393187 - DNA, 140 bp, Artificial Sequence
  Synthetic
atacgccatgctgggtctcccaggcgccctaatcacaccatgcgccgcggaggagagcaagctgcccatcaatccgttgagcaactctttgctgcgtcaccacaacatggtctacgccaccgtacttgggagtcggccat

SEQ ID NO: 393188 - DNA, 140 bp, Artificial Sequence
  Synthetic
atggccgactcccaagtacggtggcgtagaccatgttgtggtgacgcagcaaagagttgctcaacggattgatgggcagcttgctctcctccgcggcgcatggtgtgattagggcgcctgggagacccagcatggcgtat

SEQ ID NO: 393189 - DNA, 140 bp, Artificial Sequence
  Synthetic
atacgccatgctgggtctccctgacggatgaagtcacgttctccgtgggccttaactcgtttgtggtaggatcccagctgccctgtgaaccagaaccggacgtggccgtgttaacatccacgtacttgggagtcggccat

SEQ ID NO: 393190 - DNA, 140 bp, Artificial Sequence
  Synthetic
atggccgactcccaagtacgtggatgttaacacggccacgtccggttctggttcacagggcagctgggatcctaccacaaacgagttaaggcccacggagaacgtgacttcatccgtcagggagacccagcatggcgtat

SEQ ID NO: 393191 - DNA, 140 bp, Artificial Sequence
  Synthetic
aggccctggctgctgatatgatcccagctgccctgtgaaccagaaccggacgtggccgtgttaacatccatgcttacagacccatcccacatcaccgcggaggctgcgcggcgcaggctggaccttttgggacagcggtg

SEQ ID NO: 393192 - DNA, 140 bp, Artificial Sequence
  Synthetic
caccgctgtcccaaaaggtccagcctgcgccgcgcagcctccgcggtgatgtgggatgggtctgtaagcatggatgttaacacggccacgtccggttctggttcacagggcagctgggatcatatcagcagccagggcct

SEQ ID NO: 393193 - DNA, 140 bp, Artificial Sequence
  Synthetic
atacgccatgctgggtctccctcctctcatggccaagaggctataagggagagtggcgcggagatggcgtgatgcatacgacatgcccctgcggagcagatctggcaggtcacatcaagacgtacttgggagtcggccat

SEQ ID NO: 393194 - DNA, 140 bp, Artificial Sequence
  Synthetic
atggccgactcccaagtacgtcttgatgtgacctgccagatctgctccgcaggggcatgtcgtatgcatcacgccatctccgcgccactctcccttatagcctcttggccatgagaggagggagacccagcatggcgtat

SEQ ID NO: 393195 - DNA, 140 bp, Artificial Sequence
  Synthetic
aggccctggctgctgatatgacacgggtgcgctctacctcctagtaaccagcccccggttcctcctcccaggaggaggaagaagacggtcgtgctctccgagtccaccgtctcagacgccgaccttttgggacagcggtg

SEQ ID NO: 393196 - DNA, 140 bp, Artificial Sequence
  Synthetic
caccgctgtcccaaaaggtcggcgtctgagacggtggactcggagagcacgaccgtcttcttcctcctcctgggaggaggaaccgggggctggttactaggaggtagagcgcacccgtgtcatatcagcagccagggcct

SEQ ID NO: 393197 - DNA, 140 bp, Artificial Sequence
  Synthetic
atacgccatgctgggtctcctcattgcggatgacaagtctgacgacgggtcctactcgtccatgcctccgcttgaaggggagcccggtgatccagacctcacatcggactcttggtccaccgtacttgggagtcggccat

SEQ ID NO: 393198 - DNA, 140 bp, Artificial Sequence
  Synthetic
atggccgactcccaagtacggtggaccaagagtccgatgtgaggtctggatcaccgggctccccttcaagcggaggcatggacgagtaggacccgtcgtcagacttgtcatccgcaatgaggagacccagcatggcgtat

SEQ ID NO: 393199 - DNA, 140 bp, Artificial Sequence
  Synthetic
atacgccatgctgggtctccgctgttttacgtgcacaagttcaactcatccggatgcccagagcgcatggccagctgccgccccatcgacgcgttcgctcaggggtggggtcccatcacccgtacttgggagtcggccat

SEQ ID NO: 393200 - DNA, 140 bp, Artificial Sequence
  Synthetic
atggccgactcccaagtacgggtgatgggaccccacccctgagcgaacgcgtcgatggggcggcagctggccatgcgctctgggcatccggatgagttgaacttgtgcacgtaaaacagcggagacccagcatggcgtat

SEQ ID NO: 393201 - DNA, 140 bp, Artificial Sequence
  Synthetic
aggccctggctgctgatatgtacaggtgctggacaaccattaccatgagacacttaaggagattaaggcacgagcgtcgcgagtgaaggcgcgggccctcacagttgaggaggcctgcgagaccttttgggacagcggtg

SEQ ID NO: 393202 - DNA, 140 bp, Artificial Sequence
  Synthetic
caccgctgtcccaaaaggtctcgcaggcctcctcaactgtgagggcccgcgccttcactcgcgacgctcgtgccttaatctccttaagtgtctcatggtaatggttgtccagcacctgtacatatcagcagccagggcct

SEQ ID NO: 393203 - DNA, 140 bp, Artificial Sequence
  Synthetic
aggccctggctgctgatatgacctcgaccgtgcggtatcgtgcccgcgtcgcaggtgtgcggtccagtgtattgcttcaccccgagccctgttgtggtggggacgaccgatcgttttggcgaccttttgggacagcggtg

SEQ ID NO: 393204 - DNA, 140 bp, Artificial Sequence
  Synthetic
caccgctgtcccaaaaggtcgccaaaacgatcggtcgtccccaccacaacagggctcggggtgaagcaatacactggaccgcacacctgcgacgcgggcacgataccgcacggtcgaggtcatatcagcagccagggcct

SEQ ID NO: 393205 - DNA, 140 bp, Artificial Sequence
  Synthetic
atacgccatgctgggtctccaaggagacttcaccagtggattagcgaggactattccaccccctgtgactcaacctggctcagagaaatctgggactgggtgtgcaccattctaactgaccgtacttgggagtcggccat

SEQ ID NO: 393206 - DNA, 140 bp, Artificial Sequence
  Synthetic
atggccgactcccaagtacggtcagttagaatggtgcacacccagtcccagatttctctgagccaggttgagtcacagggggtggaatagtcctcgctaatccactggtgaagtctccttggagacccagcatggcgtat

SEQ ID NO: 393207 - DNA, 140 bp, Artificial Sequence
  Synthetic
atacgccatgctgggtctccgccgaaagcgatggtgtcgacgaggaccgccgagctctcggagttttcacggaagctatgacgagatactcggctccccccggagacctaccgcaaccagcgtacttgggagtcggccat

SEQ ID NO: 393208 - DNA, 140 bp, Artificial Sequence
  Synthetic
atggccgactcccaagtacgctggttgcggtaggtctccggggggagccgagtatctcgtcatagcttccgtgaaaactccgagagctcggcggtcctcgtcgacaccatcgctttcggcggagacccagcatggcgtat

SEQ ID NO: 393209 - DNA, 140 bp, Artificial Sequence
  Synthetic
atacgccatgctgggtctcctcccctcgccagagccgcgtgggaaacagccagacacactccagtcaactcctggttgggaaacatcatagtctacgcgcccaccatatgggtgcgcatgcgtacttgggagtcggccat

SEQ ID NO: 393210 - DNA, 140 bp, Artificial Sequence
  Synthetic
atggccgactcccaagtacgcatgcgcacccatatggtgggcgcgtagactatgatgtttcccaaccaggagttgactggagtgtgtctggctgtttcccacgcggctctggcgaggggaggagacccagcatggcgtat

SEQ ID NO: 393211 - DNA, 140 bp, Artificial Sequence
  Synthetic
aggccctggctgctgatatgtaagctcatatggtggttacaatatttcatcaccagagccgaggcgcatctgcaagtgtggatcccccccctcaacgtgcgggggggccgcgatgccatcgaccttttgggacagcggtg

SEQ ID NO: 393212 - DNA, 140 bp, Artificial Sequence
  Synthetic
caccgctgtcccaaaaggtcgatggcatcgcggcccccccgcacgttgaggggggggatccacacttgcagatgcgcctcggctctggtgatgaaatattgtaaccaccatatgagcttacatatcagcagccagggcct

SEQ ID NO: 393213 - DNA, 140 bp, Artificial Sequence
  Synthetic
aggccctggctgctgatatgaatcttgctcgccatactcggtccgctcatggtgctccaggctggcttaaccaaaatcccgtactttgtgcgcgcccacgggctcattcgtgtgtgcatggaccttttgggacagcggtg

SEQ ID NO: 393214 - DNA, 140 bp, Artificial Sequence
  Synthetic
caccgctgtcccaaaaggtccatgcacacacgaatgagcccgtgggcgcgcacaaagtacgggattttggttaagccagcctggagcaccatgagcggaccgagtatggcgagcaagattcatatcagcagccagggcct

SEQ ID NO: 393215 - DNA, 140 bp, Artificial Sequence
  Synthetic
atacgccatgctgggtctccggggggatatttatcacagcgtatcccgcgcccgaccccgctactttctcctgtgcctactcctactttcagtaggggtaggcatctttttgctgcctgccgtacttgggagtcggccat

SEQ ID NO: 393216 - DNA, 140 bp, Artificial Sequence
  Synthetic
atggccgactcccaagtacggcaggcagcaaaaagatgcctacccctactgaaagtaggagtaggcacaggagaaagtagcggggtcgggcgcgggatacgctgtgataaatatccccccggagacccagcatggcgtat

SEQ ID NO: 393217 - DNA, 140 bp, Artificial Sequence
  Synthetic
aggccctggctgctgatatgggttttgattgtgatgctgctctttgccggcgctgacgggaccacccacgtgacagggggggtgcaagcccacggtgcctacgggcttgcatccctctttgaccttttgggacagcggtg

SEQ ID NO: 393218 - DNA, 140 bp, Artificial Sequence
  Synthetic
caccgctgtcccaaaaggtcaaagagggatgcaagcccgtaggcaccgtgggcttgcaccccccctgtcacgtgggtggtcccgtcagcgccggcaaagagcagcatcacaatcaaaacccatatcagcagccagggcct

SEQ ID NO: 393219 - DNA, 140 bp, Artificial Sequence
  Synthetic
aggccctggctgctgatatgcacttctctcgtgcctgactgttcctgcctcggctgtgcattaccataacacctcgggcatctatcacatcactaatgactgccccaactctagcatagtgaccttttgggacagcggtg

SEQ ID NO: 393220 - DNA, 140 bp, Artificial Sequence
  Synthetic
caccgctgtcccaaaaggtcactatgctagagttggggcagtcattagtgatgtgatagatgcccgaggtgttatggtaatgcacagccgaggcaggaacagtcaggcacgagagaagtgcatatcagcagccagggcct

SEQ ID NO: 393221 - DNA, 140 bp, Artificial Sequence
  Synthetic
atacgccatgctgggtctccgccgcgccaaccatcggcgctccacttgagtccatgcggcgtcatgtagatttgatggtgggctccgccacgctgtgctccgtactctacgttggagatccgtacttgggagtcggccat

SEQ ID NO: 393222 - DNA, 140 bp, Artificial Sequence
  Synthetic
atggccgactcccaagtacggatctccaacgtagagtacggagcacagcgtggcggagcccaccatcaaatctacatgacgccgcatggactcaagtggagcgccgatggttggcgcggcggagacccagcatggcgtat

SEQ ID NO: 393223 - DNA, 140 bp, Artificial Sequence
  Synthetic
atacgccatgctgggtctcccacgggtcatagaatggcgtgggacatgatgatgaactggagtcctaccgccaccctggtcctagcacaaatcatgagattgcctgtcgccctagttgatcgtacttgggagtcggccat

SEQ ID NO: 393224 - DNA, 140 bp, Artificial Sequence
  Synthetic
atggccgactcccaagtacgatcaactagggcgacaggcaatctcatgatttgtgctaggaccagggtggcggtaggactccagttcatcatcatgtcccacgccattctatgacccgtgggagacccagcatggcgtat

SEQ ID NO: 393225 - DNA, 140 bp, Artificial Sequence
  Synthetic
aggccctggctgctgatatggttgcttttcctcctcctggcggacgcgcgcgtctgtgcctgcttgtggatgatgctgctgatagcccaggctgaggccgccttagagaacttggtggtcgaccttttgggacagcggtg

SEQ ID NO: 393226 - DNA, 140 bp, Artificial Sequence
  Synthetic
caccgctgtcccaaaaggtcgaccaccaagttctctaaggcggcctcagcctgggctatcagcagcatcatccacaagcaggcacagacgcgcgcgtccgccaggaggaggaaaagcaaccatatcagcagccagggcct

SEQ ID NO: 393227 - DNA, 140 bp, Artificial Sequence
  Synthetic
atacgccatgctgggtctccgagtcgacgcgaacacacacgtcactggaagtactgttggccaaggtgtttcccagcttactggcttattcaccacgggggctagccagaacctccagctcgtacttgggagtcggccat

SEQ ID NO: 393228 - DNA, 140 bp, Artificial Sequence
  Synthetic
atggccgactcccaagtacgagctggaggttctggctagcccccgtggtgaataagccagtaagctgggaaacaccttggccaacagtacttccagtgacgtgtgtgttcgcgtcgactcggagacccagcatggcgtat

SEQ ID NO: 393229 - DNA, 140 bp, Artificial Sequence
  Synthetic
aggccctggctgctgatatgccgccacgtgctttcgccatggaccgggagatggctgcatcatgtggaggcgcagtttttgtaggtctggcattgctgactttgtcgccacactacaaaggaccttttgggacagcggtg

SEQ ID NO: 393230 - DNA, 140 bp, Artificial Sequence
  Synthetic
caccgctgtcccaaaaggtcctttgtagtgtggcgacaaagtcagcaatgccagacctacaaaaactgcgcctccacatgatgcagccatctcccggtccatggcgaaagcacgtggcggcatatcagcagccagggcct

SEQ ID NO: 393231 - DNA, 140 bp, Artificial Sequence
  Synthetic
atacgccatgctgggtctccttcaacagctccgggtgcccggagaggcttgccagatgcaaacgcctcgacgaattcgcacaaggctggggcaagcttgaggccgctaacatcacgggctcgtacttgggagtcggccat

SEQ ID NO: 393232 - DNA, 140 bp, Artificial Sequence
  Synthetic
atggccgactcccaagtacgagcccgtgatgttagcggcctcaagcttgccccagccttgtgcgaattcgtcgaggcgtttgcatctggcaagcctctccgggcacccggagctgttgaaggagacccagcatggcgtat

SEQ ID NO: 393233 - DNA, 140 bp, Artificial Sequence
  Synthetic
aggccctggctgctgatatgcgatgccatcatcctcctcatgtgcgcggtccacccagagctaatctttgacatcaccaaactcctgctcgccatactcggtccgctcatggtgctccaggaccttttgggacagcggtg

SEQ ID NO: 393234 - DNA, 140 bp, Artificial Sequence
  Synthetic
caccgctgtcccaaaaggtcctggagcaccatgagcggaccgagtatggcgagcaggagtttggtgatgtcaaagattagctctgggtggaccgcgcacatgaggaggatgatggcatcgcatatcagcagccagggcct

SEQ ID NO: 393235 - DNA, 140 bp, Artificial Sequence
  Synthetic
aggccctggctgctgatatgacatcaccaaactcctgctcgccatactcggtccgctcatggtgctccaggctggcataactagagtgccgtactttgtgcgcgctcaagggctcattcggaccttttgggacagcggtg

SEQ ID NO: 393236 - DNA, 140 bp, Artificial Sequence
  Synthetic
caccgctgtcccaaaaggtccgaatgagcccttgagcgcgcacaaagtacggcactctagttatgccagcctggagcaccatgagcggaccgagtatggcgagcaggagtttggtgatgtcatatcagcagccagggcct

SEQ ID NO: 393237 - DNA, 140 bp, Artificial Sequence
  Synthetic
atacgccatgctgggtctcctcctgtagcggtgggcaccaccgacagggccggcctccccacctacaactggggggaaaacgagacagacgtcttcatcctcaactcgaccagacctccgcgtacttgggagtcggccat

SEQ ID NO: 393238 - DNA, 140 bp, Artificial Sequence
  Synthetic
atggccgactcccaagtacgcggaggtctggtcgagttgaggatgaagacgtctgtctcgttttccccccagttgtaggtggggaggccggccctgtcggtggtgcccaccgctacaggaggagacccagcatggcgtat

SEQ ID NO: 393239 - DNA, 140 bp, Artificial Sequence
  Synthetic
aggccctggctgctgatatggctggagttgtcccaccgattgcttcaggaaacatccagaaacaacttacaccaagtgtggttcaggtccgtggctcacgccgcggtgcttggtccactagaccttttgggacagcggtg

SEQ ID NO: 393240 - DNA, 140 bp, Artificial Sequence
  Synthetic
caccgctgtcccaaaaggtctagtggaccaagcaccgcggcgtgagccacggacctgaaccacacttggtgtaagttgtttctggatgtttcctgaagcaatcggtgggacaactccagccatatcagcagccagggcct

SEQ ID NO: 393241 - DNA, 140 bp, Artificial Sequence
  Synthetic
aggccctggctgctgatatgaattggaccaggggagaaccttgcggtttagagcatagggatcgcacagaaatgtcacccctgctcttatccaccactcaatggcaggtccttccctgctgaccttttgggacagcggtg

SEQ ID NO: 393242 - DNA, 140 bp, Artificial Sequence
  Synthetic
caccgctgtcccaaaaggtcagcagggaaggacctgccattgagtggtggataagagcaggggtgacatttctgtgcgatccctatgctctaaaccgcaaggttctcccctggtccaattcatatcagcagccagggcct

SEQ ID NO: 393243 - DNA, 140 bp, Artificial Sequence
  Synthetic
atacgccatgctgggtctccttgggctctcaagtgggagtatgtcgtgctagccttcttgctgctggcggacgccagggtctgtgcatgtctttggatgatgctgctagtatcgcaggttcgtacttgggagtcggccat

SEQ ID NO: 393244 - DNA, 140 bp, Artificial Sequence
  Synthetic
atggccgactcccaagtacgaacctgcgatactagcagcatcatccaaagacatgcacagaccctggcgtccgccagcagcaagaaggctagcacgacatactcccacttgagagcccaaggagacccagcatggcgtat

SEQ ID NO: 393245 - DNA, 140 bp, Artificial Sequence
  Synthetic
aggccctggctgctgatatgtaaaggggcgagccccggccgcagccgcgtatgcggcttgcggaatgtggcctttgctcctcctgctcctcgcgttgcccgaacgggcttacgcgcacgagaccttttgggacagcggtg

SEQ ID NO: 393246 - DNA, 140 bp, Artificial Sequence
  Synthetic
caccgctgtcccaaaaggtctcgtgcgcgtaagcccgttcgggcaacgcgaggagcaggaggagcaaaggccacattccgcaagccgcatacgcggctgcggccggggctcgcccctttacatatcagcagccagggcct

SEQ ID NO: 393247 - DNA, 140 bp, Artificial Sequence
  Synthetic
aggccctggctgctgatatgattcaactctacaggctgtcccgagaggttggccagctgccgacccctcaccgattttgcccagggctggggccctattagttacgctaatggaagcggcgaccttttgggacagcggtg

SEQ ID NO: 393248 - DNA, 140 bp, Artificial Sequence
  Synthetic
caccgctgtcccaaaaggtcgccgcttccattagcgtaactaatagggccccagccctgggcaaaatcggtgaggggtcggcagctggccaacctctcgggacagcctgtagagttgaatcatatcagcagccagggcct

SEQ ID NO: 393249 - DNA, 140 bp, Artificial Sequence
  Synthetic
atacgccatgctgggtctcctggtcgcaatatttcatagctagggcggaggccttgctgcatgtctatgttccatcatttgagccacgcggccctcgggactccgtgatcatcctcttggcgtacttgggagtcggccat

SEQ ID NO: 393250 - DNA, 140 bp, Artificial Sequence
  Synthetic
atggccgactcccaagtacgccaagaggatgatcacggagtcccgagggccgcgtggctcaaatgatggaacatagacatgcagcaaggcctccgccctagctatgaaatattgcgaccaggagacccagcatggcgtat

SEQ ID NO: 393251 - DNA, 140 bp, Artificial Sequence
  Synthetic
aggccctggctgctgatatgtccatcatttgagccacgcggccctcgggactccgtgatcatcctcttggtcctgtttcggcctcatctagcctttgacatcacaaaatacctcttggccgaccttttgggacagcggtg

SEQ ID NO: 393252 - DNA, 140 bp, Artificial Sequence
  Synthetic
caccgctgtcccaaaaggtcggccaagaggtattttgtgatgtcaaaggctagatgaggccgaaacaggaccaagaggatgatcacggagtcccgagggccgcgtggctcaaatgatggacatatcagcagccagggcct

SEQ ID NO: 393253 - DNA, 140 bp, Artificial Sequence
  Synthetic
aggccctggctgctgatatgtgtgcggagcgcccccctgtgtcatcggaggggtgggcaacaacaccttgcgctgccccactgattgtttccgcaagcatccggaagccacgtactctcggaccttttgggacagcggtg

SEQ ID NO: 393254 - DNA, 140 bp, Artificial Sequence
  Synthetic
caccgctgtcccaaaaggtccgagagtacgtggcttccggatgcttgcggaaacaatcagtggggcagcgcaaggtgttgttgcccacccctccgatgacacaggggggcgctccgcacacatatcagcagccagggcct

SEQ ID NO: 393255 - DNA, 140 bp, Artificial Sequence
  Synthetic
atacgccatgctgggtctcctcatgtatggcaagcactgccagatggctctactgaagctaggggctctcactggtacctacatctatgaccacctttcccctttgtccgactgggccgccgtacttgggagtcggccat

SEQ ID NO: 393256 - DNA, 140 bp, Artificial Sequence
  Synthetic
atggccgactcccaagtacggcggcccagtcggacaaaggggaaaggtggtcatagatgtaggtaccagtgagagcccctagcttcagtagagccatctggcagtgcttgccatacatgaggagacccagcatggcgtat

SEQ ID NO: 393257 - DNA, 140 bp, Artificial Sequence
  Synthetic
atacgccatgctgggtctcctgacggccttaaggacttagcggtagcccttgagccggtgatattcacgcccatggagaagaaggttatagtctggggcgcggatactgctgcatgcggccgtacttgggagtcggccat

SEQ ID NO: 393258 - DNA, 140 bp, Artificial Sequence
  Synthetic
atggccgactcccaagtacggccgcatgcagcagtatccgcgccccagactataaccttcttctccatgggcgtgaatatcaccggctcaagggctaccgctaagtccttaaggccgtcaggagacccagcatggcgtat

SEQ ID NO: 393259 - DNA, 140 bp, Artificial Sequence
  Synthetic
aggccctggctgctgatatgcggacttgtacctcgttacgaggcatgcagacgttgtgcctgtacgtaggagaggggacacccggggcgcccttctaagccccaggccaatatccaccctgaccttttgggacagcggtg

SEQ ID NO: 393260 - DNA, 140 bp, Artificial Sequence
  Synthetic
caccgctgtcccaaaaggtcagggtggatattggcctggggcttagaagggcgccccgggtgtcccctctcctacgtacaggcacaacgtctgcatgcctcgtaacgaggtacaagtccgcatatcagcagccagggcct

SEQ ID NO: 393261 - DNA, 140 bp, Artificial Sequence
  Synthetic
aggccctggctgctgatatgggaggccattacgtgcaaatggccatcatcaagttaggggcgcttactggcacctatatttataaccatctcactcctcttcgggactgggcgcacaacggaccttttgggacagcggtg

SEQ ID NO: 393262 - DNA, 140 bp, Artificial Sequence
  Synthetic
caccgctgtcccaaaaggtccgttgtgcgcccagtcccgaagaggagtgagatggttataaatataggtgccagtaagcgcccctaacttgatgatggccatttgcacgtaatggcctcccatatcagcagccagggcct

SEQ ID NO: 393263 - DNA, 140 bp, Artificial Sequence
  Synthetic
aggccctggctgctgatatggtgctcgcaactgccacaccaccagggtccgtgacaaccccccatcccaacatagaggaagtcgctttgccgacgacaggggaaatacccttctacggcagaccttttgggacagcggtg

SEQ ID NO: 393264 - DNA, 140 bp, Artificial Sequence
  Synthetic
caccgctgtcccaaaaggtctgccgtagaagggtatttcccctgtcgtcggcaaagcgacttcctctatgttgggatggggggttgtcacggaccctggtggtgtggcagttgcgagcaccatatcagcagccagggcct

SEQ ID NO: 393265 - DNA, 140 bp, Artificial Sequence
  Synthetic
aggccctggctgctgatatgcggccctactgctggcactaccccccaaaaccttgtggtatcgtgccagcacagagcgtatgtggccctgtgtattgtttcacccccagtcctgtggtgggaccttttgggacagcggtg

SEQ ID NO: 393266 - DNA, 140 bp, Artificial Sequence
  Synthetic
caccgctgtcccaaaaggtcccaccacaggactgggggtgaaacaatacacagggccacatacgctctgtgctggcacgataccacaaggttttggggggtagtgccagcagtagggccgcatatcagcagccagggcct

SEQ ID NO: 393267 - DNA, 140 bp, Artificial Sequence
  Synthetic
aggccctggctgctgatatgcggctgttggcagcataggccttgggaaggtgcttgtggacatcctggcgggctatggggcaggggtggctggcgcactcgtagcttttaagatcatgaggaccttttgggacagcggtg

SEQ ID NO: 393268 - DNA, 140 bp, Artificial Sequence
  Synthetic
caccgctgtcccaaaaggtcctcatgatcttaaaagctacgagtgcgccagccacccctgccccatagcccgccaggatgtccacaagcaccttcccaaggcctatgctgccaacagccgcatatcagcagccagggcct

SEQ ID NO: 393269 - DNA, 140 bp, Artificial Sequence
  Synthetic
atacgccatgctgggtctcccccaggacgcggtttcccgctctcagcggaggggccgcaccggtaggggaaggttgggtatatacagatttgtcactccgggggagagaccgtccggcatcgtacttgggagtcggccat

SEQ ID NO: 393270 - DNA, 140 bp, Artificial Sequence
  Synthetic
atggccgactcccaagtacgatgccggacggtctctcccccggagtgacaaatctgtatatacccaaccttcccctaccggtgcggcccctccgctgagagcgggaaaccgcgtcctgggggagacccagcatggcgtat

SEQ ID NO: 393271 - DNA, 140 bp, Artificial Sequence
  Synthetic
aggccctggctgctgatatgtgactgtttccgcaaacatccggaagccacatactctcggtgtggctccggtccctggatcacgcccaggtgcctggtccactatccttataggctttgggaccttttgggacagcggtg

SEQ ID NO: 393272 - DNA, 140 bp, Artificial Sequence
  Synthetic
caccgctgtcccaaaaggtcccaaagcctataaggatagtggaccaggcacctgggcgtgatccagggaccggagccacaccgagagtatgtggcttccggatgtttgcggaaacagtcacatatcagcagccagggcct

SEQ ID NO: 393273 - DNA, 140 bp, Artificial Sequence
  Synthetic
aggccctggctgctgatatgacaccaggcctccccgtctgccaagaccatctcgagttctgggagggcgtctttacgggattgaccaatatagatgctcacttcctgtctcagactaagcgaccttttgggacagcggtg

SEQ ID NO: 393274 - DNA, 140 bp, Artificial Sequence
  Synthetic
caccgctgtcccaaaaggtcgcttagtctgagacaggaagtgagcatctatattggtcaatcccgtaaagacgccctcccagaactcgagatggtcttggcagacggggaggcctggtgtcatatcagcagccagggcct

SEQ ID NO: 393275 - DNA, 140 bp, Artificial Sequence
  Synthetic
aggccctggctgctgatatgctttacgggattgaccaatatagatgctcacttcctgtctcagactaagcaggcgggagagaattacccatacctggtagcttatcaagccacagtttgcgaccttttgggacagcggtg

SEQ ID NO: 393276 - DNA, 140 bp, Artificial Sequence
  Synthetic
caccgctgtcccaaaaggtcgcaaactgtggcttgataagctaccaggtatgggtaattctctcccgcctgcttagtctgagacaggaagtgagcatctatattggtcaatcccgtaaagcatatcagcagccagggcct

SEQ ID NO: 393277 - DNA, 140 bp, Artificial Sequence
  Synthetic
aggccctggctgctgatatgatcccagaccgagaggtgctctaccagcagttcgacgaaatggaggaatgttccaaacatcttccactagtcgagcacggactgcaattggcagagcaatgaccttttgggacagcggtg

SEQ ID NO: 393278 - DNA, 140 bp, Artificial Sequence
  Synthetic
caccgctgtcccaaaaggtcattgctctgccaattgcagtccgtgctcgactagtggaagatgtttggaacattcctccatttcgtcgaactgctggtagagcacctctcggtctgggatcatatcagcagccagggcct

SEQ ID NO: 393279 - DNA, 140 bp, Artificial Sequence
  Synthetic
aggccctggctgctgatatgccatattacaagcgccatatcagctggtgcttatggtggcttcagtattttctgaccagagcagaagcgcacctgcaagtgtgggttccccccctcaacggaccttttgggacagcggtg

SEQ ID NO: 393280 - DNA, 140 bp, Artificial Sequence
  Synthetic
caccgctgtcccaaaaggtccgttgagggggggaacccacacttgcaggtgcgcttctgctctggtcagaaaatactgaagccaccataagcaccagctgatatggcgcttgtaatatggcatatcagcagccagggcct

SEQ ID NO: 393281 - DNA, 140 bp, Artificial Sequence
  Synthetic
atacgccatgctgggtctccggtcgcgcacgatgcatctggcaaaagggtgtactacctcacccgtgaccccaccaccccccttgcgcgggctgcgtgggagacagctagacacactccacgtacttgggagtcggccat

SEQ ID NO: 393282 - DNA, 140 bp, Artificial Sequence
  Synthetic
atggccgactcccaagtacgtggagtgtgtctagctgtctcccacgcagcccgcgcaaggggggtggtggggtcacgggtgaggtagtacacccttttgccagatgcatcgtgcgcgaccggagacccagcatggcgtat

SEQ ID NO: 393283 - DNA, 140 bp, Artificial Sequence
  Synthetic
aggccctggctgctgatatgctccccggatgctgacctcatcgaggccaacctcttgtggcggcaagagatgggcgggaacatcacccgcgtggagtcagagaacaaggtagtgattttggaccttttgggacagcggtg

SEQ ID NO: 393284 - DNA, 140 bp, Artificial Sequence
  Synthetic
caccgctgtcccaaaaggtccaaaatcactaccttgttctctgactccacgcgggtgatgttcccgcccatctcttgccgccacaagaggttggcctcgatgaggtcagcatccggggagcatatcagcagccagggcct

SEQ ID NO: 393285 - DNA, 140 bp, Artificial Sequence
  Synthetic
aggccctggctgctgatatggcctcaggaaacttggggtaccgcccttgcgagtctggagacatcgggccagaagtgtccgcgctaagctactgtcccagggggggagggctgccacttggaccttttgggacagcggtg

SEQ ID NO: 393286 - DNA, 140 bp, Artificial Sequence
  Synthetic
caccgctgtcccaaaaggtccaagtggcagccctccccccctgggacagtagcttagcgcggacacttctggcccgatgtctccagactcgcaagggcggtaccccaagtttcctgaggccatatcagcagccagggcct

SEQ ID NO: 393287 - DNA, 140 bp, Artificial Sequence
  Synthetic
atacgccatgctgggtctccacttggtaaacttgctcccggccatactatcgccgggcgccctggtggtgggggtagtgtgcgccgcaatcctgcggcgtcacgtgggcccgggcgagggcgtacttgggagtcggccat

SEQ ID NO: 393288 - DNA, 140 bp, Artificial Sequence
  Synthetic
atggccgactcccaagtacgccctcgcccgggcccacgtgacgccgcaggattgcggcgcacactacccccaccaccagggcgcccggcgatagtatggccgggagcaagtttaccaagtggagacccagcatggcgtat

SEQ ID NO: 393289 - DNA, 140 bp, Artificial Sequence
  Synthetic
aggccctggctgctgatatgtatgggcacgcccggattacaaccctccactgctagagtcctggaaggacccggactacgtccctccggtggtacacgggtgcccattgccgcctaccaagaccttttgggacagcggtg

SEQ ID NO: 393290 - DNA, 140 bp, Artificial Sequence
  Synthetic
caccgctgtcccaaaaggtcttggtaggcggcaatgggcacccgtgtaccaccggagggacgtagtccgggtccttccaggactctagcagtggagggttgtaatccgggcgtgcccatacatatcagcagccagggcct

SEQ ID NO: 393291 - DNA, 140 bp, Artificial Sequence
  Synthetic
atacgccatgctgggtctccgggaaatctgggattgggtctgcaccgtgctgtctgactttaagacttggctgaaggctaagctattgccccggatgcccggcatccccttttactcctgcgtacttgggagtcggccat

SEQ ID NO: 393292 - DNA, 140 bp, Artificial Sequence
  Synthetic
atggccgactcccaagtacgcaggagtaaaaggggatgccgggcatccggggcaatagcttagccttcagccaagtcttaaagtcagacagcacggtgcagacccaatcccagatttcccggagacccagcatggcgtat

SEQ ID NO: 393293 - DNA, 140 bp, Artificial Sequence
  Synthetic
aggccctggctgctgatatgatgtcacgaacgactgctccaacgcaagcattgtgtatgaggcagcggacatgatcatgcatacccccgggtgcgtgccctgcgttcgggagaacaactcgaccttttgggacagcggtg

SEQ ID NO: 393294 - DNA, 140 bp, Artificial Sequence
  Synthetic
caccgctgtcccaaaaggtcgagttgttctcccgaacgcagggcacgcacccgggggtatgcatgatcatgtccgctgcctcatacacaatgcttgcgttggagcagtcgttcgtgacatcatatcagcagccagggcct

SEQ ID NO: 393295 - DNA, 140 bp, Artificial Sequence
  Synthetic
atacgccatgctgggtctccgaaagccacatgtaccgcccaccacagttcccctggcttggacctcattgaagccaaccttctatggggtgccaatgccaccagggtcgagctgggtgatcgtacttgggagtcggccat

SEQ ID NO: 393296 - DNA, 140 bp, Artificial Sequence
  Synthetic
atggccgactcccaagtacgatcacccagctcgaccctggtggcattggcaccccatagaaggttggcttcaatgaggtccaagccaggggaactgtggtgggcggtacatgtggctttcggagacccagcatggcgtat

SEQ ID NO: 393297 - DNA, 140 bp, Artificial Sequence
  Synthetic
atacgccatgctgggtctcccggccataccaatctgggcccgggcagactacaacccgcctctggttgagtcgtggaaacaaccgggttacacacccccggtcgtgcacgggtgcgccctcgtacttgggagtcggccat

SEQ ID NO: 393298 - DNA, 140 bp, Artificial Sequence
  Synthetic
atggccgactcccaagtacgagggcgcacccgtgcacgaccgggggtgtgtaacccggttgtttccacgactcaaccagaggcgggttgtagtctgcccgggcccagattggtatggccgggagacccagcatggcgtat

SEQ ID NO: 393299 - DNA, 140 bp, Artificial Sequence
  Synthetic
atacgccatgctgggtctccacctcctagtaaccagcccccagttcctccccccaggaggaagaagaagacggttgtgctctccgagtctaccgtttcagacgccttggcggacttggcgcgtacttgggagtcggccat

SEQ ID NO: 393300 - DNA, 140 bp, Artificial Sequence
  Synthetic
atggccgactcccaagtacgcgccaagtccgccaaggcgtctgaaacggtagactcggagagcacaaccgtcttcttcttcctcctggggggaggaactgggggctggttactaggaggtggagacccagcatggcgtat

SEQ ID NO: 393301 - DNA, 140 bp, Artificial Sequence
  Synthetic
aggccctggctgctgatatgagctggcacatcaacaggactgccctgaactgcaatgactccctccaaactggattcctcgccgcgctgttctacacacacaagttcaacgcgtccggatgaccttttgggacagcggtg

SEQ ID NO: 393302 - DNA, 140 bp, Artificial Sequence
  Synthetic
caccgctgtcccaaaaggtcatccggacgcgttgaacttgtgtgtgtagaacagcgcggcgaggaatccagtttggagggagtcattgcagttcagggcagtcctgttgatgtgccagctcatatcagcagccagggcct

SEQ ID NO: 393303 - DNA, 140 bp, Artificial Sequence
  Synthetic
atacgccatgctgggtctcctcactactgcggcaccataacatggtgtacgctaccacctccaaatcagcaaccgctcggcagaagaaggtcaccttcgaccgcgtacaggtgctggacacgtacttgggagtcggccat

SEQ ID NO: 393304 - DNA, 140 bp, Artificial Sequence
  Synthetic
atggccgactcccaagtacgtgtccagcacctgtacgcggtcgaaggtgaccttcttctgccgagcggttgctgatttggaggtggtagcgtacaccatgttatggtgccgcagtagtgaggagacccagcatggcgtat

SEQ ID NO: 393305 - DNA, 140 bp, Artificial Sequence
  Synthetic
atacgccatgctgggtctcctcgcctgatcgtgtatccggatctcggatcccgggtttgcgagaagagagcgcttcacgacgtcatcaaaaaaactgccttagccgtgatgggagccgctcgtacttgggagtcggccat

SEQ ID NO: 393306 - DNA, 140 bp, Artificial Sequence
  Synthetic
atggccgactcccaagtacgagcggctcccatcacggctaaggcagtttttttgatgacgtcgtgaagcgctctcttctcgcaaacccgggatccgagatccggatacacgatcaggcgaggagacccagcatggcgtat

SEQ ID NO: 393307 - DNA, 140 bp, Artificial Sequence
  Synthetic
atacgccatgctgggtctccctattacttacagtgagcctagcagctcggaccagaggccctattgctggcattacgcgcctcggcggtgtggcgttgtgcccgcggcggaggtgtgtggcgtacttgggagtcggccat

SEQ ID NO: 393308 - DNA, 140 bp, Artificial Sequence
  Synthetic
atggccgactcccaagtacgccacacacctccgccgcgggcacaacgccacaccgccgaggcgcgtaatgccagcaatagggcctctggtccgagctgctaggctcactgtaagtaatagggagacccagcatggcgtat

SEQ ID NO: 393309 - DNA, 140 bp, Artificial Sequence
  Synthetic
aggccctggctgctgatatgagacggcatcatgcataccacctgcccatgtggagcacaaatcaccggacatgtcaaaaacggttccatgaggatcgttgggcctaaaacctgcagcaacgaccttttgggacagcggtg

SEQ ID NO: 393310 - DNA, 140 bp, Artificial Sequence
  Synthetic
caccgctgtcccaaaaggtcgttgctgcaggttttaggcccaacgatcctcatggaaccgtttttgacatgtccggtgatttgtgctccacatgggcaggtggtatgcatgatgccgtctcatatcagcagccagggcct

SEQ ID NO: 393311 - DNA, 140 bp, Artificial Sequence
  Synthetic
atacgccatgctgggtctcctgggcggccctatgtacaacagcagaggtgacctgtgcgggtaccgtagatgccgcgcgagcggcgtctacaccacaagcttcgggaacacgctgacgtgcgtacttgggagtcggccat

SEQ ID NO: 393312 - DNA, 140 bp, Artificial Sequence
  Synthetic
atggccgactcccaagtacgcacgtcagcgtgttcccgaagcttgtggtgtagacgccgctcgcgcggcatctacggtacccgcacaggtcacctctgctgttgtacatagggccgcccaggagacccagcatggcgtat

SEQ ID NO: 393313 - DNA, 140 bp, Artificial Sequence
  Synthetic
aggccctggctgctgatatggggatcggtcaccgtgccacaccccaacatcgaggaggtggccttgtccaatactggagagatccccttctatggcaaagccatccccatcgagaccatcgaccttttgggacagcggtg

SEQ ID NO: 393314 - DNA, 140 bp, Artificial Sequence
  Synthetic
caccgctgtcccaaaaggtcgatggtctcgatggggatggctttgccatagaaggggatctctccagtattggacaaggccacctcctcgatgttggggtgtggcacggtgaccgatccccatatcagcagccagggcct

SEQ ID NO: 393315 - DNA, 140 bp, Artificial Sequence
  Synthetic
aggccctggctgctgatatggagccgaggcgcatctgcaagtgtggatcccccccctcaacgttcgggggggccgcgatgccatcatcctcctcacgtgtgcggtccacccagagctaatgaccttttgggacagcggtg

SEQ ID NO: 393316 - DNA, 140 bp, Artificial Sequence
  Synthetic
caccgctgtcccaaaaggtcattagctctgggtggaccgcacacgtgaggaggatgatggcatcgcggcccccccgaacgttgaggggggggatccacacttgcagatgcgcctcggctccatatcagcagccagggcct

SEQ ID NO: 393317 - DNA, 140 bp, Artificial Sequence
  Synthetic
aggccctggctgctgatatgtccaggctggcataaccaaagtgccgtactttgtgcgcgctcaggggctcattcgtgtgtgcatgttagtgcggaaagtcgctgggggccattacgtccagaccttttgggacagcggtg

SEQ ID NO: 393318 - DNA, 140 bp, Artificial Sequence
  Synthetic
caccgctgtcccaaaaggtctggacgtaatggcccccagcgactttccgcactaacatgcacacacgaatgagcccctgagcgcgcacaaagtacggcactttggttatgccagcctggacatatcagcagccagggcct

SEQ ID NO: 393319 - DNA, 140 bp, Artificial Sequence
  Synthetic
aggccctggctgctgatatgtgtccaccacgcagtggcaggtccttccgtgttccttcacgaccctgccagccttgtccaccggcctcatccacctccaccagaacattgtggacgtgcagaccttttgggacagcggtg

SEQ ID NO: 393320 - DNA, 140 bp, Artificial Sequence
  Synthetic
caccgctgtcccaaaaggtctgcacgtccacaatgttctggtggaggtggatgaggccggtggacaaggctggcagggtcgtgaaggaacacggaaggacctgccactgcgtggtggacacatatcagcagccagggcct

SEQ ID NO: 393321 - DNA, 140 bp, Artificial Sequence
  Synthetic
atacgccatgctgggtctccccccatcacctataccgagcctagggacctggatcagaggccttactgctggcattacgcacctcggcagtgtggtatcgtacctgcgtcgcaggtgtgtcgtacttgggagtcggccat

SEQ ID NO: 393322 - DNA, 140 bp, Artificial Sequence
  Synthetic
atggccgactcccaagtacgacacacctgcgacgcaggtacgataccacactgccgaggtgcgtaatgccagcagtaaggcctctgatccaggtccctaggctcggtataggtgatggggggagacccagcatggcgtat

SEQ ID NO: 393323 - DNA, 140 bp, Artificial Sequence
  Synthetic
aggccctggctgctgatatggtaccgcagacattccaagtggcccatctacacgctcccactggcagcggcaagagcactaaggtgccggctgcgtatgcagcccaagggtacaaggtacgaccttttgggacagcggtg

SEQ ID NO: 393324 - DNA, 140 bp, Artificial Sequence
  Synthetic
caccgctgtcccaaaaggtcgtaccttgtacccttgggctgcatacgcagccggcaccttagtgctcttgccgctgccagtgggagcgtgtagatgggccacttggaatgtctgcggtaccatatcagcagccagggcct

SEQ ID NO: 393325 - DNA, 140 bp, Artificial Sequence
  Synthetic
aggccctggctgctgatatgcactacaggcgcccctatcacgtactccacctatggcaagttccttgctgatggtggttgctctggaggcgcctatgacatcataatatgtgatgaatgcgaccttttgggacagcggtg

SEQ ID NO: 393326 - DNA, 140 bp, Artificial Sequence
  Synthetic
caccgctgtcccaaaaggtcgcattcatcacatattatgatgtcataggcgcctccagagcaaccaccatcagcaaggaacttgccataggtggagtacgtgataggggcgcctgtagtgcatatcagcagccagggcct

SEQ ID NO: 393327 - DNA, 140 bp, Artificial Sequence
  Synthetic
aggccctggctgctgatatgcctcgggcatctatcacatcactaatgactgccctaactccagcatagtctttgaggcagaccatcatatcttgcacctaccgggatgcgtcccttgtgtgaccttttgggacagcggtg

SEQ ID NO: 393328 - DNA, 140 bp, Artificial Sequence
  Synthetic
caccgctgtcccaaaaggtcacacaagggacgcatcccggtaggtgcaagatatgatggtctgcctcaaagactatgctggagttagggcagtcattagtgatgtgatagatgcccgaggcatatcagcagccagggcct

SEQ ID NO: 393329 - DNA, 140 bp, Artificial Sequence
  Synthetic
atacgccatgctgggtctcctccactggaccacccaggagtgcaattgttccatctatccgggccatatcacgggtcacagaatggcgtgggacatgatgatgaactggagccctaccgtcgtacttgggagtcggccat

SEQ ID NO: 393330 - DNA, 140 bp, Artificial Sequence
  Synthetic
atggccgactcccaagtacgacggtagggctccagttcatcatcatgtcccacgccattctgtgacccgtgatatggcccggatagatggaacaattgcactcctgggtggtccagtggaggagacccagcatggcgtat

SEQ ID NO: 393331 - DNA, 140 bp, Artificial Sequence
  Synthetic
aggccctggctgctgatatggttgcttttccttctcctggcggacgcgcgcgtctgtgcctgcttgtggatgatgctgctgatagcccaggctgaggccgccctagagaacctggtggtcgaccttttgggacagcggtg

SEQ ID NO: 393332 - DNA, 140 bp, Artificial Sequence
  Synthetic
caccgctgtcccaaaaggtcgaccaccaggttctctagggcggcctcagcctgggctatcagcagcatcatccacaagcaggcacagacgcgcgcgtccgccaggagaaggaaaagcaaccatatcagcagccagggcct

SEQ ID NO: 393333 - DNA, 140 bp, Artificial Sequence
  Synthetic
atacgccatgctgggtctccatgcaagctaactgggctaaggtcatcctgattttattcgtctttgctggggtcgacgcgaacacgcacgtctctggcagcgtcgccggctccagtatctcgtacttgggagtcggccat

SEQ ID NO: 393334 - DNA, 140 bp, Artificial Sequence
  Synthetic
atggccgactcccaagtacgagatactggagccggcgacgctgccagagacgtgcgtgttcgcgtcgaccccagcaaagacgaataaaatcaggatgaccttagcccagttagcttgcatggagacccagcatggcgtat

SEQ ID NO: 393335 - DNA, 140 bp, Artificial Sequence
  Synthetic
atacgccatgctgggtctcctgttcctcgccaggctcatatggtggttacaatactttatcaccagggccgaggcgcatttgtgcgtgtgggtcccccctctcaatgtccgggggggccgcgtacttgggagtcggccat

SEQ ID NO: 393336 - DNA, 140 bp, Artificial Sequence
  Synthetic
atggccgactcccaagtacgcggcccccccggacattgagaggggggacccacacgcacaaatgcgcctcggccctggtgataaagtattgtaaccaccatatgagcctggcgaggaacaggagacccagcatggcgtat

SEQ ID NO: 393337 - DNA, 140 bp, Artificial Sequence
  Synthetic
atacgccatgctgggtctcctggtacccgcatccgaagtgtgtggccctgtctactgtttcacgcctagtcctgtagcggtgggtaccaccgacaggcttggcgtccccacatacaactgcgtacttgggagtcggccat

SEQ ID NO: 393338 - DNA, 140 bp, Artificial Sequence
  Synthetic
atggccgactcccaagtacgcagttgtatgtggggacgccaagcctgtcggtggtacccaccgctacaggactaggcgtgaaacagtagacagggccacacacttcggatgcgggtaccaggagacccagcatggcgtat

SEQ ID NO: 393339 - DNA, 140 bp, Artificial Sequence
  Synthetic
atacgccatgctgggtctccacttgcggggccccgccatgccaagtgcagacaacacctgacaatcaaacctggagctgtcccaccgactgcttcaggaagcacccggagacaacctatacgtacttgggagtcggccat

SEQ ID NO: 393340 - DNA, 140 bp, Artificial Sequence
  Synthetic
atggccgactcccaagtacgtataggttgtctccgggtgcttcctgaagcagtcggtgggacagctccaggtttgattgtcaggtgttgtctgcacttggcatggcggggccccgcaagtggagacccagcatggcgtat

SEQ ID NO: 393341 - DNA, 140 bp, Artificial Sequence
  Synthetic
atacgccatgctgggtctccggtgaggatgtatgtcggtggcgtggaacatcgactggaggcagcatgcaactggaccaggggagaaccttgcgacttggagcatagggatcgcaccgagcgtacttgggagtcggccat

SEQ ID NO: 393342 - DNA, 140 bp, Artificial Sequence
  Synthetic
atggccgactcccaagtacgctcggtgcgatccctatgctccaagtcgcaaggttctcccctggtccagttgcatgctgcctccagtcgatgttccacgccaccgacatacatcctcaccggagacccagcatggcgtat

SEQ ID NO: 393343 - DNA, 140 bp, Artificial Sequence
  Synthetic
atacgccatgctgggtctcccttcagtgtcctcatagccagggatcagcttgaacaggcccttgattgcgaaatctacggagcctgctactccatagaaccactggatctacctccaatccgtacttgggagtcggccat

SEQ ID NO: 393344 - DNA, 140 bp, Artificial Sequence
  Synthetic
atggccgactcccaagtacggattggaggtagatccagtggttctatggagtagcaggctccgtagatttcgcaatcaagggcctgttcaagctgatccctggctatgaggacactgaagggagacccagcatggcgtat

SEQ ID NO: 393345 - DNA, 140 bp, Artificial Sequence
  Synthetic
atacgccatgctgggtctccacatagtggatgtccagtacatctacggcatcgggtccgcggtggtatcttgggctctcaggtgggagtatgtcgtgctagccttcctgctgctggcagacgtacttgggagtcggccat

SEQ ID NO: 393346 - DNA, 140 bp, Artificial Sequence
  Synthetic
atggccgactcccaagtacgtctgccagcagcaggaaggctagcacgacatactcccacctgagagcccaagataccaccgcggacccgatgccgtagatgtactggacatccactatgtggagacccagcatggcgtat

SEQ ID NO: 393347 - DNA, 140 bp, Artificial Sequence
  Synthetic
aggccctggctgctgatatgtggcgggttatggagcaggggtggcaggcgcactcgtggcctttaaggttatgagtggcgagatgccctccaccgaggacctggtcaatttgctccctgcgaccttttgggacagcggtg

SEQ ID NO: 393348 - DNA, 140 bp, Artificial Sequence
  Synthetic
caccgctgtcccaaaaggtcgcagggagcaaattgaccaggtcctcggtggagggcatctcgccactcataaccttaaaggccacgagtgcgcctgccacccctgctccataacccgccacatatcagcagccagggcct

SEQ ID NO: 393349 - DNA, 140 bp, Artificial Sequence
  Synthetic
atacgccatgctgggtctccactcaggggctcctctacgccattcttttcatctgtgtggtgtggtacataaagggccgagtcccggctgcggccgcatatgtggcctgcggaatgtggccgtacttgggagtcggccat

SEQ ID NO: 393350 - DNA, 140 bp, Artificial Sequence
  Synthetic
atggccgactcccaagtacggccacattccgcaggccacatatgcggccgcagccgggactcggccctttatgtaccacaccacacagatgaaaagaatggcgtagaggagcccctgagtggagacccagcatggcgtat

SEQ ID NO: 393351 - DNA, 140 bp, Artificial Sequence
  Synthetic
atacgccatgctgggtctcccctgacattgtctccgcactacaagcgctggctgagctggggcatgtggtggctgcaatatttcatagctagagtggaggccattctgcacgtctatgttcgtacttgggagtcggccat

SEQ ID NO: 393352 - DNA, 140 bp, Artificial Sequence
  Synthetic
atggccgactcccaagtacgaacatagacgtgcagaatggcctccactctagctatgaaatattgcagccaccacatgccccagctcagccagcgcttgtagtgcggagacaatgtcaggggagacccagcatggcgtat

SEQ ID NO: 393353 - DNA, 140 bp, Artificial Sequence
  Synthetic
atacgccatgctgggtctccccatcatttgagccgcgcggccctcgggactctgtaatcatccttctggtcctgtttcatccccacctagcctttgacatcacaaaatacatcttggccacgtacttgggagtcggccat

SEQ ID NO: 393354 - DNA, 140 bp, Artificial Sequence
  Synthetic
atggccgactcccaagtacgtggccaagatgtattttgtgatgtcaaaggctaggtggggatgaaacaggaccagaaggatgattacagagtcccgagggccgcgcggctcaaatgatggggagacccagcatggcgtat

SEQ ID NO: 393355 - DNA, 140 bp, Artificial Sequence
  Synthetic
atacgccatgctgggtctccctggtacttacatctatgaccacctttctcccttgtccgactgggccgccgacggccttaaggacttagcagtagcccttgagccagtgatattcacgcccgtacttgggagtcggccat

SEQ ID NO: 393356 - DNA, 140 bp, Artificial Sequence
  Synthetic
atggccgactcccaagtacgggcgtgaatatcactggctcaagggctactgctaagtccttaaggccgtcggcggcccagtcggacaagggagaaaggtggtcatagatgtaagtaccagggagacccagcatggcgtat

SEQ ID NO: 393357 - DNA, 140 bp, Artificial Sequence
  Synthetic
aggccctggctgctgatatgcctcctgtgcctccgccccggaagaagcggacggtggtcctcaccgagtcaaccgtatctactgccttggccgagcttgccaccaagagctttggcagctgaccttttgggacagcggtg

SEQ ID NO: 393358 - DNA, 140 bp, Artificial Sequence
  Synthetic
caccgctgtcccaaaaggtcagctgccaaagctcttggtggcaagctcggccaaggcagtagatacggttgactcggtgaggaccaccgtccgcttcttccggggcggaggcacaggaggcatatcagcagccagggcct

SEQ ID NO: 393359 - DNA, 140 bp, Artificial Sequence
  Synthetic
aggccctggctgctgatatgcattaccgcctatgcgcagcaaactcgaggcttgtttagcaccatcgtggcgagcctcactggcaaggacactaacgagaattgtggtgagatccaggtggaccttttgggacagcggtg

SEQ ID NO: 393360 - DNA, 140 bp, Artificial Sequence
  Synthetic
caccgctgtcccaaaaggtccacctggatctcaccacaattctcgttagtgtccttgccagtgaggctcgccacgatggtgctaaacaagcctcgagtttgctgcgcataggcggtaatgcatatcagcagccagggcct

SEQ ID NO: 393361 - DNA, 140 bp, Artificial Sequence
  Synthetic
aggccctggctgctgatatgccagcacctcctggggtcaagtctcttgtaccgtgcaattgcggcgcatcggacttgtacctcgtcacaaggcatgcagacgttgtgcctgtacgtaggagaccttttgggacagcggtg

SEQ ID NO: 393362 - DNA, 140 bp, Artificial Sequence
  Synthetic
caccgctgtcccaaaaggtctcctacgtacaggcacaacgtctgcatgccttgtgacgaggtacaagtccgatgcgccgcaattgcacggtacaagagacttgaccccaggaggtgctggcatatcagcagccagggcct

SEQ ID NO: 393363 - DNA, 140 bp, Artificial Sequence
  Synthetic
atacgccatgctgggtctccggacttgtacctcgtcacaaggcatgcagacgttgtgcctgtacgtaggaggggagacacccggggtgctcttttgagccccaggccgatatccgtccttcgtacttgggagtcggccat

SEQ ID NO: 393364 - DNA, 140 bp, Artificial Sequence
  Synthetic
atggccgactcccaagtacgaaggacggatatcggcctggggctcaaaagagcaccccgggtgtctcccctcctacgtacaggcacaacgtctgcatgccttgtgacgaggtacaagtccggagacccagcatggcgtat

SEQ ID NO: 393365 - DNA, 140 bp, Artificial Sequence
  Synthetic
aggccctggctgctgatatggcccatatgggcacgcccggattacaaccctccactgatagagtcctggaaggacccggactacgtccctccagtggtgcacgggtgcccattgccacctgaccttttgggacagcggtg

SEQ ID NO: 393366 - DNA, 140 bp, Artificial Sequence
  Synthetic
caccgctgtcccaaaaggtcaggtggcaatgggcacccgtgcaccactggagggacgtagtccgggtccttccaggactctatcagtggagggttgtaatccgggcgtgcccatatgggccatatcagcagccagggcct

SEQ ID NO: 393367 - DNA, 140 bp, Artificial Sequence
  Synthetic
aggccctggctgctgatatggacagaatccaccgtatcttctgccttggcggagctcgccacaaagacctttggtagctccgaatcgtcggccgtcgacagcggcacggcgaccgcccctgaccttttgggacagcggtg

SEQ ID NO: 393368 - DNA, 140 bp, Artificial Sequence
  Synthetic
caccgctgtcccaaaaggtcaggggcggtcgccgtgccgctgtcgacggccgacgattcggagctaccaaaggtctttgtggcgagctccgccaaggcagaagatacggtggattctgtccatatcagcagccagggcct

SEQ ID NO: 393369 - DNA, 140 bp, Artificial Sequence
  Synthetic
atacgccatgctgggtctcccggcccagggctacaaggtgctagtgctcaacccctccgtcgcagcgacattgggcttcggggcatatatgtccaaggcgcatggcatcgacccgaacatcgtacttgggagtcggccat

SEQ ID NO: 393370 - DNA, 140 bp, Artificial Sequence
  Synthetic
atggccgactcccaagtacgatgttcgggtcgatgccatgcgccttggacatatatgccccgaagcccaatgtcgctgcgacggaggggttgagcactagcaccttgtagccctgggccgggagacccagcatggcgtat

SEQ ID NO: 393371 - DNA, 140 bp, Artificial Sequence
  Synthetic
atacgccatgctgggtctcctcaataccaacggcagttggcacatcaacagaacggccttgaactgcaacgcaagccttgagaccggctggttagcaggactcttttatttcaacaagttcgtacttgggagtcggccat

SEQ ID NO: 393372 - DNA, 140 bp, Artificial Sequence
  Synthetic
atggccgactcccaagtacgaacttgttgaaataaaagagtcctgctaaccagccggtctcaaggcttgcgttgcagttcaaggccgttctgttgatgtgccaactgccgttggtattgaggagacccagcatggcgtat

SEQ ID NO: 393373 - DNA, 140 bp, Artificial Sequence
  Synthetic
aggccctggctgctgatatgatagaggaagtcgccttgccgacgacgggagaggtacccttctacggcagggcgattcccctcgctctgatcaagggggggagacacctaatattctgccgaccttttgggacagcggtg

SEQ ID NO: 393374 - DNA, 140 bp, Artificial Sequence
  Synthetic
caccgctgtcccaaaaggtcggcagaatattaggtgtctcccccccttgatcagagcgaggggaatcgccctgccgtagaagggtacctctcccgtcgtcggcaaggcgacttcctctatcatatcagcagccagggcct

SEQ ID NO: 393375 - DNA, 140 bp, Artificial Sequence
  Synthetic
atacgccatgctgggtctccgttgacttcagtttggaccctactttctcaatagagaccacaactgtcccccaggacgcggtctcccgctcacagcggagagggcgtaccggtaggggaacgtacttgggagtcggccat

SEQ ID NO: 393376 - DNA, 140 bp, Artificial Sequence
  Synthetic
atggccgactcccaagtacgttcccctaccggtacgccctctccgctgtgagcgggagaccgcgtcctgggggacagttgtggtctctattgagaaagtagggtccaaactgaagtcaacggagacccagcatggcgtat

SEQ ID NO: 393377 - DNA, 140 bp, Artificial Sequence
  Synthetic
  misc_feature (54)..(54): n is a, c, g, or t
atacgccatgctgggtctcctgaactgacaccagctgagacaacaactaggttnagagcctatttcaacacaccaggcctccccgtctgccaagaccatcttgagttctgggagagcgttcgtacttgggagtcggccat

SEQ ID NO: 393378 - DNA, 140 bp, Artificial Sequence
  Synthetic
  misc_feature (87)..(87): n is a, c, g, or t
atggccgactcccaagtacgaacgctctcccagaactcaagatggtcttggcagacggggaggcctggtgtgttgaaataggctctnaacctagttgttgtctcagctggtgtcagttcaggagacccagcatggcgtat

SEQ ID NO: 393379 - DNA, 140 bp, Artificial Sequence
  Synthetic
  misc_feature (47)..(47): n is a, c, g, or t
atacgccatgctgggtctccatccgtctcaagcccacactgcatggncccacccccctcctttacaggttgggggcggtacagaatgaagtgacactcacccatcctataaccaaatacacgtacttgggagtcggccat

SEQ ID NO: 393380 - DNA, 140 bp, Artificial Sequence
  Synthetic
  misc_feature (94)..(94): n is a, c, g, or t
atggccgactcccaagtacgtgtatttggttataggatgggtgagtgtcacttcattctgtaccgcccccaacctgtaaaggaggggggtgggnccatgcagtgtgggcttgagacggatggagacccagcatggcgtat

SEQ ID NO: 393381 - DNA, 140 bp, Artificial Sequence
  Synthetic
atacgccatgctgggtctccccggactacgtccctccggcggtgcatgggtgcccattgccgcctaccacgggccctccaataccgcctccacggaaaaagaggacggttgttctgacagcgtacttgggagtcggccat

SEQ ID NO: 393382 - DNA, 140 bp, Artificial Sequence
  Synthetic
atggccgactcccaagtacgctgtcagaacaaccgtcctctttttccgtggaggcggtattggagggcccgtggtaggcggcaatgggcacccatgcaccgccggagggacgtagtccggggagacccagcatggcgtat

SEQ ID NO: 393383 - DNA, 140 bp, Artificial Sequence
  Synthetic
atacgccatgctgggtctccaagtggatcaatgaagactgccccactccatgtgactcttcctggctgtgggagatctgggattgggtctgcaccgtattgtctgacttcaagacctggccgtacttgggagtcggccat

SEQ ID NO: 393384 - DNA, 140 bp, Artificial Sequence
  Synthetic
atggccgactcccaagtacggccaggtcttgaagtcagacaatacggtgcagacccaatcccagatctcccacagccaggaagagtcacatggagtggggcagtcttcattgatccacttggagacccagcatggcgtat

SEQ ID NO: 393385 - DNA, 140 bp, Artificial Sequence
  Synthetic
atacgccatgctgggtctccctgcccttgcggtgcgcagattgccggccatatcaaaaatggttcgatgaggatagtcgggcctaagacttgcagcaacacctggcacgggaccttcccccgtacttgggagtcggccat

SEQ ID NO: 393386 - DNA, 140 bp, Artificial Sequence
  Synthetic
atggccgactcccaagtacgggggaaggtcccgtgccaggtgttgctgcaagtcttaggcccgactatcctcatcgaaccatttttgatatggccggcaatctgcgcaccgcaagggcagggagacccagcatggcgtat

SEQ ID NO: 393387 - DNA, 140 bp, Artificial Sequence
  Synthetic
atacgccatgctgggtctcctcctactttctgtaggggtaggcatcttcctgctcccagcccggtaggctgagagccccacactccacacagttttttttttttttttttttttttttttcgtacttgggagtcggccat

SEQ ID NO: 393388 - DNA, 140 bp, Artificial Sequence
  Synthetic
atggccgactcccaagtacgaaaaaaaaaaaaaaaaaaaaaaaaaaaactgtgtggagtgtggggctctcagcctaccgggctgggagcaggaagatgcctacccctacagaaagtaggaggagacccagcatggcgtat

SEQ ID NO: 393389 - DNA, 140 bp, Artificial Sequence
  Synthetic
atacgccatgctgggtctcctagaattcaccgccacgcgcctaggtgcaagcccttgctaacggatgaagttacgttctccgtgggcctcaactcgtttgtggtaggatcccaacttccccgtacttgggagtcggccat

SEQ ID NO: 393390 - DNA, 140 bp, Artificial Sequence
  Synthetic
atggccgactcccaagtacggggaagttgggatcctaccacaaacgagttgaggcccacggagaacgtaacttcatccgttagcaagggcttgcacctaggcgcgtggcggtgaattctaggagacccagcatggcgtat

SEQ ID NO: 393391 - DNA, 140 bp, Artificial Sequence
  Synthetic
  misc_feature (118)..(118): n is a, c, g, or t
aggccctggctgctgatatgccccctcgctagccagctcctccgctagtcagctttccgcgccatccttgaaagccacatgtgccgctcacgacagctcccctggccaggacctcatngagaccttttgggacagcggtg

SEQ ID NO: 393392 - DNA, 140 bp, Artificial Sequence
  Synthetic
  misc_feature (23)..(23): n is a, c, g, or t
caccgctgtcccaaaaggtctcnatgaggtcctggccaggggagctgtcgtgagcggcacatgtggctttcaaggatggcgcggaaagctgactagcggaggagctggctagcgagggggcatatcagcagccagggcct

SEQ ID NO: 393393 - DNA, 140 bp, Artificial Sequence
  Synthetic
  misc_feature (68)..(68): n is a, c, g, or t
aggccctggctgctgatatgaaagccacatgtgccgctcacgacagctcccctggccaggacctcatngaagccaatctcttatggggtaccaatgccaccagggtcgagctaggtgatagaccttttgggacagcggtg

SEQ ID NO: 393394 - DNA, 140 bp, Artificial Sequence
  Synthetic
  misc_feature (73)..(73): n is a, c, g, or t
caccgctgtcccaaaaggtctatcacctagctcgaccctggtggcattggtaccccataagagattggcttcnatgaggtcctggccaggggagctgtcgtgagcggcacatgtggctttcatatcagcagccagggcct

SEQ ID NO: 393395 - DNA, 140 bp, Artificial Sequence
  Synthetic
aggccctggctgctgatatgcaacgactccctccagactgggtttcttgccgcgctgttctacacacacaggttcaacgcgtccggatgcccagaacgcatggccagctgccgccccatcgaccttttgggacagcggtg

SEQ ID NO: 393396 - DNA, 140 bp, Artificial Sequence
  Synthetic
caccgctgtcccaaaaggtcgatggggcggcagctggccatgcgttctgggcatccggacgcgttgaacctgtgtgtgtagaacagcgcggcaagaaacccagtctggagggagtcgttgcatatcagcagccagggcct

SEQ ID NO: 393397 - DNA, 140 bp, Artificial Sequence
  Synthetic
atacgccatgctgggtctcccttggaccagaggccttattgctggcactacgcacctcggccgtgtggtactatacccgcgtcgcaggtgtgcggtccggtgtactgcttcaccccaagccgtacttgggagtcggccat

SEQ ID NO: 393398 - DNA, 140 bp, Artificial Sequence
  Synthetic
atggccgactcccaagtacggcttggggtgaagcagtacaccggaccgcacacctgcgacgcgggtatagtaccacacggccgaggtgcgtagtgccagcaataaggcctctggtccaagggagacccagcatggcgtat

SEQ ID NO: 393399 - DNA, 140 bp, Artificial Sequence
  Synthetic
aggccctggctgctgatatgccgcaaggccgttaaccacatcaactccgtgtgggaggacttgctggaggacaacacaacccctattccgacaacaatcatggccaaaaacgaggtttttgaccttttgggacagcggtg

SEQ ID NO: 393400 - DNA, 140 bp, Artificial Sequence
  Synthetic
caccgctgtcccaaaaggtcaaaaacctcgtttttggccatgattgttgtcggaataggggttgtgttgtcctccagcaagtcctcccacacggagttgatgtggttaacggccttgcggcatatcagcagccagggcct

SEQ ID NO: 393401 - DNA, 140 bp, Artificial Sequence
  Synthetic
atacgccatgctgggtctccgggcggccctatgcacaacagcaaaggagacctatgcgggtaccgtagatgccgcgcgagcggcgtatacaccacaagcttcgggaacacactgacgtgccgtacttgggagtcggccat

SEQ ID NO: 393402 - DNA, 140 bp, Artificial Sequence
  Synthetic
atggccgactcccaagtacggcacgtcagtgtgttcccgaagcttgtggtgtatacgccgctcgcgcggcatctacggtacccgcataggtctcctttgctgttgtgcatagggccgcccggagacccagcatggcgtat

SEQ ID NO: 393403 - DNA, 140 bp, Artificial Sequence
  Synthetic
atacgccatgctgggtctcctacaatatcttatcaccagagccgaggcacaattgcaaacgtggatccctcccctcaacgctcgggggggccgcgacgccatcatcctccttacatgtgccgtacttgggagtcggccat

SEQ ID NO: 393404 - DNA, 140 bp, Artificial Sequence
  Synthetic
atggccgactcccaagtacggcacatgtaaggaggatgatggcgtcgcggcccccccgagcgttgaggggagggatccacgtttgcaattgtgcctcggctctggtgataagatattgtaggagacccagcatggcgtat

SEQ ID NO: 393405 - DNA, 140 bp, Artificial Sequence
  Synthetic
aggccctggctgctgatatgcaccatgctcgtgtgtggcgacgacttagtcgttatctgtgaaagtgcgggagtccaggaggacgcggcgagcctgcgagccttcacggaggctatgaccgaccttttgggacagcggtg

SEQ ID NO: 393406 - DNA, 140 bp, Artificial Sequence
  Synthetic
caccgctgtcccaaaaggtcggtcatagcctccgtgaaggctcgcaggctcgccgcgtcctcctggactcccgcactttcacagataacgactaagtcgtcgccacacacgagcatggtgcatatcagcagccagggcct

SEQ ID NO: 393407 - DNA, 140 bp, Artificial Sequence
  Synthetic
aggccctggctgctgatatgacacctaggtgcatagttgactacccatacaggctctggcactacccctgcactgtcaactttaccatctttaaggttaggatgtatgtggggggcgtgggaccttttgggacagcggtg

SEQ ID NO: 393408 - DNA, 140 bp, Artificial Sequence
  Synthetic
caccgctgtcccaaaaggtcccacgccccccacatacatcctaaccttaaagatggtaaagttgacagtgcaggggtagtgccagagcctgtatgggtagtcaactatgcacctaggtgtcatatcagcagccagggcct

SEQ ID NO: 393409 - DNA, 140 bp, Artificial Sequence
  Synthetic
atacgccatgctgggtctccttttttttttttccttttttttttttccccccctttaggggggggttttttttcccccccaagggggggggtgttggaaaccaaatttttggggggggggcgtacttgggagtcggccat

SEQ ID NO: 393410 - DNA, 140 bp, Artificial Sequence
  Synthetic
atggccgactcccaagtacgccccccccccaaaaatttggtttccaacacccccccccttgggggggaaaaaaaacccccccctaaagggggggaaaaaaaaaaaaggaaaaaaaaaaaaggagacccagcatggcgtat

SEQ ID NO: 393411 - DNA, 140 bp, Artificial Sequence
  Synthetic
atacgccatgctgggtctccgaagacgggatcaactatgcaacagggaatcttcccggttgctctttctctatcttcatcttggcacttctctcgtgcctgactgtcccggcctcagctccgtacttgggagtcggccat

SEQ ID NO: 393412 - DNA, 140 bp, Artificial Sequence
  Synthetic
atggccgactcccaagtacggagctgaggccgggacagtcaggcacgagagaagtgccaagatgaagatagagaaagagcaaccgggaagattccctgttgcatagttgatcccgtcttcggagacccagcatggcgtat

SEQ ID NO: 393413 - DNA, 140 bp, Artificial Sequence
  Synthetic
aggccctggctgctgatatgcgctcccactggtagcggcaagagcaccaaggtgccggctgcatatgcagcccaagggtacaaggtactagtcctgaacccgtccgttgccgccaccttagaccttttgggacagcggtg

SEQ ID NO: 393414 - DNA, 140 bp, Artificial Sequence
  Synthetic
caccgctgtcccaaaaggtctaaggtggcggcaacggacgggttcaggactagtaccttgtacccttgggctgcatatgcagccggcaccttggtgctcttgccgctaccagtgggagcgcatatcagcagccagggcct

SEQ ID NO: 393415 - DNA, 140 bp, Artificial Sequence
  Synthetic
atacgccatgctgggtctccatgcgtgccctgtgtgaagaccgagggcactccgcgctgctgggtagccttgacacctactgtggccgctccccaccttgcggctccgcttatgtcgctgcgtacttgggagtcggccat

SEQ ID NO: 393416 - DNA, 140 bp, Artificial Sequence
  Synthetic
atggccgactcccaagtacgcagcgacataagcggagccgcaaggtggggagcggccacagtaggtgtcaaggctacccagcagcgcggagtgccctcggtcttcacacagggcacgcatggagacccagcatggcgtat

SEQ ID NO: 393417 - DNA, 140 bp, Artificial Sequence
  Synthetic
aggccctggctgctgatatgtgacacctactgtggccgctccccaccttgcggctccgcttatgtcgctgcggcggcatgtggacctgatggtgggcgcggccaccctgtgctctgccctgaccttttgggacagcggtg

SEQ ID NO: 393418 - DNA, 140 bp, Artificial Sequence
  Synthetic
caccgctgtcccaaaaggtcagggcagagcacagggtggccgcgcccaccatcaggtccacatgccgccgcagcgacataagcggagccgcaaggtggggagcggccacagtaggtgtcacatatcagcagccagggcct

SEQ ID NO: 393419 - DNA, 140 bp, Artificial Sequence
  Synthetic
aggccctggctgctgatatgtatgtcggccatatcaccggtcacagaatggcgtgggacatgatgatgaattggagccctaccaccacgctcctcctcgcccaggtcatgaggatcccctgaccttttgggacagcggtg

SEQ ID NO: 393420 - DNA, 140 bp, Artificial Sequence
  Synthetic
caccgctgtcccaaaaggtcaggggatcctcatgacctgggcgaggaggagcgtggtggtagggctccaattcatcatcatgtcccacgccattctgtgaccggtgatatggccgacatacatatcagcagccagggcct

SEQ ID NO: 393421 - DNA, 140 bp, Artificial Sequence
  Synthetic
aggccctggctgctgatatgttggagccctaccaccacgctcctcctcgcccaggtcatgaggatcccctctgcccttgttgacatgctcagcgggggccattggggtgtcctagcaggcgaccttttgggacagcggtg

SEQ ID NO: 393422 - DNA, 140 bp, Artificial Sequence
  Synthetic
caccgctgtcccaaaaggtcgcctgctaggacaccccaatggcccccgctgagcatgtcaacaagggcagaggggatcctcatgacctgggcgaggaggagcgtggtggtagggctccaacatatcagcagccagggcct

SEQ ID NO: 393423 - DNA, 140 bp, Artificial Sequence
  Synthetic
atacgccatgctgggtctccgttcctcttcgcgggggtggacgccaccactgttaccaccggtggaattgctgcacagagcgcgtctggccttgtcaaccttttcagccccgggtctcggcgtacttgggagtcggccat

SEQ ID NO: 393424 - DNA, 140 bp, Artificial Sequence
  Synthetic
atggccgactcccaagtacgccgagacccggggctgaaaaggttgacaaggccagacgcgctctgtgcagcaattccaccggtggtaacagtggtggcgtccacccccgcgaagaggaacggagacccagcatggcgtat

SEQ ID NO: 393425 - DNA, 140 bp, Artificial Sequence
  Synthetic
atacgccatgctgggtctcctctatcaccacaagttcaattcttccgggtgcccagagaggcttgccgcgtgcaagaggttagaagctttccaacagggctggggcaagcttggggtcgccgtacttgggagtcggccat

SEQ ID NO: 393426 - DNA, 140 bp, Artificial Sequence
  Synthetic
atggccgactcccaagtacggcgaccccaagcttgccccagccctgttggaaagcttctaacctcttgcacgcggcaagcctctctgggcacccggaagaattgaacttgtggtgatagaggagacccagcatggcgtat

SEQ ID NO: 393427 - DNA, 140 bp, Artificial Sequence
  Synthetic
atacgccatgctgggtctcctgcttcacgcccagtcccgtggtcgttggcacgaccgaccggcttggagcccccacctacacctggggggagaatgaaactgatgtattcattctgaactcgtacttgggagtcggccat

SEQ ID NO: 393428 - DNA, 140 bp, Artificial Sequence
  Synthetic
atggccgactcccaagtacgagttcagaatgaatacatcagtttcattctccccccaggtgtaggtgggggctccaagccggtcggtcgtgccaacgaccacgggactgggcgtgaagcaggagacccagcatggcgtat

SEQ ID NO: 393429 - DNA, 140 bp, Artificial Sequence
  Synthetic
aggccctggctgctgatatgacatccagctgatcaacaccaacggcagttggcacatcaatagcacggccttgaactgcaatgatagccttaacaccggctggatagcaggtcttttctagaccttttgggacagcggtg

SEQ ID NO: 393430 - DNA, 140 bp, Artificial Sequence
  Synthetic
caccgctgtcccaaaaggtctagaaaagacctgctatccagccggtgttaaggctatcattgcagttcaaggccgtgctattgatgtgccaactgccgttggtgttgatcagctggatgtcatatcagcagccagggcct

SEQ ID NO: 393431 - DNA, 140 bp, Artificial Sequence
  Synthetic
atacgccatgctgggtctcccaacggctcctggcactgccccacggactgcttcaggaaacatccggagacgacttacatcaagtgtggctcggggccttggctcacgccaaggtgcatgcgtacttgggagtcggccat

SEQ ID NO: 393432 - DNA, 140 bp, Artificial Sequence
  Synthetic
atggccgactcccaagtacgcatgcaccttggcgtgagccaaggccccgagccacacttgatgtaagtcgtctccggatgtttcctgaagcagtccgtggggcagtgccaggagccgttgggagacccagcatggcgtat

SEQ ID NO: 393433 - DNA, 140 bp, Artificial Sequence
  Synthetic
aggccctggctgctgatatggaccccttaccgattttgcccagggctggggccctatcagtcatgccaacggaagtggccccgaccaacgtccctactgctggcactaccctccaagaccgaccttttgggacagcggtg

SEQ ID NO: 393434 - DNA, 140 bp, Artificial Sequence
  Synthetic
caccgctgtcccaaaaggtcggtcttggagggtagtgccagcagtagggacgttggtcggggccacttccgttggcatgactgatagggccccagccctgggcaaaatcggtaaggggtccatatcagcagccagggcct

SEQ ID NO: 393435 - DNA, 140 bp, Artificial Sequence
  Synthetic
atacgccatgctgggtctcccggcgtgcaactggactaggggggaaccgtgtagcttagagcatagagatcgcaccgagctttcaccgctgctgctttccaccacgcagtggcaggtcctcgtacttgggagtcggccat

SEQ ID NO: 393436 - DNA, 140 bp, Artificial Sequence
  Synthetic
atggccgactcccaagtacgaggacctgccactgcgtggtggaaagcagcagcggtgaaagctcggtgcgatctctatgctctaagctacacggttcccccctagtccagttgcacgccgggagacccagcatggcgtat

SEQ ID NO: 393437 - DNA, 140 bp, Artificial Sequence
  Synthetic
atacgccatgctgggtctcctccatcagaacatcgtggacgtccaatacctttatggcgttgggtctgccgttgtgtcatgggcacttaagtgggagtacatagtacttgctttcctgctcgtacttgggagtcggccat

SEQ ID NO: 393438 - DNA, 140 bp, Artificial Sequence
  Synthetic
atggccgactcccaagtacgagcaggaaagcaagtactatgtactcccacttaagtgcccatgacacaacggcagacccaacgccataaaggtattggacgtccacgatgttctgatggaggagacccagcatggcgtat

SEQ ID NO: 393439 - DNA, 140 bp, Artificial Sequence
  Synthetic
atacgccatgctgggtctccgctgccagtacccacggtctcccctgggccatgattttcatctgtgtggcttggtatgttaagggcaggcttccagcagccgctgtgtacgcagcttgtgcgtacttgggagtcggccat

SEQ ID NO: 393440 - DNA, 140 bp, Artificial Sequence
  Synthetic
atggccgactcccaagtacgcacaagctgcgtacacagcggctgctggaagcctgcccttaacataccaagccacacagatgaaaatcatggcccaggggagaccgtgggtactggcagcggagacccagcatggcgtat

SEQ ID NO: 393441 - DNA, 140 bp, Artificial Sequence
  Synthetic
atacgccatgctgggtctccgataaccatcttgacattgtccccctggtacaaacactggttggcgcgcatactgtggtggttgcagtacttcatagccagggctgaggccttgctacatcgtacttgggagtcggccat

SEQ ID NO: 393442 - DNA, 140 bp, Artificial Sequence
  Synthetic
atggccgactcccaagtacgatgtagcaaggcctcagccctggctatgaagtactgcaaccaccacagtatgcgcgccaaccagtgtttgtaccagggggacaatgtcaagatggttatcggagacccagcatggcgtat

SEQ ID NO: 393443 - DNA, 140 bp, Artificial Sequence
  Synthetic
atacgccatgctgggtctcctcctggctgtgttaggttcactttacctgctccaaagctcgcttttgcgcgtcccttactatgtgagggcccacgccttagtcaagatctgtggctttgtcgtacttgggagtcggccat

SEQ ID NO: 393444 - DNA, 140 bp, Artificial Sequence
  Synthetic
atggccgactcccaagtacgacaaagccacagatcttgactaaggcgtgggccctcacatagtaagggacgcgcaaaagcgagctttggagcaggtaaagtgaacctaacacagccaggaggagacccagcatggcgtat

SEQ ID NO: 393445 - DNA, 140 bp, Artificial Sequence
  Synthetic
aggccctggctgctgatatggtcccttactatgtgagggcccacgccttagtcaagatctgtggctttgtgcgcaacatggcgcatggcaaatacatccagcttgccctgcttaaggttggaccttttgggacagcggtg

SEQ ID NO: 393446 - DNA, 140 bp, Artificial Sequence
  Synthetic
caccgctgtcccaaaaggtccaaccttaagcagggcaagctggatgtatttgccatgcgccatgttgcgcacaaagccacagatcttgactaaggcgtgggccctcacatagtaagggaccatatcagcagccagggcct

SEQ ID NO: 393447 - DNA, 140 bp, Artificial Sequence
  Synthetic
atacgccatgctgggtctccgttcacacctatggagaagaaggtgatagtttggggtgctgacacagctgcgtgtggtgacatcatcaacggccttccggtgtctgccaggctaggcaatcgtacttgggagtcggccat

SEQ ID NO: 393448 - DNA, 140 bp, Artificial Sequence
  Synthetic
atggccgactcccaagtacgattgcctagcctggcagacaccggaaggccgttgatgatgtcaccacacgcagctgtgtcagcaccccaaactatcaccttcttctccataggtgtgaacggagacccagcatggcgtat

SEQ ID NO: 393449 - DNA, 140 bp, Artificial Sequence
  Synthetic
  misc_feature (62)..(62): n is a, c, g, or t
atacgccatgctgggtctccgagatattgctaggtccggctgacgctgaagtgcagaagggntggaggctccttgcccccatcacagcatacgcgcagcagacacgaggcttgttgggcacgtacttgggagtcggccat

SEQ ID NO: 393450 - DNA, 140 bp, Artificial Sequence
  Synthetic
  misc_feature (79)..(79): n is a, c, g, or t
atggccgactcccaagtacgtgcccaacaagcctcgtgtctgctgcgcgtatgctgtgatgggggcaaggagcctccancccttctgcacttcagcgtcagccggacctagcaatatctcggagacccagcatggcgtat

SEQ ID NO: 393451 - DNA, 140 bp, Artificial Sequence
  Synthetic
atacgccatgctgggtctcccggcgttatgtggaccgtataccacggggccggcagcaagaccatctgcggcccaaagggccccgtctgccaaatgtacaccaatgttgaccaagacctacgtacttgggagtcggccat

SEQ ID NO: 393452 - DNA, 140 bp, Artificial Sequence
  Synthetic
atggccgactcccaagtacgtaggtcttggtcaacattggtgtacatttggcagacggggccctttgggccgcagatggtcttgctgccggccccgtggtatacggtccacataacgccgggagacccagcatggcgtat

SEQ ID NO: 393453 - DNA, 140 bp, Artificial Sequence
  Synthetic
atacgccatgctgggtctcctgcgccgaaggggggacactcgtggggcgctcatcagccccagaccaatcgccacgctcaagggatcctctggcgggccgttgctatgcgcgaaaggccacgtacttgggagtcggccat

SEQ ID NO: 393454 - DNA, 140 bp, Artificial Sequence
  Synthetic
atggccgactcccaagtacgtggcctttcgcgcatagcaacggcccgccagaggatcccttgagcgtggcgattggtctggggctgatgagcgccccacgagtgtccccccttcggcgcaggagacccagcatggcgtat

SEQ ID NO: 393455 - DNA, 140 bp, Artificial Sequence
  Synthetic
atacgccatgctgggtctcccggccccaagcagaacatccagctcatcaactccaatggcagttggcacatcaataggacggccttgaactgtaatgatagcctcaacaccggctggatacgtacttgggagtcggccat

SEQ ID NO: 393456 - DNA, 140 bp, Artificial Sequence
  Synthetic
atggccgactcccaagtacgtatccagccggtgttgaggctatcattacagttcaaggccgtcctattgatgtgccaactgccattggagttgatgagctggatgttctgcttggggccgggagacccagcatggcgtat

SEQ ID NO: 393457 - DNA, 140 bp, Artificial Sequence
  Synthetic
atacgccatgctgggtctccgtgttctcggacaactcgacacctccggctgtaccccagacataccaggtcgctcacctgcatgcaccaacgggaagtggcaagagcaccaaggttccggcgtacttgggagtcggccat

SEQ ID NO: 393458 - DNA, 140 bp, Artificial Sequence
  Synthetic
atggccgactcccaagtacgccggaaccttggtgctcttgccacttcccgttggtgcatgcaggtgagcgacctggtatgtctggggtacagccggaggtgtcgagttgtccgagaacacggagacccagcatggcgtat

SEQ ID NO: 393459 - DNA, 140 bp, Artificial Sequence
  Synthetic
atacgccatgctgggtctcccccgaacatccggtctggcgtcaggaccatcaccacaggcgcaccaatcacatactccacgtacgggaaattcctggccgatggaggttgtggggggggacgtacttgggagtcggccat

SEQ ID NO: 393460 - DNA, 140 bp, Artificial Sequence
  Synthetic
atggccgactcccaagtacgtccccccccacaacctccatcggccaggaatttcccgtacgtggagtatgtgattggtgcgcctgtggtgatggtcctgacgccagaccggatgttcgggggagacccagcatggcgtat

SEQ ID NO: 393461 - DNA, 140 bp, Artificial Sequence
  Synthetic
atacgccatgctgggtctccgcctatgacatcatcatctgtgacgagtgccactccactgactcaacaacgatccttggcataggcacggtcttagaccaagctgagacggctggcgtaccgtacttgggagtcggccat

SEQ ID NO: 393462 - DNA, 140 bp, Artificial Sequence
  Synthetic
atggccgactcccaagtacggtacgccagccgtctcagcttggtctaagaccgtgcctatgccaaggatcgttgttgagtcagtggagtggcactcgtcacagatgatgatgtcataggcggagacccagcatggcgtat

SEQ ID NO: 393463 - DNA, 140 bp, Artificial Sequence
  Synthetic
aggccctggctgctgatatggtccgacgttgagtcgtactcctccatgcccccccttgagggggagccgggggaccccgatctcagcgacgggtcctggtctaccgtgagcgaggaggccgaccttttgggacagcggtg

SEQ ID NO: 393464 - DNA, 140 bp, Artificial Sequence
  Synthetic
caccgctgtcccaaaaggtcggcctcctcgctcacggtagaccaggacccgtcgctgagatcggggtcccccggctccccctcaagggggggcatggaggagtacgactcaacgtcggaccatatcagcagccagggcct

SEQ ID NO: 393465 - DNA, 140 bp, Artificial Sequence
  Synthetic
atacgccatgctgggtctccttacggcagagcgatccctctagagctcatcaaagggggtaggcatctcatcttctgtcattccaggaaaaagtgtgacgaactagccaagcagttgtcacgtacttgggagtcggccat

SEQ ID NO: 393466 - DNA, 140 bp, Artificial Sequence
  Synthetic
atggccgactcccaagtacgtgacaactgcttggctagttcgtcacactttttcctggaatgacagaagatgagatgcctaccccctttgatgagctctagagggatcgctctgccgtaaggagacccagcatggcgtat

SEQ ID NO: 393467 - DNA, 140 bp, Artificial Sequence
  Synthetic
aggccctggctgctgatatgagacagggacaggtccgagctcagcccgctgctgctgtccaccacacagtggcaggtccttccgtgttcgttcacgaccctgccagccttgtccaccggcgaccttttgggacagcggtg

SEQ ID NO: 393468 - DNA, 140 bp, Artificial Sequence
  Synthetic
caccgctgtcccaaaaggtcgccggtggacaaggctggcagggtcgtgaacgaacacggaaggacctgccactgtgtggtggacagcagcagcgggctgagctcggacctgtccctgtctcatatcagcagccagggcct

SEQ ID NO: 393469 - DNA, 140 bp, Artificial Sequence
  Synthetic
atacgccatgctgggtctcccggggttcaccggcgacttcgactccgtaatagattgcaacacatctgtcatacagactgtggacttcagcttggaccctacattttccattgagaccaccgtacttgggagtcggccat

SEQ ID NO: 393470 - DNA, 140 bp, Artificial Sequence
  Synthetic
atggccgactcccaagtacggtggtctcaatggaaaatgtagggtccaagctgaagtccacagtctgtatgacagatgtgttgcaatctattacggagtcgaagtcgccggtgaaccccgggagacccagcatggcgtat

SEQ ID NO: 393471 - DNA, 140 bp, Artificial Sequence
  Synthetic
atacgccatgctgggtctcctcgggcatgtttgacacttcagtgctctgtgagtgctatgatgctggctgtgcttggtatgagttgactccggcggagacaactaccaggctgagggcgtcgtacttgggagtcggccat

SEQ ID NO: 393472 - DNA, 140 bp, Artificial Sequence
  Synthetic
atggccgactcccaagtacgacgccctcagcctggtagttgtctccgccggagtcaactcataccaagcacagccagcatcatagcactcacagagcactgaagtgtcaaacatgcccgaggagacccagcatggcgtat

SEQ ID NO: 393473 - DNA, 140 bp, Artificial Sequence
  Synthetic
aggccctggctgctgatatgtgcttggtatgagttgactccggcggagacaactaccaggctgagggcgtacttcaacacaccggggctccccgtttgccaagaccatctcgagttctgggaccttttgggacagcggtg

SEQ ID NO: 393474 - DNA, 140 bp, Artificial Sequence
  Synthetic
caccgctgtcccaaaaggtcccagaactcgagatggtcttggcaaacggggagccccggtgtgttgaagtacgccctcagcctggtagttgtctccgccggagtcaactcataccaagcacatatcagcagccagggcct

SEQ ID NO: 393475 - DNA, 140 bp, Artificial Sequence
  Synthetic
aggccctggctgctgatatgtcatcgccgcgctgttctaccatcacaagttcaacgcgtccggatgcccagaacgcatggcgagctgccgtcccattggcgagttcgctcaggggtgggggaccttttgggacagcggtg

SEQ ID NO: 393476 - DNA, 140 bp, Artificial Sequence
  Synthetic
caccgctgtcccaaaaggtcccccacccctgagcgaactcgccaatgggacggcagctcgccatgcgttctgggcatccggacgcgttgaacttgtgatggtagaacagcgcggcgatgacatatcagcagccagggcct

SEQ ID NO: 393477 - DNA, 140 bp, Artificial Sequence
  Synthetic
atacgccatgctgggtctcccggtctgtgctagggcccaggcccccccaccatcgtgggacgctatgtggaagtgcttgatccgcctgaaacccaccttgcatggccccacccccctcctcgtacttgggagtcggccat

SEQ ID NO: 393478 - DNA, 140 bp, Artificial Sequence
  Synthetic
atggccgactcccaagtacgaggaggggggtggggccatgcaaggtgggtttcaggcggatcaagcacttccacatagcgtcccacgatggtgggggggcctgggccctagcacagaccgggagacccagcatggcgtat

SEQ ID NO: 393479 - DNA, 140 bp, Artificial Sequence
  Synthetic
aggccctggctgctgatatggcaactgcacgtgtgggtcccccccctcaacgtccgaggggggcgcgacgccgtcatcttgctcatgtgtgttgtgcacccgactttggtattcgatatcgaccttttgggacagcggtg

SEQ ID NO: 393480 - DNA, 140 bp, Artificial Sequence
  Synthetic
caccgctgtcccaaaaggtcgatatcgaataccaaagtcgggtgcacaacacacatgagcaagatgacggcgtcgcgcccccctcggacgttgaggggggggacccacacgtgcagttgccatatcagcagccagggcct

SEQ ID NO: 393481 - DNA, 140 bp, Artificial Sequence
  Synthetic
aggccctggctgctgatatgctgccgttattcctgacagggaggtgctctatcaacagtttgatgagatggaggaatgttccaaccacatcccgctggttgagcacggcttgcaattggcgaccttttgggacagcggtg

SEQ ID NO: 393482 - DNA, 140 bp, Artificial Sequence
  Synthetic
caccgctgtcccaaaaggtcgccaattgcaagccgtgctcaaccagcgggatgtggttggaacattcctccatctcatcaaactgttgatagagcacctccctgtcaggaataacggcagcatatcagcagccagggcct

SEQ ID NO: 393483 - DNA, 140 bp, Artificial Sequence
  Synthetic
aggccctggctgctgatatgctggcaaaagggtgtactacctcacccgtgaccccaccaccccccttgcacgggctgcgtgggagacagctagacacactccagtcaactcctggctagggaccttttgggacagcggtg

SEQ ID NO: 393484 - DNA, 140 bp, Artificial Sequence
  Synthetic
caccgctgtcccaaaaggtccctagccaggagttgactggagtgtgtctagctgtctcccacgcagcccgtgcaaggggggtggtggggtcacgggtgaggtagtacacccttttgccagcatatcagcagccagggcct

SEQ ID NO: 393485 - DNA, 140 bp, Artificial Sequence
  Synthetic
atacgccatgctgggtctcccaattctgggcaaaacacatgtggaacttcatcagtggcatccaatacctggcagggttgtccaccctgcctggcaatccagccattgcttcactcatgtcgtacttgggagtcggccat

SEQ ID NO: 393486 - DNA, 140 bp, Artificial Sequence
  Synthetic
atggccgactcccaagtacgacatgagtgaagcaatggctggattgccaggcagggtggacaaccctgccaggtattggatgccactgatgaagttccacatgtgttttgcccagaattgggagacccagcatggcgtat

SEQ ID NO: 393487 - DNA, 140 bp, Artificial Sequence
  Synthetic
aggccctggctgctgatatgttggaggacagggatagatcggagctcagtccgctgctgctgtctacaacagagtggcagataatgccctgttcttttaccaccctaccagccttgtccagaccttttgggacagcggtg

SEQ ID NO: 393488 - DNA, 140 bp, Artificial Sequence
  Synthetic
caccgctgtcccaaaaggtctggacaaggctggtagggtggtaaaagaacagggcattatctgccactctgttgtagacagcagcagcggactgagctccgatctatccctgtcctccaacatatcagcagccagggcct

SEQ ID NO: 393489 - DNA, 140 bp, Artificial Sequence
  Synthetic
atacgccatgctgggtctccctctacggctttcgtcgtgagcggcctgaccggcgccgcagtcggcagtgtggggctagggaagatcctcgttgacatccttgctggttatggtgccggtcgtacttgggagtcggccat

SEQ ID NO: 393490 - DNA, 140 bp, Artificial Sequence
  Synthetic
atggccgactcccaagtacgaccggcaccataaccagcaaggatgtcaacgaggatcttccctagccccacactgccgactgcggcgccggtcaggccgctcacgacgaaagccgtagagggagacccagcatggcgtat

SEQ ID NO: 393491 - DNA, 140 bp, Artificial Sequence
  Synthetic
atacgccatgctgggtctcctggtggtgggggtagtgtgcgcggcgatcctgcgtcgccacgtgggccccggcgagggggctgtgcagtggatgaaccgtctcattgccttcgcatcgcgcgtacttgggagtcggccat

SEQ ID NO: 393492 - DNA, 140 bp, Artificial Sequence
  Synthetic
atggccgactcccaagtacgcgcgatgcgaaggcaatgagacggttcatccactgcacagccccctcgccggggcccacgtggcgacgcaggatcgccgcgcacactacccccaccaccaggagacccagcatggcgtat

SEQ ID NO: 393493 - DNA, 140 bp, Artificial Sequence
  Synthetic
aggccctggctgctgatatgcccgcgtgactgccatactctcatccctaactgtgacttccctccttaggaggctccataagtggatcaatgaagactgctccaccccctgtgattcatcgaccttttgggacagcggtg

SEQ ID NO: 393494 - DNA, 140 bp, Artificial Sequence
  Synthetic
caccgctgtcccaaaaggtcgatgaatcacagggggtggagcagtcttcattgatccacttatggagcctcctaaggagggaagtcacagttagggatgagagtatggcagtcacgcgggcatatcagcagccagggcct

SEQ ID NO: 393495 - DNA, 140 bp, Artificial Sequence
  Synthetic
aggccctggctgctgatatgtggtggggaactgggcgaaggtcctgctagtgctgctgctatttgccggcgtcgacgcgaccactcacgtcaccgggggagctacggccaaaaacgcatagaccttttgggacagcggtg

SEQ ID NO: 393496 - DNA, 140 bp, Artificial Sequence
  Synthetic
caccgctgtcccaaaaggtctatgcgtttttggccgtagctcccccggtgacgtgagtggtcgcgtcgacgccggcaaatagcagcagcactagcaggaccttcgcccagttccccaccacatatcagcagccagggcct

SEQ ID NO: 393497 - DNA, 140 bp, Artificial Sequence
  Synthetic
atacgccatgctgggtctccctctcttgccagaaggggtttaagggagagtggcggggggacggggtcatgcacacaacatgtccctgcggagcagaaatagccggccacgtcaagaatgcgtacttgggagtcggccat

SEQ ID NO: 393498 - DNA, 140 bp, Artificial Sequence
  Synthetic
atggccgactcccaagtacgcattcttgacgtggccggctatttctgctccgcagggacatgttgtgtgcatgaccccgtccccccgccactctcccttaaaccccttctggcaagagagggagacccagcatggcgtat

SEQ ID NO: 393499 - DNA, 140 bp, Artificial Sequence
  Synthetic
atacgccatgctgggtctccgcccaactacaagttcgcgctgtggcgggtgtcggctgaggaatacgtggaagttcgcagggtgggagattaccactacatagtgggagtcacacaagaccgtacttgggagtcggccat

SEQ ID NO: 393500 - DNA, 140 bp, Artificial Sequence
  Synthetic
atggccgactcccaagtacggtcttgtgtgactcccactatgtagtggtaatctcccaccctgcgaacttccacgtattcctcagccgacacccgccacagcgcgaacttgtagttgggcggagacccagcatggcgtat

SEQ ID NO: 393501 - DNA, 140 bp, Artificial Sequence
  Synthetic
atacgccatgctgggtctccgggacgaggtgaccttcagcgtgggcctcaacacgttcgtggtggggtcccagctcccttgcgagccggagccagacgtggcggtgttaacatccatgctcgtacttgggagtcggccat

SEQ ID NO: 393502 - DNA, 140 bp, Artificial Sequence
  Synthetic
atggccgactcccaagtacgagcatggatgttaacaccgccacgtctggctccggctcgcaagggagctgggaccccaccacgaacgtgttgaggcccacgctgaaggtcacctcgtcccggagacccagcatggcgtat

SEQ ID NO: 393503 - DNA, 140 bp, Artificial Sequence
  Synthetic
atacgccatgctgggtctccccttcactcaaggccacatgtacaacccatcatgagtcccccgacgctgatctcatcgaggcgaatcttctgtggagacaggagatggggagcaacatcacgtacttgggagtcggccat

SEQ ID NO: 393504 - DNA, 140 bp, Artificial Sequence
  Synthetic
atggccgactcccaagtacgtgatgttgctccccatctcctgtctccacagaagattcgcctcgatgagatcagcgtcgggggactcatgatgggttgtacatgtggccttgagtgaaggggagacccagcatggcgtat

SEQ ID NO: 393505 - DNA, 140 bp, Artificial Sequence
  Synthetic
atacgccatgctgggtctccgcgcacgtccaagcggttccccgcgcccctgccagtgtgggctcgcccggattacaatccacccttggtggaggtctggaagaagccggaatacgatcctcgtacttgggagtcggccat

SEQ ID NO: 393506 - DNA, 140 bp, Artificial Sequence
  Synthetic
atggccgactcccaagtacgaggatcgtattccggcttcttccagacctccaccaagggtggattgtaatccgggcgagcccacactggcaggggcgcggggaaccgcttggacgtgcgcggagacccagcatggcgtat

SEQ ID NO: 393507 - DNA, 140 bp, Artificial Sequence
  Synthetic
atacgccatgctgggtctccatcctggcgggcctcgcctactattccatggtggggaactgggctaaggttttgattgtgttgctacttttttccggcgttgacgggaccggcaccgtggcgtacttgggagtcggccat

SEQ ID NO: 393508 - DNA, 140 bp, Artificial Sequence
  Synthetic
atggccgactcccaagtacgccacggtgccggtcccgtcaacgccggaaaaaagtagcaacacaatcaaaaccttagcccagttccccaccatggaatagtaggcgaggcccgccaggatggagacccagcatggcgtat

SEQ ID NO: 393509 - DNA, 140 bp, Artificial Sequence
  Synthetic
atacgccatgctgggtctccgcgctctggcagagttggctgcgcggtccttcggtaccaccgaaccaagcgccgactccggggtagaccagggaccccctactgaaacttctgaacccgacgtacttgggagtcggccat

SEQ ID NO: 393510 - DNA, 140 bp, Artificial Sequence
  Synthetic
atggccgactcccaagtacgtcgggttcagaagtttcagtagggggtccctggtctaccccggagtcggcgcttggttcggtggtaccgaaggaccgcgcagccaactctgccagagcgcggagacccagcatggcgtat

SEQ ID NO: 393511 - DNA, 140 bp, Artificial Sequence
  Synthetic
atacgccatgctgggtctcccaacaggactgccctcaactgcaatgactctctccagaccgggttccttgctgcactgttctacacgaacagttttaactcgtctggatgcccagagcgccgtacttgggagtcggccat

SEQ ID NO: 393512 - DNA, 140 bp, Artificial Sequence
  Synthetic
atggccgactcccaagtacggcgctctgggcatccagacgagttaaaactgttcgtgtagaacagtgcagcaaggaacccggtctggagagagtcattgcagttgagggcagtcctgttgggagacccagcatggcgtat

SEQ ID NO: 393513 - DNA, 140 bp, Artificial Sequence
  Synthetic
atacgccatgctgggtctcctccacagtcagtagctcagaggatgtggtctgttgctcaatgtcatattcatggacaggggctctagttacaccatgtgcggctgaagagaccaagctgccgtacttgggagtcggccat

SEQ ID NO: 393514 - DNA, 140 bp, Artificial Sequence
  Synthetic
atggccgactcccaagtacggcagcttggtctcttcagccgcacatggtgtaactagagcccctgtccatgaatatgacattgagcaacagaccacatcctctgagctactgactgtggaggagacccagcatggcgtat

SEQ ID NO: 393515 - DNA, 140 bp, Artificial Sequence
  Synthetic
atacgccatgctgggtctccgccacgacttctcgctcggcaactgcccggcagaagaaagtcacctttgaccgcctccaagtgcttgacaaccactaccacgaagtccttaaggagattacgtacttgggagtcggccat

SEQ ID NO: 393516 - DNA, 140 bp, Artificial Sequence
  Synthetic
atggccgactcccaagtacgtaatctccttaaggacttcgtggtagtggttgtcaagcacttggaggcggtcaaaggtgactttcttctgccgggcagttgccgagcgagaagtcgtggcggagacccagcatggcgtat

SEQ ID NO: 393517 - DNA, 140 bp, Artificial Sequence
  Synthetic
aggccctggctgctgatatgtgtgggaggacttgcaggaagacactaccacccccattccaaccaccatcatggccaagagtgaagtcttctccgtgaaaccggagaagggtggccggaagaccttttgggacagcggtg

SEQ ID NO: 393518 - DNA, 140 bp, Artificial Sequence
  Synthetic
caccgctgtcccaaaaggtcttccggccacccttctccggtttcacggagaagacttcactcttggccatgatggtggttggaatgggggtggtagtgtcttcctgcaagtcctcccacacatatcagcagccagggcct

SEQ ID NO: 393519 - DNA, 140 bp, Artificial Sequence
  Synthetic
atacgccatgctgggtctccgatgcctacggcttccaatactcaccagcgcagcgggtcgagtatctcctgaaatcctggaaatccaaaaaggttcccatgggattttcgtatgacaccccgtacttgggagtcggccat

SEQ ID NO: 393520 - DNA, 140 bp, Artificial Sequence
  Synthetic
atggccgactcccaagtacggggtgtcatacgaaaatcccatgggaacctttttggatttccaggatttcaggagatactcgacccgctgcgctggtgagtattggaagccgtaggcatcggagacccagcatggcgtat

SEQ ID NO: 393521 - DNA, 140 bp, Artificial Sequence
  Synthetic
atacgccatgctgggtctccgacgtccgttgccatgccagaaaggccgtaaaccacatcaactccgtgtggaaagaccttctggaagacagtgtaacaccaatagacactaccatcatggcgtacttgggagtcggccat

SEQ ID NO: 393522 - DNA, 140 bp, Artificial Sequence
  Synthetic
atggccgactcccaagtacgccatgatggtagtgtctattggtgttacactgtcttccagaaggtctttccacacggagttgatgtggtttacggcctttctggcatggcaacggacgtcggagacccagcatggcgtat

SEQ ID NO: 393523 - DNA, 140 bp, Artificial Sequence
  Synthetic
atacgccatgctgggtctccacctctgcgggtatcggaggtgccgcgcaagcggagtgtacaccacaagcttcgggaatacagtgacctgctatcttaaggctgtcgcagccaccagggccgtacttgggagtcggccat

SEQ ID NO: 393524 - DNA, 140 bp, Artificial Sequence
  Synthetic
atggccgactcccaagtacggccctggtggctgcgacagccttaagatagcaggtcactgtattcccgaagcttgtggtgtacactccgcttgcgcggcacctccgatacccgcagaggtggagacccagcatggcgtat

SEQ ID NO: 393525 - DNA, 140 bp, Artificial Sequence
  Synthetic
atacgccatgctgggtctccttcacggaggctatgacgaggtactcggctccccccggagacgccccgcagccagcatatgatctcgagctaataacatcttgctcatccaacgtctcggcgtacttgggagtcggccat

SEQ ID NO: 393526 - DNA, 140 bp, Artificial Sequence
  Synthetic
atggccgactcccaagtacgccgagacgttggatgagcaagatgttattagctcgagatcatatgctggctgcggggcgtctccggggggagccgagtacctcgtcatagcctccgtgaaggagacccagcatggcgtat

SEQ ID NO: 393527 - DNA, 140 bp, Artificial Sequence
  Synthetic
atacgccatgctgggtctcctcgcacacgatgcagccgggaagaaggtttactacctcacccgcgaccctgagacgcccctggcacgagccgcctgggaaacagtgcgacacactccagtcgtacttgggagtcggccat

SEQ ID NO: 393528 - DNA, 140 bp, Artificial Sequence
  Synthetic
atggccgactcccaagtacgactggagtgtgtcgcactgtttcccaggcggctcgtgccaggggcgtctcagggtcgcgggtgaggtagtaaaccttcttcccggctgcatcgtgtgcgaggagacccagcatggcgtat

SEQ ID NO: 393529 - DNA, 140 bp, Artificial Sequence
  Synthetic
atacgccatgctgggtctcccggcgggggggacatttatcacagcgtgtcccgtgctcggccccgctatttactcctgtgcctactcctactgtccgtaggggtaggcatcttcctcctgcgtacttgggagtcggccat

SEQ ID NO: 393530 - DNA, 140 bp, Artificial Sequence
  Synthetic
atggccgactcccaagtacgcaggaggaagatgcctacccctacggacagtaggagtaggcacaggagtaaatagcggggccgagcacgggacacgctgtgataaatgtcccccccgccgggagacccagcatggcgtat

SEQ ID NO: 393531 - DNA, 140 bp, Artificial Sequence
  Synthetic
atacgccatgctgggtctccgagggggaggttcaagtggtctccaccgcaacacaatctttcctggcgacctgtatcaacggcgtgtgttggactgtctatcatggcgccggctcaaagacgtacttgggagtcggccat

SEQ ID NO: 393532 - DNA, 140 bp, Artificial Sequence
  Synthetic
atggccgactcccaagtacgtctttgagccggcgccatgatagacagtccaacacacgccgttgatacaggtcgccaggaaagattgtgttgcggtggagaccacttgaacctccccctcggagacccagcatggcgtat

SEQ ID NO: 393533 - DNA, 140 bp, Artificial Sequence
  Synthetic
aggccctggctgctgatatgacccagctgttgaagaggctccaccagtggattaatgaggactgctccacgccatgttccggctcgtggctgagggatgtttgggactggatatgcacgggaccttttgggacagcggtg

SEQ ID NO: 393534 - DNA, 140 bp, Artificial Sequence
  Synthetic
caccgctgtcccaaaaggtcccgtgcatatccagtcccaaacatccctcagccacgagccggaacatggcgtggagcagtcctcattaatccactggtggagcctcttcaacagctgggtcatatcagcagccagggcct

SEQ ID NO: 393535 - DNA, 140 bp, Artificial Sequence
  Synthetic
atacgccatgctgggtctccttttttttttttttttttttccccccccccccccctttttttttttttttttttcccggggggggggggggcccccccccccccccccgcggggggggggcgtacttgggagtcggccat

SEQ ID NO: 393536 - DNA, 140 bp, Artificial Sequence
  Synthetic
atggccgactcccaagtacgccccccccccgcgggggggggggggggggccccccccccccccgggaaaaaaaaaaaaaaaaaaagggggggggggggggaaaaaaaaaaaaaaaaaaaaggagacccagcatggcgtat

SEQ ID NO: 393537 - DNA, 140 bp, Artificial Sequence
  Synthetic
atacgccatgctgggtctccaacacgtggcatggaacattccccatcaacgcatacaccacgggcccctgcacaccctccccggcgccaaactattccagggcgctgtggcgggtggctgcgtacttgggagtcggccat

SEQ ID NO: 393538 - DNA, 140 bp, Artificial Sequence
  Synthetic
atggccgactcccaagtacgcagccacccgccacagcgccctggaatagtttggcgccggggagggtgtgcaggggcccgtggtgtatgcgttgatggggaatgttccatgccacgtgttggagacccagcatggcgtat

SEQ ID NO: 393539 - DNA, 140 bp, Artificial Sequence
  Synthetic
atacgccatgctgggtctccgtgaaggccgggaacgtctcgcgctgctgggtggccttaacacctactgtagctgcgccctaccatgcggctccacttaggtcgctccggcgacatgtggcgtacttgggagtcggccat

SEQ ID NO: 393540 - DNA, 140 bp, Artificial Sequence
  Synthetic
atggccgactcccaagtacgccacatgtcgccggagcgacctaagtggagccgcatggtagggcgcagctacagtaggtgttaaggccacccagcagcgcgagacgttcccggccttcacggagacccagcatggcgtat

SEQ ID NO: 393541 - DNA, 140 bp, Artificial Sequence
  Synthetic
atacgccatgctgggtctcctcgccactggactgtccaagactgcaactgttccatctatgttggccacatcaccggccacagaatggcgtgggacatgatgatgaattggagccctacccgtacttgggagtcggccat

SEQ ID NO: 393542 - DNA, 140 bp, Artificial Sequence
  Synthetic
atggccgactcccaagtacgggtagggctccaattcatcatcatgtcccacgccattctgtggccggtgatgtggccaacatagatggaacagttgcagtcttggacagtccagtggcgaggagacccagcatggcgtat

SEQ ID NO: 393543 - DNA, 140 bp, Artificial Sequence
  Synthetic
atacgccatgctgggtctccggagtggaggccaatacagttgtcaccggtgggtccgctgcgcggagcgtagctagccttaccagccttttcacccccgggtctatgcagaatatcatgccgtacttgggagtcggccat

SEQ ID NO: 393544 - DNA, 140 bp, Artificial Sequence
  Synthetic
atggccgactcccaagtacggcatgatattctgcatagacccgggggtgaaaaggctggtaaggctagctacgctccgcgcagcggacccaccggtgacaactgtattggcctccactccggagacccagcatggcgtat

SEQ ID NO: 393545 - DNA, 140 bp, Artificial Sequence
  Synthetic
aggccctggctgctgatatgatggcatgggatatgatgatgaactggtcccctacgacggcgttggtagtggctcagctgctccggatcccacaagccatcttggacatgatcgctggtggaccttttgggacagcggtg

SEQ ID NO: 393546 - DNA, 140 bp, Artificial Sequence
  Synthetic
caccgctgtcccaaaaggtccaccagcgatcatgtccaagatggcttgtgggatccggagcagctgagccactaccaacgccgtcgtaggggaccagttcatcatcatatcccatgccatcatatcagcagccagggcct

SEQ ID NO: 393547 - DNA, 140 bp, Artificial Sequence
  Synthetic
atacgccatgctgggtctccgttcaattcttccgggtgtccagagaggcttgccgcgtgcaagggtctagaagccttcgcacagggctggggcgagcttggggtcgctaacgtcagtggacgtacttgggagtcggccat

SEQ ID NO: 393548 - DNA, 140 bp, Artificial Sequence
  Synthetic
atggccgactcccaagtacgtccactgacgttagcgaccccaagctcgccccagccctgtgcgaaggcttctagacccttgcacgcggcaagcctctctggacacccggaagaattgaacggagacccagcatggcgtat

SEQ ID NO: 393549 - DNA, 140 bp, Artificial Sequence
  Synthetic
atacgccatgctgggtctccgtcccgtggtcgtcggcacgaccgaccggcttggagcccctacctattcctggggggacaacgagaccgatgtgctcattctaaactccaccagaccccccgtacttgggagtcggccat

SEQ ID NO: 393550 - DNA, 140 bp, Artificial Sequence
  Synthetic
atggccgactcccaagtacggggggtctggtggagtttagaatgagcacatcggtctcgttgtccccccaggaataggtaggggctccaagccggtcggtcgtgccgacgaccacgggacggagacccagcatggcgtat

SEQ ID NO: 393551 - DNA, 140 bp, Artificial Sequence
  Synthetic
atacgccatgctgggtctccaactgccccaccgactgcttcaggaaacacccggggacgacctactctaggtgtggctcgggcccttggctcacgccaaggtgcatggtccactacccttcgtacttgggagtcggccat

SEQ ID NO: 393552 - DNA, 140 bp, Artificial Sequence
  Synthetic
atggccgactcccaagtacgaagggtagtggaccatgcaccttggcgtgagccaagggcccgagccacacctagagtaggtcgtccccgggtgtttcctgaagcagtcggtggggcagttggagacccagcatggcgtat

SEQ ID NO: 393553 - DNA, 140 bp, Artificial Sequence
  Synthetic
atacgccatgctgggtctccgactaggggggaaccgtgcggcttggagcacagggatcgcaccgagctgtcgccgctgctgctttccaccacacagtggcagattctcccctgctctttccgtacttgggagtcggccat

SEQ ID NO: 393554 - DNA, 140 bp, Artificial Sequence
  Synthetic
atggccgactcccaagtacggaaagagcaggggagaatctgccactgtgtggtggaaagcagcagcggcgacagctcggtgcgatccctgtgctccaagccgcacggttcccccctagtcggagacccagcatggcgtat

SEQ ID NO: 393555 - DNA, 140 bp, Artificial Sequence
  Synthetic
atacgccatgctgggtctcccgtggacgttcagtacatttacggcgttgggtccgccgttgtatcatgggcactcaagtgggaatacgtagtgcttgccttcctgctactcgcagatgctcgtacttgggagtcggccat

SEQ ID NO: 393556 - DNA, 140 bp, Artificial Sequence
  Synthetic
atggccgactcccaagtacgagcatctgcgagtagcaggaaggcaagcactacgtattcccacttgagtgcccatgatacaacggcggacccaacgccgtaaatgtactgaacgtccacgggagacccagcatggcgtat

SEQ ID NO: 393557 - DNA, 140 bp, Artificial Sequence
  Synthetic
aggccctggctgctgatatgacggcttctcctgggccatgattttcatctgtgtggcttggtatgttaagggcaggcttccagcagccgctgtgtatgcagcttgtgggatgtggcccctgaccttttgggacagcggtg

SEQ ID NO: 393558 - DNA, 140 bp, Artificial Sequence
  Synthetic
caccgctgtcccaaaaggtcaggggccacatcccacaagctgcatacacagcggctgctggaagcctgcccttaacataccaagccacacagatgaaaatcatggcccaggagaagccgtcatatcagcagccagggcct

SEQ ID NO: 393559 - DNA, 140 bp, Artificial Sequence
  Synthetic
atacgccatgctgggtctccacattgtctccttggtacaaacgctggctggcgcgaatactgtggtggttgcagtactttatagctagggccgaggccatgctacatgtatacgttccaccgtacttgggagtcggccat

SEQ ID NO: 393560 - DNA, 140 bp, Artificial Sequence
  Synthetic
atggccgactcccaagtacggtggaacgtatacatgtagcatggcctcggccctagctataaagtactgcaaccaccacagtattcgcgccagccagcgtttgtaccaaggagacaatgtggagacccagcatggcgtat

SEQ ID NO: 393561 - DNA, 140 bp, Artificial Sequence
  Synthetic
atacgccatgctgggtctccaggcccactctatctgctccaaagctcacttttgcgcgtcccttactatgtgagggcccacgccttaattaagatctgtggttttgcgcgcaacgtagcacgtacttgggagtcggccat

SEQ ID NO: 393562 - DNA, 140 bp, Artificial Sequence
  Synthetic
atggccgactcccaagtacgtgctacgttgcgcgcaaaaccacagatcttaattaaggcgtgggccctcacatagtaagggacgcgcaaaagtgagctttggagcagatagagtgggcctggagacccagcatggcgtat

SEQ ID NO: 393563 - DNA, 140 bp, Artificial Sequence
  Synthetic
aggccctggctgctgatatgtgagggcccacgccttaattaagatctgtggttttgcgcgcaacgtagcatatggcaaatacatccaactcgccttgctcaagattggagcgtggaccgggaccttttgggacagcggtg

SEQ ID NO: 393564 - DNA, 140 bp, Artificial Sequence
  Synthetic
caccgctgtcccaaaaggtcccggtccacgctccaatcttgagcaaggcgagttggatgtatttgccatatgctacgttgcgcgcaaaaccacagatcttaattaaggcgtgggccctcacatatcagcagccagggcct

SEQ ID NO: 393565 - DNA, 140 bp, Artificial Sequence
  Synthetic
atacgccatgctgggtctccgcccggctgacgatgaagtgcgggggggctggaggctccttgcccccattacagcgtacgcacagcagacgcgaggcctattaggcaccatcgtgaccagcgtacttgggagtcggccat

SEQ ID NO: 393566 - DNA, 140 bp, Artificial Sequence
  Synthetic
atggccgactcccaagtacgctggtcacgatggtgcctaataggcctcgcgtctgctgtgcgtacgctgtaatgggggcaaggagcctccagcccccccgcacttcatcgtcagccgggcggagacccagcatggcgtat

SEQ ID NO: 393567 - DNA, 140 bp, Artificial Sequence
  Synthetic
aggccctggctgctgatatgaccgtataccacggggccggcagcaagaccatctgcggcccaaagggcccgatctgccaaatgtacaccaacgttgaccaagacctagtgggctggccaggaccttttgggacagcggtg

SEQ ID NO: 393568 - DNA, 140 bp, Artificial Sequence
  Synthetic
caccgctgtcccaaaaggtcctggccagcccactaggtcttggtcaacgttggtgtacatttggcagatcgggccctttgggccgcagatggtcttgctgccggccccgtggtatacggtcatatcagcagccagggcct

SEQ ID NO: 393569 - DNA, 140 bp, Artificial Sequence
  Synthetic
atacgccatgctgggtctccagacactcgtggagcgctccttagccccaggccaatcgccacgctcaagggatcctctggcggtccgttgctatgcgcaaaagggcatgccgtaggcatacgtacttgggagtcggccat

SEQ ID NO: 393570 - DNA, 140 bp, Artificial Sequence
  Synthetic
atggccgactcccaagtacgtatgcctacggcatgcccttttgcgcatagcaacggaccgccagaggatcccttgagcgtggcgattggcctggggctaaggagcgctccacgagtgtctggagacccagcatggcgtat

SEQ ID NO: 393571 - DNA, 140 bp, Artificial Sequence
  Synthetic
atacgccatgctgggtctccactcaacacccccggctgtgccccaaacataccaggttgcccatctgcacgcaccgacgggaagtggcaagagcaccagagttccagcggcatacgccgccgtacttgggagtcggccat

SEQ ID NO: 393572 - DNA, 140 bp, Artificial Sequence
  Synthetic
atggccgactcccaagtacggcggcgtatgccgctggaactctggtgctcttgccacttcccgtcggtgcgtgcagatgggcaacctggtatgtttggggcacagccgggggtgttgagtggagacccagcatggcgtat

SEQ ID NO: 393573 - DNA, 140 bp, Artificial Sequence
  Synthetic
aggccctggctgctgatatgtccttcctcgtgttcttctgctttgcgtggtatctgaagggtaggtgggtgcccggagcggtctacgccctctacgggatgtggcctctcctcctgctccgaccttttgggacagcggtg

SEQ ID NO: 393574 - DNA, 140 bp, Artificial Sequence
  Synthetic
caccgctgtcccaaaaggtcggagcaggaggagaggccacatcccgtagagggcgtagaccgctccgggcacccacctacccttcagataccacgcaaagcagaagaacacgaggaaggacatatcagcagccagggcct

SEQ ID NO: 393575 - DNA, 140 bp, Artificial Sequence
  Synthetic
aggccctggctgctgatatgtcatttgtgacgagtgccactccactgattcaacaacgatccttggcataggcacggtcttagaccaagctgagacggctggcgcacgcctcgtcgtactgaccttttgggacagcggtg

SEQ ID NO: 393576 - DNA, 140 bp, Artificial Sequence
  Synthetic
caccgctgtcccaaaaggtcagtacgacgaggcgtgcgccagccgtctcagcttggtctaagaccgtgcctatgccaaggatcgttgttgaatcagtggagtggcactcgtcacaaatgacatatcagcagccagggcct

SEQ ID NO: 393577 - DNA, 140 bp, Artificial Sequence
  Synthetic
atacgccatgctgggtctccattcctctagagctcatcaaggggggtaggcacctcattttctgccattccaggaaaaagtgtgatgaactggccaagcagctgtcatcccttggcctcacgtacttgggagtcggccat

SEQ ID NO: 393578 - DNA, 140 bp, Artificial Sequence
  Synthetic
atggccgactcccaagtacgtgaggccaagggatgacagctgcttggccagttcatcacactttttcctggaatggcagaaaatgaggtgcctaccccccttgatgagctctagaggaatggagacccagcatggcgtat

SEQ ID NO: 393579 - DNA, 140 bp, Artificial Sequence
  Synthetic
atacgccatgctgggtctcctctcagaatatccagcttataaacaccaacggcagctggcacattaacaggactgccctgaactgcaatgactccctccaaaccgggttcattgccgcaccgtacttgggagtcggccat

SEQ ID NO: 393580 - DNA, 140 bp, Artificial Sequence
  Synthetic
atggccgactcccaagtacggtgcggcaatgaacccggtttggagggagtcattgcagttcagggcagtcctgttaatgtgccagctgccgttggtgtttataagctggatattctgagaggagacccagcatggcgtat

SEQ ID NO: 393581 - DNA, 140 bp, Artificial Sequence
  Synthetic
atacgccatgctgggtctcccgactttgactccgtaatagactgtaacacgtctgtcatacagactgtggacttcagcttggaccctacattttcaatagagaccactactgtgccccagcgtacttgggagtcggccat

SEQ ID NO: 393582 - DNA, 140 bp, Artificial Sequence
  Synthetic
atggccgactcccaagtacgctggggcacagtagtggtctctattgaaaatgtagggtccaagctgaagtccacagtctgtatgacagacgtgttacagtctattacggagtcaaagtcgggagacccagcatggcgtat

SEQ ID NO: 393583 - DNA, 140 bp, Artificial Sequence
  Synthetic
atacgccatgctgggtctccacacctcggtgctctgtgagtgctatgacgctggctgtgcttggtacgaactgactccggcggagacaaccaccagactgagggcgtatttcaatacacccgtacttgggagtcggccat

SEQ ID NO: 393584 - DNA, 140 bp, Artificial Sequence
  Synthetic
atggccgactcccaagtacgggtgtattgaaatacgccctcagtctggtggttgtctccgccggagtcagttcgtaccaagcacagccagcgtcatagcactcacagagcaccgaggtgtggagacccagcatggcgtat

SEQ ID NO: 393585 - DNA, 140 bp, Artificial Sequence
  Synthetic
aggccctggctgctgatatgctgactccggcggagacaaccaccagactgagggcgtatttcaatacaccagggctccccgtttgccaagaccatcttgagttctgggaaagcgtctttagaccttttgggacagcggtg

SEQ ID NO: 393586 - DNA, 140 bp, Artificial Sequence
  Synthetic
caccgctgtcccaaaaggtctaaagacgctttcccagaactcaagatggtcttggcaaacggggagccctggtgtattgaaatacgccctcagtctggtggttgtctccgccggagtcagcatatcagcagccagggcct

SEQ ID NO: 393587 - DNA, 140 bp, Artificial Sequence
  Synthetic
atacgccatgctgggtctccgtggtaataacagggagagtcctcctatcagggcagcccgccgtcattcccgaccgggaggtgctctatcaacagtttgatgagatggaggaatgttccacgtacttgggagtcggccat

SEQ ID NO: 393588 - DNA, 140 bp, Artificial Sequence
  Synthetic
atggccgactcccaagtacgtggaacattcctccatctcatcaaactgttgatagagcacctcccggtcgggaatgacggcgggctgccctgataggaggactctccctgttattaccacggagacccagcatggcgtat

SEQ ID NO: 393589 - DNA, 140 bp, Artificial Sequence
  Synthetic
aggccctggctgctgatatgatctccaccagaacatcgtggacgtgcaatacctgtacggtgtagggtcagcggttgtctccttcgcaatcaaatgggagtatgtcctgttgcttttcctgaccttttgggacagcggtg

SEQ ID NO: 393590 - DNA, 140 bp, Artificial Sequence
  Synthetic
caccgctgtcccaaaaggtcaggaaaagcaacaggacatactcccatttgattgcgaaggagacaaccgctgaccctacaccgtacaggtattgcacgtccacgatgttctggtggagatcatatcagcagccagggcct

SEQ ID NO: 393591 - DNA, 140 bp, Artificial Sequence
  Synthetic
atacgccatgctgggtctccagcaccggtggttcagtccaactttgccagattagaacaattctgggcaaaacatatgtggaacttcatcagtggcattcaatatttggccgggttatcccgtacttgggagtcggccat

SEQ ID NO: 393592 - DNA, 140 bp, Artificial Sequence
  Synthetic
atggccgactcccaagtacgggataacccggccaaatattgaatgccactgatgaagttccacatatgttttgcccagaattgttctaatctggcaaagttggactgaaccaccggtgctggagacccagcatggcgtat

SEQ ID NO: 393593 - DNA, 140 bp, Artificial Sequence
  Synthetic
atacgccatgctgggtctccgagggtgggttgcttcccaaattgcgacccctacggcctctacggctttcgtcgtgagcggccttgccggtgccgcgattggcagcgtggggttgggaaacgtacttgggagtcggccat

SEQ ID NO: 393594 - DNA, 140 bp, Artificial Sequence
  Synthetic
atggccgactcccaagtacgtttcccaaccccacgctgccaatcgcggcaccggcaaggccgctcacgacgaaagccgtagaggccgtaggggtcgcaatttgggaagcaacccaccctcggagacccagcatggcgtat

SEQ ID NO: 393595 - DNA, 140 bp, Artificial Sequence
  Synthetic
aggccctggctgctgatatggtcgtgagcggccttgccggtgccgcgattggcagcgtggggttgggaaaaattctcgtagacattcttgctggttacggtgccggtgtggccggcgccggaccttttgggacagcggtg

SEQ ID NO: 393596 - DNA, 140 bp, Artificial Sequence
  Synthetic
caccgctgtcccaaaaggtccggcgccggccacaccggcaccgtaaccagcaagaatgtctacgagaatttttcccaaccccacgctgccaatcgcggcaccggcaaggccgctcacgaccatatcagcagccagggcct

SEQ ID NO: 393597 - DNA, 140 bp, Artificial Sequence
  Synthetic
aggccctggctgctgatatgtctcctcacgtgtgcggtccatccagagctaatctttgacatcaccaaaattgtgctcgccatactcggtccgctcatggtgctccaggctggtatagcagaccttttgggacagcggtg

SEQ ID NO: 393598 - DNA, 140 bp, Artificial Sequence
  Synthetic
caccgctgtcccaaaaggtctgctataccagcctggagcaccatgagcggaccgagtatggcgagcacaattttggtgatgtcaaagattagctctggatggaccgcacacgtgaggagacatatcagcagccagggcct

SEQ ID NO: 393599 - DNA, 140 bp, Artificial Sequence
  Synthetic
atacgccatgctgggtctcctcccccacgcactacgtcccggagaccgacgccgcggcccgcgtgaccgccatactctcatccctaactgtgacttccctccttaggaggctccacaaatcgtacttgggagtcggccat

SEQ ID NO: 393600 - DNA, 140 bp, Artificial Sequence
  Synthetic
atggccgactcccaagtacgatttgtggagcctcctaaggagggaagtcacagttagggatgagagtatggcggtcacgcgggccgcggcgtcggtctccgggacgtagtgcgtgggggaggagacccagcatggcgtat

SEQ ID NO: 393601 - DNA, 140 bp, Artificial Sequence
  Synthetic
atacgccatgctgggtctcctggccgaattgaaaggtacgtccgtctatgaccacctcactccactgcgggactgggcccacacaggcctacgagacctggcggtagcggtcgagcccgtcgtacttgggagtcggccat

SEQ ID NO: 393602 - DNA, 140 bp, Artificial Sequence
  Synthetic
atggccgactcccaagtacgacgggctcgaccgctaccgccaggtctcgtaggcctgtgtgggcccagtcccgcagtggagtgaggtggtcatagacggacgtacctttcaattcggccaggagacccagcatggcgtat

SEQ ID NO: 393603 - DNA, 140 bp, Artificial Sequence
  Synthetic
aggccctggctgctgatatgtactccggctcccacaagctgtcgtggatatgatagcgggggcccactggggagtcctggcgggccttgcatattattccatggtggggaactgggctaagaccttttgggacagcggtg

SEQ ID NO: 393604 - DNA, 140 bp, Artificial Sequence
  Synthetic
caccgctgtcccaaaaggtcttagcccagttccccaccatggaataatatgcaaggcccgccaggactccccagtgggcccccgctatcatatccacgacagcttgtgggagccggagtacatatcagcagccagggcct

SEQ ID NO: 393605 - DNA, 140 bp, Artificial Sequence
  Synthetic
atacgccatgctgggtctccagctaagctgctacctcgcttgcctggcatccccttcctttcctgccagaaagggtttaggggggaatggcggggagacggggtcatgcacacaacatgccgtacttgggagtcggccat

SEQ ID NO: 393606 - DNA, 140 bp, Artificial Sequence
  Synthetic
atggccgactcccaagtacggcatgttgtgtgcatgaccccgtctccccgccattcccccctaaaccctttctggcaggaaaggaaggggatgccaggcaagcgaggtagcagcttagctggagacccagcatggcgtat

SEQ ID NO: 393607 - DNA, 140 bp, Artificial Sequence
  Synthetic
atacgccatgctgggtctccagggagatactcctaggaccagccgacagtcttgaggggcaggggtggcgactcctcgcgcccatcacggcctactcccaacagacgcggggcctgtttgcgtacttgggagtcggccat

SEQ ID NO: 393608 - DNA, 140 bp, Artificial Sequence
  Synthetic
atggccgactcccaagtacgcaaacaggccccgcgtctgttgggagtaggccgtgatgggcgcgaggagtcgccacccctgcccctcaagactgtcggctggtcctaggagtatctccctggagacccagcatggcgtat

SEQ ID NO: 393609 - DNA, 140 bp, Artificial Sequence
  Synthetic
atacgccatgctgggtctccatgcttacaccagtggacctagcgtacccgtcccggcgccgaactataagttcgcgctatggcgggtgtctgccgaggactacgtggaagttcgcagggtcgtacttgggagtcggccat

SEQ ID NO: 393610 - DNA, 140 bp, Artificial Sequence
  Synthetic
atggccgactcccaagtacgaccctgcgaacttccacgtagtcctcggcagacacccgccatagcgcgaacttatagttcggcgccgggacgggtacgctaggtccactggtgtaagcatggagacccagcatggcgtat

SEQ ID NO: 393611 - DNA, 140 bp, Artificial Sequence
  Synthetic
aggccctggctgctgatatgttcgcgctatggcgggtgtctgccgaggactacgtggaagttcgcagggtgggagacagccactatgtagtgggggtcacacaagacaacatcaagtgtcgaccttttgggacagcggtg

SEQ ID NO: 393612 - DNA, 140 bp, Artificial Sequence
  Synthetic
caccgctgtcccaaaaggtcgacacttgatgttgtcttgtgtgacccccactacatagtggctgtctcccaccctgcgaacttccacgtagtcctcggcagacacccgccatagcgcgaacatatcagcagccagggcct

SEQ ID NO: 393613 - DNA, 140 bp, Artificial Sequence
  Synthetic
aggccctggctgctgatatgggcactacgcacctcgaccgtgtggtactgtacccgcgtcgcaggtgtgtggtccggtgtattgcttcaccccaagccctgttgtggtggggacgaccgagaccttttgggacagcggtg

SEQ ID NO: 393614 - DNA, 140 bp, Artificial Sequence
  Synthetic
caccgctgtcccaaaaggtctcggtcgtccccaccacaacagggcttggggtgaagcaatacaccggaccacacacctgcgacgcgggtacagtaccacacggtcgaggtgcgtagtgcccatatcagcagccagggcct

SEQ ID NO: 393615 - DNA, 140 bp, Artificial Sequence
  Synthetic
aggccctggctgctgatatgggtccggtgtattgcttcaccccaagccctgttgtggtggggacgaccgatcgtttcggcgcccctacgtacaactggggggagaatgagacggacgtgcgaccttttgggacagcggtg

SEQ ID NO: 393616 - DNA, 140 bp, Artificial Sequence
  Synthetic
caccgctgtcccaaaaggtcgcacgtccgtctcattctccccccagttgtacgtaggggcgccgaaacgatcggtcgtccccaccacaacagggcttggggtgaagcaatacaccggacccatatcagcagccagggcct

SEQ ID NO: 393617 - DNA, 140 bp, Artificial Sequence
  Synthetic
aggccctggctgctgatatgctacatgtacaacccatcatgagtcccccgacgctgacctcatcgaggcgaatcttctgtggagacaggagatggggagtaacatcaccagagttgagtcgaccttttgggacagcggtg

SEQ ID NO: 393618 - DNA, 140 bp, Artificial Sequence
  Synthetic
caccgctgtcccaaaaggtcgactcaactctggtgatgttactccccatctcctgtctccacagaagattcgcctcgatgaggtcagcgtcgggggactcatgatgggttgtacatgtagcatatcagcagccagggcct

SEQ ID NO: 393619 - DNA, 140 bp, Artificial Sequence
  Synthetic
atacgccatgctgggtctcccggttccctaaacctctgccggtatgggcccgcccggactacaacccaccgttgttagagacgtggaagaaaccggaatacgatcctccggccgtacacgcgtacttgggagtcggccat

SEQ ID NO: 393620 - DNA, 140 bp, Artificial Sequence
  Synthetic
atggccgactcccaagtacgcgtgtacggccggaggatcgtattccggtttcttccacgtctctaacaacggtgggttgtagtccgggcgggcccataccggcagaggtttagggaaccgggagacccagcatggcgtat

SEQ ID NO: 393621 - DNA, 140 bp, Artificial Sequence
  Synthetic
atacgccatgctgggtctccgttggccgcacggtccttcggtaccactgaaccgagtgctgactccggggtggaccagggaccccccactgaaacttctgaacccgacccccccaacgcgcgtacttgggagtcggccat

SEQ ID NO: 393622 - DNA, 140 bp, Artificial Sequence
  Synthetic
atggccgactcccaagtacgcgcgttgggggggtcgggttcagaagtttcagtggggggtccctggtccaccccggagtcagcactcggttcagtggtaccgaaggaccgtgcggccaacggagacccagcatggcgtat

SEQ ID NO: 393623 - DNA, 140 bp, Artificial Sequence
  Synthetic
atacgccatgctgggtctccgctcagaggatgtggtctgctgctcgatgtcatactcatggacaggggcattagttacaccatgcgcagctgaggagaccaagctgccaatcagccccttcgtacttgggagtcggccat

SEQ ID NO: 393624 - DNA, 140 bp, Artificial Sequence
  Synthetic
atggccgactcccaagtacgaaggggctgattggcagcttggtctcctcagctgcgcatggtgtaactaatgcccctgtccatgagtatgacatcgagcagcagaccacatcctctgagcggagacccagcatggcgtat

SEQ ID NO: 393625 - DNA, 140 bp, Artificial Sequence
  Synthetic
aggccctggctgctgatatgcatatgccctctacggcgtatggccgctgctcctgctcctgttggcgttaccaccacgagcatacgccatggaccgggagatggccgcatcgtgcggagggaccttttgggacagcggtg

SEQ ID NO: 393626 - DNA, 140 bp, Artificial Sequence
  Synthetic
caccgctgtcccaaaaggtccctccgcacgatgcggccatctcccggtccatggcgtatgctcgtggtggtaacgccaacaggagcaggagcagcggccatacgccgtagagggcatatgcatatcagcagccagggcct

SEQ ID NO: 393627 - DNA, 140 bp, Artificial Sequence
  Synthetic
aggccctggctgctgatatgccaccacgagcatacgccatggaccgggagatggccgcatcgtgcggaggcgcagttttcgtaggtctggcgctcctgaccttgtcaccacactacaaaagaccttttgggacagcggtg

SEQ ID NO: 393628 - DNA, 140 bp, Artificial Sequence
  Synthetic
caccgctgtcccaaaaggtcttttgtagtgtggtgacaaggtcaggagcgccagacctacgaaaactgcgcctccgcacgatgcggccatctcccggtccatggcgtatgctcgtggtggcatatcagcagccagggcct

SEQ ID NO: 393629 - DNA, 140 bp, Artificial Sequence
  Synthetic
atacgccatgctgggtctccgctcagcaactgcccggcagaaaaaagtcacctttgaccgcctccaagtggttgacgatcactaccacgacgtcctaaaggagattaaggcgcgagcgaccgtacttgggagtcggccat

SEQ ID NO: 393630 - DNA, 140 bp, Artificial Sequence
  Synthetic
atggccgactcccaagtacggtcgctcgcgccttaatctcctttaggacgtcgtggtagtgatcgtcaaccacttggaggcggtcaaaggtgacttttttctgccgggcagttgctgagcggagacccagcatggcgtat

SEQ ID NO: 393631 - DNA, 140 bp, Artificial Sequence
  Synthetic
atacgccatgctgggtctcctcgaaggtgccgcgcaagcggtgtatacaccacaagcttcgggaacacagtgacctgctatcttaaggccgtcgcagccaccagggctgcaggcctaaaacgtacttgggagtcggccat

SEQ ID NO: 393632 - DNA, 140 bp, Artificial Sequence
  Synthetic
atggccgactcccaagtacgttttaggcctgcagccctggtggctgcgacggccttaagatagcaggtcactgtgttcccgaagcttgtggtgtatacaccgcttgcgcggcaccttcgaggagacccagcatggcgtat

SEQ ID NO: 393633 - DNA, 140 bp, Artificial Sequence
  Synthetic
atacgccatgctgggtctccgggtccccccattgagagcgtggagacaccgagccagagctgttcgcgccaagctaatcgcccagggggggagggccaaaatctgtggcatatacctcttcgtacttgggagtcggccat

SEQ ID NO: 393634 - DNA, 140 bp, Artificial Sequence
  Synthetic
atggccgactcccaagtacgaagaggtatatgccacagattttggccctccccccctgggcgattagcttggcgcgaacagctctggctcggtgtctccacgctctcaatggggggacccggagacccagcatggcgtat

SEQ ID NO: 393635 - DNA, 140 bp, Artificial Sequence
  Synthetic
atacgccatgctgggtctccttttttttttccccccccccccttttttttttttttttttccccccagggggggcccccccccccccaaagcccccacacttggaaaacaaaaagtttttcgtacttgggagtcggccat

SEQ ID NO: 393636 - DNA, 140 bp, Artificial Sequence
  Synthetic
atggccgactcccaagtacgaaaaactttttgttttccaagtgtgggggctttgggggggggggggccccccctggggggaaaaaaaaaaaaaaaaaaggggggggggggaaaaaaaaaaggagacccagcatggcgtat

SEQ ID NO: 393637 - DNA, 140 bp, Artificial Sequence
  Synthetic
aggccctggctgctgatatggcggccccgttgggggcgtctcaagggctctcgcacacggtgtgaaggttcttgaagacgggataaactatgcaacagggaatctacccggttgccctttgaccttttgggacagcggtg

SEQ ID NO: 393638 - DNA, 140 bp, Artificial Sequence
  Synthetic
caccgctgtcccaaaaggtcaaagggcaaccgggtagattccctgttgcatagtttatcccgtcttcaagaaccttcacaccgtgtgcgagagcccttgagacgcccccaacggggccgccatatcagcagccagggcct

SEQ ID NO: 393639 - DNA, 140 bp, Artificial Sequence
  Synthetic
aggccctggctgctgatatgtgacctcatcgaggccaacctcctgtggcggcaggagatgggcgggaacatcactcgcgtggagtcagagaacaaggtaattatcctggactctttcgacgaccttttgggacagcggtg

SEQ ID NO: 393640 - DNA, 140 bp, Artificial Sequence
  Synthetic
caccgctgtcccaaaaggtcgtcgaaagagtccaggataattaccttgttctctgactccacgcgagtgatgttcccgcccatctcctgccgccacaggaggttggcctcgatgaggtcacatatcagcagccagggcct

SEQ ID NO: 393641 - DNA, 140 bp, Artificial Sequence
  Synthetic
atacgccatgctgggtctcccccaactcttccatagtctacgaggccgacaacctgatcttacacgcacctggttgtgtgccctgtgtcctggaagataatgtcagtaggtgctgggtcccgtacttgggagtcggccat

SEQ ID NO: 393642 - DNA, 140 bp, Artificial Sequence
  Synthetic
atggccgactcccaagtacgggacccagcacctactgacattatcttccaggacacagggcacacaaccaggtgcgtgtaagatcaggttgtcggcctcgtagactatggaagagttgggggagacccagcatggcgtat

SEQ ID NO: 393643 - DNA, 140 bp, Artificial Sequence
  Synthetic
aggccctggctgctgatatggagttcgatgagatggaagagtgcgcctcacaccttccttacatcgaacaggggatgcagctcgccgagcagttcaagcagaaagcgctcgggttgctgcgaccttttgggacagcggtg

SEQ ID NO: 393644 - DNA, 140 bp, Artificial Sequence
  Synthetic
caccgctgtcccaaaaggtcgcagcaacccgagcgctttctgcttgaactgctcggcgagctgcatcccctgttcgatgtaaggaaggtgtgaggcgcactcttccatctcatcgaactccatatcagcagccagggcct

SEQ ID NO: 393645 - DNA, 140 bp, Artificial Sequence
  Synthetic
atacgccatgctgggtctccgttatacgtcggagacgcgtgtggggcattatccttggtaggccaaatgttcacctataagcctcgccagcatactacggtgcaggactgcaactgttcccgtacttgggagtcggccat

SEQ ID NO: 393646 - DNA, 140 bp, Artificial Sequence
  Synthetic
atggccgactcccaagtacgggaacagttgcagtcctgcaccgtagtatgctggcgaggcttataggtgaacatttggcctaccaaggataatgccccacacgcgtctccgacgtataacggagacccagcatggcgtat

SEQ ID NO: 393647 - DNA, 140 bp, Artificial Sequence
  Synthetic
atacgccatgctgggtctcccccaggtggtcattgacatcattgccgggggccactggggggtcctgctcgccgccgcatactttgcgtcaacggctaactgggccaaggttatactggtcgtacttgggagtcggccat

SEQ ID NO: 393648 - DNA, 140 bp, Artificial Sequence
  Synthetic
atggccgactcccaagtacgaccagtataaccttggcccagttagccgttgacgcaaagtatgcggcggcgagcaggaccccccagtggcccccggcaatgatgtcaatgaccacctgggggagacccagcatggcgtat

SEQ ID NO: 393649 - DNA, 140 bp, Artificial Sequence
  Synthetic
atacgccatgctgggtctcccagcggcagttgcagttcgtaaataccaacgggagctggcatatcaatagtactgcccttaactgtaatgacagcctccagaccgggtttatagccggcccgtacttgggagtcggccat

SEQ ID NO: 393650 - DNA, 140 bp, Artificial Sequence
  Synthetic
atggccgactcccaagtacgggccggctataaacccggtctggaggctgtcattacagttaagggcagtactattgatatgccagctcccgttggtatttacgaactgcaactgccgctgggagacccagcatggcgtat

SEQ ID NO: 393651 - DNA, 140 bp, Artificial Sequence
  Synthetic
atacgccatgctgggtctcctgccaccatatcgggccccagtgatgacaagccgtattgctggcactatcccccacgaccgtgcggggtggtgccagcccgggatgtctgcggtccagtccgtacttgggagtcggccat

SEQ ID NO: 393652 - DNA, 140 bp, Artificial Sequence
  Synthetic
atggccgactcccaagtacggactggaccgcagacatcccgggctggcaccaccccgcacggtcgtgggggatagtgccagcaatacggcttgtcatcactggggcccgatatggtggcaggagacccagcatggcgtat

SEQ ID NO: 393653 - DNA, 140 bp, Artificial Sequence
  Synthetic
atacgccatgctgggtctcctactgtttcacacctagcccagtggtcgttggcactactgaccgcagagggtgtcccacttataactggggcagcaacgagactgacatccttctcttgacgtacttgggagtcggccat

SEQ ID NO: 393654 - DNA, 140 bp, Artificial Sequence
  Synthetic
atggccgactcccaagtacgtcaagagaaggatgtcagtctcgttgctgccccagttataagtgggacaccctctgcggtcagtagtgccaacgaccactgggctaggtgtgaaacagtaggagacccagcatggcgtat

SEQ ID NO: 393655 - DNA, 140 bp, Artificial Sequence
  Synthetic
atacgccatgctgggtctccaacaggcaacaacagccttaagtgtcctactgattgcttccgcaagcacccagacgccacctacaccagatgtgggtcaggaccctggctcaccccccggcgtacttgggagtcggccat

SEQ ID NO: 393656 - DNA, 140 bp, Artificial Sequence
  Synthetic
atggccgactcccaagtacgccggggggtgagccagggtcctgacccacatctggtgtaggtggcgtctgggtgcttgcggaagcaatcagtaggacacttaaggctgttgttgcctgttggagacccagcatggcgtat

SEQ ID NO: 393657 - DNA, 140 bp, Artificial Sequence
  Synthetic
aggccctggctgctgatatgcagacgccacctacaccagatgtgggtcaggaccctggctcaccccccggtgtttggtgcactacccttaccggttgtggcattacccgtgcaccgtaaagaccttttgggacagcggtg

SEQ ID NO: 393658 - DNA, 140 bp, Artificial Sequence
  Synthetic
caccgctgtcccaaaaggtctttacggtgcacgggtaatgccacaaccggtaagggtagtgcaccaaacaccggggggtgagccagggtcctgacccacatctggtgtaggtggcgtctgcatatcagcagccagggcct

SEQ ID NO: 393659 - DNA, 140 bp, Artificial Sequence
  Synthetic
atacgccatgctgggtctccagagatagggccgagttgagcccgctcctgcacaccaccacacagtgggccatattgccgtgctccttcacacctacgcccgctcttagcactggtcttacgtacttgggagtcggccat

SEQ ID NO: 393660 - DNA, 140 bp, Artificial Sequence
  Synthetic
atggccgactcccaagtacgtaagaccagtgctaagagcgggcgtaggtgtgaaggagcacggcaatatggcccactgtgtggtggtgtgcaggagcgggctcaactcggccctatctctggagacccagcatggcgtat

SEQ ID NO: 393661 - DNA, 140 bp, Artificial Sequence
  Synthetic
atacgccatgctgggtctcctttactacttgctgatgcccgtatctgcacttgcctgttgatcttgctcctaatctgtcaggcagaagcaacctgcaagaacgtcattgtcctaaacgcgcgtacttgggagtcggccat

SEQ ID NO: 393662 - DNA, 140 bp, Artificial Sequence
  Synthetic
atggccgactcccaagtacgcgcgtttaggacaatgacgttcttgcaggttgcttctgcctgacagattaggagcaagatcaacaggcaagtgcagatacgggcatcagcaagtagtaaaggagacccagcatggcgtat

SEQ ID NO: 393663 - DNA, 140 bp, Artificial Sequence
  Synthetic
atacgccatgctgggtctccgcttgggcgtttggccactactcttagtccgtctcctccggccccacagggccctggccctggactcaagcgatggcgggactgtgggttgtcttgtgctcgtacttgggagtcggccat

SEQ ID NO: 393664 - DNA, 140 bp, Artificial Sequence
  Synthetic
atggccgactcccaagtacgagcacaagacaacccacagtcccgccatcgcttgagtccagggccagggccctgtggggccggaggagacggactaagagtagtggccaaacgcccaagcggagacccagcatggcgtat

SEQ ID NO: 393665 - DNA, 140 bp, Artificial Sequence
  Synthetic
atacgccatgctgggtctccatccacgtgtgggtgcccccgttgcaggttaagggtggtcgtgacgctgtcatcatgctcacatgcctcttccaccctgccttggggtttgagatcacaacgtacttgggagtcggccat

SEQ ID NO: 393666 - DNA, 140 bp, Artificial Sequence
  Synthetic
atggccgactcccaagtacgttgtgatctcaaaccccaaggcagggtggaagaggcatgtgagcatgatgacagcgtcacgaccacccttaacctgcaacgggggcacccacacgtggatggagacccagcatggcgtat

SEQ ID NO: 393667 - DNA, 140 bp, Artificial Sequence
  Synthetic
aggccctggctgctgatatgcatcatgctcacatgcctcttccaccctgccttggggtttgagatcacaaaaatcctcttcgggatactgggccccttgtacctgctgcaacattcactcgaccttttgggacagcggtg

SEQ ID NO: 393668 - DNA, 140 bp, Artificial Sequence
  Synthetic
caccgctgtcccaaaaggtcgagtgaatgttgcagcaggtacaaggggcccagtatcccgaagaggatttttgtgatctcaaaccccaaggcagggtggaagaggcatgtgagcatgatgcatatcagcagccagggcct

SEQ ID NO: 393669 - DNA, 140 bp, Artificial Sequence
  Synthetic
aggccctggctgctgatatgaccttggtaggctgaccggaacctacatttatgaccatcttgcccccatgaaggattgggcagcgtctgggctccgcgaattaacggtggccacagaaccgaccttttgggacagcggtg

SEQ ID NO: 393670 - DNA, 140 bp, Artificial Sequence
  Synthetic
caccgctgtcccaaaaggtcggttctgtggccaccgttaattcgcggagcccagacgctgcccaatccttcatgggggcaagatggtcataaatgtaggttccggtcagcctaccaaggtcatatcagcagccagggcct

SEQ ID NO: 393671 - DNA, 140 bp, Artificial Sequence
  Synthetic
atacgccatgctgggtctccggccgcgaaattttcctggggccggccgacgacatcaagacgtcgggttggcgactcctcgcccctatcaccgcgtatgcgcagcagacgcgaggggtaccgtacttgggagtcggccat

SEQ ID NO: 393672 - DNA, 140 bp, Artificial Sequence
  Synthetic
atggccgactcccaagtacggtacccctcgcgtctgctgcgcatacgcggtgataggggcgaggagtcgccaacccgacgtcttgatgtcgtcggccggccccaggaaaatttcgcggccggagacccagcatggcgtat

SEQ ID NO: 393673 - DNA, 140 bp, Artificial Sequence
  Synthetic
atacgccatgctgggtctcctatcaatggagtgatgtggacactcttccatggggccggttctaagacccttgctggccccaaaggcccggtagtgcagatgtacaccaatgtagacaaacgtacttgggagtcggccat

SEQ ID NO: 393674 - DNA, 140 bp, Artificial Sequence
  Synthetic
atggccgactcccaagtacgtttgtctacattggtgtacatctgcactaccgggcctttggggccagcaagggtcttagaaccggccccatggaagagtgtccacatcactccattgataggagacccagcatggcgtat

SEQ ID NO: 393675 - DNA, 140 bp, Artificial Sequence
  Synthetic
aggccctggctgctgatatgatacgacgccacgtcgatttgctcgttggggcggctgctttctgctccgctatgtacgtgggggatctctgcggatctgttttcctcgtctcccagctgtgaccttttgggacagcggtg

SEQ ID NO: 393676 - DNA, 140 bp, Artificial Sequence
  Synthetic
caccgctgtcccaaaaggtcacagctgggagacgaggaaaacagatccgcagagatcccccacgtacatagcggagcagaaagcagccgccccaacgagcaaatcgacgtggcgtcgtatcatatcagcagccagggcct

SEQ ID NO: 393677 - DNA, 140 bp, Artificial Sequence
  Synthetic
aggccctggctgctgatatgatctatcccggccacgtatcaggtcaccgcatggcttgggatatgatgatgaactggtcacctacaacagccctagtggtatcgcagctactccggatccgaccttttgggacagcggtg

SEQ ID NO: 393678 - DNA, 140 bp, Artificial Sequence
  Synthetic
caccgctgtcccaaaaggtcggatccggagtagctgcgataccactagggctgttgtaggtgaccagttcatcatcatatcccaagccatgcggtgacctgatacgtggccgggatagatcatatcagcagccagggcct

SEQ ID NO: 393679 - DNA, 140 bp, Artificial Sequence
  Synthetic
aggccctggctgctgatatggatttaccaaagtgtgcggagcgcctccttgtgtcatcggaggggtgggcaacaacaccttgcactgccccactgactgtttccgcaagcatccggaagcgaccttttgggacagcggtg

SEQ ID NO: 393680 - DNA, 140 bp, Artificial Sequence
  Synthetic
caccgctgtcccaaaaggtcgcttccggatgcttgcggaaacagtcagtggggcagtgcaaggtgttgttgcccacccctccgatgacacaaggaggcgctccgcacactttggtaaatccatatcagcagccagggcct

SEQ ID NO: 393681 - DNA, 140 bp, Artificial Sequence
  Synthetic
atacgccatgctgggtctcctgcccgccgcttacgcggcccaagggtacaaggtgctggtgctaaacccgtccgtcgcagcaacgttcgggttcggggcatacatgtcaagagcatacggcgtacttgggagtcggccat

SEQ ID NO: 393682 - DNA, 140 bp, Artificial Sequence
  Synthetic
atggccgactcccaagtacgccgtatgctcttgacatgtatgccccgaacccgaacgttgctgcgacggacgggtttagcaccagcaccttgtacccttgggccgcgtaagcggcgggcaggagacccagcatggcgtat

SEQ ID NO: 393683 - DNA, 140 bp, Artificial Sequence
  Synthetic
atacgccatgctgggtctccggcggcgcgtatgacgtaatcatatgcgacgagtgccattcccaggacgctaccaccatccttgggataggcacagtccttgaccaggcagagacggctgcgtacttgggagtcggccat

SEQ ID NO: 393684 - DNA, 140 bp, Artificial Sequence
  Synthetic
atggccgactcccaagtacgcagccgtctctgcctggtcaaggactgtgcctatcccaaggatggtggtagcgtcctgggaatggcactcgtcgcatatgattacgtcatacgcgccgccggagacccagcatggcgtat

SEQ ID NO: 393685 - DNA, 140 bp, Artificial Sequence
  Synthetic
atacgccatgctgggtctccacgccccaccccaacattgaggaggtggccctgccttcggagggggaaatccccttctacggcagagccatcccccttgttcttataaagggcggtaggccgtacttgggagtcggccat

SEQ ID NO: 393686 - DNA, 140 bp, Artificial Sequence
  Synthetic
atggccgactcccaagtacggcctaccgccctttataagaacaagggggatggctctgccgtagaaggggatttccccctccgaaggcagggccacctcctcaatgttggggtggggcgtggagacccagcatggcgtat

SEQ ID NO: 393687 - DNA, 140 bp, Artificial Sequence
  Synthetic
atacgccatgctgggtctcccgccgtcatacccgcgacaggagacgtagtcgtgtgcagcactgacgcgctcatgacgggttttaccggcgactttgattctgtcatagactgcaactcccgtacttgggagtcggccat

SEQ ID NO: 393688 - DNA, 140 bp, Artificial Sequence
  Synthetic
atggccgactcccaagtacgggagttgcagtctatgacagaatcaaagtcgccggtaaaacccgtcatgagcgcgtcagtgctgcacacgactacgtctcctgtcgcgggtatgacggcgggagacccagcatggcgtat

SEQ ID NO: 393689 - DNA, 140 bp, Artificial Sequence
  Synthetic
atacgccatgctgggtctccgccgtcactcagacggtggacttcagtctggatcccaccttcaccattgagactactacagtgccccaggacgcagtgtccagaagccagcgtaggggcccgtacttgggagtcggccat

SEQ ID NO: 393690 - DNA, 140 bp, Artificial Sequence
  Synthetic
atggccgactcccaagtacgggcccctacgctggcttctggacactgcgtcctggggcactgtagtagtctcaatggtgaaggtgggatccagactgaagtccaccgtctgagtgacggcggagacccagcatggcgtat

SEQ ID NO: 393691 - DNA, 140 bp, Artificial Sequence
  Synthetic
aggccctggctgctgatatgtaccatcttcaaggttaggatgtatgtggggggcgtggagcacaggctcaacgccgcatgcaattggactcgaggagagcgttgtgacttggaggacagggaccttttgggacagcggtg

SEQ ID NO: 393692 - DNA, 140 bp, Artificial Sequence
  Synthetic
caccgctgtcccaaaaggtccctgtcctccaagtcacaacgctctcctcgagtccaattgcatgcggcgttgagcctgtgctccacgccccccacatacatcctaaccttgaagatggtacatatcagcagccagggcct

SEQ ID NO: 393693 - DNA, 140 bp, Artificial Sequence
  Synthetic
atacgccatgctgggtctccttctgggaaggggtgttcacagggcttactaacatcgacgcccacatgctgtcacaggcaaagcagggtggggaaaacttcccataccttgtggcatacccgtacttgggagtcggccat

SEQ ID NO: 393694 - DNA, 140 bp, Artificial Sequence
  Synthetic
atggccgactcccaagtacgggtatgccacaaggtatgggaagttttccccaccctgctttgcctgtgacagcatgtgggcgtcgatgttagtaagccctgtgaacaccccttcccagaaggagacccagcatggcgtat

SEQ ID NO: 393695 - DNA, 140 bp, Artificial Sequence
  Synthetic
aggccctggctgctgatatgcctcctggcggacgcgcgcgtctgtgcctgcttgtggatgatgctgctgatagctcaggctgaggccgccctagagaacctggtggtcctcaatgcggcggaccttttgggacagcggtg

SEQ ID NO: 393696 - DNA, 140 bp, Artificial Sequence
  Synthetic
caccgctgtcccaaaaggtccgccgcattgaggaccaccaggttctctagggcggcctcagcctgagctatcagcagcatcatccacaagcaggcacagacgcgcgcgtccgccaggaggcatatcagcagccagggcct

SEQ ID NO: 393697 - DNA, 140 bp, Artificial Sequence
  Synthetic
atacgccatgctgggtctcccctcctgtacaggctgggggccgttcagaatgagatcacactgacacaccccatcaccaagtacatcatggcttgcatgtccgcagacttggaggtcattcgtacttgggagtcggccat

SEQ ID NO: 393698 - DNA, 140 bp, Artificial Sequence
  Synthetic
atggccgactcccaagtacgaatgacctccaagtctgcggacatgcaagccatgatgtacttggtgatggggtgtgtcagtgtgatctcattctgaacggcccccagcctgtacaggaggggagacccagcatggcgtat

SEQ ID NO: 393699 - DNA, 140 bp, Artificial Sequence
  Synthetic
aggccctggctgctgatatgatggcgtatggccgctactcctgctcctgctggcgttaccaccacgagcatacgccatggaccgggagatggctgcatcgtgcggaggcgcggttttcgtgaccttttgggacagcggtg

SEQ ID NO: 393700 - DNA, 140 bp, Artificial Sequence
  Synthetic
caccgctgtcccaaaaggtcacgaaaaccgcgcctccgcacgatgcagccatctcccggtccatggcgtatgctcgtggtggtaacgccagcaggagcaggagtagcggccatacgccatcatatcagcagccagggcct

SEQ ID NO: 393701 - DNA, 140 bp, Artificial Sequence
  Synthetic
atacgccatgctgggtctccggagacctgcgatcacccctgacagggaggtactataccagcaatttgatgagatggaggagtgctcagcctccttgccctatgtggacgaggcacgtgccgtacttgggagtcggccat

SEQ ID NO: 393702 - DNA, 140 bp, Artificial Sequence
  Synthetic
atggccgactcccaagtacggcacgtgcctcgtccacatagggcaaggaggctgagcactcctccatctcatcaaattgctggtatagtacctccctgtcaggggtgatcgcaggtctccggagacccagcatggcgtat

SEQ ID NO: 393703 - DNA, 140 bp, Artificial Sequence
  Synthetic
aggccctggctgctgatatgggggtgtgctggaccgtctaccacggggccggaacaaggaccatcgcgtcatctaagggtcctgttatccagatgtataccaatgtagaccaggacctcggaccttttgggacagcggtg

SEQ ID NO: 393704 - DNA, 140 bp, Artificial Sequence
  Synthetic
caccgctgtcccaaaaggtccgaggtcctggtctacattggtatacatctggataacaggacccttagatgacgcgatggtccttgttccggccccgtggtagacggtccagcacacccccatatcagcagccagggcct

SEQ ID NO: 393705 - DNA, 140 bp, Artificial Sequence
  Synthetic
atacgccatgctgggtctccgccagaaagctgaaactctgaaaccggcagctacgtccatgtggagcaaggccgagcagttctgggcaaagcatatgtggaactttgtcagtgggatccacgtacttgggagtcggccat

SEQ ID NO: 393706 - DNA, 140 bp, Artificial Sequence
  Synthetic
atggccgactcccaagtacgtggatcccactgacaaagttccacatatgctttgcccagaactgctcggccttgctccacatggacgtagctgccggtttcagagtttcagctttctggcggagacccagcatggcgtat

SEQ ID NO: 393707 - DNA, 140 bp, Artificial Sequence
  Synthetic
atacgccatgctgggtctccctcctttttaatattctaggagggtgggtggcctcacagatcgcgccacccacggccgccaccgcgttcgtcgttagtggaatggccggggccgcagtcgcgtacttgggagtcggccat

SEQ ID NO: 393708 - DNA, 140 bp, Artificial Sequence
  Synthetic
atggccgactcccaagtacgcgactgcggccccggccattccactaacgacgaacgcggtggcggccgtgggtggcgcgatctgtgaggccacccaccctcctagaatattaaaaaggagggagacccagcatggcgtat

SEQ ID NO: 393709 - DNA, 140 bp, Artificial Sequence
  Synthetic
atacgccatgctgggtctccgccgacagccgaagaactggtaaacctcctgccttcaatactctgccctggagccctagtggttggtgtcatatgcgccgccgttctgcggcgccacattcgtacttgggagtcggccat

SEQ ID NO: 393710 - DNA, 140 bp, Artificial Sequence
  Synthetic
atggccgactcccaagtacgaatgtggcgccgcagaacggcggcgcatatgacaccaaccactagggctccagggcagagtattgaaggcaggaggtttaccagttcttcggctgtcggcggagacccagcatggcgtat

SEQ ID NO: 393711 - DNA, 140 bp, Artificial Sequence
  Synthetic
atacgccatgctgggtctccggcccaggcgagggggctgtacagtggatgaataggctgattgcgttcgcttcccggggcaatcatgggtctccgacacactacgtgcccgagacggacgcgtacttgggagtcggccat

SEQ ID NO: 393712 - DNA, 140 bp, Artificial Sequence
  Synthetic
atggccgactcccaagtacgcgtccgtctcgggcacgtagtgtgtcggagacccatgattgccccgggaagcgaacgcaatcagcctattcatccactgtacagccccctcgcctgggccggagacccagcatggcgtat

SEQ ID NO: 393713 - DNA, 140 bp, Artificial Sequence
  Synthetic
atacgccatgctgggtctcctggtacatggcttagggccatttgggactgggtctgcacggcactgacagacttcaaagcctggctgcaggcaaaactcctcccgcaactccccggagtgcgtacttgggagtcggccat

SEQ ID NO: 393714 - DNA, 140 bp, Artificial Sequence
  Synthetic
atggccgactcccaagtacgcactccggggagttgcgggaggagttttgcctgcagccaggctttgaagtctgtcagtgccgtgcagacccagtcccaaatggccctaagccatgtaccaggagacccagcatggcgtat

SEQ ID NO: 393715 - DNA, 140 bp, Artificial Sequence
  Synthetic
aggccctggctgctgatatggtgtattgcttcactccaagccctgttgtggtggggacgaccgatcgtttcggcgcccctacgtacacttggggggagaatgagacggacgtgctgattcgaccttttgggacagcggtg

SEQ ID NO: 393716 - DNA, 140 bp, Artificial Sequence
  Synthetic
caccgctgtcccaaaaggtcgaatcagcacgtccgtctcattctccccccaagtgtacgtaggggcgccgaaacgatcggtcgtccccaccacaacagggcttggagtgaagcaatacaccatatcagcagccagggcct

SEQ ID NO: 393717 - DNA, 140 bp, Artificial Sequence
  Synthetic
atacgccatgctgggtctccagaacggaaccatgagaatcgtcggcccgaagctgtgcagtaacacctggcaaggcaccttcccaatcaacgccacaacaacagggcccagcgtacctgccgtacttgggagtcggccat

SEQ ID NO: 393718 - DNA, 140 bp, Artificial Sequence
  Synthetic
atggccgactcccaagtacggcaggtacgctgggccctgttgttgtggcgttgattgggaaggtgccttgccaggtgttactgcacagcttcgggccgacgattctcatggttccgttctggagacccagcatggcgtat

SEQ ID NO: 393719 - DNA, 140 bp, Artificial Sequence
  Synthetic
atacgccatgctgggtctcccaagacaatctgaagtgtccctgccaggtaccatctccagagttcttcacggagctggatggcgtgaggattcaccgcttcgcgccaccctgtaaccccccgtacttgggagtcggccat

SEQ ID NO: 393720 - DNA, 140 bp, Artificial Sequence
  Synthetic
atggccgactcccaagtacggggggttacagggtggcgcgaagcggtgaatcctcacgccatccagctccgtgaagaactctggagatggtacctggcagggacacttcagattgtcttgggagacccagcatggcgtat

SEQ ID NO: 393721 - DNA, 140 bp, Artificial Sequence
  Synthetic
aggccctggctgctgatatgccggcatgttcgactcgtctgtcctctgcgagtgctatgacgcgggctgtgcttggtatgagctcacgcccgccgagaccacagttaggctacgagcatagaccttttgggacagcggtg

SEQ ID NO: 393722 - DNA, 140 bp, Artificial Sequence
  Synthetic
caccgctgtcccaaaaggtctatgctcgtagcctaactgtggtctcggcgggcgtgagctcataccaagcacagcccgcgtcatagcactcgcagaggacagacgagtcgaacatgccggcatatcagcagccagggcct

SEQ ID NO: 393723 - DNA, 140 bp, Artificial Sequence
  Synthetic
atacgccatgctgggtctccaatgctgtcagatcccgcccacatcacggcggaaacggccaagcgcaggctaaatcgagggtctccaccctctctggcaaactcctcggccagtcagctccgtacttgggagtcggccat

SEQ ID NO: 393724 - DNA, 140 bp, Artificial Sequence
  Synthetic
atggccgactcccaagtacggagctgactggccgaggagtttgccagagagggtggagaccctcgatttagcctgcgcttggccgtttccgccgtgatgtgggcgggatctgacagcattggagacccagcatggcgtat

SEQ ID NO: 393725 - DNA, 140 bp, Artificial Sequence
  Synthetic
atacgccatgctgggtctccatatcacgcgagtagaggctgagaacaaggtcgagatccttgactgcttcaagccgctcaaagaggaagaagatgacagagagatctccgtgtccgccgacgtacttgggagtcggccat

SEQ ID NO: 393726 - DNA, 140 bp, Artificial Sequence
  Synthetic
atggccgactcccaagtacgtcggcggacacggagatctctctgtcatcttcttcctctttgagcggcttgaagcagtcaaggatctcgaccttgttctcagcctctactcgcgtgatatggagacccagcatggcgtat

SEQ ID NO: 393727 - DNA, 140 bp, Artificial Sequence
  Synthetic
atacgccatgctgggtctccgacccccctcaggtgtggggctgcccgataccacctgcgggccccccgcctgtcccgcttccgcggaggaaaaggaagccaatggaactatctgattctacgtacttgggagtcggccat

SEQ ID NO: 393728 - DNA, 140 bp, Artificial Sequence
  Synthetic
atggccgactcccaagtacgtagaatcagatagttccattggcttccttttcctccgcggaagcgggacaggcggggggcccgcaggtggtatcgggcagccccacacctgaggggggtcggagacccagcatggcgtat

SEQ ID NO: 393729 - DNA, 140 bp, Artificial Sequence
  Synthetic
aggccctggctgctgatatgtgacgggctttaccggcgactttgactcagtgatcgactgtaatacatgtgtcacccagacagtcgatttcagcttggaccctaccttcaccattgagacgaccttttgggacagcggtg

SEQ ID NO: 393730 - DNA, 140 bp, Artificial Sequence
  Synthetic
caccgctgtcccaaaaggtcgtctcaatggtgaaggtagggtccaagctgaaatcgactgtctgggtgacacatgtattacagtcgatcactgagtcaaagtcgccggtaaagcccgtcacatatcagcagccagggcct

SEQ ID NO: 393731 - DNA, 140 bp, Artificial Sequence
  Synthetic
atacgccatgctgggtctcccgattcggggcctgaggagaagcgtgatgacaactcggacgcggcttcatattcttccatgcctccgctagagggcgaacctggggaccctgacctttcgcgtacttgggagtcggccat

SEQ ID NO: 393732 - DNA, 140 bp, Artificial Sequence
  Synthetic
atggccgactcccaagtacgcgaaaggtcagggtccccaggttcgccctctagcggaggcatggaagaatatgaagccgcgtccgagttgtcatcacgcttctcctcaggccccgaatcgggagacccagcatggcgtat

SEQ ID NO: 393733 - DNA, 140 bp, Artificial Sequence
  Synthetic
atacgccatgctgggtctccaggaaaaattacccatcaatcccttaagcaacaccttattacgccaccacaatcttgtgtactccacctcctctcggagtgcgggtctgaggcagaaaaacgtacttgggagtcggccat

SEQ ID NO: 393734 - DNA, 140 bp, Artificial Sequence
  Synthetic
atggccgactcccaagtacgtttttctgcctcagacccgcactccgagaggaggtggagtacacaagattgtggtggcgtaataaggtgttgcttaagggattgatgggtaatttttcctggagacccagcatggcgtat

SEQ ID NO: 393735 - DNA, 140 bp, Artificial Sequence
  Synthetic
  misc_feature (99)..(99): n is a, c, g, or t
aggccctggctgctgatatgacgagcatacgccatggatcgggagatggctgcatcgtgcggaggcgcggtttttgtaggtctgatactcttgaccctntctccacactataaagagttcgaccttttgggacagcggtg

SEQ ID NO: 393736 - DNA, 140 bp, Artificial Sequence
  Synthetic
  misc_feature (42)..(42): n is a, c, g, or t
caccgctgtcccaaaaggtcgaactctttatagtgtggaganagggtcaagagtatcagacctacaaaaaccgcgcctccgcacgatgcagccatctcccgatccatggcgtatgctcgtcatatcagcagccagggcct

SEQ ID NO: 393737 - DNA, 140 bp, Artificial Sequence
  Synthetic
atacgccatgctgggtctcctggacgagatgaagcgattagcctccaaggttaaggccagactactgcccctagaggaagcctgtgggttaacaccaccccactccgcccgttccaagtacgtacttgggagtcggccat

SEQ ID NO: 393738 - DNA, 140 bp, Artificial Sequence
  Synthetic
atggccgactcccaagtacgtacttggaacgggcggagtggggtggtgttaacccacaggcttcctctaggggcagtagtctggccttaaccttggaggctaatcgcttcatctcgtccaggagacccagcatggcgtat

SEQ ID NO: 393739 - DNA, 140 bp, Artificial Sequence
  Synthetic
atacgccatgctgggtctccccgacaaccatcatggcaaaaaacgaagtgttcgcagtggagccgtctaagggggggaagaagcctgcacggctgatagtctaccccgaccttggagtcccgtacttgggagtcggccat

SEQ ID NO: 393740 - DNA, 140 bp, Artificial Sequence
  Synthetic
atggccgactcccaagtacgggactccaaggtcggggtagactatcagccgtgcaggcttcttcccccccttagacggctccactgcgaacacttcgttttttgccatgatggttgtcggggagacccagcatggcgtat

SEQ ID NO: 393741 - DNA, 140 bp, Artificial Sequence
  Synthetic
atacgccatgctgggtctcctgacttcttactgaaggcgtggaaatctaagaagatccccatggctttctcctatgacacccgctgctttgactcgaccattaccgaacatgacataatgcgtacttgggagtcggccat

SEQ ID NO: 393742 - DNA, 140 bp, Artificial Sequence
  Synthetic
atggccgactcccaagtacgcattatgtcatgttcggtaatggtcgagtcaaagcagcgggtgtcataggagaaagccatggggatcttcttagatttccacgccttcagtaagaagtcaggagacccagcatggcgtat

SEQ ID NO: 393743 - DNA, 140 bp, Artificial Sequence
  Synthetic
atacgccatgctgggtctccacagcaagggccagcaatgtggttatcgtagatgccgcgccagcggcgtcttcaccactagtatgggcaacaccatgacgtgctacattaaggctttagccgtacttgggagtcggccat

SEQ ID NO: 393744 - DNA, 140 bp, Artificial Sequence
  Synthetic
atggccgactcccaagtacggctaaagccttaatgtagcacgtcatggtgttgcccatactagtggtgaagacgccgctggcgcggcatctacgataaccacattgctggcccttgctgtggagacccagcatggcgtat

SEQ ID NO: 393745 - DNA, 140 bp, Artificial Sequence
  Synthetic
atacgccatgctgggtctccagcctgagagccttcactgaggctatgaccaggtactccgctcccccgggtgatcccccggttccagcttatgacctggagctcgtaacatcttgctcctcgtacttgggagtcggccat

SEQ ID NO: 393746 - DNA, 140 bp, Artificial Sequence
  Synthetic
atggccgactcccaagtacgaggagcaagatgttacgagctccaggtcataagctggaaccgggggatcacccgggggagcggagtacctggtcatagcctcagtgaaggctctcaggctggagacccagcatggcgtat

SEQ ID NO: 393747 - DNA, 140 bp, Artificial Sequence
  Synthetic
aggccctggctgctgatatgccctggtcgtcggggtcgtgtgcgcagcaatactgcgtcggcatgtgggcccgggagagggggctgtgcagtggatgaaccggctgatagcgttcgcttcgaccttttgggacagcggtg

SEQ ID NO: 393748 - DNA, 140 bp, Artificial Sequence
  Synthetic
caccgctgtcccaaaaggtcgaagcgaacgctatcagccggttcatccactgcacagccccctctcccgggcccacatgccgacgcagtattgctgcgcacacgaccccgacgaccagggcatatcagcagccagggcct

SEQ ID NO: 393749 - DNA, 140 bp, Artificial Sequence
  Synthetic
atacgccatgctgggtctccacactccccggttaattcctggctagggaacatcatcatgtacgcgccgaccttgtgggctcggatagtgctgatgacgcactttttcagcgttctacagcgtacttgggagtcggccat

SEQ ID NO: 393750 - DNA, 140 bp, Artificial Sequence
  Synthetic
atggccgactcccaagtacgctgtagaacgctgaaaaagtgcgtcatcagcactatccgagcccacaaggtcggcgcgtacatgatgatgttccctagccaggaattaaccggggagtgtggagacccagcatggcgtat

SEQ ID NO: 393751 - DNA, 140 bp, Artificial Sequence
  Synthetic
atacgccatgctgggtctccgacttagcgcgttttcactccattcatactctccgagcgagatcaatagggtggctagttgcctcaggaagcttggggtaccccctttgagagcttggagcgtacttgggagtcggccat

SEQ ID NO: 393752 - DNA, 140 bp, Artificial Sequence
  Synthetic
atggccgactcccaagtacgctccaagctctcaaagggggtaccccaagcttcctgaggcaactagccaccctattgatctcgctcggagagtatgaatggagtgaaaacgcgctaagtcggagacccagcatggcgtat

SEQ ID NO: 393753 - DNA, 140 bp, Artificial Sequence
  Synthetic
atacgccatgctgggtctccaaactcactccattagctgacgctgaccggctggacttgtccagctggttcaccgttggcgctggcgggggggacatttatcacagcatgtcccgtgccccgtacttgggagtcggccat

SEQ ID NO: 393754 - DNA, 140 bp, Artificial Sequence
  Synthetic
atggccgactcccaagtacggggcacgggacatgctgtgataaatgtcccccccgccagcgccaacggtgaaccagctggacaagtccagccggtcagcgtcagctaatggagtgagtttggagacccagcatggcgtat

SEQ ID NO: 393755 - DNA, 140 bp, Artificial Sequence
  Synthetic
aggccctggctgctgatatgcaccgttggcgctggcgggggggacatttatcacagcatgtcccgtgcccgaccccgcaacttactcctgtgcctactcctacttagcgtaggggtaggcgaccttttgggacagcggtg

SEQ ID NO: 393756 - DNA, 140 bp, Artificial Sequence
  Synthetic
caccgctgtcccaaaaggtcgcctacccctacgctaagtaggagtaggcacaggagtaagttgcggggtcgggcacgggacatgctgtgataaatgtcccccccgccagcgccaacggtgcatatcagcagccagggcct

SEQ ID NO: 393757 - DNA, 140 bp, Artificial Sequence
  Synthetic
atacgccatgctgggtctcccgccagcccacgggccggtcctggggtcaacccgggtacccttggcccctttatgccaatgagggcctcgggtgggcagggtggttgctctccccccgagcgtacttgggagtcggccat

SEQ ID NO: 393758 - DNA, 140 bp, Artificial Sequence
  Synthetic
atggccgactcccaagtacgctcggggggagagcaaccaccctgcccacccgaggccctcattggcataaaggggccaagggtacccgggttgaccccaggaccggcccgtgggctggcgggagacccagcatggcgtat

SEQ ID NO: 393759 - DNA, 140 bp, Artificial Sequence
  Synthetic
aggccctggctgctgatatgaccacctccacggaggaagaggacggttgtcctgacagaatccactgtgtcttctgccttggcggagcttgctacaaagaccttcggcagctccgaatcggaccttttgggacagcggtg

SEQ ID NO: 393760 - DNA, 140 bp, Artificial Sequence
  Synthetic
caccgctgtcccaaaaggtccgattcggagctgccgaaggtctttgtagcaagctccgccaaggcagaagacacagtggattctgtcaggacaaccgtcctcttcctccgtggaggtggtcatatcagcagccagggcct

SEQ ID NO: 393761 - DNA, 140 bp, Artificial Sequence
  Synthetic
atacgccatgctgggtctccgtacatcccgctcgtaggcggccccgttgggggcgtcgcaagggctctcgcacacggtgtgagggtccttgaggacggggtaaactatgcaacagggaatcgtacttgggagtcggccat

SEQ ID NO: 393762 - DNA, 140 bp, Artificial Sequence
  Synthetic
atggccgactcccaagtacgattccctgttgcatagtttaccccgtcctcaaggaccctcacaccgtgtgcgagagcccttgcgacgcccccaacggggccgcctacgagcgggatgtacggagacccagcatggcgtat

SEQ ID NO: 393763 - DNA, 140 bp, Artificial Sequence
  Synthetic
  misc_feature (46)..(46): n is a, c, g, or t
atacgccatgctgggtctccatgtcaccaatgattgcccaaactcntccatcgtctatgaggctgaagacctgatcttacacgcacctggttgcgtgccctgtgttaggcagggtaatgtcgtacttgggagtcggccat

SEQ ID NO: 393764 - DNA, 140 bp, Artificial Sequence
  Synthetic
  misc_feature (95)..(95): n is a, c, g, or t
atggccgactcccaagtacgacattaccctgcctaacacagggcacgcaaccaggtgcgtgtaagatcaggtcttcagcctcatagacgatggangagtttgggcaatcattggtgacatggagacccagcatggcgtat

SEQ ID NO: 393765 - DNA, 140 bp, Artificial Sequence
  Synthetic
aggccctggctgctgatatgttggcagcataggccttgggaaggtgcttgtggacattctggcgggctatggagcaggggtggcaggcgcgctcgtggcctttaaggtcatgagcggcgagaccttttgggacagcggtg

SEQ ID NO: 393766 - DNA, 140 bp, Artificial Sequence
  Synthetic
caccgctgtcccaaaaggtctcgccgctcatgaccttaaaggccacgagcgcgcctgccacccctgctccatagcccgccagaatgtccacaagcaccttcccaaggcctatgctgccaacatatcagcagccagggcct

SEQ ID NO: 393767 - DNA, 140 bp, Artificial Sequence
  Synthetic
atacgccatgctgggtctccccagttgttacggattccccaggtggtcattgacatcattgccggggcccactggggggtcttgttcgccgccgcatactacgcgtcggcggctaactggcgtacttgggagtcggccat

SEQ ID NO: 393768 - DNA, 140 bp, Artificial Sequence
  Synthetic
atggccgactcccaagtacgccagttagccgccgacgcgtagtatgcggcggcgaacaagaccccccagtgggccccggcaatgatgtcaatgaccacctggggaatccgtaacaactggggagacccagcatggcgtat

SEQ ID NO: 393769 - DNA, 140 bp, Artificial Sequence
  Synthetic
atacgccatgctgggtctccttttcacccctgggccgcagcagaacttgcagctcataaataccaacgggagctggcacatcaacagaactgcccttaactgtaatgacagcctccagaccgtacttgggagtcggccat

SEQ ID NO: 393770 - DNA, 140 bp, Artificial Sequence
  Synthetic
atggccgactcccaagtacggtctggaggctgtcattacagttaagggcagttctgttgatgtgccagctcccgttggtatttatgagctgcaagttctgctgcggcccaggggtgaaaaggagacccagcatggcgtat

SEQ ID NO: 393771 - DNA, 140 bp, Artificial Sequence
  Synthetic
atacgccatgctgggtctcctggggaactatcagctatgccgccgtgtcgggccccagtgatgacaagccctattgctggcactaccccccacgcccgtgcggaatagtgccagcccgagcgtacttgggagtcggccat

SEQ ID NO: 393772 - DNA, 140 bp, Artificial Sequence
  Synthetic
atggccgactcccaagtacgctcgggctggcactattccgcacgggcgtggggggtagtgccagcaatagggcttgtcatcactggggcccgacacggcggcatagctgatagttccccaggagacccagcatggcgtat

SEQ ID NO: 393773 - DNA, 140 bp, Artificial Sequence
  Synthetic
atacgccatgctgggtctcccactatccttataggctttggcattatccttgtactgtcaactacaccctgttcaaagtcaggatgtacgtgggaggggtcgagcacaggctggaagttgcgtacttgggagtcggccat

SEQ ID NO: 393774 - DNA, 140 bp, Artificial Sequence
  Synthetic
atggccgactcccaagtacgcaacttccagcctgtgctcgacccctcccacgtacatcctgactttgaacagggtgtagttgacagtacaaggataatgccaaagcctataaggatagtgggagacccagcatggcgtat

SEQ ID NO: 393775 - DNA, 140 bp, Artificial Sequence
  Synthetic
atacgccatgctgggtctccaccacagaccgcaaggggaatcccacttacagttggggcgaaaatgagactgacatctttctcttgaacaacacgaggccccctactggcaactggtttgcgtacttgggagtcggccat

SEQ ID NO: 393776 - DNA, 140 bp, Artificial Sequence
  Synthetic
atggccgactcccaagtacgcaaaccagttgccagtagggggcctcgtgttgttcaagagaaagatgtcagtctcattttcgccccaactgtaagtgggattccccttgcggtctgtggtggagacccagcatggcgtat

SEQ ID NO: 393777 - DNA, 140 bp, Artificial Sequence
  Synthetic
atacgccatgctgggtctccggtgtgatcttgaagacagagacagggccgagctgagcccgctcctacataccaccacgcagtgggccatattgccgtgctctttcacacccacacccgccgtacttgggagtcggccat

SEQ ID NO: 393778 - DNA, 140 bp, Artificial Sequence
  Synthetic
atggccgactcccaagtacggcgggtgtgggtgtgaaagagcacggcaatatggcccactgcgtggtggtatgtaggagcgggctcagctcggccctgtctctgtcttcaagatcacaccggagacccagcatggcgtat

SEQ ID NO: 393779 - DNA, 140 bp, Artificial Sequence
  Synthetic
atacgccatgctgggtctcctacatagtgctggccttcttattacttgctgatgcccgtatttgtacttgcctatggatcatgctcctggtttgtcaggctgaagcagccctggagaacgcgtacttgggagtcggccat

SEQ ID NO: 393780 - DNA, 140 bp, Artificial Sequence
  Synthetic
atggccgactcccaagtacgcgttctccagggctgcttcagcctgacaaaccaggagcatgatccataggcaagtacaaatacgggcatcagcaagtaataagaaggccagcactatgtaggagacccagcatggcgtat

SEQ ID NO: 393781 - DNA, 140 bp, Artificial Sequence
  Synthetic
atacgccatgctgggtctcctggggccacctacctttgcttgggcatttggccattactcttactccttttcctcctgccccaaagggctttagccctggactcaagcgatggcgggactcgtacttgggagtcggccat

SEQ ID NO: 393782 - DNA, 140 bp, Artificial Sequence
  Synthetic
atggccgactcccaagtacgagtcccgccatcgcttgagtccagggctaaagccctttggggcaggaggaaaaggagtaagagtaatggccaaatgcccaagcaaaggtaggtggccccaggagacccagcatggcgtat

SEQ ID NO: 393783 - DNA, 140 bp, Artificial Sequence
  Synthetic
aggccctggctgctgatatgccccccttgagggggagccgggggaccccgatctcagcgacgggtcctggtctaccgtgagtgaggaggccagtgaggacgtcgtctgctgttcgatgtcgaccttttgggacagcggtg

SEQ ID NO: 393784 - DNA, 140 bp, Artificial Sequence
  Synthetic
caccgctgtcccaaaaggtcgacatcgaacagcagacgacgtcctcactggcctcctcactcacggtagaccaggacccgtcgctgagatcggggtcccccggctccccctcaaggggggcatatcagcagccagggcct

SEQ ID NO: 393785 - DNA, 140 bp, Artificial Sequence
  Synthetic
atacgccatgctgggtctcccccgggtagaggcctttatccatgtgtgggtgcccccgttgcaggttaggggtggtcgtgatgctattatcatgctcacatgccttttccatcctgccctcgtacttgggagtcggccat

SEQ ID NO: 393786 - DNA, 140 bp, Artificial Sequence
  Synthetic
atggccgactcccaagtacgagggcaggatggaaaaggcatgtgagcatgataatagcatcacgaccacccctaacctgcaacgggggcacccacacatggataaaggcctctacccgggggagacccagcatggcgtat

SEQ ID NO: 393787 - DNA, 140 bp, Artificial Sequence
  Synthetic
aggccctggctgctgatatgggtggtcgtgatgctattatcatgctcacatgccttttccatcctgccctggggtttgaggtcacaaaaatcctcctcgggatactaggtcctttgtaccgaccttttgggacagcggtg

SEQ ID NO: 393788 - DNA, 140 bp, Artificial Sequence
  Synthetic
caccgctgtcccaaaaggtcggtacaaaggacctagtatcccgaggaggatttttgtgacctcaaaccccagggcaggatggaaaaggcatgtgagcatgataatagcatcacgaccacccatatcagcagccagggcct

SEQ ID NO: 393789 - DNA, 140 bp, Artificial Sequence
  Synthetic
atacgccatgctgggtctccgcaggcggccttgctccaccttggtaggctgaccggaacgtacatttatgaccaccttgcccccatgaaggattgggcagcgtccgggctgcgcgacttacgtacttgggagtcggccat

SEQ ID NO: 393790 - DNA, 140 bp, Artificial Sequence
  Synthetic
atggccgactcccaagtacgtaagtcgcgcagcccggacgctgcccaatccttcatgggggcaaggtggtcataaatgtacgttccggtcagcctaccaaggtggagcaaggccgcctgcggagacccagcatggcgtat

SEQ ID NO: 393791 - DNA, 140 bp, Artificial Sequence
  Synthetic
  misc_feature (53)..(53): n is a, c, g, or t
aggccctggctgctgatatgctgtatcagctaggcgaggccatgaaatcttcntggggccagccgatgacatcagagaggcgggctggcgacttctcgcccctatcaccgcgtatgcgcagaccttttgggacagcggtg

SEQ ID NO: 393792 - DNA, 140 bp, Artificial Sequence
  Synthetic
  misc_feature (88)..(88): n is a, c, g, or t
caccgctgtcccaaaaggtctgcgcatacgcggtgataggggcgagaagtcgccagcccgcctctctgatgtcatcggctggccccangaagatttcatggcctcgcctagctgatacagcatatcagcagccagggcct

SEQ ID NO: 393793 - DNA, 140 bp, Artificial Sequence
  Synthetic
atacgccatgctgggtctccacattccttggtacttgcatcaatggggtgatgtggacagtcttccacggggccggcgctaagacccttgcgggccccaaaggcccagtggtgcaaatgtcgtacttgggagtcggccat

SEQ ID NO: 393794 - DNA, 140 bp, Artificial Sequence
  Synthetic
atggccgactcccaagtacgacatttgcaccactgggcctttggggcccgcaagggtcttagcgccggccccgtggaagactgtccacatcaccccattgatgcaagtaccaaggaatgtggagacccagcatggcgtat

SEQ ID NO: 393795 - DNA, 140 bp, Artificial Sequence
  Synthetic
atacgccatgctgggtctcccaggcatgcagacgtcgttccagctcgtagacggggcgacactcgtgcctccctgctcagcccgagacccatcagctatctcaagggttcatcgggcggccgtacttgggagtcggccat

SEQ ID NO: 393796 - DNA, 140 bp, Artificial Sequence
  Synthetic
atggccgactcccaagtacggccgcccgatgaacccttgagatagctgatgggtctcgggctgagcagggaggcacgagtgtcgccccgtctacgagctggaacgacgtctgcatgcctgggagacccagcatggcgtat

SEQ ID NO: 393797 - DNA, 140 bp, Artificial Sequence
  Synthetic
aggccctggctgctgatatgtatgacataataatttgtgacgagtgccactccacggatgcaacatccatcttgggcatcggcaccgtccttgaccaagcagagaccgcgggggcgagacgaccttttgggacagcggtg

SEQ ID NO: 393798 - DNA, 140 bp, Artificial Sequence
  Synthetic
caccgctgtcccaaaaggtcgtctcgcccccgcggtctctgcttggtcaaggacggtgccgatgcccaagatggatgttgcatccgtggagtggcactcgtcacaaattattatgtcatacatatcagcagccagggcct

SEQ ID NO: 393799 - DNA, 140 bp, Artificial Sequence
  Synthetic
atacgccatgctgggtctcctggaaaccacgatgcgctcgcccgtgttcactgacaacagcacaccccccgcggtccctcacgagttccaagtgggacacctccatgcgcctaccgggagcgtacttgggagtcggccat

SEQ ID NO: 393800 - DNA, 140 bp, Artificial Sequence
  Synthetic
atggccgactcccaagtacgctcccggtaggcgcatggaggtgtcccacttggaactcgtgagggaccgcggggggtgtgctgttgtcagtgaacacgggcgagcgcatcgtggtttccaggagacccagcatggcgtat

SEQ ID NO: 393801 - DNA, 140 bp, Artificial Sequence
  Synthetic
atacgccatgctgggtctcctgctggtgctaaatccatctgtcgcggcgacgctcgggttcggggcatacatgtcaagagcttatggcgtggaccccaacatcaggaccggagttaggaccgtacttgggagtcggccat

SEQ ID NO: 393802 - DNA, 140 bp, Artificial Sequence
  Synthetic
atggccgactcccaagtacggtcctaactccggtcctgatgttggggtccacgccataagctcttgacatgtatgccccgaacccgagcgtcgccgcgacagatggatttagcaccagcaggagacccagcatggcgtat

SEQ ID NO: 393803 - DNA, 140 bp, Artificial Sequence
  Synthetic
aggccctggctgctgatatgtgttctacacacacaggttcaacgattccggatgcccagagcgtatggccagctgtcggcccattgacaagtttgctcaggggtggggtcccatcacttagaccttttgggacagcggtg

SEQ ID NO: 393804 - DNA, 140 bp, Artificial Sequence
  Synthetic
caccgctgtcccaaaaggtctaagtgatgggaccccacccctgagcaaacttgtcaatgggccgacagctggccatacgctctgggcatccggaatcgttgaacctgtgtgtgtagaacacatatcagcagccagggcct

SEQ ID NO: 393805 - DNA, 140 bp, Artificial Sequence
  Synthetic
atacgccatgctgggtctccccccacgtataactggggggggaatgagacggacgtgctactccttaacaacacgcggccgccgcaaggcaactggttcggctgcacatggatgaacagccgtacttgggagtcggccat

SEQ ID NO: 393806 - DNA, 140 bp, Artificial Sequence
  Synthetic
atggccgactcccaagtacggctgttcatccatgtgcagccgaaccagttgccttgcggcggccgcgtgttgttaaggagtagcacgtccgtctcattccccccccagttatacgtggggggagacccagcatggcgtat

SEQ ID NO: 393807 - DNA, 140 bp, Artificial Sequence
  Synthetic
atacgccatgctgggtctcccggcaacaacacctttacctgccctacggactgtttccggaagcatcctgaggccacttacaccaaatgcggatcggggccttggctgacacctaggtgtcgtacttgggagtcggccat

SEQ ID NO: 393808 - DNA, 140 bp, Artificial Sequence
  Synthetic
atggccgactcccaagtacgacacctaggtgtcagccaaggccccgatccgcatttggtgtaagtggcctcaggatgcttccggaaacagtccgtagggcaggtaaaggtgttgttgccgggagacccagcatggcgtat

SEQ ID NO: 393809 - DNA, 140 bp, Artificial Sequence
  Synthetic
aggccctggctgctgatatgtcatagactgcaacaccaccgtcacgcagacggtggatttcagtctggatcccacctttaccattgagactaccacggtgccccaggacgcagtgtccaggaccttttgggacagcggtg

SEQ ID NO: 393810 - DNA, 140 bp, Artificial Sequence
  Synthetic
caccgctgtcccaaaaggtcctggacactgcgtcctggggcaccgtggtagtctcaatggtaaaggtgggatccagactgaaatccaccgtctgcgtgacggtggtgttgcagtctatgacatatcagcagccagggcct

SEQ ID NO: 393811 - DNA, 140 bp, Artificial Sequence
  Synthetic
atacgccatgctgggtctcctgtgagtgctacgatgccggatgtgcatggtatgatctgacccctgcagagactaccgtgaggttgcgtgcttacctgaacacccccggactccctgtctcgtacttgggagtcggccat

SEQ ID NO: 393812 - DNA, 140 bp, Artificial Sequence
  Synthetic
atggccgactcccaagtacgagacagggagtccgggggtgttcaggtaagcacgcaacctcacggtagtctctgcaggggtcagatcataccatgcacatccggcatcgtagcactcacaggagacccagcatggcgtat

SEQ ID NO: 393813 - DNA, 140 bp, Artificial Sequence
  Synthetic
aggccctggctgctgatatgttggcggagtttacttgttgccgcgcaggggccccaggttgggtgtgcgcgcgactaggaagacttccgagcggtcgcaacctcgtggaaggcgacaaccgaccttttgggacagcggtg

SEQ ID NO: 393814 - DNA, 140 bp, Artificial Sequence
  Synthetic
caccgctgtcccaaaaggtcggttgtcgccttccacgaggttgcgaccgctcggaagtcttcctagtcgcgcgcacacccaacctggggcccctgcgcggcaacaagtaaactccgccaacatatcagcagccagggcct

SEQ ID NO: 393815 - DNA, 140 bp, Artificial Sequence
  Synthetic
atacgccatgctgggtctccatcgacgcccacatgctgtcacagactaaacagggtggggagaacttcccataccttgtagcgtaccaagcaacagtctgtgtccgcgcgaaagcgcccccgtacttgggagtcggccat

SEQ ID NO: 393816 - DNA, 140 bp, Artificial Sequence
  Synthetic
atggccgactcccaagtacgggggcgctttcgcgcggacacagactgttgcttggtacgctacaaggtatgggaagttctccccaccctgtttagtctgtgacagcatgtgggcgtcgatggagacccagcatggcgtat

SEQ ID NO: 393817 - DNA, 140 bp, Artificial Sequence
  Synthetic
atacgccatgctgggtctccccgacctcatggggtacattccgctcgtcggcgcccccctagggggcgctgccagggccctggcgcatggcgtccgggttctggaggacggcgtgaactacgtacttgggagtcggccat

SEQ ID NO: 393818 - DNA, 140 bp, Artificial Sequence
  Synthetic
atggccgactcccaagtacgtagttcacgccgtcctccagaacccggacgccatgcgccagggccctggcagcgccccctaggggggcgccgacgagcggaatgtaccccatgaggtcggggagacccagcatggcgtat

SEQ ID NO: 393819 - DNA, 140 bp, Artificial Sequence
  Synthetic
atacgccatgctgggtctcctgtaccaacaatttgatgagatggaggagtgttcggcctcgttgccctacatggacgaggcacgtgctattgccgagcaattcaaggagaaagtgcttggcgtacttgggagtcggccat

SEQ ID NO: 393820 - DNA, 140 bp, Artificial Sequence
  Synthetic
atggccgactcccaagtacgccaagcactttctccttgaattgctcggcaatagcacgtgcctcgtccatgtagggcaacgaggccgaacactcctccatctcatcaaattgttggtacaggagacccagcatggcgtat

SEQ ID NO: 393821 - DNA, 140 bp, Artificial Sequence
  Synthetic
aggccctggctgctgatatgaaagtgccgtacttcgtgcgcgctcaagggctcatccgtgcatgcatgttggtgcggaaggtcgctgggggtcattatgtccaaatggctttcgtgaagcgaccttttgggacagcggtg

SEQ ID NO: 393822 - DNA, 140 bp, Artificial Sequence
  Synthetic
caccgctgtcccaaaaggtcgcttcacgaaagccatttggacataatgacccccagcgaccttccgcaccaacatgcatgcacggatgagcccttgagcgcgcacgaagtacggcactttcatatcagcagccagggcct

SEQ ID NO: 393823 - DNA, 140 bp, Artificial Sequence
  Synthetic
aggccctggctgctgatatgtcgcagatcgcgccacccacggccgccactgcgttcgtcgttagtgggatggccggggccgcggtcggcagcatcgggctgggtagggtcctcattgacagaccttttgggacagcggtg

SEQ ID NO: 393824 - DNA, 140 bp, Artificial Sequence
  Synthetic
caccgctgtcccaaaaggtctgtcaatgaggaccctacccagcccgatgctgccgaccgcggccccggccatcccactaacgacgaacgcagtggcggccgtgggtggcgcgatctgcgacatatcagcagccagggcct

SEQ ID NO: 393825 - DNA, 140 bp, Artificial Sequence
  Synthetic
aggccctggctgctgatatggtggcgggggcccactggggagtcctggcgggccttgcctactattccatggcggggaactgggccaaggtcttgattgtgatgctgctcttcgccggcggaccttttgggacagcggtg

SEQ ID NO: 393826 - DNA, 140 bp, Artificial Sequence
  Synthetic
caccgctgtcccaaaaggtccgccggcgaagagcagcatcacaatcaagaccttggcccagttccccgccatggaatagtaggcaaggcccgccaggactccccagtgggcccccgccaccatatcagcagccagggcct

SEQ ID NO: 393827 - DNA, 140 bp, Artificial Sequence
  Synthetic
atacgccatgctgggtctccttcaatactctgccctggagccctagtggtcggggtcatatgcgccgcggttttgcggcgccatatcggcccgggcgagggggccgtgcagtggatgaaccgtacttgggagtcggccat

SEQ ID NO: 393828 - DNA, 140 bp, Artificial Sequence
  Synthetic
atggccgactcccaagtacggttcatccactgcacggccccctcgcccgggccgatatggcgccgcaaaaccgcggcgcatatgaccccgaccactagggctccagggcagagtattgaaggagacccagcatggcgtat

SEQ ID NO: 393829 - DNA, 140 bp, Artificial Sequence
  Synthetic
atacgccatgctgggtctccaggctgatcgcgttcgcctcccgaggcaatcatgtgtctccgacacactacgtgcccgagaccgacgcgtcggccaaagtcacacagctgctcagctccccgtacttgggagtcggccat

SEQ ID NO: 393830 - DNA, 140 bp, Artificial Sequence
  Synthetic
atggccgactcccaagtacggggagctgagcagctgtgtgactttggccgacgcgtcggtctcgggcacgtagtgtgtcggagacacatgattgcctcgggaggcgaacgcgatcagcctggagacccagcatggcgtat

SEQ ID NO: 393831 - DNA, 140 bp, Artificial Sequence
  Synthetic
aggccctggctgctgatatgaccagaggccctattgctggcactacgcgcctcgaccatgtggtatcgtacccgcgtcgcaggtgtgtggtccagtatactgcttcaccccaagccctgtgaccttttgggacagcggtg

SEQ ID NO: 393832 - DNA, 140 bp, Artificial Sequence
  Synthetic
caccgctgtcccaaaaggtcacagggcttggggtgaagcagtatactggaccacacacctgcgacgcgggtacgataccacatggtcgaggcgcgtagtgccagcaatagggcctctggtcatatcagcagccagggcct

SEQ ID NO: 393833 - DNA, 140 bp, Artificial Sequence
  Synthetic
atacgccatgctgggtctccgatatctggccacgtgaaaaacggaaccatgaggatcgtcggcccgaagctgtgcagcaacacctggcacggaaccttccccatcaacgccacaacaacgcgtacttgggagtcggccat

SEQ ID NO: 393834 - DNA, 140 bp, Artificial Sequence
  Synthetic
atggccgactcccaagtacgcgttgttgtggcgttgatggggaaggttccgtgccaggtgttgctgcacagcttcgggccgacgatcctcatggttccgtttttcacgtggccagatatcggagacccagcatggcgtat

SEQ ID NO: 393835 - DNA, 140 bp, Artificial Sequence
  Synthetic
aggccctggctgctgatatgtgtgcagcaacacctggcacggaaccttccccatcaacgccacaacaacggggcccagtgtgcctgctccggcccccaactacaaatttgccttgtggaggaccttttgggacagcggtg

SEQ ID NO: 393836 - DNA, 140 bp, Artificial Sequence
  Synthetic
caccgctgtcccaaaaggtcctccacaaggcaaatttgtagttgggggccggagcaggcacactgggccccgttgttgtggcgttgatggggaaggttccgtgccaggtgttgctgcacacatatcagcagccagggcct

SEQ ID NO: 393837 - DNA, 140 bp, Artificial Sequence
  Synthetic
aggccctggctgctgatatgtctccagagttcttcacggagctggacggcgtgaggattcaccgctacgcgccaccctgcaaccccctcctaagggaggaggtctgcttctccgtggggcgaccttttgggacagcggtg

SEQ ID NO: 393838 - DNA, 140 bp, Artificial Sequence
  Synthetic
caccgctgtcccaaaaggtcgccccacggagaagcagacctcctcccttaggagggggttgcagggtggcgcgtagcggtgaatcctcacgccgtccagctccgtgaagaactctggagacatatcagcagccagggcct

SEQ ID NO: 393839 - DNA, 140 bp, Artificial Sequence
  Synthetic
aggccctggctgctgatatggctgctgctatctacaacagaatggcagatattgccctgttccttcaccaccctaccggctctgtccactggtttgatccatctccaccagaacatcgtggaccttttgggacagcggtg

SEQ ID NO: 393840 - DNA, 140 bp, Artificial Sequence
  Synthetic
caccgctgtcccaaaaggtccacgatgttctggtggagatggatcaaaccagtggacagagccggtagggtggtgaaggaacagggcaatatctgccattctgttgtagatagcagcagccatatcagcagccagggcct

SEQ ID NO: 393841 - DNA, 140 bp, Artificial Sequence
  Synthetic
atacgccatgctgggtctccgacggccaagcgcaggctagatcgagggtctccgccctctctagctagctcctcggccagccaactctcggccccctcccttaaggctacttgcactacacgtacttgggagtcggccat

SEQ ID NO: 393842 - DNA, 140 bp, Artificial Sequence
  Synthetic
atggccgactcccaagtacgtgtagtgcaagtagccttaagggagggggccgagagttggctggccgaggagctagctagagagggcggagaccctcgatctagcctgcgcttggccgtcggagacccagcatggcgtat

SEQ ID NO: 393843 - DNA, 140 bp, Artificial Sequence
  Synthetic
atacgccatgctgggtctcccttctatggcaaagccatccccctcgacaccatcaagggggggaggcatcttattttttggcactccaagaagaagtgtgacgagctcgctacgaagttgcgtacttgggagtcggccat

SEQ ID NO: 393844 - DNA, 140 bp, Artificial Sequence
  Synthetic
atggccgactcccaagtacgcaacttcgtagcgagctcgtcacacttcttcttggagtgccaaaaaataagatgcctcccccccttgatggtgtcgagggggatggctttgccatagaagggagacccagcatggcgtat

SEQ ID NO: 393845 - DNA, 140 bp, Artificial Sequence
  Synthetic
atacgccatgctgggtctcctgatccttgactcctttgagccgcttaaggcggatgacgacgacagagagatctctgtgtccgctgactgctttaggaggggaccggcgtttccccccgccgtacttgggagtcggccat

SEQ ID NO: 393846 - DNA, 140 bp, Artificial Sequence
  Synthetic
atggccgactcccaagtacggcggggggaaacgccggtcccctcctaaagcagtcagcggacacagagatctctctgtcgtcgtcatccgccttaagcggctcaaaggagtcaaggatcaggagacccagcatggcgtat

SEQ ID NO: 393847 - DNA, 140 bp, Artificial Sequence
  Synthetic
atacgccatgctgggtctcccctgcgggcctcccacctgtcccgcctccacggaggaagaggaaaccggtggtgctatctgactccaacgtgtcccaagtcctggccgacttggcgcacgcgtacttgggagtcggccat

SEQ ID NO: 393848 - DNA, 140 bp, Artificial Sequence
  Synthetic
atggccgactcccaagtacgcgtgcgccaagtcggccaggacttgggacacgttggagtcagatagcaccaccggtttcctcttcctccgtggaggcgggacaggtgggaggcccgcaggggagacccagcatggcgtat

SEQ ID NO: 393849 - DNA, 140 bp, Artificial Sequence
  Synthetic
atacgccatgctgggtctccctcggacgcggcttcatattcttccatgcctccgctggagggcgagcctggggaccctgacctttcatcagggtcgtggtcaactgtcagcgatgaggaccgtacttgggagtcggccat

SEQ ID NO: 393850 - DNA, 140 bp, Artificial Sequence
  Synthetic
atggccgactcccaagtacggtcctcatcgctgacagttgaccacgaccctgatgaaaggtcagggtccccaggctcgccctccagcggaggcatggaagaatatgaagccgcgtccgagggagacccagcatggcgtat

SEQ ID NO: 393851 - DNA, 140 bp, Artificial Sequence
  Synthetic
aggccctggctgctgatatgcgctcaagggctcattcgtgcatgcatgctggtgcggaaagtcgctgggggtcattatgtccaaatggctttcatgaagctggccgcgctgacaggtacggaccttttgggacagcggtg

SEQ ID NO: 393852 - DNA, 140 bp, Artificial Sequence
  Synthetic
caccgctgtcccaaaaggtccgtacctgtcagcgcggccagcttcatgaaagccatttggacataatgacccccagcgactttccgcaccagcatgcatgcacgaatgagcccttgagcgcatatcagcagccagggcct

SEQ ID NO: 393853 - DNA, 140 bp, Artificial Sequence
  Synthetic
aggccctggctgctgatatggtcattatgtccaaatggctttcatgaagctggccgcgctgacaggtacgtacgtttatgaccatcttactccactgcgggactgggcccacgcgggcctgaccttttgggacagcggtg

SEQ ID NO: 393854 - DNA, 140 bp, Artificial Sequence
  Synthetic
caccgctgtcccaaaaggtcaggcccgcgtgggcccagtcccgcagtggagtaagatggtcataaacgtacgtacctgtcagcgcggccagcttcatgaaagccatttggacataatgaccatatcagcagccagggcct

SEQ ID NO: 393855 - DNA, 140 bp, Artificial Sequence
  Synthetic
aggccctggctgctgatatgtacgtttatgaccatcttactccactgcgggactgggcccacgcgggcctgcgagaccttgcggtggcagttgagcccgtcgtcttctctgacatggagagaccttttgggacagcggtg

SEQ ID NO: 393856 - DNA, 140 bp, Artificial Sequence
  Synthetic
caccgctgtcccaaaaggtctctccatgtcagagaagacgacgggctcaactgccaccgcaaggtctcgcaggcccgcgtgggcccagtcccgcagtggagtaagatggtcataaacgtacatatcagcagccagggcct

SEQ ID NO: 393857 - DNA, 140 bp, Artificial Sequence
  Synthetic
atacgccatgctgggtctccaagccagactgctgcctctagaggaagcttgtgggttaacaccaccccattccgcccgttccaagtatggatacggcgctaaggaggttcgctctctcgacgtacttgggagtcggccat

SEQ ID NO: 393858 - DNA, 140 bp, Artificial Sequence
  Synthetic
atggccgactcccaagtacgtcgagagagcgaacctccttagcgccgtatccatacttggaacgggcggaatggggtggtgttaacccacaagcttcctctagaggcagcagtctggcttggagacccagcatggcgtat

SEQ ID NO: 393859 - DNA, 140 bp, Artificial Sequence
  Synthetic
atacgccatgctgggtctcctctccagcgcagcgggttgaatttttattgaagacgtggaggtctaaaaagactcccatggccttctcctatgatacccgctgctttgactcaaccgttacgtacttgggagtcggccat

SEQ ID NO: 393860 - DNA, 140 bp, Artificial Sequence
  Synthetic
atggccgactcccaagtacgtaacggttgagtcaaagcagcgggtatcataggagaaggccatgggagtctttttagacctccacgtcttcaataaaaattcaacccgctgcgctggagaggagacccagcatggcgtat

SEQ ID NO: 393861 - DNA, 140 bp, Artificial Sequence
  Synthetic
aggccctggctgctgatatggactcccatggccttctcctatgatacccgctgctttgactcaaccgttaccgaacatgacataatgactgaagagtctatctaccaatcatgtgacttggaccttttgggacagcggtg

SEQ ID NO: 393862 - DNA, 140 bp, Artificial Sequence
  Synthetic
caccgctgtcccaaaaggtccaagtcacatgattggtagatagactcttcagtcattatgtcatgttcggtaacggttgagtcaaagcagcgggtatcataggagaaggccatgggagtccatatcagcagccagggcct

SEQ ID NO: 393863 - DNA, 140 bp, Artificial Sequence
  Synthetic
atacgccatgctgggtctccgcgtgggagactgctaaacactccccagttaactcctggttggggaacatcatcatgtacgctccgaccctgtgggctcggatagtgctgatgacgcactcgtacttgggagtcggccat

SEQ ID NO: 393864 - DNA, 140 bp, Artificial Sequence
  Synthetic
atggccgactcccaagtacgagtgcgtcatcagcactatccgagcccacagggtcggagcgtacatgatgatgttccccaaccaggagttaactggggagtgtttagcagtctcccacgcggagacccagcatggcgtat

SEQ ID NO: 393865 - DNA, 140 bp, Artificial Sequence
  Synthetic
aggccctggctgctgatatgcatcatgtacgctccgaccctgtgggctcggatagtgctgatgacgcactttttcagcgtactgcagagccaggagcaactggaaaaagccctagcatttgaccttttgggacagcggtg

SEQ ID NO: 393866 - DNA, 140 bp, Artificial Sequence
  Synthetic
caccgctgtcccaaaaggtcaaatgctagggctttttccagttgctcctggctctgcagtacgctgaaaaagtgcgtcatcagcactatccgagcccacagggtcggagcgtacatgatgcatatcagcagccagggcct

SEQ ID NO: 393867 - DNA, 140 bp, Artificial Sequence
  Synthetic
atacgccatgctgggtctcccatgcacaccatctgcccctgtggagcacaaatcgccggacatttcaaaaatggttccatgaagatcgtcgggcctaaaacctgtagcaacacgtgggaccgtacttgggagtcggccat

SEQ ID NO: 393868 - DNA, 140 bp, Artificial Sequence
  Synthetic
atggccgactcccaagtacggtcccacgtgttgctacaggttttaggcccgacgatcttcatggaaccatttttgaaatgtccggcgatttgtgctccacaggggcagatggtgtgcatgggagacccagcatggcgtat

SEQ ID NO: 393869 - DNA, 140 bp, Artificial Sequence
  Synthetic
atacgccatgctgggtctcctaaacactccataactcctgttttttttttttttttttttttttttttcttttttttttcttttcctgttctttttttttttttaaatctttggtggctccgtacttgggagtcggccat

SEQ ID NO: 393870 - DNA, 140 bp, Artificial Sequence
  Synthetic
atggccgactcccaagtacggagccaccaaagatttaaaaaaaaaaaaagaacaggaaaagaaaaaaaaaagaaaaaaaaaaaaaaaaaaaaaaaaaaaacaggagttatggagtgtttaggagacccagcatggcgtat

SEQ ID NO: 393871 - DNA, 140 bp, Artificial Sequence
  Synthetic
aggccctggctgctgatatgtcacccgtgtcgagtcagagaataaggtagtgattctggactcttttgacccgcttcgagcggaagaggatgaaagggaagtgtccgtcgcggcggagatgaccttttgggacagcggtg

SEQ ID NO: 393872 - DNA, 140 bp, Artificial Sequence
  Synthetic
caccgctgtcccaaaaggtcatctccgccgcgacggacacttccctttcatcctcttccgctcgaagcgggtcaaaagagtccagaatcactaccttattctctgactcgacacgggtgacatatcagcagccagggcct

SEQ ID NO: 393873 - DNA, 140 bp, Artificial Sequence
  Synthetic
aggccctggctgctgatatgcggactacaacccaccactgctagagccctggagggacccggactacgcccctccggtggtacatgggtgcccattgccacctgccaaggaccctccaatgaccttttgggacagcggtg

SEQ ID NO: 393874 - DNA, 140 bp, Artificial Sequence
  Synthetic
caccgctgtcccaaaaggtcattggagggtccttggcaggtggcaatgggcacccatgtaccaccggaggggcgtagtccgggtccctccagggctctagcagtggtgggttgtagtccgcatatcagcagccagggcct

SEQ ID NO: 393875 - DNA, 140 bp, Artificial Sequence
  Synthetic
aggccctggctgctgatatgccgcaagcacccagacgccacctacaccaagtgtgggtcaggaccctggctcactccccggtgtctggtgcattacccttaccggttgtggcattacccggaccttttgggacagcggtg

SEQ ID NO: 393876 - DNA, 140 bp, Artificial Sequence
  Synthetic
caccgctgtcccaaaaggtccgggtaatgccacaaccggtaagggtaatgcaccagacaccggggagtgagccagggtcctgacccacacttggtgtaggtggcgtctgggtgcttgcggcatatcagcagccagggcct

SEQ ID NO: 393877 - DNA, 140 bp, Artificial Sequence
  Synthetic
atacgccatgctgggtctccttagagccctggaaagacccggactacgtccctccagtggtacatgggtgcccattgccacccgctaaggcccccccaataccacccccacggaggaagacgtacttgggagtcggccat

SEQ ID NO: 393878 - DNA, 140 bp, Artificial Sequence
  Synthetic
atggccgactcccaagtacgtcttcctccgtgggggtggtattgggggggccttagcgggtggcaatgggcacccatgtaccactggagggacgtagtccgggtctttccagggctctaaggagacccagcatggcgtat

SEQ ID NO: 393879 - DNA, 140 bp, Artificial Sequence
  Synthetic
aggccctggctgctgatatggtgtcaactgccgcccaaaccttcctggcaacgtgcatcaacggggtatgctggactgtctatcacggggccggaacgaggaccatcgcatcacccaagggaccttttgggacagcggtg

SEQ ID NO: 393880 - DNA, 140 bp, Artificial Sequence
  Synthetic
caccgctgtcccaaaaggtcccttgggtgatgcgatggtcctcgttccggccccgtgatagacagtccagcataccccgttgatgcacgttgccaggaaggtttgggcggcagttgacaccatatcagcagccagggcct

SEQ ID NO: 393881 - DNA, 140 bp, Artificial Sequence
  Synthetic
aggccctggctgctgatatggctggggtgaaaacgagacggacgtcttcgtcctcaacaacaccaggccaccgctgggcaattggttcggttgtacttggatgaactcaactggattcacgaccttttgggacagcggtg

SEQ ID NO: 393882 - DNA, 140 bp, Artificial Sequence
  Synthetic
caccgctgtcccaaaaggtcgtgaatccagttgagttcatccaagtacaaccgaaccaattgcccagcggtggcctggtgttgttgaggacgaagacgtccgtctcgttttcaccccagccatatcagcagccagggcct

SEQ ID NO: 393883 - DNA, 140 bp, Artificial Sequence
  Synthetic
atacgccatgctgggtctccgggggctgacacggccgcatgtggggacatacttgccggccttcctgtatcagctaggcgaggccatgaaatcttcctggggccagccgatgacatcagacgtacttgggagtcggccat

SEQ ID NO: 393884 - DNA, 140 bp, Artificial Sequence
  Synthetic
atggccgactcccaagtacgtctgatgtcatcggctggccccaggaagatttcatggcctcgcctagctgatacaggaaggccggcaagtatgtccccacatgcggccgtgtcagcccccggagacccagcatggcgtat

SEQ ID NO: 393885 - DNA, 140 bp, Artificial Sequence
  Synthetic
aggccctggctgctgatatgagccaggcatctacagatttgtggcaccgggggagcgcccctccggcatgttcgactcgtccgtcctctgtgagtgctatgacgcgggctgtgcttggtagaccttttgggacagcggtg

SEQ ID NO: 393886 - DNA, 140 bp, Artificial Sequence
  Synthetic
caccgctgtcccaaaaggtctaccaagcacagcccgcgtcatagcactcacagaggacggacgagtcgaacatgccggaggggcgctcccccggtgccacaaatctgtagatgcctggctcatatcagcagccagggcct

SEQ ID NO: 393887 - DNA, 140 bp, Artificial Sequence
  Synthetic
aggccctggctgctgatatgtgaagggtaggtgggtgcccggagcggtctacgccctctacgggatgtggcctctcctcctgctcctgttggcgttgccccagcgggcatacgcgctggagaccttttgggacagcggtg

SEQ ID NO: 393888 - DNA, 140 bp, Artificial Sequence
  Synthetic
caccgctgtcccaaaaggtctccagcgcgtatgcccgctggggcaacgccaacaggagcaggaggagaggccacatcccgtagagggcgtagaccgctccgggcacccacctacccttcacatatcagcagccagggcct

SEQ ID NO: 393889 - DNA, 140 bp, Artificial Sequence
  Synthetic
aggccctggctgctgatatggacatcatcaacggcttgcccgtctctgcccgcaggggccgggagatactgctcggaccggccgatggaatggtctccaaggggtggaggttgctggcgcgaccttttgggacagcggtg

SEQ ID NO: 393890 - DNA, 140 bp, Artificial Sequence
  Synthetic
caccgctgtcccaaaaggtcgcgccagcaacctccaccccttggagaccattccatcggccggtccgagcagtatctcccggcccctgcgggcagagacgggcaagccgttgatgatgtccatatcagcagccagggcct

SEQ ID NO: 393891 - DNA, 140 bp, Artificial Sequence
  Synthetic
aggccctggctgctgatatgattgcctttgcttccagaggaaaccacgtcgcccctactcactacgtgacggagtcggatgcgtcgcagcgtgtgacccaactacttggctctcttactagaccttttgggacagcggtg

SEQ ID NO: 393892 - DNA, 140 bp, Artificial Sequence
  Synthetic
caccgctgtcccaaaaggtctagtaagagagccaagtagttgggtcacacgctgcgacgcatccgactccgtcacgtagtgagtaggggcgacgtggtttcctctggaagcaaaggcaatcatatcagcagccagggcct

SEQ ID NO: 393893 - DNA, 140 bp, Artificial Sequence
  Synthetic
aggccctggctgctgatatggcgtcgtgtggcggcgttgttcttgtcgggttgatggcgctgactctgtcaccgtattacaagcgctatatcagctggtgcttatggtggcttcagtattgaccttttgggacagcggtg

SEQ ID NO: 393894 - DNA, 140 bp, Artificial Sequence
  Synthetic
caccgctgtcccaaaaggtcaatactgaagccaccataagcaccagctgatatagcgcttgtaatacggtgacagagtcagcgccatcaacccgacaagaacaacgccgccacacgacgccatatcagcagccagggcct

SEQ ID NO: 393895 - DNA, 140 bp, Artificial Sequence
  Synthetic
aggccctggctgctgatatggagtttttctcctgggtggacggtgtgcagatccataggtttgcacccacaccaaagccgtttttccgggatgaggtctcgttctgcgttgggcttaattgaccttttgggacagcggtg

SEQ ID NO: 393896 - DNA, 140 bp, Artificial Sequence
  Synthetic
caccgctgtcccaaaaggtcaattaagcccaacgcagaacgagacctcatcccggaaaaacggctttggtgtgggtgcaaacctatggatctgcacaccgtccacccaggagaaaaactccatatcagcagccagggcct

SEQ ID NO: 393897 - DNA, 140 bp, Artificial Sequence
  Synthetic
atacgccatgctgggtctccgtgctgctccatgtcatactcctggaccggggctctaataactccctgtagccccgaagaggaaaagttgccaatcaaccctttgagtaactcgctgttgcgtacttgggagtcggccat

SEQ ID NO: 393898 - DNA, 140 bp, Artificial Sequence
  Synthetic
atggccgactcccaagtacgcaacagcgagttactcaaagggttgattggcaacttttcctcttcggggctacagggagttattagagccccggtccaggagtatgacatggagcagcacggagacccagcatggcgtat

SEQ ID NO: 393899 - DNA, 140 bp, Artificial Sequence
  Synthetic
aggccctggctgctgatatgatacgacgccacgtcgacttgctcgttggggcggctgctttctgctccgctatgtacgtgggggatctctgcggatctgttttcctcgtctcccagctgtgaccttttgggacagcggtg

SEQ ID NO: 393900 - DNA, 140 bp, Artificial Sequence
  Synthetic
caccgctgtcccaaaaggtcacagctgggagacgaggaaaacagatccgcagagatcccccacgtacatagcggagcagaaagcagccgccccaacgagcaagtcgacgtggcgtcgtatcatatcagcagccagggcct

SEQ ID NO: 393901 - DNA, 140 bp, Artificial Sequence
  Synthetic
aggccctggctgctgatatgatcgaggaggtggccctgtccaacactggggagatccccttttatggcaaagccatccccatcgagaccatcaagggggggagacatctcatcttctgccgaccttttgggacagcggtg

SEQ ID NO: 393902 - DNA, 140 bp, Artificial Sequence
  Synthetic
caccgctgtcccaaaaggtcggcagaagatgagatgtctcccccccttgatggtctcgatggggatggctttgccataaaaggggatctccccagtgttggacagggccacctcctcgatcatatcagcagccagggcct

SEQ ID NO: 393903 - DNA, 140 bp, Artificial Sequence
  Synthetic
aggccctggctgctgatatgacggcagctggcacatcaaccgcacggccttgaactgtaatgagagcctcgacactggctgggtagcggggctcctctattaccacaaattcaactcttcgaccttttgggacagcggtg

SEQ ID NO: 393904 - DNA, 140 bp, Artificial Sequence
  Synthetic
caccgctgtcccaaaaggtcgaagagttgaatttgtggtaatagaggagccccgctacccagccagtgtcgaggctctcattacagttcaaggccgtgcggttgatgtgccagctgccgtcatatcagcagccagggcct

SEQ ID NO: 393905 - DNA, 140 bp, Artificial Sequence
  Synthetic
atacgccatgctgggtctccggaaaccaccgtcagcgggggacaagctggcagagctgcattcgggatcgccacccttttcagtacgggtgccaagcaggacattcagctgatcaactcccgtacttgggagtcggccat

SEQ ID NO: 393906 - DNA, 140 bp, Artificial Sequence
  Synthetic
atggccgactcccaagtacgggagttgatcagctgaatgtcctgcttggcacccgtactgaaaagggtggcgatcccgaatgcagctctgccagcttgtcccccgctgacggtggtttccggagacccagcatggcgtat

SEQ ID NO: 393907 - DNA, 140 bp, Artificial Sequence
  Synthetic
atacgccatgctgggtctcccagcgtggtcattgtgggcaggatcatcttgtccgggaagccggctgtcattcccgacagggaagttctctatcgggagttcgatgagatggaagagtgccgtacttgggagtcggccat

SEQ ID NO: 393908 - DNA, 140 bp, Artificial Sequence
  Synthetic
atggccgactcccaagtacggcactcttccatctcatcgaactcccgatagagaacttccctgtcgggaatgacagccggcttcccggacaagatgatcctgcccacaatgaccacgctgggagacccagcatggcgtat

SEQ ID NO: 393909 - DNA, 140 bp, Artificial Sequence
  Synthetic
aggccctggctgctgatatgttgttgccgcgcaggggcccccggttgggtgtgcgcgcgacgagaaagacttccgagcgatcccagcccagaggcaggcgccaacctataccaaaggcgcgaccttttgggacagcggtg

SEQ ID NO: 393910 - DNA, 140 bp, Artificial Sequence
  Synthetic
caccgctgtcccaaaaggtcgcgcctttggtataggttggcgcctgcctctgggctgggatcgctcggaagtctttctcgtcgcgcgcacacccaaccgggggcccctgcgcggcaacaacatatcagcagccagggcct

SEQ ID NO: 393911 - DNA, 140 bp, Artificial Sequence
  Synthetic
atacgccatgctgggtctccctcccggccacattggggccctaatgacccccggcgtcgatcccggaatttgggtaaggttatcgataccctaacgtgtgggttcgccgatctcatggggcgtacttgggagtcggccat

SEQ ID NO: 393912 - DNA, 140 bp, Artificial Sequence
  Synthetic
atggccgactcccaagtacgccccatgagatcggcgaacccacacgttagggtatcgataaccttacccaaattccgggatcgacgccgggggtcattagggccccaatgtggccgggagggagacccagcatggcgtat

SEQ ID NO: 393913 - DNA, 140 bp, Artificial Sequence
  Synthetic
aggccctggctgctgatatgtgggtaaggttatcgataccctaacgtgtgggttcgccgatctcatggggtacattcccgtcgtgggcgcgcccttgggcggcgtcgcggctgcgctcgcgaccttttgggacagcggtg

SEQ ID NO: 393914 - DNA, 140 bp, Artificial Sequence
  Synthetic
caccgctgtcccaaaaggtcgcgagcgcagccgcgacgccgcccaagggcgcgcccacgacgggaatgtaccccatgagatcggcgaacccacacgttagggtatcgataaccttacccacatatcagcagccagggcct

SEQ ID NO: 393915 - DNA, 140 bp, Artificial Sequence
  Synthetic
aggccctggctgctgatatggagacatttatcacagcgtgtctcgtgcccggccccgctggttctggttttgcctactcctgcttgctgcaggggtaggcatctacctcctccccaaccggaccttttgggacagcggtg

SEQ ID NO: 393916 - DNA, 140 bp, Artificial Sequence
  Synthetic
caccgctgtcccaaaaggtccggttggggaggaggtagatgcctacccctgcagcaagcaggagtaggcaaaaccagaaccagcggggccgggcacgagacacgctgtgataaatgtctccatatcagcagccagggcct

SEQ ID NO: 393917 - DNA, 140 bp, Artificial Sequence
  Synthetic
aggccctggctgctgatatgagcatcttgagggtacctgagatctgtgcgagtgtgatatttggtggccattgggggatactactagccgttgcctactttggtatggctggcaactggcgaccttttgggacagcggtg

SEQ ID NO: 393918 - DNA, 140 bp, Artificial Sequence
  Synthetic
caccgctgtcccaaaaggtcgccagttgccagccataccaaagtaggcaacggctagtagtatcccccaatggccaccaaatatcacactcgcacagatctcaggtaccctcaagatgctcatatcagcagccagggcct

SEQ ID NO: 393919 - DNA, 140 bp, Artificial Sequence
  Synthetic
atacgccatgctgggtctccttgggggatactactagccgttgcctactttggtatggctggcaactggctaaaagttctggctgttctgttcttatttgcaggggttgaagcaaccacccgtacttgggagtcggccat

SEQ ID NO: 393920 - DNA, 140 bp, Artificial Sequence
  Synthetic
atggccgactcccaagtacgggtggttgcttcaacccctgcaaataagaacagaacagccagaacttttagccagttgccagccataccaaagtaggcaacggctagtagtatcccccaaggagacccagcatggcgtat

SEQ ID NO: 393921 - DNA, 140 bp, Artificial Sequence
  Synthetic
aggccctggctgctgatatgggtgtgcggccctgtttactgcttcacgcccagccctgttgtgataggaaccactgacaggcggggcaaccccacatacacctggggggagaatgagacggaccttttgggacagcggtg

SEQ ID NO: 393922 - DNA, 140 bp, Artificial Sequence
  Synthetic
caccgctgtcccaaaaggtccgtctcattctccccccaggtgtatgtggggttgccccgcctgtcagtggttcctatcacaacagggctgggcgtgaagcagtaaacagggccgcacacccatatcagcagccagggcct

SEQ ID NO: 393923 - DNA, 140 bp, Artificial Sequence
  Synthetic
aggccctggctgctgatatgtgcctgaccgtgcccgcgtcagcctaccaagtacgcaactcctcgggcctttatcatgtcaccaatgattgccctaactcgagtattgtgtacgagacgggaccttttgggacagcggtg

SEQ ID NO: 393924 - DNA, 140 bp, Artificial Sequence
  Synthetic
caccgctgtcccaaaaggtcccgtctcgtacacaatactcgagttagggcaatcattggtgacatgataaaggcccgaggagttgcgtacttggtaggctgacgcgggcacggtcaggcacatatcagcagccagggcct

SEQ ID NO: 393925 - DNA, 140 bp, Artificial Sequence
  Synthetic
atacgccatgctgggtctcctgccccaccgactgcttccgtaaacatccggaagctacataccagcggtgtggatcgggaccctgggtaacacctaggtgtctggtggattacccttacacgtacttgggagtcggccat

SEQ ID NO: 393926 - DNA, 140 bp, Artificial Sequence
  Synthetic
atggccgactcccaagtacgtgtaagggtaatccaccagacacctaggtgttacccagggtcccgatccacaccgctggtatgtagcttccggatgtttacggaagcagtcggtggggcaggagacccagcatggcgtat

SEQ ID NO: 393927 - DNA, 140 bp, Artificial Sequence
  Synthetic
atacgccatgctgggtctccatgttcgtgggaggcattgagcaccggttcgacgccgcatgtaattggaccaggggcgagcggtgcgagctacatgacagagacaggattgaaatgagcccgtacttgggagtcggccat

SEQ ID NO: 393928 - DNA, 140 bp, Artificial Sequence
  Synthetic
atggccgactcccaagtacgggctcatttcaatcctgtctctgtcatgtagctcgcaccgctcgcccctggtccaattacatgcggcgtcgaaccggtgctcaatgcctcccacgaacatggagacccagcatggcgtat

SEQ ID NO: 393929 - DNA, 140 bp, Artificial Sequence
  Synthetic
aggccctggctgctgatatgtgcccactggggagtcctagcgggcatagcgtatttctccatggtggggaactgggcgaaggtcctggtagtgctgttgttgtttgccggcgtcgatgcggaccttttgggacagcggtg

SEQ ID NO: 393930 - DNA, 140 bp, Artificial Sequence
  Synthetic
caccgctgtcccaaaaggtccgcatcgacgccggcaaacaacaacagcactaccaggaccttcgcccagttccccaccatggagaaatacgctatgcccgctaggactccccagtgggcacatatcagcagccagggcct

SEQ ID NO: 393931 - DNA, 140 bp, Artificial Sequence
  Synthetic
aggccctggctgctgatatgggacgtgcagtacctctacggagtctcctcgagcgtcacctcgtgggtagtgaagtgggagtacattgtcctgatgttcctggttctggcagatgctcgggaccttttgggacagcggtg

SEQ ID NO: 393932 - DNA, 140 bp, Artificial Sequence
  Synthetic
caccgctgtcccaaaaggtcccgagcatctgccagaaccaggaacatcaggacaatgtactcccacttcactacccacgaggtgacgctcgaggagactccgtagaggtactgcacgtcccatatcagcagccagggcct

SEQ ID NO: 393933 - DNA, 140 bp, Artificial Sequence
  Synthetic
atacgccatgctgggtctccgctggtggtgggcggtgcttttcctgtgctgtgtttggtatgtgaaaggccgccttgtgcctgcgtgtacctacatggcactgggaatgtggccgttgctcgtacttgggagtcggccat

SEQ ID NO: 393934 - DNA, 140 bp, Artificial Sequence
  Synthetic
atggccgactcccaagtacgagcaacggccacattcccagtgccatgtaggtacacgcaggcacaaggcggcctttcacataccaaacacagcacaggaaaagcaccgcccaccaccagcggagacccagcatggcgtat

SEQ ID NO: 393935 - DNA, 140 bp, Artificial Sequence
  Synthetic
aggccctggctgctgatatgctccactgaggacctggtcaacttactccctgccatcctctcccctggtgccctggtcgtcggggtcgtgtgcgcagcaatactgcgtcggcatgtgggcgaccttttgggacagcggtg

SEQ ID NO: 393936 - DNA, 140 bp, Artificial Sequence
  Synthetic
caccgctgtcccaaaaggtcgcccacatgccgacgcagtattgctgcgcacacgaccccgacgaccagggcaccaggggagaggatggcagggagtaagttgaccaggtcctcagtggagcatatcagcagccagggcct

SEQ ID NO: 393937 - DNA, 140 bp, Artificial Sequence
  Synthetic
aggccctggctgctgatatgcagcacgtgtcactcagatcctctccagccttaccatcactcagctgttgaagaggctccaccagtggattaatgaggactgctccacgccatgctccgggaccttttgggacagcggtg

SEQ ID NO: 393938 - DNA, 140 bp, Artificial Sequence
  Synthetic
caccgctgtcccaaaaggtcccggagcatggcgtggagcagtcctcattaatccactggtggagcctcttcaacagctgagtgatggtaaggctggagaggatctgagtgacacgtgctgcatatcagcagccagggcct

SEQ ID NO: 393939 - DNA, 140 bp, Artificial Sequence
  Synthetic
aggccctggctgctgatatgtatcgtattcccagacttgggagttcgtgtgtgcgagaaaatggccctctacgacgtggtctccactcttcctcaggccgtgatgggctcctcatacggagaccttttgggacagcggtg

SEQ ID NO: 393940 - DNA, 140 bp, Artificial Sequence
  Synthetic
caccgctgtcccaaaaggtctccgtatgaggagcccatcacggcctgaggaagagtggagaccacgtcgtagagggccattttctcgcacacacgaactcccaagtctgggaatacgatacatatcagcagccagggcct

SEQ ID NO: 393941 - DNA, 140 bp, Artificial Sequence
  Synthetic
aggccctggctgctgatatgctttatctatgaccatctcgcccccctctctgactgggctagcgacggactgcgcgatctggcagttgcagtcgagccggtcattttctctcccatggaggaccttttgggacagcggtg

SEQ ID NO: 393942 - DNA, 140 bp, Artificial Sequence
  Synthetic
caccgctgtcccaaaaggtcctccatgggagagaaaatgaccggctcgactgcaactgccagatcgcgcagtccgtcgctagcccagtcagagaggggggcgagatggtcatagataaagcatatcagcagccagggcct

SEQ ID NO: 393943 - DNA, 140 bp, Artificial Sequence
  Synthetic
atacgccatgctgggtctcctgcgcgatctggcagttgcagtcgagccggtcattttctctcccatggagaagaaaatcatcacctggggtgcggacactgccgcgtgcggtgacatcttcgtacttgggagtcggccat

SEQ ID NO: 393944 - DNA, 140 bp, Artificial Sequence
  Synthetic
atggccgactcccaagtacgaagatgtcaccgcacgcggcagtgtccgcaccccaggtgatgattttcttctccatgggagagaaaatgaccggctcgactgcaactgccagatcgcgcaggagacccagcatggcgtat

SEQ ID NO: 393945 - DNA, 140 bp, Artificial Sequence
  Synthetic
aggccctggctgctgatatgggcaattggttcggttgcacctggatgaactcatctggatttaccaaagtgtgcggagcgcctccttgtgccatcggaggggtgggcaacaacaccttgcgaccttttgggacagcggtg

SEQ ID NO: 393946 - DNA, 140 bp, Artificial Sequence
  Synthetic
caccgctgtcccaaaaggtcgcaaggtgttgttgcccacccctccgatggcacaaggaggcgctccgcacactttggtaaatccagatgagttcatccaggtgcaaccgaaccaattgcccatatcagcagccagggcct

SEQ ID NO: 393947 - DNA, 140 bp, Artificial Sequence
  Synthetic
aggccctggctgctgatatgtgcttgtggatgatgttactcatatcccaagcggaggcagctttggagaaccttgtgttgctcaatgcggcgtctctggccgggacgcacggtcttgtgtgaccttttgggacagcggtg

SEQ ID NO: 393948 - DNA, 140 bp, Artificial Sequence
  Synthetic
caccgctgtcccaaaaggtcacacaagaccgtgcgtcccggccagagacgccgcattgagcaacacaaggttctccaaagctgcctccgcttgggatatgagtaacatcatccacaagcacatatcagcagccagggcct

SEQ ID NO: 393949 - DNA, 140 bp, Artificial Sequence
  Synthetic
aggccctggctgctgatatggttggcgttgccccaacgggcatacgcgctggactcggagatggccgcgtcgtgtggcggcgttgttcttgtcgggttaatggcgctaactctgtcaccggaccttttgggacagcggtg

SEQ ID NO: 393950 - DNA, 140 bp, Artificial Sequence
  Synthetic
caccgctgtcccaaaaggtccggtgacagagttagcgccattaacccgacaagaacaacgccgccacacgacgcggccatctccgagtccagcgcgtatgcccgttggggcaacgccaaccatatcagcagccagggcct

SEQ ID NO: 393951 - DNA, 140 bp, Artificial Sequence
  Synthetic
atacgccatgctgggtctccgccgctgttggcacgataggccttgggaaggtgcttgtggacattctggcaggttatggagcaggggtggcgggcgcacttgtggcctttaagatcatgacgtacttgggagtcggccat

SEQ ID NO: 393952 - DNA, 140 bp, Artificial Sequence
  Synthetic
atggccgactcccaagtacgtcatgatcttaaaggccacaagtgcgcccgccacccctgctccataacctgccagaatgtccacaagcaccttcccaaggcctatcgtgccaacagcggcggagacccagcatggcgtat

SEQ ID NO: 393953 - DNA, 140 bp, Artificial Sequence
  Synthetic
aggccctggctgctgatatggaatggtctccaaagggtggaggttgctggcgcctatcacggcgtatgcccagcagacaaggggcctcttgggatgcataattaccagcctgaccggccggaccttttgggacagcggtg

SEQ ID NO: 393954 - DNA, 140 bp, Artificial Sequence
  Synthetic
caccgctgtcccaaaaggtccggccggtcaggctggtaattatgcatcccaagaggccccttgtctgctgggcatacgccgtgataggcgccagcaacctccaccctttggagaccattccatatcagcagccagggcct

SEQ ID NO: 393955 - DNA, 140 bp, Artificial Sequence
  Synthetic
aggccctggctgctgatatgagacagccctcccgactacgggagaaataccattttatggaaaggccatcccccttgagtacatcaaagggggaagacatctcatattctgtcactcaaagaccttttgggacagcggtg

SEQ ID NO: 393956 - DNA, 140 bp, Artificial Sequence
  Synthetic
caccgctgtcccaaaaggtctttgagtgacagaatatgagatgtcttccccctttgatgtactcaagggggatggcctttccataaaatggtatttctcccgtagtcgggagggctgtctcatatcagcagccagggcct

SEQ ID NO: 393957 - DNA, 140 bp, Artificial Sequence
  Synthetic
atacgccatgctgggtctcctcagcttggacccaacattttccatagagactaccactgtccctcaagatgcggtatcacggagccaacgacgaggccgcacggggcggggtaaaccgggcgtacttgggagtcggccat

SEQ ID NO: 393958 - DNA, 140 bp, Artificial Sequence
  Synthetic
atggccgactcccaagtacgcccggtttaccccgccccgtgcggcctcgtcgttggctccgtgataccgcatcttgagggacagtggtagtctctatggaaaatgttgggtccaagctgaggagacccagcatggcgtat

SEQ ID NO: 393959 - DNA, 140 bp, Artificial Sequence
  Synthetic
atacgccatgctgggtctccagtgtacagatttgtctcccaaggggagaggccttcgggtatgttcgacaccgtcgtcctgtgtgaggcttatgacacgggatgcgcgtggtacgaactacgtacttgggagtcggccat

SEQ ID NO: 393960 - DNA, 140 bp, Artificial Sequence
  Synthetic
atggccgactcccaagtacgtagttcgtaccacgcgcatcccgtgtcataagcctcacacaggacgacggtgtcgaacatacccgaaggcctctccccttgggagacaaatctgtacactggagacccagcatggcgtat

SEQ ID NO: 393961 - DNA, 140 bp, Artificial Sequence
  Synthetic
aggccctggctgctgatatgccctccgggctccgtcactgtgccccatcctaacatcgaggaggttgctctgtccaccaccggagagatccccttttacggcaaggctatccccctcgaggaccttttgggacagcggtg

SEQ ID NO: 393962 - DNA, 140 bp, Artificial Sequence
  Synthetic
caccgctgtcccaaaaggtcctcgagggggatagccttgccgtaaaaggggatctctccggtggtggacagagcaacctcctcgatgttaggatggggcacagtgacggagcccggagggcatatcagcagccagggcct

SEQ ID NO: 393963 - DNA, 140 bp, Artificial Sequence
  Synthetic
aggccctggctgctgatatgtcgtgagatcttataccagcaatttgacgagatggaggagtgctctaggcacatcccctacctcgctgagggccagcagatcgccgaacagttcagacaagaccttttgggacagcggtg

SEQ ID NO: 393964 - DNA, 140 bp, Artificial Sequence
  Synthetic
caccgctgtcccaaaaggtcttgtctgaactgttcggcgatctgctggccctcagcgaggtaggggatgtgcctagagcactcctccatctcgtcaaattgctggtataagatctcacgacatatcagcagccagggcct

SEQ ID NO: 393965 - DNA, 140 bp, Artificial Sequence
  Synthetic
atacgccatgctgggtctccacatcccctacctcgctgagggccagcagatcgccgaacagttcagacaaaaggtgttgggactcctccaagcgagcgctaagcaggcagaagaactgaacgtacttgggagtcggccat

SEQ ID NO: 393966 - DNA, 140 bp, Artificial Sequence
  Synthetic
atggccgactcccaagtacgttcagttcttctgcctgcttagcgctcgcttggaggagtcccaacaccttttgtctgaactgttcggcgatctgctggccctcagcgaggtaggggatgtggagacccagcatggcgtat

SEQ ID NO: 393967 - DNA, 140 bp, Artificial Sequence
  Synthetic
atacgccatgctgggtctccacatgtggaactttgtcagcggaattcagtacttggcgggcttatccactctgcccggcaacccagccgtggcatcattgatgtcatttacagcgtcgctcgtacttgggagtcggccat

SEQ ID NO: 393968 - DNA, 140 bp, Artificial Sequence
  Synthetic
atggccgactcccaagtacgagcgacgctgtaaatgacatcaatgatgccacggctgggttgccgggcagagtggataagcccgccaagtactgaattccgctgacaaagttccacatgtggagacccagcatggcgtat

SEQ ID NO: 393969 - DNA, 140 bp, Artificial Sequence
  Synthetic
aggccctggctgctgatatgctgcccggcaacccagccgtggcatcattgatgtcatttacagcgtcgctgaccagtcctctgaggacttctcagaccctgctcctcaacatactcggtggaccttttgggacagcggtg

SEQ ID NO: 393970 - DNA, 140 bp, Artificial Sequence
  Synthetic
caccgctgtcccaaaaggtccaccgagtatgttgaggagcagggtctgagaagtcctcagaggactggtcagcgacgctgtaaatgacatcaatgatgccacggctgggttgccgggcagcatatcagcagccagggcct

SEQ ID NO: 393971 - DNA, 140 bp, Artificial Sequence
  Synthetic
aggccctggctgctgatatggctggcacatcaacaggactgccctgaactgcaatgactccctccacactgggttccttgccgcgctgttctacacatcgcgcttcaacgcgtccggatggaccttttgggacagcggtg

SEQ ID NO: 393972 - DNA, 140 bp, Artificial Sequence
  Synthetic
caccgctgtcccaaaaggtccatccggacgcgttgaagcgcgatgtgtagaacagcgcggcaaggaacccagtgtggagggagtcattgcagttcagggcagtcctgttgatgtgccagccatatcagcagccagggcct

SEQ ID NO: 393973 - DNA, 140 bp, Artificial Sequence
  Synthetic
aggccctggctgctgatatggttggttgatgtgctcgccggatacggagccggtgtgtcgggtgctctagtcgctttcaagatcatgagcggcgattgcccgaccacggaagacatggtcgaccttttgggacagcggtg

SEQ ID NO: 393974 - DNA, 140 bp, Artificial Sequence
  Synthetic
caccgctgtcccaaaaggtcgaccatgtcttccgtggtcgggcaatcgccgctcatgatcttgaaagcgactagagcacccgacacaccggctccgtatccggcgagcacatcaaccaaccatatcagcagccagggcct

SEQ ID NO: 393975 - DNA, 140 bp, Artificial Sequence
  Synthetic
aggccctggctgctgatatggtgtggtccagtgtattgcttcaccccaagccctgttgtggtggggacgaccgaccgtttcggcgcccctacgtacaggtggggggagaatgagacggacgaccttttgggacagcggtg

SEQ ID NO: 393976 - DNA, 140 bp, Artificial Sequence
  Synthetic
caccgctgtcccaaaaggtcgtccgtctcattctccccccacctgtacgtaggggcgccgaaacggtcggtcgtccccaccacaacagggcttggggtgaagcaatacactggaccacaccatatcagcagccagggcct

SEQ ID NO: 393977 - DNA, 140 bp, Artificial Sequence
  Synthetic
aggccctggctgctgatatggctctctggcgggtatctgccgaggactacgttgaggtacggaggttgggcgactgccattacgtggtaggggtcactgctgaagggctgaagtgcccttgaccttttgggacagcggtg

SEQ ID NO: 393978 - DNA, 140 bp, Artificial Sequence
  Synthetic
caccgctgtcccaaaaggtcaagggcacttcagcccttcagcagtgacccctaccacgtaatggcagtcgcccaacctccgtacctcaacgtagtcctcggcagatacccgccagagagccatatcagcagccagggcct

SEQ ID NO: 393979 - DNA, 140 bp, Artificial Sequence
  Synthetic
atacgccatgctgggtctccgccaggtgcctgcgcctgaattcttcaccgaggtcgatggcgtgaggatacaccgttacgcgccaccttgcaagcccttgctcagggacgaagtgactttcgtacttgggagtcggccat

SEQ ID NO: 393980 - DNA, 140 bp, Artificial Sequence
  Synthetic
atggccgactcccaagtacgaaagtcacttcgtccctgagcaagggcttgcaaggtggcgcgtaacggtgtatcctcacgccatcgacctcggtgaagaattcaggcgcaggcacctggcggagacccagcatggcgtat

SEQ ID NO: 393981 - DNA, 140 bp, Artificial Sequence
  Synthetic
aggccctggctgctgatatgcaccgttacgcgccaccttgcaagcccttgctcagggacgaagtgactttctctgtgggtctttcaaactatgccatagggtcgcagctcccttgcgagcgaccttttgggacagcggtg

SEQ ID NO: 393982 - DNA, 140 bp, Artificial Sequence
  Synthetic
caccgctgtcccaaaaggtcgctcgcaagggagctgcgaccctatggcatagtttgaaagacccacagagaaagtcacttcgtccctgagcaagggcttgcaaggtggcgcgtaacggtgcatatcagcagccagggcct

SEQ ID NO: 393983 - DNA, 140 bp, Artificial Sequence
  Synthetic
atacgccatgctgggtctccctctgtgggtctttcaaactatgccatagggtcgcagctcccttgcgagccagagcctgacgtgaccgtagtcacctcaatgctcacagaccccacgcaccgtacttgggagtcggccat

SEQ ID NO: 393984 - DNA, 140 bp, Artificial Sequence
  Synthetic
atggccgactcccaagtacggtgcgtggggtctgtgagcattgaggtgactacggtcacgtcaggctctggctcgcaagggagctgcgaccctatggcatagtttgaaagacccacagagggagacccagcatggcgtat

SEQ ID NO: 393985 - DNA, 140 bp, Artificial Sequence
  Synthetic
atacgccatgctgggtctcccttagccagctcttcggccagccagctgtctgcaccgtccctcaaggctacttgcacaacctccaaagaccacccggacatggaactcattgaggccaaccgtacttgggagtcggccat

SEQ ID NO: 393986 - DNA, 140 bp, Artificial Sequence
  Synthetic
atggccgactcccaagtacggttggcctcaatgagttccatgtccgggtggtctttggaggttgtgcaagtagccttgagggacggtgcagacagctggctggccgaagagctggctaagggagacccagcatggcgtat

SEQ ID NO: 393987 - DNA, 140 bp, Artificial Sequence
  Synthetic
aggccctggctgctgatatgcttgcacaacctccaaagaccacccggacatggaactcattgaggccaacctcctctggaggcaggagatgggaggcaacatcactcgagtcgagtcagagaccttttgggacagcggtg

SEQ ID NO: 393988 - DNA, 140 bp, Artificial Sequence
  Synthetic
caccgctgtcccaaaaggtctctgactcgactcgagtgatgttgcctcccatctcctgcctccagaggaggttggcctcaatgagttccatgtccgggtggtctttggaggttgtgcaagcatatcagcagccagggcct

SEQ ID NO: 393989 - DNA, 140 bp, Artificial Sequence
  Synthetic
atacgccatgctgggtctccctcctctggaggcaggagatgggaggcaacatcactcgagtcgagtcagagaacaaagtcgtagtacttgactcctttgagcctctaaccgctgagtatgcgtacttgggagtcggccat

SEQ ID NO: 393990 - DNA, 140 bp, Artificial Sequence
  Synthetic
atggccgactcccaagtacgcatactcagcggttagaggctcaaaggagtcaagtactacgactttgttctctgactcgactcgagtgatgttgcctcccatctcctgcctccagaggagggagacccagcatggcgtat

SEQ ID NO: 393991 - DNA, 140 bp, Artificial Sequence
  Synthetic
atacgccatgctgggtctcctctcctacaagcatggcaaatgcccggatacgagcctccagtcgtgtctgggtgtgccgtcgccccacctaaaccggcaccaattcccccgccgaggcggcgtacttgggagtcggccat

SEQ ID NO: 393992 - DNA, 140 bp, Artificial Sequence
  Synthetic
atggccgactcccaagtacgccgcctcggcgggggaattggtgccggtttaggtggggcgacggcacacccagacacgactggaggctcgtatccgggcatttgccatgcttgtaggagaggagacccagcatggcgtat

SEQ ID NO: 393993 - DNA, 140 bp, Artificial Sequence
  Synthetic
atacgccatgctgggtctccttcgtgcatgcatgttagtgcggaaagccgctgggggccattatgtccagatggctctcatgaggctggccgcgctgacaggtacgtacgtttatgatcacgtacttgggagtcggccat

SEQ ID NO: 393994 - DNA, 140 bp, Artificial Sequence
  Synthetic
atggccgactcccaagtacgtgatcataaacgtacgtacctgtcagcgcggccagcctcatgagagccatctggacataatggcccccagcggctttccgcactaacatgcatgcacgaaggagacccagcatggcgtat

SEQ ID NO: 393995 - DNA, 140 bp, Artificial Sequence
  Synthetic
atacgccatgctgggtctcctgagcgatcaggacgacgtcgtgtgttgttccatgtcctattcctggacgggggctctaataacaccatgtgctgcggaggaggagaagcttccaataaacgtacttgggagtcggccat

SEQ ID NO: 393996 - DNA, 140 bp, Artificial Sequence
  Synthetic
atggccgactcccaagtacgtttattggaagcttctcctcctccgcagcacatggtgttattagagcccccgtccaggaataggacatggaacaacacacgacgtcgtcctgatcgctcaggagacccagcatggcgtat

SEQ ID NO: 393997 - DNA, 140 bp, Artificial Sequence
  Synthetic
aggccctggctgctgatatgcatcacgcagcgccagcctccgccagaagaaggtcacatttgacagattgcaagtgttcgaccaacattatcaggatgtactaaaggagattaagcttcggaccttttgggacagcggtg

SEQ ID NO: 393998 - DNA, 140 bp, Artificial Sequence
  Synthetic
caccgctgtcccaaaaggtccgaagcttaatctcctttagtacatcctgataatgttggtcgaacacttgcaatctgtcaaatgtgaccttcttctggcggaggctggcgctgcgtgatgcatatcagcagccagggcct

SEQ ID NO: 393999 - DNA, 140 bp, Artificial Sequence
  Synthetic
aggccctggctgctgatatgacggattccagtactcccctaaccagagggttgagtacttgctcaaaatgtggcggtcaaagaaggtgcccatgggcttttcttacgacaccaggtgtttgaccttttgggacagcggtg

SEQ ID NO: 394000 - DNA, 140 bp, Artificial Sequence
  Synthetic
caccgctgtcccaaaaggtcaaacacctggtgtcgtaagaaaagcccatgggcaccttctttgaccgccacattttgagcaagtactcaaccctctggttaggggagtactggaatccgtcatatcagcagccagggcct

SEQ ID NO: 394001 - DNA, 140 bp, Artificial Sequence
  Synthetic
aggccctggctgctgatatgtggcggtcaaagaaggtgcccatgggcttttcttacgacaccaggtgttttgattcaaccgtcaccgagcgggatatccggactgagaacgacatctatcgaccttttgggacagcggtg

SEQ ID NO: 394002 - DNA, 140 bp, Artificial Sequence
  Synthetic
caccgctgtcccaaaaggtcgatagatgtcgttctcagtccggatatcccgctcggtgacggttgaatcaaaacacctggtgtcgtaagaaaagcccatgggcaccttctttgaccgccacatatcagcagccagggcct

SEQ ID NO: 394003 - DNA, 140 bp, Artificial Sequence
  Synthetic
atacgccatgctgggtctccgaacggctctacgtaggtggccccatggtaaactccaagggacagtcatgtggctaccgtagatgccgcgccagtggggtgctgcccacgagcatgggaacgtacttgggagtcggccat

SEQ ID NO: 394004 - DNA, 140 bp, Artificial Sequence
  Synthetic
atggccgactcccaagtacgttcccatgctcgtgggcagcaccccactggcgcggcatctacggtagccacatgactgtcccttggagtttaccatggggccacctacgtagagccgttcggagacccagcatggcgtat

SEQ ID NO: 394005 - DNA, 140 bp, Artificial Sequence
  Synthetic
aggccctggctgctgatatgtggctaccgtagatgccgcgccagtggggtgctgcccacgagcatgggaaacaccctcacatgctatctgaaagcacaggccgcctgcagggcggccaacgaccttttgggacagcggtg

SEQ ID NO: 394006 - DNA, 140 bp, Artificial Sequence
  Synthetic
caccgctgtcccaaaaggtcgttggccgccctgcaggcggcctgtgctttcagatagcatgtgagggtgtttcccatgctcgtgggcagcaccccactggcgcggcatctacggtagccacatatcagcagccagggcct

SEQ ID NO: 394007 - DNA, 140 bp, Artificial Sequence
  Synthetic
atacgccatgctgggtctccacaccctcacatgctatctgaaagcacaggccgcctgcagggcggccaacatcaaggactgtgacatgttggtgtgcggagatgacctagtggtcatttgcgtacttgggagtcggccat

SEQ ID NO: 394008 - DNA, 140 bp, Artificial Sequence
  Synthetic
atggccgactcccaagtacgcaaatgaccactaggtcatctccgcacaccaacatgtcacagtccttgatgttggccgccctgcaggcggcctgtgctttcagatagcatgtgagggtgtggagacccagcatggcgtat

SEQ ID NO: 394009 - DNA, 140 bp, Artificial Sequence
  Synthetic
atacgccatgctgggtctcccacttgcgcgggccgcttgggagacagcccgccacactccagtcaattcgtggttgggcaacatcattatgtttgcccccacgatatgggtgcgtatggtcgtacttgggagtcggccat

SEQ ID NO: 394010 - DNA, 140 bp, Artificial Sequence
  Synthetic
atggccgactcccaagtacgaccatacgcacccatatcgtgggggcaaacataatgatgttgcccaaccacgaattgactggagtgtggcgggctgtctcccaagcggcccgcgcaagtgggagacccagcatggcgtat

SEQ ID NO: 394011 - DNA, 140 bp, Artificial Sequence
  Synthetic
atacgccatgctgggtctccgatctcccagcaatcattcaacgactccatggcatggcagcgttttcactccacggatactctccaactgagctcaacagggtaggggcttgcctcaggacgtacttgggagtcggccat

SEQ ID NO: 394012 - DNA, 140 bp, Artificial Sequence
  Synthetic
atggccgactcccaagtacgtcctgaggcaagcccctaccctgttgagctcagttggagagtatccgtggagtgaaaacgctgccatgccatggagtcgttgaatgattgctgggagatcggagacccagcatggcgtat

SEQ ID NO: 394013 - DNA, 140 bp, Artificial Sequence
  Synthetic
atacgccatgctgggtctcccctctttaactgggcggtgaagaccaaactaaaactcactccattggtctccgcgagcaagcttgacttatcaggctggttcgtggcaggctacgacgggcgtacttgggagtcggccat

SEQ ID NO: 394014 - DNA, 140 bp, Artificial Sequence
  Synthetic
atggccgactcccaagtacgcccgtcgtagcctgccacgaaccagcctgataagtcaagcttgctcgcggagaccaatggagtgagttttagtttggtcttcaccgcccagttaaagaggggagacccagcatggcgtat

SEQ ID NO: 394015 - DNA, 140 bp, Artificial Sequence
  Synthetic
aggccctggctgctgatatggattatgcccagggctggggccctatcagtcatgccaacggaagcggccccgacgaacgcccctactgctggcactaccccccaagaccttgtggtattggaccttttgggacagcggtg

SEQ ID NO: 394016 - DNA, 140 bp, Artificial Sequence
  Synthetic
caccgctgtcccaaaaggtccaataccacaaggtcttggggggtagtgccagcagtaggggcgttcgtcggggccgcttccgttggcatgactgatagggccccagccctgggcataatccatatcagcagccagggcct

SEQ ID NO: 394017 - DNA, 140 bp, Artificial Sequence
  Synthetic
aggccctggctgctgatatgccgcagtggtttgctcatccctatacatcggggatctgtgtggctctctctttttggcgggacaactattcaccttccagccccgccgtcattggactgtgaccttttgggacagcggtg

SEQ ID NO: 394018 - DNA, 140 bp, Artificial Sequence
  Synthetic
caccgctgtcccaaaaggtcacagtccaatgacggcggggctggaaggtgaatagttgtcccgccaaaaagagagagccacacagatccccgatgtatagggatgagcaaaccactgcggcatatcagcagccagggcct

SEQ ID NO: 394019 - DNA, 140 bp, Artificial Sequence
  Synthetic
atacgccatgctgggtctcctttttggcgggacaactattcaccttccagccccgccgtcattggactgtgcaagactgcaactgctccatctatacaggccacgtcaccggctacaggacgtacttgggagtcggccat

SEQ ID NO: 394020 - DNA, 140 bp, Artificial Sequence
  Synthetic
atggccgactcccaagtacgtcctgtagccggtgacgtggcctgtatagatggagcagttgcagtcttgcacagtccaatgacggcggggctggaaggtgaatagttgtcccgccaaaaaggagacccagcatggcgtat

SEQ ID NO: 394021 - DNA, 140 bp, Artificial Sequence
  Synthetic
atacgccatgctgggtctcctggcttgggacatgatgatgaactggtcacccacaaccactctggtcctatctagcatcttgagggtacctgagatctgtgcgagtgtgatatttggtggcgtacttgggagtcggccat

SEQ ID NO: 394022 - DNA, 140 bp, Artificial Sequence
  Synthetic
atggccgactcccaagtacgccaccaaatatcacactcgcacagatctcaggtaccctcaagatgctagataggaccagagtggttgtgggtgaccagttcatcatcatgtcccaagccaggagacccagcatggcgtat

SEQ ID NO: 394023 - DNA, 140 bp, Artificial Sequence
  Synthetic
aggccctggctgctgatatgacaggctgtggcactacccctgcactgtcaacttcaccttgcataaagtcaggatgttcgtgggaggcattgagcaccgatttgacgccgcatgtaattggaccttttgggacagcggtg

SEQ ID NO: 394024 - DNA, 140 bp, Artificial Sequence
  Synthetic
caccgctgtcccaaaaggtccaattacatgcggcgtcaaatcggtgctcaatgcctcccacgaacatcctgactttatgcaaggtgaagttgacagtgcaggggtagtgccacagcctgtcatatcagcagccagggcct

SEQ ID NO: 394025 - DNA, 140 bp, Artificial Sequence
  Synthetic
aggccctggctgctgatatgtcaggatgtacgtgggaggggtcgagcacaggctggaagctgcctgcaactggacgcggggcgagcgttgcgatctggaagacagggacaggtccgagctgaccttttgggacagcggtg

SEQ ID NO: 394026 - DNA, 140 bp, Artificial Sequence
  Synthetic
caccgctgtcccaaaaggtcagctcggacctgtccctgtcttccagatcgcaacgctcgccccgcgtccagttgcaggcagcttccagcctgtgctcgacccctcccacgtacatcctgacatatcagcagccagggcct

SEQ ID NO: 394027 - DNA, 140 bp, Artificial Sequence
  Synthetic
aggccctggctgctgatatgctcccccgggagcaaggtcgctcaccccatgtacttgtggctctagtgacctctatctggtcacgagggaggccgatgttatccccgcaaggcgcagggggaccttttgggacagcggtg

SEQ ID NO: 394028 - DNA, 140 bp, Artificial Sequence
  Synthetic
caccgctgtcccaaaaggtccccctgcgccttgcggggataacatcggcctccctcgtgaccagatagaggtcactagagccacaagtacatggggtgagcgaccttgctcccgggggagcatatcagcagccagggcct

SEQ ID NO: 394029 - DNA, 140 bp, Artificial Sequence
  Synthetic
  misc_feature (114)..(114): n is a, c, g, or t
atacgccatgctgggtctccccaatgactgttccaatgacagcatcacctggcagcttcaggctgcggtcctccacgtccccgggtgtgtcccgtgtgagaaagtgggaaatanatcacgcgtacttgggagtcggccat

SEQ ID NO: 394030 - DNA, 140 bp, Artificial Sequence
  Synthetic
  misc_feature (27)..(27): n is a, c, g, or t
atggccgactcccaagtacgcgtgatntatttcccactttctcacacgggacacacccggggacgtggaggaccgcagcctgaagctgccaggtgatgctgtcattggaacagtcattggggagacccagcatggcgtat

SEQ ID NO: 394031 - DNA, 140 bp, Artificial Sequence
  Synthetic
atacgccatgctgggtctccgctcctcgggaggccccattatgtgtccctcggggcacgttgtgggactcttccgagctgccgtatgcacaaggggtgtagcaaaatccttagattttatcgtacttgggagtcggccat

SEQ ID NO: 394032 - DNA, 140 bp, Artificial Sequence
  Synthetic
atggccgactcccaagtacgataaaatctaaggattttgctacaccccttgtgcatacggcagctcggaagagtcccacaacgtgccccgagggacacataatggggcctcccgaggagcggagacccagcatggcgtat

SEQ ID NO: 394033 - DNA, 140 bp, Artificial Sequence
  Synthetic
aggccctggctgctgatatgttccgagctgccgtatgcacaaggggtgtagcaaaatccttagattttatcccagtggaaaacatggagacgaccatgcgctctccctcattcacagacagaccttttgggacagcggtg

SEQ ID NO: 394034 - DNA, 140 bp, Artificial Sequence
  Synthetic
caccgctgtcccaaaaggtctgtctgtgaatgagggagagcgcatggtcgtctccatgttttccactgggataaaatctaaggattttgctacaccccttgtgcatacggcagctcggaacatatcagcagccagggcct

SEQ ID NO: 394035 - DNA, 140 bp, Artificial Sequence
  Synthetic
aggccctggctgctgatatgggttgcgaactgggctaaagtcctcgctgtcttggtcctttttgctggggtcgacggaactacctacgttggccgcagtgcgggtgcgcagacgcggggcgaccttttgggacagcggtg

SEQ ID NO: 394036 - DNA, 140 bp, Artificial Sequence
  Synthetic
caccgctgtcccaaaaggtcgccccgcgtctgcgcacccgcactgcggccaacgtaggtagttccgtcgaccccagcaaaaaggaccaagacagcgaggactttagcccagttcgcaacccatatcagcagccagggcct

SEQ ID NO: 394037 - DNA, 140 bp, Artificial Sequence
  Synthetic
atacgccatgctgggtctcccagagacagccctctcgactacgggagaaataccattttatggaaaggccatcccccttgagtacatcaaagggggaagacatctcatattctgtcactccgtacttgggagtcggccat

SEQ ID NO: 394038 - DNA, 140 bp, Artificial Sequence
  Synthetic
atggccgactcccaagtacggagtgacagaatatgagatgtcttccccctttgatgtactcaagggggatggcctttccataaaatggtatttctcccgtagtcgagagggctgtctctgggagacccagcatggcgtat

SEQ ID NO: 394039 - DNA, 140 bp, Artificial Sequence
  Synthetic
aggccctggctgctgatatgttggaggacagggataggtcagaactcagcccgctgctgctgtctacaacagagtggcagatactgccctgttccttcaccaccctaccggctctgtccagaccttttgggacagcggtg

SEQ ID NO: 394040 - DNA, 140 bp, Artificial Sequence
  Synthetic
caccgctgtcccaaaaggtctggacagagccggtagggtggtgaaggaacagggcagtatctgccactctgttgtagacagcagcagcgggctgagttctgacctatccctgtcctccaacatatcagcagccagggcct

SEQ ID NO: 394041 - DNA, 140 bp, Artificial Sequence
  Synthetic
atacgccatgctgggtctccctggcttgactcacatagacgcccacttcctgtctcagacgaagcaggggggtgagaacttcgcgtacctcgtggcataccaggctacagtgtgcgccagcgtacttgggagtcggccat

SEQ ID NO: 394042 - DNA, 140 bp, Artificial Sequence
  Synthetic
atggccgactcccaagtacgctggcgcacactgtagcctggtatgccacgaggtacgcgaagttctcacccccctgcttcgtctgagacaggaagtgggcgtctatgtgagtcaagccagggagacccagcatggcgtat

SEQ ID NO: 394043 - DNA, 140 bp, Artificial Sequence
  Synthetic
aggccctggctgctgatatgggcgacttcgactcggtgatagactgcaacacgtgtgtcacccagacagtcgatttcagccttgaccctaccttcaccattgagacaaccacgcttccccgaccttttgggacagcggtg

SEQ ID NO: 394044 - DNA, 140 bp, Artificial Sequence
  Synthetic
caccgctgtcccaaaaggtcggggaagcgtggttgtctcaatggtgaaggtagggtcaaggctgaaatcgactgtctgggtgacacacgtgttgcagtctatcaccgagtcgaagtcgcccatatcagcagccagggcct

SEQ ID NO: 394045 - DNA, 140 bp, Artificial Sequence
  Synthetic
atacgccatgctgggtctccagtagagcccgttgttttttctgacatggaaaccaaaatcatcacctggggggcggacaccgcggcgtgtggggacatcctttcgggtctgcccgtctcccgtacttgggagtcggccat

SEQ ID NO: 394046 - DNA, 140 bp, Artificial Sequence
  Synthetic
atggccgactcccaagtacgggagacgggcagacccgaaaggatgtccccacacgccgcggtgtccgccccccaggtgatgattttggtttccatgtcagaaaaaacaacgggctctactggagacccagcatggcgtat

SEQ ID NO: 394047 - DNA, 140 bp, Artificial Sequence
  Synthetic
atacgccatgctgggtctccacctgtggggccgtgatagctggacacgtcaaaaatggcaccatgaaaatcacagggcccaagacatgcagtaacacttggcacgggacttttccaatcacgtacttgggagtcggccat

SEQ ID NO: 394048 - DNA, 140 bp, Artificial Sequence
  Synthetic
atggccgactcccaagtacgtgattggaaaagtcccgtgccaagtgttactgcatgtcttgggccctgtgattttcatggtgccatttttgacgtgtccagctatcacggccccacaggtggagacccagcatggcgtat

SEQ ID NO: 394049 - DNA, 140 bp, Artificial Sequence
  Synthetic
aggccctggctgctgatatggtggatcccccccctcaatgttcgggggggccgcgacgccatcatcctcctcacgtgtgtggtccacccagagctaatttttgacatcaccaagctcttggaccttttgggacagcggtg

SEQ ID NO: 394050 - DNA, 140 bp, Artificial Sequence
  Synthetic
caccgctgtcccaaaaggtccaagagcttggtgatgtcaaaaattagctctgggtggaccacacacgtgaggaggatgatggcgtcgcggcccccccgaacattgaggggggggatccaccatatcagcagccagggcct

SEQ ID NO: 394051 - DNA, 140 bp, Artificial Sequence
  Synthetic
aggccctggctgctgatatgtttctgacatggagaccaagatcatcacctggggggcggacactgcggcgtgtggtgacatcatctcggggttacctgtctccgcccgaagggggagggagaccttttgggacagcggtg

SEQ ID NO: 394052 - DNA, 140 bp, Artificial Sequence
  Synthetic
caccgctgtcccaaaaggtctccctcccccttcgggcggagacaggtaaccccgagatgatgtcaccacacgccgcagtgtccgccccccaggtgatgatcttggtctccatgtcagaaacatatcagcagccagggcct

SEQ ID NO: 394053 - DNA, 140 bp, Artificial Sequence
  Synthetic
atacgccatgctgggtctccgttcagactcggggctatcaataaccagtcccgttccacctgccccaacaacaccggacgacgcctgctcagaagcagagtcctatagctcaatgccccccgtacttgggagtcggccat

SEQ ID NO: 394054 - DNA, 140 bp, Artificial Sequence
  Synthetic
atggccgactcccaagtacggggggcattgagctataggactctgcttctgagcaggcgtcgtccggtgttgttggggcaggtggaacgggactggttattgatagccccgagtctgaacggagacccagcatggcgtat

SEQ ID NO: 394055 - DNA, 140 bp, Artificial Sequence
  Synthetic
aggccctggctgctgatatgtcctgctcgctgcaggggtaggcatctacctcctccccaaccgatgaacctagtcacggctagctgtgaggtcatagctgattcctgaccagcctggtgcgaccttttgggacagcggtg

SEQ ID NO: 394056 - DNA, 140 bp, Artificial Sequence
  Synthetic
caccgctgtcccaaaaggtcgcaccaggctggtcaggaatcagctatgacctcacagctagccgtgactaggttcatcggttggggaggaggtagatgcctacccctgcagcgagcaggacatatcagcagccagggcct

SEQ ID NO: 394057 - DNA, 140 bp, Artificial Sequence
  Synthetic
atacgccatgctgggtctcccatacggattccagtactcccctaaccagagggttgagtacttgctcaaaatgtggcggtcaaagaaggtgcccatgggcttttcttacgacaccaggtgcgtacttgggagtcggccat

SEQ ID NO: 394058 - DNA, 140 bp, Artificial Sequence
  Synthetic
atggccgactcccaagtacgcacctggtgtcgtaagaaaagcccatgggcaccttctttgaccgccacattttgagcaagtactcaaccctctggttaggggagtactggaatccgtatgggagacccagcatggcgtat

SEQ ID NO: 394059 - DNA, 140 bp, Artificial Sequence
  Synthetic
aggccctggctgctgatatgcctcggactcaacgctgtagcgtattaccggggccttgacgtgtccgtcataccgaccagcggagacgtcgttgtcgtagcaacagacgctctaatgacggaccttttgggacagcggtg

SEQ ID NO: 394060 - DNA, 140 bp, Artificial Sequence
  Synthetic
caccgctgtcccaaaaggtccgtcattagagcgtctgttgctacgacaacgacgtctccgctggtcggtatgacggacacgtcaaggccccggtaatacgctacagcgttgagtccgaggcatatcagcagccagggcct

SEQ ID NO: 394061 - DNA, 140 bp, Artificial Sequence
  Synthetic
atacgccatgctgggtctcccggatgctatgaccaggtactcagctccccctggagatgccccgcaacctacgtatgaccttgagctcataacatcgtgctcatccaatgtctccgtcgccgtacttgggagtcggccat

SEQ ID NO: 394062 - DNA, 140 bp, Artificial Sequence
  Synthetic
atggccgactcccaagtacggcgacggagacattggatgagcacgatgttatgagctcaaggtcatacgtaggttgcggggcatctccagggggagctgagtacctggtcatagcatccgggagacccagcatggcgtat

SEQ ID NO: 394063 - DNA, 140 bp, Artificial Sequence
  Synthetic
aggccctggctgctgatatggggggggacatttatcacagcgtgtcccaggctcgaccccgtctcttactccttggcctactcctactcaccgtaggggtaggcatctttttgctccccggaccttttgggacagcggtg

SEQ ID NO: 394064 - DNA, 140 bp, Artificial Sequence
  Synthetic
caccgctgtcccaaaaggtccggggagcaaaaagatgcctacccctacggtgagtaggagtaggccaaggagtaagagacggggtcgagcctgggacacgctgtgataaatgtccccccccatatcagcagccagggcct

SEQ ID NO: 394065 - DNA, 140 bp, Artificial Sequence
  Synthetic
aggccctggctgctgatatggccgggacaaaaaccaagtggagggtgaggtccagattgtgtcaactgctgcccaaactttcctggcaacgtgcatcaatggggtatgctggactgtctagaccttttgggacagcggtg

SEQ ID NO: 394066 - DNA, 140 bp, Artificial Sequence
  Synthetic
caccgctgtcccaaaaggtctagacagtccagcataccccattgatgcacgttgccaggaaagtttgggcagcagttgacacaatctggacctcaccctccacttggtttttgtcccggccatatcagcagccagggcct

SEQ ID NO: 394067 - DNA, 140 bp, Artificial Sequence
  Synthetic
atacgccatgctgggtctcccaggcgccaagcagaacatccaactggtcaacaccaacggcagttggcacatcaatagcacggccttgaactgcaatgatagccttaacaccggctggatcgtacttgggagtcggccat

SEQ ID NO: 394068 - DNA, 140 bp, Artificial Sequence
  Synthetic
atggccgactcccaagtacgatccagccggtgttaaggctatcattgcagttcaaggccgtgctattgatgtgccaactgccgttggtgttgaccagttggatgttctgcttggcgcctgggagacccagcatggcgtat

SEQ ID NO: 394069 - DNA, 140 bp, Artificial Sequence
  Synthetic
aggccctggctgctgatatgatcaatagcacggccttgaactgcaatgatagccttaacaccggctggatagcagggctcttctatcaccacaaattcaactcttcaggctgtcccgagagaccttttgggacagcggtg

SEQ ID NO: 394070 - DNA, 140 bp, Artificial Sequence
  Synthetic
caccgctgtcccaaaaggtctctcgggacagcctgaagagttgaatttgtggtgatagaagagccctgctatccagccggtgttaaggctatcattgcagttcaaggccgtgctattgatcatatcagcagccagggcct

SEQ ID NO: 394071 - DNA, 140 bp, Artificial Sequence
  Synthetic
atacgccatgctgggtctccagcagggctcttctatcaccacaaattcaactcttcaggctgtcccgagaggttggccagctgccgacgccttaccgattttgcccagggctggggcccccgtacttgggagtcggccat

SEQ ID NO: 394072 - DNA, 140 bp, Artificial Sequence
  Synthetic
atggccgactcccaagtacgggggccccagccctgggcaaaatcggtaaggcgtcggcagctggccaacctctcgggacagcctgaagagttgaatttgtggtgatagaagagccctgctggagacccagcatggcgtat

SEQ ID NO: 394073 - DNA, 140 bp, Artificial Sequence
  Synthetic
aggccctggctgctgatatgctccacggaaaaagaggacggttgtcctgacagagtccaccgtgtcttctgccttggcggagcttgctacaaagaccttcggcagctccgaatcgtcggcgaccttttgggacagcggtg

SEQ ID NO: 394074 - DNA, 140 bp, Artificial Sequence
  Synthetic
caccgctgtcccaaaaggtcgccgacgattcggagctgccgaaggtctttgtagcaagctccgccaaggcagaagacacggtggactctgtcaggacaaccgtcctctttttccgtggagcatatcagcagccagggcct

SEQ ID NO: 394075 - DNA, 140 bp, Artificial Sequence
  Synthetic
atacgccatgctgggtctcctccaccatgccggccttgtcaactggcctcatccacctgcatcagaacatagtggacgtgcagtacctctacggagtctcctcgagcgtcacctcgtgggcgtacttgggagtcggccat

SEQ ID NO: 394076 - DNA, 140 bp, Artificial Sequence
  Synthetic
atggccgactcccaagtacgcccacgaggtgacgctcgaggagactccgtagaggtactgcacgtccactatgttctgatgcaggtggatgaggccagttgacaaggccggcatggtggaggagacccagcatggcgtat

SEQ ID NO: 394077 - DNA, 140 bp, Artificial Sequence
  Synthetic
aggccctggctgctgatatgctacccctccgggctccgtcactgtgccccatcctaacatcgaggaggttgctctgtccaccaccggagagatccctttttacggcaaggctatccccctgaccttttgggacagcggtg

SEQ ID NO: 394078 - DNA, 140 bp, Artificial Sequence
  Synthetic
caccgctgtcccaaaaggtcagggggatagccttgccgtaaaaagggatctctccggtggtggacagagcaacctcctcgatgttaggatggggcacagtgacggagcccggaggggtagcatatcagcagccagggcct

SEQ ID NO: 394079 - DNA, 140 bp, Artificial Sequence
  Synthetic
aggccctggctgctgatatgtgcaagtcctggacgaccactaccgggacgtgctcaaggagatgaaggcgaaggcgtccacagttaaggctaaacttctatccgtagaagaagcctgcaagaccttttgggacagcggtg

SEQ ID NO: 394080 - DNA, 140 bp, Artificial Sequence
  Synthetic
caccgctgtcccaaaaggtcttgcaggcttcttctacggatagaagtttagccttaactgtggacgccttcgccttcatctccttgagcacgtcccggtagtggtcgtccaggacttgcacatatcagcagccagggcct

SEQ ID NO: 394081 - DNA, 140 bp, Artificial Sequence
  Synthetic
aggccctggctgctgatatgtccttgccgcgctgttctacacacacaagttcaacgcgtccggatgcccagagcgcatggccagctgccgccccattgacaagttcgctcaggggtgggggaccttttgggacagcggtg

SEQ ID NO: 394082 - DNA, 140 bp, Artificial Sequence
  Synthetic
caccgctgtcccaaaaggtcccccacccctgagcgaacttgtcaatggggcggcagctggccatgcgctctgggcatccggacgcgttgaacttgtgtgtgtagaacagcgcggcaaggacatatcagcagccagggcct

SEQ ID NO: 394083 - DNA, 140 bp, Artificial Sequence
  Synthetic
aggccctggctgctgatatgctctccgagactgggcgcacaacggcctgcgagatctggccgtggctgtagaaccagtcgtcttctcccgaatggagaccaagctcatcacgtggggggcgaccttttgggacagcggtg

SEQ ID NO: 394084 - DNA, 140 bp, Artificial Sequence
  Synthetic
caccgctgtcccaaaaggtcgccccccacgtgatgagcttggtctccattcgggagaagacgactggttctacagccacggccagatctcgcaggccgttgtgcgcccagtctcggagagcatatcagcagccagggcct

SEQ ID NO: 394085 - DNA, 140 bp, Artificial Sequence
  Synthetic
aggccctggctgctgatatgtgctccttaacaacacgcggccaccccacggcaactggttcggctgcacatggatgaatagcaccgggttcaccaagacgtgcgggggccccccgtgcaagaccttttgggacagcggtg

SEQ ID NO: 394086 - DNA, 140 bp, Artificial Sequence
  Synthetic
caccgctgtcccaaaaggtcttgcacggggggcccccgcacgtcttggtgaacccggtgctattcatccatgtgcagccgaaccagttgccgtggggtggccgcgtgttgttaaggagcacatatcagcagccagggcct

SEQ ID NO: 394087 - DNA, 140 bp, Artificial Sequence
  Synthetic
aggccctggctgctgatatgtggatgaatagcaccgggttcaccaagacgtgcgggggccccccgtgcaacatcgggggggtcggcaacaacaccttgacctgccccacggattgcttccgaccttttgggacagcggtg

SEQ ID NO: 394088 - DNA, 140 bp, Artificial Sequence
  Synthetic
caccgctgtcccaaaaggtcggaagcaatccgtggggcaggtcaaggtgttgttgccgacccccccgatgttgcacggggggcccccgcacgtcttggtgaacccggtgctattcatccacatatcagcagccagggcct

SEQ ID NO: 394089 - DNA, 140 bp, Artificial Sequence
  Synthetic
aggccctggctgctgatatgggggagacatatatcacagcctgtctcgtgcccgaccccgctggttcatgtggtgcctactcctactttctgtaggggtaggcatctacctgctccccaagaccttttgggacagcggtg

SEQ ID NO: 394090 - DNA, 140 bp, Artificial Sequence
  Synthetic
caccgctgtcccaaaaggtcttggggagcaggtagatgcctacccctacagaaagtaggagtaggcaccacatgaaccagcggggtcgggcacgagacaggctgtgatatatgtctcccccatatcagcagccagggcct

SEQ ID NO: 394091 - DNA, 140 bp, Artificial Sequence
  Synthetic
aggccctggctgctgatatggcccgaccccgctggttcatgtggtgcctactcctactttctgtaggggtaggcatctacctgctccccaaccgatgaacggggagctaaccactccagggaccttttgggacagcggtg

SEQ ID NO: 394092 - DNA, 140 bp, Artificial Sequence
  Synthetic
caccgctgtcccaaaaggtccctggagtggttagctccccgttcatcggttggggagcaggtagatgcctacccctacagaaagtaggagtaggcaccacatgaaccagcggggtcgggccatatcagcagccagggcct

SEQ ID NO: 394093 - DNA, 140 bp, Artificial Sequence
  Synthetic
aggccctggctgctgatatggaagcgctcttgcaagtgtggatcccccctctcaacgttcgcgggggccgcgatgccatcatcctcctcacgtgcgcggtccatccagagctaatttttggaccttttgggacagcggtg

SEQ ID NO: 394094 - DNA, 140 bp, Artificial Sequence
  Synthetic
caccgctgtcccaaaaggtccaaaaattagctctggatggaccgcgcacgtgaggaggatgatggcatcgcggcccccgcgaacgttgagaggggggatccacacttgcaagagcgcttccatatcagcagccagggcct

SEQ ID NO: 394095 - DNA, 140 bp, Artificial Sequence
  Synthetic
atacgccatgctgggtctccgttgtcatctgtggcaggataactttgactggcaagcctgctgttgtccctgatcgcgagatcttataccagcaatttgacgagatggaggagtgctctacgtacttgggagtcggccat

SEQ ID NO: 394096 - DNA, 140 bp, Artificial Sequence
  Synthetic
atggccgactcccaagtacgtagagcactcctccatctcgtcaaattgctggtataagatctcgcgatcagggacaacagcaggcttgccagtcaaagttatcctgccacagatgacaacggagacccagcatggcgtat

SEQ ID NO: 394097 - DNA, 140 bp, Artificial Sequence
  Synthetic
aggccctggctgctgatatggggagtcctggcgggccttgcctactattccatggtggggaactgggctaaggtcttgattgtgatgctactctttgccggcgttgacgggagaaccaccgaccttttgggacagcggtg

SEQ ID NO: 394098 - DNA, 140 bp, Artificial Sequence
  Synthetic
caccgctgtcccaaaaggtcggtggttctcccgtcaacgccggcaaagagtagcatcacaatcaagaccttagcccagttccccaccatggaatagtaggcaaggcccgccaggactccccatatcagcagccagggcct

SEQ ID NO: 394099 - DNA, 140 bp, Artificial Sequence
  Synthetic
atacgccatgctgggtctcccatgtaacgggggggcaaacaggccggaccaccctgggcattacggccatgtttgcgtttggcccgcatcaaaagctccaactcattaacaccaatggcacgtacttgggagtcggccat

SEQ ID NO: 394100 - DNA, 140 bp, Artificial Sequence
  Synthetic
atggccgactcccaagtacgtgccattggtgttaatgagttggagcttttgatgcgggccaaacgcaaacatggccgtaatgcccagggtggtccggcctgtttgcccccccgttacatgggagacccagcatggcgtat

SEQ ID NO: 394101 - DNA, 140 bp, Artificial Sequence
  Synthetic
aggccctggctgctgatatgtgaccctgggggaagccatggtccaggagtgggcaccatccatgcaggcgcgcggtggccgcgatggcatcatatgggccgccaccatattctgcccggggaccttttgggacagcggtg

SEQ ID NO: 394102 - DNA, 140 bp, Artificial Sequence
  Synthetic
caccgctgtcccaaaaggtccccgggcagaatatggtggcggcccatatgatgccatcgcggccaccgcgcgcctgcatggatggtgcccactcctggaccatggcttcccccagggtcacatatcagcagccagggcct

SEQ ID NO: 394103 - DNA, 140 bp, Artificial Sequence
  Synthetic
aggccctggctgctgatatgagacggctggagcgcgactcgtcgtgctcgccaccgctacacctccgggatcggtcactgtgccacatcccaacatcgaggaggtggccctgtccaacacgaccttttgggacagcggtg

SEQ ID NO: 394104 - DNA, 140 bp, Artificial Sequence
  Synthetic
caccgctgtcccaaaaggtcgtgttggacagggccacctcctcgatgttgggatgtggcacagtgaccgatcccggaggtgtagcggtggcgagcacgacgagtcgcgctccagccgtctcatatcagcagccagggcct

SEQ ID NO: 394105 - DNA, 140 bp, Artificial Sequence
  Synthetic
aggccctggctgctgatatgcccacttccacctccacggtcccctcctgtgcccccgccccggaagaagcggacggtggtcctcaccgaatcacttgtatcttctgccttggccgagcttgaccttttgggacagcggtg

SEQ ID NO: 394106 - DNA, 140 bp, Artificial Sequence
  Synthetic
caccgctgtcccaaaaggtcaagctcggccaaggcagaagatacaagtgattcggtgaggaccaccgtccgcttcttccggggcgggggcacaggaggggaccgtggaggtggaagtgggcatatcagcagccagggcct

SEQ ID NO: 394107 - DNA, 140 bp, Artificial Sequence
  Synthetic
atacgccatgctgggtctcctccaccggtctgatccacctccatcagaacatcgtggacgtgcaatacctgtatggcgtggggtcagcggtcgtctccattgtcatcaagtgggagtatacgtacttgggagtcggccat

SEQ ID NO: 394108 - DNA, 140 bp, Artificial Sequence
  Synthetic
atggccgactcccaagtacgtatactcccacttgatgacaatggagacgaccgctgaccccacgccatacaggtattgcacgtccacgatgttctgatggaggtggatcagaccggtggaggagacccagcatggcgtat

SEQ ID NO: 394109 - DNA, 140 bp, Artificial Sequence
  Synthetic
atacgccatgctgggtctccagctcctgaggcgactgcaccagtggataagctcggagtgtaccactccgtgctccggttcctggctaagggacatctgggactggatatgcgaggtgctcgtacttgggagtcggccat

SEQ ID NO: 394110 - DNA, 140 bp, Artificial Sequence
  Synthetic
atggccgactcccaagtacgagcacctcgcatatccagtcccagatgtcccttagccaggaaccggagcacggagtggtacactccgagcttatccactggtgcagtcgcctcaggagctggagacccagcatggcgtat

SEQ ID NO: 394111 - DNA, 140 bp, Artificial Sequence
  Synthetic
atacgccatgctgggtctccggccgaggcgctagtacaggtgtggatcccccccctcaacgttcgggggggccgcgatgccatcatcctcctcacgtgcgcggtccatccggggctgattcgtacttgggagtcggccat

SEQ ID NO: 394112 - DNA, 140 bp, Artificial Sequence
  Synthetic
atggccgactcccaagtacgaatcagccccggatggaccgcgcacgtgaggaggatgatggcatcgcggcccccccgaacgttgaggggggggatccacacctgtactagcgcctcggccggagacccagcatggcgtat

SEQ ID NO: 394113 - DNA, 140 bp, Artificial Sequence
  Synthetic
atacgccatgctgggtctccctccgcccgaagggggagggagatacttctgggaccggccgacagttttgaggggcgggggtggcgactccttgcccctatcacggcctactcccaacagcgtacttgggagtcggccat

SEQ ID NO: 394114 - DNA, 140 bp, Artificial Sequence
  Synthetic
atggccgactcccaagtacgctgttgggagtaggccgtgataggggcaaggagtcgccacccccgcccctcaaaactgtcggccggtcccagaagtatctccctcccccttcgggcggagggagacccagcatggcgtat

SEQ ID NO: 394115 - DNA, 140 bp, Artificial Sequence
  Synthetic
atacgccatgctgggtctccggtcaggccgtgtctagaatcgtcggcttgttcactcagggccctaagcaggacgtccagctgatcaacaccaacggcagctggcacatcaaccgcacagcgtacttgggagtcggccat

SEQ ID NO: 394116 - DNA, 140 bp, Artificial Sequence
  Synthetic
atggccgactcccaagtacgctgtgcggttgatgtgccagctgccgttggtgttgatcagctggacgtcctgcttagggccctgagtgaacaagccgacgattctagacacggcctgaccggagacccagcatggcgtat

SEQ ID NO: 394117 - DNA, 140 bp, Artificial Sequence
  Synthetic
aggccctggctgctgatatgacggaagtggccctgaacaccggccctactgttggcactaccccccaaagccttgcggcattgtgtccgcacaaaccgtatgtggcccagtgtactgcttgaccttttgggacagcggtg

SEQ ID NO: 394118 - DNA, 140 bp, Artificial Sequence
  Synthetic
caccgctgtcccaaaaggtcaagcagtacactgggccacatacggtttgtgcggacacaatgccgcaaggctttggggggtagtgccaacagtagggccggtgttcagggccacttccgtcatatcagcagccagggcct

SEQ ID NO: 394119 - DNA, 140 bp, Artificial Sequence
  Synthetic
aggccctggctgctgatatgtgggcgggaacatcacccgcgtggagtcagagaataaggtagtaatcctagactcttttgacccgctccgagcggaggaggatgagagggaagtatccgtgaccttttgggacagcggtg

SEQ ID NO: 394120 - DNA, 140 bp, Artificial Sequence
  Synthetic
caccgctgtcccaaaaggtcacggatacttccctctcatcctcctccgctcggagcgggtcaaaagagtctaggattactaccttattctctgactccacgcgggtgatgttcccgcccacatatcagcagccagggcct

SEQ ID NO: 394121 - DNA, 140 bp, Artificial Sequence
  Synthetic
aggccctggctgctgatatggcctgagagccttcacggaggctatgaccaggtactccgccccccccggggaccccccacaaccagaatacgacttggagctcataacatcatgctcctcgaccttttgggacagcggtg

SEQ ID NO: 394122 - DNA, 140 bp, Artificial Sequence
  Synthetic
caccgctgtcccaaaaggtcgaggagcatgatgttatgagctccaagtcgtattctggttgtggggggtccccggggggggcggagtacctggtcatagcctccgtgaaggctctcaggccatatcagcagccagggcct

SEQ ID NO: 394123 - DNA, 140 bp, Artificial Sequence
  Synthetic
aggccctggctgctgatatgccggactacgtccctccggtggtacacgggtgcccattgccacctgccaagacccctccaataccacctccacggagaaagaggacggttgtcctgacaggaccttttgggacagcggtg

SEQ ID NO: 394124 - DNA, 140 bp, Artificial Sequence
  Synthetic
caccgctgtcccaaaaggtcctgtcaggacaaccgtcctctttctccgtggaggtggtattggaggggtcttggcaggtggcaatgggcacccgtgtaccaccggagggacgtagtccggcatatcagcagccagggcct

SEQ ID NO: 394125 - DNA, 140 bp, Artificial Sequence
  Synthetic
aggccctggctgctgatatgtgagtcagagaataaagtggtggttctggactccttcgatccgcttgtggcggaggaggatgaacgggaggtctccgtgcccgcagaaatcctgcggaaggaccttttgggacagcggtg

SEQ ID NO: 394126 - DNA, 140 bp, Artificial Sequence
  Synthetic
caccgctgtcccaaaaggtccttccgcaggatttctgcgggcacggagacctcccgttcatcctcctccgccacaagcggatcgaaggagtccagaaccaccactttattctctgactcacatatcagcagccagggcct

SEQ ID NO: 394127 - DNA, 140 bp, Artificial Sequence
  Synthetic
atacgccatgctgggtctcccccagagcggatggctgcgtgcaggccccttgcggatttccggcaggggtggggtcagataacctacaaagataacatctcgggcccctccgacgaccgtcgtacttgggagtcggccat

SEQ ID NO: 394128 - DNA, 140 bp, Artificial Sequence
  Synthetic
atggccgactcccaagtacgacggtcgtcggaggggcccgagatgttatctttgtaggttatctgaccccacccctgccggaaatccgcaaggggcctgcacgcagccatccgctctgggggagacccagcatggcgtat

SEQ ID NO: 394129 - DNA, 140 bp, Artificial Sequence
  Synthetic
aggccctggctgctgatatgccaatacccggtcgggtcacagctcccatgtgagcccgaaccggatgtaacagtgctcacctccatgctcaccgacccctcccacatcacagcagagacggaccttttgggacagcggtg

SEQ ID NO: 394130 - DNA, 140 bp, Artificial Sequence
  Synthetic
caccgctgtcccaaaaggtccgtctctgctgtgatgtgggaggggtcggtgagcatggaggtgagcactgttacatccggttcgggctcacatgggagctgtgacccgaccgggtattggcatatcagcagccagggcct

SEQ ID NO: 394131 - DNA, 140 bp, Artificial Sequence
  Synthetic
aggccctggctgctgatatgttctccatggcggggaactgggcgaaggtcctggtggtgctattgctgttcgccggcgtcgacgcagagacctacaccaccgggggcaacgctgctcggcgaccttttgggacagcggtg

SEQ ID NO: 394132 - DNA, 140 bp, Artificial Sequence
  Synthetic
caccgctgtcccaaaaggtcgccgagcagcgttgcccccggtggtgtaggtctctgcgtcgacgccggcgaacagcaatagcaccaccaggaccttcgcccagttccccgccatggagaacatatcagcagccagggcct

SEQ ID NO: 394133 - DNA, 140 bp, Artificial Sequence
  Synthetic
aggccctggctgctgatatgtcaccaggacagcgggttgaattcctcgtgcaagcgtggaagtccaagaagaccccaatggggttttcatatgatacccgctgctttgactccacagtcagaccttttgggacagcggtg

SEQ ID NO: 394134 - DNA, 140 bp, Artificial Sequence
  Synthetic
caccgctgtcccaaaaggtctgactgtggagtcaaagcagcgggtatcatatgaaaaccccattggggtcttcttggacttccacgcttgcacgaggaattcaacccgctgtcctggtgacatatcagcagccagggcct

SEQ ID NO: 394135 - DNA, 140 bp, Artificial Sequence
  Synthetic
atacgccatgctgggtctcctcagtatttcctcgcccgagctgaggccatgatacacgagtgggtgcccgacctacgggttaggggtggtagggactccatcatcttacttacctgcttgcgtacttgggagtcggccat

SEQ ID NO: 394136 - DNA, 140 bp, Artificial Sequence
  Synthetic
atggccgactcccaagtacgcaagcaggtaagtaagatgatggagtccctaccacccctaacccgtaggtcgggcacccactcgtgtatcatggcctcagctcgggcgaggaaatactgaggagacccagcatggcgtat

SEQ ID NO: 394137 - DNA, 140 bp, Artificial Sequence
  Synthetic
aggccctggctgctgatatgtacctatgtctatgaccatcttgcccccctctctgactgggctagcgacggactgcgcgatctggcagttgcagtcgagccggtcattttctctcccatggaccttttgggacagcggtg

SEQ ID NO: 394138 - DNA, 140 bp, Artificial Sequence
  Synthetic
caccgctgtcccaaaaggtccatgggagagaaaatgaccggctcgactgcaactgccagatcgcgcagtccgtcgctagcccagtcagagaggggggcaagatggtcatagacataggtacatatcagcagccagggcct

SEQ ID NO: 394139 - DNA, 140 bp, Artificial Sequence
  Synthetic
aggccctggctgctgatatgggcagaagaaggtcacctttgacagactgcaagtcctggacgaccactaccgggacgtgctcaaggagatgaaggcgaaggcgtccacagttaaggctaagaccttttgggacagcggtg

SEQ ID NO: 394140 - DNA, 140 bp, Artificial Sequence
  Synthetic
caccgctgtcccaaaaggtcttagccttaactgtggacgccttcgccttcatctccttgagcacgtcccggtagtggtcgtccaggacttgcagtctgtcaaaggtgaccttcttctgcccatatcagcagccagggcct

SEQ ID NO: 394141 - DNA, 140 bp, Artificial Sequence
  Synthetic
aggccctggctgctgatatgcatttgcgacgaatgccattcaacagatcctactactgtcctgggtatagggaccgtcttggaccaagcggagacggctggagtcagactcaccgtgcttgaccttttgggacagcggtg

SEQ ID NO: 394142 - DNA, 140 bp, Artificial Sequence
  Synthetic
caccgctgtcccaaaaggtcaagcacggtgagtctgactccagccgtctccgcttggtccaagacggtccctatacccaggacagtagtaggatctgttgaatggcattcgtcgcaaatgcatatcagcagccagggcct

SEQ ID NO: 394143 - DNA, 140 bp, Artificial Sequence
  Synthetic
atacgccatgctgggtctccccagggctacaaggtgttggtcttgaacccatcggtggcggcaacgcttagctttggctcttatatgaggcaagcttacggcgtggagccgaatgtccggcgtacttgggagtcggccat

SEQ ID NO: 394144 - DNA, 140 bp, Artificial Sequence
  Synthetic
atggccgactcccaagtacgccggacattcggctccacgccgtaagcttgcctcatataagagccaaagctaagcgttgccgccaccgatgggttcaagaccaacaccttgtagccctggggagacccagcatggcgtat

SEQ ID NO: 394145 - DNA, 140 bp, Artificial Sequence
  Synthetic
aggccctggctgctgatatggggagtcctggcgggccttgcctactatcccatggtggggaactgggctaaggttttgattgtgatgctactttttgctggcgtcgacggaacgaccgtggaccttttgggacagcggtg

SEQ ID NO: 394146 - DNA, 140 bp, Artificial Sequence
  Synthetic
caccgctgtcccaaaaggtccacggtcgttccgtcgacgccagcaaaaagtagcatcacaatcaaaaccttagcccagttccccaccatgggatagtaggcaaggcccgccaggactccccatatcagcagccagggcct

SEQ ID NO: 394147 - DNA, 140 bp, Artificial Sequence
  Synthetic
atacgccatgctgggtctccgtcccatcacctacgctgagaatggcagctcggaccagaggccctactgctggcactacgcgccccgacggtgtggcatcgtacccgcgtcgcaggtgtgcgtacttgggagtcggccat

SEQ ID NO: 394148 - DNA, 140 bp, Artificial Sequence
  Synthetic
atggccgactcccaagtacgcacacctgcgacgcgggtacgatgccacaccgtcggggcgcgtagtgccagcagtagggcctctggtccgagctgccattctcagcgtaggtgatgggacggagacccagcatggcgtat

SEQ ID NO: 394149 - DNA, 140 bp, Artificial Sequence
  Synthetic
aggccctggctgctgatatggctacaaggtgctagtgctcaacccctccgttgctgcaacactgggctttggcgcttatatgtccaaggcccatggggtcgatcctaacatcaggaccgggaccttttgggacagcggtg

SEQ ID NO: 394150 - DNA, 140 bp, Artificial Sequence
  Synthetic
caccgctgtcccaaaaggtcccggtcctgatgttaggatcgaccccatgggccttggacatataagcgccaaagcccagtgttgcagcaacggaggggttgagcactagcaccttgtagccatatcagcagccagggcct

SEQ ID NO: 394151 - DNA, 140 bp, Artificial Sequence
  Synthetic
aggccctggctgctgatatgcctcaatgcagcgtccgtggccggagcgcatggcatcctctccttccttgtgttcttctgtgctgcctggtacatcaagggcaggctggtccctggggcggaccttttgggacagcggtg

SEQ ID NO: 394152 - DNA, 140 bp, Artificial Sequence
  Synthetic
caccgctgtcccaaaaggtccgccccagggaccagcctgcccttgatgtaccaggcagcacagaagaacacaaggaaggagaggatgccatgcgctccggccacggacgctgcattgaggcatatcagcagccagggcct

SEQ ID NO: 394153 - DNA, 140 bp, Artificial Sequence
  Synthetic
aggccctggctgctgatatggcattcaagatcatgagcggtgaggtcccctccacggaggacctggtcaatctactgcccgccatcctctcgcctggagcccttgtagtcggcgtggtctgaccttttgggacagcggtg

SEQ ID NO: 394154 - DNA, 140 bp, Artificial Sequence
  Synthetic
caccgctgtcccaaaaggtcagaccacgccgactacaagggctccaggcgagaggatggcgggcagtagattgaccaggtcctccgtggaggggacctcaccgctcatgatcttgaatgccatatcagcagccagggcct

SEQ ID NO: 394155 - DNA, 140 bp, Artificial Sequence
  Synthetic
atacgccatgctgggtctcctggggtcccatcacctacgctgagcctggcagcttggaccagaggccctactgctggcactacgcgcctcaaccgtgtggtattgtacccgcgtcggaggcgtacttgggagtcggccat

SEQ ID NO: 394156 - DNA, 140 bp, Artificial Sequence
  Synthetic
atggccgactcccaagtacgcctccgacgcgggtacaataccacacggttgaggcgcgtagtgccagcagtagggcctctggtccaagctgccaggctcagcgtaggtgatgggaccccaggagacccagcatggcgtat

SEQ ID NO: 394157 - DNA, 140 bp, Artificial Sequence
  Synthetic
atacgccatgctgggtctccatcgaccaccgtgccacaccccaatattgaggaggtggcattgcccaacactggagagatccccttctatggcagagccatccccatcgagttcatcaagcgtacttgggagtcggccat

SEQ ID NO: 394158 - DNA, 140 bp, Artificial Sequence
  Synthetic
atggccgactcccaagtacgcttgatgaactcgatggggatggctctgccatagaaggggatctctccagtgttgggcaatgccacctcctcaatattggggtgtggcacggtggtcgatggagacccagcatggcgtat

SEQ ID NO: 394159 - DNA, 140 bp, Artificial Sequence
  Synthetic
aggccctggctgctgatatggagccgaggcgcatttgcaagtgtggatcccccctcttaacgttcgagggggccgcgatgccatcatccttctcacgtgcgcggtccacccagagctaatgaccttttgggacagcggtg

SEQ ID NO: 394160 - DNA, 140 bp, Artificial Sequence
  Synthetic
caccgctgtcccaaaaggtcattagctctgggtggaccgcgcacgtgagaaggatgatggcatcgcggccccctcgaacgttaagaggggggatccacacttgcaaatgcgcctcggctccatatcagcagccagggcct

SEQ ID NO: 394161 - DNA, 140 bp, Artificial Sequence
  Synthetic
atacgccatgctgggtctcctctccgcccgaagggggaaggagatacttctgggaccagccgatagtcttgaggggcaagggtggcgacttctcgcgcctatcacggcctattcccaacacgtacttgggagtcggccat

SEQ ID NO: 394162 - DNA, 140 bp, Artificial Sequence
  Synthetic
atggccgactcccaagtacgtgttgggaataggccgtgataggcgcgagaagtcgccacccttgcccctcaagactatcggctggtcccagaagtatctccttcccccttcgggcggagaggagacccagcatggcgtat

SEQ ID NO: 394163 - DNA, 140 bp, Artificial Sequence
  Synthetic
aggccctggctgctgatatgagcggccccgaacaccgcccctactgctggcattaccccccaaagccttgtggtatcgtgccagcacggaacgtgtgtggcccagtgtattgcttcactcgaccttttgggacagcggtg

SEQ ID NO: 394164 - DNA, 140 bp, Artificial Sequence
  Synthetic
caccgctgtcccaaaaggtcgagtgaagcaatacactgggccacacacgttccgtgctggcacgataccacaaggctttggggggtaatgccagcagtaggggcggtgttcggggccgctcatatcagcagccagggcct

SEQ ID NO: 394165 - DNA, 140 bp, Artificial Sequence
  Synthetic
aggccctggctgctgatatgctgctctgcccctcggggcatgtcgtgggcatcttccgggctgctgtgtgcacccggggggttgcgaaggcggtggactttgtgcccgttgagtctatgggaccttttgggacagcggtg

SEQ ID NO: 394166 - DNA, 140 bp, Artificial Sequence
  Synthetic
caccgctgtcccaaaaggtcccatagactcaacgggcacaaagtccaccgccttcgcaaccccccgggtgcacacagcagcccggaagatgcccacgacatgccccgaggggcagagcagcatatcagcagccagggcct

SEQ ID NO: 394167 - DNA, 140 bp, Artificial Sequence
  Synthetic
aggccctggctgctgatatgtgagtgtcgtacagcctccaggcccccccctcccgggagagccatagtggtctgcggaaccggtgagtacaccggaattgccaggatgaccgggtcctttgaccttttgggacagcggtg

SEQ ID NO: 394168 - DNA, 140 bp, Artificial Sequence
  Synthetic
caccgctgtcccaaaaggtcaaaggacccggtcatcctggcaattccggtgtactcaccggttccgcagaccactatggctctcccgggaggggggggcctggaggctgtacgacactcacatatcagcagccagggcct

SEQ ID NO: 394169 - DNA, 140 bp, Artificial Sequence
  Synthetic
aggccctggctgctgatatgacttcgtgcgcgtccaaggccttctccggatctgcgcgctagtgcgcaagatggccggaggccattacgtgcagatggccatcatcaaggtgggggcgctgaccttttgggacagcggtg

SEQ ID NO: 394170 - DNA, 140 bp, Artificial Sequence
  Synthetic
caccgctgtcccaaaaggtcagcgcccccaccttgatgatggccatctgcacgtaatggcctccggccatcttgcgcactagcgcgcagatccggagaaggccttggacgcgcacgaagtcatatcagcagccagggcct

SEQ ID NO: 394171 - DNA, 140 bp, Artificial Sequence
  Synthetic
atacgccatgctgggtctccttccacgcccgcaacgggattccgcaggcatgtggatcttcttgcgggcgccgcagtggtttgctcatccctgtacattggggatctgtgcggctctctccgtacttgggagtcggccat

SEQ ID NO: 394172 - DNA, 140 bp, Artificial Sequence
  Synthetic
atggccgactcccaagtacggagagagccgcacagatccccaatgtacagggatgagcaaaccactgcggcgcccgcaagaagatccacatgcctgcggaatcccgttgcgggcgtggaaggagacccagcatggcgtat

SEQ ID NO: 394173 - DNA, 140 bp, Artificial Sequence
  Synthetic
aggccctggctgctgatatgcatcatgggatcagatgtggaagtgtctcatacggctaaagcctacgctgcacgggccaacacccctgttgtataggctgggagccgtccaaaacgaggtgaccttttgggacagcggtg

SEQ ID NO: 394174 - DNA, 140 bp, Artificial Sequence
  Synthetic
caccgctgtcccaaaaggtcacctcgttttggacggctcccagcctatacaacaggggtgttggcccgtgcagcgtaggctttagccgtatgagacacttccacatctgatcccatgatgcatatcagcagccagggcct

SEQ ID NO: 394175 - DNA, 140 bp, Artificial Sequence
  Synthetic
aggccctggctgctgatatgcaaatggagaccaagctcattacgtggggggcagacaccgccgcatgcggtgacatcatcaacggcttgcccgtctctgcccgtaggggccgagagatacgaccttttgggacagcggtg

SEQ ID NO: 394176 - DNA, 140 bp, Artificial Sequence
  Synthetic
caccgctgtcccaaaaggtcgtatctctcggcccctacgggcagagacgggcaagccgttgatgatgtcaccgcatgcggcggtgtctgccccccacgtaatgagcttggtctccatttgcatatcagcagccagggcct

SEQ ID NO: 394177 - DNA, 140 bp, Artificial Sequence
  Synthetic
atacgccatgctgggtctcctttcacccctggtgccaagcagaatctacaactcatcaagtccaatggcagctggcacataaacaggactgctctgaactgcaatgattccctccagacgcgtacttgggagtcggccat

SEQ ID NO: 394178 - DNA, 140 bp, Artificial Sequence
  Synthetic
atggccgactcccaagtacgcgtctggagggaatcattgcagttcagagcagtcctgtttatgtgccagctgccattggacttgatgagttgtagattctgcttggcaccaggggtgaaaggagacccagcatggcgtat

SEQ ID NO: 394179 - DNA, 140 bp, Artificial Sequence
  Synthetic
aggccctggctgctgatatggggtcctgttatccagatgtataccaatgtagaccaagacctcgtaggctggcccgctccccaaggtgcccgctcattgacaccctgcacttgcggctccgaccttttgggacagcggtg

SEQ ID NO: 394180 - DNA, 140 bp, Artificial Sequence
  Synthetic
caccgctgtcccaaaaggtcggagccgcaagtgcagggtgtcaatgagcgggcaccttggggagcgggccagcctacgaggtcttggtctacattggtatacatctggataacaggaccccatatcagcagccagggcct

SEQ ID NO: 394181 - DNA, 140 bp, Artificial Sequence
  Synthetic
atacgccatgctgggtctccctcccagccccgtggtggtgggaacgaccaacaagttgggcgcgcctacctacaactggggtagtaatgactcggacgttttcgtccttaacaacaccagcgtacttgggagtcggccat

SEQ ID NO: 394182 - DNA, 140 bp, Artificial Sequence
  Synthetic
atggccgactcccaagtacgctggtgttgttaaggacgaaaacgtccgagtcattactaccccagttgtaggtaggcgcgcccaacttgttggtcgttcccaccaccacggggctgggagggagacccagcatggcgtat

SEQ ID NO: 394183 - DNA, 140 bp, Artificial Sequence
  Synthetic
atacgccatgctgggtctcctcggccgtcgacagcggcacggcgaccgcccctcccgaccaggcctccgacgacggcgacaaaggatccgacgttgagtcgtactcctccatgccccccccgtacttgggagtcggccat

SEQ ID NO: 394184 - DNA, 140 bp, Artificial Sequence
  Synthetic
atggccgactcccaagtacggggggggcatggaggagtacgactcaacgtcggatcctttgtcgccgtcgtcggaggcctggtcgggaggggcggtcgccgtgccgctgtcgacggccgaggagacccagcatggcgtat

SEQ ID NO: 394185 - DNA, 140 bp, Artificial Sequence
  Synthetic
atacgccatgctgggtctccgacccgcggatgatatgcagcgcggaggttggaagcttttggctcccatcaccgcgtatgcgcagcagacgaggggcctagtcggcaccattgtgaccagcgtacttgggagtcggccat

SEQ ID NO: 394186 - DNA, 140 bp, Artificial Sequence
  Synthetic
atggccgactcccaagtacgctggtcacaatggtgccgactaggcccctcgtctgctgcgcatacgcggtgatgggagccaaaagcttccaacctccgcgctgcatatcatccgcgggtcggagacccagcatggcgtat

SEQ ID NO: 394187 - DNA, 140 bp, Artificial Sequence
  Synthetic
aggccctggctgctgatatgaccgcgtatgcgcagcagacgaggggcctagtcggcaccattgtgaccagcctaaccgggcgtgacaaaaatgaggtcgaaggggaggtacaggtggtctgaccttttgggacagcggtg

SEQ ID NO: 394188 - DNA, 140 bp, Artificial Sequence
  Synthetic
caccgctgtcccaaaaggtcagaccacctgtacctccccttcgacctcatttttgtcacgcccggttaggctggtcacaatggtgccgactaggcccctcgtctgctgcgcatacgcggtcatatcagcagccagggcct

SEQ ID NO: 394189 - DNA, 140 bp, Artificial Sequence
  Synthetic
aggccctggctgctgatatgtgatgctgctgatagcccaggctgaggccgccttagagaacttggtggtcctcaatgcggcgtccgtggccggagcgcatggtatcctctccttccttgtgaccttttgggacagcggtg

SEQ ID NO: 394190 - DNA, 140 bp, Artificial Sequence
  Synthetic
caccgctgtcccaaaaggtcacaaggaaggagaggataccatgcgctccggccacggacgccgcattgaggaccaccaagttctctaaggcggcctcagcctgggctatcagcagcatcacatatcagcagccagggcct

SEQ ID NO: 394191 - DNA, 140 bp, Artificial Sequence
  Synthetic
aggccctggctgctgatatgccgccacgtgcttacgccatggaccgggagatggctgcatcatgtggaggcgcagtttttgtaggattggcattcttgactttgtcgccatactataaaggaccttttgggacagcggtg

SEQ ID NO: 394192 - DNA, 140 bp, Artificial Sequence
  Synthetic
caccgctgtcccaaaaggtcctttatagtatggcgacaaagtcaagaatgccaatcctacaaaaactgcgcctccacatgatgcagccatctcccggtccatggcgtaagcacgtggcggcatatcagcagccagggcct

SEQ ID NO: 394193 - DNA, 140 bp, Artificial Sequence
  Synthetic
aggccctggctgctgatatggaagcccgctgtccattccgcgtggcctagggtggaggagttttggaggaaacacatgtggaactttgtcagcgggattcagtacctggcgggcttatccgaccttttgggacagcggtg

SEQ ID NO: 394194 - DNA, 140 bp, Artificial Sequence
  Synthetic
caccgctgtcccaaaaggtcggataagcccgccaggtactgaatcccgctgacaaagttccacatgtgtttcctccaaaactcctccaccctaggccacgcggaatggacagcgggcttccatatcagcagccagggcct

SEQ ID NO: 394195 - DNA, 140 bp, Artificial Sequence
  Synthetic
atacgccatgctgggtctcccgtgtgtgctgccatcttaagacgccacgttggccctgctgagggtgctaatcagtggatgaacaggctaatagcctttgcatcaagaggcaaccacgtgcgtacttgggagtcggccat

SEQ ID NO: 394196 - DNA, 140 bp, Artificial Sequence
  Synthetic
atggccgactcccaagtacgcacgtggttgcctcttgatgcaaaggctattagcctgttcatccactgattagcaccctcagcagggccaacgtggcgtcttaagatggcagcacacacgggagacccagcatggcgtat

SEQ ID NO: 394197 - DNA, 140 bp, Artificial Sequence
  Synthetic
aggccctggctgctgatatggtagaccaggacctcgtcggctggcaggcgccccccggggcacgttccatgacaccatgcacctgcggcagctcggacctttacttggtcacgagacatggaccttttgggacagcggtg

SEQ ID NO: 394198 - DNA, 140 bp, Artificial Sequence
  Synthetic
caccgctgtcccaaaaggtccatgtctcgtgaccaagtaaaggtccgagctgccgcaggtgcatggtgtcatggaacgtgccccggggggcgcctgccagccgacgaggtcctggtctaccatatcagcagccagggcct

SEQ ID NO: 394199 - DNA, 140 bp, Artificial Sequence
  Synthetic
atacgccatgctgggtctcccgcgtgggccgtctcaggaaatccagcttataaacaccaacggcagctggcacatcaacagaactgccctaaactgcaatgactctctcaaaactgggttcgtacttgggagtcggccat

SEQ ID NO: 394200 - DNA, 140 bp, Artificial Sequence
  Synthetic
atggccgactcccaagtacgaacccagttttgagagagtcattgcagtttagggcagttctgttgatgtgccagctgccgttggtgtttataagctggatttcctgagacggcccacgcgggagacccagcatggcgtat

SEQ ID NO: 394201 - DNA, 140 bp, Artificial Sequence
  Synthetic
atacgccatgctgggtctcccgcgctctttggcgggtatccgccgaggactacgttgaggtacggaggttgggcgactgccactatgtggtaggggtcactgctgaagggctgaagtgcccgtacttgggagtcggccat

SEQ ID NO: 394202 - DNA, 140 bp, Artificial Sequence
  Synthetic
atggccgactcccaagtacgggcacttcagcccttcagcagtgacccctaccacatagtggcagtcgcccaacctccgtacctcaacgtagtcctcggcggatacccgccaaagagcgcgggagacccagcatggcgtat

SEQ ID NO: 394203 - DNA, 140 bp, Artificial Sequence
  Synthetic
aggccctggctgctgatatgtcgggcagcctccaggaccccccctcccgggagagccatagtggtctgcggaaccggtgagtacaccggaattgccaggacgaccgggtcctttcttggagaccttttgggacagcggtg

SEQ ID NO: 394204 - DNA, 140 bp, Artificial Sequence
  Synthetic
caccgctgtcccaaaaggtctccaagaaaggacccggtcgtcctggcaattccggtgtactcaccggttccgcagaccactatggctctcccgggagggggggtcctggaggctgcccgacatatcagcagccagggcct

SEQ ID NO: 394205 - DNA, 140 bp, Artificial Sequence
  Synthetic
atacgccatgctgggtctccccacatcacgcagcgccagcctccgccagaagaaggtcacatttgacagagtgcaagtgttcgaccaacattaccgagaggtactaaaggagattaagctcgtacttgggagtcggccat

SEQ ID NO: 394206 - DNA, 140 bp, Artificial Sequence
  Synthetic
atggccgactcccaagtacgagcttaatctcctttagtacctctcggtaatgttggtcgaacacttgcactctgtcaaatgtgaccttcttctggcggaggctggcgctgcgtgatgtggggagacccagcatggcgtat

SEQ ID NO: 394207 - DNA, 140 bp, Artificial Sequence
  Synthetic
aggccctggctgctgatatggagttcgatgagatggaagagtgcgcctcacacctcccttacatcgaacagggaatgcagctcgccgaacaattcaaacagaaggcgctcgggttgctgcgaccttttgggacagcggtg

SEQ ID NO: 394208 - DNA, 140 bp, Artificial Sequence
  Synthetic
caccgctgtcccaaaaggtcgcagcaacccgagcgccttctgtttgaattgttcggcgagctgcattccctgttcgatgtaagggaggtgtgaggcgcactcttccatctcatcgaactccatatcagcagccagggcct

SEQ ID NO: 394209 - DNA, 140 bp, Artificial Sequence
  Synthetic
aggccctggctgctgatatgagtccaccgtgtcttctgccttggcggagctcgctactaagaccttcggcagctccggatcgtcggccgccgacagcggcacggcgactgcccctcctgagaccttttgggacagcggtg

SEQ ID NO: 394210 - DNA, 140 bp, Artificial Sequence
  Synthetic
caccgctgtcccaaaaggtctcaggaggggcagtcgccgtgccgctgtcggcggccgacgatccggagctgccgaaggtcttagtagcgagctccgccaaggcagaagacacggtggactcatatcagcagccagggcct

SEQ ID NO: 394211 - DNA, 140 bp, Artificial Sequence
  Synthetic
aggccctggctgctgatatgtatgacgcgggctgtgcttggtacgagctcacgcccgccgagacctcggtcagactgcgggcttacctaaatacaccagggttgcccgtctgccaggaccgaccttttgggacagcggtg

SEQ ID NO: 394212 - DNA, 140 bp, Artificial Sequence
  Synthetic
caccgctgtcccaaaaggtcggtcctggcagacgggcaaccctggtgtatttaggtaagcccgcagtctgaccgaggtctcggcgggcgtgagctcgtaccaagcacagcccgcgtcatacatatcagcagccagggcct

SEQ ID NO: 394213 - DNA, 140 bp, Artificial Sequence
  Synthetic
atacgccatgctgggtctcctgggtgcacgtggatgaactctacgggctttaccaagacctgtggtgccccgccatgtcagatagtcccaggagattacaacagctctgccaatgagcttcgtacttgggagtcggccat

SEQ ID NO: 394214 - DNA, 140 bp, Artificial Sequence
  Synthetic
atggccgactcccaagtacgaagctcattggcagagctgttgtaatctcctgggactatctgacatggcggggcaccacaggtcttggtaaagcccgtagagttcatccacgtgcacccaggagacccagcatggcgtat

SEQ ID NO: 394215 - DNA, 140 bp, Artificial Sequence
  Synthetic
aggccctggctgctgatatgacctacgggttaggggtggtagggactccatcatcttacttacctgcttgttacatccacagctggggtttgaggtcactaagatcctactagctatcctgaccttttgggacagcggtg

SEQ ID NO: 394216 - DNA, 140 bp, Artificial Sequence
  Synthetic
caccgctgtcccaaaaggtcaggatagctagtaggatcttagtgacctcaaaccccagctgtggatgtaacaagcaggtaagtaagatgatggagtccctaccacccctaacccgtaggtcatatcagcagccagggcct

SEQ ID NO: 394217 - DNA, 140 bp, Artificial Sequence
  Synthetic
atacgccatgctgggtctcctgggaaattcttggccgatgggggatgttccggaggagcgtacgacatcatcatctgtgatgagtgccactccacagaccctacgacggtgttgggcattcgtacttgggagtcggccat

SEQ ID NO: 394218 - DNA, 140 bp, Artificial Sequence
  Synthetic
atggccgactcccaagtacgaatgcccaacaccgtcgtagggtctgtggagtggcactcatcacagatgatgatgtcgtacgctcctccggaacatcccccatcggccaagaatttcccaggagacccagcatggcgtat

SEQ ID NO: 394219 - DNA, 140 bp, Artificial Sequence
  Synthetic
atacgccatgctgggtctccttatgctgagtctagcagatcagaccagaggccatattgctggcactacccacctccacaatgtaccatcgtacctgcgtcggaggtgtgcggcccagtgcgtacttgggagtcggccat

SEQ ID NO: 394220 - DNA, 140 bp, Artificial Sequence
  Synthetic
atggccgactcccaagtacgcactgggccgcacacctccgacgcaggtacgatggtacattgtggaggtgggtagtgccagcaatatggcctctggtctgatctgctagactcagcataaggagacccagcatggcgtat

SEQ ID NO: 394221 - DNA, 140 bp, Artificial Sequence
  Synthetic
aggccctggctgctgatatgcgtcgtcttctccgacatggagaccaagatcatcacctggggagcagacaccgcggcgtgtggggacatcatcttgggtctgcccgtctccgcccgaagggaccttttgggacagcggtg

SEQ ID NO: 394222 - DNA, 140 bp, Artificial Sequence
  Synthetic
caccgctgtcccaaaaggtcccttcgggcggagacgggcagacccaagatgatgtccccacacgccgcggtgtctgctccccaggtgatgatcttggtctccatgtcggagaagacgacgcatatcagcagccagggcct

SEQ ID NO: 394223 - DNA, 140 bp, Artificial Sequence
  Synthetic
aggccctggctgctgatatgagccagagcctgacgtgaccgtagtcacctcaatgctcacagaccccacgcacatcaccgcagagacggcagcacggcggttaaagagggggtcccccccgaccttttgggacagcggtg

SEQ ID NO: 394224 - DNA, 140 bp, Artificial Sequence
  Synthetic
caccgctgtcccaaaaggtcgggggggaccccctctttaaccgccgtgctgccgtctctgcggtgatgtgcgtggggtctgtgagcattgaggtgactacggtcacgtcaggctctggctcatatcagcagccagggcct

SEQ ID NO: 394225 - DNA, 140 bp, Artificial Sequence
  Synthetic
aggccctggctgctgatatgtactccggatcccacaagccgtcgtggacatggtggcgggggcccactggggggtcctggcgggcctcgcctactattccatggtggggaactgggctaagaccttttgggacagcggtg

SEQ ID NO: 394226 - DNA, 140 bp, Artificial Sequence
  Synthetic
caccgctgtcccaaaaggtcttagcccagttccccaccatggaatagtaggcgaggcccgccaggaccccccagtgggcccccgccaccatgtccacgacggcttgtgggatccggagtacatatcagcagccagggcct

SEQ ID NO: 394227 - DNA, 140 bp, Artificial Sequence
  Synthetic
aggccctggctgctgatatgggggtcctggcgggcctcgcctactattccatggtggggaactgggctaaggtcttgattgtgatgctactctttgccggcgttgacggccagacccgcagaccttttgggacagcggtg

SEQ ID NO: 394228 - DNA, 140 bp, Artificial Sequence
  Synthetic
caccgctgtcccaaaaggtctgcgggtctggccgtcaacgccggcaaagagtagcatcacaatcaagaccttagcccagttccccaccatggaatagtaggcgaggcccgccaggacccccatatcagcagccagggcct

SEQ ID NO: 394229 - DNA, 140 bp, Artificial Sequence
  Synthetic
atacgccatgctgggtctccgacgttagaagccatgctagcaaggccgttgaccacatccgctccgtgtgggaggacttgctagaagactctgataccccaattcccacgaccatcatggcgtacttgggagtcggccat

SEQ ID NO: 394230 - DNA, 140 bp, Artificial Sequence
  Synthetic
atggccgactcccaagtacgccatgatggtcgtgggaattggggtatcagagtcttctagcaagtcctcccacacggagcggatgtggtcaacggccttgctagcatggcttctaacgtcggagacccagcatggcgtat

SEQ ID NO: 394231 - DNA, 140 bp, Artificial Sequence
  Synthetic
aggccctggctgctgatatgggaggacttgctagaagactctgataccccaattcccacgaccatcatggctaagaatgaagtcttctgcgtagatccgtcgaagggtggacgcaagccggaccttttgggacagcggtg

SEQ ID NO: 394232 - DNA, 140 bp, Artificial Sequence
  Synthetic
caccgctgtcccaaaaggtccggcttgcgtccacccttcgacggatctacgcagaagacttcattcttagccatgatggtcgtgggaattggggtatcagagtcttctagcaagtcctcccatatcagcagccagggcct

SEQ ID NO: 394233 - DNA, 140 bp, Artificial Sequence
  Synthetic
atacgccatgctgggtctccggcactacgcacctcggccgtgtggtattgtgcccgcgtcgcaagtgtgcggtccagtgtattgtttcaccccaagccctgttgtagtggggacgaccgacgtacttgggagtcggccat

SEQ ID NO: 394234 - DNA, 140 bp, Artificial Sequence
  Synthetic
atggccgactcccaagtacgtcggtcgtccccactacaacagggcttggggtgaaacaatacactggaccgcacacttgcgacgcgggcacaataccacacggccgaggtgcgtagtgccggagacccagcatggcgtat

SEQ ID NO: 394235 - DNA, 140 bp, Artificial Sequence
  Synthetic
aggccctggctgctgatatggtgacttggaggacagggatagatcagagcttagcccactgctgctgtctacaacagagtggcagatactgccctgttccttcaccaccctaccggccctgaccttttgggacagcggtg

SEQ ID NO: 394236 - DNA, 140 bp, Artificial Sequence
  Synthetic
caccgctgtcccaaaaggtcagggccggtagggtggtgaaggaacagggcagtatctgccactctgttgtagacagcagcagtgggctaagctctgatctatccctgtcctccaagtcaccatatcagcagccagggcct

SEQ ID NO: 394237 - DNA, 140 bp, Artificial Sequence
  Synthetic
aggccctggctgctgatatggctcgccgagcaattcaagcagaaagcgctcgggttactgcaaacagccaccaaacaagcggaggctgctgctcccgtggtggagtccaagtggcgagccgaccttttgggacagcggtg

SEQ ID NO: 394238 - DNA, 140 bp, Artificial Sequence
  Synthetic
caccgctgtcccaaaaggtcggctcgccacttggactccaccacgggagcagcagcctccgcttgtttggtggctgtttgcagtaacccgagcgctttctgcttgaattgctcggcgagccatatcagcagccagggcct

SEQ ID NO: 394239 - DNA, 140 bp, Artificial Sequence
  Synthetic
aggccctggctgctgatatggccggcctaactagagtgccgtacttcgtgcgcgctcaagggctcatccgtgcgtgcatgttggtgcggaaagtcgccgggggtcattatgtccaaatgggaccttttgggacagcggtg

SEQ ID NO: 394240 - DNA, 140 bp, Artificial Sequence
  Synthetic
caccgctgtcccaaaaggtcccatttggacataatgacccccggcgactttccgcaccaacatgcacgcacggatgagcccttgagcgcgcacgaagtacggcactctagttaggccggccatatcagcagccagggcct

SEQ ID NO: 394241 - DNA, 140 bp, Artificial Sequence
  Synthetic
atacgccatgctgggtctccagcaagcggcatccctcggagctgttggtctattggttattaccatcttcaccatcacccccatgtataagcagctgttgacctgcttcatttggtggaacgtacttgggagtcggccat

SEQ ID NO: 394242 - DNA, 140 bp, Artificial Sequence
  Synthetic
atggccgactcccaagtacgttccaccaaatgaagcaggtcaacagctgcttatacatgggggtgatggtgaagatggtaataaccaatagaccaacagctccgagggatgccgcttgctggagacccagcatggcgtat

SEQ ID NO: 394243 - DNA, 140 bp, Artificial Sequence
  Synthetic
atacgccatgctgggtctccgaccacctacgtcaccgggggatctgaaggccgagccgcaaacatcattgctagtctcttcaccccgggcgccaagcagaacctccagctgatcaacacccgtacttgggagtcggccat

SEQ ID NO: 394244 - DNA, 140 bp, Artificial Sequence
  Synthetic
atggccgactcccaagtacgggtgttgatcagctggaggttctgcttggcgcccggggtgaagagactagcaatgatgtttgcggctcggccttcagatcccccggtgacgtaggtggtcggagacccagcatggcgtat

SEQ ID NO: 394245 - DNA, 140 bp, Artificial Sequence
  Synthetic
aggccctggctgctgatatgggattcttcaagccagtttgctaaaagtaccctacttcgtgcgcgttcagggtcttctccgggcctgcgcgctagcgcggaagctggccggaggccattagaccttttgggacagcggtg

SEQ ID NO: 394246 - DNA, 140 bp, Artificial Sequence
  Synthetic
caccgctgtcccaaaaggtctaatggcctccggccagcttccgcgctagcgcgcaggcccggagaagaccctgaacgcgcacgaagtagggtacttttagcaaactggcttgaagaatcccatatcagcagccagggcct

SEQ ID NO: 394247 - DNA, 140 bp, Artificial Sequence
  Synthetic
atacgccatgctgggtctcctgttaagccttcggcttcggaccagaggccatactgctggcactacgcacctcaaccgtgtggtatcgtacctgcgtcggaggtgtgtggtccagtgtatcgtacttgggagtcggccat

SEQ ID NO: 394248 - DNA, 140 bp, Artificial Sequence
  Synthetic
atggccgactcccaagtacgatacactggaccacacacctccgacgcaggtacgataccacacggttgaggtgcgtagtgccagcagtatggcctctggtccgaagccgaaggcttaacaggagacccagcatggcgtat

SEQ ID NO: 394249 - DNA, 140 bp, Artificial Sequence
  Synthetic
atacgccatgctgggtctccttagttgactatccatacagactttggcactacccctgcactgtcaattttagcatctttaagatcagaatgtacgtggggggcctggaacacaggctcacgtacttgggagtcggccat

SEQ ID NO: 394250 - DNA, 140 bp, Artificial Sequence
  Synthetic
atggccgactcccaagtacgtgagcctgtgttccaggccccccacgtacattctgatcttaaagatgctaaaattgacagtgcaggggtagtgccaaagtctgtatggatagtcaactaaggagacccagcatggcgtat

SEQ ID NO: 394251 - DNA, 140 bp, Artificial Sequence
  Synthetic
atacgccatgctgggtctccttgagtcagaggacaaagtggtgattctggactccttcgatccgcttatagcaaaggaggacgagcgggaggtctccgtacccgcagagattctgcggaacgtacttgggagtcggccat

SEQ ID NO: 394252 - DNA, 140 bp, Artificial Sequence
  Synthetic
atggccgactcccaagtacgttccgcagaatctctgcgggtacggagacctcccgctcgtcctcctttgctataagcggatcgaaggagtccagaatcaccactttgtcctctgactcaaggagacccagcatggcgtat

SEQ ID NO: 394253 - DNA, 140 bp, Artificial Sequence
  Synthetic
aggccctggctgctgatatgacgcactgagcaactcgttgctacgtcaccacaatctggtgtattccaccacctcacgcagtgcttgccaaaggcagaagaaagtcacatttgacagactgaccttttgggacagcggtg

SEQ ID NO: 394254 - DNA, 140 bp, Artificial Sequence
  Synthetic
caccgctgtcccaaaaggtcagtctgtcaaatgtgactttcttctgcctttggcaagcactgcgtgaggtggtggaatacaccagattgtggtgacgtagcaacgagttgctcagtgcgtcatatcagcagccagggcct

SEQ ID NO: 394255 - DNA, 140 bp, Artificial Sequence
  Synthetic
atacgccatgctgggtctccccttgctcgccatactcgggccgctcacagtgctccaggttggcctaactaaagtgccgtactttgtgcgcgctcaagggctcatccgtgcgtgtatgttcgtacttgggagtcggccat

SEQ ID NO: 394256 - DNA, 140 bp, Artificial Sequence
  Synthetic
atggccgactcccaagtacgaacatacacgcacggatgagcccttgagcgcgcacaaagtacggcactttagttaggccaacctggagcactgtgagcggcccgagtatggcgagcaaggggagacccagcatggcgtat

SEQ ID NO: 394257 - DNA, 140 bp, Artificial Sequence
  Synthetic
aggccctggctgctgatatgcgtcttctctgacatggagaccaagatcatcacctggggggcagacaccgcggcgtgtggagacatcatctcgggtctacccgtctccgcccgaaggggggaccttttgggacagcggtg

SEQ ID NO: 394258 - DNA, 140 bp, Artificial Sequence
  Synthetic
caccgctgtcccaaaaggtccccccttcgggcggagacgggtagacccgagatgatgtctccacacgccgcggtgtctgccccccaggtgatgatcttggtctccatgtcagagaagacgcatatcagcagccagggcct

SEQ ID NO: 394259 - DNA, 140 bp, Artificial Sequence
  Synthetic
aggccctggctgctgatatgttacgtactccacctacggcaagttccttgccgacggtggttgctctgggggcgcctatgacatcataatatgtgatgagtgccactcaactgactcgacgaccttttgggacagcggtg

SEQ ID NO: 394260 - DNA, 140 bp, Artificial Sequence
  Synthetic
caccgctgtcccaaaaggtcgtcgagtcagttgagtggcactcatcacatattatgatgtcataggcgcccccagagcaaccaccgtcggcaaggaacttgccgtaggtggagtacgtaacatatcagcagccagggcct

SEQ ID NO: 394261 - DNA, 140 bp, Artificial Sequence
  Synthetic
aggccctggctgctgatatgctcacaacgccagcttcggctcttacctacggtaactccagtgggctataccatctcacaaatgattgccccaactccagcatcgtgctggaggcggatggaccttttgggacagcggtg

SEQ ID NO: 394262 - DNA, 140 bp, Artificial Sequence
  Synthetic
caccgctgtcccaaaaggtccatccgcctccagcacgatgctggagttggggcaatcatttgtgagatggtatagcccactggagttaccgtaggtaagagccgaagctggcgttgtgagcatatcagcagccagggcct

SEQ ID NO: 394263 - DNA, 140 bp, Artificial Sequence
  Synthetic
atacgccatgctgggtctccccatctcacaaatgattgccccaactccagcatcgtgctggaggcggatgctatgatcttgcatttgcctggatgcttgccttgtgtgagggtcggcaatcgtacttgggagtcggccat

SEQ ID NO: 394264 - DNA, 140 bp, Artificial Sequence
  Synthetic
atggccgactcccaagtacgattgccgaccctcacacaaggcaagcatccaggcaaatgcaagatcatagcatccgcctccagcacgatgctggagttggggcaatcatttgtgagatggggagacccagcatggcgtat

SEQ ID NO: 394265 - DNA, 140 bp, Artificial Sequence
  Synthetic
aggccctggctgctgatatgctatgatcttgcatttgcctggatgcttgccttgtgtgagggtcggcaatcagtccacctgctggcatgctgtgtcccccaccctagccataccaaatgcgaccttttgggacagcggtg

SEQ ID NO: 394266 - DNA, 140 bp, Artificial Sequence
  Synthetic
caccgctgtcccaaaaggtcgcatttggtatggctagggtgggggacacagcatgccagcaggtggactgattgccgaccctcacacaaggcaagcatccaggcaaatgcaagatcatagcatatcagcagccagggcct

SEQ ID NO: 394267 - DNA, 140 bp, Artificial Sequence
  Synthetic
aggccctggctgctgatatgatacgctttctatggcgtatggccgctgctcctgctcttgatggcgctaccgccacgggcgtacgccatggaccgggagatggctgcatcgtgcggaggcgaccttttgggacagcggtg

SEQ ID NO: 394268 - DNA, 140 bp, Artificial Sequence
  Synthetic
caccgctgtcccaaaaggtcgcctccgcacgatgcagccatctcccggtccatggcgtacgcccgtggcggtagcgccatcaagagcaggagcagcggccatacgccatagaaagcgtatcatatcagcagccagggcct

SEQ ID NO: 394269 - DNA, 140 bp, Artificial Sequence
  Synthetic
aggccctggctgctgatatgccacctccacagtcccctcctgtgcctccgcctcggaagaagcggacggtggtcctcactgaatcaaccgtatctactgccttggccgaacttgccaccagaccttttgggacagcggtg

SEQ ID NO: 394270 - DNA, 140 bp, Artificial Sequence
  Synthetic
caccgctgtcccaaaaggtctggtggcaagttcggccaaggcagtagatacggttgattcagtgaggaccaccgtccgcttcttccgaggcggaggcacaggaggggactgtggaggtggcatatcagcagccagggcct

SEQ ID NO: 394271 - DNA, 140 bp, Artificial Sequence
  Synthetic
atacgccatgctgggtctccaacagcaacggcagctggcacatcaatcgcacagccttaaactgcaatgatagccttcataccggctggatagcagggctcttctatcacaacaaattcacgtacttgggagtcggccat

SEQ ID NO: 394272 - DNA, 140 bp, Artificial Sequence
  Synthetic
atggccgactcccaagtacgtgaatttgttgtgatagaagagccctgctatccagccggtatgaaggctatcattgcagtttaaggctgtgcgattgatgtgccagctgccgttgctgttggagacccagcatggcgtat

SEQ ID NO: 394273 - DNA, 140 bp, Artificial Sequence
  Synthetic
atacgccatgctgggtctcccccagagcggatggctgcgtgtaagcccctcgcggacttccggcaggggtggggccaaataacctacaaagtcaacatctcgggcccctctgacgaccgtcgtacttgggagtcggccat

SEQ ID NO: 394274 - DNA, 140 bp, Artificial Sequence
  Synthetic
atggccgactcccaagtacgacggtcgtcagaggggcccgagatgttgactttgtaggttatttggccccacccctgccggaagtccgcgaggggcttacacgcagccatccgctctgggggagacccagcatggcgtat

SEQ ID NO: 394275 - DNA, 140 bp, Artificial Sequence
  Synthetic
aggccctggctgctgatatgggagagatccccttctatggcaaggccatccccctcgaggccatcaagggggggaggcatctcattttctgccattccaagaagaaatgtgacgagctcggaccttttgggacagcggtg

SEQ ID NO: 394276 - DNA, 140 bp, Artificial Sequence
  Synthetic
caccgctgtcccaaaaggtccgagctcgtcacatttcttcttggaatggcagaaaatgagatgcctcccccccttgatggcctcgagggggatggccttgccatagaaggggatctctcccatatcagcagccagggcct

SEQ ID NO: 394277 - DNA, 140 bp, Artificial Sequence
  Synthetic
atacgccatgctgggtctcccctgcggaaaaccaggaaatttcccccagcgatacccatatgggcacgcccggattacaacccaccactgatagagtcttggagggacccggactacgtccgtacttgggagtcggccat

SEQ ID NO: 394278 - DNA, 140 bp, Artificial Sequence
  Synthetic
atggccgactcccaagtacggacgtagtccgggtccctccaagactctatcagtggtgggttgtaatccgggcgtgcccatatgggtatcgctgggggaaatttcctggttttccgcaggggagacccagcatggcgtat

SEQ ID NO: 394279 - DNA, 140 bp, Artificial Sequence
  Synthetic
atacgccatgctgggtctccaccacctccacggagaaagaagacggttgttctgacagaatccactgtgtcttctgccttggccgaacttgctgtaaaggctttcggcagctctggatcgcgtacttgggagtcggccat

SEQ ID NO: 394280 - DNA, 140 bp, Artificial Sequence
  Synthetic
atggccgactcccaagtacgcgatccagagctgccgaaagcctttacagcaagttcggccaaggcagaagacacagtggattctgtcagaacaaccgtcttctttctccgtggaggtggtggagacccagcatggcgtat

SEQ ID NO: 394281 - DNA, 140 bp, Artificial Sequence
  Synthetic
aggccctggctgctgatatgagttggcacatcaatagtacggccttgaactgcaatgacagccttaacaccggctggatagcaggtctcctctatgcccacaaattcaactcttcgggctgaccttttgggacagcggtg

SEQ ID NO: 394282 - DNA, 140 bp, Artificial Sequence
  Synthetic
caccgctgtcccaaaaggtcagcccgaagagttgaatttgtgggcatagaggagacctgctatccagccggtgttaaggctgtcattgcagttcaaggccgtactattgatgtgccaactcatatcagcagccagggcct

SEQ ID NO: 394283 - DNA, 140 bp, Artificial Sequence
  Synthetic
aggccctggctgctgatatgtgcaagctgacgcccccacattcggccaaatccaaatttggctatggggcaaaggacgtccggaacctatccagcaaggccgttaaccacatccactccggaccttttgggacagcggtg

SEQ ID NO: 394284 - DNA, 140 bp, Artificial Sequence
  Synthetic
caccgctgtcccaaaaggtccggagtggatgtggttaacggccttgctggataggttccggacgtcctttgccccatagccaaatttggatttggccgaatgtgggggcgtcagcttgcacatatcagcagccagggcct

SEQ ID NO: 394285 - DNA, 140 bp, Artificial Sequence
  Synthetic
atacgccatgctgggtctcctgtggcccagtgtattgcttcactcctagccccgtggtggtgggaacgaccgacaagttgggcgtgcctacctacaactggggtagcaatgacacggacgcgtacttgggagtcggccat

SEQ ID NO: 394286 - DNA, 140 bp, Artificial Sequence
  Synthetic
atggccgactcccaagtacgcgtccgtgtcattgctaccccagttgtaggtaggcacgcccaacttgtcggtcgttcccaccaccacggggctaggagtgaagcaatacactgggccacaggagacccagcatggcgtat

SEQ ID NO: 394287 - DNA, 140 bp, Artificial Sequence
  Synthetic
aggccctggctgctgatatgtacggggtggggtcaagcattgtgtcctgggccatcaagtgggagtacgtcatcctcttgtttctcctgcttgcagacgcgcgcgtctgctcctgcttgtgaccttttgggacagcggtg

SEQ ID NO: 394288 - DNA, 140 bp, Artificial Sequence
  Synthetic
caccgctgtcccaaaaggtcacaagcaggagcagacgcgcgcgtctgcaagcaggagaaacaagaggatgacgtactcccacttgatggcccaggacacaatgcttgaccccaccccgtacatatcagcagccagggcct

SEQ ID NO: 394289 - DNA, 140 bp, Artificial Sequence
  Synthetic
aggccctggctgctgatatgggccttgcctactattccatggtggggaactgggctaaggtcttggttgtgatgctactctttgccggcgttgacgggactacccacgtgtcaggggcgcgaccttttgggacagcggtg

SEQ ID NO: 394290 - DNA, 140 bp, Artificial Sequence
  Synthetic
caccgctgtcccaaaaggtcgcgcccctgacacgtgggtagtcccgtcaacgccggcaaagagtagcatcacaaccaagaccttagcccagttccccaccatggaatagtaggcaaggcccatatcagcagccagggcct

SEQ ID NO: 394291 - DNA, 140 bp, Artificial Sequence
  Synthetic
aggccctggctgctgatatgttgacatcaccaagctgctgctggccgtcttcggacccctttggattcttcaaaccagcctgctcaaagtgccctacttcgtgcgcgtccaaggccttctgaccttttgggacagcggtg

SEQ ID NO: 394292 - DNA, 140 bp, Artificial Sequence
  Synthetic
caccgctgtcccaaaaggtcagaaggccttggacgcgcacgaagtagggcactttgagcaggctggtttgaagaatccaaaggggtccgaagacggccagcagcagcttggtgatgtcaacatatcagcagccagggcct

SEQ ID NO: 394293 - DNA, 140 bp, Artificial Sequence
  Synthetic
aggccctggctgctgatatgctcactcctcttcgggactgggcgcacaacggcctacgagatctggccgtggctgtagagccagtcgtcttttcccagatggagaccaagctcatcacgtgaccttttgggacagcggtg

SEQ ID NO: 394294 - DNA, 140 bp, Artificial Sequence
  Synthetic
caccgctgtcccaaaaggtcacgtgatgagcttggtctccatctgggaaaagacgactggctctacagccacggccagatctcgtaggccgttgtgcgcccagtcccgaagaggagtgagcatatcagcagccagggcct

SEQ ID NO: 394295 - DNA, 140 bp, Artificial Sequence
  Synthetic
aggccctggctgctgatatggccataaggtcgctcacagagcggctttatatcgggggccccctgactaattcaaaggggcagaactgcggttatcgccggtgccgcgccagcggcgtgcgaccttttgggacagcggtg

SEQ ID NO: 394296 - DNA, 140 bp, Artificial Sequence
  Synthetic
caccgctgtcccaaaaggtcgcacgccgctggcgcggcaccggcgataaccgcagttctgcccctttgaattagtcagggggcccccgatataaagccgctctgtgagcgaccttatggccatatcagcagccagggcct

SEQ ID NO: 394297 - DNA, 140 bp, Artificial Sequence
  Synthetic
atacgccatgctgggtctccatcttcccggttgctctttctctatcttccttttggcactactctcgtgcctcacaacgccagcttcggcccttacctacggtaactccagtgggctgtacgtacttgggagtcggccat

SEQ ID NO: 394298 - DNA, 140 bp, Artificial Sequence
  Synthetic
atggccgactcccaagtacgtacagcccactggagttaccgtaggtaagggccgaagctggcgttgtgaggcacgagagtagtgccaaaaggaagatagagaaagagcaaccgggaagatggagacccagcatggcgtat

SEQ ID NO: 394299 - DNA, 140 bp, Artificial Sequence
  Synthetic
aggccctggctgctgatatgctctcagctgttcaccttctcgcctcgccggcatgagacagtacaggactgcaattgctcaatctatcccggccacgtgtcaggtcaccgcatggcttgggaccttttgggacagcggtg

SEQ ID NO: 394300 - DNA, 140 bp, Artificial Sequence
  Synthetic
caccgctgtcccaaaaggtcccaagccatgcggtgacctgacacgtggccgggatagattgagcaattgcagtcctgtactgtctcatgccggcgaggcgagaaggtgaacagctgagagcatatcagcagccagggcct

SEQ ID NO: 394301 - DNA, 140 bp, Artificial Sequence
  Synthetic
aggccctggctgctgatatggctggcacataaacaggactgctttgaactgcaatgattccctccagacggggttcatagcgtcactcttttatgcccacaaattcaactcctcgggctggaccttttgggacagcggtg

SEQ ID NO: 394302 - DNA, 140 bp, Artificial Sequence
  Synthetic
caccgctgtcccaaaaggtccagcccgaggagttgaatttgtgggcataaaagagtgacgctatgaaccccgtctggagggaatcattgcagttcaaagcagtcctgtttatgtgccagccatatcagcagccagggcct

SEQ ID NO: 394303 - DNA, 140 bp, Artificial Sequence
  Synthetic
atacgccatgctgggtctccccctactgctggcattacgctcctaggccatgtagcgtggtgtcggctagcacggtgtgcggtcctgtttactgcttcactcccagccctgttgtggtagcgtacttgggagtcggccat

SEQ ID NO: 394304 - DNA, 140 bp, Artificial Sequence
  Synthetic
atggccgactcccaagtacgctaccacaacagggctgggagtgaagcagtaaacaggaccgcacaccgtgctagccgacaccacgctacatggcctaggagcgtaatgccagcagtagggggagacccagcatggcgtat

SEQ ID NO: 394305 - DNA, 140 bp, Artificial Sequence
  Synthetic
aggccctggctgctgatatgttcttctgtgctgcctggtacatcaagggcaggctggtccctggggcggcatatgctctctatggcgtatggccgctactcctgctcctgctggcgttacgaccttttgggacagcggtg

SEQ ID NO: 394306 - DNA, 140 bp, Artificial Sequence
  Synthetic
caccgctgtcccaaaaggtcgtaacgccagcaggagcaggagtagcggccatacgccatagagagcatatgccgccccagggaccagcctgcccttgatgtaccaggcagcacagaagaacatatcagcagccagggcct

SEQ ID NO: 394307 - DNA, 140 bp, Artificial Sequence
  Synthetic
aggccctggctgctgatatggatgccatcatcctcctcacgtgtgcgatccacccagagctaatctttaccatcaccaaaatcttgctcgccatactcggtccgctcatggtgctccagggaccttttgggacagcggtg

SEQ ID NO: 394308 - DNA, 140 bp, Artificial Sequence
  Synthetic
caccgctgtcccaaaaggtccctggagcaccatgagcggaccgagtatggcgagcaagattttggtgatggtaaagattagctctgggtggatcgcacacgtgaggaggatgatggcatccatatcagcagccagggcct

SEQ ID NO: 394309 - DNA, 140 bp, Artificial Sequence
  Synthetic
aggccctggctgctgatatgtacgccatggaccgggaggtgactgcatcgtgcggaggcgcggttcttataggtttggcactcttgaccttgtcaccacactataaagtgatcctcgctagaccttttgggacagcggtg

SEQ ID NO: 394310 - DNA, 140 bp, Artificial Sequence
  Synthetic
caccgctgtcccaaaaggtctagcgaggatcactttatagtgtggtgacaaggtcaagagtgccaaacctataagaaccgcgcctccgcacgatgcagtcacctcccggtccatggcgtacatatcagcagccagggcct

SEQ ID NO: 394311 - DNA, 140 bp, Artificial Sequence
  Synthetic
atacgccatgctgggtctcccctcctcacatgcgcggttcacccagggctgatttttgaaatcaccaagatcttgctcgccatatttggaccgctcacggtgctccaggccggcctaattcgtacttgggagtcggccat

SEQ ID NO: 394312 - DNA, 140 bp, Artificial Sequence
  Synthetic
atggccgactcccaagtacgaattaggccggcctggagcaccgtgagcggtccaaatatggcgagcaagatcttggtgatttcaaaaatcagccctgggtgaaccgcgcatgtgaggaggggagacccagcatggcgtat

SEQ ID NO: 394313 - DNA, 140 bp, Artificial Sequence
  Synthetic
aggccctggctgctgatatgtcttgctcgccatatttggaccgctcacggtgctccaggccggcctaattagagtgccgtacttcgtgcgcgctcaagggcttatccgtgcgtgcatgctgaccttttgggacagcggtg

SEQ ID NO: 394314 - DNA, 140 bp, Artificial Sequence
  Synthetic
caccgctgtcccaaaaggtcagcatgcacgcacggataagcccttgagcgcgcacgaagtacggcactctaattaggccggcctggagcaccgtgagcggtccaaatatggcgagcaagacatatcagcagccagggcct

SEQ ID NO: 394315 - DNA, 140 bp, Artificial Sequence
  Synthetic
aggccctggctgctgatatgcaggggtggcggctccttgcgcctatcacggcctactcccaacagacgcggggcctacttggctgtatcatcactagcctcacaggccgggacaagaaccgaccttttgggacagcggtg

SEQ ID NO: 394316 - DNA, 140 bp, Artificial Sequence
  Synthetic
caccgctgtcccaaaaggtcggttcttgtcccggcctgtgaggctagtgatgatacagccaagtaggccccgcgtctgttgggagtaggccgtgataggcgcaaggagccgccacccctgcatatcagcagccagggcct

SEQ ID NO: 394317 - DNA, 140 bp, Artificial Sequence
  Synthetic
atacgccatgctgggtctccagtgtgtcaaatgtacaccaatgtggacaaggacctagtaggatggccatctcccccgggagcaaggtcgctcaccccatgtacttgtggctctagtgaccgtacttgggagtcggccat

SEQ ID NO: 394318 - DNA, 140 bp, Artificial Sequence
  Synthetic
atggccgactcccaagtacggtcactagagccacaagtacatggggtgagcgaccttgctcccgggggagatggccatcctactaggtccttgtccacattggtgtacatttgacacactggagacccagcatggcgtat

SEQ ID NO: 394319 - DNA, 140 bp, Artificial Sequence
  Synthetic
atacgccatgctgggtctccggcgatgtcgtcatctgcgcaacagacgcccttatgaccggctacacaggcgatttcgattccgtcatcgactgtaacgtagccgtgacacaggtggtggcgtacttgggagtcggccat

SEQ ID NO: 394320 - DNA, 140 bp, Artificial Sequence
  Synthetic
atggccgactcccaagtacgccaccacctgtgtcacggctacgttacagtcgatgacggaatcgaaatcgcctgtgtagccggtcataagggcgtctgttgcgcagatgacgacatcgccggagacccagcatggcgtat

SEQ ID NO: 394321 - DNA, 140 bp, Artificial Sequence
  Synthetic
aggccctggctgctgatatgtgacgggctataccggcgactttgactcagtgatcgactgcaacacatgtgtcacccagacagtcgacttcagcttggaccctaccttcaccattgagacgaccttttgggacagcggtg

SEQ ID NO: 394322 - DNA, 140 bp, Artificial Sequence
  Synthetic
caccgctgtcccaaaaggtcgtctcaatggtgaaggtagggtccaagctgaagtcgactgtctgggtgacacatgtgttgcagtcgatcactgagtcaaagtcgccggtatagcccgtcacatatcagcagccagggcct

SEQ ID NO: 394323 - DNA, 140 bp, Artificial Sequence
  Synthetic
atacgccatgctgggtctccgcggctggatagccgcccaagtggctcccccccccgcgtctacagcttttgtcgtgagcggtctagcaggcgccacggttgcaagcattgggctcgggagcgtacttgggagtcggccat

SEQ ID NO: 394324 - DNA, 140 bp, Artificial Sequence
  Synthetic
atggccgactcccaagtacgctcccgagcccaatgcttgcaaccgtggcgcctgctagaccgctcacgacaaaagctgtagacgcgggggggggagccacttgggcggctatccagccgcggagacccagcatggcgtat

SEQ ID NO: 394325 - DNA, 140 bp, Artificial Sequence
  Synthetic
atacgccatgctgggtctccgttgtacaggctaggggccgtccaaaacgagatcaccctcacgcaccccataaccaaattcatcatgacatgcatgtcagctgacctagaggtcgtcacgcgtacttgggagtcggccat

SEQ ID NO: 394326 - DNA, 140 bp, Artificial Sequence
  Synthetic
atggccgactcccaagtacgcgtgacgacctctaggtcagctgacatgcatgtcatgatgaatttggttatggggtgcgtgagggtgatctcgttttggacggcccctagcctgtacaacggagacccagcatggcgtat

SEQ ID NO: 394327 - DNA, 140 bp, Artificial Sequence
  Synthetic
aggccctggctgctgatatgtaaccaaattcatcatgacatgcatgtcagctgacctagaggtcgtcacgagcacttgggtactagtagggggggttcttgcagctctggccgcgtactggaccttttgggacagcggtg

SEQ ID NO: 394328 - DNA, 140 bp, Artificial Sequence
  Synthetic
caccgctgtcccaaaaggtccagtacgcggccagagctgcaagaaccccccctactagtacccaagtgctcgtgacgacctctaggtcagctgacatgcatgtcatgatgaatttggttacatatcagcagccagggcct

SEQ ID NO: 394329 - DNA, 140 bp, Artificial Sequence
  Synthetic
aggccctggctgctgatatgacaccggacgacgcctgctcagaagcagagtcctacagctcaatgccccctcttgagggggagcctggtgaccctgacctaagctcaggctcttggtccagaccttttgggacagcggtg

SEQ ID NO: 394330 - DNA, 140 bp, Artificial Sequence
  Synthetic
caccgctgtcccaaaaggtctggaccaagagcctgagcttaggtcagggtcaccaggctccccctcaagagggggcattgagctgtaggactctgcttctgagcaggcgtcgtccggtgtcatatcagcagccagggcct

SEQ ID NO: 394331 - DNA, 140 bp, Artificial Sequence
  Synthetic
atacgccatgctgggtctcctgccaagcagaacatccagctgatcaacaccaatggcagttggcacatcaaccgcacggccttgaactgcaacgatagccttcagaccggctgggtggcacgtacttgggagtcggccat

SEQ ID NO: 394332 - DNA, 140 bp, Artificial Sequence
  Synthetic
atggccgactcccaagtacgtgccacccagccggtctgaaggctatcgttgcagttcaaggccgtgcggttgatgtgccaactgccattggtgttgatcagctggatgttctgcttggcaggagacccagcatggcgtat

SEQ ID NO: 394333 - DNA, 140 bp, Artificial Sequence
  Synthetic
aggccctggctgctgatatgaccgcacggccttgaactgcaacgatagccttcagaccggctgggtggcagggctcttttatgtcaacaaattcaactcttcaggctgtcccgaaaggttgaccttttgggacagcggtg

SEQ ID NO: 394334 - DNA, 140 bp, Artificial Sequence
  Synthetic
caccgctgtcccaaaaggtcaacctttcgggacagcctgaagagttgaatttgttgacataaaagagccctgccacccagccggtctgaaggctatcgttgcagttcaaggccgtgcggtcatatcagcagccagggcct

SEQ ID NO: 394335 - DNA, 140 bp, Artificial Sequence
  Synthetic
aggccctggctgctgatatggcatgaccactgacaacgtaaaatgcccatgccaggttccggcccccgaattcttcacagaagtggatggggtgcggttgcacaggtacgctccggcgtggaccttttgggacagcggtg

SEQ ID NO: 394336 - DNA, 140 bp, Artificial Sequence
  Synthetic
caccgctgtcccaaaaggtccacgccggagcgtacctgtgcaaccgcaccccatccacttctgtgaagaattcgggggccggaacctggcatgggcattttacgttgtcagtggtcatgccatatcagcagccagggcct

SEQ ID NO: 394337 - DNA, 140 bp, Artificial Sequence
  Synthetic
atacgccatgctgggtctccacctggttgggtcacagctcccatgcgagcccgaaccggacgtaacagtgcttacttccatgctcaccgacccctcccacattacagcagagacggctaacgtacttgggagtcggccat

SEQ ID NO: 394338 - DNA, 140 bp, Artificial Sequence
  Synthetic
atggccgactcccaagtacgttagccgtctctgctgtaatgtgggaggggtcggtgagcatggaagtaagcactgttacgtccggttcgggctcgcatgggagctgtgacccaaccaggtggagacccagcatggcgtat

SEQ ID NO: 394339 - DNA, 140 bp, Artificial Sequence
  Synthetic
aggccctggctgctgatatggcgcgcctacctacaactggggtgaaaatgatacggacgtcttcgtccttaacaacaccaggccaccgctgggcaattggttcggttgcacctggatgaagaccttttgggacagcggtg

SEQ ID NO: 394340 - DNA, 140 bp, Artificial Sequence
  Synthetic
caccgctgtcccaaaaggtcttcatccaggtgcaaccgaaccaattgcccagcggtggcctggtgttgttaaggacgaagacgtccgtatcattttcaccccagttgtaggtaggcgcgccatatcagcagccagggcct

SEQ ID NO: 394341 - DNA, 140 bp, Artificial Sequence
  Synthetic
atacgccatgctgggtctcccctctgcgagcggaggaggatgagagggaagtgtccattgcggcggagatcctgcggaaaaccaggagtttccccccggcaattcctgtatgggcacgcccgtacttgggagtcggccat

SEQ ID NO: 394342 - DNA, 140 bp, Artificial Sequence
  Synthetic
atggccgactcccaagtacgggcgtgcccatacaggaattgccggggggaaactcctggttttccgcaggatctccgccgcaatggacacttccctctcatcctcctccgctcgcagaggggagacccagcatggcgtat

SEQ ID NO: 394343 - DNA, 140 bp, Artificial Sequence
  Synthetic
aggccctggctgctgatatgtgacgactagctgcggtaataccctcacatgttacttgaaggccactgcggcctgtcgagctgcgaagctccaggactgcacgatgctcgtgtgcggagagaccttttgggacagcggtg

SEQ ID NO: 394344 - DNA, 140 bp, Artificial Sequence
  Synthetic
caccgctgtcccaaaaggtctctccgcacacgagcatcgtgcagtcctggagcttcgcagctcgacaggccgcagtggccttcaagtaacatgtgagggtattaccgcagctagtcgtcacatatcagcagccagggcct

SEQ ID NO: 394345 - DNA, 140 bp, Artificial Sequence
  Synthetic
aggccctggctgctgatatgggccgccttgtgcctgcgtgtacctacatggcactgggaatgtggccgctgctcctgacaatcttggccctgcctcaccgagcatacgctatggacaatggaccttttgggacagcggtg

SEQ ID NO: 394346 - DNA, 140 bp, Artificial Sequence
  Synthetic
caccgctgtcccaaaaggtccattgtccatagcgtatgctcggtgaggcagggccaagattgtcaggagcagcggccacattcccagtgccatgtaggtacacgcaggcacaaggcggcccatatcagcagccagggcct

SEQ ID NO: 394347 - DNA, 140 bp, Artificial Sequence
  Synthetic
aggccctggctgctgatatgaccatcacccccatgtacaagaagctgttgacctgcttcatttggtggaaccagtatttcctcgcccgagctgaggccatgatacacgagtgggtgcccggaccttttgggacagcggtg

SEQ ID NO: 394348 - DNA, 140 bp, Artificial Sequence
  Synthetic
caccgctgtcccaaaaggtccgggcacccactcgtgtatcatggcctcagctcgggcgaggaaatactggttccaccaaatgaagcaggtcaacagcttcttgtacatgggggtgatggtcatatcagcagccagggcct

SEQ ID NO: 394349 - DNA, 140 bp, Artificial Sequence
  Synthetic
atacgccatgctgggtctccgggggtaagtacgtgcaggcgtgccttctgaggttgggcgcttggactggtacctttgtctatgaccatctcacccccctctctgactgggctagcgacgcgtacttgggagtcggccat

SEQ ID NO: 394350 - DNA, 140 bp, Artificial Sequence
  Synthetic
atggccgactcccaagtacgcgtcgctagcccagtcagagaggggggtgagatggtcatagacaaaggtaccagtccaagcgcccaacctcagaaggcacgcctgcacgtacttacccccggagacccagcatggcgtat

SEQ ID NO: 394351 - DNA, 140 bp, Artificial Sequence
  Synthetic
aggccctggctgctgatatgcctgcttgctgcaggggtaggcctctacctcctccccaaccgatgaacctagtcacggctagctgtgaggtcatagctgtttcctgatctccgacttgttgaccttttgggacagcggtg

SEQ ID NO: 394352 - DNA, 140 bp, Artificial Sequence
  Synthetic
caccgctgtcccaaaaggtcaacaagtcggagatcaggaaacagctatgacctcacagctagccgtgactaggttcatcggttggggaggaggtagaggcctacccctgcagcaagcaggcatatcagcagccagggcct

SEQ ID NO: 394353 - DNA, 140 bp, Artificial Sequence
  Synthetic
aggccctggctgctgatatggagtggcagatactgccctgttccttcaccaccttaccggccttatccaccggcttgatccacctccatcagaacatcgtggacgtgcaatacctgtacggaccttttgggacagcggtg

SEQ ID NO: 394354 - DNA, 140 bp, Artificial Sequence
  Synthetic
caccgctgtcccaaaaggtccgtacaggtattgcacgtccacgatgttctgatggaggtggatcaagccggtggataaggccggtaaggtggtgaaggaacagggcagtatctgccactccatatcagcagccagggcct

SEQ ID NO: 394355 - DNA, 140 bp, Artificial Sequence
  Synthetic
aggccctggctgctgatatgcggcttgatccacctccatcagaacatcgtggacgtgcaatacctgtacggtatagggtcagcagtcgtctcctttgcaatcaaatgggagtatgtcgtggaccttttgggacagcggtg

SEQ ID NO: 394356 - DNA, 140 bp, Artificial Sequence
  Synthetic
caccgctgtcccaaaaggtccacgacatactcccatttgattgcaaaggagacgactgctgaccctataccgtacaggtattgcacgtccacgatgttctgatggaggtggatcaagccgcatatcagcagccagggcct

SEQ ID NO: 394357 - DNA, 140 bp, Artificial Sequence
  Synthetic
aggccctggctgctgatatgttcttctgtgctgcctggtacatcaaaggcaggctggtccctggggcggcatatgccatctatggcgtatggccgctgctcctgctcctgttggcgttacgaccttttgggacagcggtg

SEQ ID NO: 394358 - DNA, 140 bp, Artificial Sequence
  Synthetic
caccgctgtcccaaaaggtcgtaacgccaacaggagcaggagcagcggccatacgccatagatggcatatgccgccccagggaccagcctgcctttgatgtaccaggcagcacagaagaacatatcagcagccagggcct

SEQ ID NO: 394359 - DNA, 140 bp, Artificial Sequence
  Synthetic
aggccctggctgctgatatgcttatgaagtgcgcaacgtgtccggggtataccatgtcacgaacgactgctccaactcaagcattgtgtatgaggtagcggacatgatcatgcataccccgaccttttgggacagcggtg

SEQ ID NO: 394360 - DNA, 140 bp, Artificial Sequence
  Synthetic
caccgctgtcccaaaaggtcggggtatgcatgatcatgtccgctacctcatacacaatgcttgagttggagcagtcgttcgtgacatggtataccccggacacgttgcgcacttcataagcatatcagcagccagggcct

SEQ ID NO: 394361 - DNA, 140 bp, Artificial Sequence
  Synthetic
aggccctggctgctgatatgaggcgcatttgcaagtgtggattcccccccttaacgttcgggggggccgcgatgccatcatcctcctcacgtgtgcagtccatccagagctaatttttgagaccttttgggacagcggtg

SEQ ID NO: 394362 - DNA, 140 bp, Artificial Sequence
  Synthetic
caccgctgtcccaaaaggtctcaaaaattagctctggatggactgcacacgtgaggaggatgatggcatcgcggcccccccgaacgttaagggggggaatccacacttgcaaatgcgcctcatatcagcagccagggcct

SEQ ID NO: 394363 - DNA, 140 bp, Artificial Sequence
  Synthetic
aggccctggctgctgatatgagcgtatttctccatggtggggaactgggcgaaggtcctggtagtgctgctgctatttgccggcgtcgacgcgaatacccacgtcaccggggggagcgctgaccttttgggacagcggtg

SEQ ID NO: 394364 - DNA, 140 bp, Artificial Sequence
  Synthetic
caccgctgtcccaaaaggtcagcgctccccccggtgacgtgggtattcgcgtcgacgccggcaaatagcagcagcactaccaggaccttcgcccagttccccaccatggagaaatacgctcatatcagcagccagggcct

SEQ ID NO: 394365 - DNA, 140 bp, Artificial Sequence
  Synthetic
atacgccatgctgggtctccgttgctccgggggcgcctacgacatcataatatgtgatgagtgccactcaaccgacgcgactaccatcttgggcgtcggtacggtcctggaccaagcggacgtacttgggagtcggccat

SEQ ID NO: 394366 - DNA, 140 bp, Artificial Sequence
  Synthetic
atggccgactcccaagtacgtccgcttggtccaggaccgtaccgacgcccaagatggtagtcgcgtcggttgagtggcactcatcacatattatgatgtcgtaggcgcccccggagcaacggagacccagcatggcgtat

SEQ ID NO: 394367 - DNA, 140 bp, Artificial Sequence
  Synthetic
aggccctggctgctgatatggacggctggagcgcggctcgtcgtgctcgccaccgccacacctccgggatcggttaccgtgccacatcccaatatcgaggaggtagccctgtccaacatcgaccttttgggacagcggtg

SEQ ID NO: 394368 - DNA, 140 bp, Artificial Sequence
  Synthetic
caccgctgtcccaaaaggtcgatgttggacagggctacctcctcgatattgggatgtggcacggtaaccgatcccggaggtgtggcggtggcgagcacgacgagccgcgctccagccgtccatatcagcagccagggcct

SEQ ID NO: 394369 - DNA, 140 bp, Artificial Sequence
  Synthetic
aggccctggctgctgatatgcgagtgccgtacttcgtacgcgctcaagggctcatccgtgcatgcatgttggtgcggaaggtcgccgggggtcattatgtccaaatggccttcatgaagcgaccttttgggacagcggtg

SEQ ID NO: 394370 - DNA, 140 bp, Artificial Sequence
  Synthetic
caccgctgtcccaaaaggtcgcttcatgaaggccatttggacataatgacccccggcgaccttccgcaccaacatgcatgcacggatgagcccttgagcgcgtacgaagtacggcactcgcatatcagcagccagggcct

SEQ ID NO: 394371 - DNA, 140 bp, Artificial Sequence
  Synthetic
aggccctggctgctgatatggatggccagctgtagacccctcgctgatttcgaccagggctggggccctatcagctacgccaacgggagcggccccgaacaccgcccctactgctggcacgaccttttgggacagcggtg

SEQ ID NO: 394372 - DNA, 140 bp, Artificial Sequence
  Synthetic
caccgctgtcccaaaaggtcgtgccagcagtaggggcggtgttcggggccgctcccgttggcgtagctgatagggccccagccctggtcgaaatcagcgaggggtctacagctggccatccatatcagcagccagggcct

SEQ ID NO: 394373 - DNA, 140 bp, Artificial Sequence
  Synthetic
aggccctggctgctgatatgctgtgacgagtgccattccactgactccacaacgatccttggcataggcacagtcctggaccaagcggagaccgctggagtgcgcctcgtcgtgctcgcggaccttttgggacagcggtg

SEQ ID NO: 394374 - DNA, 140 bp, Artificial Sequence
  Synthetic
caccgctgtcccaaaaggtccgcgagcacgacgaggcgcactccagcggtctccgcttggtccaggactgtgcctatgccaaggatcgttgtggagtcagtggaatggcactcgtcacagcatatcagcagccagggcct

SEQ ID NO: 394375 - DNA, 140 bp, Artificial Sequence
  Synthetic
aggccctggctgctgatatgcgcggctcgtcgtgctcgccaccgctacgcctccgggatcggtcaccgtgccacaccccaacatcgaggaggtggccctgtccaacactggagagatcccgaccttttgggacagcggtg

SEQ ID NO: 394376 - DNA, 140 bp, Artificial Sequence
  Synthetic
caccgctgtcccaaaaggtcgggatctctccagtgttggacagggccacctcctcgatgttggggtgtggcacggtgaccgatcccggaggcgtagcggtggcgagcacgacgagccgcgcatatcagcagccagggcct

SEQ ID NO: 394377 - DNA, 140 bp, Artificial Sequence
  Synthetic
atacgccatgctgggtctccctgtaatgatagcctcaccaccggctggttagcagggctcttctatttcaacaaattcaactctacaggctgtcctgagagattggccagctgccgatcccgtacttgggagtcggccat

SEQ ID NO: 394378 - DNA, 140 bp, Artificial Sequence
  Synthetic
atggccgactcccaagtacgggatcggcagctggccaatctctcaggacagcctgtagagttgaatttgttgaaatagaagagccctgctaaccagccggtggtgaggctatcattacagggagacccagcatggcgtat

SEQ ID NO: 394379 - DNA, 140 bp, Artificial Sequence
  Synthetic
aggccctggctgctgatatgacatcaaccgcacggccttgaactgcaatgatagccttcacaccggctggatagcagggcttgtctatgtcaacagattcaactcctcaggttgtcccgagaccttttgggacagcggtg

SEQ ID NO: 394380 - DNA, 140 bp, Artificial Sequence
  Synthetic
caccgctgtcccaaaaggtctcgggacaacctgaggagttgaatctgttgacatagacaagccctgctatccagccggtgtgaaggctatcattgcagttcaaggccgtgcggttgatgtcatatcagcagccagggcct

SEQ ID NO: 394381 - DNA, 140 bp, Artificial Sequence
  Synthetic
aggccctggctgctgatatgagcacctgggtgctggtaggcggagtccttgcagctctggccgcatattgcttgacaacaggcagcgtggtcattgtgggtaggatcatcttgtccgggagaccttttgggacagcggtg

SEQ ID NO: 394382 - DNA, 140 bp, Artificial Sequence
  Synthetic
caccgctgtcccaaaaggtctcccggacaagatgatcctacccacaatgaccacgctgcctgttgtcaagcaatatgcggccagagctgcaaggactccgcctaccagcacccaggtgctcatatcagcagccagggcct

SEQ ID NO: 394383 - DNA, 140 bp, Artificial Sequence
  Synthetic
aggccctggctgctgatatggcccctccaataccacctccacggaggaagaggacggttgtcctatcagaatccaccgtgtcttctgccttggcggagcttgccacaaaaacctttggtagaccttttgggacagcggtg

SEQ ID NO: 394384 - DNA, 140 bp, Artificial Sequence
  Synthetic
caccgctgtcccaaaaggtctaccaaaggtttttgtggcaagctccgccaaggcagaagacacggtggattctgataggacaaccgtcctcttcctccgtggaggtggtattggaggggccatatcagcagccagggcct

SEQ ID NO: 394385 - DNA, 140 bp, Artificial Sequence
  Synthetic
aggccctggctgctgatatgctggtatttgacatcaccaaactgctgctggccgtcctcggacccctttggattcttcaagccagtttgcttagagtaccctacttcgtgcgcgtccaaggaccttttgggacagcggtg

SEQ ID NO: 394386 - DNA, 140 bp, Artificial Sequence
  Synthetic
caccgctgtcccaaaaggtccttggacgcgcacgaagtagggtactctaagcaaactggcttgaagaatccaaaggggtccgaggacggccagcagcagtttggtgatgtcaaataccagcatatcagcagccagggcct

SEQ ID NO: 394387 - DNA, 140 bp, Artificial Sequence
  Synthetic
aggccctggctgctgatatgggagtcctagcgggccttgcctactattccatggtggggaactgggctaaggttttgattgtgatgctactctttgccggcgttgacgggcatacccgcggaccttttgggacagcggtg

SEQ ID NO: 394388 - DNA, 140 bp, Artificial Sequence
  Synthetic
caccgctgtcccaaaaggtccgcgggtatgcccgtcaacgccggcaaagagtagcatcacaatcaaaaccttagcccagttccccaccatggaatagtaggcaaggcccgctaggactcccatatcagcagccagggcct

SEQ ID NO: 394389 - DNA, 140 bp, Artificial Sequence
  Synthetic
atacgccatgctgggtctccgtgcagcctccaggaccccccctcccgggagagccatagtggtctgctgaaccggtgagtcaccggaattgccaggacgaccgggtcctttcttggatcacgtacttgggagtcggccat

SEQ ID NO: 394390 - DNA, 140 bp, Artificial Sequence
  Synthetic
atggccgactcccaagtacgtgatccaagaaaggacccggtcgtcctggcaattccggtgactcaccggttcagcagaccactatggctctcccgggagggggggtcctggaggctgcacggagacccagcatggcgtat

SEQ ID NO: 394391 - DNA, 140 bp, Artificial Sequence
  Synthetic
aggccctggctgctgatatgagtcctggcgggccttgcctactattccatggttgggaactgggctaaggttttgattgtgatgctactctttgccggcgtcgacgggggtcacaccaccgaccttttgggacagcggtg

SEQ ID NO: 394392 - DNA, 140 bp, Artificial Sequence
  Synthetic
caccgctgtcccaaaaggtcggtggtgtgacccccgtcgacgccggcaaagagtagcatcacaatcaaaaccttagcccagttcccaaccatggaatagtaggcaaggcccgccaggactcatatcagcagccagggcct

SEQ ID NO: 394393 - DNA, 140 bp, Artificial Sequence
  Synthetic
aggccctggctgctgatatgggcacatcaacaggactgccctgaactgcaatgactccctccacactggattcctcgccgcgctgttctacgtaaataagttcaacgcgtccggatgcccgaccttttgggacagcggtg

SEQ ID NO: 394394 - DNA, 140 bp, Artificial Sequence
  Synthetic
caccgctgtcccaaaaggtcgggcatccggacgcgttgaacttatttacgtagaacagcgcggcgaggaatccagtgtggagggagtcattgcagttcagggcagtcctgttgatgtgcccatatcagcagccagggcct

SEQ ID NO: 394395 - DNA, 140 bp, Artificial Sequence
  Synthetic
aggccctggctgctgatatgtatgctttctacggcgtatggccgctgctcttgctcctgctggcgttgccacaacgggcgtacgccatggaccgagagctggctgcgtcgtgcggaggtggaccttttgggacagcggtg

SEQ ID NO: 394396 - DNA, 140 bp, Artificial Sequence
  Synthetic
caccgctgtcccaaaaggtccacctccgcacgacgcagccagctctcggtccatggcgtacgcccgttgtggcaacgccagcaggagcaagagcagcggccatacgccgtagaaagcatacatatcagcagccagggcct

SEQ ID NO: 394397 - DNA, 140 bp, Artificial Sequence
  Synthetic
atacgccatgctgggtctccgtcgtgagcggtctagcaggagccacggttggaagcatcgggctcgggagggtgttggttgatgtgctcgccggatacggagccggtgtgtcgggtgctccgtacttgggagtcggccat

SEQ ID NO: 394398 - DNA, 140 bp, Artificial Sequence
  Synthetic
atggccgactcccaagtacggagcacccgacacaccggctccgtatccggcgagcacatcaaccaacaccctcccgagcccgatgcttccaaccgtggctcctgctagaccgctcacgacggagacccagcatggcgtat

SEQ ID NO: 394399 - DNA, 140 bp, Artificial Sequence
  Synthetic
aggccctggctgctgatatggccgagtagtgttgggtcgcgaaaggccttgtggtactgcctgatagggtgcttgcgagtgccccgggaggtctcgtagaccgtgcaccatgagcacgaagaccttttgggacagcggtg

SEQ ID NO: 394400 - DNA, 140 bp, Artificial Sequence
  Synthetic
caccgctgtcccaaaaggtcttcgtgctcatggtgcacggtctacgagacctcccggggcactcgcaagcaccctatcaggcagtaccacaaggcctttcgcgacccaacactactcggccatatcagcagccagggcct

SEQ ID NO: 394401 - DNA, 140 bp, Artificial Sequence
  Synthetic
aggccctggctgctgatatgatgacgagagggaaatctcagtatcagctgagtgccacaggccacccaggcataaattccctccagctctcccaatatgggccaggcctgactacaatccgaccttttgggacagcggtg

SEQ ID NO: 394402 - DNA, 140 bp, Artificial Sequence
  Synthetic
caccgctgtcccaaaaggtcggattgtagtcaggcctggcccatattgggagagctggagggaatttatgcctgggtggcctgtggcactcagctgatactgagatttccctctcgtcatcatatcagcagccagggcct

SEQ ID NO: 394403 - DNA, 140 bp, Artificial Sequence
  Synthetic
aggccctggctgctgatatgacgggcgcccccatcacgtactccacctacggcaagttccttgccgacggtggttgctctgggggcgcctatgacatcataatatgtgatgagtgccactgaccttttgggacagcggtg

SEQ ID NO: 394404 - DNA, 140 bp, Artificial Sequence
  Synthetic
caccgctgtcccaaaaggtcagtggcactcatcacatattatgatgtcataggcgcccccagagcaaccaccgtcggcaaggaacttgccgtaggtggagtacgtgatgggggcgcccgtcatatcagcagccagggcct

SEQ ID NO: 394405 - DNA, 140 bp, Artificial Sequence
  Synthetic
aggccctggctgctgatatgggtggaggttgctggcgcccatcacggcgtatgcccagcagacgaggggcctcttgggatgcataatcaccagcctgaccggccgggacaaaaaccaggtgaccttttgggacagcggtg

SEQ ID NO: 394406 - DNA, 140 bp, Artificial Sequence
  Synthetic
caccgctgtcccaaaaggtcacctggtttttgtcccggccggtcaggctggtgattatgcatcccaagaggcccctcgtctgctgggcatacgccgtgatgggcgccagcaacctccacccatatcagcagccagggcct

SEQ ID NO: 394407 - DNA, 140 bp, Artificial Sequence
  Synthetic
aggccctggctgctgatatgacagacgctctaatgacgggctataccggcgactttgactcagtgatcgactgcaatacatgtgtcacccagacagtcgacttcagcttggaccctacctgaccttttgggacagcggtg

SEQ ID NO: 394408 - DNA, 140 bp, Artificial Sequence
  Synthetic
caccgctgtcccaaaaggtcaggtagggtccaagctgaagtcgactgtctgggtgacacatgtattgcagtcgatcactgagtcaaagtcgccggtatagcccgtcattagagcgtctgtcatatcagcagccagggcct

SEQ ID NO: 394409 - DNA, 140 bp, Artificial Sequence
  Synthetic
aggccctggctgctgatatgagagtgccgtacttcgtacgcgctcaagggctcatccgtgcatgcatgttagtgcggaaggtcgctgggggtcattatgtccaaatggccttcatgaagcgaccttttgggacagcggtg

SEQ ID NO: 394410 - DNA, 140 bp, Artificial Sequence
  Synthetic
caccgctgtcccaaaaggtcgcttcatgaaggccatttggacataatgacccccagcgaccttccgcactaacatgcatgcacggatgagcccttgagcgcgtacgaagtacggcactctcatatcagcagccagggcct

SEQ ID NO: 394411 - DNA, 140 bp, Artificial Sequence
  Synthetic
atacgccatgctgggtctccgcacatcaacagaactgccctgaattgcaatgactccctccagactgggttcattgccgctctgttctacacacacaagttcaactcgtccggatgcacgcgtacttgggagtcggccat

SEQ ID NO: 394412 - DNA, 140 bp, Artificial Sequence
  Synthetic
atggccgactcccaagtacgcgtgcatccggacgagttgaacttgtgtgtgtagaacagagcggcaatgaacccagtctggagggagtcattgcaattcagggcagttctgttgatgtgcggagacccagcatggcgtat

SEQ ID NO: 394413 - DNA, 140 bp, Artificial Sequence
  Synthetic
aggccctggctgctgatatgcgccatgctccggctcgtggctaagggatgtttgggactggatatgcacggtgttgactgatttcaagacctggctccagtccaagctcctgccgcggttgaccttttgggacagcggtg

SEQ ID NO: 394414 - DNA, 140 bp, Artificial Sequence
  Synthetic
caccgctgtcccaaaaggtcaaccgcggcaggagcttggactggagccaggtcttgaaatcagtcaacaccgtgcatatccagtcccaaacatcccttagccacgagccggagcatggcgcatatcagcagccagggcct

SEQ ID NO: 394415 - DNA, 140 bp, Artificial Sequence
  Synthetic
aggccctggctgctgatatgtcggccctcggaatcaatgctgtagcgtattaccgaggtcttgatgtgtccgtcataccgactagcggagacgtcgttgtcgtggcaacagacgctctaagaccttttgggacagcggtg

SEQ ID NO: 394416 - DNA, 140 bp, Artificial Sequence
  Synthetic
caccgctgtcccaaaaggtcttagagcgtctgttgccacgacaacgacgtctccgctagtcggtatgacggacacatcaagacctcggtaatacgctacagcattgattccgagggccgacatatcagcagccagggcct

SEQ ID NO: 394417 - DNA, 140 bp, Artificial Sequence
  Synthetic
aggccctggctgctgatatggtacctggatgaactcaaccggattcaccaaagtgtgcggagcgcccccctgtgtcatcggaggggtgggcaacaacaccttgcgctgccccactgattggaccttttgggacagcggtg

SEQ ID NO: 394418 - DNA, 140 bp, Artificial Sequence
  Synthetic
caccgctgtcccaaaaggtccaatcagtggggcagcgcaaggtgttgttgcccacccctccgatgacacaggggggcgctccgcacactttggtgaatccggttgagttcatccaggtaccatatcagcagccagggcct

SEQ ID NO: 394419 - DNA, 140 bp, Artificial Sequence
  Synthetic
aggccctggctgctgatatgaccaggcctccgacggcggcgacacaggatccgacgttgagtcgtactcctccatgcccccccttgagggggagccgggggaccccgatctcagtgacgggaccttttgggacagcggtg

SEQ ID NO: 394420 - DNA, 140 bp, Artificial Sequence
  Synthetic
caccgctgtcccaaaaggtcccgtcactgagatcggggtcccccggctccccctcaagggggggcatggaggagtacgactcaacgtcggatcctgtgtcgccgccgtcggaggcctggtcatatcagcagccagggcct

SEQ ID NO: 394421 - DNA, 140 bp, Artificial Sequence
  Synthetic
aggccctggctgctgatatggggcgcgacgccgtcatcttactcacgtgtgttgtacacccggctttggtatttgacatcaccaagctactgctggccgtcatcggacccctttggattcgaccttttgggacagcggtg

SEQ ID NO: 394422 - DNA, 140 bp, Artificial Sequence
  Synthetic
caccgctgtcccaaaaggtcgaatccaaaggggtccgatgacggccagcagtagcttggtgatgtcaaataccaaagccgggtgtacaacacacgtgagtaagatgacggcgtcgcgccccatatcagcagccagggcct

SEQ ID NO: 394423 - DNA, 140 bp, Artificial Sequence
  Synthetic
aggccctggctgctgatatgttacatccacagctagggtttgaggtcactaagatcctactagccatcctggcccctctatacatcttgcagtacagtttgctcaaagtgccttactttggaccttttgggacagcggtg

SEQ ID NO: 394424 - DNA, 140 bp, Artificial Sequence
  Synthetic
caccgctgtcccaaaaggtccaaagtaaggcactttgagcaaactgtactgcaagatgtatagaggggccaggatggctagtaggatcttagtgacctcaaaccctagctgtggatgtaacatatcagcagccagggcct

SEQ ID NO: 394425 - DNA, 140 bp, Artificial Sequence
  Synthetic
aggccctggctgctgatatgtgacctcatcgaggccaacctcctgtggcggcaggagatgggcgggaacatcacccgcgtggagtcagagaataaggtagtaattctggactctttcgatgaccttttgggacagcggtg

SEQ ID NO: 394426 - DNA, 140 bp, Artificial Sequence
  Synthetic
caccgctgtcccaaaaggtcatcgaaagagtccagaattactaccttattctctgactccacgcgggtgatgttcccgcccatctcctgccgccacaggaggttggcctcgatgaggtcacatatcagcagccagggcct

SEQ ID NO: 394427 - DNA, 140 bp, Artificial Sequence
  Synthetic
aggccctggctgctgatatgctacctccttcccaaccgatgaaagtcacggctagctgtgaggtcatagctgtttcctgaaccccccttccccgttagccctatgtgaccactgagctatgaccttttgggacagcggtg

SEQ ID NO: 394428 - DNA, 140 bp, Artificial Sequence
  Synthetic
caccgctgtcccaaaaggtcatagctcagtggtcacatagggctaacggggaaggggggttcaggaaacagctatgacctcacagctagccgtgactttcatcggttgggaaggaggtagcatatcagcagccagggcct

SEQ ID NO: 394429 - DNA, 140 bp, Artificial Sequence
  Synthetic
atacgccatgctgggtctcccacatcaacaggactgcccttaactgcaatgagtccctcaacactggatggctcgccgcgctgttctacacaaacaagttcaacgcgtccggatgcccagcgtacttgggagtcggccat

SEQ ID NO: 394430 - DNA, 140 bp, Artificial Sequence
  Synthetic
atggccgactcccaagtacgctgggcatccggacgcgttgaacttgtttgtgtagaacagcgcggcgagccatccagtgttgagggactcattgcagttaagggcagtcctgttgatgtgggagacccagcatggcgtat

SEQ ID NO: 394431 - DNA, 140 bp, Artificial Sequence
  Synthetic
aggccctggctgctgatatgtgccggcgtcgacgcggaaacccacgtcaccgggggaagtgccggccacagcgcgtctgtgttcgctgggctcttcacacgaggggccaagcagaacatcgaccttttgggacagcggtg

SEQ ID NO: 394432 - DNA, 140 bp, Artificial Sequence
  Synthetic
caccgctgtcccaaaaggtcgatgttctgcttggcccctcgtgtgaagagcccagcgaacacagacgcgctgtggccggcacttcccccggtgacgtgggtttccgcgtcgacgccggcacatatcagcagccagggcct

SEQ ID NO: 394433 - DNA, 140 bp, Artificial Sequence
  Synthetic
aggccctggctgctgatatggatgccatcatcctcctcacgtgtgcggtccacccagagctgatcttttccatcaccaagatcttgctcgccatactcggtccgctcatggtgctccagggaccttttgggacagcggtg

SEQ ID NO: 394434 - DNA, 140 bp, Artificial Sequence
  Synthetic
caccgctgtcccaaaaggtccctggagcaccatgagcggaccgagtatggcgagcaagatcttggtgatggaaaagatcagctctgggtggaccgcacacgtgaggaggatgatggcatccatatcagcagccagggcct

SEQ ID NO: 394435 - DNA, 140 bp, Artificial Sequence
  Synthetic
aggccctggctgctgatatggttgagcccgtcgtcttctctgacatggagaccaagatcatcacctggggggcagacaccgctgcgtgcggggacatcatctcgggtctgcccgtctccggaccttttgggacagcggtg

SEQ ID NO: 394436 - DNA, 140 bp, Artificial Sequence
  Synthetic
caccgctgtcccaaaaggtccggagacgggcagacccgagatgatgtccccgcacgcagcggtgtctgccccccaggtgatgatcttggtctccatgtcagagaagacgacgggctcaaccatatcagcagccagggcct

SEQ ID NO: 394437 - DNA, 140 bp, Artificial Sequence
  Synthetic
aggccctggctgctgatatgtgttctacacacacaagttcaacgcgtccggatgcccagagcgcatggccagctgtcgctccattgataagtttgatcaggggtggggtcccatcacttagaccttttgggacagcggtg

SEQ ID NO: 394438 - DNA, 140 bp, Artificial Sequence
  Synthetic
caccgctgtcccaaaaggtctaagtgatgggaccccacccctgatcaaacttatcaatggagcgacagctggccatgcgctctgggcatccggacgcgttgaacttgtgtgtgtagaacacatatcagcagccagggcct

SEQ ID NO: 394439 - DNA, 140 bp, Artificial Sequence
  Synthetic
aggccctggctgctgatatgccctacgtacagctggggggagaatgagacagacgtgctgctcctcaacaacacgcggccgccgcaaggcaactggttcggctgtacatggatgaatagcgaccttttgggacagcggtg

SEQ ID NO: 394440 - DNA, 140 bp, Artificial Sequence
  Synthetic
caccgctgtcccaaaaggtcgctattcatccatgtacagccgaaccagttgccttgcggcggccgcgtgttgttgaggagcagcacgtctgtctcattctccccccagctgtacgtagggcatatcagcagccagggcct

SEQ ID NO: 394441 - DNA, 140 bp, Artificial Sequence
  Synthetic
aggccctggctgctgatatggggatcaaatgtggaagtgtctcatacggctaaagcctacgctgcacgggccaacacccctgctgtataggctgggagccgtccaaaacgaggtcaccctgaccttttgggacagcggtg

SEQ ID NO: 394442 - DNA, 140 bp, Artificial Sequence
  Synthetic
caccgctgtcccaaaaggtcagggtgacctcgttttggacggctcccagcctatacagcaggggtgttggcccgtgcagcgtaggctttagccgtatgagacacttccacatttgatccccatatcagcagccagggcct

SEQ ID NO: 394443 - DNA, 140 bp, Artificial Sequence
  Synthetic
aggccctggctgctgatatgtcacgtactccacctatggcaagttccttgccgacggtggttgctccgggggcgcctatgacatcataatatgtgatgagtgccactcaactgactcgacgaccttttgggacagcggtg

SEQ ID NO: 394444 - DNA, 140 bp, Artificial Sequence
  Synthetic
caccgctgtcccaaaaggtcgtcgagtcagttgagtggcactcatcacatattatgatgtcataggcgcccccggagcaaccaccgtcggcaaggaacttgccataggtggagtacgtgacatatcagcagccagggcct

SEQ ID NO: 394445 - DNA, 140 bp, Artificial Sequence
  Synthetic
atacgccatgctgggtctcctggtgctgctgctattcgccggcgtcgacgcggagacccacgtctccggggggagtgccgcccacgccacggctggaattgctggcttccttgcacctggcgtacttgggagtcggccat

SEQ ID NO: 394446 - DNA, 140 bp, Artificial Sequence
  Synthetic
atggccgactcccaagtacgccaggtgcaaggaagccagcaattccagccgtggcgtgggcggcactccccccggagacgtgggtctccgcgtcgacgccggcgaatagcagcagcaccaggagacccagcatggcgtat

SEQ ID NO: 394447 - DNA, 140 bp, Artificial Sequence
  Synthetic
atacgccatgctgggtctccgcagctggcacataaacaggactgctttgaactgcaatgattccctccagacggggttcgtagcggcactcttttacgcccgcagattcaactcctcgggcgtacttgggagtcggccat

SEQ ID NO: 394448 - DNA, 140 bp, Artificial Sequence
  Synthetic
atggccgactcccaagtacgcccgaggagttgaatctgcgggcgtaaaagagtgccgctacgaaccccgtctggagggaatcattgcagttcaaagcagtcctgtttatgtgccagctgcggagacccagcatggcgtat

SEQ ID NO: 394449 - DNA, 140 bp, Artificial Sequence
  Synthetic
aggccctggctgctgatatgtaaccaaatacatcatggcatgcatgtcggctgacctggaggtcgtcacgagcacctgggtgctggtaggcggggtccttgcagctctggccgcgtactggaccttttgggacagcggtg

SEQ ID NO: 394450 - DNA, 140 bp, Artificial Sequence
  Synthetic
caccgctgtcccaaaaggtccagtacgcggccagagctgcaaggaccccgcctaccagcacccaggtgctcgtgacgacctccaggtcagccgacatgcatgccatgatgtatttggttacatatcagcagccagggcct

SEQ ID NO: 394451 - DNA, 140 bp, Artificial Sequence
  Synthetic
aggccctggctgctgatatggggtgggcaacaacaccctatactgccccactgactgcttccgcaagcacccggaagccacgtactctcggtgcggctccggtccctggattacgcccaggaccttttgggacagcggtg

SEQ ID NO: 394452 - DNA, 140 bp, Artificial Sequence
  Synthetic
caccgctgtcccaaaaggtcctgggcgtaatccagggaccggagccgcaccgagagtacgtggcttccgggtgcttgcggaagcagtcagtggggcagtatagggtgttgttgcccaccccatatcagcagccagggcct

SEQ ID NO: 394453 - DNA, 140 bp, Artificial Sequence
  Synthetic
aggccctggctgctgatatgcggactacgtccctccagtggtacacgggtgcccattgccacctaccaaggcccctccaataccacctccacggaggaagaggacggttgtcctgacagagaccttttgggacagcggtg

SEQ ID NO: 394454 - DNA, 140 bp, Artificial Sequence
  Synthetic
caccgctgtcccaaaaggtctctgtcaggacaaccgtcctcttcctccgtggaggtggtattggaggggccttggtaggtggcaatgggcacccgtgtaccactggagggacgtagtccgcatatcagcagccagggcct

SEQ ID NO: 394455 - DNA, 140 bp, Artificial Sequence
  Synthetic
aggccctggctgctgatatgaggtccttccgtgttccttcacgaccctgccagccttgtccaccggcctcatccacctccaccaaaacatcgtggacgtgcagtacttgtacggggtggggaccttttgggacagcggtg

SEQ ID NO: 394456 - DNA, 140 bp, Artificial Sequence
  Synthetic
caccgctgtcccaaaaggtccccaccccgtacaagtactgcacgtccacgatgttttggtggaggtggatgaggccggtggacaaggctggcagggtcgtgaaggaacacggaaggacctcatatcagcagccagggcct

SEQ ID NO: 394457 - DNA, 140 bp, Artificial Sequence
  Synthetic
aggccctggctgctgatatgcagccctccgacgacggcgacgcaggatccgacgttgagtcgtactcctccatgcccccccttgagggggagccgggggaccccgatctcagcgacgggtgaccttttgggacagcggtg

SEQ ID NO: 394458 - DNA, 140 bp, Artificial Sequence
  Synthetic
caccgctgtcccaaaaggtcacccgtcgctgagatcggggtcccccggctccccctcaagggggggcatggaggagtacgactcaacgtcggatcctgcgtcgccgtcgtcggagggctgcatatcagcagccagggcct

SEQ ID NO: 394459 - DNA, 140 bp, Artificial Sequence
  Synthetic
atacgccatgctgggtctccctgtcggttggtggcgggcggtgcttttcctgtgctgtgtttgggatgtgaaagggcgtcttgtgcctgcgtgtgcctacatgacactgggaatgtggcccgtacttgggagtcggccat

SEQ ID NO: 394460 - DNA, 140 bp, Artificial Sequence
  Synthetic
atggccgactcccaagtacgggccacattcccagtgtcatgtaggcacacgcaggcacaagacgccctttcacatcccaaacacagcacaggaaaagcaccgcccgccaccaaccgacagggagacccagcatggcgtat

SEQ ID NO: 394461 - DNA, 140 bp, Artificial Sequence
  Synthetic
aggccctggctgctgatatgtcacagctcccatgtgagcccgagccggatgtggcagtgttcacttccatgctcaccgacccttcccacatcacagcagagacagctaagcgtaggctgggaccttttgggacagcggtg

SEQ ID NO: 394462 - DNA, 140 bp, Artificial Sequence
  Synthetic
caccgctgtcccaaaaggtcccagcctacgcttagctgtctctgctgtgatgtgggaagggtcggtgagcatggaagtgaacactgccacatccggctcgggctcacatgggagctgtgacatatcagcagccagggcct

SEQ ID NO: 394463 - DNA, 140 bp, Artificial Sequence
  Synthetic
aggccctggctgctgatatgatggcaaaaaatgaggttttctgcgtccaaccagagaaaggaggccgcaagccagctcgccttatcgtattcccagacctgggagttcgtgtatgcgagagaccttttgggacagcggtg

SEQ ID NO: 394464 - DNA, 140 bp, Artificial Sequence
  Synthetic
caccgctgtcccaaaaggtctctcgcatacacgaactcccaggtctgggaatacgataaggcgagctggcttgcggcctcctttctctggttggacgcagaaaacctcattttttgccatcatatcagcagccagggcct

SEQ ID NO: 394465 - DNA, 140 bp, Artificial Sequence
  Synthetic
atacgccatgctgggtctccccccgaccgcgaggtcttatatcagcagttcgacgagatggaggagtgctctaagcatatcccctacctcgccgagggccagcagatcgccgaacagttccgtacttgggagtcggccat

SEQ ID NO: 394466 - DNA, 140 bp, Artificial Sequence
  Synthetic
atggccgactcccaagtacggaactgttcggcgatctgctggccctcggcgaggtaggggatatgcttagagcactcctccatctcgtcgaactgctgatataagacctcgcggtcggggggagacccagcatggcgtat

SEQ ID NO: 394467 - DNA, 140 bp, Artificial Sequence
  Synthetic
aggccctggctgctgatatggtgtccccgacgcactacgtgcctgagactgacgcatcaaaaaatgtgacccaaatactttcttctcttaccatcaccagcctactccgcagattacaccgaccttttgggacagcggtg

SEQ ID NO: 394468 - DNA, 140 bp, Artificial Sequence
  Synthetic
caccgctgtcccaaaaggtcggtgtaatctgcggagtaggctggtgatggtaagagaagaaagtatttgggtcacattttttgatgcgtcagtctcaggcacgtagtgcgtcggggacaccatatcagcagccagggcct

SEQ ID NO: 394469 - DNA, 140 bp, Artificial Sequence
  Synthetic
aggccctggctgctgatatggcaagccaaacttctccctcgcctgccggggatcccctttctctcgtgtcaaaagggatacaggggagtctgggcgggggatggggtgtgccacaccaccgaccttttgggacagcggtg

SEQ ID NO: 394470 - DNA, 140 bp, Artificial Sequence
  Synthetic
caccgctgtcccaaaaggtcggtggtgtggcacaccccatcccccgcccagactcccctgtatcccttttgacacgagagaaaggggatccccggcaggcgagggagaagtttggcttgccatatcagcagccagggcct

SEQ ID NO: 394471 - DNA, 140 bp, Artificial Sequence
  Synthetic
aggccctggctgctgatatgtctcctggcagatgcgcgcgtctgcgcctgcttatggatgatgctgctggtagcccaggctgaggccgccttagagaacctggtggtcctcaatgcggcggaccttttgggacagcggtg

SEQ ID NO: 394472 - DNA, 140 bp, Artificial Sequence
  Synthetic
caccgctgtcccaaaaggtccgccgcattgaggaccaccaggttctctaaggcggcctcagcctgggctaccagcagcatcatccataagcaggcgcagacgcgcgcatctgccaggagacatatcagcagccagggcct

SEQ ID NO: 394473 - DNA, 140 bp, Artificial Sequence
  Synthetic
atacgccatgctgggtctcctcaacgccaccactaccggccccagcacaccacggccggcccccaactatcagcgtgctctttggcgggtatctgccgaagagtacgttgaggtacggagcgtacttgggagtcggccat

SEQ ID NO: 394474 - DNA, 140 bp, Artificial Sequence
  Synthetic
atggccgactcccaagtacgctccgtacctcaacgtactcttcggcagatacccgccaaagagcacgctgatagttgggggccggccgtggtgtgctggggccggtagtggtggcgttgaggagacccagcatggcgtat

SEQ ID NO: 394475 - DNA, 140 bp, Artificial Sequence
  Synthetic
atacgccatgctgggtctcccccctccttggccagctcctcggccagccagctgtctgcaccgtccctcaaggctacttgcgggactcccaacgatcacccggacatggaactcatcgagcgtacttgggagtcggccat

SEQ ID NO: 394476 - DNA, 140 bp, Artificial Sequence
  Synthetic
atggccgactcccaagtacgctcgatgagttccatgtccgggtgatcgttgggagtcccgcaagtagccttgagggacggtgcagacagctggctggccgaggagctggccaaggaggggggagacccagcatggcgtat

SEQ ID NO: 394477 - DNA, 140 bp, Artificial Sequence
  Synthetic
aggccctggctgctgatatgaggctacttgcgggactcccaacgatcacccggacatggaactcatcgaggctaacctgctctggaggcaggagatgggaggcaccatcactcgagtcgagaccttttgggacagcggtg

SEQ ID NO: 394478 - DNA, 140 bp, Artificial Sequence
  Synthetic
caccgctgtcccaaaaggtctcgactcgagtgatggtgcctcccatctcctgcctccagagcaggttagcctcgatgagttccatgtccgggtgatcgttgggagtcccgcaagtagcctcatatcagcagccagggcct

SEQ ID NO: 394479 - DNA, 140 bp, Artificial Sequence
  Synthetic
atacgccatgctgggtctccctagttcagactcgggaccatcaatagccagtcgcgttccacctgtccctacaacaccggacgacactcgctcagaagcggagtcctatagctctatgcccgtacttgggagtcggccat

SEQ ID NO: 394480 - DNA, 140 bp, Artificial Sequence
  Synthetic
atggccgactcccaagtacgggcatagagctataggactccgcttctgagcgagtgtcgtccggtgttgtagggacaggtggaacgcgactggctattgatggtcccgagtctgaactagggagacccagcatggcgtat

SEQ ID NO: 394481 - DNA, 140 bp, Artificial Sequence
  Synthetic
aggccctggctgctgatatgaacggcgtgtgttggactgtctaccatggcgccggctccaagaccctagccggcccaaaaggcccagtcatccaaatgtacaccaatgtagaccaggaccgaccttttgggacagcggtg

SEQ ID NO: 394482 - DNA, 140 bp, Artificial Sequence
  Synthetic
caccgctgtcccaaaaggtcggtcctggtctacattggtgtacatttggatgactgggccttttgggccggctagggtcttggagccggcgccatggtagacagtccaacacacgccgttcatatcagcagccagggcct

SEQ ID NO: 394483 - DNA, 140 bp, Artificial Sequence
  Synthetic
aggccctggctgctgatatgcggtcttcacggacaactcgtcccccccggccgtaccgcagacattccaagtggcccatctacacgctcccactggcagcggcaagagcactaaggtgccgaccttttgggacagcggtg

SEQ ID NO: 394484 - DNA, 140 bp, Artificial Sequence
  Synthetic
caccgctgtcccaaaaggtcggcaccttagtgctcttgccgctgccagtgggagcgtgtagatgggccacttggaatgtctgcggtacggccgggggggacgagttgtccgtgaagaccgcatatcagcagccagggcct

SEQ ID NO: 394485 - DNA, 140 bp, Artificial Sequence
  Synthetic
aggccctggctgctgatatgctggcatgactagagtgccgtacttcgtgcgcgctcaagggctcattcgtgcatgcatgttggtgcggaaagtcgctgggggtcattatgtccaaatggcgaccttttgggacagcggtg

SEQ ID NO: 394486 - DNA, 140 bp, Artificial Sequence
  Synthetic
caccgctgtcccaaaaggtcgccatttggacataatgacccccagcgactttccgcaccaacatgcatgcacgaatgagcccttgagcgcgcacgaagtacggcactctagtcatgccagcatatcagcagccagggcct

SEQ ID NO: 394487 - DNA, 140 bp, Artificial Sequence
  Synthetic
aggccctggctgctgatatggcaagcggaggctgctgctcccgtggtggagtccaaatggcgagcccttgaggccttctgggcgaagcacatgtggaatttcatcagcgggatacagtacgaccttttgggacagcggtg

SEQ ID NO: 394488 - DNA, 140 bp, Artificial Sequence
  Synthetic
caccgctgtcccaaaaggtcgtactgtatcccgctgatgaaattccacatgtgcttcgcccagaaggcctcaagggctcgccatttggactccaccacgggagcagcagcctccgcttgccatatcagcagccagggcct

SEQ ID NO: 394489 - DNA, 140 bp, Artificial Sequence
  Synthetic
aggccctggctgctgatatgaggccttctgggcgaagcacatgtggaatttcatcagcgggatacagtacttagcaggcttgtccactctgcctggaaaccccgctatagcatcactgatgaccttttgggacagcggtg

SEQ ID NO: 394490 - DNA, 140 bp, Artificial Sequence
  Synthetic
caccgctgtcccaaaaggtcatcagtgatgctatagcggggtttccaggcagagtggacaagcctgctaagtactgtatcccgctgatgaaattccacatgtgcttcgcccagaaggcctcatatcagcagccagggcct

SEQ ID NO: 394491 - DNA, 140 bp, Artificial Sequence
  Synthetic
aggccctggctgctgatatgcgggtgcgtgccctgcgttcgggagaacaactcctcccgttgctgggtagcgctcactcccacgctcgcggccaggaacatcagcatccccactacgacagaccttttgggacagcggtg

SEQ ID NO: 394492 - DNA, 140 bp, Artificial Sequence
  Synthetic
caccgctgtcccaaaaggtctgtcgtagtggggatgctgatgttcctggccgcgagcgtgggagtgagcgctacccagcaacgggaggagttgttctcccgaacgcagggcacgcacccgcatatcagcagccagggcct

SEQ ID NO: 394493 - DNA, 140 bp, Artificial Sequence
  Synthetic
aggccctggctgctgatatgcataggccttgggaaggtgcttgtggacatcctggcgggctatggggcaggagtggcaggcgcgctcgtggcctttaaggtcatgagcggcgagatgcccgaccttttgggacagcggtg

SEQ ID NO: 394494 - DNA, 140 bp, Artificial Sequence
  Synthetic
caccgctgtcccaaaaggtcgggcatctcgccgctcatgaccttaaaggccacgagcgcgcctgccactcctgccccatagcccgccaggatgtccacaagcaccttcccaaggcctatgcatatcagcagccagggcct

SEQ ID NO: 394495 - DNA, 140 bp, Artificial Sequence
  Synthetic
atacgccatgctgggtctccgactgctctgaactgcaatgactccctccagactgggttcatcgccgcgctgttctacacacacaggttcaactcgtccggatgcccagagcgcatggcccgtacttgggagtcggccat

SEQ ID NO: 394496 - DNA, 140 bp, Artificial Sequence
  Synthetic
atggccgactcccaagtacgggccatgcgctctgggcatccggacgagttgaacctgtgtgtgtagaacagcgcggcgatgaacccagtctggagggagtcattgcagttcagagcagtcggagacccagcatggcgtat

SEQ ID NO: 394497 - DNA, 140 bp, Artificial Sequence
  Synthetic
atacgccatgctgggtctccggccccagccaagatatccggctgatcaacaccaacggcagctggcacatcaatcgcacggccttgaactgtaacgacagcctccacaccggctgggtagcgtacttgggagtcggccat

SEQ ID NO: 394498 - DNA, 140 bp, Artificial Sequence
  Synthetic
atggccgactcccaagtacgctacccagccggtgtggaggctgtcgttacagttcaaggccgtgcgattgatgtgccagctgccgttggtgttgatcagccggatatcttggctggggccggagacccagcatggcgtat

SEQ ID NO: 394499 - DNA, 140 bp, Artificial Sequence
  Synthetic
atacgccatgctgggtctccccctactgttggcattacgcccctaggccatgtgacgtggtgccggcccgcacggtgtgcggccctgtctactgcttcacgcccagccctgttgtggtagcgtacttgggagtcggccat

SEQ ID NO: 394500 - DNA, 140 bp, Artificial Sequence
  Synthetic
atggccgactcccaagtacgctaccacaacagggctgggcgtgaagcagtagacagggccgcacaccgtgcgggccggcaccacgtcacatggcctaggggcgtaatgccaacagtagggggagacccagcatggcgtat

SEQ ID NO: 394501 - DNA, 140 bp, Artificial Sequence
  Synthetic
atacgccatgctgggtctcccagccacgccaacggaagcgactccgaccaacgcccctactgctggcattaccccccaaagccttgtggtgttgtgccagcccggagcgtatgtggcccacgtacttgggagtcggccat

SEQ ID NO: 394502 - DNA, 140 bp, Artificial Sequence
  Synthetic
atggccgactcccaagtacgtgggccacatacgctccgggctggcacaacaccacaaggctttggggggtaatgccagcagtaggggcgttggtcggagtcgcttccgttggcgtggctgggagacccagcatggcgtat

SEQ ID NO: 394503 - DNA, 140 bp, Artificial Sequence
  Synthetic
atacgccatgctgggtctcctaacttcactctgttcaaagtcaggatgtatgtgggaggggttgagcacaggcttgatgttgcttgcaactggacgcggggtgacccttgcaatctggaccgtacttgggagtcggccat

SEQ ID NO: 394504 - DNA, 140 bp, Artificial Sequence
  Synthetic
atggccgactcccaagtacggtccagattgcaagggtcaccccgcgtccagttgcaagcaacatcaagcctgtgctcaacccctcccacatacatcctgactttgaacagagtgaagttaggagacccagcatggcgtat

SEQ ID NO: 394505 - DNA, 140 bp, Artificial Sequence
  Synthetic
aggccctggctgctgatatgccgtctacgggatgtggcctctccttctgctcctgttggcgttgccccagcgggcatacgcactggacacggagatggccgcgtcgtgtggcggcgttgtgaccttttgggacagcggtg

SEQ ID NO: 394506 - DNA, 140 bp, Artificial Sequence
  Synthetic
caccgctgtcccaaaaggtcacaacgccgccacacgacgcggccatctccgtgtccagtgcgtatgcccgctggggcaacgccaacaggagcagaaggagaggccacatcccgtagacggcatatcagcagccagggcct

SEQ ID NO: 394507 - DNA, 140 bp, Artificial Sequence
  Synthetic
aggccctggctgctgatatgtgccccccagactccgacgctgagtcctattcttccatgccccccctggagggggagcctggggatccggacctcagcgacgggtcgtggtcgacggttagaccttttgggacagcggtg

SEQ ID NO: 394508 - DNA, 140 bp, Artificial Sequence
  Synthetic
caccgctgtcccaaaaggtctaaccgtcgaccacgacccgtcgctgaggtccggatccccaggctccccctccagggggggcatggaagaataggactcagcgtcggagtctggggggcacatatcagcagccagggcct

SEQ ID NO: 394509 - DNA, 140 bp, Artificial Sequence
  Synthetic
aggccctggctgctgatatgccggtcttcacagacaactcatcccccccggccgtaccgcagacattccaagtggcccatctacacgctcccactggcagcggcaagagcactaaagtgcgaccttttgggacagcggtg

SEQ ID NO: 394510 - DNA, 140 bp, Artificial Sequence
  Synthetic
caccgctgtcccaaaaggtcgcactttagtgctcttgccgctgccagtgggagcgtgtagatgggccacttggaatgtctgcggtacggccgggggggatgagttgtctgtgaagaccggcatatcagcagccagggcct

SEQ ID NO: 394511 - DNA, 140 bp, Artificial Sequence
  Synthetic
aggccctggctgctgatatgcttccaggtggcccacctgcatgctcccaccggcagcggtaagagcaccaaggtcccggccgcatacgcggctcagggctacaaggtgctggtgctcaacgaccttttgggacagcggtg

SEQ ID NO: 394512 - DNA, 140 bp, Artificial Sequence
  Synthetic
caccgctgtcccaaaaggtcgttgagcaccagcaccttgtagccctgagccgcgtatgcggccgggaccttggtgctcttaccgctgccggtgggagcatgcaggtgggccacctggaagcatatcagcagccagggcct

SEQ ID NO: 394513 - DNA, 140 bp, Artificial Sequence
  Synthetic
atacgccatgctgggtctccaccacatgtccttgcgggggacatattacaggccatgtcaggaacgggacgatgaagatcactggtcccaagacatgcaatgtctggcatggcacgttcccgtacttgggagtcggccat

SEQ ID NO: 394514 - DNA, 140 bp, Artificial Sequence
  Synthetic
atggccgactcccaagtacgggaacgtgccatgccagacattgcatgtcttgggaccagtgatcttcatcgtcccgttcctgacatggcctgtaatatgtcccccgcaaggacatgtggtggagacccagcatggcgtat

SEQ ID NO: 394515 - DNA, 140 bp, Artificial Sequence
  Synthetic
aggccctggctgctgatatgagtgtccgcgctaagctactgtcccagggggggagggccgccacttgtggcaagtacctcttcaactgggcagtaaggaccaagctcaaactcactccaagaccttttgggacagcggtg

SEQ ID NO: 394516 - DNA, 140 bp, Artificial Sequence
  Synthetic
caccgctgtcccaaaaggtcttggagtgagtttgagcttggtccttactgcccagttgaagaggtacttgccacaagtggcggccctccccccctgggacagtagcttagcgcggacactcatatcagcagccagggcct

SEQ ID NO: 394517 - DNA, 140 bp, Artificial Sequence
  Synthetic
atacgccatgctgggtctccccacagtgtgcgccagggctcaggctccacctccatcgtgggatcaaatgtggaagtgtctcatacggcttaaacctacactgcacgggccaacacccctcgtacttgggagtcggccat

SEQ ID NO: 394518 - DNA, 140 bp, Artificial Sequence
  Synthetic
atggccgactcccaagtacgaggggtgttggcccgtgcagtgtaggtttaagccgtatgagacacttccacatttgatcccacgatggaggtggagcctgagccctggcgcacactgtggggagacccagcatggcgtat

SEQ ID NO: 394519 - DNA, 140 bp, Artificial Sequence
  Synthetic
aggccctggctgctgatatgtgcctgaccgtgcccgcttcagcctaccaagtgcgcaactcctcggggctctaccatgtcaccaatgattgccctaactcgagtattgtgtacgaggcgggaccttttgggacagcggtg

SEQ ID NO: 394520 - DNA, 140 bp, Artificial Sequence
  Synthetic
caccgctgtcccaaaaggtcccgcctcgtacacaatactcgagttagggcaatcattggtgacatggtagagccccgaggagttgcgcacttggtaggctgaagcgggcacggtcaggcacatatcagcagccagggcct

SEQ ID NO: 394521 - DNA, 140 bp, Artificial Sequence
  Synthetic
aggccctggctgctgatatgcttagcaggcttatccactctgcctgggaaccccgcgatagcatcactgatggcattcacagcctctatcaccagcccgctcaccacccaaagcaccctcgaccttttgggacagcggtg

SEQ ID NO: 394522 - DNA, 140 bp, Artificial Sequence
  Synthetic
caccgctgtcccaaaaggtcgagggtgctttgggtggtgagcgggctggtgatagaggctgtgaatgccatcagtgatgctatcgcggggttcccaggcagagtggataagcctgctaagcatatcagcagccagggcct

SEQ ID NO: 394523 - DNA, 140 bp, Artificial Sequence
  Synthetic
aggccctggctgctgatatgtggcattcacagcctctatcaccagcccgctcaccacccaaagcaccctcctgtttaacatcttggggggatgggtggctgcccaactcgctccccccaggaccttttgggacagcggtg

SEQ ID NO: 394524 - DNA, 140 bp, Artificial Sequence
  Synthetic
caccgctgtcccaaaaggtcctggggggagcgagttgggcagccacccatccccccaagatgttaaacaggagggtgctttgggtggtgagcgggctggtgatagaggctgtgaatgccacatatcagcagccagggcct

SEQ ID NO: 394525 - DNA, 140 bp, Artificial Sequence
  Synthetic
aggccctggctgctgatatgctgtttaacatcttggggggatgggtggctgcccaactcgctccccccagcgctgcttcggcattcgtgggcgccggcatcgccggtgcggctgttggcagaccttttgggacagcggtg

SEQ ID NO: 394526 - DNA, 140 bp, Artificial Sequence
  Synthetic
caccgctgtcccaaaaggtctgccaacagccgcaccggcgatgccggcgcccacgaatgccgaagcagcgctggggggagcgagttgggcagccacccatccccccaagatgttaaacagcatatcagcagccagggcct

SEQ ID NO: 394527 - DNA, 140 bp, Artificial Sequence
  Synthetic
atacgccatgctgggtctccgtgtgggactgggtgtgtacagtgttatctgattttaaagtatggctgcaagccaaacttctccctcgcctgccggggatccccttcctctcgtgccaaacgtacttgggagtcggccat

SEQ ID NO: 394528 - DNA, 140 bp, Artificial Sequence
  Synthetic
atggccgactcccaagtacgtttggcacgagaggaaggggatccccggcaggcgagggagaagtttggcttgcagccatactttaaaatcagataacactgtacacacccagtcccacacggagacccagcatggcgtat

SEQ ID NO: 394529 - DNA, 140 bp, Artificial Sequence
  Synthetic
aggccctggctgctgatatggcactacgcgcctcaaccgtgcggtatcgtacccgcgtcgcaggtgtgtggtccagtgtactgcttcaccccaagccctgttgtggtggggacgaccgatgaccttttgggacagcggtg

SEQ ID NO: 394530 - DNA, 140 bp, Artificial Sequence
  Synthetic
caccgctgtcccaaaaggtcatcggtcgtccccaccacaacagggcttggggtgaagcagtacactggaccacacacctgcgacgcgggtacgataccgcacggttgaggcgcgtagtgccatatcagcagccagggcct

SEQ ID NO: 394531 - DNA, 140 bp, Artificial Sequence
  Synthetic
aggccctggctgctgatatgatcgggggggccggcaacaacaccttgacctgccccacggactgcttccggaagcaccccgaggccacttacaccaaatgcggttcggggccttggttgagaccttttgggacagcggtg

SEQ ID NO: 394532 - DNA, 140 bp, Artificial Sequence
  Synthetic
caccgctgtcccaaaaggtctcaaccaaggccccgaaccgcatttggtgtaagtggcctcggggtgcttccggaagcagtccgtggggcaggtcaaggtgttgttgccggcccccccgatcatatcagcagccagggcct

SEQ ID NO: 394533 - DNA, 140 bp, Artificial Sequence
  Synthetic
aggccctggctgctgatatggggcgcccctatcacgtattccacctacggcaagttccttgccgacggtggttgctctggaggcgcctatgacatcataatatgtgatgagtgccactcagaccttttgggacagcggtg

SEQ ID NO: 394534 - DNA, 140 bp, Artificial Sequence
  Synthetic
caccgctgtcccaaaaggtctgagtggcactcatcacatattatgatgtcataggcgcctccagagcaaccaccgtcggcaaggaacttgccgtaggtggaatacgtgataggggcgccccatatcagcagccagggcct

SEQ ID NO: 394535 - DNA, 140 bp, Artificial Sequence
  Synthetic
aggccctggctgctgatatgcccttgagggggagccgggggaccccgatctcagcgacgggtcttggtctaccgtgagcgaggaggctagtgaggacgtcgtctgctgctcgatgtcctagaccttttgggacagcggtg

SEQ ID NO: 394536 - DNA, 140 bp, Artificial Sequence
  Synthetic
caccgctgtcccaaaaggtctaggacatcgagcagcagacgacgtcctcactagcctcctcgctcacggtagaccaagacccgtcgctgagatcggggtcccccggctccccctcaagggcatatcagcagccagggcct

SEQ ID NO: 394537 - DNA, 140 bp, Artificial Sequence
  Synthetic
atacgccatgctgggtctcctggatcttcttgcgggcgccgcggtggtttgctcatccctgtatgtcggggatctgtgcggctctctctttctggcagggcaattattcacctttcagcccgtacttgggagtcggccat

SEQ ID NO: 394538 - DNA, 140 bp, Artificial Sequence
  Synthetic
atggccgactcccaagtacgggctgaaaggtgaataattgccctgccagaaagagagagccgcacagatccccgacatacagggatgagcaaaccaccgcggcgcccgcaagaagatccaggagacccagcatggcgtat

SEQ ID NO: 394539 - DNA, 140 bp, Artificial Sequence
  Synthetic
atacgccatgctgggtctccttggcatggctggcaactggctaaaagttctggctgttctgtttctgtttgcaggggtcgaagcaaccaccaccactggcagcgaggtggcccgcactgtcgtacttgggagtcggccat

SEQ ID NO: 394540 - DNA, 140 bp, Artificial Sequence
  Synthetic
atggccgactcccaagtacgacagtgcgggccacctcgctgccagtggtggtggttgcttcgacccctgcaaacagaaacagaacagccagaacttttagccagttgccagccatgccaaggagacccagcatggcgtat

SEQ ID NO: 394541 - DNA, 140 bp, Artificial Sequence
  Synthetic
atacgccatgctgggtctccgatgctactcttcgccggtgtcgacgggaccacccacgtgacgggggcccaggcaggtcaacacctccggcgctttacgtctttcttctcatttggggcgcgtacttgggagtcggccat

SEQ ID NO: 394542 - DNA, 140 bp, Artificial Sequence
  Synthetic
atggccgactcccaagtacgcgccccaaatgagaagaaagacgtaaagcgccggaggtgttgacctgcctgggcccccgtcacgtgggtggtcccgtcgacaccggcgaagagtagcatcggagacccagcatggcgtat

SEQ ID NO: 394543 - DNA, 140 bp, Artificial Sequence
  Synthetic
atacgccatgctgggtctccggcccctctgacgaccgtccctactgctggcattacgctcctaggcaatgtgacgtggtgtcggcccttacggtgtgcggtcctgtctactgcttcactccgtacttgggagtcggccat

SEQ ID NO: 394544 - DNA, 140 bp, Artificial Sequence
  Synthetic
atggccgactcccaagtacggagtgaagcagtagacaggaccgcacaccgtaagggccgacaccacgtcacattgcctaggagcgtaatgccagcagtagggacggtcgtcagaggggccggagacccagcatggcgtat

SEQ ID NO: 394545 - DNA, 140 bp, Artificial Sequence
  Synthetic
aggccctggctgctgatatgtgacgtggtgtcggcccttacggtgtgcggtcctgtctactgcttcactcccagccctgttgtggtaggaaccactgacaggcggggcatccctacttacgaccttttgggacagcggtg

SEQ ID NO: 394546 - DNA, 140 bp, Artificial Sequence
  Synthetic
caccgctgtcccaaaaggtcgtaagtagggatgccccgcctgtcagtggttcctaccacaacagggctgggagtgaagcagtagacaggaccgcacaccgtaagggccgacaccacgtcacatatcagcagccagggcct

SEQ ID NO: 394547 - DNA, 140 bp, Artificial Sequence
  Synthetic
aggccctggctgctgatatggctccacgagtacccggtggggtcgcaattaccttgcgagcccgaaccggacgtagccgtgttgacgtccatgctcactgatccctcccatataacagcagaccttttgggacagcggtg

SEQ ID NO: 394548 - DNA, 140 bp, Artificial Sequence
  Synthetic
caccgctgtcccaaaaggtctgctgttatatgggagggatcagtgagcatggacgtcaacacggctacgtccggttcgggctcgcaaggtaattgcgaccccaccgggtactcgtggagccatatcagcagccagggcct

SEQ ID NO: 394549 - DNA, 140 bp, Artificial Sequence
  Synthetic
atacgccatgctgggtctccctagtgccgctggcactgccggttggtggtgggcgatacttttcctgtgctgtgcttggtatgtgaaaggtcgccttgtacctgtgtgtacctacatagccgtacttgggagtcggccat

SEQ ID NO: 394550 - DNA, 140 bp, Artificial Sequence
  Synthetic
atggccgactcccaagtacggctatgtaggtacacacaggtacaaggcgacctttcacataccaagcacagcacaggaaaagtatcgcccaccaccaaccggcagtgccagcggcactagggagacccagcatggcgtat

SEQ ID NO: 394551 - DNA, 140 bp, Artificial Sequence
  Synthetic
aggccctggctgctgatatgtacgccatggatcgggagatggctgcatcatgcggaggcgcggttttcataggtctggcactcttgaccttgtcaccacactacaaggtgttcctcgccagaccttttgggacagcggtg

SEQ ID NO: 394552 - DNA, 140 bp, Artificial Sequence
  Synthetic
caccgctgtcccaaaaggtctggcgaggaacaccttgtagtgtggtgacaaggtcaagagtgccagacctatgaaaaccgcgcctccgcatgatgcagccatctcccgatccatggcgtacatatcagcagccagggcct

SEQ ID NO: 394553 - DNA, 140 bp, Artificial Sequence
  Synthetic
aggccctggctgctgatatgcttggtctaccgtgagcgaggaggccagtgaggacgtcgtctgctgctcgatgtcctacacatggacaggcgccctgatcacgccatgcgccgcggaggagaccttttgggacagcggtg

SEQ ID NO: 394554 - DNA, 140 bp, Artificial Sequence
  Synthetic
caccgctgtcccaaaaggtctcctccgcggcgcatggcgtgatcagggcgcctgtccatgtgtaggacatcgagcagcagacgacgtcctcactggcctcctcgctcacggtagaccaagcatatcagcagccagggcct

SEQ ID NO: 394555 - DNA, 140 bp, Artificial Sequence
  Synthetic
atacgccatgctgggtctccgctgtatcatcaccagcctcaccggtcgggacaaaaaccaggtcgagggggaggttcaggtggtctccaccgcaacgcaatccttcctagcgacctgcatcgtacttgggagtcggccat

SEQ ID NO: 394556 - DNA, 140 bp, Artificial Sequence
  Synthetic
atggccgactcccaagtacgatgcaggtcgctaggaaggattgcgttgcggtggagaccacctgaacctccccctcgacctggtttttgtcccgaccggtgaggctggtgatgatacagcggagacccagcatggcgtat

SEQ ID NO: 394557 - DNA, 140 bp, Artificial Sequence
  Synthetic
aggccctggctgctgatatgaggcggtggactttgtacccgttgagtctatggaaactactatgcggtctccggtcttcacggataattcatctcccccggccgtaccgcagacattccagaccttttgggacagcggtg

SEQ ID NO: 394558 - DNA, 140 bp, Artificial Sequence
  Synthetic
caccgctgtcccaaaaggtctggaatgtctgcggtacggccgggggagatgaattatccgtgaagaccggagaccgcatagtagtttccatagactcaacgggtacaaagtccaccgcctcatatcagcagccagggcct

SEQ ID NO: 394559 - DNA, 140 bp, Artificial Sequence
  Synthetic
atacgccatgctgggtctcctccggcagcgtatgctagtcagggctacaaggtgttagtcttgaacccgtcggtagcggcaacgcttagctttggctcttatatgaggcaagcttatggccgtacttgggagtcggccat

SEQ ID NO: 394560 - DNA, 140 bp, Artificial Sequence
  Synthetic
atggccgactcccaagtacggccataagcttgcctcatataagagccaaagctaagcgttgccgctaccgacgggttcaagactaacaccttgtagccctgactagcatacgctgccggaggagacccagcatggcgtat

SEQ ID NO: 394561 - DNA, 140 bp, Artificial Sequence
  Synthetic
aggccctggctgctgatatgcccgtgaccccaccaccccccttgcgcgggctgcgtgggagacagctagacacactccagttaactcctggctaggcaacatcatcatgtatgcgcccacgaccttttgggacagcggtg

SEQ ID NO: 394562 - DNA, 140 bp, Artificial Sequence
  Synthetic
caccgctgtcccaaaaggtcgtgggcgcatacatgatgatgttgcctagccaggagttaactggagtgtgtctagctgtctcccacgcagcccgcgcaaggggggtggtggggtcacgggcatatcagcagccagggcct

SEQ ID NO: 394563 - DNA, 140 bp, Artificial Sequence
  Synthetic
aggccctggctgctgatatggtccaatacctctacggtgttggatctgcattggtgtcttgggcccttaagtgggaatatgtggtactcgcgttcctgcttcttgcagacgcgagggtctgaccttttgggacagcggtg

SEQ ID NO: 394564 - DNA, 140 bp, Artificial Sequence
  Synthetic
caccgctgtcccaaaaggtcagaccctcgcgtctgcaagaagcaggaacgcgagtaccacatattcccacttaagggcccaagacaccaatgcagatccaacaccgtagaggtattggaccatatcagcagccagggcct

SEQ ID NO: 394565 - DNA, 140 bp, Artificial Sequence
  Synthetic
aggccctggctgctgatatgcaccacgagcatacgccatggaccgggagatggctgcgtcgtgcggaggtatggttttcgtcggcctgatactcttgaccttgtcaccacactataaagcgaccttttgggacagcggtg

SEQ ID NO: 394566 - DNA, 140 bp, Artificial Sequence
  Synthetic
caccgctgtcccaaaaggtcgctttatagtgtggtgacaaggtcaagagtatcaggccgacgaaaaccatacctccgcacgacgcagccatctcccggtccatggcgtatgctcgtggtgcatatcagcagccagggcct

SEQ ID NO: 394567 - DNA, 140 bp, Artificial Sequence
  Synthetic
atacgccatgctgggtctcccctttgcggatccgttttcctagttggccagctatttgttttctcgccccgtcaccattggacgacgcaagactgcaattgttcactctacccaggccaccgtacttgggagtcggccat

SEQ ID NO: 394568 - DNA, 140 bp, Artificial Sequence
  Synthetic
atggccgactcccaagtacggtggcctgggtagagtgaacaattgcagtcttgcgtcgtccaatggtgacggggcgagaaaacaaatagctggccaactaggaaaacggatccgcaaaggggagacccagcatggcgtat

SEQ ID NO: 394569 - DNA, 140 bp, Artificial Sequence
  Synthetic
aggccctggctgctgatatgccaattcccccgccaaggcggaagaggctagtgcacttgaatgagtcagtggtctcgagcgccttggcgcagcttgccgataaggtgtttgtggagagtagaccttttgggacagcggtg

SEQ ID NO: 394570 - DNA, 140 bp, Artificial Sequence
  Synthetic
caccgctgtcccaaaaggtctactctccacaaacaccttatcggcaagctgcgccaaggcgctcgagaccactgactcattcaagtgcactagcctcttccgccttggcgggggaattggcatatcagcagccagggcct

SEQ ID NO: 394571 - DNA, 140 bp, Artificial Sequence
  Synthetic
aggccctggctgctgatatggccacaacatcccgcagcgcaagccaacggcagaaaaaggtcacctttgacagactgcaagtcctggacgaccactaccgggacgtgctcaaggagatgagaccttttgggacagcggtg

SEQ ID NO: 394572 - DNA, 140 bp, Artificial Sequence
  Synthetic
caccgctgtcccaaaaggtctcatctccttgagcacgtcccggtagtggtcgtccaggacttgcagtctgtcaaaggtgacctttttctgccgttggcttgcgctgcgggatgttgtggccatatcagcagccagggcct

SEQ ID NO: 394573 - DNA, 140 bp, Artificial Sequence
  Synthetic
aggccctggctgctgatatgacaccatgcacctgcggcagctcggacctttacttggtcacgaggcatgctgatgttattccggtgcgccggcggggcgacagcaggggaagcctactctgaccttttgggacagcggtg

SEQ ID NO: 394574 - DNA, 140 bp, Artificial Sequence
  Synthetic
caccgctgtcccaaaaggtcagagtaggcttcccctgctgtcgccccgccggcgcaccggaataacatcagcatgcctcgtgaccaagtaaaggtccgagctgccgcaggtgcatggtgtcatatcagcagccagggcct

SEQ ID NO: 394575 - DNA, 140 bp, Artificial Sequence
  Synthetic
atacgccatgctgggtctccacatggtggcgggggcccactggggagtcctaatgggccttgcctactattccatggtggggaactgggcgaaggtactagttgtactactgcttttcgccgtacttgggagtcggccat

SEQ ID NO: 394576 - DNA, 140 bp, Artificial Sequence
  Synthetic
atggccgactcccaagtacggcgaaaagcagtagtacaactagtaccttcgcccagttccccaccatggaatagtaggcaaggcccattaggactccccagtgggcccccgccaccatgtggagacccagcatggcgtat

SEQ ID NO: 394577 - DNA, 140 bp, Artificial Sequence
  Synthetic
aggccctggctgctgatatgggggacgaaccacgcccggaatacgacttggagctaataacatcatgctcatcgaacgtctccgtggcccatgacaacaccggacagagatactattaccgaccttttgggacagcggtg

SEQ ID NO: 394578 - DNA, 140 bp, Artificial Sequence
  Synthetic
caccgctgtcccaaaaggtcggtaatagtatctctgtccggtgttgtcatgggccacggagacgttcgatgagcatgatgttattagctccaagtcgtattccgggcgtggttcgtcccccatatcagcagccagggcct

SEQ ID NO: 394579 - DNA, 140 bp, Artificial Sequence
  Synthetic
atacgccatgctgggtctccgacgatttgggtgcgtatggtgatgatgacgcacttctttggaatactccagtcccaagaaacgctccacaaagcactcgacttcgacatgtacggggtccgtacttgggagtcggccat

SEQ ID NO: 394580 - DNA, 140 bp, Artificial Sequence
  Synthetic
atggccgactcccaagtacggaccccgtacatgtcgaagtcgagtgctttgtggagcgtttcttgggactggagtattccaaagaagtgcgtcatcatcaccatacgcacccaaatcgtcggagacccagcatggcgtat

SEQ ID NO: 394581 - DNA, 140 bp, Artificial Sequence
  Synthetic
aggccctggctgctgatatgagtcccaagaaacgctccacaaagcactcgacttcgacatgtacggggtcacctattctatcactccattggatttaccgccgattatccagcggttacagaccttttgggacagcggtg

SEQ ID NO: 394582 - DNA, 140 bp, Artificial Sequence
  Synthetic
caccgctgtcccaaaaggtctgtaaccgctggataatcggcggtaaatccaatggagtgatagaataggtgaccccgtacatgtcgaagtcgagtgctttgtggagcgtttcttgggactcatatcagcagccagggcct

SEQ ID NO: 394583 - DNA, 140 bp, Artificial Sequence
  Synthetic
atacgccatgctgggtctccttcgtggcaggcggtcgcgggggggacatatttcacagcgtgtcccgggcccgaccccgcattttactcctgtgcctactcctacttaccgtaggggtagcgtacttgggagtcggccat

SEQ ID NO: 394584 - DNA, 140 bp, Artificial Sequence
  Synthetic
atggccgactcccaagtacgctacccctacggtaagtaggagtaggcacaggagtaaaatgcggggtcgggcccgggacacgctgtgaaatatgtcccccccgcgaccgcctgccacgaaggagacccagcatggcgtat

SEQ ID NO: 394585 - DNA, 140 bp, Artificial Sequence
  Synthetic
  misc_feature (74)..(74): n is a, c, g, or t
  misc_feature (111)..(111): n is a, c, g, or t
atacgccatgctgggtctccctctacatactccaggtctcactcctacgcgtcccttactttgtgagggcacangcgctggtcaagatctgcagcttgttgcgtggggtantttacggcacgtacttgggagtcggccat

SEQ ID NO: 394586 - DNA, 140 bp, Artificial Sequence
  Synthetic
  misc_feature (30)..(30): n is a, c, g, or t
  misc_feature (67)..(67): n is a, c, g, or t
atggccgactcccaagtacgtgccgtaaantaccccacgcaacaagctgcagatcttgaccagcgcntgtgccctcacaaagtaagggacgcgtaggagtgagacctggagtatgtagagggagacccagcatggcgtat

SEQ ID NO: 394587 - DNA, 140 bp, Artificial Sequence
  Synthetic
aggccctggctgctgatatgcagctgctccggatcccacaagccatcttggacatgatcgctggtgcccactggggagtcctggcgggcatagcgtatttttccatggtggggaactggggaccttttgggacagcggtg

SEQ ID NO: 394588 - DNA, 140 bp, Artificial Sequence
  Synthetic
caccgctgtcccaaaaggtccccagttccccaccatggaaaaatacgctatgcccgccaggactccccagtgggcaccagcgatcatgtccaagatggcttgtgggatccggagcagctgcatatcagcagccagggcct

SEQ ID NO: 394589 - DNA, 140 bp, Artificial Sequence
  Synthetic
aggccctggctgctgatatgacctggttgggtcacagctcccatgcgagcccgaaccggacgtagcagtgctcacttccatgctcaccgacccctcccacattacagcagagacggctaagaccttttgggacagcggtg

SEQ ID NO: 394590 - DNA, 140 bp, Artificial Sequence
  Synthetic
caccgctgtcccaaaaggtcttagccgtctctgctgtaatgtgggaggggtcggtgagcatggaagtgagcactgctacgtccggttcgggctcgcatgggagctgtgacccaaccaggtcatatcagcagccagggcct

SEQ ID NO: 394591 - DNA, 140 bp, Artificial Sequence
  Synthetic
aggccctggctgctgatatgtgctggcactacccgccaaaaccttgtggtattgtgcccgcgaagagcgtgtgtggcccggtatattgcttcactcccagccccgtggtggtgggaacgagaccttttgggacagcggtg

SEQ ID NO: 394592 - DNA, 140 bp, Artificial Sequence
  Synthetic
caccgctgtcccaaaaggtctcgttcccaccaccacggggctgggagtgaagcaatataccgggccacacacgctcttcgcgggcacaataccacaaggttttggcgggtagtgccagcacatatcagcagccagggcct

SEQ ID NO: 394593 - DNA, 140 bp, Artificial Sequence
  Synthetic
aggccctggctgctgatatgcaagtgtgggtcccccctctcaacgttcgggggggccgtgatgccatcatcctcctcacgtgcgcagtccacccagagctaatctttgacatcaccaaatgaccttttgggacagcggtg

SEQ ID NO: 394594 - DNA, 140 bp, Artificial Sequence
  Synthetic
caccgctgtcccaaaaggtcatttggtgatgtcaaagattagctctgggtggactgcgcacgtgaggaggatgatggcatcacggcccccccgaacgttgagaggggggacccacacttgcatatcagcagccagggcct

SEQ ID NO: 394595 - DNA, 140 bp, Artificial Sequence
  Synthetic
aggccctggctgctgatatgtcgttctcctgttccttctgcttgcagacgcgcgcgtctgctcctgcttgtggatgatgttactcatatcccaagcggaggcggctttggagaacctcgtgaccttttgggacagcggtg

SEQ ID NO: 394596 - DNA, 140 bp, Artificial Sequence
  Synthetic
caccgctgtcccaaaaggtcacgaggttctccaaagccgcctccgcttgggatatgagtaacatcatccacaagcaggagcagacgcgcgcgtctgcaagcagaaggaacaggagaacgacatatcagcagccagggcct

SEQ ID NO: 394597 - DNA, 140 bp, Artificial Sequence
  Synthetic
aggccctggctgctgatatgactcctcgcgcccatcacggcctactcccaacagacgcggggcctacttggttgcatcatcactagcctcacaggccgggacaagaaccaggtcgagggggaccttttgggacagcggtg

SEQ ID NO: 394598 - DNA, 140 bp, Artificial Sequence
  Synthetic
caccgctgtcccaaaaggtccccctcgacctggttcttgtcccggcctgtgaggctagtgatgatgcaaccaagtaggccccgcgtctgttgggagtaggccgtgatgggcgcgaggagtcatatcagcagccagggcct

SEQ ID NO: 394599 - DNA, 140 bp, Artificial Sequence
  Synthetic
aggccctggctgctgatatgacaaggggcctcctggggtgtataatcaccagcctaactggccgggacaaaaaccaagtggagggtgaggtccagattgtgtcaactgctgcccaaacttgaccttttgggacagcggtg

SEQ ID NO: 394600 - DNA, 140 bp, Artificial Sequence
  Synthetic
caccgctgtcccaaaaggtcaagtttgggcagcagttgacacaatctggacctcaccctccacttggtttttgtcccggccagttaggctggtgattatacaccccaggaggccccttgtcatatcagcagccagggcct

SEQ ID NO: 394601 - DNA, 140 bp, Artificial Sequence
  Synthetic
aggccctggctgctgatatgtcacgtactccacctatggcaagttccttgccgacggtggctgctctgggggcgcctatgacatcataatatgtgatgagtgccactcaactgactcgacgaccttttgggacagcggtg

SEQ ID NO: 394602 - DNA, 140 bp, Artificial Sequence
  Synthetic
caccgctgtcccaaaaggtcgtcgagtcagttgagtggcactcatcacatattatgatgtcataggcgcccccagagcagccaccgtcggcaaggaacttgccataggtggagtacgtgacatatcagcagccagggcct

SEQ ID NO: 394603 - DNA, 140 bp, Artificial Sequence
  Synthetic
aggccctggctgctgatatgcttctatggcaaagccatccccattgaggtcatcaagggggggaggcatctcattttctgccattccaagaagaagtgtgatgagctcgccgcaaagctggaccttttgggacagcggtg

SEQ ID NO: 394604 - DNA, 140 bp, Artificial Sequence
  Synthetic
caccgctgtcccaaaaggtccagctttgcggcgagctcatcacacttcttcttggaatggcagaaaatgagatgcctcccccccttgatgacctcaatggggatggctttgccatagaagcatatcagcagccagggcct

SEQ ID NO: 394605 - DNA, 140 bp, Artificial Sequence
  Synthetic
aggccctggctgctgatatggagtcctagcgggcctcgcctactattccatggtggggaactgggctaaggtcttgattgtggcgctactttttaccggcgttgacggccataccaccgtgaccttttgggacagcggtg

SEQ ID NO: 394606 - DNA, 140 bp, Artificial Sequence
  Synthetic
caccgctgtcccaaaaggtcacggtggtatggccgtcaacgccggtaaaaagtagcgccacaatcaagaccttagcccagttccccaccatggaatagtaggcgaggcccgctaggactccatatcagcagccagggcct

SEQ ID NO: 394607 - DNA, 140 bp, Artificial Sequence
  Synthetic
atacgccatgctgggtctcccacatcaatagtactgccctgaactgcaatgattccctcagcaccgggttccttgccgcgctgttctatacacaccggttcaactcgtccggatgcccagcgtacttgggagtcggccat

SEQ ID NO: 394608 - DNA, 140 bp, Artificial Sequence
  Synthetic
atggccgactcccaagtacgctgggcatccggacgagttgaaccggtgtgtatagaacagcgcggcaaggaacccggtgctgagggaatcattgcagttcagggcagtactattgatgtgggagacccagcatggcgtat

SEQ ID NO: 394609 - DNA, 140 bp, Artificial Sequence
  Synthetic
aggccctggctgctgatatggtatttctccatggtggggaactgggcaaaggtcctggtggtgctgctgctatttgccggcgtcgacgcgggcacccacgtcaccgggggagtcactgccgaccttttgggacagcggtg

SEQ ID NO: 394610 - DNA, 140 bp, Artificial Sequence
  Synthetic
caccgctgtcccaaaaggtcggcagtgactcccccggtgacgtgggtgcccgcgtcgacgccggcaaatagcagcagcaccaccaggacctttgcccagttccccaccatggagaaataccatatcagcagccagggcct

SEQ ID NO: 394611 - DNA, 140 bp, Artificial Sequence
  Synthetic
atacgccatgctgggtctcctgaactgcaacgacagcctcaacaccggctttatagcggggcttctctattaccacaaattcaactcctcgggctgtcccgagaggttggccagctgccacgtacttgggagtcggccat

SEQ ID NO: 394612 - DNA, 140 bp, Artificial Sequence
  Synthetic
atggccgactcccaagtacgtggcagctggccaacctctcgggacagcccgaggagttgaatttgtggtaatagagaagccccgctataaagccggtgttgaggctgtcgttgcagttcaggagacccagcatggcgtat

SEQ ID NO: 394613 - DNA, 140 bp, Artificial Sequence
  Synthetic
aggccctggctgctgatatgcacctaggtgcatggttgactatccatacagactctggcactacccctgcactgtcaactttaccatcttcaaggttaggatgtatgtggggggcgtggagaccttttgggacagcggtg

SEQ ID NO: 394614 - DNA, 140 bp, Artificial Sequence
  Synthetic
caccgctgtcccaaaaggtctccacgccccccacatacatcctaaccttgaagatggtaaagttgacagtgcaggggtagtgccagagtctgtatggatagtcaaccatgcacctaggtgcatatcagcagccagggcct

SEQ ID NO: 394615 - DNA, 140 bp, Artificial Sequence
  Synthetic
aggccctggctgctgatatgtcagtgggatacaatacttggcgggcctgtcaacgttgcctggtaaccccgccattgcttcattgatggcttttacagctgctgtcaccagcccactaacgaccttttgggacagcggtg

SEQ ID NO: 394616 - DNA, 140 bp, Artificial Sequence
  Synthetic
caccgctgtcccaaaaggtcgttagtgggctggtgacagcagctgtaaaagccatcaatgaagcaatggcggggttaccaggcaacgttgacaggcccgccaagtattgtatcccactgacatatcagcagccagggcct

SEQ ID NO: 394617 - DNA, 140 bp, Artificial Sequence
  Synthetic
aggccctggctgctgatatgtaatagcctttgcatcaagaggcaaccacgtgtccccgacgcactacgtgcctgagactgacgcgtcaaaaaatgtgactcagatactcacttctcttacgaccttttgggacagcggtg

SEQ ID NO: 394618 - DNA, 140 bp, Artificial Sequence
  Synthetic
caccgctgtcccaaaaggtcgtaagagaagtgagtatctgagtcacattttttgacgcgtcagtctcaggcacgtagtgcgtcggggacacgtggttgcctcttgatgcaaaggctattacatatcagcagccagggcct

SEQ ID NO: 394619 - DNA, 140 bp, Artificial Sequence
  Synthetic
atacgccatgctgggtctccctggcataattaaaatgccgtactttgtacgcgctcaggccctcattcgtgcatgcatgttggtgcggaagatcgctgggggccattatgtccagatggccgtacttgggagtcggccat

SEQ ID NO: 394620 - DNA, 140 bp, Artificial Sequence
  Synthetic
atggccgactcccaagtacggccatctggacataatggcccccagcgatcttccgcaccaacatgcatgcacgaatgagggcctgagcgcgtacaaagtacggcattttaattatgccagggagacccagcatggcgtat

SEQ ID NO: 394621 - DNA, 140 bp, Artificial Sequence
  Synthetic
atacgccatgctgggtctccaaaaacacccggaaatggaactcctccaagccaacctcctctggaagcacgaaatgggaagccacatccctcgagtccaatcagaaaacaaagttgtagtcgtacttgggagtcggccat

SEQ ID NO: 394622 - DNA, 140 bp, Artificial Sequence
  Synthetic
atggccgactcccaagtacgactacaactttgttttctgattggactcgagggatgtggcttcccatttcgtgcttccagaggaggttggcttggaggagttccatttccgggtgtttttggagacccagcatggcgtat

SEQ ID NO: 394623 - DNA, 140 bp, Artificial Sequence
  Synthetic
aggccctggctgctgatatggaaatgggaagccacatccctcgagtccaatcagaaaacaaagttgtagtacttgactcctttgagctctacccgcttgagtatgaggagagggaaatttgaccttttgggacagcggtg

SEQ ID NO: 394624 - DNA, 140 bp, Artificial Sequence
  Synthetic
caccgctgtcccaaaaggtcaaatttccctctcctcatactcaagcgggtagagctcaaaggagtcaagtactacaactttgttttctgattggactcgagggatgtggcttcccatttccatatcagcagccagggcct

SEQ ID NO: 394625 - DNA, 140 bp, Artificial Sequence
  Synthetic
aggccctggctgctgatatgcacctaaaccggcaccagttcccccgccgaggcggaagaggctagtgcacttggatgagtccacggtctcgcacgccttggcgcagctcgccgacaaggtgaccttttgggacagcggtg

SEQ ID NO: 394626 - DNA, 140 bp, Artificial Sequence
  Synthetic
caccgctgtcccaaaaggtcaccttgtcggcgagctgcgccaaggcgtgcgagaccgtggactcatccaagtgcactagcctcttccgcctcggcgggggaactggtgccggtttaggtgcatatcagcagccagggcct

SEQ ID NO: 394627 - DNA, 140 bp, Artificial Sequence
  Synthetic
aggccctggctgctgatatgagatggctctttatgacgtggtctccacccttcctcaggccgtgatgggctcctcatacggattccagtactctcctgggcagcgggtcgagttcctggtgaccttttgggacagcggtg

SEQ ID NO: 394628 - DNA, 140 bp, Artificial Sequence
  Synthetic
caccgctgtcccaaaaggtcaccaggaactcgacccgctgcccaggagagtactggaatccgtatgaggagcccatcacggcctgaggaagggtggagaccacgtcataaagagccatctcatatcagcagccagggcct

SEQ ID NO: 394629 - DNA, 140 bp, Artificial Sequence
  Synthetic
atacgccatgctgggtctcctgcagcctacccggagctgatatttgacatcaccaagctcctgcttgccattattggtcctatgtggatactccagaccagcttgcttagggtgccgtaccgtacttgggagtcggccat

SEQ ID NO: 394630 - DNA, 140 bp, Artificial Sequence
  Synthetic
atggccgactcccaagtacggtacggcaccctaagcaagctggtctggagtatccacataggaccaataatggcaagcaggagcttggtgatgtcaaatatcagctccgggtaggctgcaggagacccagcatggcgtat

SEQ ID NO: 394631 - DNA, 140 bp, Artificial Sequence
  Synthetic
aggccctggctgctgatatgcgaccagcggcgacgttgtcgtcgtggcaaccgatgctctcatgaccggctataccggcgacttcgactcggtgatagactgcaacacgtgtgtcacccagaccttttgggacagcggtg

SEQ ID NO: 394632 - DNA, 140 bp, Artificial Sequence
  Synthetic
caccgctgtcccaaaaggtctgggtgacacacgtgttgcagtctatcaccgagtcgaagtcgccggtatagccggtcatgagagcatcggttgccacgacgacaacgtcgccgctggtcgcatatcagcagccagggcct

SEQ ID NO: 394633 - DNA, 140 bp, Artificial Sequence
  Synthetic
atacgccatgctgggtctcctatccccaaggcgcgtcggcccgagggcaggtcctgggctcagcccgggtacccttggcccctctatggcaatgagggttgcgggtgggcgggatggctccgtacttgggagtcggccat

SEQ ID NO: 394634 - DNA, 140 bp, Artificial Sequence
  Synthetic
atggccgactcccaagtacggagccatcccgcccacccgcaaccctcattgccatagaggggccaagggtacccgggctgagcccaggacctgccctcgggccgacgcgccttggggataggagacccagcatggcgtat

SEQ ID NO: 394635 - DNA, 140 bp, Artificial Sequence
  Synthetic
aggccctggctgctgatatgacttcctaaacctcaaagaaaaaccaaaagaaacaccaaccgtcgcccaatggacgtcaagttcccgggcggcggccagatcgttggtggagtttacttggaccttttgggacagcggtg

SEQ ID NO: 394636 - DNA, 140 bp, Artificial Sequence
  Synthetic
caccgctgtcccaaaaggtccaagtaaactccaccaacgatctggccgccgcccgggaacttgacgtccattgggcgacggttggtgtttcttttggtttttctttgaggtttaggaagtcatatcagcagccagggcct

SEQ ID NO: 394637 - DNA, 140 bp, Artificial Sequence
  Synthetic
atacgccatgctgggtctcctgctctcttgcctgactgtgcccgcttcagcctaccaagtgcgcaactcctcggggctttaccatgtcaccaatgattgccctaactcgagtattgtgtacgtacttgggagtcggccat

SEQ ID NO: 394638 - DNA, 140 bp, Artificial Sequence
  Synthetic
atggccgactcccaagtacgtacacaatactcgagttagggcaatcattggtgacatggtaaagccccgaggagttgcgcacttggtaggctgaagcgggcacagtcaggcaagagagcaggagacccagcatggcgtat

SEQ ID NO: 394639 - DNA, 140 bp, Artificial Sequence
  Synthetic
atacgccatgctgggtctcccatctcagggccggacctggggtcagcctggctacccctggcccctgtatgggaatgagggctgcgggtgggcaggctggcttatgtctccccgcggctccgtacttgggagtcggccat

SEQ ID NO: 394640 - DNA, 140 bp, Artificial Sequence
  Synthetic
atggccgactcccaagtacggagccgcggggagacataagccagcctgcccacccgcagccctcattcccatacaggggccaggggtagccaggctgaccccaggtccggccctgagatgggagacccagcatggcgtat

SEQ ID NO: 394641 - DNA, 140 bp, Artificial Sequence
  Synthetic
atacgccatgctgggtctccattcccgtcgtaggcggacccttgggtggcgtcgcggctgcgctcgcacatggtgtgagggcaatcgaggacgggattaactatgcaacagggaatcttccgtacttgggagtcggccat

SEQ ID NO: 394642 - DNA, 140 bp, Artificial Sequence
  Synthetic
atggccgactcccaagtacggaagattccctgttgcatagttaatcccgtcctcgattgccctcacaccatgtgcgagcgcagccgcgacgccacccaagggtccgcctacgacgggaatggagacccagcatggcgtat

SEQ ID NO: 394643 - DNA, 140 bp, Artificial Sequence
  Synthetic
atacgccatgctgggtctccaaccaatgattgtccacgctccagcatagtgctggaagcggaggccatgatcctacacctagctggttgtgtgccttgcgtgagagccggaaacatttcacgtacttgggagtcggccat

SEQ ID NO: 394644 - DNA, 140 bp, Artificial Sequence
  Synthetic
atggccgactcccaagtacgtgaaatgtttccggctctcacgcaaggcacacaaccagctaggtgtaggatcatggcctccgcttccagcactatgctggagcgtggacaatcattggttggagacccagcatggcgtat

SEQ ID NO: 394645 - DNA, 140 bp, Artificial Sequence
  Synthetic
aggccctggctgctgatatgctcacttccatgctcaccgacccctcccacatcacagcagagacggctaagcgcaggctggccagggggtctcccccctccttggccagctcttcagctagaccttttgggacagcggtg

SEQ ID NO: 394646 - DNA, 140 bp, Artificial Sequence
  Synthetic
caccgctgtcccaaaaggtctagctgaagagctggccaaggaggggggagaccccctggccagcctgcgcttagccgtctctgctgtgatgtgggaggggtcggtgagcatggaagtgagcatatcagcagccagggcct

SEQ ID NO: 394647 - DNA, 140 bp, Artificial Sequence
  Synthetic
atacgccatgctgggtctcctcgtttgctcttcgatgtatatcggagacctctgcggtgccgtatttttggcaggacagttggctaccttcagtcctcgcatccacgacataacgcaggacgtacttgggagtcggccat

SEQ ID NO: 394648 - DNA, 140 bp, Artificial Sequence
  Synthetic
atggccgactcccaagtacgtcctgcgttatgtcgtggatgcgaggactgaaggtagccaactgtcctgccaaaaatacggcaccgcagaggtctccgatatacatcgaagagcaaacgaggagacccagcatggcgtat

SEQ ID NO: 394649 - DNA, 140 bp, Artificial Sequence
  Synthetic
atacgccatgctgggtctccattctgagagtgcccgaaatagtgctcgaggtgttcgccggcggtcactggggtgtcctgatcgccatcgcctacttcggcatgtcaggcaattggttgacgtacttgggagtcggccat

SEQ ID NO: 394650 - DNA, 140 bp, Artificial Sequence
  Synthetic
atggccgactcccaagtacgtcaaccaattgcctgacatgccgaagtaggcgatggcgatcaggacaccccagtgaccgccggcgaacacctcgagcactatttcgggcactctcagaatggagacccagcatggcgtat

SEQ ID NO: 394651 - DNA, 140 bp, Artificial Sequence
  Synthetic
aggccctggctgctgatatgtctcaaggtaacttgcaccaccaatcatgactcccctgatgtcgagctcatagaagcctacctcgcatggaggcatgagatgggcggcgacatcaccagggaccttttgggacagcggtg

SEQ ID NO: 394652 - DNA, 140 bp, Artificial Sequence
  Synthetic
caccgctgtcccaaaaggtccctggtgatgtcgccgcccatctcatgcctccatgcgaggtaggcttctatgagctcgacatcaggggagtcatgattggtggtgcaagttaccttgagacatatcagcagccagggcct

SEQ ID NO: 394653 - DNA, 140 bp, Artificial Sequence
  Synthetic
aggccctggctgctgatatgatccaccgtgtcttctgccctggcggagcttgccacaaagaccttcggcagctccgaatcgtcggccgtcgacagcggcacggcgactgcccctcctgacgaccttttgggacagcggtg

SEQ ID NO: 394654 - DNA, 140 bp, Artificial Sequence
  Synthetic
caccgctgtcccaaaaggtcgtcaggaggggcagtcgccgtgccgctgtcgacggccgacgattcggagctgccgaaggtctttgtggcaagctccgccagggcagaagacacggtggatcatatcagcagccagggcct

SEQ ID NO: 394655 - DNA, 140 bp, Artificial Sequence
  Synthetic
atacgccatgctgggtctccctataacccacaagtccaacatcacagggccgtctgaggaccggccctactgctggcactatgctcctagggagtgtagtgtagtgccggcgtcatcagtcgtacttgggagtcggccat

SEQ ID NO: 394656 - DNA, 140 bp, Artificial Sequence
  Synthetic
atggccgactcccaagtacgactgatgacgccggcactacactacactccctaggagcatagtgccagcagtagggccggtcctcagacggccctgtgatgttggacttgtgggttatagggagacccagcatggcgtat

SEQ ID NO: 394657 - DNA, 140 bp, Artificial Sequence
  Synthetic
atacgccatgctgggtctccatggcgtatggccgctgctcctgctcctgctggcactaccaccacgagcttatgctatggaccgggagatggctgcgtcatgcggaggcggggtttttatcgtacttgggagtcggccat

SEQ ID NO: 394658 - DNA, 140 bp, Artificial Sequence
  Synthetic
atggccgactcccaagtacgataaaaaccccgcctccgcatgacgcagccatctcccggtccatagcataagctcgtggtggtagtgccagcaggagcaggagcagcggccatacgccatggagacccagcatggcgtat

SEQ ID NO: 394659 - DNA, 140 bp, Artificial Sequence
  Synthetic
atacgccatgctgggtctccgtgttcatgctagagagcctgcggcctccgcaaggaggttggttcgggtgcacgtggatgaactctacgggcttcaccaagacctgcggagccccgccttcgtacttgggagtcggccat

SEQ ID NO: 394660 - DNA, 140 bp, Artificial Sequence
  Synthetic
atggccgactcccaagtacgaaggcggggctccgcaggtcttggtgaagcccgtagagttcatccacgtgcacccgaaccaacctccttgcggaggccgcaggctctctagcatgaacacggagacccagcatggcgtat

SEQ ID NO: 394661 - DNA, 140 bp, Artificial Sequence
  Synthetic
atacgccatgctgggtctccgtcggggccctggctgacccccaggtgtctggtggactatccctacagattgtggcactatccatgcactgtcaactacacaatacacaaggttcgcatgcgtacttgggagtcggccat

SEQ ID NO: 394662 - DNA, 140 bp, Artificial Sequence
  Synthetic
atggccgactcccaagtacgcatgcgaaccttgtgtattgtgtagttgacagtgcatggatagtgccacaatctgtagggatagtccaccagacacctgggggtcagccagggccccgacggagacccagcatggcgtat

SEQ ID NO: 394663 - DNA, 140 bp, Artificial Sequence
  Synthetic
atacgccatgctgggtctcctcctcttttcaaccacgcagcttgctatcttgccttgcagctttaccaccatgcccgccttgtcaacaggacttatacatctccatcaaaacattgtagacgtacttgggagtcggccat

SEQ ID NO: 394664 - DNA, 140 bp, Artificial Sequence
  Synthetic
atggccgactcccaagtacgtctacaatgttttgatggagatgtataagtcctgttgacaaggcgggcatggtggtaaagctgcaaggcaagatagcaagctgcgtggttgaaaagaggaggagacccagcatggcgtat

SEQ ID NO: 394665 - DNA, 140 bp, Artificial Sequence
  Synthetic
atacgccatgctgggtctcctgcacttgcctttggttgatgctgctcgtcggcaaggtcgaagcagcattggagcggctcgtcgtcctcaatgcagccagcgccgcgggtaccgccggttcgtacttgggagtcggccat

SEQ ID NO: 394666 - DNA, 140 bp, Artificial Sequence
  Synthetic
atggccgactcccaagtacgaaccggcggtacccgcggcgctggctgcattgaggacgacgagccgctccaatgctgcttcgaccttgccgacgagcagcatcaaccaaaggcaagtgcaggagacccagcatggcgtat

SEQ ID NO: 394667 - DNA, 140 bp, Artificial Sequence
  Synthetic
atacgccatgctgggtctccggtgattctggccctgccccaacgggcatatgcctgggacaatagtcaggctgcatcacttggggtcgttgcccttctggtgttgacaatctttaccctccgtacttgggagtcggccat

SEQ ID NO: 394668 - DNA, 140 bp, Artificial Sequence
  Synthetic
atggccgactcccaagtacggagggtaaagattgtcaacaccagaagggcaacgaccccaagtgatgcagcctgactattgtcccaggcatatgcccgttggggcagggccagaatcaccggagacccagcatggcgtat

SEQ ID NO: 394669 - DNA, 140 bp, Artificial Sequence
  Synthetic
atacgccatgctgggtctccgggtcaggggcggtagggatgccatcattctgctcacctgcttgttacacccacatctcgggtttgaggtcacaaagattttgttagccatcttagcccccgtacttgggagtcggccat

SEQ ID NO: 394670 - DNA, 140 bp, Artificial Sequence
  Synthetic
atggccgactcccaagtacgggggctaagatggctaacaaaatctttgtgacctcaaacccgagatgtgggtgtaacaagcaggtgagcagaatgatggcatccctaccgcccctgacccggagacccagcatggcgtat

SEQ ID NO: 394671 - DNA, 140 bp, Artificial Sequence
  Synthetic
atacgccatgctgggtctccaaatatgtgcaagcttgcctcttgaggttgggcgcctggactggcacatacatatacgatcatctagctcctctcagtgagtgggcgagcgacggcttgccgtacttgggagtcggccat

SEQ ID NO: 394672 - DNA, 140 bp, Artificial Sequence
  Synthetic
atggccgactcccaagtacggcaagccgtcgctcgcccactcactgagaggagctagatgatcgtatatgtatgtgccagtccaggcgcccaacctcaagaggcaagcttgcacatatttggagacccagcatggcgtat

SEQ ID NO: 394673 - DNA, 140 bp, Artificial Sequence
  Synthetic
atacgccatgctgggtctccgggtctccctgtgtccgcgagactaggggacttggtgctgctgggacccgcggatgacatgcgtcacggaggttggaagcttctggctcccatcaccgcacgtacttgggagtcggccat

SEQ ID NO: 394674 - DNA, 140 bp, Artificial Sequence
  Synthetic
atggccgactcccaagtacgtgcggtgatgggagccagaagcttccaacctccgtgacgcatgtcatccgcgggtcccagcagcaccaagtcccctagtctcgcggacacagggagacccggagacccagcatggcgtat

SEQ ID NO: 394675 - DNA, 140 bp, Artificial Sequence
  Synthetic
atacgccatgctgggtctccccactcagagtttcctggcgaccactatcaacggtgtcctatggactgtttatcacggtgctggctcgaaaaaccttgccggaccaaaagggcccgtatgcgtacttgggagtcggccat

SEQ ID NO: 394676 - DNA, 140 bp, Artificial Sequence
  Synthetic
atggccgactcccaagtacgcatacgggcccttttggtccggcaaggtttttcgagccagcaccgtgataaacagtccataggacaccgttgatagtggtcgccaggaaactctgagtggggagacccagcatggcgtat

SEQ ID NO: 394677 - DNA, 140 bp, Artificial Sequence
  Synthetic
atacgccatgctgggtctccctggtcacgagaggtgctgatgttatccctgcacgtcgtaggggtgatactcgcgctgctcttttgtcccccagacccataagcaccctcaaaggctcttcgtacttgggagtcggccat

SEQ ID NO: 394678 - DNA, 140 bp, Artificial Sequence
  Synthetic
atggccgactcccaagtacgaagagcctttgagggtgcttatgggtctgggggacaaaagagcagcgcgagtatcacccctacgacgtgcagggataacatcagcacctctcgtgaccagggagacccagcatggcgtat

SEQ ID NO: 394679 - DNA, 140 bp, Artificial Sequence
  Synthetic
atacgccatgctgggtctccggagaatatggacacaaccatgcgatctcctgtgtttaccgacaactcctcgccgcctgcggtgcctcagacctaccaggtggggtacctgcacgctccgcgtacttgggagtcggccat

SEQ ID NO: 394680 - DNA, 140 bp, Artificial Sequence
  Synthetic
atggccgactcccaagtacgcggagcgtgcaggtaccccacctggtaggtctgaggcaccgcaggcggcgaggagttgtcggtaaacacaggagatcgcatggttgtgtccatattctccggagacccagcatggcgtat

SEQ ID NO: 394681 - DNA, 140 bp, Artificial Sequence
  Synthetic
atacgccatgctgggtctccgggcatacatgagcaaagctcatggtatagacccgaatatccggacgggtgtcaggaccatcaccacagggggtcccgtaacatactcaacatatgggaacgtacttgggagtcggccat

SEQ ID NO: 394682 - DNA, 140 bp, Artificial Sequence
  Synthetic
atggccgactcccaagtacgttcccatatgttgagtatgttacgggaccccctgtggtgatggtcctgacacccgtccggatattcgggtctataccatgagctttgctcatgtatgcccggagacccagcatggcgtat

SEQ ID NO: 394683 - DNA, 140 bp, Artificial Sequence
  Synthetic
aggccctggctgctgatatgatttgctcgttggggcggctgctttctgctccgctatgtacgtgggagatctctgcggatctgttttccttgtctcccagctgttcaccttctcgcctcggaccttttgggacagcggtg

SEQ ID NO: 394684 - DNA, 140 bp, Artificial Sequence
  Synthetic
caccgctgtcccaaaaggtccgaggcgagaaggtgaacagctgggagacaaggaaaacagatccgcagagatctcccacgtacatagcggagcagaaagcagccgccccaacgagcaaatcatatcagcagccagggcct

SEQ ID NO: 394685 - DNA, 140 bp, Artificial Sequence
  Synthetic
atacgccatgctgggtctccgaaatgcgacgaactgtctaaacaactaacctcattaggtctcaatgctgtcgcattctatagaggtgtcgatgtggctgtgatccccacctcaggcgaccgtacttgggagtcggccat

SEQ ID NO: 394686 - DNA, 140 bp, Artificial Sequence
  Synthetic
atggccgactcccaagtacggtcgcctgaggtggggatcacagccacatcgacacctctatagaatgcgacagcattgagacctaatgaggttagttgtttagacagttcgtcgcatttcggagacccagcatggcgtat

SEQ ID NO: 394687 - DNA, 140 bp, Artificial Sequence
  Synthetic
atacgccatgctgggtctccgcttggacccaactttttccatagagaccaccacagtcccccaagacgctgtctcgagaagccaacggcgtggtcgcacgggacgaggaaagccgggggtcgtacttgggagtcggccat

SEQ ID NO: 394688 - DNA, 140 bp, Artificial Sequence
  Synthetic
atggccgactcccaagtacgacccccggctttcctcgtcccgtgcgaccacgccgttggcttctcgagacagcgtcttgggggactgtggtggtctctatggaaaaagttgggtccaagcggagacccagcatggcgtat

SEQ ID NO: 394689 - DNA, 140 bp, Artificial Sequence
  Synthetic
aggccctggctgctgatatgaatgactccctccacactgggttccttgctgcgctgttcttcgtaaacaagttcaacgcgtcaggatgcccagagcgcatggccagctgccgccccatcggaccttttgggacagcggtg

SEQ ID NO: 394690 - DNA, 140 bp, Artificial Sequence
  Synthetic
caccgctgtcccaaaaggtccgatggggcggcagctggccatgcgctctgggcatcctgacgcgttgaacttgtttacgaagaacagcgcagcaaggaacccagtgtggagggagtcattcatatcagcagccagggcct

SEQ ID NO: 394691 - DNA, 140 bp, Artificial Sequence
  Synthetic
atacgccatgctgggtctcccctgcagagacaacggttagactacgtgcctacctaaacactcccgggttgcccgtctgccaagaccacctggagttttgggagggggtattcacaggatcgtacttgggagtcggccat

SEQ ID NO: 394692 - DNA, 140 bp, Artificial Sequence
  Synthetic
atggccgactcccaagtacgatcctgtgaataccccctcccaaaactccaggtggtcttggcagacgggcaacccgggagtgtttaggtaggcacgtagtctaaccgttgtctctgcaggggagacccagcatggcgtat

SEQ ID NO: 394693 - DNA, 140 bp, Artificial Sequence
  Synthetic
aggccctggctgctgatatgggggtggctggcgcactcgtagcctttaaaatcatgagcggcgaggcgccctccaccgaggacctggttaatttgctccctgccatcctctctcccggcggaccttttgggacagcggtg

SEQ ID NO: 394694 - DNA, 140 bp, Artificial Sequence
  Synthetic
caccgctgtcccaaaaggtccgccgggagagaggatggcagggagcaaattaaccaggtcctcggtggagggcgcctcgccgctcatgattttaaaggctacgagtgcgccagccacccccatatcagcagccagggcct

SEQ ID NO: 394695 - DNA, 140 bp, Artificial Sequence
  Synthetic
atacgccatgctgggtctccagcccccccgccgtcatgggacgtgatgtggaaatgtctcaccagacttaagccgaccctcacaggtcctacccccctcctatatcgtctgggggctgtccgtacttgggagtcggccat

SEQ ID NO: 394696 - DNA, 140 bp, Artificial Sequence
  Synthetic
atggccgactcccaagtacggacagcccccagacgatataggaggggggtaggacctgtgagggtcggcttaagtctggtgagacatttccacatcacgtcccatgacggcgggggggctggagacccagcatggcgtat

SEQ ID NO: 394697 - DNA, 140 bp, Artificial Sequence
  Synthetic
atacgccatgctgggtctccgagtccttgccgcattagcagcctactgtttgacagtgggctgtgttgtcatctgtggcaggatcgtgacaagcggcaagcctgcggttgtccctgatcgcgtacttgggagtcggccat

SEQ ID NO: 394698 - DNA, 140 bp, Artificial Sequence
  Synthetic
atggccgactcccaagtacgcgatcagggacaaccgcaggcttgccgcttgtcacgatcctgccacagatgacaacacagcccactgtcaaacagtaggctgctaatgcggcaaggactcggagacccagcatggcgtat

SEQ ID NO: 394699 - DNA, 140 bp, Artificial Sequence
  Synthetic
atacgccatgctgggtctccgtccttgggctgctccaggccggcaccaaacatgcagaagaactgaaacccgctatccattccacgtggcccagggtggaggagttctggaggaaacacacgtacttgggagtcggccat

SEQ ID NO: 394700 - DNA, 140 bp, Artificial Sequence
  Synthetic
atggccgactcccaagtacgtgtgtttcctccagaactcctccaccctgggccacgtggaatggatagcgggtttcagttcttctgcatgtttggtgccggcctggagcagcccaaggacggagacccagcatggcgtat

SEQ ID NO: 394701 - DNA, 140 bp, Artificial Sequence
  Synthetic
aggccctggctgctgatatgcgtggacgtgcaatacctgtacggtatagggtcagcggttgtctccttcgcaatcaaatgggagtatgtcctgttgctcttccttctcctggcggacgcggaccttttgggacagcggtg

SEQ ID NO: 394702 - DNA, 140 bp, Artificial Sequence
  Synthetic
caccgctgtcccaaaaggtccgcgtccgccaggagaaggaagagcaacaggacatactcccatttgattgcgaaggagacaaccgctgaccctataccgtacaggtattgcacgtccacgcatatcagcagccagggcct

SEQ ID NO: 394703 - DNA, 140 bp, Artificial Sequence
  Synthetic
atacgccatgctgggtctcctagtcctctaaggacctcccagaccctgttgctcaacatattgggcggctggatagcttcccaagtagctcccccctccgcgtccacagctttcgtcgtgcgtacttgggagtcggccat

SEQ ID NO: 394704 - DNA, 140 bp, Artificial Sequence
  Synthetic
atggccgactcccaagtacgcacgacgaaagctgtggacgcggaggggggagctacttgggaagctatccagccgcccaatatgttgagcaacagggtctgggaggtccttagaggactaggagacccagcatggcgtat

SEQ ID NO: 394705 - DNA, 140 bp, Artificial Sequence
  Synthetic
atacgccatgctgggtctcccctttaagatcatgagcggcgagtgtccatcaacagaggacatggtgaacttgctacccgccttgctgtcgccgggtgcccttgtggtgggagttgtgtgcgtacttgggagtcggccat

SEQ ID NO: 394706 - DNA, 140 bp, Artificial Sequence
  Synthetic
atggccgactcccaagtacgcacacaactcccaccacaagggcacccggcgacagcaaggcgggtagcaagttcaccatgtcctctgttgatggacactcgccgctcatgatcttaaaggggagacccagcatggcgtat

SEQ ID NO: 394707 - DNA, 140 bp, Artificial Sequence
  Synthetic
aggccctggctgctgatatgaccttgtcaccacactataaagagttcctcgccaagctcatatggtggttacaatattttatcaccagggccgaggcgcatttgcaagtgtgggtcccccgaccttttgggacagcggtg

SEQ ID NO: 394708 - DNA, 140 bp, Artificial Sequence
  Synthetic
caccgctgtcccaaaaggtcgggggacccacacttgcaaatgcgcctcggccctggtgataaaatattgtaaccaccatatgagcttggcgaggaactctttatagtgtggtgacaaggtcatatcagcagccagggcct

SEQ ID NO: 394709 - DNA, 140 bp, Artificial Sequence
  Synthetic
atacgccatgctgggtctccacacactatgtgcccgagacggacgcatcaaacaaagtcacccaaatactcagttcacttaccatcactagcctgttacgcaggctacaccagtggattccgtacttgggagtcggccat

SEQ ID NO: 394710 - DNA, 140 bp, Artificial Sequence
  Synthetic
atggccgactcccaagtacggaatccactggtgtagcctgcgtaacaggctagtgatggtaagtgaactgagtatttgggtgactttgtttgatgcgtccgtctcgggcacatagtgtgtggagacccagcatggcgtat

SEQ ID NO: 394711 - DNA, 140 bp, Artificial Sequence
  Synthetic
atacgccatgctgggtctccaataacgccccgcatacctggaatcccctttatatcttgccaggcagggtataggggagtttgggctggtgacggggtgtgtcacaccacttgctcatgccgtacttgggagtcggccat

SEQ ID NO: 394712 - DNA, 140 bp, Artificial Sequence
  Synthetic
atggccgactcccaagtacggcatgagcaagtggtgtgacacaccccgtcaccagcccaaactcccctataccctgcctggcaagatataaaggggattccaggtatgcggggcgttattggagacccagcatggcgtat

SEQ ID NO: 394713 - DNA, 140 bp, Artificial Sequence
  Synthetic
atacgccatgctgggtctcccaactaccagccctagtgtgccggtaccggcccccaactacaaacgcgctctctggcgagtttccgctgaggagtacgttgaagtagagaggcacggcgacgtacttgggagtcggccat

SEQ ID NO: 394714 - DNA, 140 bp, Artificial Sequence
  Synthetic
atggccgactcccaagtacgtcgccgtgcctctctacttcaacgtactcctcagcggaaactcgccagagagcgcgtttgtagttgggggccggtaccggcacactagggctggtagttgggagacccagcatggcgtat

SEQ ID NO: 394715 - DNA, 140 bp, Artificial Sequence
  Synthetic
aggccctggctgctgatatgtcctgtggaggcaggagatgggcggcaacatcaccagggttgagtcagagaacaaagtggtgattctggactccttcgatccgcttgtggcggaggaggagaccttttgggacagcggtg

SEQ ID NO: 394716 - DNA, 140 bp, Artificial Sequence
  Synthetic
caccgctgtcccaaaaggtctcctcctccgccacaagcggatcgaaggagtccagaatcaccactttgttctctgactcaaccctggtgatgttgccgcccatctcctgcctccacaggacatatcagcagccagggcct

SEQ ID NO: 394717 - DNA, 140 bp, Artificial Sequence
  Synthetic
aggccctggctgctgatatgacggcttactcccaacagacgcggggcctacttggctgcatcatcactagcctcacaggccgggacaagaaccaggttgagggagaggttcaagtggtttgaccttttgggacagcggtg

SEQ ID NO: 394718 - DNA, 140 bp, Artificial Sequence
  Synthetic
caccgctgtcccaaaaggtcaaaccacttgaacctctccctcaacctggttcttgtcccggcctgtgaggctagtgatgatgcagccaagtaggccccgcgtctgttgggagtaagccgtcatatcagcagccagggcct

SEQ ID NO: 394719 - DNA, 140 bp, Artificial Sequence
  Synthetic
atacgccatgctgggtctcccgttatgcgccaccctgcaaacccctgcttagagatgaggtgagcttctctgtgggcctcctagagtttgttgtggggtctcagctcccttgtgagccagcgtacttgggagtcggccat

SEQ ID NO: 394720 - DNA, 140 bp, Artificial Sequence
  Synthetic
atggccgactcccaagtacgctggctcacaagggagctgagaccccacaacaaactctaggaggcccacagagaagctcacctcatctctaagcaggggtttgcagggtggcgcataacgggagacccagcatggcgtat

SEQ ID NO: 394721 - DNA, 140 bp, Artificial Sequence
  Synthetic
atacgccatgctgggtctcccagcggagatcctgcggaaatccaggatgttccctccagcgatgcccatatgggcacgaccggattacaaccccccactgctagagtcttggaaggcccccgtacttgggagtcggccat

SEQ ID NO: 394722 - DNA, 140 bp, Artificial Sequence
  Synthetic
atggccgactcccaagtacgggggccttccaagactctagcagtggggggttgtaatccggtcgtgcccatatgggcatcgctggagggaacatcctggatttccgcaggatctccgctgggagacccagcatggcgtat

SEQ ID NO: 394723 - DNA, 140 bp, Artificial Sequence
  Synthetic
atacgccatgctgggtctccggcgagttcatccgccagccagttgtcagcgccatcacttaaagccacttgcacggcgaacggagaccacccggacgccgagctgatcgaggccaatctccgtacttgggagtcggccat

SEQ ID NO: 394724 - DNA, 140 bp, Artificial Sequence
  Synthetic
atggccgactcccaagtacggagattggcctcgatcagctcggcgtccgggtggtctccgttcgccgtgcaagtggctttaagtgatggcgctgacaactggctggcggatgaactcgccggagacccagcatggcgtat

SEQ ID NO: 394725 - DNA, 140 bp, Artificial Sequence
  Synthetic
atacgccatgctgggtctccacagggagatatcagtgtcagcagagtgccatagaccacctaggcctaagttccctcctgctctcccgatttgggccagacctgactacaatccacctctcgtacttgggagtcggccat

SEQ ID NO: 394726 - DNA, 140 bp, Artificial Sequence
  Synthetic
atggccgactcccaagtacgagaggtggattgtagtcaggtctggcccaaatcgggagagcaggagggaacttaggcctaggtggtctatggcactctgctgacactgatatctccctgtggagacccagcatggcgtat

SEQ ID NO: 394727 - DNA, 140 bp, Artificial Sequence
  Synthetic
atacgccatgctgggtctccaggctcatacagctggacgagtctgctgtatcgcaagctctacaacagctggctgataaggtgtttgtggaggacactagcacctcagagccgagctccgcgtacttgggagtcggccat

SEQ ID NO: 394728 - DNA, 140 bp, Artificial Sequence
  Synthetic
atggccgactcccaagtacgcggagctcggctctgaggtgctagtgtcctccacaaacaccttatcagccagctgttgtagagcttgcgatacagcagactcgtccagctgtatgagcctggagacccagcatggcgtat

SEQ ID NO: 394729 - DNA, 140 bp, Artificial Sequence
  Synthetic
atacgccatgctgggtctccgggggaacctggagacccagacttgagcactggttcctggtccactgttagtgaagaggacgatgtcgtctgttgctctatgtcatacacttggacggggcgtacttgggagtcggccat

SEQ ID NO: 394730 - DNA, 140 bp, Artificial Sequence
  Synthetic
atggccgactcccaagtacgccccgtccaagtgtatgacatagagcaacagacgacatcgtcctcttcactaacagtggaccaggaaccagtgctcaagtctgggtctccaggttcccccggagacccagcatggcgtat

SEQ ID NO: 394731 - DNA, 140 bp, Artificial Sequence
  Synthetic
atacgccatgctgggtctcccacgtagcgccggccttcgccagaagaaagtcacatttgacagactacaggtagttgaccaacactaccaagatgtcctaaaggagattaagctcagagccgtacttgggagtcggccat

SEQ ID NO: 394732 - DNA, 140 bp, Artificial Sequence
  Synthetic
atggccgactcccaagtacggctctgagcttaatctcctttaggacatcttggtagtgttggtcaactacctgtagtctgtcaaatgtgactttcttctggcgaaggccggcgctacgtgggagacccagcatggcgtat

SEQ ID NO: 394733 - DNA, 140 bp, Artificial Sequence
  Synthetic
aggccctggctgctgatatgggagacgtcgttgtcgtggcaacagacgctctgatgacgggctttaccggcgactttgactcagtgatcgactgtaacacatgtgtcacccagacagtcggaccttttgggacagcggtg

SEQ ID NO: 394734 - DNA, 140 bp, Artificial Sequence
  Synthetic
caccgctgtcccaaaaggtccgactgtctgggtgacacatgtgttacagtcgatcactgagtcaaagtcgccggtaaagcccgtcatcagagcgtctgttgccacgacaacgacgtctcccatatcagcagccagggcct

SEQ ID NO: 394735 - DNA, 140 bp, Artificial Sequence
  Synthetic
atacgccatgctgggtctccaggagccatactagcaaggccgttaaacacatcgactccgtgtgggaggacttgctagaagacaatgccaccccaatacctaccactatcatggccaagacgtacttgggagtcggccat

SEQ ID NO: 394736 - DNA, 140 bp, Artificial Sequence
  Synthetic
atggccgactcccaagtacgtcttggccatgatagtggtaggtattggggtggcattgtcttctagcaagtcctcccacacggagtcgatgtgtttaacggccttgctagtatggctcctggagacccagcatggcgtat

SEQ ID NO: 394737 - DNA, 140 bp, Artificial Sequence
  Synthetic
aggccctggctgctgatatggacgcggtgtcgcgctcgcagcggcgaggcaggactggtaggggcaggatgggcatctacaggtttgtaactccaggagaacggccctcgggcatgttcggaccttttgggacagcggtg

SEQ ID NO: 394738 - DNA, 140 bp, Artificial Sequence
  Synthetic
caccgctgtcccaaaaggtccgaacatgcccgagggccgttctcctggagttacaaacctgtagatgcccatcctgcccctaccagtcctgcctcgccgctgcgagcgcgacaccgcgtccatatcagcagccagggcct

SEQ ID NO: 394739 - DNA, 140 bp, Artificial Sequence
  Synthetic
atacgccatgctgggtctccctacgatgtgacgcagaagttgcctaagaccgtgatgggatctgcatacggtttccagtactccccctcccaacgggtagagtacttgctcaaaatgtggcgtacttgggagtcggccat

SEQ ID NO: 394740 - DNA, 140 bp, Artificial Sequence
  Synthetic
atggccgactcccaagtacgccacattttgagcaagtactctacccgttgggagggggagtactggaaaccgtatgcagatcccatcacggtcttaggcaacttctgcgtcacatcgtagggagacccagcatggcgtat

SEQ ID NO: 394741 - DNA, 140 bp, Artificial Sequence
  Synthetic
atacgccatgctgggtctcccttgccaactagaccctaccgcgaggaaagcaatatcatccctcacagaacgcctctattgtggtggcccgatgtttaactccaaaggggaatcatgtggcgtacttgggagtcggccat

SEQ ID NO: 394742 - DNA, 140 bp, Artificial Sequence
  Synthetic
atggccgactcccaagtacgccacatgattcccctttggagttaaacatcgggccaccacaatagaggcgttctgtgagggatgatattgctttcctcgcggtagggtctagttggcaagggagacccagcatggcgtat

SEQ ID NO: 394743 - DNA, 140 bp, Artificial Sequence
  Synthetic
atacgccatgctgggtctccaaaaattttgacatgctggtatgcggagatgatctggtggtcatttgtgagagcgccggcgtacaggaggatgtcgtagcactgagagcgtttacagacgcgtacttgggagtcggccat

SEQ ID NO: 394744 - DNA, 140 bp, Artificial Sequence
  Synthetic
atggccgactcccaagtacgcgtctgtaaacgctctcagtgctacgacatcctcctgtacgccggcgctctcacaaatgaccaccagatcatctccgcataccagcatgtcaaaatttttggagacccagcatggcgtat

SEQ ID NO: 394745 - DNA, 140 bp, Artificial Sequence
  Synthetic
atacgccatgctgggtctcctggcaccggacagagatattactacctcacccgtgactgtaccactccacttgcgcgagctgcttgggagacagctcgccatacccctgtcaattcgtggcgtacttgggagtcggccat

SEQ ID NO: 394746 - DNA, 140 bp, Artificial Sequence
  Synthetic
atggccgactcccaagtacgccacgaattgacaggggtatggcgagctgtctcccaagcagctcgcgcaagtggagtggtacagtcacgggtgaggtagtaatatctctgtccggtgccaggagacccagcatggcgtat

SEQ ID NO: 394747 - DNA, 140 bp, Artificial Sequence
  Synthetic
atacgccatgctgggtctcccacttaattttgacatgtatggggtaacctactccgtcactccactcgatctccctgcaatcattcaacgactccatggtatggcagctttttccctacacgtacttgggagtcggccat

SEQ ID NO: 394748 - DNA, 140 bp, Artificial Sequence
  Synthetic
atggccgactcccaagtacgtgtagggaaaaagctgccataccatggagtcgttgaatgattgcagggagatcgagtggagtgacggagtaggttaccccatacatgtcaaaattaagtgggagacccagcatggcgtat

SEQ ID NO: 394749 - DNA, 140 bp, Artificial Sequence
  Synthetic
atacgccatgctgggtctccttggggcgccacccttaagagcttggagacatcgagccagagctgtcagagccaaactcattgcccaaggtgggaaagcagcgatatgcggcaagtacctcgtacttgggagtcggccat

SEQ ID NO: 394750 - DNA, 140 bp, Artificial Sequence
  Synthetic
atggccgactcccaagtacgaggtacttgccgcatatcgctgctttcccaccttgggcaatgagtttggctctgacagctctggctcgatgtctccaagctcttaagggtggcgccccaaggagacccagcatggcgtat

SEQ ID NO: 394751 - DNA, 140 bp, Artificial Sequence
  Synthetic
aggccctggctgctgatatgcctactcctactcactgtaggggtaggcatctttttactccccgctcggtagacgagcggccctaaacaacactccataacattttttttttttttttttgaccttttgggacagcggtg

SEQ ID NO: 394752 - DNA, 140 bp, Artificial Sequence
  Synthetic
caccgctgtcccaaaaggtcaaaaaaaaaaaaaaaaaatgttatggagtgttgtttagggccgctcgtctaccgagcggggagtaaaaagatgcctacccctacagtgagtaggagtaggcatatcagcagccagggcct

SEQ ID NO: 394753 - DNA, 140 bp, Artificial Sequence
  Synthetic
aggccctggctgctgatatgggccttgcctactattccatggtggggaactgggctaaggtcttgattgtgatgctactctttgccggcgttgacgggaacaccaggacaatgggggggtgaccttttgggacagcggtg

SEQ ID NO: 394754 - DNA, 140 bp, Artificial Sequence
  Synthetic
caccgctgtcccaaaaggtcacccccccattgtcctggtgttcccgtcaacgccggcaaagagtagcatcacaatcaagaccttagcccagttccccaccatggaatagtaggcaaggcccatatcagcagccagggcct

SEQ ID NO: 394755 - DNA, 140 bp, Artificial Sequence
  Synthetic
atacgccatgctgggtctccagtctcctctcactgggcgccagacagaacatccagctgatcaacactaacggcagttggcacattaataggacggccttgaactgcaatgacagcctcccgtacttgggagtcggccat

SEQ ID NO: 394756 - DNA, 140 bp, Artificial Sequence
  Synthetic
atggccgactcccaagtacgggaggctgtcattgcagttcaaggccgtcctattaatgtgccaactgccgttagtgttgatcagctggatgttctgtctggcgcccagtgagaggagactggagacccagcatggcgtat

SEQ ID NO: 394757 - DNA, 140 bp, Artificial Sequence
  Synthetic
atacgccatgctgggtctccgttgctccttttctatcttcctcttggcacttctctcgtgccttaccacgcccgcctcagcggttaattatgccaacaaatctggaatctaccatctgaccgtacttgggagtcggccat

SEQ ID NO: 394758 - DNA, 140 bp, Artificial Sequence
  Synthetic
atggccgactcccaagtacggtcagatggtagattccagatttgttggcataattaaccgctgaggcgggcgtggtaaggcacgagagaagtgccaagaggaagatagaaaaggagcaacggagacccagcatggcgtat

SEQ ID NO: 394759 - DNA, 140 bp, Artificial Sequence
  Synthetic
atacgccatgctgggtctcctgttggttgcccgccacgcccaccatggcggtgccgaatgcgtccgtgccgatccaggggtttcgcaaacacgtagacctcttggttggcgctgccgcttcgtacttgggagtcggccat

SEQ ID NO: 394760 - DNA, 140 bp, Artificial Sequence
  Synthetic
atggccgactcccaagtacgaagcggcagcgccaaccaagaggtctacgtgtttgcgaaacccctggatcggcacggacgcattcggcaccgccatggtgggcgtggcgggcaaccaacaggagacccagcatggcgtat

SEQ ID NO: 394761 - DNA, 140 bp, Artificial Sequence
  Synthetic
atacgccatgctgggtctcccaactgttccatctatgtgggccgcatcactgggcatcggatggcgtgggatatgatgatgaactggtccccgaccaccaccctgctgttatcgtatgctcgtacttgggagtcggccat

SEQ ID NO: 394762 - DNA, 140 bp, Artificial Sequence
  Synthetic
atggccgactcccaagtacgagcatacgataacagcagggtggtggtcggggaccagttcatcatcatatcccacgccatccgatgcccagtgatgcggcccacatagatggaacagttgggagacccagcatggcgtat

SEQ ID NO: 394763 - DNA, 140 bp, Artificial Sequence
  Synthetic
atacgccatgctgggtctcctccttggcatcttgttcctattcgccggcgtagatgctggtacggatgtgggacattctgtcagccacactgtatcgaagcttacaaacttattcagcctcgtacttgggagtcggccat

SEQ ID NO: 394764 - DNA, 140 bp, Artificial Sequence
  Synthetic
atggccgactcccaagtacgaggctgaataagtttgtaagcttcgatacagtgtggctgacagaatgtcccacatccgtaccagcatctacgccggcgaataggaacaagatgccaaggaggagacccagcatggcgtat

SEQ ID NO: 394765 - DNA, 140 bp, Artificial Sequence
  Synthetic
  misc_feature (47)..(47): n is a, c, g, or t
atacgccatgctgggtctccgctggtctgttctacaccaaaaattanaacttttcaggatgccctgaacggctcgccgcatgtaagcctatcacatactttgaccaaggatggggtcccacgtacttgggagtcggccat

SEQ ID NO: 394766 - DNA, 140 bp, Artificial Sequence
  Synthetic
  misc_feature (94)..(94): n is a, c, g, or t
atggccgactcccaagtacgtgggaccccatccttggtcaaagtatgtgataggcttacatgcggcgagccgttcagggcatcctgaaaagttntaatttttggtgtagaacagaccagcggagacccagcatggcgtat

SEQ ID NO: 394767 - DNA, 140 bp, Artificial Sequence
  Synthetic
atacgccatgctgggtctccgccagtttactgcttcacgccgagccctgtggttgtaggcactacggacagacggggggcgcccacctacacgttcggtgagaacgagactgacgtcctccgtacttgggagtcggccat

SEQ ID NO: 394768 - DNA, 140 bp, Artificial Sequence
  Synthetic
atggccgactcccaagtacggaggacgtcagtctcgttctcaccgaacgtgtaggtgggcgccccccgtctgtccgtagtgcctacaaccacagggctcggcgtgaagcagtaaactggcggagacccagcatggcgtat

SEQ ID NO: 394769 - DNA, 140 bp, Artificial Sequence
  Synthetic
aggccctggctgctgatatggaccctagccggcccgaaaggcccaatcgcccaaatgtacaccaatgtggaccaggacctcgtcggctggcaagcgccccccggggcgcgttccctgacagaccttttgggacagcggtg

SEQ ID NO: 394770 - DNA, 140 bp, Artificial Sequence
  Synthetic
caccgctgtcccaaaaggtctgtcagggaacgcgccccggggggcgcttgccagccgacgaggtcctggtccacattggtgtacatttgggcgattgggcctttcgggccggctagggtccatatcagcagccagggcct

SEQ ID NO: 394771 - DNA, 140 bp, Artificial Sequence
  Synthetic
atacgccatgctgggtctcctcggacctgagtccaacaagtcgctaatctgtcccactgattgcttccggaaacatccggaggccacctatgggaagtgcggctctggcccctggatcaccgtacttgggagtcggccat

SEQ ID NO: 394772 - DNA, 140 bp, Artificial Sequence
  Synthetic
atggccgactcccaagtacggtgatccaggggccagagccgcacttcccataggtggcctccggatgtttccggaagcaatcagtgggacagattagcgacttgttggactcaggtccgaggagacccagcatggcgtat

SEQ ID NO: 394773 - DNA, 140 bp, Artificial Sequence
  Synthetic
aggccctggctgctgatatgctgcggcagctcggacctttacttggtcacgaggcatgctgatgtcattccggtgcgccggcggggcgacagcagggggagcctactctcccccaggcccgaccttttgggacagcggtg

SEQ ID NO: 394774 - DNA, 140 bp, Artificial Sequence
  Synthetic
caccgctgtcccaaaaggtcgggcctgggggagagtaggctccccctgctgtcgccccgccggcgcaccggaatgacatcagcatgcctcgtgaccaagtaaaggtccgagctgccgcagcatatcagcagccagggcct

SEQ ID NO: 394775 - DNA, 140 bp, Artificial Sequence
  Synthetic
atacgccatgctgggtctcccatcgatttgaagcagcttgcaattggacccgtggtgagcgctgtgagctagaggatagggaccgtattgagatgagtcctctcctgttttcaacaactgcgtacttgggagtcggccat

SEQ ID NO: 394776 - DNA, 140 bp, Artificial Sequence
  Synthetic
atggccgactcccaagtacgcagttgttgaaaacaggagaggactcatctcaatacggtccctatcctctagctcacagcgctcaccacgggtccaattgcaagctgcttcaaatcgatgggagacccagcatggcgtat

SEQ ID NO: 394777 - DNA, 140 bp, Artificial Sequence
  Synthetic
atacgccatgctgggtctcccatttcgcctgcgctggtgtcctgggccatcaagtgggagtatgtggtccttgcatttctagtgctagcagacgcgcgcatctgtgcgtgcttgtggcttcgtacttgggagtcggccat

SEQ ID NO: 394778 - DNA, 140 bp, Artificial Sequence
  Synthetic
atggccgactcccaagtacgaagccacaagcacgcacagatgcgcgcgtctgctagcactagaaatgcaaggaccacatactcccacttgatggcccaggacaccagcgcaggcgaaatgggagacccagcatggcgtat

SEQ ID NO: 394779 - DNA, 140 bp, Artificial Sequence
  Synthetic
atacgccatgctgggtctcctcgtcctctttgcctggtacatcaaggggcgtgttgttcctgcctttacgtatggcctgctacaactatggcctctcctgctactggttttggccctgcccgtacttgggagtcggccat

SEQ ID NO: 394780 - DNA, 140 bp, Artificial Sequence
  Synthetic
atggccgactcccaagtacgggcagggccaaaaccagtagcaggagaggccatagttgtagcaggccatacgtaaaggcaggaacaacacgccccttgatgtaccaggcaaagaggacgaggagacccagcatggcgtat

SEQ ID NO: 394781 - DNA, 140 bp, Artificial Sequence
  Synthetic
atacgccatgctgggtctccctgcttgtccagctgctatggtggtcccagtacttcctagcacgagcagaggccatgctgcaagtgtggattcccagtttccatgttcgggggggtcgagcgtacttgggagtcggccat

SEQ ID NO: 394782 - DNA, 140 bp, Artificial Sequence
  Synthetic
atggccgactcccaagtacgctcgacccccccgaacatggaaactgggaatccacacttgcagcatggcctctgctcgtgctaggaagtactgggaccaccatagcagctggacaagcagggagacccagcatggcgtat

SEQ ID NO: 394783 - DNA, 140 bp, Artificial Sequence
  Synthetic
atacgccatgctgggtctcccagcctgctgtgtgtgccatactatgtgcgtgcgcacgcgttgctgcggatgtgcatgctcgcgcgccgcgtagcgtgtggcaagtatgttcaggcctgccgtacttgggagtcggccat

SEQ ID NO: 394784 - DNA, 140 bp, Artificial Sequence
  Synthetic
atggccgactcccaagtacggcaggcctgaacatacttgccacacgctacgcggcgcgcgagcatgcacatccgcagcaacgcgtgcgcacgcacatagtatggcacacacagcaggctgggagacccagcatggcgtat

SEQ ID NO: 394785 - DNA, 140 bp, Artificial Sequence
  Synthetic
aggccctggctgctgatatgcccgctcctcaaggtgctcgctcattgacaccctgcacctgcggctcctcggacctttacctggtcacgaggcacgccgatgtcattcccgtgcgccggcgaccttttgggacagcggtg

SEQ ID NO: 394786 - DNA, 140 bp, Artificial Sequence
  Synthetic
caccgctgtcccaaaaggtcgccggcgcacgggaatgacatcggcgtgcctcgtgaccaggtaaaggtccgaggagccgcaggtgcagggtgtcaatgagcgagcaccttgaggagcgggcatatcagcagccagggcct

SEQ ID NO: 394787 - DNA, 140 bp, Artificial Sequence
  Synthetic
atacgccatgctgggtctccttgagccggtcgtcttctcccccatggagaagaagatcataacctggggagcagacaccgccgcgtgcggtgacatcttggctggccttccggtgtcagccgtacttgggagtcggccat

SEQ ID NO: 394788 - DNA, 140 bp, Artificial Sequence
  Synthetic
atggccgactcccaagtacggctgacaccggaaggccagccaagatgtcaccgcacgcggcggtgtctgctccccaggttatgatcttcttctccatgggggagaagacgaccggctcaaggagacccagcatggcgtat

SEQ ID NO: 394789 - DNA, 140 bp, Artificial Sequence
  Synthetic
atacgccatgctgggtctccggattggtgggaacgattgtcaccagtctcaccggccgcgataaaaacgaagttgaaggcgagatacaggtggtttccaccgccacccagtctttcctggcgtacttgggagtcggccat

SEQ ID NO: 394790 - DNA, 140 bp, Artificial Sequence
  Synthetic
atggccgactcccaagtacgccaggaaagactgggtggcggtggaaaccacctgtatctcgccttcaacttcgtttttatcgcggccggtgagactggtgacaatcgttcccaccaatccggagacccagcatggcgtat

SEQ ID NO: 394791 - DNA, 140 bp, Artificial Sequence
  Synthetic
atacgccatgctgggtctccggatcaggacttggtaggctggccagcacctcctggcgcgaggtcattgacaccatgcacctgtggcgcaagcgacctctacctggtaacccggaatgcccgtacttgggagtcggccat

SEQ ID NO: 394792 - DNA, 140 bp, Artificial Sequence
  Synthetic
atggccgactcccaagtacgggcattccgggttaccaggtagaggtcgcttgcgccacaggtgcatggtgtcaatgacctcgcgccaggaggtgctggccagcctaccaagtcctgatccggagacccagcatggcgtat

SEQ ID NO: 394793 - DNA, 140 bp, Artificial Sequence
  Synthetic
aggccctggctgctgatatgttctgctccgctatgtacgtgggggatctctgcggatctgttttccttgtctctcagctgttcaccttctcgcctcgtcggcatgagacagtacaggactgaccttttgggacagcggtg

SEQ ID NO: 394794 - DNA, 140 bp, Artificial Sequence
  Synthetic
caccgctgtcccaaaaggtcagtcctgtactgtctcatgccgacgaggcgagaaggtgaacagctgagagacaaggaaaacagatccgcagagatcccccacgtacatagcggagcagaacatatcagcagccagggcct

SEQ ID NO: 394795 - DNA, 140 bp, Artificial Sequence
  Synthetic
atacgccatgctgggtctccgtccgtcaggccatgtggttgggctcttccgtgccgccgtctgcacacggggcgtagccaaagctttggattttgtgcccgtggagaatatggaaaccaccgtacttgggagtcggccat

SEQ ID NO: 394796 - DNA, 140 bp, Artificial Sequence
  Synthetic
atggccgactcccaagtacggtggtttccatattctccacgggcacaaaatccaaagctttggctacgccccgtgtgcagacggcggcacggaagagcccaaccacatggcctgacggacggagacccagcatggcgtat

SEQ ID NO: 394797 - DNA, 140 bp, Artificial Sequence
  Synthetic
  misc_feature (107)..(107): n is a, c, g, or t
atacgccatgctgggtctccacgaaggtgccggcagcctatgcctctcagggctataaggtattggtgcttaatccatcagtggctgctacattaagttttggggcntacatgagcaaagcgtacttgggagtcggccat

SEQ ID NO: 394798 - DNA, 140 bp, Artificial Sequence
  Synthetic
  misc_feature (34)..(34): n is a, c, g, or t
atggccgactcccaagtacgctttgctcatgtangccccaaaacttaatgtagcagccactgatggattaagcaccaataccttatagccctgagaggcataggctgccggcaccttcgtggagacccagcatggcgtat

SEQ ID NO: 394799 - DNA, 140 bp, Artificial Sequence
  Synthetic
atacgccatgctgggtctccgtgctcgggtggcgcgtatgacatcatcatctgtgacgagtgccattccacagaccccacgacggtcttggggatcggcaccgtcctagaccaagcagaacgtacttgggagtcggccat

SEQ ID NO: 394800 - DNA, 140 bp, Artificial Sequence
  Synthetic
atggccgactcccaagtacgttctgcttggtctaggacggtgccgatccccaagaccgtcgtggggtctgtggaatggcactcgtcacagatgatgatgtcatacgcgccacccgagcacggagacccagcatggcgtat

SEQ ID NO: 394801 - DNA, 140 bp, Artificial Sequence
  Synthetic
atacgccatgctgggtctccgggaggttcctttctacgggaaggctattcccctggaatacatccgtggcggtaggcacctcattttctgtcactcaaagaagaaatgcgatgagctggccgtacttgggagtcggccat

SEQ ID NO: 394802 - DNA, 140 bp, Artificial Sequence
  Synthetic
atggccgactcccaagtacggccagctcatcgcatttcttctttgagtgacagaaaatgaggtgcctaccgccacggatgtattccaggggaatagccttcccgtagaaaggaacctcccggagacccagcatggcgtat

SEQ ID NO: 394803 - DNA, 140 bp, Artificial Sequence
  Synthetic
aggccctggctgctgatatgactgtaatgcgagcctcgacactggctggttagcggggctcttttattacaacagcttcaactcttcaggctgccccgagaggatggctagctgcaagccgaccttttgggacagcggtg

SEQ ID NO: 394804 - DNA, 140 bp, Artificial Sequence
  Synthetic
caccgctgtcccaaaaggtcggcttgcagctagccatcctctcggggcagcctgaagagttgaagctgttgtaataaaagagccccgctaaccagccagtgtcgaggctcgcattacagtcatatcagcagccagggcct

SEQ ID NO: 394805 - DNA, 140 bp, Artificial Sequence
  Synthetic
atacgccatgctgggtctccgacgccctcatgaccgggtacactggcgacttcgactctgtaattgactgcaatgttgcggtcactcagatagtcgacttcagcctagaccctacctttgcgtacttgggagtcggccat

SEQ ID NO: 394806 - DNA, 140 bp, Artificial Sequence
  Synthetic
atggccgactcccaagtacgcaaaggtagggtctaggctgaagtcgactatctgagtgaccgcaacattgcagtcaattacagagtcgaagtcgccagtgtacccggtcatgagggcgtcggagacccagcatggcgtat

SEQ ID NO: 394807 - DNA, 140 bp, Artificial Sequence
  Synthetic
atacgccatgctgggtctccggcatcgtgccggcacggaacgtatgtggcccagtgtattgtttcacccccagtcccgtggtggtggggacgaccgacaggttgggcgttcctacctacacgtacttgggagtcggccat

SEQ ID NO: 394808 - DNA, 140 bp, Artificial Sequence
  Synthetic
atggccgactcccaagtacgtgtaggtaggaacgcccaacctgtcggtcgtccccaccaccacgggactgggggtgaaacaatacactgggccacatacgttccgtgccggcacgatgccggagacccagcatggcgtat

SEQ ID NO: 394809 - DNA, 140 bp, Artificial Sequence
  Synthetic
aggccctggctgctgatatgcagtcccgtggtggtggggacgaccgacaggttgggcgttcctacctacaactggggtaggaatgatacggacttcctcgtccttaataacaccaggccagaccttttgggacagcggtg

SEQ ID NO: 394810 - DNA, 140 bp, Artificial Sequence
  Synthetic
caccgctgtcccaaaaggtctggcctggtgttattaaggacgaggaagtccgtatcattcctaccccagttgtaggtaggaacgcccaacctgtcggtcgtccccaccaccacgggactgcatatcagcagccagggcct

SEQ ID NO: 394811 - DNA, 140 bp, Artificial Sequence
  Synthetic
atacgccatgctgggtctccgggcgaacggccgtctggcatgtttgacactgttgtgctctgcgaggcatatgacgtggggtgtgcatggtatgagttgacaccacctgagactaccgtccgtacttgggagtcggccat

SEQ ID NO: 394812 - DNA, 140 bp, Artificial Sequence
  Synthetic
atggccgactcccaagtacggacggtagtctcaggtggtgtcaactcataccatgcacaccccacgtcatatgcctcgcagagcacaacagtgtcaaacatgccagacggccgttcgcccggagacccagcatggcgtat

SEQ ID NO: 394813 - DNA, 140 bp, Artificial Sequence
  Synthetic
  misc_feature (67)..(67): n is a, c, g, or t
atacgccatgctgggtctccacttcctgtcacaaaccaaacaggggggagaaaacttcgcatacctngtggcttatcaagccacagtttgtgcgcgggcgaaagccccccccccctcatgcgtacttgggagtcggccat

SEQ ID NO: 394814 - DNA, 140 bp, Artificial Sequence
  Synthetic
  misc_feature (74)..(74): n is a, c, g, or t
atggccgactcccaagtacgcatgagggggggggggctttcgcccgcgcacaaactgtggcttgataagccacnaggtatgcgaagttttctcccccctgtttggtttgtgacaggaagtggagacccagcatggcgtat

SEQ ID NO: 394815 - DNA, 140 bp, Artificial Sequence
  Synthetic
  misc_feature (74)..(74): n is a, c, g, or t
  misc_feature (86)..(86): n is a, c, g, or t
  misc_feature (117)..(117): n is a, c, g, or t
atacgccatgctgggtctccacgcatccaatcactaaatacatcatgacctgcatgtcggctgatttagaagtnatcaccagtacntgggtgcttgccggagggatcctagcggccntggcgtacttgggagtcggccat

SEQ ID NO: 394816 - DNA, 140 bp, Artificial Sequence
  Synthetic
  misc_feature (24)..(24): n is a, c, g, or t
  misc_feature (55)..(55): n is a, c, g, or t
  misc_feature (67)..(67): n is a, c, g, or t
atggccgactcccaagtacgccanggccgctaggatccctccggcaagcacccangtactggtgatnacttctaaatcagccgacatgcaggtcatgatgtatttagtgattggatgcgtggagacccagcatggcgtat

SEQ ID NO: 394817 - DNA, 140 bp, Artificial Sequence
  Synthetic
atacgccatgctgggtctccgtacgatgagatggaggagtgctcccagcgcattccttatcttgccgaaggccaacaaattgccgagcagttcaagcagaagattttgggtcttctgcagcgtacttgggagtcggccat

SEQ ID NO: 394818 - DNA, 140 bp, Artificial Sequence
  Synthetic
atggccgactcccaagtacgctgcagaagacccaaaatcttctgcttgaactgctcggcaatttgttggccttcggcaagataaggaatgcgctgggagcactcctccatctcatcgtacggagacccagcatggcgtat

SEQ ID NO: 394819 - DNA, 140 bp, Artificial Sequence
  Synthetic
atacgccatgctgggtctccgcatacagtacctcgctggcctatccacattaccgggcaatccggctgtagcatcattgatgtctttctctgcagccttgaccagcccgctacccacttccgtacttgggagtcggccat

SEQ ID NO: 394820 - DNA, 140 bp, Artificial Sequence
  Synthetic
atggccgactcccaagtacggaagtgggtagcgggctggtcaaggctgcagagaaagacatcaatgatgctacagccggattgcccggtaatgtggataggccagcgaggtactgtatgcggagacccagcatggcgtat

SEQ ID NO: 394821 - DNA, 140 bp, Artificial Sequence
  Synthetic
aggccctggctgctgatatgtggcttcagtatttcctgaccagagtagaagcgcaactgcacgtgtgggttccccccctcaacgtccgaggggggcgcgatgctgtcatcctactcatgtgaccttttgggacagcggtg

SEQ ID NO: 394822 - DNA, 140 bp, Artificial Sequence
  Synthetic
caccgctgtcccaaaaggtcacatgagtaggatgacagcatcgcgcccccctcggacgttgagggggggaacccacacgtgcagttgcgcttctactctggtcaggaaatactgaagccacatatcagcagccagggcct

SEQ ID NO: 394823 - DNA, 140 bp, Artificial Sequence
  Synthetic
atacgccatgctgggtctccgctgtgggtagtattgggttgggcagggtcattgtggacatccttgccgggtacggagcaggcgtgtctggagctctcgtggcttttaaaatcatgagcgcgtacttgggagtcggccat

SEQ ID NO: 394824 - DNA, 140 bp, Artificial Sequence
  Synthetic
atggccgactcccaagtacgcgctcatgattttaaaagccacgagagctccagacacgcctgctccgtacccggcaaggatgtccacaatgaccctgcccaacccaatactacccacagcggagacccagcatggcgtat

SEQ ID NO: 394825 - DNA, 140 bp, Artificial Sequence
  Synthetic
atacgccatgctgggtctccccatgttggcccaacggaaggcgctgcccagtggatgaataggctcatagcgtttgcctcacgtggcaatcacgtgtcacctacacactacgtgcctgaacgtacttgggagtcggccat

SEQ ID NO: 394826 - DNA, 140 bp, Artificial Sequence
  Synthetic
atggccgactcccaagtacgttcaggcacgtagtgtgtaggtgacacgtgattgccacgtgaggcaaacgctatgagcctattcatccactgggcagcgccttccgttgggccaacatggggagacccagcatggcgtat

SEQ ID NO: 394827 - DNA, 140 bp, Artificial Sequence
  Synthetic
atacgccatgctgggtctcccatgtaacaccacatggttgagggaggtttgggactgggtttgcacggtgttgtctgatttcaaggtgtggctgaagtcaaaacttgtacctgctctgcccgtacttgggagtcggccat

SEQ ID NO: 394828 - DNA, 140 bp, Artificial Sequence
  Synthetic
atggccgactcccaagtacgggcagagcaggtacaagttttgacttcagccacaccttgaaatcagacaacaccgtgcaaacccagtcccaaacctccctcaaccatgtggtgttacatgggagacccagcatggcgtat

SEQ ID NO: 394829 - DNA, 140 bp, Artificial Sequence
  Synthetic
atacgccatgctgggtctcccacgtgaaaaatgggaccatgaaaatcgtcgggcccaagacatgcagtaacgtctggcgtggcacgttccctatcaatcctaccacgactggccccagcgcgtacttgggagtcggccat

SEQ ID NO: 394830 - DNA, 140 bp, Artificial Sequence
  Synthetic
atggccgactcccaagtacgcgctggggccagtcgtggtaggattgatagggaacgtgccacgccagacgttactgcatgtcttgggcccgacgattttcatggtcccatttttcacgtgggagacccagcatggcgtat

SEQ ID NO: 394831 - DNA, 140 bp, Artificial Sequence
  Synthetic
aggccctggctgctgatatgcgtgtgctgctcaatgtcttattcctggacaggcgcacttgtcaccccgtgcgccgcggaagaacaaaaactgcccatcaacgcactgagcaactcgttggaccttttgggacagcggtg

SEQ ID NO: 394832 - DNA, 140 bp, Artificial Sequence
  Synthetic
caccgctgtcccaaaaggtccaacgagttgctcagtgcgttgatgggcagtttttgttcttccgcggcgcacggggtgacaagtgcgcctgtccaggaataagacattgagcagcacacgcatatcagcagccagggcct

SEQ ID NO: 394833 - DNA, 140 bp, Artificial Sequence
  Synthetic
  misc_feature (94)..(94): n is a, c, g, or t
  misc_feature (105)..(105): n is a, c, g, or t
atacgccatgctgggtctcccgccacagccgacaatcttaagtgcccctgccaggtcccagcacccgagtttttcactgaggtagacggtgtcnggctacacagntacgcgccgccatgccgtacttgggagtcggccat

SEQ ID NO: 394834 - DNA, 140 bp, Artificial Sequence
  Synthetic
  misc_feature (36)..(36): n is a, c, g, or t
  misc_feature (47)..(47): n is a, c, g, or t
atggccgactcccaagtacggcatggcggcgcgtanctgtgtagccngacaccgtctacctcagtgaaaaactcgggtgctgggacctggcaggggcacttaagattgtcggctgtggcgggagacccagcatggcgtat

SEQ ID NO: 394835 - DNA, 140 bp, Artificial Sequence
  Synthetic
  misc_feature (34)..(34): n is a, c, g, or t
atacgccatgctgggtctcctggcgtccatgctnactgacccaagccatataactgctgagacagcgggtcgacgcctcgcacgaggatccccgccatccttagctagctcttctgcaagcgtacttgggagtcggccat

SEQ ID NO: 394836 - DNA, 140 bp, Artificial Sequence
  Synthetic
  misc_feature (107)..(107): n is a, c, g, or t
atggccgactcccaagtacgcttgcagaagagctagctaaggatggcggggatcctcgtgcgaggcgtcgacccgctgtctcagcagttatatggcttgggtcagtnagcatggacgccaggagacccagcatggcgtat

SEQ ID NO: 394837 - DNA, 140 bp, Artificial Sequence
  Synthetic
atacgccatgctgggtctccggcggcaacatcacgcgagttgagtctgagaacaaagtcatagtgctcgactccttcgatcctctagtcgctgaaacagatgacagagagatatccgtggcgtacttgggagtcggccat

SEQ ID NO: 394838 - DNA, 140 bp, Artificial Sequence
  Synthetic
atggccgactcccaagtacgccacggatatctctctgtcatctgtttcagcgactagaggatcgaaggagtcgagcactatgactttgttctcagactcaactcgcgtgatgttgccgccggagacccagcatggcgtat

SEQ ID NO: 394839 - DNA, 140 bp, Artificial Sequence
  Synthetic
atacgccatgctgggtctccgcccgattacgaaccccctgtagtgcatgggtgcgctttgccttctaagggactaccacctatcccgcctcctaggaggaagaaggttgtcaaacttgaccgtacttgggagtcggccat

SEQ ID NO: 394840 - DNA, 140 bp, Artificial Sequence
  Synthetic
atggccgactcccaagtacggtcaagtttgacaaccttcttcctcctaggaggcgggataggtggtagtcccttagaaggcaaagcgcacccatgcactacagggggttcgtaatcgggcggagacccagcatggcgtat

SEQ ID NO: 394841 - DNA, 140 bp, Artificial Sequence
  Synthetic
atacgccatgctgggtctcctgggctccaatatgacgtcctctcttgagggggctgatggggtttcagatgacggttcatacgattcgatgccgccccttgagggtgagcctggtgaccccgtacttgggagtcggccat

SEQ ID NO: 394842 - DNA, 140 bp, Artificial Sequence
  Synthetic
atggccgactcccaagtacggggtcaccaggctcaccctcaaggggcggcatcgaatcgtatgaaccgtcatctgaaaccccatcagccccctcaagagaggacgtcatattggagcccaggagacccagcatggcgtat

SEQ ID NO: 394843 - DNA, 140 bp, Artificial Sequence
  Synthetic
atacgccatgctgggtctcctgtgctgctgaggaggagaagctgccaattagcccattgagcaactccctcattcggcaccacaacatggtgtatagcactacatcacgtagtgcctccccgtacttgggagtcggccat

SEQ ID NO: 394844 - DNA, 140 bp, Artificial Sequence
  Synthetic
atggccgactcccaagtacggggaggcactacgtgatgtagtgctatacaccatgttgtggtgccgaatgagggagttgctcaatgggctaattggcagcttctcctcctcagcagcacaggagacccagcatggcgtat

SEQ ID NO: 394845 - DNA, 140 bp, Artificial Sequence
  Synthetic
atacgccatgctgggtctcctaacctactaaccgtagaggaagcatgctcattaacccctcctcactcagcccgatccaagttcgggtatggtgctaaggaggttcgagcccatgccagccgtacttgggagtcggccat

SEQ ID NO: 394846 - DNA, 140 bp, Artificial Sequence
  Synthetic
atggccgactcccaagtacggctggcatgggctcgaacctccttagcaccatacccgaacttggatcgggctgagtgaggaggggttaatgagcatgcttcctctacggttagtaggttaggagacccagcatggcgtat

SEQ ID NO: 394847 - DNA, 140 bp, Artificial Sequence
  Synthetic
aggccctggctgctgatatgggccccacggacccccggcgtaggtcgcgcaatttgggtaaggtcatcgataccctcacgtgcggcttcgccgacctcatggggtacattccgctcgtcggaccttttgggacagcggtg

SEQ ID NO: 394848 - DNA, 140 bp, Artificial Sequence
  Synthetic
caccgctgtcccaaaaggtccgacgagcggaatgtaccccatgaggtcggcgaagccgcacgtgagggtatcgatgaccttacccaaattgcgcgacctacgccgggggtccgtggggcccatatcagcagccagggcct

SEQ ID NO: 394849 - DNA, 140 bp, Artificial Sequence
  Synthetic
atacgccatgctgggtctcctagaccctcagaaggggggccggaagccagcccggctcatcgtgtaccctgacctatcggtaagggtgtgcgagaagatggccctgtatgacattacacacgtacttgggagtcggccat

SEQ ID NO: 394850 - DNA, 140 bp, Artificial Sequence
  Synthetic
atggccgactcccaagtacgtgtgtaatgtcatacagggccatcttctcgcacacccttaccgataggtcagggtacacgatgagccgggctggcttccggccccccttctgagggtctaggagacccagcatggcgtat

SEQ ID NO: 394851 - DNA, 140 bp, Artificial Sequence
  Synthetic
atacgccatgctgggtctccccaatggggttctcctatgacaccagatgcttcgactccacagtcacggagcgtgacattcacaccgaggaggacatctaccagtgttgccagttgaatccgtacttgggagtcggccat

SEQ ID NO: 394852 - DNA, 140 bp, Artificial Sequence
  Synthetic
atggccgactcccaagtacggattcaactggcaacactggtagatgtcctcctcggtgtgaatgtcacgctccgtgactgtggagtcgaagcatctggtgtcataggagaaccccattggggagacccagcatggcgtat

SEQ ID NO: 394853 - DNA, 140 bp, Artificial Sequence
  Synthetic
  misc_feature (21)..(21): n is a, c, g, or t
  misc_feature (106)..(106): n is a, c, g, or t
atacgccatgctgggtctccngccagtggtgtccttactaccagtctggggaacaccctgacatgctacctgaaggcacaagcagcttgcagagcagcagggctcnaaaaatttgacatgcgtacttgggagtcggccat

SEQ ID NO: 394854 - DNA, 140 bp, Artificial Sequence
  Synthetic
  misc_feature (35)..(35): n is a, c, g, or t
  misc_feature (120)..(120): n is a, c, g, or t
atggccgactcccaagtacgcatgtcaaatttttngagccctgctgctctgcaagctgcttgtgccttcaggtagcatgtcagggtgttccccagactggtagtaaggacaccactggcnggagacccagcatggcgtat

SEQ ID NO: 394855 - DNA, 140 bp, Artificial Sequence
  Synthetic
atacgccatgctgggtctcccagccccacccggagacgaaccgcacccggagtacgacctcgagctgataacatcctgctcttccaacgtttccgtggcccacgacaacaatggacagagcgtacttgggagtcggccat

SEQ ID NO: 394856 - DNA, 140 bp, Artificial Sequence
  Synthetic
atggccgactcccaagtacgctctgtccattgttgtcgtgggccacggaaacgttggaagagcaggatgttatcagctcgaggtcgtactccgggtgcggttcgtctccgggtggggctgggagacccagcatggcgtat

SEQ ID NO: 394857 - DNA, 140 bp, Artificial Sequence
  Synthetic
atacgccatgctgggtctccgatgctactcttcgccggcgtcgacgggaacacccacacgacgggggggcagtcagccaagctcaccagaggctttgtgtctcttttcacccccggcccgcgtacttgggagtcggccat

SEQ ID NO: 394858 - DNA, 140 bp, Artificial Sequence
  Synthetic
atggccgactcccaagtacgcgggccgggggtgaaaagagacacaaagcctctggtgagcttggctgactgcccccccgtcgtgtgggtgttcccgtcgacgccggcgaagagtagcatcggagacccagcatggcgtat

SEQ ID NO: 394859 - DNA, 140 bp, Artificial Sequence
  Synthetic
atacgccatgctgggtctccatgtatgcgcctacaatatgggtgcgtatggtgctgatgacccatttctttggaatactccagtcccaagagacactccataaagtacttgacttcgacacgtacttgggagtcggccat

SEQ ID NO: 394860 - DNA, 140 bp, Artificial Sequence
  Synthetic
atggccgactcccaagtacgtgtcgaagtcaagtactttatggagtgtctcttgggactggagtattccaaagaaatgggtcatcagcaccatacgcacccatattgtaggcgcatacatggagacccagcatggcgtat

SEQ ID NO: 394861 - DNA, 140 bp, Artificial Sequence
  Synthetic
atacgccatgctgggtctccagaactcaatagagtggctgccagcctcaggaagcttggggcaccacctttgagagcctggagacatcgggccagggcggtcagagctaagctcattgctcgtacttgggagtcggccat

SEQ ID NO: 394862 - DNA, 140 bp, Artificial Sequence
  Synthetic
atggccgactcccaagtacgagcaatgagcttagctctgaccgccctggcccgatgtctccaggctctcaaaggtggtgccccaagcttcctgaggctggcagccactctattgagttctggagacccagcatggcgtat

SEQ ID NO: 394863 - DNA, 140 bp, Artificial Sequence
  Synthetic
atacgccatgctgggtctccaagtggatcaatgatgactgctccaccccgtgtgccggttcctggttgagagacatttgggactggatatgcgaggtgttgagcgatttcaaaacctggacgtacttgggagtcggccat

SEQ ID NO: 394864 - DNA, 140 bp, Artificial Sequence
  Synthetic
atggccgactcccaagtacgtccaggttttgaaatcgctcaacacctcgcatatccagtcccaaatgtctctcaaccaggaaccggcacacggggtggagcagtcatcattgatccacttggagacccagcatggcgtat

SEQ ID NO: 394865 - DNA, 140 bp, Artificial Sequence
  Synthetic
atacgccatgctgggtctcctatccggatggttcgttgcgggcggaagcgggggggacatatttcacagcgtgtcccgggcccgaccccgcgtattactcctgtgcctactcctacttaccgtacttgggagtcggccat

SEQ ID NO: 394866 - DNA, 140 bp, Artificial Sequence
  Synthetic
atggccgactcccaagtacggtaagtaggagtaggcacaggagtaatacgcggggtcgggcccgggacacgctgtgaaatatgtcccccccgcttccgcccgcaacgaaccatccggataggagacccagcatggcgtat

SEQ ID NO: 394867 - DNA, 140 bp, Artificial Sequence
  Synthetic
atacgccatgctgggtctccggtaggagtaggcatctttttacttcccgctcgatagacggggagcataaagctacactccattaggcttttttttttttttccgtttttttttttttttcgtacttgggagtcggccat

SEQ ID NO: 394868 - DNA, 140 bp, Artificial Sequence
  Synthetic
atggccgactcccaagtacgaaaaaaaaaaaaaaacggaaaaaaaaaaaaaagcctaatggagtgtagctttatgctccccgtctatcgagcgggaagtaaaaagatgcctactcctaccggagacccagcatggcgtat

SEQ ID NO: 394869 - DNA, 140 bp, Artificial Sequence
  Synthetic
aggccctggctgctgatatgcgcgcaggggcccccggttgggtgtgcgcgcgacgaggaagacttctgaacggtcccagcccagaggtaggcgccagcccataccaaaggcgcgccgccagaccttttgggacagcggtg

SEQ ID NO: 394870 - DNA, 140 bp, Artificial Sequence
  Synthetic
caccgctgtcccaaaaggtctggcggcgcgcctttggtatgggctggcgcctacctctgggctgggaccgttcagaagtcttcctcgtcgcgcgcacacccaaccgggggcccctgcgcgcatatcagcagccagggcct

SEQ ID NO: 394871 - DNA, 140 bp, Artificial Sequence
  Synthetic
aggccctggctgctgatatgttgcgagccagaaccggatgtggccgtgttgacgtccatgctcactgaaccctctcacataacggcggaggcggctaggaggaggttagcaaggggatcagaccttttgggacagcggtg

SEQ ID NO: 394872 - DNA, 140 bp, Artificial Sequence
  Synthetic
caccgctgtcccaaaaggtctgatccccttgctaacctcctcctagccgcctccgccgttatgtgagagggttcagtgagcatggacgtcaacacggccacatccggttctggctcgcaacatatcagcagccagggcct

SEQ ID NO: 394873 - DNA, 140 bp, Artificial Sequence
  Synthetic
atacgccatgctgggtctccttgctccttttctatcttcctcttggcattgttgtcctgccttactacgcctgcctcagcagtgcactatgccaacaaatctggtatctaccatctgacccgtacttgggagtcggccat

SEQ ID NO: 394874 - DNA, 140 bp, Artificial Sequence
  Synthetic
atggccgactcccaagtacgggtcagatggtagataccagatttgttggcatagtgcactgctgaggcaggcgtagtaaggcaggacaacaatgccaagaggaagatagaaaaggagcaaggagacccagcatggcgtat

SEQ ID NO: 394875 - DNA, 140 bp, Artificial Sequence
  Synthetic
aggccctggctgctgatatgggctcatatggtggttgcaatactttatcaccagggctgaggcgcaattgcaagtgtggatcccccccctcaacgttcgggggggccgcgatgccatcatgaccttttgggacagcggtg

SEQ ID NO: 394876 - DNA, 140 bp, Artificial Sequence
  Synthetic
caccgctgtcccaaaaggtcatgatggcatcgcggcccccccgaacgttgaggggggggatccacacttgcaattgcgcctcagccctggtgataaagtattgcaaccaccatatgagcccatatcagcagccagggcct

SEQ ID NO: 394877 - DNA, 140 bp, Artificial Sequence
  Synthetic
atacgccatgctgggtctccgttggctgccggccacgctcaccatcgcggtgccgaatgcttccatacccgtccgtgggttccgcagacatgtggatctcatggtgggcgctgctgcattcgtacttgggagtcggccat

SEQ ID NO: 394878 - DNA, 140 bp, Artificial Sequence
  Synthetic
atggccgactcccaagtacgaatgcagcagcgcccaccatgagatccacatgtctgcggaacccacggacgggtatggaagcattcggcaccgcgatggtgagcgtggccggcagccaacggagacccagcatggcgtat

SEQ ID NO: 394879 - DNA, 140 bp, Artificial Sequence
  Synthetic
aggccctggctgctgatatgagagtgccgtacttcgtgcgcgctcaagggctcatccgtgcatgcatgttggtgcggaaagtcgctgggggtcactatgtccaaatggctctcatgaagcgaccttttgggacagcggtg

SEQ ID NO: 394880 - DNA, 140 bp, Artificial Sequence
  Synthetic
caccgctgtcccaaaaggtcgcttcatgagagccatttggacatagtgacccccagcgactttccgcaccaacatgcatgcacggatgagcccttgagcgcgcacgaagtacggcactctcatatcagcagccagggcct

SEQ ID NO: 394881 - DNA, 140 bp, Artificial Sequence
  Synthetic
atacgccatgctgggtctccaattgttccatctatgttggtcatattaccggccacaggatggcatgggatatgatgatgaattggtctccaactgcaaccctggtcttgtcgtatgtcacgtacttgggagtcggccat

SEQ ID NO: 394882 - DNA, 140 bp, Artificial Sequence
  Synthetic
atggccgactcccaagtacgtgacatacgacaagaccagggttgcagttggagaccaattcatcatcatatcccatgccatcctgtggccggtaatatgaccaacatagatggaacaattggagacccagcatggcgtat

SEQ ID NO: 394883 - DNA, 140 bp, Artificial Sequence
  Synthetic
aggccctggctgctgatatgcgtcttctctgacatggagaccaagatcatcacctggggggcagacaccgcggcgtgtggggacatcatctcgggtctacccgtctccgcccgaaggggggaccttttgggacagcggtg

SEQ ID NO: 394884 - DNA, 140 bp, Artificial Sequence
  Synthetic
caccgctgtcccaaaaggtccccccttcgggcggagacgggtagacccgagatgatgtccccacacgccgcggtgtctgccccccaggtgatgatcttggtctccatgtcagagaagacgcatatcagcagccagggcct

SEQ ID NO: 394885 - DNA, 140 bp, Artificial Sequence
  Synthetic
atacgccatgctgggtctcccctctgcatcctgttcctgttcgctggtgtggatgctaccacccgcaccaccggagcacaggcggcgcgcgcgacgctgggctttacaggcttatttcagcgtacttgggagtcggccat

SEQ ID NO: 394886 - DNA, 140 bp, Artificial Sequence
  Synthetic
atggccgactcccaagtacgctgaaataagcctgtaaagcccagcgtcgcgcgcgccgcctgtgctccggtggtgcgggtggtagcatccacaccagcgaacaggaacaggatgcagaggggagacccagcatggcgtat

SEQ ID NO: 394887 - DNA, 140 bp, Artificial Sequence
  Synthetic
atacgccatgctgggtctcctggcagcgctgttttacctccataaattcaactccacaggatgtcccgagcgccttagcgcctgcaagtccatcacacaattcgcccaggggtggggacccgtacttgggagtcggccat

SEQ ID NO: 394888 - DNA, 140 bp, Artificial Sequence
  Synthetic
atggccgactcccaagtacgggtccccacccctgggcgaattgtgtgatggacttgcaggcgctaaggcgctcgggacatcctgtggagttgaatttatggaggtaaaacagcgctgccaggagacccagcatggcgtat

SEQ ID NO: 394889 - DNA, 140 bp, Artificial Sequence
  Synthetic
atacgccatgctgggtctccggtccggtgtattgtttcactcccagccccgtggtcgtaggcaccaccgaccgaaggggagtaccaacttacacgtggggcgagaatgagtcggatgtgtcgtacttgggagtcggccat

SEQ ID NO: 394890 - DNA, 140 bp, Artificial Sequence
  Synthetic
atggccgactcccaagtacgacacatccgactcattctcgccccacgtgtaagttggtactccccttcggtcggtggtgcctacgaccacggggctgggagtgaaacaatacaccggaccggagacccagcatggcgtat

SEQ ID NO: 394891 - DNA, 140 bp, Artificial Sequence
  Synthetic
atacgccatgctgggtctcccattgggccacccgatcagttctgccccaccgattgcttccggaagcaccccgaagcaacctacagaaagtgtggatcaggcccctggcttacacccagacgtacttgggagtcggccat

SEQ ID NO: 394892 - DNA, 140 bp, Artificial Sequence
  Synthetic
atggccgactcccaagtacgtctgggtgtaagccaggggcctgatccacactttctgtaggttgcttcggggtgcttccggaagcaatcggtggggcagaactgatcgggtggcccaatgggagacccagcatggcgtat

SEQ ID NO: 394893 - DNA, 140 bp, Artificial Sequence
  Synthetic
atacgccatgctgggtctcctcgatgcagcgtgcaactggacccggggggagcgctgcgagctcgaggacagagatcggatcgaaatgagcccactcttgttctcgacgacagagctcgccgtacttgggagtcggccat

SEQ ID NO: 394894 - DNA, 140 bp, Artificial Sequence
  Synthetic
atggccgactcccaagtacggcgagctctgtcgtcgagaacaagagtgggctcatttcgatccgatctctgtcctcgagctcgcagcgctccccccgggtccagttgcacgctgcatcgaggagacccagcatggcgtat

SEQ ID NO: 394895 - DNA, 140 bp, Artificial Sequence
  Synthetic
atacgccatgctgggtctccgagtgggggatttccactacgtgacgggcatgaccactgacaacctgaaatgcccatgccaagtcccatcacctgaattcttcacagaggtggacggggtcgtacttgggagtcggccat

SEQ ID NO: 394896 - DNA, 140 bp, Artificial Sequence
  Synthetic
atggccgactcccaagtacgaccccgtccacctctgtgaagaattcaggtgatgggacttggcatgggcatttcaggttgtcagtggtcatgcccgtcacgtagtggaaatcccccactcggagacccagcatggcgtat

SEQ ID NO: 394897 - DNA, 140 bp, Artificial Sequence
  Synthetic
atacgccatgctgggtctcccctgccctggtctcctgggccgtcaggtgggagtatgtggtacttgctttcctgctgttggctgacgcgcgtatttgcgcgtgcctgtggatggtgttaccgtacttgggagtcggccat

SEQ ID NO: 394898 - DNA, 140 bp, Artificial Sequence
  Synthetic
atggccgactcccaagtacggtaacaccatccacaggcacgcgcaaatacgcgcgtcagccaacagcaggaaagcaagtaccacatactcccacctgacggcccaggagaccagggcaggggagacccagcatggcgtat

SEQ ID NO: 394899 - DNA, 140 bp, Artificial Sequence
  Synthetic
atacgccatgctgggtctccttgtgcttggtacatcaaaggacgggttgtcccgggcgccacttacgccatattacatctatggcccctcctgctcctggttctagcgttgccccagcggcgtacttgggagtcggccat

SEQ ID NO: 394900 - DNA, 140 bp, Artificial Sequence
  Synthetic
atggccgactcccaagtacgccgctggggcaacgctagaaccaggagcaggaggggccatagatgtaatatggcgtaagtggcgcccgggacaacccgtcctttgatgtaccaagcacaaggagacccagcatggcgtat

SEQ ID NO: 394901 - DNA, 140 bp, Artificial Sequence
  Synthetic
atacgccatgctgggtctcctgcatttcttgtggtggaatcagtatttcatagcacggagtgaggccttgattcagcagtgggtcccgagtctccgggtccggggaggtcgtgatgctgtcgtacttgggagtcggccat

SEQ ID NO: 394902 - DNA, 140 bp, Artificial Sequence
  Synthetic
atggccgactcccaagtacgacagcatcacgacctccccggacccggagactcgggacccactgctgaatcaaggcctcactccgtgctatgaaatactgattccaccacaagaaatgcaggagacccagcatggcgtat

SEQ ID NO: 394903 - DNA, 140 bp, Artificial Sequence
  Synthetic
atacgccatgctgggtctccttgcgcgtgccgtactatgtgcgcgcgcacgccctgttgcgagtgtgcatccttgtgcggcgcgtcgcaggcggcaaatacattcaggccgctcttctgacgtacttgggagtcggccat

SEQ ID NO: 394904 - DNA, 140 bp, Artificial Sequence
  Synthetic
atggccgactcccaagtacgtcagaagagcggcctgaatgtatttgccgcctgcgacgcgccgcacaaggatgcacactcgcaacagggcgtgcgcgcgcacatagtacggcacgcgcaaggagacccagcatggcgtat

SEQ ID NO: 394905 - DNA, 140 bp, Artificial Sequence
  Synthetic
aggccctggctgctgatatgttctgctccgctatgtacgtgggggatctctgcggatctgttttcctcgtctcccagctgttcaccttctcgcctcgccggcatgagacggtacaggactgaccttttgggacagcggtg

SEQ ID NO: 394906 - DNA, 140 bp, Artificial Sequence
  Synthetic
caccgctgtcccaaaaggtcagtcctgtaccgtctcatgccggcgaggcgagaaggtgaacagctgggagacgaggaaaacagatccgcagagatcccccacgtacatagcggagcagaacatatcagcagccagggcct

SEQ ID NO: 394907 - DNA, 140 bp, Artificial Sequence
  Synthetic
atacgccatgctgggtctccagtcaccttctcgcctatggagaagaaaattatcacctggggtgcagacactgcagcgtgtggcgatatcctggctgggcttccggtctctgcacgcttgcgtacttgggagtcggccat

SEQ ID NO: 394908 - DNA, 140 bp, Artificial Sequence
  Synthetic
atggccgactcccaagtacgcaagcgtgcagagaccggaagcccagccaggatatcgccacacgctgcagtgtctgcaccccaggtgataattttcttctccataggcgagaaggtgactggagacccagcatggcgtat

SEQ ID NO: 394909 - DNA, 140 bp, Artificial Sequence
  Synthetic
atacgccatgctgggtctcctgggaacaattgttaccagcctcaccggccgggataggaatgtggttgaaggagagatacaagtgctctccacagcgacccagtctttcctgggtaccgccgtacttgggagtcggccat

SEQ ID NO: 394910 - DNA, 140 bp, Artificial Sequence
  Synthetic
atggccgactcccaagtacggcggtacccaggaaagactgggtcgctgtggagagcacttgtatctctccttcaaccacattcctatcccggccggtgaggctggtaacaattgttcccaggagacccagcatggcgtat

SEQ ID NO: 394911 - DNA, 140 bp, Artificial Sequence
  Synthetic
aggccctggctgctgatatgagctcacgcccgccgagactacagttaggctacgagcgtacatgaacaccccggggcttcccgtgtgccaggaccatcttgaattttgggagggcgtcttgaccttttgggacagcggtg

SEQ ID NO: 394912 - DNA, 140 bp, Artificial Sequence
  Synthetic
caccgctgtcccaaaaggtcaagacgccctcccaaaattcaagatggtcctggcacacgggaagccccggggtgttcatgtacgctcgtagcctaactgtagtctcggcgggcgtgagctcatatcagcagccagggcct

SEQ ID NO: 394913 - DNA, 140 bp, Artificial Sequence
  Synthetic
atacgccatgctgggtctccgacatggttggctggcctgcacctcccggcactaggtcgttgaccccgtgtacatgcggggccagcgacctgtatctggtaaccaggaacgctgacgtcacgtacttgggagtcggccat

SEQ ID NO: 394914 - DNA, 140 bp, Artificial Sequence
  Synthetic
atggccgactcccaagtacgtgacgtcagcgttcctggttaccagatacaggtcgctggccccgcatgtacacggggtcaacgacctagtgccgggaggtgcaggccagccaaccatgtcggagacccagcatggcgtat

SEQ ID NO: 394915 - DNA, 140 bp, Artificial Sequence
  Synthetic
atacgccatgctgggtctcctgaccacgttgtcgggctcttccgtgccgctgtctgcactaggggtgtagccaaggcgctggacttcgtgcccgtggagaacatggagacaaccatgaggcgtacttgggagtcggccat

SEQ ID NO: 394916 - DNA, 140 bp, Artificial Sequence
  Synthetic
atggccgactcccaagtacgcctcatggttgtctccatgttctccacgggcacgaagtccagcgccttggctacacccctagtgcagacagcggcacggaagagcccgacaacgtggtcaggagacccagcatggcgtat

SEQ ID NO: 394917 - DNA, 140 bp, Artificial Sequence
  Synthetic
atacgccatgctgggtctcctcccggcagcgtatgcctcccaaggttacaaagtgttggtgcttaacccgtcagtggctgccacccttgggtttggcagctacatgagcacagcccacggcgtacttgggagtcggccat

SEQ ID NO: 394918 - DNA, 140 bp, Artificial Sequence
  Synthetic
atggccgactcccaagtacgccgtgggctgtgctcatgtagctgccaaacccaagggtggcagccactgacgggttaagcaccaacactttgtaaccttgggaggcatacgctgccgggaggagacccagcatggcgtat

SEQ ID NO: 394919 - DNA, 140 bp, Artificial Sequence
  Synthetic
atacgccatgctgggtctccgggggcgcgtatgatatcatcatatgtgacgagtgccactccacggatccgaccacggtcctaggaatcggcaccgtcttggatcaggcagaaacagctgcgtacttgggagtcggccat

SEQ ID NO: 394920 - DNA, 140 bp, Artificial Sequence
  Synthetic
atggccgactcccaagtacgcagctgtttctgcctgatccaagacggtgccgattcctaggaccgtggtcggatccgtggagtggcactcgtcacatatgatgatatcatacgcgcccccggagacccagcatggcgtat

SEQ ID NO: 394921 - DNA, 140 bp, Artificial Sequence
  Synthetic
aggccctggctgctgatatggaaaatccaactgatcaacaccaacggcagttggcacatcaataggacggccttgaactgcaatgatagccttcacaccggctttatagcagggcttatcgaccttttgggacagcggtg

SEQ ID NO: 394922 - DNA, 140 bp, Artificial Sequence
  Synthetic
caccgctgtcccaaaaggtcgataagccctgctataaagccggtgtgaaggctatcattgcagttcaaggccgtcctattgatgtgccaactgccgttggtgttgatcagttggattttccatatcagcagccagggcct

SEQ ID NO: 394923 - DNA, 140 bp, Artificial Sequence
  Synthetic
aggccctggctgctgatatgccttgaactgcaatgatagccttcacaccggctttatagcagggcttatctatctcaacaaatttaattcttcaggctgtccccagagattggcgagctggaccttttgggacagcggtg

SEQ ID NO: 394924 - DNA, 140 bp, Artificial Sequence
  Synthetic
caccgctgtcccaaaaggtccagctcgccaatctctggggacagcctgaagaattaaatttgttgagatagataagccctgctataaagccggtgtgaaggctatcattgcagttcaaggcatatcagcagccagggcct

SEQ ID NO: 394925 - DNA, 140 bp, Artificial Sequence
  Synthetic
atacgccatgctgggtctccccccttttatgggaaagccatccccctggagtgcatcaaaggtggtagacatctgatcttctgtcactcaaagaaaaagtgcgacgaattggccaagcaacgtacttgggagtcggccat

SEQ ID NO: 394926 - DNA, 140 bp, Artificial Sequence
  Synthetic
atggccgactcccaagtacgttgcttggccaattcgtcgcactttttctttgagtgacagaagatcagatgtctaccacctttgatgcactccagggggatggctttcccataaaaggggggagacccagcatggcgtat

SEQ ID NO: 394927 - DNA, 140 bp, Artificial Sequence
  Synthetic
atacgccatgctgggtctcctcatgaccgggtacacgggcgatttcgactctgtgattgactgcaatgtcgcagtgactcagatagttgattttagcctggaccccaccttctcaattgacgtacttgggagtcggccat

SEQ ID NO: 394928 - DNA, 140 bp, Artificial Sequence
  Synthetic
atggccgactcccaagtacgtcaattgagaaggtggggtccaggctaaaatcaactatctgagtcactgcgacattgcagtcaatcacagagtcgaaatcgcccgtgtacccggtcatgaggagacccagcatggcgtat

SEQ ID NO: 394929 - DNA, 140 bp, Artificial Sequence
  Synthetic
  misc_feature (25)..(25): n is a, c, g, or t
  misc_feature (99)..(99): n is a, c, g, or t
  misc_feature (102)..(102): n is a, c, g, or t
  misc_feature (108)..(108): n is a, c, g, or t
  misc_feature (111)..(111): n is a, c, g, or t
  misc_feature (117)..(117): n is a, c, g, or t
aggccctggctgctgatatgagctncagccgctattaaagcggcggggctgagagactgcactatgctggtatgcggtgacgacttggtcgttatcgcnganagcganggngtggangaggaccttttgggacagcggtg

SEQ ID NO: 394930 - DNA, 140 bp, Artificial Sequence
  Synthetic
  misc_feature (24)..(24): n is a, c, g, or t
  misc_feature (30)..(30): n is a, c, g, or t
  misc_feature (33)..(33): n is a, c, g, or t
  misc_feature (39)..(39): n is a, c, g, or t
  misc_feature (42)..(42): n is a, c, g, or t
  misc_feature (116)..(116): n is a, c, g, or t
caccgctgtcccaaaaggtcctcntccacnccntcgctntcngcgataacgaccaagtcgtcaccgcataccagcatagtgcagtctctcagccccgccgctttaatagcggctgnagctcatatcagcagccagggcct

SEQ ID NO: 394931 - DNA, 140 bp, Artificial Sequence
  Synthetic
atacgccatgctgggtctcccggccgtctggcatgtttgacactgtcgttctttgcgaggcgtatgatgttgggtgcgcatggtatgaactgactccatcagagacgaccgtcagactgccgtacttgggagtcggccat

SEQ ID NO: 394932 - DNA, 140 bp, Artificial Sequence
  Synthetic
atggccgactcccaagtacggcagtctgacggtcgtctctgatggagtcagttcataccatgcgcacccaacatcatacgcctcgcaaagaacgacagtgtcaaacatgccagacggccgggagacccagcatggcgtat

SEQ ID NO: 394933 - DNA, 140 bp, Artificial Sequence
  Synthetic
atacgccatgctgggtctccatcccaaactaaacagggaggggagaatttcgcctacctcgtggcctatcaagccaccgtgtgtgcgcgagcaaaggcgccccccccctcgtgggacacccgtacttgggagtcggccat

SEQ ID NO: 394934 - DNA, 140 bp, Artificial Sequence
  Synthetic
atggccgactcccaagtacgggtgtcccacgagggggggggcgcctttgctcgcgcacacacggtggcttgataggccacgaggtaggcgaaattctcccctccctgtttagtttgggatggagacccagcatggcgtat

SEQ ID NO: 394935 - DNA, 140 bp, Artificial Sequence
  Synthetic
atacgccatgctgggtctcccaatcaccaaatacatcatgacctgcatggcagctgacctggaggtgatcaccagcacgtgggtgcttgccggggggattgtcgcggcattggcagcctacgtacttgggagtcggccat

SEQ ID NO: 394936 - DNA, 140 bp, Artificial Sequence
  Synthetic
atggccgactcccaagtacgtaggctgccaatgccgcgacaatccccccggcaagcacccacgtgctggtgatcacctccaggtcagctgccatgcaggtcatgatgtatttggtgattgggagacccagcatggcgtat

SEQ ID NO: 394937 - DNA, 140 bp, Artificial Sequence
  Synthetic
atacgccatgctgggtctccgagatggaggagtgctcacggcacatcccctacctcgccgagggtcaacagattgccgaacagttcaagcagaagatccttggactgttgcagaacactgcgtacttgggagtcggccat

SEQ ID NO: 394938 - DNA, 140 bp, Artificial Sequence
  Synthetic
atggccgactcccaagtacgcagtgttctgcaacagtccaaggatcttctgcttgaactgttcggcaatctgttgaccctcggcgaggtaggggatgtgccgtgagcactcctccatctcggagacccagcatggcgtat

SEQ ID NO: 394939 - DNA, 140 bp, Artificial Sequence
  Synthetic
atacgccatgctgggtctccgtacctagccggcttgtccaccttgccaggtaatcccgctgtggcctccctaatgtccttctccgccgccctgactagcccgctttctacgtcaacgacccgtacttgggagtcggccat

SEQ ID NO: 394940 - DNA, 140 bp, Artificial Sequence
  Synthetic
atggccgactcccaagtacgggtcgttgacgtagaaagcgggctagtcagggcggcggagaaggacattagggaggccacagcgggattacctggcaaggtggacaagccggctaggtacggagacccagcatggcgtat

SEQ ID NO: 394941 - DNA, 140 bp, Artificial Sequence
  Synthetic
atacgccatgctgggtctccgcagcattgggctgggtaaggtcatcattgacattttagcgggttatggggcaggggtttcgggagcccttgtagcttttaagatcatgagcggcgaggccgtacttgggagtcggccat

SEQ ID NO: 394942 - DNA, 140 bp, Artificial Sequence
  Synthetic
atggccgactcccaagtacggcctcgccgctcatgatcttaaaagctacaagggctcccgaaacccctgccccataacccgctaaaatgtcaatgatgaccttacccagcccaatgctgcggagacccagcatggcgtat

SEQ ID NO: 394943 - DNA, 140 bp, Artificial Sequence
  Synthetic
atacgccatgctgggtctccggcccatctgaaggggctacccagtggatgaacagactcatagctttcgcttcgcggggcaaccatgtgtctccaacacattatgtgcccgagacggatgcgtacttgggagtcggccat

SEQ ID NO: 394944 - DNA, 140 bp, Artificial Sequence
  Synthetic
atggccgactcccaagtacgcatccgtctcgggcacataatgtgttggagacacatggttgccccgcgaagcgaaagctatgagtctgttcatccactgggtagccccttcagatgggccggagacccagcatggcgtat

SEQ ID NO: 394945 - DNA, 140 bp, Artificial Sequence
  Synthetic
atacgccatgctgggtctccctgttcttggttaaaggatgtttgggattgggtctgtacggtattgtctgacttcaagacgtggctgagagccaagcttgtgcccactctcccgggtatccgtacttgggagtcggccat

SEQ ID NO: 394946 - DNA, 140 bp, Artificial Sequence
  Synthetic
atggccgactcccaagtacggatacccgggagagtgggcacaagcttggctctcagccacgtcttgaagtcagacaataccgtacagacccaatcccaaacatcctttaaccaagaacagggagacccagcatggcgtat

SEQ ID NO: 394947 - DNA, 140 bp, Artificial Sequence
  Synthetic
aggccctggctgctgatatgccagattgtgtcaactgctgcccaaactttcctggcaacatgcatcaatggggtatgctggactgtctaccacggggctggaacgaggaccatcgcatcagaccttttgggacagcggtg

SEQ ID NO: 394948 - DNA, 140 bp, Artificial Sequence
  Synthetic
caccgctgtcccaaaaggtctgatgcgatggtcctcgttccagccccgtggtagacagtccagcataccccattgatgcatgttgccaggaaagtttgggcagcagttgacacaatctggcatatcagcagccagggcct

SEQ ID NO: 394949 - DNA, 140 bp, Artificial Sequence
  Synthetic
atacgccatgctgggtctccagaatgggtcaatgaagatcgtaggcccaaagatgtgcagcaatgtctggaataataggttccccatcaacgccatcacaactggccctagcgtgcccgtcgtacttgggagtcggccat

SEQ ID NO: 394950 - DNA, 140 bp, Artificial Sequence
  Synthetic
atggccgactcccaagtacgacgggcacgctagggccagttgtgatggcgttgatggggaacctattattccagacattgctgcacatctttgggcctacgatcttcattgacccattctggagacccagcatggcgtat

SEQ ID NO: 394951 - DNA, 140 bp, Artificial Sequence
  Synthetic
atacgccatgctgggtctccccgcaaagctgtcgggcctcggactcaacgctgtagcgtattaccggggccttgatgtgtccgtcataccgaccagcggagacgtcgttgtcgtggcaaccgtacttgggagtcggccat

SEQ ID NO: 394952 - DNA, 140 bp, Artificial Sequence
  Synthetic
atggccgactcccaagtacggttgccacgacaacgacgtctccgctggtcggtatgacggacacatcaaggccccggtaatacgctacagcgttgagtccgaggcccgacagctttgcggggagacccagcatggcgtat

SEQ ID NO: 394953 - DNA, 140 bp, Artificial Sequence
  Synthetic
atacgccatgctgggtctccgctgacaatctgaaatgtccatgccaggttcccgcaccagaattcttcactgaagtggatggcgtcaggctgcatagatttgcaccgccctgccgtccaccgtacttgggagtcggccat

SEQ ID NO: 394954 - DNA, 140 bp, Artificial Sequence
  Synthetic
atggccgactcccaagtacggtggacggcagggcggtgcaaatctatgcagcctgacgccatccacttcagtgaagaattctggtgcgggaacctggcatggacatttcagattgtcagcggagacccagcatggcgtat

SEQ ID NO: 394955 - DNA, 140 bp, Artificial Sequence
  Synthetic
atacgccatgctgggtctcccatgcttactgatccagaccacattacagctgagaccgcggctcgacgcctcgcgcgagggtccccgccgtcgcttgccagttcatctgcaagccagctgcgtacttgggagtcggccat

SEQ ID NO: 394956 - DNA, 140 bp, Artificial Sequence
  Synthetic
atggccgactcccaagtacgcagctggcttgcagatgaactggcaagcgacggcggggaccctcgcgcgaggcgtcgagccgcggtctcagctgtaatgtggtctggatcagtaagcatgggagacccagcatggcgtat

SEQ ID NO: 394957 - DNA, 140 bp, Artificial Sequence
  Synthetic
atacgccatgctgggtctcctttgacatcaccaaactcttgctcgccatactcggtccgctcatggtgttccaggctggcataactagagtgccgtacttcgtacgcgctcaagggctcacgtacttgggagtcggccat

SEQ ID NO: 394958 - DNA, 140 bp, Artificial Sequence
  Synthetic
atggccgactcccaagtacgtgagcccttgagcgcgtacgaagtacggcactctagttatgccagcctggaacaccatgagcggaccgagtatggcgagcaagagtttggtgatgtcaaaggagacccagcatggcgtat

SEQ ID NO: 394959 - DNA, 140 bp, Artificial Sequence
  Synthetic
atacgccatgctgggtctccacataacacgggtcgagtctgagaataagatcatagtcctcgactcgtttgatcccctgatagccgagacggacgacagggagatatccgtgggtgccgacgtacttgggagtcggccat

SEQ ID NO: 394960 - DNA, 140 bp, Artificial Sequence
  Synthetic
atggccgactcccaagtacgtcggcacccacggatatctccctgtcgtccgtctcggctatcaggggatcaaacgagtcgaggactatgatcttattctcagactcgacccgtgttatgtggagacccagcatggcgtat

SEQ ID NO: 394961 - DNA, 140 bp, Artificial Sequence
  Synthetic
atacgccatgctgggtctcctacgagcctcccctggtgcatgggtgcgctttgcctcccaagggcttgcccccagtgccaccccctcggaaaaaaagagtagtgcagctcgacgaggggtcgtacttgggagtcggccat

SEQ ID NO: 394962 - DNA, 140 bp, Artificial Sequence
  Synthetic
atggccgactcccaagtacgacccctcgtcgagctgcactactctttttttccgagggggtggcactgggggcaagcccttgggaggcaaagcgcacccatgcaccaggggaggctcgtaggagacccagcatggcgtat

SEQ ID NO: 394963 - DNA, 140 bp, Artificial Sequence
  Synthetic
atacgccatgctgggtctcctgacatgacgcctcctcgcgaggaggctgacagggcttcagacgatggctcctacagctccatgccgcccttggaaggcgagcctggagaccccgacctccgtacttgggagtcggccat

SEQ ID NO: 394964 - DNA, 140 bp, Artificial Sequence
  Synthetic
atggccgactcccaagtacggaggtcggggtctccaggctcgccttccaagggcggcatggagctgtaggagccatcgtctgaagccctgtcagcctcctcgcgaggaggcgtcatgtcaggagacccagcatggcgtat

SEQ ID NO: 394965 - DNA, 140 bp, Artificial Sequence
  Synthetic
atacgccatgctgggtctccccgaggaggaaaagttgcctattagtccattgagcaacgccctcattcgccaccacaacctggtgtactccaccacgtcgcgcagcgcgtccctccgccacgtacttgggagtcggccat

SEQ ID NO: 394966 - DNA, 140 bp, Artificial Sequence
  Synthetic
atggccgactcccaagtacgtggcggagggacgcgctgcgcgacgtggtggagtacaccaggttgtggtggcgaatgagggcgttgctcaatggactaataggcaacttttcctcctcggggagacccagcatggcgtat

SEQ ID NO: 394967 - DNA, 140 bp, Artificial Sequence
  Synthetic
atacgccatgctgggtctccctatctgttgaagaagcttgcgcgctgactccaccgcactcagcccgatctaagttcgggtatggggccaaggaggtccgaggtcttgccagcaaagccgcgtacttgggagtcggccat

SEQ ID NO: 394968 - DNA, 140 bp, Artificial Sequence
  Synthetic
atggccgactcccaagtacgcggctttgctggcaagacctcggacctccttggccccatacccgaacttagatcgggctgagtgcggtggagtcagcgcgcaagcttcttcaacagatagggagacccagcatggcgtat

SEQ ID NO: 394969 - DNA, 140 bp, Artificial Sequence
  Synthetic
atacgccatgctgggtctcctcaaaagggcggccggaaaccggcccgactcattgtgtatcctgacctaggggtgagggtatgcgaaaagagagccctttatgacgtcacgcagaaattacgtacttgggagtcggccat

SEQ ID NO: 394970 - DNA, 140 bp, Artificial Sequence
  Synthetic
atggccgactcccaagtacgtaatttctgcgtgacgtcataaagggctctcttttcgcataccctcacccctaggtcaggatacacaatgagtcgggccggtttccggccgcccttttgaggagacccagcatggcgtat

SEQ ID NO: 394971 - DNA, 140 bp, Artificial Sequence
  Synthetic
atacgccatgctgggtctccggttctcctacgacaccaggtgctttgattctacggtcaccgagcgcgacatccggactgaggaggacatctaccaatgctgccaattggatcctgttgccgtacttgggagtcggccat

SEQ ID NO: 394972 - DNA, 140 bp, Artificial Sequence
  Synthetic
atggccgactcccaagtacggcaacaggatccaattggcagcattggtagatgtcctcctcagtccggatgtcgcgctcggtgaccgtagaatcaaagcacctggtgtcgtaggagaaccggagacccagcatggcgtat

SEQ ID NO: 394973 - DNA, 140 bp, Artificial Sequence
  Synthetic
atacgccatgctgggtctccggcgtgctcactaccagtctgggcaacaccctaacatgctacctgaaggcgcaagcagcgtgcagagcagccaagctcaaagactttgacatgttggtctcgtacttgggagtcggccat

SEQ ID NO: 394974 - DNA, 140 bp, Artificial Sequence
  Synthetic
atggccgactcccaagtacgagaccaacatgtcaaagtctttgagcttggctgctctgcacgctgcttgcgccttcaggtagcatgttagggtgttgcccagactggtagtgagcacgccggagacccagcatggcgtat

SEQ ID NO: 394975 - DNA, 140 bp, Artificial Sequence
  Synthetic
atacgccatgctgggtctccccccggtgacgacccgcagccggagtatgacctcgagctgataacatcatgctcgtcaaacgtctccgtagctcatgacggcgctgggcagagatattaccgtacttgggagtcggccat

SEQ ID NO: 394976 - DNA, 140 bp, Artificial Sequence
  Synthetic
atggccgactcccaagtacggtaatatctctgcccagcgccgtcatgagctacggagacgtttgacgagcatgatgttatcagctcgaggtcatactccggctgcgggtcgtcaccggggggagacccagcatggcgtat

SEQ ID NO: 394977 - DNA, 140 bp, Artificial Sequence
  Synthetic
aggccctggctgctgatatgcaaacctctcctacgggaggaggtcacattccaggtcgggctcaaccaatacctggttgggtcacaactcccatgcgagcccgaaccggatgtagcagtggaccttttgggacagcggtg

SEQ ID NO: 394978 - DNA, 140 bp, Artificial Sequence
  Synthetic
caccgctgtcccaaaaggtccactgctacatccggttcgggctcgcatgggagttgtgacccaaccaggtattggttgagcccgacctggaatgtgacctcctcccgtaggagaggtttgcatatcagcagccagggcct

SEQ ID NO: 394979 - DNA, 140 bp, Artificial Sequence
  Synthetic
atacgccatgctgggtctcccaccaaccatttgggtacgtatggtgttaatgactcatttctttgcaatactccaatcccaggaaatactccataaagcacttgacttcgacatgtacggcgtacttgggagtcggccat

SEQ ID NO: 394980 - DNA, 140 bp, Artificial Sequence
  Synthetic
atggccgactcccaagtacgccgtacatgtcgaagtcaagtgctttatggagtatttcctgggattggagtattgcaaagaaatgagtcattaacaccatacgtacccaaatggttggtgggagacccagcatggcgtat

SEQ ID NO: 394981 - DNA, 140 bp, Artificial Sequence
  Synthetic
atacgccatgctgggtctccaatagagtggcatcttgtctcaggaagcttggggcaccacccctaagagcctggaggcaccgagccagggcagtcagagctaagctcatcgcccaaggggcgtacttgggagtcggccat

SEQ ID NO: 394982 - DNA, 140 bp, Artificial Sequence
  Synthetic
atggccgactcccaagtacgccccttgggcgatgagcttagctctgactgccctggctcggtgcctccaggctcttaggggtggtgccccaagcttcctgagacaagatgccactctattggagacccagcatggcgtat

SEQ ID NO: 394983 - DNA, 140 bp, Artificial Sequence
  Synthetic
atacgccatgctgggtctccgtggtttgtgtcgggcggtagcgggggggacatatttcacagcgtgtcccgggctcggccccgcaacttactcctgtgcctactcctactcaccgtagggcgtacttgggagtcggccat

SEQ ID NO: 394984 - DNA, 140 bp, Artificial Sequence
  Synthetic
atggccgactcccaagtacgccctacggtgagtaggagtaggcacaggagtaagttgcggggccgagcccgggacacgctgtgaaatatgtcccccccgctaccgcccgacacaaaccacggagacccagcatggcgtat

SEQ ID NO: 394985 - DNA, 140 bp, Artificial Sequence
  Synthetic
atacgccatgctgggtctccgtaggcatctttttgctccctgctcggtaagcggggagcttaaagcaacactccattagtttttttttttttttttttttttttttttttttttttttttcgtacttgggagtcggccat

SEQ ID NO: 394986 - DNA, 140 bp, Artificial Sequence
  Synthetic
atggccgactcccaagtacgaaaaaaaaaaaaaaaaaaaaaaaaaaaaaaaaaaaaaaaaactaatggagtgttgctttaagctccccgcttaccgagcagggagcaaaaagatgcctacggagacccagcatggcgtat

SEQ ID NO: 394987 - DNA, 140 bp, Artificial Sequence
  Synthetic
aggccctggctgctgatatgctgatccctcccatataacggcagaggcggccaagaggaggttggcgagagggtcacccccttccgtggccagctcctcggctagccagctgtccgctccgaccttttgggacagcggtg

SEQ ID NO: 394988 - DNA, 140 bp, Artificial Sequence
  Synthetic
caccgctgtcccaaaaggtcggagcggacagctggctagccgaggagctggccacggaagggggtgaccctctcgccaacctcctcttggccgcctctgccgttatatgggagggatcagcatatcagcagccagggcct

SEQ ID NO: 394989 - DNA, 140 bp, Artificial Sequence
  Synthetic
aggccctggctgctgatatgatcgttggtggagtttacttgttgccgcgcaggggccctcgtttgggtgtgcgcgcgacgagaaaaacttctgaacggtcccagcccaggggtagacgccgaccttttgggacagcggtg

SEQ ID NO: 394990 - DNA, 140 bp, Artificial Sequence
  Synthetic
caccgctgtcccaaaaggtcggcgtctacccctgggctgggaccgttcagaagtttttctcgtcgcgcgcacacccaaacgagggcccctgcgcggcaacaagtaaactccaccaacgatcatatcagcagccagggcct

SEQ ID NO: 394991 - DNA, 140 bp, Artificial Sequence
  Synthetic
atacgccatgctgggtctcccgggtctcacccatatagacgcccacttcctatcccagacaaagcagagtggggaaaaccttccttacctggtagcgtaccaagccaccgtgtgcgctagcgtacttgggagtcggccat

SEQ ID NO: 394992 - DNA, 140 bp, Artificial Sequence
  Synthetic
atggccgactcccaagtacgctagcgcacacggtggcttggtacgctaccaggtaaggaaggttttccccactctgctttgtctgggataggaagtgggcgtctatatgggtgagacccgggagacccagcatggcgtat

SEQ ID NO: 394993 - DNA, 140 bp, Artificial Sequence
  Synthetic
aggccctggctgctgatatgactatgcaacagggaatcttcccggttgctctttttctattttccttttggcactcctctcgtgcctcaccacacccgcctcagccgcgcactacaccaagaccttttgggacagcggtg

SEQ ID NO: 394994 - DNA, 140 bp, Artificial Sequence
  Synthetic
caccgctgtcccaaaaggtcttggtgtagtgcgcggctgaggcgggtgtggtgaggcacgagaggagtgccaaaaggaaaatagaaaaagagcaaccgggaagattccctgttgcatagtcatatcagcagccagggcct

SEQ ID NO: 394995 - DNA, 140 bp, Artificial Sequence
  Synthetic
atacgccatgctgggtctccgttaaggtcggcaatcggtccacatgctggttgccggcttcgcccacgctggctgtcccgaacgcgacaacgcccctcactgggttccgcaaacatgtggcgtacttgggagtcggccat

SEQ ID NO: 394996 - DNA, 140 bp, Artificial Sequence
  Synthetic
atggccgactcccaagtacgccacatgtttgcggaacccagtgaggggcgttgtcgcgttcgggacagccagcgtgggcgaagccggcaaccagcatgtggaccgattgccgaccttaacggagacccagcatggcgtat

SEQ ID NO: 394997 - DNA, 140 bp, Artificial Sequence
  Synthetic
atacgccatgctgggtctccatatgtggcggactgttcctactcggacaggtcgtcacgatcaggcctcgcttacatcagaccgtccaggagtgcaactgttccatctacacaggccagacgtacttgggagtcggccat

SEQ ID NO: 394998 - DNA, 140 bp, Artificial Sequence
  Synthetic
atggccgactcccaagtacgtctggcctgtgtagatggaacagttgcactcctggacggtctgatgtaagcgaggcctgatcgtgacgacctgtccgagtaggaacagtccgccacatatggagacccagcatggcgtat

SEQ ID NO: 394999 - DNA, 140 bp, Artificial Sequence
  Synthetic
aggccctggctgctgatatgcatatttgtgggcggtcattggggggtgctggctggaatattatactatagcatggtagccaactgggccaaggtcatcggcatccttctcctgttcgcagaccttttgggacagcggtg

SEQ ID NO: 395000 - DNA, 140 bp, Artificial Sequence
  Synthetic
caccgctgtcccaaaaggtctgcgaacaggagaaggatgccgatgaccttggcccagttggctaccatgctatagtataatattccagccagcaccccccaatgaccgcccacaaatatgcatatcagcagccagggcct

SEQ ID NO: 395001 - DNA, 140 bp, Artificial Sequence
  Synthetic
aggccctggctgctgatatgcaatgtagaccaggacctcgtcggctggcaggcgccccccggggcgcgttccttgacaccatgcacctgcggcagctcggacctttacttggtcacgagagaccttttgggacagcggtg

SEQ ID NO: 395002 - DNA, 140 bp, Artificial Sequence
  Synthetic
caccgctgtcccaaaaggtctctcgtgaccaagtaaaggtccgagctgccgcaggtgcatggtgtcaaggaacgcgccccggggggcgcctgccagccgacgaggtcctggtctacattgcatatcagcagccagggcct

SEQ ID NO: 395003 - DNA, 140 bp, Artificial Sequence
  Synthetic
atacgccatgctgggtctcctcgtgaataccaacgggagctggcacattaataggactgccttgaactgtaatgatagcttaagtacaggcttcatcaccgctctgttttatacccgtagcgtacttgggagtcggccat

SEQ ID NO: 395004 - DNA, 140 bp, Artificial Sequence
  Synthetic
atggccgactcccaagtacgctacgggtataaaacagagcggtgatgaagcctgtacttaagctatcattacagttcaaggcagtcctattaatgtgccagctcccgttggtattcacgaggagacccagcatggcgtat

SEQ ID NO: 395005 - DNA, 140 bp, Artificial Sequence
  Synthetic
atacgccatgctgggtctccagctcagaagacaagccctattgctggcactacccaccaagaccacgcgaggtggtgccggccttacaagtgtgcggccctgtttactgctttacaccaacgtacttgggagtcggccat

SEQ ID NO: 395006 - DNA, 140 bp, Artificial Sequence
  Synthetic
atggccgactcccaagtacgttggtgtaaagcagtaaacagggccgcacacttgtaaggccggcaccacctcgcgtggtcttggtgggtagtgccagcaatagggcttgtcttctgagctggagacccagcatggcgtat

SEQ ID NO: 395007 - DNA, 140 bp, Artificial Sequence
  Synthetic
aggccctggctgctgatatgggccttgcctactattccatggtggggaactgggctaaggtcttgcttgtgatgctactctttgccggcgttgacggggacaccaacgcggcgggggggtgaccttttgggacagcggtg

SEQ ID NO: 395008 - DNA, 140 bp, Artificial Sequence
  Synthetic
caccgctgtcccaaaaggtcacccccccgccgcgttggtgtccccgtcaacgccggcaaagagtagcatcacaagcaagaccttagcccagttccccaccatggaatagtaggcaaggcccatatcagcagccagggcct

SEQ ID NO: 395009 - DNA, 140 bp, Artificial Sequence
  Synthetic
atacgccatgctgggtctcccatgggtggttggtatgggtgcacctggatgaattccaccgggtttgttaaaacatgtggggcgcctccatgcaacatacggcccaacccagtcaacgggcgtacttgggagtcggccat

SEQ ID NO: 395010 - DNA, 140 bp, Artificial Sequence
  Synthetic
atggccgactcccaagtacgcccgttgactgggttgggccgtatgttgcatggaggcgccccacatgttttaacaaacccggtggaattcatccaggtgcacccataccaaccacccatgggagacccagcatggcgtat

SEQ ID NO: 395011 - DNA, 140 bp, Artificial Sequence
  Synthetic
atacgccatgctgggtctccaactgccctgaactgcaacgagtctatcaacactgggtggcttgccgcgctgttctacacacacaagttcaacgcgtccggatgcccagagcgcctggctcgtacttgggagtcggccat

SEQ ID NO: 395012 - DNA, 140 bp, Artificial Sequence
  Synthetic
atggccgactcccaagtacgagccaggcgctctgggcatccggacgcgttgaacttgtgtgtgtagaacagcgcggcaagccacccagtgttgatagactcgttgcagttcagggcagttggagacccagcatggcgtat

SEQ ID NO: 395013 - DNA, 140 bp, Artificial Sequence
  Synthetic
atacgccatgctgggtctccttgactatccttataggctgtggcactacccttgcactgtgaacttcactgttcataaggtccgcatgtatgtgggaggactggagcacaggtttagcgccgtacttgggagtcggccat

SEQ ID NO: 395014 - DNA, 140 bp, Artificial Sequence
  Synthetic
atggccgactcccaagtacggcgctaaacctgtgctccagtcctcccacatacatgcggaccttatgaacagtgaagttcacagtgcaagggtagtgccacagcctataaggatagtcaaggagacccagcatggcgtat

SEQ ID NO: 395015 - DNA, 140 bp, Artificial Sequence
  Synthetic
atacgccatgctgggtctccccctgttcgttcacgacaatgccggcactttccacggggctgatacacctgcaccagaacatagtggacgtccagtacctctatgggatttctccatcggcgtacttgggagtcggccat

SEQ ID NO: 395016 - DNA, 140 bp, Artificial Sequence
  Synthetic
atggccgactcccaagtacgccgatggagaaatcccatagaggtactggacgtccactatgttctggtgcaggtgtatcagccccgtggaaagtgccggcattgtcgtgaacgaacagggggagacccagcatggcgtat

SEQ ID NO: 395017 - DNA, 140 bp, Artificial Sequence
  Synthetic
atacgccatgctgggtctccccaagccgaggccgcattggagaacttaatcgtcctcaatgctgcctcggctgctagcatccacggatggggatggtgctttgtctttttgtgctgtgcccgtacttgggagtcggccat

SEQ ID NO: 395018 - DNA, 140 bp, Artificial Sequence
  Synthetic
atggccgactcccaagtacgggcacagcacaaaaagacaaagcaccatccccatccgtggatgctagcagccgaggcagcattgaggacgattaagttctccaatgcggcctcggcttggggagacccagcatggcgtat

SEQ ID NO: 395019 - DNA, 140 bp, Artificial Sequence
  Synthetic
atacgccatgctgggtctcccatacgatcaagagcaagcggcctctatcggtgcagcagtgctggtaaccatcaccgccttcacgctcacaccgcactacaaaaggatgcttgtccagttcgtacttgggagtcggccat

SEQ ID NO: 395020 - DNA, 140 bp, Artificial Sequence
  Synthetic
atggccgactcccaagtacgaactggacaagcatccttttgtagtgcggtgtgagcgtgaaggcggtgatggttaccagcactgctgcaccgatagaggccgcttgctcttgatcgtatgggagacccagcatggcgtat

SEQ ID NO: 395021 - DNA, 140 bp, Artificial Sequence
  Synthetic
atacgccatgctgggtctccctcacatgcttgttacacccctctctcggattcgacattaccaaggtgcttttggcactcattggccccctctaccttctgcaggccagcctcctgcgcgcgtacttgggagtcggccat

SEQ ID NO: 395022 - DNA, 140 bp, Artificial Sequence
  Synthetic
atggccgactcccaagtacgcgcgcaggaggctggcctgcagaaggtagagggggccaatgagtgccaaaagcaccttggtaatgtcgaatccgagagaggggtgtaacaagcatgtgagggagacccagcatggcgtat

SEQ ID NO: 395023 - DNA, 140 bp, Artificial Sequence
  Synthetic
atacgccatgctgggtctccggcatggacgggcacctacatttacaaccatctggcacctcttgagacctgggccagcgacgggttacgcgatcttgctgtcgctgtagagcctgttgtgcgtacttgggagtcggccat

SEQ ID NO: 395024 - DNA, 140 bp, Artificial Sequence
  Synthetic
atggccgactcccaagtacgcacaacaggctctacagcgacagcaagatcgcgtaacccgtcgctggcccaggtctcaagaggtgccagatggttgtaaatgtaggtgcccgtccatgccggagacccagcatggcgtat

SEQ ID NO: 395025 - DNA, 140 bp, Artificial Sequence
  Synthetic
atacgccatgctgggtctcctggtgttggtaggcccggctgataacatgcaagaccagggctggaggctactcgcccctatcacagcataccatcaacagacccgcggcctattggggaccgtacttgggagtcggccat

SEQ ID NO: 395026 - DNA, 140 bp, Artificial Sequence
  Synthetic
atggccgactcccaagtacggtccccaataggccgcgggtctgttgatggtatgctgtgataggggcgagtagcctccagccctggtcttgcatgttatcagccgggcctaccaacaccaggagacccagcatggcgtat

SEQ ID NO: 395027 - DNA, 140 bp, Artificial Sequence
  Synthetic
atacgccatgctgggtctccggagtactgtggactgtttaccacggcgctggctccaagaccctagccggtccgaagggtccggtgtgccagatgtatactaatgttgaccaagacatggcgtacttgggagtcggccat

SEQ ID NO: 395028 - DNA, 140 bp, Artificial Sequence
  Synthetic
atggccgactcccaagtacgccatgtcttggtcaacattagtatacatctggcacaccggacccttcggaccggctagggtcttggagccagcgccgtggtaaacagtccacagtactccggagacccagcatggcgtat

SEQ ID NO: 395029 - DNA, 140 bp, Artificial Sequence
  Synthetic
atacgccatgctgggtctcccagacgcaggggtgacactcgtgcagggcttcttagtcccagacccttgtcgactctcaaaggctcatccggtgggccagtgatgtgtccggcaggccatcgtacttgggagtcggccat

SEQ ID NO: 395030 - DNA, 140 bp, Artificial Sequence
  Synthetic
atggccgactcccaagtacgatggcctgccggacacatcactggcccaccggatgagcctttgagagtcgacaagggtctgggactaagaagccctgcacgagtgtcacccctgcgtctgggagacccagcatggcgtat

SEQ ID NO: 395031 - DNA, 140 bp, Artificial Sequence
  Synthetic
atacgccatgctgggtctcctattctctgataactcatcaccgcccgctgtaccgcagacctatcaggttggatatctccatgctccaaccggcagtgggaagagcacgaaggtgccggccgtacttgggagtcggccat

SEQ ID NO: 395032 - DNA, 140 bp, Artificial Sequence
  Synthetic
atggccgactcccaagtacggccggcaccttcgtgctcttcccactgccggttggagcatggagatatccaacctgataggtctgcggtacagcgggcggtgatgagttatcagagaataggagacccagcatggcgtat

SEQ ID NO: 395033 - DNA, 140 bp, Artificial Sequence
  Synthetic
aggccctggctgctgatatgcaggccaccgttgggcaattggttcggttgcacctggatgaactcatctggatataccaaagtgtgcggagcgcctccttgtgtcatcggaggggtgggcgaccttttgggacagcggtg

SEQ ID NO: 395034 - DNA, 140 bp, Artificial Sequence
  Synthetic
caccgctgtcccaaaaggtcgcccacccctccgatgacacaaggaggcgctccgcacactttggtatatccagatgagttcatccaggtgcaaccgaaccaattgcccaacggtggcctgcatatcagcagccagggcct

SEQ ID NO: 395035 - DNA, 140 bp, Artificial Sequence
  Synthetic
atacgccatgctgggtctcccctaacatcaggaccggcgtcaggactataacaacaggaggacccatcacctattctacctatggaaaatttctggctgacggggggtgctcgggaggggcgtacttgggagtcggccat

SEQ ID NO: 395036 - DNA, 140 bp, Artificial Sequence
  Synthetic
atggccgactcccaagtacgcccctcccgagcaccccccgtcagccagaaattttccataggtagaataggtgatgggtcctcctgttgttatagtcctgacgccggtcctgatgttaggggagacccagcatggcgtat

SEQ ID NO: 395037 - DNA, 140 bp, Artificial Sequence
  Synthetic
atacgccatgctgggtctccccttactgtcctagccacagccacacctcctgggtcggtcaccgtcccccatccaaacatcacagagatcgctctacctactacaggggagatcccattccgtacttgggagtcggccat

SEQ ID NO: 395038 - DNA, 140 bp, Artificial Sequence
  Synthetic
atggccgactcccaagtacggaatgggatctcccctgtagtaggtagagcgatctctgtgatgtttggatgggggacggtgaccgacccaggaggtgtggctgtggctaggacagtaaggggagacccagcatggcgtat

SEQ ID NO: 395039 - DNA, 140 bp, Artificial Sequence
  Synthetic
aggccctggctgctgatatggtgccgtactttgtgcgcgctcaagggctcattcgtgcatgcttgttagtgcggaaagtcgctgggggccattatgtccaaatggctttcatgaggctgggaccttttgggacagcggtg

SEQ ID NO: 395040 - DNA, 140 bp, Artificial Sequence
  Synthetic
caccgctgtcccaaaaggtcccagcctcatgaaagccatttggacataatggcccccagcgactttccgcactaacaagcatgcacgaatgagcccttgagcgcgcacaaagtacggcaccatatcagcagccagggcct

SEQ ID NO: 395041 - DNA, 140 bp, Artificial Sequence
  Synthetic
aggccctggctgctgatatggcggaaagtcgctgggggccattatgtccaaatggctttcatgaggctggccgcactgacgggtacgtacgtttatgaccatcttactccactgcaggacgaccttttgggacagcggtg

SEQ ID NO: 395042 - DNA, 140 bp, Artificial Sequence
  Synthetic
caccgctgtcccaaaaggtcgtcctgcagtggagtaagatggtcataaacgtacgtacccgtcagtgcggccagcctcatgaaagccatttggacataatggcccccagcgactttccgccatatcagcagccagggcct

SEQ ID NO: 395043 - DNA, 140 bp, Artificial Sequence
  Synthetic
aggccctggctgctgatatgcttctctgacatggagaccaagatcatcacctggggggcagacaccgcggcgtgcggggacatcatctcgggcctacctgtctccgcccgaagggggagggaccttttgggacagcggtg

SEQ ID NO: 395044 - DNA, 140 bp, Artificial Sequence
  Synthetic
caccgctgtcccaaaaggtccctcccccttcgggcggagacaggtaggcccgagatgatgtccccgcacgccgcggtgtctgccccccaggtgatgatcttggtctccatgtcagagaagcatatcagcagccagggcct

SEQ ID NO: 395045 - DNA, 140 bp, Artificial Sequence
  Synthetic
atacgccatgctgggtctccagtgcctcatacggctcaagcccgtattaacgggccctacccctctgttgtacagactgggagccgtgcaaaatgagatcactaccacgcatcctattaccgtacttgggagtcggccat

SEQ ID NO: 395046 - DNA, 140 bp, Artificial Sequence
  Synthetic
atggccgactcccaagtacggtaataggatgcgtggtagtgatctcattttgcacggctcccagtctgtacaacagaggggtagggcccgttaatacgggcttgagccgtatgaggcactggagacccagcatggcgtat

SEQ ID NO: 395047 - DNA, 140 bp, Artificial Sequence
  Synthetic
aggccctggctgctgatatggtcggctggcaggcgccccccggggcgcgttccttgacaccatgcacctgcggcagctcggacctttacttggtcacgaggcatgctgatgtcattccgggaccttttgggacagcggtg

SEQ ID NO: 395048 - DNA, 140 bp, Artificial Sequence
  Synthetic
caccgctgtcccaaaaggtcccggaatgacatcagcatgcctcgtgaccaagtaaaggtccgagctgccgcaggtgcatggtgtcaaggaacgcgccccggggggcgcctgccagccgaccatatcagcagccagggcct

SEQ ID NO: 395049 - DNA, 140 bp, Artificial Sequence
  Synthetic
atacgccatgctgggtctcccggccctgcccatttgggcacggccggactacaaccccccgttgttggagacgtggaaaaagccggactacgaaccacctgtggtccatggctgcccactcgtacttgggagtcggccat

SEQ ID NO: 395050 - DNA, 140 bp, Artificial Sequence
  Synthetic
atggccgactcccaagtacgagtgggcagccatggaccacaggtggttcgtagtccggctttttccacgtctccaacaacggggggttgtagtccggccgtgcccaaatgggcagggccgggagacccagcatggcgtat

SEQ ID NO: 395051 - DNA, 140 bp, Artificial Sequence
  Synthetic
aggccctggctgctgatatgacgtggaaaaagccggactacgaaccacctgtggtccatggctgcccacttccacctccacagtcccctcctgtgcctccgccccggaagaagcggacgggaccttttgggacagcggtg

SEQ ID NO: 395052 - DNA, 140 bp, Artificial Sequence
  Synthetic
caccgctgtcccaaaaggtcccgtccgcttcttccggggcggaggcacaggaggggactgtggaggtggaagtgggcagccatggaccacaggtggttcgtagtccggctttttccacgtcatatcagcagccagggcct

SEQ ID NO: 395053 - DNA, 140 bp, Artificial Sequence
  Synthetic
atacgccatgctgggtctcctcaacatactgggggggtgggtagcatcccaactagcgccgccaacagcatcgacagcatttgtcgtaagcggcattgctggtgccaccgtcggtagcatcgtacttgggagtcggccat

SEQ ID NO: 395054 - DNA, 140 bp, Artificial Sequence
  Synthetic
atggccgactcccaagtacgatgctaccgacggtggcaccagcaatgccgcttacgacaaatgctgtcgatgctgttggcggcgctagttgggatgctacccacccccccagtatgttgaggagacccagcatggcgtat

SEQ ID NO: 395055 - DNA, 140 bp, Artificial Sequence
  Synthetic
aggccctggctgctgatatgtcgacagcatttgtcgtaagcggcattgctggtgccaccgtcggtagcattgggttgggtagggtcattgttgacatcctagcagggtatggagcaggtggaccttttgggacagcggtg

SEQ ID NO: 395056 - DNA, 140 bp, Artificial Sequence
  Synthetic
caccgctgtcccaaaaggtccacctgctccataccctgctaggatgtcaacaatgaccctacccaacccaatgctaccgacggtggcaccagcaatgccgcttacgacaaatgctgtcgacatatcagcagccagggcct

SEQ ID NO: 395057 - DNA, 140 bp, Artificial Sequence
  Synthetic
  misc_feature (84)..(84): n is a, c, g, or t
atacgccatgctgggtctccggtagtgggcgcggtatgcgctgccgtcctgaggcgccacataggaccatcagaaggcgccgcncagtggatgaacaggctcatagcgtttgcgtcgcggcgtacttgggagtcggccat

SEQ ID NO: 395058 - DNA, 140 bp, Artificial Sequence
  Synthetic
  misc_feature (57)..(57): n is a, c, g, or t
atggccgactcccaagtacgccgcgacgcaaacgctatgagcctgttcatccactgngcggcgccttctgatggtcctatgtggcgcctcaggacggcagcgcataccgcgcccactaccggagacccagcatggcgtat

SEQ ID NO: 395059 - DNA, 140 bp, Artificial Sequence
  Synthetic
  misc_feature (118)..(118): n is a, c, g, or t
atacgccatgctgggtctccgactccacaattggatcaacggggattggacaacaccatgcgccacaagctggctgagggacgtgtgggactgggtgtgtatggttctatctgacttnaacgtacttgggagtcggccat

SEQ ID NO: 395060 - DNA, 140 bp, Artificial Sequence
  Synthetic
  misc_feature (23)..(23): n is a, c, g, or t
atggccgactcccaagtacgttnaagtcagatagaaccatacacacccagtcccacacgtccctcagccagcttgtggcgcatggtgttgtccaatccccgttgatccaattgtggagtcggagacccagcatggcgtat

SEQ ID NO: 395061 - DNA, 140 bp, Artificial Sequence
  Synthetic
atacgccatgctgggtctccgacttggctcaaggcaaagcttatgccctccctaccgggtatccccttcctctcatgccagaggggttttaggggtacttggcgtggtgacggcgtgtgccgtacttgggagtcggccat

SEQ ID NO: 395062 - DNA, 140 bp, Artificial Sequence
  Synthetic
atggccgactcccaagtacggcacacgccgtcaccacgccaagtacccctaaaacccctctggcatgagaggaaggggatacccggtagggagggcataagctttgccttgagccaagtcggagacccagcatggcgtat

SEQ ID NO: 395063 - DNA, 140 bp, Artificial Sequence
  Synthetic
atacgccatgctgggtctcccgttccccataaacgccacaacaactggccctagcgtacccatcccggagcccaattacaaaagggctttgtggagggtgtccgcagaggactatgttgacgtacttgggagtcggccat

SEQ ID NO: 395064 - DNA, 140 bp, Artificial Sequence
  Synthetic
atggccgactcccaagtacgtcaacatagtcctctgcggacaccctccacaaagcccttttgtaattgggctccgggatgggtacgctagggccagttgttgtggcgtttatggggaacgggagacccagcatggcgtat

SEQ ID NO: 395065 - DNA, 140 bp, Artificial Sequence
  Synthetic
atacgccatgctgggtctccacctcaagtgcccatgtcaagtgccggcacccgagtttttcacggaagttgacggagtgagactgcacaggtacgcacctgcatgcggccccctcttgagcgtacttgggagtcggccat

SEQ ID NO: 395066 - DNA, 140 bp, Artificial Sequence
  Synthetic
atggccgactcccaagtacgctcaagagggggccgcatgcaggtgcgtacctgtgcagtctcactccgtcaacttccgtgaaaaactcgggtgccggcacttgacatgggcacttgaggtggagacccagcatggcgtat

SEQ ID NO: 395067 - DNA, 140 bp, Artificial Sequence
  Synthetic
atacgccatgctgggtctcctctgatccaacacacataaccgcagaaacggcgggtcgacgcctcgcgaggggctcccctccgtcgctggctagctcctcagctagtcagctttctgcgccgtacttgggagtcggccat

SEQ ID NO: 395068 - DNA, 140 bp, Artificial Sequence
  Synthetic
atggccgactcccaagtacggcgcagaaagctgactagctgaggagctagccagcgacggaggggagcccctcgcgaggcgtcgacccgccgtttctgcggttatgtgtgttggatcagaggagacccagcatggcgtat

SEQ ID NO: 395069 - DNA, 140 bp, Artificial Sequence
  Synthetic
atacgccatgctgggtctccgagagtcgagtctgagaacaaggtcatagtcctcgactccttcgacccgctagtggccgaagcggacgacagggaaatatcagtggcagcggaatgtcaccgtacttgggagtcggccat

SEQ ID NO: 395070 - DNA, 140 bp, Artificial Sequence
  Synthetic
atggccgactcccaagtacggtgacattccgctgccactgatatttccctgtcgtccgcttcggccactagcgggtcgaaggagtcgaggactatgaccttgttctcagactcgactctcggagacccagcatggcgtat

SEQ ID NO: 395071 - DNA, 140 bp, Artificial Sequence
  Synthetic
atacgccatgctgggtctccttcaaagactccatggccttagcgcgttctctctccacagttactctccaggtgaaatcaatagggtggccgcatgcctcaggaaacttggggtcccgcccgtacttgggagtcggccat

SEQ ID NO: 395072 - DNA, 140 bp, Artificial Sequence
  Synthetic
atggccgactcccaagtacgggcgggaccccaagtttcctgaggcatgcggccaccctattgatttcacctggagagtaactgtggagagagaacgcgctaaggccatggagtctttgaaggagacccagcatggcgtat

SEQ ID NO: 395073 - DNA, 140 bp, Artificial Sequence
  Synthetic
atacgccatgctgggtctcccccccaccgtgtcgggatgcgcgctccccccaaaagggttgccgcccgtacctccgcctcggcggaagaaggtcgtacagctcgacgaatccgcagccgccgtacttgggagtcggccat

SEQ ID NO: 395074 - DNA, 140 bp, Artificial Sequence
  Synthetic
atggccgactcccaagtacggcggctgcggattcgtcgagctgtacgaccttcttccgccgaggcggaggtacgggcggcaacccttttggggggagcgcgcatcccgacacggtgggggggagacccagcatggcgtat

SEQ ID NO: 395075 - DNA, 140 bp, Artificial Sequence
  Synthetic
atacgccatgctgggtctccccagtctctgatgggccagactcggagtctgatgctggttcatacagttctatgccccccctcgagggtgagcctggagatcccgatctaagttcggggtcgtacttgggagtcggccat

SEQ ID NO: 395076 - DNA, 140 bp, Artificial Sequence
  Synthetic
atggccgactcccaagtacgaccccgaacttagatcgggatctccaggctcaccctcgagggggggcatagaactgtatgaaccagcatcagactccgagtctggcccatcagagactggggagacccagcatggcgtat

SEQ ID NO: 395077 - DNA, 140 bp, Artificial Sequence
  Synthetic
atacgccatgctgggtctccgaagctgcccatcagtccactgagcaactctctcatcagacaccacaacatggtgtactcaaccaccactcgcagcgcagccctccgccaaaagaaggtgcgtacttgggagtcggccat

SEQ ID NO: 395078 - DNA, 140 bp, Artificial Sequence
  Synthetic
atggccgactcccaagtacgcaccttcttttggcggagggctgcgctgcgagtggtggttgagtacaccatgttgtggtgtctgatgagagagttgctcagtggactgatgggcagcttcggagacccagcatggcgtat

SEQ ID NO: 395079 - DNA, 140 bp, Artificial Sequence
  Synthetic
aggccctggctgctgatatgtggtgtactcaaccaccactcgcagcgcagccctccgccaaaagaaggtgacatttcacagggtccagctgttggatcagcactaccaagatgtacttaagaccttttgggacagcggtg

SEQ ID NO: 395080 - DNA, 140 bp, Artificial Sequence
  Synthetic
caccgctgtcccaaaaggtcttaagtacatcttggtagtgctgatccaacagctggaccctgtgaaatgtcaccttcttttggcggagggctgcgctgcgagtggtggttgagtacaccacatatcagcagccagggcct

SEQ ID NO: 395081 - DNA, 140 bp, Artificial Sequence
  Synthetic
atacgccatgctgggtctcctacggggctaaagaggtccgaagccttgccagtaaggccgtgaaccacatcaactccgtgtgggaggacttgctggaagacaactctacacctatccctacgtacttgggagtcggccat

SEQ ID NO: 395082 - DNA, 140 bp, Artificial Sequence
  Synthetic
atggccgactcccaagtacgtagggataggtgtagagttgtcttccagcaagtcctcccacacggagttgatgtggttcacggccttactggcaaggcttcggacctctttagccccgtaggagacccagcatggcgtat

SEQ ID NO: 395083 - DNA, 140 bp, Artificial Sequence
  Synthetic
aggccctggctgctgatatgcaactccgtgtgggaggacttgctggaagacaactctacacctatccctacaactatcatggctaagaatgaagtgttctgtgtggacgcccggaaaggtgaccttttgggacagcggtg

SEQ ID NO: 395084 - DNA, 140 bp, Artificial Sequence
  Synthetic
caccgctgtcccaaaaggtcacctttccgggcgtccacacagaacacttcattcttagccatgatagttgtagggataggtgtagagttgtcttccagcaagtcctcccacacggagttgcatatcagcagccagggcct

SEQ ID NO: 395085 - DNA, 140 bp, Artificial Sequence
  Synthetic
atacgccatgctgggtctcctaatgggggccgcttatggtttccaatactcgccaaagcagcgcgtggaccaccttctccggatgtggcgctccaagaagacccctatggggttctcctacgtacttgggagtcggccat

SEQ ID NO: 395086 - DNA, 140 bp, Artificial Sequence
  Synthetic
atggccgactcccaagtacgtaggagaaccccataggggtcttcttggagcgccacatccggagaaggtggtccacgcgctgctttggcgagtattggaaaccataagcggcccccattaggagacccagcatggcgtat

SEQ ID NO: 395087 - DNA, 140 bp, Artificial Sequence
  Synthetic
atacgccatgctgggtctcctgacaccaggtgttttgactcaacagtcacagagcgcgacatccagacggagcatgacatctaccagtgctgccagttggagcccgcagcacggacagcccgtacttgggagtcggccat

SEQ ID NO: 395088 - DNA, 140 bp, Artificial Sequence
  Synthetic
atggccgactcccaagtacgggctgtccgtgctgcgggctccaactggcagcactggtagatgtcatgctccgtctggatgtcgcgctctgtgactgttgagtcaaaacacctggtgtcaggagacccagcatggcgtat

SEQ ID NO: 395089 - DNA, 140 bp, Artificial Sequence
  Synthetic
atacgccatgctgggtctccctaccagcctgggcaatactctgacttgctacttgaaagctcaagcggcatgcagggctgctgggctgaaggactttgacatgttggtctgcggagacgacgtacttgggagtcggccat

SEQ ID NO: 395090 - DNA, 140 bp, Artificial Sequence
  Synthetic
atggccgactcccaagtacgtcgtctccgcagaccaacatgtcaaagtccttcagcccagcagccctgcatgccgcttgagctttcaagtagcaagtcagagtattgcccaggctggtagggagacccagcatggcgtat

SEQ ID NO: 395091 - DNA, 140 bp, Artificial Sequence
  Synthetic
aggccctggctgctgatatgtgcagggctgctgggctgaaggactttgacatgttggtctgcggagacgaccttgtcgttatttcggagagtctgggggtctcggaggacgctagtgcacgaccttttgggacagcggtg

SEQ ID NO: 395092 - DNA, 140 bp, Artificial Sequence
  Synthetic
caccgctgtcccaaaaggtcgtgcactagcgtcctccgagacccccagactctccgaaataacgacaaggtcgtctccgcagaccaacatgtcaaagtccttcagcccagcagccctgcacatatcagcagccagggcct

SEQ ID NO: 395093 - DNA, 140 bp, Artificial Sequence
  Synthetic
atacgccatgctgggtctccgagcccagccccacatacgacctagagcttataacatcatgctcatccaacgtttccgtggcccacgatggagatggcagaagatactactacctcactccgtacttgggagtcggccat

SEQ ID NO: 395094 - DNA, 140 bp, Artificial Sequence
  Synthetic
atggccgactcccaagtacggagtgaggtagtagtatcttctgccatctccatcgtgggccacggaaacgttggatgagcatgatgttataagctctaggtcgtatgtggggctgggctcggagacccagcatggcgtat

SEQ ID NO: 395095 - DNA, 140 bp, Artificial Sequence
  Synthetic
atacgccatgctgggtctccgtgaccctatcactccactggcgagggcggcatgggagaccgctcgccatactcctgtgaattcatggttagggaacatcatcatgtatgctcccgccatcgtacttgggagtcggccat

SEQ ID NO: 395096 - DNA, 140 bp, Artificial Sequence
  Synthetic
atggccgactcccaagtacgatggcgggagcatacatgatgatgttccctaaccatgaattcacaggagtatggcgagcggtctcccatgccgccctcgccagtggagtgatagggtcacggagacccagcatggcgtat

SEQ ID NO: 395097 - DNA, 140 bp, Artificial Sequence
  Synthetic
atacgccatgctgggtctcctcagtcactccgcttgatctcccagtgatcatccaaagactccacggcatggccgcattttcactccatgggtactctcccggcgaactcaatcgggtggcgtacttgggagtcggccat

SEQ ID NO: 395098 - DNA, 140 bp, Artificial Sequence
  Synthetic
atggccgactcccaagtacgccacccgattgagttcgccgggagagtacccatggagtgaaaatgcggccatgccgtggagtctttggatgatcactgggagatcaagcggagtgactgaggagacccagcatggcgtat

SEQ ID NO: 395099 - DNA, 140 bp, Artificial Sequence
  Synthetic
aggccctggctgctgatatgggccgcattttcactccatgggtactctcccggcgaactcaatcgggtggcatcatgcctcaggaaacttggggctccccccttgagagcttggagacacgaccttttgggacagcggtg

SEQ ID NO: 395100 - DNA, 140 bp, Artificial Sequence
  Synthetic
caccgctgtcccaaaaggtcgtgtctccaagctctcaaggggggagccccaagtttcctgaggcatgatgccacccgattgagttcgccgggagagtacccatggagtgaaaatgcggcccatatcagcagccagggcct

SEQ ID NO: 395101 - DNA, 140 bp, Artificial Sequence
  Synthetic
aggccctggctgctgatatggcatccggaagccacatactctcggtgcggctccggtccctggattacacccaggtgcttggtcaactacccgtataggctttggcattatccttgtaccgaccttttgggacagcggtg

SEQ ID NO: 395102 - DNA, 140 bp, Artificial Sequence
  Synthetic
caccgctgtcccaaaaggtcggtacaaggataatgccaaagcctatacgggtagttgaccaagcacctgggtgtaatccagggaccggagccgcaccgagagtatgtggcttccggatgccatatcagcagccagggcct

SEQ ID NO: 395103 - DNA, 140 bp, Artificial Sequence
  Synthetic
aggccctggctgctgatatgtcaggctacggcgggggggacgtatatcacagcgcgtcccgggctcgcccccgctttatactcctgtgcctactcctacttaccgtaggggtaggcatctgaccttttgggacagcggtg

SEQ ID NO: 395104 - DNA, 140 bp, Artificial Sequence
  Synthetic
caccgctgtcccaaaaggtcagatgcctacccctacggtaagtaggagtaggcacaggagtataaagcgggggcgagcccgggacgcgctgtgatatacgtcccccccgccgtagcctgacatatcagcagccagggcct

SEQ ID NO: 395105 - DNA, 140 bp, Artificial Sequence
  Synthetic
aggccctggctgctgatatgacaacatcccgcagcgcaagccagcggcagaagaaggtcacctttgacagactgcaagtcctggacgaccattaccgggacgtgctcaaggagatgaagggaccttttgggacagcggtg

SEQ ID NO: 395106 - DNA, 140 bp, Artificial Sequence
  Synthetic
caccgctgtcccaaaaggtcccttcatctccttgagcacgtcccggtaatggtcgtccaggacttgcagtctgtcaaaggtgaccttcttctgccgctggcttgcgctgcgggatgttgtcatatcagcagccagggcct

SEQ ID NO: 395107 - DNA, 140 bp, Artificial Sequence
  Synthetic
  misc_feature (61)..(61): n is a, c, g, or t
aggccctggctgctgatatggggagaatgagactgatgtcttccttttgaactcgaccagnccgccacgtggtgcgtggttcgggtgcgtatggatgaacagcaccgggtttacaaagacgaccttttgggacagcggtg

SEQ ID NO: 395108 - DNA, 140 bp, Artificial Sequence
  Synthetic
  misc_feature (80)..(80): n is a, c, g, or t
caccgctgtcccaaaaggtcgtctttgtaaacccggtgctgttcatccatacgcacccgaaccacgcaccacgtggcggnctggtcgagttcaaaaggaagacatcagtctcattctccccatatcagcagccagggcct

SEQ ID NO: 395109 - DNA, 140 bp, Artificial Sequence
  Synthetic
aggccctggctgctgatatgccaccacctcacgcagtgcttgccaaaggcagaagaaagtcacatttgacagactgcaggttctggacagccactaccaggacgtgctcaaggaggttaagaccttttgggacagcggtg

SEQ ID NO: 395110 - DNA, 140 bp, Artificial Sequence
  Synthetic
caccgctgtcccaaaaggtcttaacctccttgagcacgtcctggtagtggctgtccagaacctgcagtctgtcaaatgtgactttcttctgcctttggcaagcactgcgtgaggtggtggcatatcagcagccagggcct

SEQ ID NO: 395111 - DNA, 140 bp, Artificial Sequence
  Synthetic
aggccctggctgctgatatggttcttgtcgggttaatggcgctgactctgtcaccatactacaagcgctatatcagctggtgcttatggtggcttcagtatttcctgaccagagtagaaggaccttttgggacagcggtg

SEQ ID NO: 395112 - DNA, 140 bp, Artificial Sequence
  Synthetic
caccgctgtcccaaaaggtccttctactctggtcaggaaatactgaagccaccataagcaccagctgatatagcgcttgtagtatggtgacagagtcagcgccattaacccgacaagaaccatatcagcagccagggcct

SEQ ID NO: 395113 - DNA, 140 bp, Artificial Sequence
  Synthetic
atacgccatgctgggtctccattatgcaaccgggaatcttcctggttgctccttttctatctttcttctggcccttttctcatgtctcaccacacctgcttcggccctgaattacgccaacgtacttgggagtcggccat

SEQ ID NO: 395114 - DNA, 140 bp, Artificial Sequence
  Synthetic
atggccgactcccaagtacgttggcgtaattcagggccgaagcaggtgtggtgagacatgagaaaagggccagaagaaagatagaaaaggagcaaccaggaagattcccggttgcataatggagacccagcatggcgtat

SEQ ID NO: 395115 - DNA, 140 bp, Artificial Sequence
  Synthetic
atacgccatgctgggtctccgttaaggtcggtaaccggtccacctgctggctgccggcttcgcccacactggcgattccgaattcgtcaacgcctctcactgggttccgcaagcacgttgcgtacttgggagtcggccat

SEQ ID NO: 395116 - DNA, 140 bp, Artificial Sequence
  Synthetic
atggccgactcccaagtacgcaacgtgcttgcggaacccagtgagaggcgttgacgaattcggaatcgccagtgtgggcgaagccggcagccagcaggtggaccggttaccgaccttaacggagacccagcatggcgtat

SEQ ID NO: 395117 - DNA, 140 bp, Artificial Sequence
  Synthetic
atacgccatgctgggtctcccgtgcaccagactgtccaggagtgtaattgttccatctacacgggtagagtctctggccatcgtatggcgtgggatatgatgatgaactggtctccgacccgtacttgggagtcggccat

SEQ ID NO: 395118 - DNA, 140 bp, Artificial Sequence
  Synthetic
atggccgactcccaagtacgggtcggagaccagttcatcatcatatcccacgccatacgatggccagagactctacccgtgtagatggaacaattacactcctggacagtctggtgcacgggagacccagcatggcgtat

SEQ ID NO: 395119 - DNA, 140 bp, Artificial Sequence
  Synthetic
atacgccatgctgggtctccgcatggtagccaactgggccaaggtaattggcatcctccttttgttcgcgggggtggacgcgaccacgtactccactggagctatcgctggcggaaatgccgtacttgggagtcggccat

SEQ ID NO: 395120 - DNA, 140 bp, Artificial Sequence
  Synthetic
atggccgactcccaagtacggcatttccgccagcgatagctccagtggagtacgtggtcgcgtccacccccgcgaacaaaaggaggatgccaattaccttggcccagttggctaccatgcggagacccagcatggcgtat

SEQ ID NO: 395121 - DNA, 140 bp, Artificial Sequence
  Synthetic
aggccctggctgctgatatgggccttgcctactattccatggtggggaactgggctaaggtgttgattgtgatgctactttttgccggcgttgacgggaagacccgcgtgacaggggggagaccttttgggacagcggtg

SEQ ID NO: 395122 - DNA, 140 bp, Artificial Sequence
  Synthetic
caccgctgtcccaaaaggtctcccccctgtcacgcgggtcttcccgtcaacgccggcaaaaagtagcatcacaatcaacaccttagcccagttccccaccatggaatagtaggcaaggcccatatcagcagccagggcct

SEQ ID NO: 395123 - DNA, 140 bp, Artificial Sequence
  Synthetic
atacgccatgctgggtctccgatgctactttttgccggcgttgacgggaagacccgcgtgacaggggggacggcagcctacaccaccaactcgctcacgaacctcttcacccgtggggcgcgtacttgggagtcggccat

SEQ ID NO: 395124 - DNA, 140 bp, Artificial Sequence
  Synthetic
atggccgactcccaagtacgcgccccacgggtgaagaggttcgtgagcgagttggtggtgtaggctgccgtcccccctgtcacgcgggtcttcccgtcaacgccggcaaaaagtagcatcggagacccagcatggcgtat

SEQ ID NO: 395125 - DNA, 140 bp, Artificial Sequence
  Synthetic
atacgccatgctgggtctccaatgacactttgcagactggattcatagctgccctgttttatgtgcaccatttcaactctacaggatgcccagagcggatgtcgtcatgcaagcccctcacgtacttgggagtcggccat

SEQ ID NO: 395126 - DNA, 140 bp, Artificial Sequence
  Synthetic
atggccgactcccaagtacgtgaggggcttgcatgacgacatccgctctgggcatcctgtagagttgaaatggtgcacataaaacagggcagctatgaatccagtctgcaaagtgtcattggagacccagcatggcgtat

SEQ ID NO: 395127 - DNA, 140 bp, Artificial Sequence
  Synthetic
atacgccatgctgggtctccaattgtgccagcctcgcaggtatgtggtcccgtctactgctttacaccaagccccgtggtcatagggactacggataagacggggctaccaacctacacccgtacttgggagtcggccat

SEQ ID NO: 395128 - DNA, 140 bp, Artificial Sequence
  Synthetic
atggccgactcccaagtacgggtgtaggttggtagccccgtcttatccgtagtccctatgaccacggggcttggtgtaaagcagtagacgggaccacatacctgcgaggctggcacaattggagacccagcatggcgtat

SEQ ID NO: 395129 - DNA, 140 bp, Artificial Sequence
  Synthetic
atacgccatgctgggtctccagacgtgcggtgctcctccatgcaacataaggtctgggtctaacagtaacaccaccttggtttgccccaccgactgcttccggaagcacccagagacaaccgtacttgggagtcggccat

SEQ ID NO: 395130 - DNA, 140 bp, Artificial Sequence
  Synthetic
atggccgactcccaagtacggttgtctctgggtgcttccggaagcagtcggtggggcaaaccaaggtggtgttactgttagacccagaccttatgttgcatggaggagcaccgcacgtctggagacccagcatggcgtat

SEQ ID NO: 395131 - DNA, 140 bp, Artificial Sequence
  Synthetic
atacgccatgctgggtctcccacaaagttcgcatgttcatagggggcttggaacatcggttcaacgccgcctgcaactggactcgtggggacccctgtaacctggaagatcgtggcagggcgtacttgggagtcggccat

SEQ ID NO: 395132 - DNA, 140 bp, Artificial Sequence
  Synthetic
atggccgactcccaagtacgccctgccacgatcttccaggttacaggggtccccacgagtccagttgcaggcggcgttgaaccgatgttccaagccccctatgaacatgcgaactttgtgggagacccagcatggcgtat

SEQ ID NO: 395133 - DNA, 140 bp, Artificial Sequence
  Synthetic
aggccctggctgctgatatgctgctgggtagcgctcactcccacgctcgcggccaggaacgccagcgtccccactacgacaatacgacgccacgtcgatttgctcgttggggcggctgctgaccttttgggacagcggtg

SEQ ID NO: 395134 - DNA, 140 bp, Artificial Sequence
  Synthetic
caccgctgtcccaaaaggtcagcagccgccccaacgagcaaatcgacgtggcgtcgtattgtcgtagtggggacgctggcgttcctggccgcgagcgtgggagtgagcgctacccagcagcatatcagcagccagggcct

SEQ ID NO: 395135 - DNA, 140 bp, Artificial Sequence
  Synthetic
atacgccatgctgggtctccccagaacatagtggacgtccagtacctctatgggataactccagcactcacatcgctggtcatcagatgggagtatgtggtgcttgccttcttgttgttgcgtacttgggagtcggccat

SEQ ID NO: 395136 - DNA, 140 bp, Artificial Sequence
  Synthetic
atggccgactcccaagtacgcaacaacaagaaggcaagcaccacatactcccatctgatgaccagcgatgtgagtgctggagttatcccatagaggtactggacgtccactatgttctggggagacccagcatggcgtat

SEQ ID NO: 395137 - DNA, 140 bp, Artificial Sequence
  Synthetic
atacgccatgctgggtctccctggttcacacgggttgggatggtgtctcgtcttcctgtgctgtgcttggtatgtcaagggtcgcttagttcccgctgctacttacgggcttctgcagttcgtacttgggagtcggccat

SEQ ID NO: 395138 - DNA, 140 bp, Artificial Sequence
  Synthetic
atggccgactcccaagtacgaactgcagaagcccgtaagtagcagcgggaactaagcgacccttgacataccaagcacagcacaggaagacgagacaccatcccaacccgtgtgaaccagggagacccagcatggcgtat

SEQ ID NO: 395139 - DNA, 140 bp, Artificial Sequence
  Synthetic
aggccctggctgctgatatggagtcctggcgggccttgcctactattccatggtggggaactgggctaaggttctgattgtgatgctactctttgccggcgttgacggggacacctacacgaccttttgggacagcggtg

SEQ ID NO: 395140 - DNA, 140 bp, Artificial Sequence
  Synthetic
caccgctgtcccaaaaggtcgtgtaggtgtccccgtcaacgccggcaaagagtagcatcacaatcagaaccttagcccagttccccaccatggaatagtaggcaaggcccgccaggactccatatcagcagccagggcct

SEQ ID NO: 395141 - DNA, 140 bp, Artificial Sequence
  Synthetic
atacgccatgctgggtctccaccatcttcacgctcacaccacactataagtggatgctcgtccagttgttgtggtggtgtcagtatttcatagcccgaatagaggcaacactggggatctcgtacttgggagtcggccat

SEQ ID NO: 395142 - DNA, 140 bp, Artificial Sequence
  Synthetic
atggccgactcccaagtacgagatccccagtgttgcctctattcgggctatgaaatactgacaccaccacaacaactggacgagcatccacttatagtgtggtgtgagcgtgaagatggtggagacccagcatggcgtat

SEQ ID NO: 395143 - DNA, 140 bp, Artificial Sequence
  Synthetic
atacgccatgctgggtctccggcgctcattggtccgctctatctcctacaggccagccttctgcaagtaccgtactatgtgcgggcacatgctttgttgcgagcctgcttgctcgtacggcgtacttgggagtcggccat

SEQ ID NO: 395144 - DNA, 140 bp, Artificial Sequence
  Synthetic
atggccgactcccaagtacgccgtacgagcaagcaggctcgcaacaaagcatgtgcccgcacatagtacggtacttgcagaaggctggcctgtaggagatagagcggaccaatgagcgccggagacccagcatggcgtat

SEQ ID NO: 395145 - DNA, 140 bp, Artificial Sequence
  Synthetic
atacgccatgctgggtctccaaagtgccgtacttcgtacgcgcacaagggctcattcgtgcatgcatgttggtgcggaaagcggctgggggtcattatatccaaatggccctcatgaagccgtacttgggagtcggccat

SEQ ID NO: 395146 - DNA, 140 bp, Artificial Sequence
  Synthetic
atggccgactcccaagtacggcttcatgagggccatttggatataatgacccccagccgctttccgcaccaacatgcatgcacgaatgagcccttgtgcgcgtacgaagtacggcactttggagacccagcatggcgtat

SEQ ID NO: 395147 - DNA, 140 bp, Artificial Sequence
  Synthetic
atacgccatgctgggtctccctagcgaaggactgcgtgatctcgccgtggccgtggagccaattgtgttctcgcctatggagaagaaggttatcacctggggggcggacacagctgcatgcgtacttgggagtcggccat

SEQ ID NO: 395148 - DNA, 140 bp, Artificial Sequence
  Synthetic
atggccgactcccaagtacgcatgcagctgtgtccgccccccaggtgataaccttcttctccataggcgagaacacaattggctccacggccacggcgagatcacgcagtccttcgctagggagacccagcatggcgtat

SEQ ID NO: 395149 - DNA, 140 bp, Artificial Sequence
  Synthetic
aggccctggctgctgatatggcttctcaacaacacgcggccgccgcaaggcaactggttcggctgtacatggatgaatagcactgggttcaccaagacgtgtgggggccccccgtgtaacgaccttttgggacagcggtg

SEQ ID NO: 395150 - DNA, 140 bp, Artificial Sequence
  Synthetic
caccgctgtcccaaaaggtcgttacacggggggcccccacacgtcttggtgaacccagtgctattcatccatgtacagccgaaccagttgccttgcggcggccgcgtgttgttgagaagccatatcagcagccagggcct

SEQ ID NO: 395151 - DNA, 140 bp, Artificial Sequence
  Synthetic
aggccctggctgctgatatgggatgaatagcactgggttcaccaagacgtgtgggggccccccgtgtaacatcgggggggtcggcaacaacaccttgacctgccccacggactgcttccggaccttttgggacagcggtg

SEQ ID NO: 395152 - DNA, 140 bp, Artificial Sequence
  Synthetic
caccgctgtcccaaaaggtccggaagcagtccgtggggcaggtcaaggtgttgttgccgacccccccgatgttacacggggggcccccacacgtcttggtgaacccagtgctattcatcccatatcagcagccagggcct

SEQ ID NO: 395153 - DNA, 140 bp, Artificial Sequence
  Synthetic
atacgccatgctgggtctccgcccccatcaccgcatatcatcagaaaacccgcggtctactgggaacgatagtcaccagtttgactggcagggacaaaaatgaggttgagggcgaggttccgtacttgggagtcggccat

SEQ ID NO: 395154 - DNA, 140 bp, Artificial Sequence
  Synthetic
atggccgactcccaagtacggaacctcgccctcaacctcatttttgtccctgccagtcaaactggtgactatcgttcccagtagaccgcgggttttctgatgatatgcggtgatgggggcggagacccagcatggcgtat

SEQ ID NO: 395155 - DNA, 140 bp, Artificial Sequence
  Synthetic
aggccctggctgctgatatgagccccgtggtggtaggaacgaccgacaggtcgggccaggccacctacagctggggtgagaaagagaccgacgtcttcgtccttaacaacaccaggccgcgaccttttgggacagcggtg

SEQ ID NO: 395156 - DNA, 140 bp, Artificial Sequence
  Synthetic
caccgctgtcccaaaaggtcgcggcctggtgttgttaaggacgaagacgtcggtctctttctcaccccagctgtaggtggcctggcccgacctgtcggtcgttcctaccaccacggggctcatatcagcagccagggcct

SEQ ID NO: 395157 - DNA, 140 bp, Artificial Sequence
  Synthetic
atacgccatgctgggtctcccaaaggccccgtctgccagatgtacaccaatgttgaccaagaccttgtggggtggccggctcctccgggcgctaagtcattgacgccatgcacctgcggccgtacttgggagtcggccat

SEQ ID NO: 395158 - DNA, 140 bp, Artificial Sequence
  Synthetic
atggccgactcccaagtacggccgcaggtgcatggcgtcaatgacttagcgcccggaggagccggccaccccacaaggtcttggtcaacattggtgtacatctggcagacggggcctttgggagacccagcatggcgtat

SEQ ID NO: 395159 - DNA, 140 bp, Artificial Sequence
  Synthetic
atacgccatgctgggtctccctctcaagggttcttccggcggccctgtgatgtgcccggcaggtcatgctgtcgggctattccgtgccgctgtttgcaccaggggagtcgccaaagcaatcgtacttgggagtcggccat

SEQ ID NO: 395160 - DNA, 140 bp, Artificial Sequence
  Synthetic
atggccgactcccaagtacgattgctttggcgactcccctggtgcaaacagcggcacggaatagcccgacagcatgacctgccgggcacatcacagggccgccggaagaacccttgagagggagacccagcatggcgtat

SEQ ID NO: 395161 - DNA, 140 bp, Artificial Sequence
  Synthetic
atacgccatgctgggtctcctatctccatgctccaacgggcagcgggaagagcacgaaggtcccggccgcgtacgcctcgcaaggctacaaggtgctggtgctcaatccatcagtggctgcgtacttgggagtcggccat

SEQ ID NO: 395162 - DNA, 140 bp, Artificial Sequence
  Synthetic
atggccgactcccaagtacgcagccactgatggattgagcaccagcaccttgtagccttgcgaggcgtacgcggccgggaccttcgtgctcttcccgctgcccgttggagcatggagataggagacccagcatggcgtat

SEQ ID NO: 395163 - DNA, 140 bp, Artificial Sequence
  Synthetic
atacgccatgctgggtctccctctacttatggcaagtttctggctgacggtggatgctctggaggggcgtatgatgttatcatatgtgacgagtgccactccacggaccctacaacgatccgtacttgggagtcggccat

SEQ ID NO: 395164 - DNA, 140 bp, Artificial Sequence
  Synthetic
atggccgactcccaagtacggatcgttgtagggtccgtggagtggcactcgtcacatatgataacatcatacgcccctccagagcatccaccgtcagccagaaacttgccataagtagagggagacccagcatggcgtat

SEQ ID NO: 395165 - DNA, 140 bp, Artificial Sequence
  Synthetic
atacgccatgctgggtctcccgaacatttcagaggtcgcactgcctacaactggggaaatcccgttttacgggagagccattcccctcgagtacatcaagggtggtaggcatctcatcttcgtacttgggagtcggccat

SEQ ID NO: 395166 - DNA, 140 bp, Artificial Sequence
  Synthetic
atggccgactcccaagtacgaagatgagatgcctaccacccttgatgtactcgaggggaatggctctcccgtaaaacgggatttccccagttgtaggcagtgcgacctctgaaatgttcgggagacccagcatggcgtat

SEQ ID NO: 395167 - DNA, 140 bp, Artificial Sequence
  Synthetic
aggccctggctgctgatatgctccactgcgggactgggcccacgcgggcctacgagaccttgcggtggcagttgagcccgtcgtcttctctgacatggagaccaaggtcatcacctgggggaccttttgggacagcggtg

SEQ ID NO: 395168 - DNA, 140 bp, Artificial Sequence
  Synthetic
caccgctgtcccaaaaggtcccccaggtgatgaccttggtctccatgtcagagaagacgacgggctcaactgccaccgcaaggtctcgtaggcccgcgtgggcccagtcccgcagtggagcatatcagcagccagggcct

SEQ ID NO: 395169 - DNA, 140 bp, Artificial Sequence
  Synthetic
atacgccatgctgggtctcccccacccaaggggacgtggttatctgcgccactgacgccctcatgactggttttacaggtgatttcgactccgtcatagactgcaatgtaactgtgacgccgtacttgggagtcggccat

SEQ ID NO: 395170 - DNA, 140 bp, Artificial Sequence
  Synthetic
atggccgactcccaagtacggcgtcacagttacattgcagtctatgacggagtcgaaatcacctgtaaaaccagtcatgagggcgtcagtggcgcagataaccacgtccccttgggtgggggagacccagcatggcgtat

SEQ ID NO: 395171 - DNA, 140 bp, Artificial Sequence
  Synthetic
atacgccatgctgggtctccaggtaaacaggggatatatagatacgtgtcgcagggagaacgaccgtctgggatattcgattctgtcgtcctctgcgaggcatatgacacaggatgcgcgcgtacttgggagtcggccat

SEQ ID NO: 395172 - DNA, 140 bp, Artificial Sequence
  Synthetic
atggccgactcccaagtacgcgcgcatcctgtgtcatatgcctcgcagaggacgacagaatcgaatatcccagacggtcgttctccctgcgacacgtatctatatatcccctgtttacctggagacccagcatggcgtat

SEQ ID NO: 395173 - DNA, 140 bp, Artificial Sequence
  Synthetic
atacgccatgctgggtctccgagtttttactgggcttactcacatcgatgctcacttcctctcacagactaagcaaagcggggagaacttcgcgtacttgacggcctatcaggccacagtcgtacttgggagtcggccat

SEQ ID NO: 395174 - DNA, 140 bp, Artificial Sequence
  Synthetic
atggccgactcccaagtacgactgtggcctgataggccgtcaagtacgcgaagttctccccgctttgcttagtctgtgagaggaagtgagcatcgatgtgagtaagcccagtaaaaactcggagacccagcatggcgtat

SEQ ID NO: 395175 - DNA, 140 bp, Artificial Sequence
  Synthetic
aggccctggctgctgatatgcctcctgtgcctccgcctcggaagaagcggacggtggtcctcaccgaatcaaccgtatctactgccttggccgagcttgccaccaaaagttttggcagctgaccttttgggacagcggtg

SEQ ID NO: 395176 - DNA, 140 bp, Artificial Sequence
  Synthetic
caccgctgtcccaaaaggtcagctgccaaaacttttggtggcaagctcggccaaggcagtagatacggttgattcggtgaggaccaccgtccgcttcttccgaggcggaggcacaggaggcatatcagcagccagggcct

SEQ ID NO: 395177 - DNA, 140 bp, Artificial Sequence
  Synthetic
atacgccatgctgggtctccaggctgggggccgtgcaaaatgagatcaccactacacatcctatcacaaaatacatcatgacctgcatgtcggcggacctggaagtggtcaccagcacttcgtacttgggagtcggccat

SEQ ID NO: 395178 - DNA, 140 bp, Artificial Sequence
  Synthetic
atggccgactcccaagtacgaagtgctggtgaccacttccaggtccgccgacatgcaggtcatgatgtattttgtgataggatgtgtagtggtgatctcattttgcacggcccccagcctggagacccagcatggcgtat

SEQ ID NO: 395179 - DNA, 140 bp, Artificial Sequence
  Synthetic
atacgccatgctgggtctccagtgatgcccgatagggaggtattctaccaacagttcgacgagatggaagagtgctcacaacgcattccttatcttgttgaaggccaacaacttgccgagcgtacttgggagtcggccat

SEQ ID NO: 395180 - DNA, 140 bp, Artificial Sequence
  Synthetic
atggccgactcccaagtacgctcggcaagttgttggccttcaacaagataaggaatgcgttgtgagcactcttccatctcgtcgaactgttggtagaatacctccctatcgggcatcactggagacccagcatggcgtat

SEQ ID NO: 395181 - DNA, 140 bp, Artificial Sequence
  Synthetic
aggccctggctgctgatatgatggaagagtgtgcctcgcacctcccttacatcgagcagggaatgcagctcgccgagcaattcaaacagaaagcgctcgggttgctgcaaacagccaccagaccttttgggacagcggtg

SEQ ID NO: 395182 - DNA, 140 bp, Artificial Sequence
  Synthetic
caccgctgtcccaaaaggtctggtggctgtttgcagcaacccgagcgctttctgtttgaattgctcggcgagctgcattccctgctcgatgtaagggaggtgcgaggcacactcttccatcatatcagcagccagggcct

SEQ ID NO: 395183 - DNA, 140 bp, Artificial Sequence
  Synthetic
atacgccatgctgggtctcctctggcagaaacatctgtggaacttcgtcagcggaatacaatatcttgctggcctttccacactgcctggaaatccagcagtggcttctttgatgtctttcgtacttgggagtcggccat

SEQ ID NO: 395184 - DNA, 140 bp, Artificial Sequence
  Synthetic
atggccgactcccaagtacgaaagacatcaaagaagccactgctggatttccaggcagtgtggaaaggccagcaagatattgtattccgctgacgaagttccacagatgtttctgccagaggagacccagcatggcgtat

SEQ ID NO: 395185 - DNA, 140 bp, Artificial Sequence
  Synthetic
atacgccatgctgggtctccacagcttttgtcgtgagcggccttgctggtgctgctgtgggtagcgttggtttgggtaaagtcattgtcgacatactagcggggtacggggcaggtgtgtcgtacttgggagtcggccat

SEQ ID NO: 395186 - DNA, 140 bp, Artificial Sequence
  Synthetic
atggccgactcccaagtacgacacacctgccccgtaccccgctagtatgtcgacaatgactttacccaaaccaacgctacccacagcagcaccagcaaggccgctcacgacaaaagctgtggagacccagcatggcgtat

SEQ ID NO: 395187 - DNA, 140 bp, Artificial Sequence
  Synthetic
atacgccatgctgggtctccagtgggcgtagtttgcgctgccgttctaaggcgccacgtaggaccatcggagggcgccaatcaatggatgaaccggctcatagcgtttgcgtcgcggggccgtacttgggagtcggccat

SEQ ID NO: 395188 - DNA, 140 bp, Artificial Sequence
  Synthetic
atggccgactcccaagtacggccccgcgacgcaaacgctatgagccggttcatccattgattggcgccctccgatggtcctacgtggcgccttagaacggcagcgcaaactacgcccactggagacccagcatggcgtat

SEQ ID NO: 395189 - DNA, 140 bp, Artificial Sequence
  Synthetic
atacgccatgctgggtctcctccatgagtggatcaatggggattggacaacaccatgcgccctgagctggcttagggacgtttgggactgggtatgcacagtcttatctgacttcaagaccgtacttgggagtcggccat

SEQ ID NO: 395190 - DNA, 140 bp, Artificial Sequence
  Synthetic
atggccgactcccaagtacggtcttgaagtcagataagactgtgcatacccagtcccaaacgtccctaagccagctcagggcgcatggtgttgtccaatccccattgatccactcatggaggagacccagcatggcgtat

SEQ ID NO: 395191 - DNA, 140 bp, Artificial Sequence
  Synthetic
aggccctggctgctgatatgaggtcgtcacgagcacctgggtgctagtaggcggagtcctcgcagctctggccgcgtattgcctgacaacaggcagcgtggtcattgtgggcaggatcatgaccttttgggacagcggtg

SEQ ID NO: 395192 - DNA, 140 bp, Artificial Sequence
  Synthetic
caccgctgtcccaaaaggtcatgatcctgcccacaatgaccacgctgcctgttgtcaggcaatacgcggccagagctgcgaggactccgcctactagcacccaggtgctcgtgacgacctcatatcagcagccagggcct

SEQ ID NO: 395193 - DNA, 140 bp, Artificial Sequence
  Synthetic
atacgccatgctgggtctccccgcgtcaaggactgccattacgtagtgggggctactgctgacaatctgaaatgcccctgccaggtgcccgcacctgagttcttcacagaggtggatggccgtacttgggagtcggccat

SEQ ID NO: 395194 - DNA, 140 bp, Artificial Sequence
  Synthetic
atggccgactcccaagtacggccatccacctctgtgaagaactcaggtgcgggcacctggcaggggcatttcagattgtcagcagtagcccccactacgtaatggcagtccttgacgcggggagacccagcatggcgtat

SEQ ID NO: 395195 - DNA, 140 bp, Artificial Sequence
  Synthetic
atacgccatgctgggtctcccgtgtgagcccgagcctgacgagatgacacttacatccatgttgactgacccatcacacataacagcagagacggcaagacggcgtctcgcgagaggctccgtacttgggagtcggccat

SEQ ID NO: 395196 - DNA, 140 bp, Artificial Sequence
  Synthetic
atggccgactcccaagtacggagcctctcgcgagacgccgtcttgccgtctctgctgttatgtgtgatgggtcagtcaacatggatgtaagtgtcatctcgtcaggctcgggctcacacgggagacccagcatggcgtat

SEQ ID NO: 395197 - DNA, 140 bp, Artificial Sequence
  Synthetic
atacgccatgctgggtctccgctcctcccagcgctgcttctgctttcgtaggcgccggcatcgctggcgcggccgttggcagcataggccttgggaaggtgcttgtggacatcttggcggcgtacttgggagtcggccat

SEQ ID NO: 395198 - DNA, 140 bp, Artificial Sequence
  Synthetic
atggccgactcccaagtacgccgccaagatgtccacaagcaccttcccaaggcctatgctgccaacggccgcgccagcgatgccggcgcctacgaaagcagaagcagcgctgggaggagcggagacccagcatggcgtat

SEQ ID NO: 395199 - DNA, 140 bp, Artificial Sequence
  Synthetic
atacgccatgctgggtctccgaggccaacctcctatgggggaaggaactcgggggtaacataacaagagtcgagtctgagaacaagatcataatcctcgattcttttgacccactggttgcgtacttgggagtcggccat

SEQ ID NO: 395200 - DNA, 140 bp, Artificial Sequence
  Synthetic
atggccgactcccaagtacgcaaccagtgggtcaaaagaatcgaggattatgatcttgttctcagactcgactcttgttatgttacccccgagttccttcccccataggaggttggcctcggagacccagcatggcgtat

SEQ ID NO: 395201 - DNA, 140 bp, Artificial Sequence
  Synthetic
atacgccatgctgggtctcctaatccccctttaatagagacttggaaggctccggactacgaccctcccactgtgtcgggatgtgcgctccccccaaaggggctaccacccgtgcctccgcgtacttgggagtcggccat

SEQ ID NO: 395202 - DNA, 140 bp, Artificial Sequence
  Synthetic
atggccgactcccaagtacgcggaggcacgggtggtagcccctttggggggagcgcacatcccgacacagtgggagggtcgtagtccggagccttccaagtctctattaaagggggattaggagacccagcatggcgtat

SEQ ID NO: 395203 - DNA, 140 bp, Artificial Sequence
  Synthetic
atacgccatgctgggtctccgggaggagtcggggatgggaacctccgctccatctaccagtgagacaccaacttctggcgagcacgacgcacagtccgacgctggctcctacagctccatcgtacttgggagtcggccat

SEQ ID NO: 395204 - DNA, 140 bp, Artificial Sequence
  Synthetic
atggccgactcccaagtacgatggagctgtaggagccagcgtcggactgtgcgtcgtgctcgccagaagttggtgtctcactggtagatggagcggaggttcccatccccgactcctcccggagacccagcatggcgtat

SEQ ID NO: 395205 - DNA, 140 bp, Artificial Sequence
  Synthetic
atacgccatgctgggtctcctactcttggacgggggcgctcattacaccgtgtgctgctgaggaggagaaattgcctatcagtcctctaagcaactctctcattaggcaccacaacatggcgtacttgggagtcggccat

SEQ ID NO: 395206 - DNA, 140 bp, Artificial Sequence
  Synthetic
atggccgactcccaagtacgccatgttgtggtgcctaatgagagagttgcttagaggactgataggcaatttctcctcctcagcagcacacggtgtaatgagcgcccccgtccaagagtaggagacccagcatggcgtat

SEQ ID NO: 395207 - DNA, 140 bp, Artificial Sequence
  Synthetic
atacgccatgctgggtctccgataaaggctcaggcgtctaaagtgaacgctagactcctctcaaccgaggaggcttgcgacctcacacccccgcactcagctcgctccaagttcgggtatcgtacttgggagtcggccat

SEQ ID NO: 395208 - DNA, 140 bp, Artificial Sequence
  Synthetic
atggccgactcccaagtacgatacccgaacttggagcgagctgagtgcgggggtgtgaggtcgcaagcctcctcggttgagaggagtctagcgttcactttagacgcctgagcctttatcggagacccagcatggcgtat

SEQ ID NO: 395209 - DNA, 140 bp, Artificial Sequence
  Synthetic
atacgccatgctgggtctccccattatggctaaaaatgaggtgttctgcgtggatgtgcggaaaggcggtcggaagccaacccgtcttatcgtatacccagaccttggtgtgagggtgtgcgtacttgggagtcggccat

SEQ ID NO: 395210 - DNA, 140 bp, Artificial Sequence
  Synthetic
atggccgactcccaagtacgcacaccctcacaccaaggtctgggtatacgataagacgggttggcttccgaccgcctttccgcacatccacgcagaacacctcatttttagccataatggggagacccagcatggcgtat

SEQ ID NO: 395211 - DNA, 140 bp, Artificial Sequence
  Synthetic
atacgccatgctgggtctccctccttcaaatgtggcgctcaaagaagaaccccatggggttctcctatgacaccagatgcttcgactcgacggtcacggagcgcgacatccaaacagaaccgtacttgggagtcggccat

SEQ ID NO: 395212 - DNA, 140 bp, Artificial Sequence
  Synthetic
atggccgactcccaagtacggttctgtttggatgtcgcgctccgtgaccgtcgagtcgaagcatctggtgtcataggagaaccccatggggttcttctttgagcgccacatttgaaggagggagacccagcatggcgtat

SEQ ID NO: 395213 - DNA, 140 bp, Artificial Sequence
  Synthetic
atacgccatgctgggtctcccaaccgcacggccttgaactgcaatgatagccttcagaccggctttgtagcggggcttttctattatcacaaattcaactcttcgggctgtcctgagaggcgtacttgggagtcggccat

SEQ ID NO: 395214 - DNA, 140 bp, Artificial Sequence
  Synthetic
atggccgactcccaagtacgcctctcaggacagcccgaagagttgaatttgtgataatagaaaagccccgctacaaagccggtctgaaggctatcattgcagttcaaggccgtgcggttgggagacccagcatggcgtat

SEQ ID NO: 395215 - DNA, 140 bp, Artificial Sequence
  Synthetic
aggccctggctgctgatatgcggactacgtccctccggtggtacacgggtgcccactgccgcctgccaaggcccctccaataccacctccacggaggaagaggacggttgtcctgacagagaccttttgggacagcggtg

SEQ ID NO: 395216 - DNA, 140 bp, Artificial Sequence
  Synthetic
caccgctgtcccaaaaggtctctgtcaggacaaccgtcctcttcctccgtggaggtggtattggaggggccttggcaggcggcagtgggcacccgtgtaccaccggagggacgtagtccgcatatcagcagccagggcct

SEQ ID NO: 395217 - DNA, 140 bp, Artificial Sequence
  Synthetic
atacgccatgctgggtctccgggtcaatcatgtggatatcgcaggtgcagagccagtggtgtattgaccaccagcttgggcaatactctcacatgctacctgaaggctcaggcggcgtgccgtacttgggagtcggccat

SEQ ID NO: 395218 - DNA, 140 bp, Artificial Sequence
  Synthetic
atggccgactcccaagtacggcacgccgcctgagccttcaggtagcatgtgagagtattgcccaagctggtggtcaatacaccactggctctgcacctgcgatatccacatgattgacccggagacccagcatggcgtat

SEQ ID NO: 395219 - DNA, 140 bp, Artificial Sequence
  Synthetic
atacgccatgctgggtctccgagctttcacggaagctatgaccaggtattcggcccctcctggagatgaaccacagccggaatacgatctcgagcggattacatcttgctcatccaacgtcgtacttgggagtcggccat

SEQ ID NO: 395220 - DNA, 140 bp, Artificial Sequence
  Synthetic
atggccgactcccaagtacgacgttggatgagcaagatgtaatccgctcgagatcgtattccggctgtggttcatctccaggaggggccgaatacctggtcatagcttccgtgaaagctcggagacccagcatggcgtat

SEQ ID NO: 395221 - DNA, 140 bp, Artificial Sequence
  Synthetic
atacgccatgctgggtctccccagtgaactcttggttgggaaacatcattgcgtatgcacccacaatatgggtccgcatggtgttaatgactcatttctttggaatactccagtcccaggcgtacttgggagtcggccat

SEQ ID NO: 395222 - DNA, 140 bp, Artificial Sequence
  Synthetic
atggccgactcccaagtacgcctgggactggagtattccaaagaaatgagtcattaacaccatgcggacccatattgtgggtgcatacgcaatgatgtttcccaaccaagagttcactggggagacccagcatggcgtat

SEQ ID NO: 395223 - DNA, 140 bp, Artificial Sequence
  Synthetic
  misc_feature (75)..(75): n is a, c, g, or t
atacgccatgctgggtctcctgccttttcactccacggttactctcccggcgaactcaacagggtggcggcaagnctcaggttgcttggggctccaccgttgagagcctggagacatcgacgtacttgggagtcggccat

SEQ ID NO: 395224 - DNA, 140 bp, Artificial Sequence
  Synthetic
  misc_feature (66)..(66): n is a, c, g, or t
atggccgactcccaagtacgtcgatgtctccaggctctcaacggtggagccccaagcaacctgagncttgccgccaccctgttgagttcgccgggagagtaaccgtggagtgaaaaggcaggagacccagcatggcgtat

SEQ ID NO: 395225 - DNA, 140 bp, Artificial Sequence
  Synthetic
  misc_feature (25)..(25): n is a, c, g, or t
  misc_feature (100)..(100): n is a, c, g, or t
aggccctggctgctgatatgcaagnctcaggttgcttggggctccaccgttgagagcctggagacatcgagccagggcagtcagggcgaagctcattgcncagggggggaaagctgctatgaccttttgggacagcggtg

SEQ ID NO: 395226 - DNA, 140 bp, Artificial Sequence
  Synthetic
  misc_feature (41)..(41): n is a, c, g, or t
  misc_feature (116)..(116): n is a, c, g, or t
caccgctgtcccaaaaggtcatagcagctttccccccctgngcaatgagcttcgccctgactgccctggctcgatgtctccaggctctcaacggtggagccccaagcaacctgagncttgcatatcagcagccagggcct

SEQ ID NO: 395227 - DNA, 140 bp, Artificial Sequence
  Synthetic
aggccctggctgctgatatgtcagctggtgcttgtggtggcttcagtattttctgaccagagtagaagcgcaactgcacgtgtgggttccccccctcaacgtccgaggggggcgcgacgcgaccttttgggacagcggtg

SEQ ID NO: 395228 - DNA, 140 bp, Artificial Sequence
  Synthetic
caccgctgtcccaaaaggtcgcgtcgcgcccccctcggacgttgagggggggaacccacacgtgcagttgcgcttctactctggtcagaaaatactgaagccaccacaagcaccagctgacatatcagcagccagggcct

SEQ ID NO: 395229 - DNA, 140 bp, Artificial Sequence
  Synthetic
aggccctggctgctgatatgactatgcaacagggaatcttcccggttgctccttttctatcttccttttggcactgctctcgtgccttaccacacctgcttcagccctgcactatgccaagaccttttgggacagcggtg

SEQ ID NO: 395230 - DNA, 140 bp, Artificial Sequence
  Synthetic
caccgctgtcccaaaaggtcttggcatagtgcagggctgaagcaggtgtggtaaggcacgagagcagtgccaaaaggaagatagaaaaggagcaaccgggaagattccctgttgcatagtcatatcagcagccagggcct

SEQ ID NO: 395231 - DNA, 140 bp, Artificial Sequence
  Synthetic
atacgccatgctgggtctccgttaaggtcggcaatcagtccacatgctgggtgtcggcctcgcccacgctagctgttccgaacgcgtcgacgcccctcactggtttccgcagacatgtggcgtacttgggagtcggccat

SEQ ID NO: 395232 - DNA, 140 bp, Artificial Sequence
  Synthetic
atggccgactcccaagtacgccacatgtctgcggaaaccagtgaggggcgtcgacgcgttcggaacagctagcgtgggcgaggccgacacccagcatgtggactgattgccgaccttaacggagacccagcatggcgtat

SEQ ID NO: 395233 - DNA, 140 bp, Artificial Sequence
  Synthetic
atacgccatgctgggtctcctatacatcagactgtccaggaatgtaattgttccatctacacgggccgtattactggccatcgcatggcgtgggacatgatgatgaactggtccccgacccgtacttgggagtcggccat

SEQ ID NO: 395234 - DNA, 140 bp, Artificial Sequence
  Synthetic
atggccgactcccaagtacgggtcggggaccagttcatcatcatgtcccacgccatgcgatggccagtaatacggcccgtgtagatggaacaattacattcctggacagtctgatgtataggagacccagcatggcgtat

SEQ ID NO: 395235 - DNA, 140 bp, Artificial Sequence
  Synthetic
aggccctggctgctgatatgtctcagaacatccagctcataaacaccaatggcagctggcacatcaacaggactgccctgaactgcaatgattccctcaagactgggttccttgccgcgcgaccttttgggacagcggtg

SEQ ID NO: 395236 - DNA, 140 bp, Artificial Sequence
  Synthetic
caccgctgtcccaaaaggtcgcgcggcaaggaacccagtcttgagggaatcattgcagttcagggcagtcctgttgatgtgccagctgccattggtgtttatgagctggatgttctgagacatatcagcagccagggcct

SEQ ID NO: 395237 - DNA, 140 bp, Artificial Sequence
  Synthetic
atacgccatgctgggtctccgcatggtagctaactgggccaaggttatcggtatccttctcctgttcgcaggggtggaggcggagacctatgtcactggcagtgtgaccggtcagaccatcgtacttgggagtcggccat

SEQ ID NO: 395238 - DNA, 140 bp, Artificial Sequence
  Synthetic
atggccgactcccaagtacgatggtctgaccggtcacactgccagtgacataggtctccgcctccacccctgcgaacaggagaaggataccgataaccttggcccagttagctaccatgcggagacccagcatggcgtat

SEQ ID NO: 395239 - DNA, 140 bp, Artificial Sequence
  Synthetic
atacgccatgctgggtctcccactggtttttccggcctatttagctcaggatcccaacagaaactacagcttgtgaacaccaacggcagctggcatatcaataggaccgccttaaactgtcgtacttgggagtcggccat

SEQ ID NO: 395240 - DNA, 140 bp, Artificial Sequence
  Synthetic
atggccgactcccaagtacgacagtttaaggcggtcctattgatatgccagctgccgttggtgttcacaagctgtagtttctgttgggatcctgagctaaataggccggaaaaaccagtgggagacccagcatggcgtat

SEQ ID NO: 395241 - DNA, 140 bp, Artificial Sequence
  Synthetic
  misc_feature (33)..(33): n is a, c, g, or t
atacgccatgctgggtctccttccggagtcaantctcttgctccgtgcacctgtggcgcgtcggacttgtatttagtcactagacacgcggatgtggtgcctgtgcgcaggagaggagaccgtacttgggagtcggccat

SEQ ID NO: 395242 - DNA, 140 bp, Artificial Sequence
  Synthetic
  misc_feature (108)..(108): n is a, c, g, or t
atggccgactcccaagtacggtctcctctcctgcgcacaggcaccacatccgcgtgtctagtgactaaatacaagtccgacgcgccacaggtgcacggagcaagaganttgactccggaaggagacccagcatggcgtat

SEQ ID NO: 395243 - DNA, 140 bp, Artificial Sequence
  Synthetic
atacgccatgctgggtctcccctatttcgatcagggctggggccccattagctatgctaatgtgagcgggagctcggaagataagccttattgctggcactacccgccaagaccgtgcggcgtacttgggagtcggccat

SEQ ID NO: 395244 - DNA, 140 bp, Artificial Sequence
  Synthetic
atggccgactcccaagtacgccgcacggtcttggcgggtagtgccagcaataaggcttatcttccgagctcccgctcacattagcatagctaatggggccccagccctgatcgaaataggggagacccagcatggcgtat

SEQ ID NO: 395245 - DNA, 140 bp, Artificial Sequence
  Synthetic
atacgccatgctgggtctcctggggtgagaatgagtcggacgtgttcctgctggaaagtttacgaccgcccaaaggcggttggtatgggtgcacctggatgaattccaccgggtttgtaacgtacttgggagtcggccat

SEQ ID NO: 395246 - DNA, 140 bp, Artificial Sequence
  Synthetic
atggccgactcccaagtacgttacaaacccggtggaattcatccaggtgcacccataccaaccgcctttgggcggtcgtaaactttccagcaggaacacgtccgactcattctcaccccaggagacccagcatggcgtat

SEQ ID NO: 395247 - DNA, 140 bp, Artificial Sequence
  Synthetic
atacgccatgctgggtctccaaggatcttctggcggacccgtactctgctctaggggacatgtcgtgggcttgttcagagcggccgtgtgcgccaggggtgtggccaaatctattgacttcgtacttgggagtcggccat

SEQ ID NO: 395248 - DNA, 140 bp, Artificial Sequence
  Synthetic
atggccgactcccaagtacgaagtcaatagatttggccacacccctggcgcacacggccgctctgaacaagcccacgacatgtcccctagagcagagtacgggtccgccagaagatccttggagacccagcatggcgtat

SEQ ID NO: 395249 - DNA, 140 bp, Artificial Sequence
  Synthetic
atacgccatgctgggtctccaacgtatgctaagtgcggctcaggtccttggctgactccgcgatgcgtagtcgactatccctacaggctgtggcattatccttgcactcagaactacactcgtacttgggagtcggccat

SEQ ID NO: 395250 - DNA, 140 bp, Artificial Sequence
  Synthetic
atggccgactcccaagtacgagtgtagttctgagtgcaaggataatgccacagcctgtagggatagtcgactacgcatcgcggagtcagccaaggacctgagccgcacttagcatacgttggagacccagcatggcgtat

SEQ ID NO: 395251 - DNA, 140 bp, Artificial Sequence
  Synthetic
aggccctggctgctgatatggttcctcgctaggctcatatggtggttgcaatattttatcaccagaaccgaggcgcacttgcaagtgtggatcccccccctcaacgttcgggggggccgcgaccttttgggacagcggtg

SEQ ID NO: 395252 - DNA, 140 bp, Artificial Sequence
  Synthetic
caccgctgtcccaaaaggtcgcggcccccccgaacgttgaggggggggatccacacttgcaagtgcgcctcggttctggtgataaaatattgcaaccaccatatgagcctagcgaggaaccatatcagcagccagggcct

SEQ ID NO: 395253 - DNA, 140 bp, Artificial Sequence
  Synthetic
aggccctggctgctgatatgccctgttcattcacgacgatgccagcgctttccacggggttaatacacttacaccagaacatagtggacgttcagtacctctatggtatatccccatcaggaccttttgggacagcggtg

SEQ ID NO: 395254 - DNA, 140 bp, Artificial Sequence
  Synthetic
caccgctgtcccaaaaggtcctgatggggatataccatagaggtactgaacgtccactatgttctggtgtaagtgtattaaccccgtggaaagcgctggcatcgtcgtgaatgaacagggcatatcagcagccagggcct

SEQ ID NO: 395255 - DNA, 140 bp, Artificial Sequence
  Synthetic
aggccctggctgctgatatgccaagccgaggccgcattagagaacttaatcgtcctcaatgccgcttcggctgctagcatccatggatggggatggtgtcttgtattcttgtgttgtgctgaccttttgggacagcggtg

SEQ ID NO: 395256 - DNA, 140 bp, Artificial Sequence
  Synthetic
caccgctgtcccaaaaggtcagcacaacacaagaatacaagacaccatccccatccatggatgctagcagccgaagcggcattgaggacgattaagttctctaatgcggcctcggcttggcatatcagcagccagggcct

SEQ ID NO: 395257 - DNA, 140 bp, Artificial Sequence
  Synthetic
atacgccatgctgggtctcccgtacgatcaagagcaagcagcctccatcggtgcagcagtgctggcagccattactgtctttacacttacaccgcattacaaatggatgcttgttcatctcgtacttgggagtcggccat

SEQ ID NO: 395258 - DNA, 140 bp, Artificial Sequence
  Synthetic
atggccgactcccaagtacgagatgaacaagcatccatttgtaatgcggtgtaagtgtaaagacagtaatggctgccagcactgctgcaccgatggaggctgcttgctcttgatcgtacgggagacccagcatggcgtat

SEQ ID NO: 395259 - DNA, 140 bp, Artificial Sequence
  Synthetic
atacgccatgctgggtctcctcctgctcgccatactcggtccgctcatggtgctccaggctgccataactaagatgccgtacttcgtacgcgctcaagggcttattcgtgcatgcatgttcgtacttgggagtcggccat

SEQ ID NO: 395260 - DNA, 140 bp, Artificial Sequence
  Synthetic
atggccgactcccaagtacgaacatgcatgcacgaataagcccttgagcgcgtacgaagtacggcatcttagttatggcagcctggagcaccatgagcggaccgagtatggcgagcaggaggagacccagcatggcgtat

SEQ ID NO: 395261 - DNA, 140 bp, Artificial Sequence
  Synthetic
aggccctggctgctgatatgcttaacaacacgcggccgccgcaaggcaactggttcggctgcacatggatgaatggcaccgggttcaccaagacgtgtgggggccccccgtgtaacatcggaccttttgggacagcggtg

SEQ ID NO: 395262 - DNA, 140 bp, Artificial Sequence
  Synthetic
caccgctgtcccaaaaggtccgatgttacacggggggcccccacacgtcttggtgaacccggtgccattcatccatgtgcagccgaaccagttgccttgcggcggccgcgtgttgttaagcatatcagcagccagggcct

SEQ ID NO: 395263 - DNA, 140 bp, Artificial Sequence
  Synthetic
  misc_feature (53)..(53): n is a, c, g, or t
  misc_feature (113)..(113): n is a, c, g, or t
atacgccatgctgggtctccctcacgtgcttgctgcacccctcccttggattngaggtcactaaggtgcttttagcaatcattggccctctttatcttctgcaggccagcctnttgcatgcgtacttgggagtcggccat

SEQ ID NO: 395264 - DNA, 140 bp, Artificial Sequence
  Synthetic
  misc_feature (28)..(28): n is a, c, g, or t
  misc_feature (88)..(88): n is a, c, g, or t
atggccgactcccaagtacgcatgcaanaggctggcctgcagaagataaagagggccaatgattgctaaaagcaccttagtgacctcnaatccaagggaggggtgcagcaagcacgtgagggagacccagcatggcgtat

SEQ ID NO: 395265 - DNA, 140 bp, Artificial Sequence
  Synthetic
atacgccatgctgggtctccgcatagggtcggcatttatctcctttgcaatcaaatgggagtatgtcgtgttgctcttcctgctcctggcggatgcgcgtatctgcgcctgcttatggatcgtacttgggagtcggccat

SEQ ID NO: 395266 - DNA, 140 bp, Artificial Sequence
  Synthetic
atggccgactcccaagtacgatccataagcaggcgcagatacgcgcatccgccaggagcaggaagagcaacacgacatactcccatttgattgcaaaggagataaatgccgaccctatgcggagacccagcatggcgtat

SEQ ID NO: 395267 - DNA, 140 bp, Artificial Sequence
  Synthetic
atacgccatgctgggtctccggcatggacaggtacttacatttatgatcatctggcacctctcaagacctgggccagcgacggcttacgtgatcttgctgtcgctgtagagccggtcgtgcgtacttgggagtcggccat

SEQ ID NO: 395268 - DNA, 140 bp, Artificial Sequence
  Synthetic
atggccgactcccaagtacgcacgaccggctctacagcgacagcaagatcacgtaagccgtcgctggcccaggtcttgagaggtgccagatgatcataaatgtaagtacctgtccatgccggagacccagcatggcgtat

SEQ ID NO: 395269 - DNA, 140 bp, Artificial Sequence
  Synthetic
atacgccatgctgggtctcctgctgttggtaggtccagctgacaatatgcaagatcagggctggaggctactcgcccctatcaccgcataccatcagcaaactcgcggcctgctggggaccgtacttgggagtcggccat

SEQ ID NO: 395270 - DNA, 140 bp, Artificial Sequence
  Synthetic
atggccgactcccaagtacggtccccagcaggccgcgagtttgctgatggtatgcggtgataggggcgagtagcctccagccctgatcttgcatattgtcagctggacctaccaacagcaggagacccagcatggcgtat

SEQ ID NO: 395271 - DNA, 140 bp, Artificial Sequence
  Synthetic
atacgccatgctgggtctccggggtgctgtggactgtctaccatggtgctggctctaagaccctagctggtccgaagggcccagtgtgccaaatgtacaccaatgttgaccaggacttggcgtacttgggagtcggccat

SEQ ID NO: 395272 - DNA, 140 bp, Artificial Sequence
  Synthetic
atggccgactcccaagtacgccaagtcctggtcaacattggtgtacatttggcacactgggcccttcggaccagctagggtcttagagccagcaccatggtagacagtccacagcaccccggagacccagcatggcgtat

SEQ ID NO: 395273 - DNA, 140 bp, Artificial Sequence
  Synthetic
atacgccatgctgggtctcctagacgcaggggggacactcgtgcaggactccttagccctaggcccctgtcaaccctcaagggctcatccggcggaccggtaatgtgttcagcaggtcatcgtacttgggagtcggccat

SEQ ID NO: 395274 - DNA, 140 bp, Artificial Sequence
  Synthetic
atggccgactcccaagtacgatgacctgctgaacacattaccggtccgccggatgagcccttgagggttgacaggggcctagggctaaggagtcctgcacgagtgtcccccctgcgtctaggagacccagcatggcgtat

SEQ ID NO: 395275 - DNA, 140 bp, Artificial Sequence
  Synthetic
aggccctggctgctgatatggttgagcccgttgtcttctctgacatggagaccaaaattatcacctggggggcagacaccgcggcgtgtggggacatcatcttgggtctgcccgtctccggaccttttgggacagcggtg

SEQ ID NO: 395276 - DNA, 140 bp, Artificial Sequence
  Synthetic
caccgctgtcccaaaaggtccggagacgggcagacccaagatgatgtccccacacgccgcggtgtctgccccccaggtgataattttggtctccatgtcagagaagacaacgggctcaaccatatcagcagccagggcct

SEQ ID NO: 395277 - DNA, 140 bp, Artificial Sequence
  Synthetic
atacgccatgctgggtctccctttttctgacaattcatcaccgcccgctgtacctcaaacctatcaggttggatacctacatgctccaacaggcagtgggaagagcacgaaggtgccggccgtacttgggagtcggccat

SEQ ID NO: 395278 - DNA, 140 bp, Artificial Sequence
  Synthetic
atggccgactcccaagtacggccggcaccttcgtgctcttcccactgcctgttggagcatgtaggtatccaacctgataggtttgaggtacagcgggcggtgatgaattgtcagaaaaagggagacccagcatggcgtat

SEQ ID NO: 395279 - DNA, 140 bp, Artificial Sequence
  Synthetic
atacgccatgctgggtctcccctaacatcaggaccggtgtcaggaccataacaacaggaggtcctattacctactctacctatggcaagttcctggctgatgggggatgctcggggggagcgtacttgggagtcggccat

SEQ ID NO: 395280 - DNA, 140 bp, Artificial Sequence
  Synthetic
atggccgactcccaagtacgctccccccgagcatcccccatcagccaggaacttgccataggtagagtaggtaataggacctcctgttgttatggtcctgacaccggtcctgatgttaggggagacccagcatggcgtat

SEQ ID NO: 395281 - DNA, 140 bp, Artificial Sequence
  Synthetic
  misc_feature (46)..(46): n is a, c, g, or t
  misc_feature (63)..(63): n is a, c, g, or t
atacgccatgctgggtctccccttactgtcttagccacggccacanctcccggatcagtcacngttccccatccaaacatttcagaggtcgcactatccaccactggggaaatccccttccgtacttgggagtcggccat

SEQ ID NO: 395282 - DNA, 140 bp, Artificial Sequence
  Synthetic
  misc_feature (78)..(78): n is a, c, g, or t
  misc_feature (95)..(95): n is a, c, g, or t
atggccgactcccaagtacggaaggggatttccccagtggtggatagtgcgacctctgaaatgtttggatggggaacngtgactgatccgggagntgtggccgtggctaagacagtaaggggagacccagcatggcgtat

SEQ ID NO: 395283 - DNA, 140 bp, Artificial Sequence
  Synthetic
atacgccatgctgggtctcccgctcggcctcaacgccgttgcgttctatagaggcatcgatgtggcagtaatccccacccagggggatgtggtcatctgtgccactgatgcccttatgaccgtacttgggagtcggccat

SEQ ID NO: 395284 - DNA, 140 bp, Artificial Sequence
  Synthetic
atggccgactcccaagtacggtcataagggcatcagtggcacagatgaccacatccccctgggtggggattactgccacatcgatgcctctatagaacgcaacggcgttgaggccgagcgggagacccagcatggcgtat

SEQ ID NO: 395285 - DNA, 140 bp, Artificial Sequence
  Synthetic
aggccctggctgctgatatggcaacatcaccagggttgagtcagagaacaaagtggtgattctggactccttcgatccgcttgtggcggaggaggatgagcgggagatctccgtgcccgcgaccttttgggacagcggtg

SEQ ID NO: 395286 - DNA, 140 bp, Artificial Sequence
  Synthetic
caccgctgtcccaaaaggtcgcgggcacggagatctcccgctcatcctcctccgccacaagcggatcgaaggagtccagaatcaccactttgttctctgactcaaccctggtgatgttgccatatcagcagccagggcct

SEQ ID NO: 395287 - DNA, 140 bp, Artificial Sequence
  Synthetic
atacgccatgctgggtctccactgtcccgcaagacgccgtggctagaagccagcggcgcgggcgtacgggtagagggaaaccagggatatacagatacgtctcacaaggagagcgaccatcgtacttgggagtcggccat

SEQ ID NO: 395288 - DNA, 140 bp, Artificial Sequence
  Synthetic
atggccgactcccaagtacgatggtcgctctccttgtgagacgtatctgtatatccctggtttccctctacccgtacgcccgcgccgctggcttctagccacggcgtcttgcgggacagtggagacccagcatggcgtat

SEQ ID NO: 395289 - DNA, 140 bp, Artificial Sequence
  Synthetic
atacgccatgctgggtctccccgggttatttgacaccattgtgctctgtgaggcgtatgacacgggatgtgcgtggtacgagttaacaccatcggagactatggttaggctgcgcgcatacgtacttgggagtcggccat

SEQ ID NO: 395290 - DNA, 140 bp, Artificial Sequence
  Synthetic
atggccgactcccaagtacgtatgcgcgcagcctaaccatagtctccgatggtgttaactcgtaccacgcacatcccgtgtcatacgcctcacagagcacaatggtgtcaaataacccggggagacccagcatggcgtat

SEQ ID NO: 395291 - DNA, 140 bp, Artificial Sequence
  Synthetic
atacgccatgctgggtctccccgtatccactgccttggccgaacttgccaccaaaagttttggcagctcctcaacttccggtattacgggcgacgatacgacaacatcctctgagcccgccgtacttgggagtcggccat

SEQ ID NO: 395292 - DNA, 140 bp, Artificial Sequence
  Synthetic
atggccgactcccaagtacggcgggctcagaggatgttgtcgtatcgtcgcccgtaataccggaagttgaggagctgccaaaacttttggtggcaagttcggccaaggcagtggatacggggagacccagcatggcgtat

SEQ ID NO: 395293 - DNA, 140 bp, Artificial Sequence
  Synthetic
atacgccatgctgggtctccactaaacaggcgggggaaaaccttgcttatctagtggcctaccaagctacggtgtgcgcccgagctaaagccccccctccttcatgggacaatatgtggacgtacttgggagtcggccat

SEQ ID NO: 395294 - DNA, 140 bp, Artificial Sequence
  Synthetic
atggccgactcccaagtacgtccacatattgtcccatgaaggagggggggctttagctcgggcgcacaccgtagcttggtaggccactagataagcaaggttttcccccgcctgtttagtggagacccagcatggcgtat

SEQ ID NO: 395295 - DNA, 140 bp, Artificial Sequence
  Synthetic
aggccctggctgctgatatgagcacctgggtgctggtaggcggggtccttgcagctctggccgcgtattgcctgacaacaggcagcgtggtcattgtgggcaggatcatcttgtccgggagaccttttgggacagcggtg

SEQ ID NO: 395296 - DNA, 140 bp, Artificial Sequence
  Synthetic
caccgctgtcccaaaaggtctcccggacaagatgatcctgcccacaatgaccacgctgcctgttgtcaggcaatacgcggccagagctgcaaggaccccgcctaccagcacccaggtgctcatatcagcagccagggcct

SEQ ID NO: 395297 - DNA, 140 bp, Artificial Sequence
  Synthetic
atacgccatgctgggtctccaaaatacatcatgacctgcatgtcagcagacctagaagtaatcactagcacttgggtaattgcaggggggattcttgctgcattagcggcctattgcctccgtacttgggagtcggccat

SEQ ID NO: 395298 - DNA, 140 bp, Artificial Sequence
  Synthetic
atggccgactcccaagtacggaggcaataggccgctaatgcagcaagaatcccccctgcaattacccaagtgctagtgattacttctaggtctgctgacatgcaggtcatgatgtattttggagacccagcatggcgtat

SEQ ID NO: 395299 - DNA, 140 bp, Artificial Sequence
  Synthetic
atacgccatgctgggtctccacggtgggtagcgtcgttatttgcggcaggatcgtcacctcaggcaagcccgcagtgatgcctgacagagaagtgctctatcaacaatttgacgagatggcgtacttgggagtcggccat

SEQ ID NO: 395300 - DNA, 140 bp, Artificial Sequence
  Synthetic
atggccgactcccaagtacgccatctcgtcaaattgttgatagagcacttctctgtcaggcatcactgcgggcttgcctgaggtgacgatcctgccgcaaataacgacgctacccaccgtggagacccagcatggcgtat

SEQ ID NO: 395301 - DNA, 140 bp, Artificial Sequence
  Synthetic
aggccctggctgctgatatgcgctgcttcggctttcgtaggcgccggcatcgccggtgcggctgttggcagcataggccttgggaaagtgcttgtggacatcctggcgggctatggggcagaccttttgggacagcggtg

SEQ ID NO: 395302 - DNA, 140 bp, Artificial Sequence
  Synthetic
caccgctgtcccaaaaggtctgccccatagcccgccaggatgtccacaagcactttcccaaggcctatgctgccaacagccgcaccggcgatgccggcgcctacgaaagccgaagcagcgcatatcagcagccagggcct

SEQ ID NO: 395303 - DNA, 140 bp, Artificial Sequence
  Synthetic
atacgccatgctgggtctccggctgaggaccttaaaccggctgttcaatcggcatggccgaagctcgaggcattctggcagaaacatctgtggaattttgttagcgggatacagtatctccgtacttgggagtcggccat

SEQ ID NO: 395304 - DNA, 140 bp, Artificial Sequence
  Synthetic
atggccgactcccaagtacggagatactgtatcccgctaacaaaattccacagatgtttctgccagaatgcctcgagcttcggccatgccgattgaacagccggtttaaggtcctcagccggagacccagcatggcgtat

SEQ ID NO: 395305 - DNA, 140 bp, Artificial Sequence
  Synthetic
aggccctggctgctgatatgcattctggcagaaacatctgtggaattttgttagcgggatacagtatctcgctggcctttccacattgcctggaaacccagcagttgcctcgctaatgtcgaccttttgggacagcggtg

SEQ ID NO: 395306 - DNA, 140 bp, Artificial Sequence
  Synthetic
caccgctgtcccaaaaggtcgacattagcgaggcaactgctgggtttccaggcaatgtggaaaggccagcgagatactgtatcccgctaacaaaattccacagatgtttctgccagaatgcatatcagcagccagggcct

SEQ ID NO: 395307 - DNA, 140 bp, Artificial Sequence
  Synthetic
atacgccatgctgggtctccttaacatactgggagggtgggtggcctcccaaatggcgccgccgacagcgtcaacggcgtttgttgtgagcggtattgctggtgcaaccgtgggcagcatcgtacttgggagtcggccat

SEQ ID NO: 395308 - DNA, 140 bp, Artificial Sequence
  Synthetic
atggccgactcccaagtacgatgctgcccacggttgcaccagcaataccgctcacaacaaacgccgttgacgctgtcggcggcgccatttgggaggccacccaccctcccagtatgttaaggagacccagcatggcgtat

SEQ ID NO: 395309 - DNA, 140 bp, Artificial Sequence
  Synthetic
aggccctggctgctgatatgtcaacggcgtttgttgtgagcggtattgctggtgcaaccgtgggcagcattggtttgggcagggtcatcgttgatatcctagcaggatacggagcaggcggaccttttgggacagcggtg

SEQ ID NO: 395310 - DNA, 140 bp, Artificial Sequence
  Synthetic
caccgctgtcccaaaaggtccgcctgctccgtatcctgctaggatatcaacgatgaccctgcccaaaccaatgctgcccacggttgcaccagcaataccgctcacaacaaacgccgttgacatatcagcagccagggcct

SEQ ID NO: 395311 - DNA, 140 bp, Artificial Sequence
  Synthetic
atacgccatgctgggtctccggtttggcttaaggctaagcttgtgccctccctaccgggcgtccctttcttctcgtgtcagagggggtttaggggcacctggcgtggtgacggtatatgccgtacttgggagtcggccat

SEQ ID NO: 395312 - DNA, 140 bp, Artificial Sequence
  Synthetic
atggccgactcccaagtacggcatataccgtcaccacgccaggtgcccctaaaccccctctgacacgagaagaaagggacgcccggtagggagggcacaagcttagccttaagccaaaccggagacccagcatggcgtat

SEQ ID NO: 395313 - DNA, 140 bp, Artificial Sequence
  Synthetic
  misc_feature (119)..(119): n is a, c, g, or t
aggccctggctgctgatatgcccaattacaagcgggctttgtggagggtgtccgcagaggactacgttgaggtcatccgggtaaaggactgccactacgtagtgggggcgactgctganagaccttttgggacagcggtg

SEQ ID NO: 395314 - DNA, 140 bp, Artificial Sequence
  Synthetic
  misc_feature (22)..(22): n is a, c, g, or t
caccgctgtcccaaaaggtctntcagcagtcgcccccactacgtagtggcagtcctttacccggatgacctcaacgtagtcctctgcggacaccctccacaaagcccgcttgtaattgggcatatcagcagccagggcct

SEQ ID NO: 395315 - DNA, 140 bp, Artificial Sequence
  Synthetic
atacgccatgctgggtctccggacgaagtgtcgttctctgtcggcctccatagctatgctatggggtcccaacttccgtgtgagcccgagcctgatgtaatgatactgacatccatgctacgtacttgggagtcggccat

SEQ ID NO: 395316 - DNA, 140 bp, Artificial Sequence
  Synthetic
atggccgactcccaagtacgtagcatggatgtcagtatcattacatcaggctcgggctcacacggaagttgggaccccatagcatagctatggaggccgacagagaacgacacttcgtccggagacccagcatggcgtat

SEQ ID NO: 395317 - DNA, 140 bp, Artificial Sequence
  Synthetic
atacgccatgctgggtctcccatccctaaaagcaacatgcaccattcctgcggaccaccctgatgctgagctgattcaggccaatcttttgtggaggcaggagatggggggcaacgtaaccgtacttgggagtcggccat

SEQ ID NO: 395318 - DNA, 140 bp, Artificial Sequence
  Synthetic
atggccgactcccaagtacggttacgttgccccccatctcctgcctccacaaaagattggcctgaatcagctcagcatcagggtggtccgcaggaatggtgcatgttgcttttagggatgggagacccagcatggcgtat

SEQ ID NO: 395319 - DNA, 140 bp, Artificial Sequence
  Synthetic
atacgccatgctgggtctccaggccgcccaggcccaagtttccacccgcactacctatatgggcaaggccagattacaaccctccactattggagacctggaaggcgccggattacgacccgtacttgggagtcggccat

SEQ ID NO: 395320 - DNA, 140 bp, Artificial Sequence
  Synthetic
atggccgactcccaagtacgggtcgtaatccggcgccttccaggtctccaatagtggagggttgtaatctggccttgcccatataggtagtgcgggtggaaacttgggcctgggcggcctggagacccagcatggcgtat

SEQ ID NO: 395321 - DNA, 140 bp, Artificial Sequence
  Synthetic
atacgccatgctgggtctcctgaagcgctcgccgagatggcccggaaatcatttccatcagatccatcagagcctgcagagtccggagtagggacctccgccacctcaactgacgagacacgtacttgggagtcggccat

SEQ ID NO: 395322 - DNA, 140 bp, Artificial Sequence
  Synthetic
atggccgactcccaagtacgtgtctcgtcagttgaggtggcggaggtccctactccggactctgcaggctctgatggatctgatggaaatgatttccgggccatctcggcgagcgcttcaggagacccagcatggcgtat

SEQ ID NO: 395323 - DNA, 140 bp, Artificial Sequence
  Synthetic
atacgccatgctgggtctccccaacctctgacgaaccagacgcacattctgatgctggttcgtacagctctatgccccccctcgagggtgagcctggagaccccgacctaagctcgggatcgtacttgggagtcggccat

SEQ ID NO: 395324 - DNA, 140 bp, Artificial Sequence
  Synthetic
atggccgactcccaagtacgatcccgagcttaggtcggggtctccaggctcaccctcgagggggggcatagagctgtacgaaccagcatcagaatgtgcgtctggttcgtcagaggttggggagacccagcatggcgtat

SEQ ID NO: 395325 - DNA, 140 bp, Artificial Sequence
  Synthetic
aggccctggctgctgatatgccggcggagatcctgcggaaatccaggaaatttcccccagcgatgcccatatgggcacgcccggattacaaccctccgctgctagagtcctggaaggaccgaccttttgggacagcggtg

SEQ ID NO: 395326 - DNA, 140 bp, Artificial Sequence
  Synthetic
caccgctgtcccaaaaggtcggtccttccaggactctagcagcggagggttgtaatccgggcgtgcccatatgggcatcgctgggggaaatttcctggatttccgcaggatctccgccggcatatcagcagccagggcct

SEQ ID NO: 395327 - DNA, 140 bp, Artificial Sequence
  Synthetic
atacgccatgctgggtctcccagaagaaggtgacttttgacagggtccagatgttggatcaacactaccaagatgtactcaaggagatgaaggatcgggcttccaatgtgagcgctagaccgtacttgggagtcggccat

SEQ ID NO: 395328 - DNA, 140 bp, Artificial Sequence
  Synthetic
atggccgactcccaagtacggtctagcgctcacattggaagcccgatccttcatctccttgagtacatcttggtagtgttgatccaacatctggaccctgtcaaaagtcaccttcttctgggagacccagcatggcgtat

SEQ ID NO: 395329 - DNA, 140 bp, Artificial Sequence
  Synthetic
atacgccatgctgggtctcctcaactcctctcaccaggcgccaagcagaacatccagctgattaactccaacggcagttggcacatcaatagcacggccttgaactgcaatgatagcatccgtacttgggagtcggccat

SEQ ID NO: 395330 - DNA, 140 bp, Artificial Sequence
  Synthetic
atggccgactcccaagtacggatgctatcattgcagttcaaggccgtgctattgatgtgccaactgccgttggagttaatcagctggatgttctgcttggcgcctggtgagaggagttgaggagacccagcatggcgtat

SEQ ID NO: 395331 - DNA, 140 bp, Artificial Sequence
  Synthetic
aggccctggctgctgatatgcgttaaccacatcaactccgtgtgggaggacttgctggaagacagctctacgcctatccctaccactgttatggctaagaatgaagtgttctgcgtggacgaccttttgggacagcggtg

SEQ ID NO: 395332 - DNA, 140 bp, Artificial Sequence
  Synthetic
caccgctgtcccaaaaggtcgtccacgcagaacacttcattcttagccataacagtggtagggataggcgtagagctgtcttccagcaagtcctcccacacggagttgatgtggttaacgcatatcagcagccagggcct

SEQ ID NO: 395333 - DNA, 140 bp, Artificial Sequence
  Synthetic
aggccctggctgctgatatgccctactgctggcactaccccccaaaaccttgtggtattgtgcccgcaaagagcgtgtgtggcccagtatattgcttcactcccagccccgtggtggtgggaccttttgggacagcggtg

SEQ ID NO: 395334 - DNA, 140 bp, Artificial Sequence
  Synthetic
caccgctgtcccaaaaggtcccaccaccacggggctgggagtgaagcaatatactgggccacacacgctctttgcgggcacaataccacaaggttttggggggtagtgccagcagtagggcatatcagcagccagggcct

SEQ ID NO: 395335 - DNA, 140 bp, Artificial Sequence
  Synthetic
atacgccatgctgggtctccatgagggctgcggctgggcagggtggctcctgtccccccgcggctctcgccctaattggggccccaatgacccccggcgaaggtcccgcaacttgggtaacgtacttgggagtcggccat

SEQ ID NO: 395336 - DNA, 140 bp, Artificial Sequence
  Synthetic
atggccgactcccaagtacgttacccaagttgcgggaccttcgccgggggtcattggggccccaattagggcgagagccgcggggggacaggagccaccctgcccagccgcagccctcatggagacccagcatggcgtat

SEQ ID NO: 395337 - DNA, 140 bp, Artificial Sequence
  Synthetic
aggccctggctgctgatatgcctaattggggccccaatgacccccggcgaaggtcccgcaacttgggtaaggtcatcgatacccttacttgcggctttgccgacctcatggggtacattcgaccttttgggacagcggtg

SEQ ID NO: 395338 - DNA, 140 bp, Artificial Sequence
  Synthetic
caccgctgtcccaaaaggtcgaatgtaccccatgaggtcggcaaagccgcaagtaagggtatcgatgaccttacccaagttgcgggaccttcgccgggggtcattggggccccaattaggcatatcagcagccagggcct

SEQ ID NO: 395339 - DNA, 140 bp, Artificial Sequence
  Synthetic
atacgccatgctgggtctccgtcagggctgtggaggacgggattaactatgcaacagggaatcttcccggttgctctttttctatcttccttctggcactgctctcgtgcctcaccacaccgtacttgggagtcggccat

SEQ ID NO: 395340 - DNA, 140 bp, Artificial Sequence
  Synthetic
atggccgactcccaagtacggtgtggtgaggcacgagagcagtgccagaaggaagatagaaaaagagcaaccgggaagattccctgttgcatagttaatcccgtcctccacagccctgacggagacccagcatggcgtat

SEQ ID NO: 395341 - DNA, 140 bp, Artificial Sequence
  Synthetic
atacgccatgctgggtctccgcatcttcctggatgcaccccttgtgtcaaggtcggtaatcattctacatgctggctgcctgcctcgcccacgctagctgtcccgaacgcgtcaacgcctcgtacttgggagtcggccat

SEQ ID NO: 395342 - DNA, 140 bp, Artificial Sequence
  Synthetic
atggccgactcccaagtacgaggcgttgacgcgttcgggacagctagcgtgggcgaggcaggcagccagcatgtagaatgattaccgaccttgacacaaggggtgcatccaggaagatgcggagacccagcatggcgtat

SEQ ID NO: 395343 - DNA, 140 bp, Artificial Sequence
  Synthetic
atacgccatgctgggtctccctgttcagccatgtacgtgggtgacatatgcggtggtctgtttctgctcggacaagtcgtcacgatcaggccccgtatacatcaaaccgtccaggagtgccgtacttgggagtcggccat

SEQ ID NO: 395344 - DNA, 140 bp, Artificial Sequence
  Synthetic
atggccgactcccaagtacggcactcctggacggtttgatgtatacggggcctgatcgtgacgacttgtccgagcagaaacagaccaccgcatatgtcacccacgtacatggctgaacagggagacccagcatggcgtat

SEQ ID NO: 395345 - DNA, 140 bp, Artificial Sequence
  Synthetic
aggccctggctgctgatatgaccgggttcaccaagacgtgcgggggccccccgtgtaacatcgggggggtcggcaacaacaccttgacctgccccacggactgcttccggaagcaccccggaccttttgggacagcggtg

SEQ ID NO: 395346 - DNA, 140 bp, Artificial Sequence
  Synthetic
caccgctgtcccaaaaggtccggggtgcttccggaagcagtccgtggggcaggtcaaggtgttgttgccgacccccccgatgttacacggggggcccccgcacgtcttggtgaacccggtcatatcagcagccagggcct

SEQ ID NO: 395347 - DNA, 140 bp, Artificial Sequence
  Synthetic
atacgccatgctgggtctcctgagggtaccccagttgatcgtcgacatatttgtgggcggtcattggggggtgttggccggaatactatactacagcatggtagccaactgggccaaggtcgtacttgggagtcggccat

SEQ ID NO: 395348 - DNA, 140 bp, Artificial Sequence
  Synthetic
atggccgactcccaagtacgaccttggcccagttggctaccatgctgtagtatagtattccggccaacaccccccaatgaccgcccacaaatatgtcgacgatcaactggggtaccctcaggagacccagcatggcgtat

SEQ ID NO: 395349 - DNA, 140 bp, Artificial Sequence
  Synthetic
atacgccatgctgggtctccccaggctcccggcagaacctgcagcttataaactccaatggaagctggcatatcaatagaaccgccttaaactgtaatgacagcttacagacaggcttcacgtacttgggagtcggccat

SEQ ID NO: 395350 - DNA, 140 bp, Artificial Sequence
  Synthetic
atggccgactcccaagtacgtgaagcctgtctgtaagctgtcattacagtttaaggcggttctattgatatgccagcttccattggagtttataagctgcaggttctgccgggagcctggggagacccagcatggcgtat

SEQ ID NO: 395351 - DNA, 140 bp, Artificial Sequence
  Synthetic
aggccctggctgctgatatgcattagctacgctaatgtgagcgggagctcggaagataagccctactgctggcactacccgccaagaccatgtggggtagtgccggcctcacaagtgtgcgaccttttgggacagcggtg

SEQ ID NO: 395352 - DNA, 140 bp, Artificial Sequence
  Synthetic
caccgctgtcccaaaaggtcgcacacttgtgaggccggcactaccccacatggtcttggcgggtagtgccagcagtagggcttatcttccgagctcccgctcacattagcgtagctaatgcatatcagcagccagggcct

SEQ ID NO: 395353 - DNA, 140 bp, Artificial Sequence
  Synthetic
aggccctggctgctgatatgccacgtacacctggggggcgaacgaaacggacgtcatcatccttaactcgaccaggcctccacaaggctcgtggttcgggtgcacgtggatgaatggcacgaccttttgggacagcggtg

SEQ ID NO: 395354 - DNA, 140 bp, Artificial Sequence
  Synthetic
caccgctgtcccaaaaggtcgtgccattcatccacgtgcacccgaaccacgagccttgtggaggcctggtcgagttaaggatgatgacgtccgtttcgttcgccccccaggtgtacgtggcatatcagcagccagggcct

SEQ ID NO: 395355 - DNA, 140 bp, Artificial Sequence
  Synthetic
atacgccatgctgggtctccttctgttggagagcttgcggccgcctaaaggtggctggtatgggtgcacctggatgaattccaccgggtatgtaaaaacctgtggtgcgcctccatgcaacgtacttgggagtcggccat

SEQ ID NO: 395356 - DNA, 140 bp, Artificial Sequence
  Synthetic
atggccgactcccaagtacgttgcatggaggcgcaccacaggtttttacatacccggtggaattcatccaggtgcacccataccagccacctttaggcggccgcaagctctccaacagaaggagacccagcatggcgtat

SEQ ID NO: 395357 - DNA, 140 bp, Artificial Sequence
  Synthetic
atacgccatgctgggtctccattgcttccgaaaacatccggaggcaacgtatactagatgtggttcaggtccttggctgactccacggtgcctggttgactatccctataggctgtggcacgtacttgggagtcggccat

SEQ ID NO: 395358 - DNA, 140 bp, Artificial Sequence
  Synthetic
atggccgactcccaagtacgtgccacagcctatagggatagtcaaccaggcaccgtggagtcagccaaggacctgaaccacatctagtatacgttgcctccggatgttttcggaagcaatggagacccagcatggcgtat

SEQ ID NO: 395359 - DNA, 140 bp, Artificial Sequence
  Synthetic
atacgccatgctgggtctccccgtgcaacctcgacgatcgtgatagggttgagatgagcccgctcctcttctccacgactgagctagcgattctcccctgctcgttcacgacgatgccagcgtacttgggagtcggccat

SEQ ID NO: 395360 - DNA, 140 bp, Artificial Sequence
  Synthetic
atggccgactcccaagtacgctggcatcgtcgtgaacgagcaggggagaatcgctagctcagtcgtggagaagaggagcgggctcatctcaaccctatcacgatcgtcgaggttgcacggggagacccagcatggcgtat

SEQ ID NO: 395361 - DNA, 140 bp, Artificial Sequence
  Synthetic
aggccctggctgctgatatgctccacgactgagctagcgattctcccctgctcgttcacgacgatgccagcactttctacggggttgatacacttacaccagaacatagtggatgttcaggaccttttgggacagcggtg

SEQ ID NO: 395362 - DNA, 140 bp, Artificial Sequence
  Synthetic
caccgctgtcccaaaaggtcctgaacatccactatgttctggtgtaagtgtatcaaccccgtagaaagtgctggcatcgtcgtgaacgagcaggggagaatcgctagctcagtcgtggagcatatcagcagccagggcct

SEQ ID NO: 395363 - DNA, 140 bp, Artificial Sequence
  Synthetic
atacgccatgctgggtctccgtggctggatttgccggcctcttcagcccaggcgccaggcaaaacattcagctgatcaacaccaacggcagttggcacatcaacagaacggccctgaactcgtacttgggagtcggccat

SEQ ID NO: 395364 - DNA, 140 bp, Artificial Sequence
  Synthetic
atggccgactcccaagtacgagttcagggccgttctgttgatgtgccaactgccgttggtgttgatcagctgaatgttttgcctggcgcctgggctgaagaggccggcaaatccagccacggagacccagcatggcgtat

SEQ ID NO: 395365 - DNA, 140 bp, Artificial Sequence
  Synthetic
aggccctggctgctgatatgggtattgtgcccgcaaagagcgtatgcggcccggtgtattgcttcactcccagccccgtggtggtgggaacgaccgacaggtcgggcgcgcctacctacagaccttttgggacagcggtg

SEQ ID NO: 395366 - DNA, 140 bp, Artificial Sequence
  Synthetic
caccgctgtcccaaaaggtctgtaggtaggcgcgcccgacctgtcggtcgttcccaccaccacggggctgggagtgaagcaatacaccgggccgcatacgctctttgcgggcacaatacccatatcagcagccagggcct

SEQ ID NO: 395367 - DNA, 140 bp, Artificial Sequence
  Synthetic
atacgccatgctgggtctccgtctttggcttatgctactcattggccaagccgaggccgcgttagagaacctgatcgtcctcaatgccgcctcggccgctagcatccatggatggggatgcgtacttgggagtcggccat

SEQ ID NO: 395368 - DNA, 140 bp, Artificial Sequence
  Synthetic
atggccgactcccaagtacgcatccccatccatggatgctagcggccgaggcggcattgaggacgatcaggttctctaacgcggcctcggcttggccaatgagtagcataagccaaagacggagacccagcatggcgtat

SEQ ID NO: 395369 - DNA, 140 bp, Artificial Sequence
  Synthetic
atacgccatgctgggtctccttggcgttgccccaacgggcgttcgcgtacgaccaagaacaagcggcctccatcggtgcggcagtgctggtagccattactgtcttcacactcacaccgccgtacttgggagtcggccat

SEQ ID NO: 395370 - DNA, 140 bp, Artificial Sequence
  Synthetic
atggccgactcccaagtacggcggtgtgagtgtgaagacagtaatggctaccagcactgccgcaccgatggaggccgcttgttcttggtcgtacgcgaacgcccgttggggcaacgccaaggagacccagcatggcgtat

SEQ ID NO: 395371 - DNA, 140 bp, Artificial Sequence
  Synthetic
atacgccatgctgggtctccggggggtcgtgatgctgtcatcttgctcacgtgcttattatacccctccctcggattcgacataaccaaggtgcttctggcaatcattggccccacttaccgtacttgggagtcggccat

SEQ ID NO: 395372 - DNA, 140 bp, Artificial Sequence
  Synthetic
atggccgactcccaagtacggtaagtggggccaatgattgccagaagcaccttggttatgtcgaatccgagggaggggtataataagcacgtgagcaagatgacagcatcacgaccccccggagacccagcatggcgtat

SEQ ID NO: 395373 - DNA, 140 bp, Artificial Sequence
  Synthetic
aggccctggctgctgatatgtcggattcgacataaccaaggtgcttctggcaatcattggccccacttaccttctgcaggccagcctgttgtatgtgccgtactatgtgcgagcccacatgaccttttgggacagcggtg

SEQ ID NO: 395374 - DNA, 140 bp, Artificial Sequence
  Synthetic
caccgctgtcccaaaaggtcatgtgggctcgcacatagtacggcacatacaacaggctggcctgcagaaggtaagtggggccaatgattgccagaagcaccttggttatgtcgaatccgacatatcagcagccagggcct

SEQ ID NO: 395375 - DNA, 140 bp, Artificial Sequence
  Synthetic
aggccctggctgctgatatggaccatctggcacctcttaagacctgggccagcgacggcttacgtgaccttgctgtcgctgtagaaccggtcgtgttctcgcctatggagaagaaagtcagaccttttgggacagcggtg

SEQ ID NO: 395376 - DNA, 140 bp, Artificial Sequence
  Synthetic
caccgctgtcccaaaaggtctgactttcttctccataggcgagaacacgaccggttctacagcgacagcaaggtcacgtaagccgtcgctggcccaggtcttaagaggtgccagatggtccatatcagcagccagggcct

SEQ ID NO: 395377 - DNA, 140 bp, Artificial Sequence
  Synthetic
atacgccatgctgggtctcccatgcaagatcagggctggaggttgctcgcccccatcaccgcataccatcaacaaacccgcggcttgctggggacaattgttactagcttgaccggtaggcgtacttgggagtcggccat

SEQ ID NO: 395378 - DNA, 140 bp, Artificial Sequence
  Synthetic
atggccgactcccaagtacgcctaccggtcaagctagtaacaattgtccccagcaagccgcgggtttgttgatggtatgcggtgatgggggcgagcaacctccagccctgatcttgcatgggagacccagcatggcgtat

SEQ ID NO: 395379 - DNA, 140 bp, Artificial Sequence
  Synthetic
atacgccatgctgggtctccgcgctggctccaagaccttggccggcccgaagggcccagtgtgccaaatgtacaccaatgttgaccaggatttggtaggatggccggctcctccgggtgccgtacttgggagtcggccat

SEQ ID NO: 395380 - DNA, 140 bp, Artificial Sequence
  Synthetic
atggccgactcccaagtacggcacccggaggagccggccatcctaccaaatcctggtcaacattggtgtacatttggcacactgggcccttcgggccggccaaggtcttggagccagcgcggagacccagcatggcgtat

SEQ ID NO: 395381 - DNA, 140 bp, Artificial Sequence
  Synthetic
atacgccatgctgggtctccggactccttagccccaggcccttgtctactcttaagggctcatccggcgggccggtaatgtgttcagcaggtcatgtcgttggactattccgcgccgccgcgtacttgggagtcggccat

SEQ ID NO: 395382 - DNA, 140 bp, Artificial Sequence
  Synthetic
atggccgactcccaagtacgcggcggcgcggaatagtccaacgacatgacctgctgaacacattaccggcccgccggatgagcccttaagagtagacaagggcctggggctaaggagtccggagacccagcatggcgtat

SEQ ID NO: 395383 - DNA, 140 bp, Artificial Sequence
  Synthetic
atacgccatgctgggtctcccgctgtaccgcaaacctatcaggttggatatctccatgctccaacaggcagcgggaaaagcacgaaggtgccagcggcgtacgcctcacagggctacaaacgtacttgggagtcggccat

SEQ ID NO: 395384 - DNA, 140 bp, Artificial Sequence
  Synthetic
atggccgactcccaagtacgtttgtagccctgtgaggcgtacgccgctggcaccttcgtgcttttcccgctgcctgttggagcatggagatatccaacctgataggtttgcggtacagcgggagacccagcatggcgtat

SEQ ID NO: 395385 - DNA, 140 bp, Artificial Sequence
  Synthetic
atacgccatgctgggtctccctataacaacaggaggtcctattacctactctacctatggaaaattcctggctgatggggggtgttcggggggggcttatgacatcatcatatgtgacgacgtacttgggagtcggccat

SEQ ID NO: 395386 - DNA, 140 bp, Artificial Sequence
  Synthetic
atggccgactcccaagtacgtcgtcacatatgatgatgtcataagccccccccgaacaccccccatcagccaggaattttccataggtagagtaggtaataggacctcctgttgttatagggagacccagcatggcgtat

SEQ ID NO: 395387 - DNA, 140 bp, Artificial Sequence
  Synthetic
atacgccatgctgggtctccccccctggatcagtcaccgtcccccatccaaacatttcagaggtcgcactgcccaccactggggaaatccccttctacggaaagggtattccccttgaatcgtacttgggagtcggccat

SEQ ID NO: 395388 - DNA, 140 bp, Artificial Sequence
  Synthetic
atggccgactcccaagtacgattcaaggggaataccctttccgtagaaggggatttccccagtggtgggcagtgcgacctctgaaatgtttggatgggggacggtgactgatccagggggggagacccagcatggcgtat

SEQ ID NO: 395389 - DNA, 140 bp, Artificial Sequence
  Synthetic
aggccctggctgctgatatgctatagaggcgtcgatgtggcagtaatccccgcccaaggggatgtggtcatctgcgccactgacgcccttatgactggttacacaggcgacttcgactccgaccttttgggacagcggtg

SEQ ID NO: 395390 - DNA, 140 bp, Artificial Sequence
  Synthetic
caccgctgtcccaaaaggtcggagtcgaagtcgcctgtgtaaccagtcataagggcgtcagtggcgcagatgaccacatccccttgggcggggattactgccacatcgacgcctctatagcatatcagcagccagggcct

SEQ ID NO: 395391 - DNA, 140 bp, Artificial Sequence
  Synthetic
atacgccatgctgggtctccgaagccagcggcgcgggcgtacgggtagagggaagccaggaacatatagatacgtttcacaaggagagcgaccatctgggatatttgactccgttgtgctcgtacttgggagtcggccat

SEQ ID NO: 395392 - DNA, 140 bp, Artificial Sequence
  Synthetic
atggccgactcccaagtacgagcacaacggagtcaaatatcccagatggtcgctctccttgtgaaacgtatctatatgttcctggcttccctctacccgtacgcccgcgccgctggcttcggagacccagcatggcgtat

SEQ ID NO: 395393 - DNA, 140 bp, Artificial Sequence
  Synthetic
atacgccatgctgggtctccctgtgaagcgtatgacacgggatgcgcgtggtatgaactaacaccatcggagaccacagtcagactacgcgcatacctgaacactcctgggctacctgtacgtacttgggagtcggccat

SEQ ID NO: 395394 - DNA, 140 bp, Artificial Sequence
  Synthetic
atggccgactcccaagtacgtacaggtagcccaggagtgttcaggtatgcgcgtagtctgactgtggtctccgatggtgttagttcataccacgcgcatcccgtgtcatacgcttcacagggagacccagcatggcgtat

SEQ ID NO: 395395 - DNA, 140 bp, Artificial Sequence
  Synthetic
  misc_feature (100)..(100): n is a, c, g, or t
aggccctggctgctgatatgcttatttagtggcctaccaagctacggtgtgcgcccgagctaaagccccccctccatcatgggacaatatgtggaagtgnctcatacggctgaagcccgtgaccttttgggacagcggtg

SEQ ID NO: 395396 - DNA, 140 bp, Artificial Sequence
  Synthetic
  misc_feature (41)..(41): n is a, c, g, or t
caccgctgtcccaaaaggtcacgggcttcagccgtatgagncacttccacatattgtcccatgatggagggggggctttagctcgggcgcacaccgtagcttggtaggccactaaataagcatatcagcagccagggcct

SEQ ID NO: 395397 - DNA, 140 bp, Artificial Sequence
  Synthetic
atacgccatgctgggtctccgctgacctagaggtgatcaccagtacgtgggtaatcgcgggggggattcttgccgcattggcggcctactgccttacggtgggtagcgttgtcatttgtgcgtacttgggagtcggccat

SEQ ID NO: 395398 - DNA, 140 bp, Artificial Sequence
  Synthetic
atggccgactcccaagtacgcacaaatgacaacgctacccaccgtaaggcagtaggccgccaatgcggcaagaatcccccccgcgattacccacgtactggtgatcacctctaggtcagcggagacccagcatggcgtat

SEQ ID NO: 395399 - DNA, 140 bp, Artificial Sequence
  Synthetic
atacgccatgctgggtctccgcaggatcgtaacctcaggtaagcccgcagtgatgcctgacagggaagtgctctatcaacaattcgacgagatggaggaatgctcacgccacatcccctacgtacttgggagtcggccat

SEQ ID NO: 395400 - DNA, 140 bp, Artificial Sequence
  Synthetic
atggccgactcccaagtacgtaggggatgtggcgtgagcattcctccatctcgtcgaattgttgatagagcacttccctgtcaggcatcactgcgggcttacctgaggttacgatcctgcggagacccagcatggcgtat

SEQ ID NO: 395401 - DNA, 140 bp, Artificial Sequence
  Synthetic
atacgccatgctgggtctccctcccagatagcgccgccaacagcgtcaacggcgtttgttgtgagcggtatggctggtgctgccgtgggcagcatcggtttgggcagggttattgttgaccgtacttgggagtcggccat

SEQ ID NO: 395402 - DNA, 140 bp, Artificial Sequence
  Synthetic
atggccgactcccaagtacggtcaacaataaccctgcccaaaccgatgctgcccacggcagcaccagccataccgctcacaacaaacgccgttgacgctgttggcggcgctatctgggagggagacccagcatggcgtat

SEQ ID NO: 395403 - DNA, 140 bp, Artificial Sequence
  Synthetic
atacgccatgctgggtctcccagctctcctctcacctggggctttggtagtgggcgtggtgtgcgctgctgtcttgaggcgccatgtaggaccatcagagggcgctgctcaatggatgaacgtacttgggagtcggccat

SEQ ID NO: 395404 - DNA, 140 bp, Artificial Sequence
  Synthetic
atggccgactcccaagtacgttcatccattgagcagcgccctctgatggtcctacatggcgcctcaagacagcagcgcacaccacgcccactaccaaagccccaggtgagaggagagctgggagacccagcatggcgtat

SEQ ID NO: 395405 - DNA, 140 bp, Artificial Sequence
  Synthetic
atacgccatgctgggtctcctcacccgtgtggagtcagagaataaggtagtaattctggactcttttgacccactccgagcagaggaggatgagagggaggtatccgttgaggcggagatcgtacttgggagtcggccat

SEQ ID NO: 395406 - DNA, 140 bp, Artificial Sequence
  Synthetic
atggccgactcccaagtacgatctccgcctcaacggatacctccctctcatcctcctctgctcggagtgggtcaaaagagtccagaattactaccttattctctgactccacacgggtgaggagacccagcatggcgtat

SEQ ID NO: 395407 - DNA, 140 bp, Artificial Sequence
  Synthetic
  misc_feature (72)..(72): n is a, c, g, or t
atacgccatgctgggtctccccctccctaccgggtgtccctttcttctcgtgtcagagggggttcaggggcncttggcgtggtgatggcatatgttgtactacatgcccttgtggagcagcgtacttgggagtcggccat

SEQ ID NO: 395408 - DNA, 140 bp, Artificial Sequence
  Synthetic
  misc_feature (69)..(69): n is a, c, g, or t
atggccgactcccaagtacgctgctccacaagggcatgtagtacaacatatgccatcaccacgccaagngcccctgaaccccctctgacacgagaagaaagggacacccggtagggagggggagacccagcatggcgtat

SEQ ID NO: 395409 - DNA, 140 bp, Artificial Sequence
  Synthetic
aggccctggctgctgatatggggtgtccgcagaggactacgttgagatcgtccgggtcaaggactgtcactacgtggtgggggcaactgctgacaatcttaagtgcccgtgccaggtgccgaccttttgggacagcggtg

SEQ ID NO: 395410 - DNA, 140 bp, Artificial Sequence
  Synthetic
caccgctgtcccaaaaggtcggcacctggcacgggcacttaagattgtcagcagttgcccccaccacgtagtgacagtccttgacccggacgatctcaacgtagtcctctgcggacaccccatatcagcagccagggcct

SEQ ID NO: 395411 - DNA, 140 bp, Artificial Sequence
  Synthetic
aggccctggctgctgatatgggccaccagggacggcaaactccccacaacgcagcttcgacgtcacatcgatctgcttgtcgggagcgccaccctctgctcggccctctacgtgggggacgaccttttgggacagcggtg

SEQ ID NO: 395412 - DNA, 140 bp, Artificial Sequence
  Synthetic
caccgctgtcccaaaaggtcgtcccccacgtagagggccgagcagagggtggcgctcccgacaagcagatcgatgtgacgtcgaagctgcgttgtggggagtttgccgtccctggtggcccatatcagcagccagggcct

SEQ ID NO: 395413 - DNA, 140 bp, Artificial Sequence
  Synthetic
aggccctggctgctgatatgaaacggcgggtcgacgcctcgggaggggctcccctccgtcgctggccagctcctcggctagtcagctttctgcgccatccttaaaggcaacatgcaccatgaccttttgggacagcggtg

SEQ ID NO: 395414 - DNA, 140 bp, Artificial Sequence
  Synthetic
caccgctgtcccaaaaggtcatggtgcatgttgcctttaaggatggcgcagaaagctgactagccgaggagctggccagcgacggaggggagcccctcccgaggcgtcgacccgccgtttcatatcagcagccagggcct

SEQ ID NO: 395415 - DNA, 140 bp, Artificial Sequence
  Synthetic
atacgccatgctgggtctccatagttctcgactcttttgacccgttgatggccgaaacagacgacaaggaaatatcagtggctgcggagtgtcacaggccgcccaggcccaagttcccaccgtacttgggagtcggccat

SEQ ID NO: 395416 - DNA, 140 bp, Artificial Sequence
  Synthetic
atggccgactcccaagtacggtgggaacttgggcctgggcggcctgtgacactccgcagccactgatatttccttgtcgtctgtttcggccatcaacgggtcaaaagagtcgagaactatggagacccagcatggcgtat

SEQ ID NO: 395417 - DNA, 140 bp, Artificial Sequence
  Synthetic
aggccctggctgctgatatgtgatcaacaccaacggcagttggcacatcaatagcacggccttgaactgcaatgatagccttaacaccggctggatagcagggctcttctatcaccacaagaccttttgggacagcggtg

SEQ ID NO: 395418 - DNA, 140 bp, Artificial Sequence
  Synthetic
caccgctgtcccaaaaggtcttgtggtgatagaagagccctgctatccagccggtgttaaggctatcattgcagttcaaggccgtgctattgatgtgccaactgccgttggtgttgatcacatatcagcagccagggcct

SEQ ID NO: 395419 - DNA, 140 bp, Artificial Sequence
  Synthetic
aggccctggctgctgatatgattcaactcttcaggctgtcccgagaggttggccagctgccgacgccttaccgattttgcccagggctggggccctatcagttatgccaacgggagcggcgaccttttgggacagcggtg

SEQ ID NO: 395420 - DNA, 140 bp, Artificial Sequence
  Synthetic
caccgctgtcccaaaaggtcgccgctcccgttggcataactgatagggccccagccctgggcaaaatcggtaaggcgtcggcagctggccaacctctcgggacagcctgaagagttgaatcatatcagcagccagggcct

SEQ ID NO: 395421 - DNA, 140 bp, Artificial Sequence
  Synthetic
atacgccatgctgggtctccgcccccaaaagggctgacacccgtacccccgcctcgacggaagagggtcgtaaagctcgatgaatcagctgctgctgaggcgctcgccgagatggcccggcgtacttgggagtcggccat

SEQ ID NO: 395422 - DNA, 140 bp, Artificial Sequence
  Synthetic
atggccgactcccaagtacgccgggccatctcggcgagcgcctcagcagcagctgattcatcgagctttacgaccctcttccgtcgaggcgggggtacgggtgtcagcccttttgggggcggagacccagcatggcgtat

SEQ ID NO: 395423 - DNA, 140 bp, Artificial Sequence
  Synthetic
atacgccatgctgggtctccctccgccacctctactgacgagacaccgacttctgacgaaccagacgcacactccgatgctggctcatatagctccatgcccccccttgagggcgagcctcgtacttgggagtcggccat

SEQ ID NO: 395424 - DNA, 140 bp, Artificial Sequence
  Synthetic
atggccgactcccaagtacgaggctcgccctcaagggggggcatggagctatatgagccagcatcggagtgtgcgtctggttcgtcagaagtcggtgtctcgtcagtagaggtggcggagggagacccagcatggcgtat

SEQ ID NO: 395425 - DNA, 140 bp, Artificial Sequence
  Synthetic
atacgccatgctgggtctcccgggggcccttataacaccgtgtgctgctgaggaagagaagctgcccatcagtccattaagcaattctctcattagacaccacaacatggtgtactctaccgtacttgggagtcggccat

SEQ ID NO: 395426 - DNA, 140 bp, Artificial Sequence
  Synthetic
atggccgactcccaagtacggtagagtacaccatgttgtggtgtctaatgagagaattgcttaatggactgatgggcagcttctcttcctcagcagcacacggtgttataagggcccccgggagacccagcatggcgtat

SEQ ID NO: 395427 - DNA, 140 bp, Artificial Sequence
  Synthetic
atacgccatgctgggtctcctccaggtgctggatcagcactaccaagatgtgctcaaggagataaaggaccgggcttccaacgtcagcgctagactcctctcaacagaggaggcatgcaacgtacttgggagtcggccat

SEQ ID NO: 395428 - DNA, 140 bp, Artificial Sequence
  Synthetic
atggccgactcccaagtacgttgcatgcctcctctgttgagaggagtctagcgctgacgttggaagcccggtcctttatctccttgagcacatcttggtagtgctgatccagcacctggaggagacccagcatggcgtat

SEQ ID NO: 395429 - DNA, 140 bp, Artificial Sequence
  Synthetic
atacgccatgctgggtctccgcgctttatgacatcacatgcaagctgcccgtggcggtaatgggagccgcttacggctttcaatactcaccaaagcagcgcgtggaccacctcctccggacgtacttgggagtcggccat

SEQ ID NO: 395430 - DNA, 140 bp, Artificial Sequence
  Synthetic
atggccgactcccaagtacgtccggaggaggtggtccacgcgctgctttggtgagtattgaaagccgtaagcggctcccattaccgccacgggcagcttgcatgtgatgtcataaagcgcggagacccagcatggcgtat

SEQ ID NO: 395431 - DNA, 140 bp, Artificial Sequence
  Synthetic
atacgccatgctgggtctccccagtgctgccagttggagcccgcagcacggaaagccattacatcgctcactgaccggctgtactgcggtggccccatgtttaactctaaaggtcaggcacgtacttgggagtcggccat

SEQ ID NO: 395432 - DNA, 140 bp, Artificial Sequence
  Synthetic
atggccgactcccaagtacgtgcctgacctttagagttaaacatggggccaccgcagtacagccggtcagtgagcgatgtaatggctttccgtgctgcgggctccaactggcagcactggggagacccagcatggcgtat

SEQ ID NO: 395433 - DNA, 140 bp, Artificial Sequence
  Synthetic
aggccctggctgctgatatgcaatactctgacttgctacttgaaagctcaagcggcatgcagggctgctgggctgagagactttgacatgttggtctgcggagacgatcttgtcgtcattgaccttttgggacagcggtg

SEQ ID NO: 395434 - DNA, 140 bp, Artificial Sequence
  Synthetic
caccgctgtcccaaaaggtcaatgacgacaagatcgtctccgcagaccaacatgtcaaagtctctcagcccagcagccctgcatgccgcttgagctttcaagtagcaagtcagagtattgcatatcagcagccagggcct

SEQ ID NO: 395435 - DNA, 140 bp, Artificial Sequence
  Synthetic
aggccctggctgctgatatgcacactccagtcaactcctggctaggcaacatcatcatgtatgcgcccaccttatgggcaaggatgattctgatgactcacttcttctccatccttctaggaccttttgggacagcggtg

SEQ ID NO: 395436 - DNA, 140 bp, Artificial Sequence
  Synthetic
caccgctgtcccaaaaggtcctagaaggatggagaagaagtgagtcatcagaatcatccttgcccataaggtgggcgcatacatgatgatgttgcctagccaggagttgactggagtgtgcatatcagcagccagggcct

SEQ ID NO: 395437 - DNA, 140 bp, Artificial Sequence
  Synthetic
atacgccatgctgggtctccagtacgatcttgagctgatcacatcttgctcttcgaacgtgtccgtagcccacgataacaatggacagagatactactacctcacaagagacccgaccaccgtacttgggagtcggccat

SEQ ID NO: 395438 - DNA, 140 bp, Artificial Sequence
  Synthetic
atggccgactcccaagtacggtggtcgggtctcttgtgaggtagtagtatctctgtccattgttatcgtgggctacggacacgttcgaagagcaagatgtgatcagctcaagatcgtactggagacccagcatggcgtat

SEQ ID NO: 395439 - DNA, 140 bp, Artificial Sequence
  Synthetic
  misc_feature (38)..(38): n is a, c, g, or t
atacgccatgctgggtctccgtactgatgacacatttntttggaatactccagtcccaagaaacactccataaagtacttgacttcgacatgtacggagtcacgtattctatcactccgtcgtacttgggagtcggccat

SEQ ID NO: 395440 - DNA, 140 bp, Artificial Sequence
  Synthetic
  misc_feature (103)..(103): n is a, c, g, or t
atggccgactcccaagtacgacggagtgatagaatacgtgactccgtacatgtcgaagtcaagtactttatggagtgtttcttgggactggagtattccaaanaaatgtgtcatcagtacggagacccagcatggcgtat

SEQ ID NO: 395441 - DNA, 140 bp, Artificial Sequence
  Synthetic
atacgccatgctgggtctccattgcttggggcgccaccgttgagagcctggagacaccgggccagggcggtcagagcgaagctcattgcccaaggggggaaagccgctatttgcggtaaacgtacttgggagtcggccat

SEQ ID NO: 395442 - DNA, 140 bp, Artificial Sequence
  Synthetic
atggccgactcccaagtacgtttaccgcaaatagcggctttccccccttgggcaatgagcttcgctctgaccgccctggcccggtgtctccaggctctcaacggtggcgccccaagcaatggagacccagcatggcgtat

SEQ ID NO: 395443 - DNA, 140 bp, Artificial Sequence
  Synthetic
aggccctggctgctgatatgtcaccttctcgcctcgccggcatgagacagtacaggactgcaattgctcaatctatcccggccatttgtcaggccatcgtatggcttgggatatgatgatgaccttttgggacagcggtg

SEQ ID NO: 395444 - DNA, 140 bp, Artificial Sequence
  Synthetic
caccgctgtcccaaaaggtcatcatcatatcccaagccatacgatggcctgacaaatggccgggatagattgagcaattgcagtcctgtactgtctcatgccggcgaggcgagaaggtgacatatcagcagccagggcct

SEQ ID NO: 395445 - DNA, 140 bp, Artificial Sequence
  Synthetic
aggccctggctgctgatatgggggggacatatttcacagcgtgtcccgggcccgaccccgcatgttactcctgtgcctactcctactttctgtaggggtaggcatcttccttcttcccgcgaccttttgggacagcggtg

SEQ ID NO: 395446 - DNA, 140 bp, Artificial Sequence
  Synthetic
caccgctgtcccaaaaggtcgcgggaagaaggaagatgcctacccctacagaaagtaggagtaggcacaggagtaacatgcggggtcgggcccgggacacgctgtgaaatatgtcccccccatatcagcagccagggcct

SEQ ID NO: 395447 - DNA, 140 bp, Artificial Sequence
  Synthetic
aggccctggctgctgatatgctgtgcctactcctactttctgtaggggtaggcatcttccttcttcccgctcggtaagggggaagcctaaagctacactccattaatgctttttttttttgaccttttgggacagcggtg

SEQ ID NO: 395448 - DNA, 140 bp, Artificial Sequence
  Synthetic
caccgctgtcccaaaaggtcaaaaaaaaaaagcattaatggagtgtagctttaggcttcccccttaccgagcgggaagaaggaagatgcctacccctacagaaagtaggagtaggcacagcatatcagcagccagggcct

SEQ ID NO: 395449 - DNA, 140 bp, Artificial Sequence
  Synthetic
aggccctggctgctgatatggatgctactttttgccggcgttgacggggagacccacgtgacaggaggggcggcaggccgcaccaccagctcgttcgcgggcttcttcacgcttgggccagaccttttgggacagcggtg

SEQ ID NO: 395450 - DNA, 140 bp, Artificial Sequence
  Synthetic
caccgctgtcccaaaaggtctggcccaagcgtgaagaagcccgcgaacgagctggtggtgcggcctgccgcccctcctgtcacgtgggtctccccgtcaacgccggcaaaaagtagcatccatatcagcagccagggcct

SEQ ID NO: 395451 - DNA, 140 bp, Artificial Sequence
  Synthetic
aggccctggctgctgatatgcttgcgagtgccccgggaggtctcgtagaccgtgcatcatgagcacacttccaaaaccccaaagaaaaaccaaaagaaacaccaaccgccgcccacaggagaccttttgggacagcggtg

SEQ ID NO: 395452 - DNA, 140 bp, Artificial Sequence
  Synthetic
caccgctgtcccaaaaggtctcctgtgggcggcggttggtgtttcttttggtttttctttggggttttggaagtgtgctcatgatgcacggtctacgagacctcccggggcactcgcaagcatatcagcagccagggcct

SEQ ID NO: 395453 - DNA, 140 bp, Artificial Sequence
  Synthetic
aggccctggctgctgatatgtgttctacacacacaggttcaacgcgtccggatgtccagagcgcatggccagctgccgccccattgacaagttcgctcaggggtggggtcccatcacttagaccttttgggacagcggtg

SEQ ID NO: 395454 - DNA, 140 bp, Artificial Sequence
  Synthetic
caccgctgtcccaaaaggtctaagtgatgggaccccacccctgagcgaacttgtcaatggggcggcagctggccatgcgctctggacatccggacgcgttgaacctgtgtgtgtagaacacatatcagcagccagggcct

SEQ ID NO: 395455 - DNA, 140 bp, Artificial Sequence
  Synthetic
  misc_feature (55)..(55): n is a, c, g, or t
aggccctggctgctgatatgcgcgcaggggcccccggttgggtgtgcgcgcaacnaggaagacttcagaacgatcccagcccagaggtaggcgccaaccaatacccaaggcgcgccaccagaccttttgggacagcggtg

SEQ ID NO: 395456 - DNA, 140 bp, Artificial Sequence
  Synthetic
  misc_feature (86)..(86): n is a, c, g, or t
caccgctgtcccaaaaggtctggtggcgcgccttgggtattggttggcgcctacctctgggctgggatcgttctgaagtcttcctngttgcgcgcacacccaaccgggggcccctgcgcgcatatcagcagccagggcct

SEQ ID NO: 395457 - DNA, 140 bp, Artificial Sequence
  Synthetic
atacgccatgctgggtctccccaaaccgtgtggtatcgtacccgcgtcgcaggtgtgtggtccagtgtattgtttcaccccaagcccagttgtggtggggaccaccgatcgcttcggtgtcgtacttgggagtcggccat

SEQ ID NO: 395458 - DNA, 140 bp, Artificial Sequence
  Synthetic
atggccgactcccaagtacgacaccgaagcgatcggtggtccccaccacaactgggcttggggtgaaacaatacactggaccacacacctgcgacgcgggtacgataccacacggtttggggagacccagcatggcgtat

SEQ ID NO: 395459 - DNA, 140 bp, Artificial Sequence
  Synthetic
atacgccatgctgggtctccccacactggggccccaatgacccccggcggaggtcccgcaacttgggtaaagtcatcgataccctgacctgcggcttcgccgacctcatggggtacatcccgtacttgggagtcggccat

SEQ ID NO: 395460 - DNA, 140 bp, Artificial Sequence
  Synthetic
atggccgactcccaagtacgggatgtaccccatgaggtcggcgaagccgcaggtcagggtatcgatgactttacccaagttgcgggacctccgccgggggtcattggggccccagtgtggggagacccagcatggcgtat

SEQ ID NO: 395461 - DNA, 140 bp, Artificial Sequence
  Synthetic
aggccctggctgctgatatgagtcatcgataccctgacctgcggcttcgccgacctcatggggtacatcccagtcgtcggcgcccccttgggaggcgtcgcggcggctttggcgcatggcgaccttttgggacagcggtg

SEQ ID NO: 395462 - DNA, 140 bp, Artificial Sequence
  Synthetic
caccgctgtcccaaaaggtcgccatgcgccaaagccgccgcgacgcctcccaagggggcgccgacgactgggatgtaccccatgaggtcggcgaagccgcaggtcagggtatcgatgactcatatcagcagccagggcct

SEQ ID NO: 395463 - DNA, 140 bp, Artificial Sequence
  Synthetic
atacgccatgctgggtctccctgcctctgcggtgcactatgccaacaggtctgacatctaccagctgaccaatgactgccccaacagtagcatcgtgtacgaggcggagagcatgatcctcgtacttgggagtcggccat

SEQ ID NO: 395464 - DNA, 140 bp, Artificial Sequence
  Synthetic
atggccgactcccaagtacgaggatcatgctctccgcctcgtacacgatgctactgttggggcagtcattggtcagctggtagatgtcagacctgttggcatagtgcaccgcagaggcagggagacccagcatggcgtat

SEQ ID NO: 395465 - DNA, 140 bp, Artificial Sequence
  Synthetic
  misc_feature (28)..(28): n is a, c, g, or t
atacgccatgctgggtctccgctgggtnccagcctcacctacgctggcggttccgaacgcctcggcgcctctcaccgggttccgcaaacatgtggacctgatggtgggcgctgctgcgttcgtacttgggagtcggccat

SEQ ID NO: 395466 - DNA, 140 bp, Artificial Sequence
  Synthetic
  misc_feature (113)..(113): n is a, c, g, or t
atggccgactcccaagtacgaacgcagcagcgcccaccatcaggtccacatgtttgcggaacccggtgagaggcgccgaggcgttcggaaccgccagcgtaggtgaggctggnacccagcggagacccagcatggcgtat

SEQ ID NO: 395467 - DNA, 140 bp, Artificial Sequence
  Synthetic
aggccctggctgctgatatgaaaggctcctcggggggcccactgctgtgccccgcgggacacgccgtaggcatattcagggccgcggtgtgcacccgtggagtggctaaggcggtggactgaccttttgggacagcggtg

SEQ ID NO: 395468 - DNA, 140 bp, Artificial Sequence
  Synthetic
caccgctgtcccaaaaggtcagtccaccgccttagccactccacgggtgcacaccgcggccctgaatatgcctacggcgtgtcccgcggggcacagcagtgggccccccgaggagcctttcatatcagcagccagggcct

SEQ ID NO: 395469 - DNA, 140 bp, Artificial Sequence
  Synthetic
aggccctggctgctgatatgacatcaacaggactgccctgaactgcaatgactccctcaacactgggtttcttgccgcgctgttctacacacacaggttcaacgcatccggatgcccagagaccttttgggacagcggtg

SEQ ID NO: 395470 - DNA, 140 bp, Artificial Sequence
  Synthetic
caccgctgtcccaaaaggtctctgggcatccggatgcgttgaacctgtgtgtgtagaacagcgcggcaagaaacccagtgttgagggagtcattgcagttcagggcagtcctgttgatgtcatatcagcagccagggcct

SEQ ID NO: 395471 - DNA, 140 bp, Artificial Sequence
  Synthetic
atacgccatgctgggtctccaactgctccgtgtatgtgggccacataacaggacacaggatggcatgggatatgatgatgaattggtcacctacggctggtctgatagtctcctacgccccgtacttgggagtcggccat

SEQ ID NO: 395472 - DNA, 140 bp, Artificial Sequence
  Synthetic
atggccgactcccaagtacggggcgtaggagactatcagaccagccgtaggtgaccaattcatcatcatatcccatgccatcctgtgtcctgttatgtggcccacatacacggagcagttggagacccagcatggcgtat

SEQ ID NO: 395473 - DNA, 140 bp, Artificial Sequence
  Synthetic
aggccctggctgctgatatggtgcttggggcgctgctgtattattccatggtagctaattgggccaaggtcatcgccgttctcattttgtttgcgggtgtggaggggactaccaccgtcggaccttttgggacagcggtg

SEQ ID NO: 395474 - DNA, 140 bp, Artificial Sequence
  Synthetic
caccgctgtcccaaaaggtccgacggtggtagtcccctccacacccgcaaacaaaatgagaacggcgatgaccttggcccaattagctaccatggaataatacagcagcgccccaagcaccatatcagcagccagggcct

SEQ ID NO: 395475 - DNA, 140 bp, Artificial Sequence
  Synthetic
  misc_feature (56)..(56): n is a, c, g, or t
atacgccatgctgggtctcccccactccacagcccggaccacgagtgggcttgtangcatatttacaccaggagctaaacagcacttgcagctcattaatagcaatggcagctggcatatcgtacttgggagtcggccat

SEQ ID NO: 395476 - DNA, 140 bp, Artificial Sequence
  Synthetic
  misc_feature (85)..(85): n is a, c, g, or t
atggccgactcccaagtacgatatgccagctgccattgctattaatgagctgcaagtgctgtttagctcctggtgtaaatatgcntacaagcccactcgtggtccgggctgtggagtgggggagacccagcatggcgtat

SEQ ID NO: 395477 - DNA, 140 bp, Artificial Sequence
  Synthetic
atacgccatgctgggtctccatgagctcatgtaagccccttacctcgtttgacaagggatggggtcctatcacgtatgccaccatcaatggctcatcttctgacaggccatattgctggccgtacttgggagtcggccat

SEQ ID NO: 395478 - DNA, 140 bp, Artificial Sequence
  Synthetic
atggccgactcccaagtacggccagcaatatggcctgtcagaagatgagccattgatggtggcatacgtgataggaccccatcccttgtcaaacgaggtaaggggcttacatgagctcatggagacccagcatggcgtat

SEQ ID NO: 395479 - DNA, 140 bp, Artificial Sequence
  Synthetic
aggccctggctgctgatatgcacaggctcaacgccgcatgcaattggactcgaggagagcgttgtgacttggaggacagggataggtcagagcttagcccgctgctgctgtctacaacaggaccttttgggacagcggtg

SEQ ID NO: 395480 - DNA, 140 bp, Artificial Sequence
  Synthetic
caccgctgtcccaaaaggtcctgttgtagacagcagcagcgggctaagctctgacctatccctgtcctccaagtcacaacgctctcctcgagtccaattgcatgcggcgttgagcctgtgcatatcagcagccagggcct

SEQ ID NO: 395481 - DNA, 140 bp, Artificial Sequence
  Synthetic
atacgccatgctgggtctccttctgaagagcgtgcggcccccacaggggggatggttcggctgtacctggatgaactctacggggttcgtcaagacatgcggagcacccccctgtaggttcgtacttgggagtcggccat

SEQ ID NO: 395482 - DNA, 140 bp, Artificial Sequence
  Synthetic
atggccgactcccaagtacgaacctacaggggggtgctccgcatgtcttgacgaaccccgtagagttcatccaggtacagccgaaccatcccccctgtgggggccgcacgctcttcagaaggagacccagcatggcgtat

SEQ ID NO: 395483 - DNA, 140 bp, Artificial Sequence
  Synthetic
atacgccatgctgggtctcctccagctgatcaactccaatggcagttggcacatcaatcgcacggccttgaactgtaacgacagcctcaatgccggctggctagcaggcctcttctaccacgtacttgggagtcggccat

SEQ ID NO: 395484 - DNA, 140 bp, Artificial Sequence
  Synthetic
atggccgactcccaagtacgtggtagaagaggcctgctagccagccggcattgaggctgtcgttacagttcaaggccgtgcgattgatgtgccaactgccattggagttgatcagctggaggagacccagcatggcgtat

SEQ ID NO: 395485 - DNA, 140 bp, Artificial Sequence
  Synthetic
aggccctggctgctgatatgcgtgaacttcaccttgcacaagattcgcatgtatgttggcggggttgagcatagactcactgctgcttgcaattggactcgcggagacccctgctcgcttgaccttttgggacagcggtg

SEQ ID NO: 395486 - DNA, 140 bp, Artificial Sequence
  Synthetic
caccgctgtcccaaaaggtcaagcgagcaggggtctccgcgagtccaattgcaagcagcagtgagtctatgctcaaccccgccaacatacatgcgaatcttgtgcaaggtgaagttcacgcatatcagcagccagggcct

SEQ ID NO: 395487 - DNA, 140 bp, Artificial Sequence
  Synthetic
atacgccatgctgggtctccgcctcatccacctgcatcagaacatcgtggacgtacagtatctctatggtctaaccccgtccgtcgtgtcgtggtcgatcaagtgggaataccttgtcctcgtacttgggagtcggccat

SEQ ID NO: 395488 - DNA, 140 bp, Artificial Sequence
  Synthetic
atggccgactcccaagtacgaggacaaggtattcccacttgatcgaccacgacacgacggacggggttagaccatagagatactgtacgtccacgatgttctgatgcaggtggatgaggcggagacccagcatggcgtat

SEQ ID NO: 395489 - DNA, 140 bp, Artificial Sequence
  Synthetic
aggccctggctgctgatatgatgccatcatcctcctcacgtgtgcggtccatccagagctaatcttcaccatcaccaaaatcttgctcgccatactcggtccgctcatggtgctccaggcgaccttttgggacagcggtg

SEQ ID NO: 395490 - DNA, 140 bp, Artificial Sequence
  Synthetic
caccgctgtcccaaaaggtcgcctggagcaccatgagcggaccgagtatggcgagcaagattttggtgatggtgaagattagctctggatggaccgcacacgtgaggaggatgatggcatcatatcagcagccagggcct

SEQ ID NO: 395491 - DNA, 140 bp, Artificial Sequence
  Synthetic
  misc_feature (26)..(26): n is a, c, g, or t
atacgccatgctgggtctccaatgcngcctctgctgccagcagtcatggctggatctggtgcattgtcttcgtgtgctcggcttggtacatcaaaggccggttcatccccgccgccacctcgtacttgggagtcggccat

SEQ ID NO: 395492 - DNA, 140 bp, Artificial Sequence
  Synthetic
  misc_feature (115)..(115): n is a, c, g, or t
atggccgactcccaagtacgaggtggcggcggggatgaaccggcctttgatgtaccaagccgagcacacgaagacaatgcaccagatccagccatgactgctggcagcagaggcngcattggagacccagcatggcgtat

SEQ ID NO: 395493 - DNA, 140 bp, Artificial Sequence
  Synthetic
aggccctggctgctgatatgcgtgtgctcggcttggtacatcaaaggccggttcatccccgccgccacctatggactgttacagctgtggccgctcctcctgctcgtgctcgcgctcccagaccttttgggacagcggtg

SEQ ID NO: 395494 - DNA, 140 bp, Artificial Sequence
  Synthetic
caccgctgtcccaaaaggtctgggagcgcgagcacgagcaggaggagcggccacagctgtaacagtccataggtggcggcggggatgaaccggcctttgatgtaccaagccgagcacacgcatatcagcagccagggcct

SEQ ID NO: 395495 - DNA, 140 bp, Artificial Sequence
  Synthetic
atacgccatgctgggtctcctgctcctgcagttcctgtggtggaaccagtacttcatagcacgcgccgaggctgtcctgcaagtgtgggttccaagcatgtccgtgcggggcggtcgagacgtacttgggagtcggccat

SEQ ID NO: 395496 - DNA, 140 bp, Artificial Sequence
  Synthetic
atggccgactcccaagtacgtctcgaccgccccgcacggacatgcttggaacccacacttgcaggacagcctcggcgcgtgctatgaagtactggttccaccacaggaactgcaggagcaggagacccagcatggcgtat

SEQ ID NO: 395497 - DNA, 140 bp, Artificial Sequence
  Synthetic
aggccctggctgctgatatgaggggtggcgactccttgcgcctatcacggcctacgcccaacagacgcgaggcctacttggctgcatcatcactagcctcacaggccgggacaagaaccagaccttttgggacagcggtg

SEQ ID NO: 395498 - DNA, 140 bp, Artificial Sequence
  Synthetic
caccgctgtcccaaaaggtctggttcttgtcccggcctgtgaggctagtgatgatgcagccaagtaggcctcgcgtctgttgggcgtaggccgtgataggcgcaaggagtcgccacccctcatatcagcagccagggcct

SEQ ID NO: 395499 - DNA, 140 bp, Artificial Sequence
  Synthetic
  misc_feature (34)..(34): n is a, c, g, or t
atacgccatgctgggtctcctactgcggctcggngcttggactggcacctacatctatgaccatctggcaccgatgtctgactgggcatgtgaagggctgcgcgacctcgcggttgcggtcgtacttgggagtcggccat

SEQ ID NO: 395500 - DNA, 140 bp, Artificial Sequence
  Synthetic
  misc_feature (107)..(107): n is a, c, g, or t
atggccgactcccaagtacgaccgcaaccgcgaggtcgcgcagcccttcacatgcccagtcagacatcggtgccagatggtcatagatgtaggtgccagtccaagcnccgagccgcagtaggagacccagcatggcgtat

SEQ ID NO: 395501 - DNA, 140 bp, Artificial Sequence
  Synthetic
atacgccatgctgggtctccgggctggaggttgctcgcccccataacagcctaccatcaacagactcgcggcttgctcggcacgattgtcaccagcttgaccggccgagacaagaacgaacgtacttgggagtcggccat

SEQ ID NO: 395502 - DNA, 140 bp, Artificial Sequence
  Synthetic
atggccgactcccaagtacgttcgttcttgtctcggccggtcaagctggtgacaatcgtgccgagcaagccgcgagtctgttgatggtaggctgttatgggggcgagcaacctccagcccggagacccagcatggcgtat

SEQ ID NO: 395503 - DNA, 140 bp, Artificial Sequence
  Synthetic
atacgccatgctgggtctcctagctgtattaacggcgtgctgtggacggtctaccacggtgctggttcaaagaccttagctggcccaaaagggcccgtctgtcagatgtacaccaatgtacgtacttgggagtcggccat

SEQ ID NO: 395504 - DNA, 140 bp, Artificial Sequence
  Synthetic
atggccgactcccaagtacgtacattggtgtacatctgacagacgggcccttttgggccagctaaggtctttgaaccagcaccgtggtagaccgtccacagcacgccgttaatacagctaggagacccagcatggcgtat

SEQ ID NO: 395505 - DNA, 140 bp, Artificial Sequence
  Synthetic
atacgccatgctgggtctccctccttgaagaggggcagcggatagccgagatgctgaagtccaagatccaaggcttattgcagcaagcctctaaacaggcccaggacatacaacccgctgcgtacttgggagtcggccat

SEQ ID NO: 395506 - DNA, 140 bp, Artificial Sequence
  Synthetic
atggccgactcccaagtacgcagcgggttgtatgtcctgggcctgtttagaggcttgctgcaataagccttggatcttggacttcagcatctcggctatccgctgcccctcttcaaggagggagacccagcatggcgtat

SEQ ID NO: 395507 - DNA, 140 bp, Artificial Sequence
  Synthetic
atacgccatgctgggtctccatgtcataccagccaggcgcagaggggataccagggcaggcttgcttagccctagacccctgagcactttaaagggctcgtcgggagggccgatcctgtgcgtacttgggagtcggccat

SEQ ID NO: 395508 - DNA, 140 bp, Artificial Sequence
  Synthetic
atggccgactcccaagtacgcacaggatcggccctcccgacgagccctttaaagtgctcaggggtctagggctaagcaagcctgccctggtatcccctctgcgcctggctggtatgacatggagacccagcatggcgtat

SEQ ID NO: 395509 - DNA, 140 bp, Artificial Sequence
  Synthetic
atacgccatgctgggtctccatgagatcaccggtcttcactgataattcaactccaccggccgtaccgcagacctaccaagtagggtacctccacgcccccaccgggagtggtaagagcacgtacttgggagtcggccat

SEQ ID NO: 395510 - DNA, 140 bp, Artificial Sequence
  Synthetic
atggccgactcccaagtacgtgctcttaccactcccggtgggggcgtggaggtaccctacttggtaggtctgcggtacggccggtggagttgaattatcagtgaagaccggtgatctcatggagacccagcatggcgtat

SEQ ID NO: 395511 - DNA, 140 bp, Artificial Sequence
  Synthetic
atacgccatgctgggtctcccagctggagcccgtctcacggtcctagccaccgcaactccccctggctcagtaaccgtcccacaccccaacattacagagacagctctgcccctaacgggcgtacttgggagtcggccat

SEQ ID NO: 395512 - DNA, 140 bp, Artificial Sequence
  Synthetic
atggccgactcccaagtacgcccgttaggggcagagctgtctctgtaatgttggggtgtgggacggttactgagccagggggagttgcggtggctaggaccgtgagacgggctccagctgggagacccagcatggcgtat

SEQ ID NO: 395513 - DNA, 140 bp, Artificial Sequence
  Synthetic
aggccctggctgctgatatggtaaccgtcccacaccccaacattacagagacagctctgcccctaacgggggaggtgcctttctacggcaaggccatccccctagaatacatcaaagggggaccttttgggacagcggtg

SEQ ID NO: 395514 - DNA, 140 bp, Artificial Sequence
  Synthetic
caccgctgtcccaaaaggtccccctttgatgtattctagggggatggccttgccgtagaaaggcacctcccccgttaggggcagagctgtctctgtaatgttggggtgtgggacggttaccatatcagcagccagggcct

SEQ ID NO: 395515 - DNA, 140 bp, Artificial Sequence
  Synthetic
atacgccatgctgggtctcccgatgtggcagttattccaacggcgggcgacgtagtcgtttgcgccaccgacgcccttatgaccgggtacacaggcgatttcgactctgtcatagactgccgtacttgggagtcggccat

SEQ ID NO: 395516 - DNA, 140 bp, Artificial Sequence
  Synthetic
atggccgactcccaagtacggcagtctatgacagagtcgaaatcgcctgtgtacccggtcataagggcgtcggtggcgcaaacgactacgtcgcccgccgttggaataactgccacatcgggagacccagcatggcgtat

SEQ ID NO: 395517 - DNA, 140 bp, Artificial Sequence
  Synthetic
atacgccatgctgggtctcctattgagaccacgaccgtcccacaagacgctgtggccagaagtcaacggcgcggccggaccggacggggaaaaccgggggtgtataggtatgtctcgcagcgtacttgggagtcggccat

SEQ ID NO: 395518 - DNA, 140 bp, Artificial Sequence
  Synthetic
atggccgactcccaagtacgctgcgagacatacctatacacccccggttttccccgtccggtccggccgcgccgttgacttctggccacagcgtcttgtgggacggtcgtggtctcaataggagacccagcatggcgtat

SEQ ID NO: 395519 - DNA, 140 bp, Artificial Sequence
  Synthetic
atacgccatgctgggtctccgattacgggcataccttaacactcccggactccctgtttgtcaggaccacctggagttctgggagggggtgtttactggcctcacccacattgatgcccacgtacttgggagtcggccat

SEQ ID NO: 395520 - DNA, 140 bp, Artificial Sequence
  Synthetic
atggccgactcccaagtacgtgggcatcaatgtgggtgaggccagtaaacaccccctcccagaactccaggtggtcctgacaaacagggagtccgggagtgttaaggtatgcccgtaatcggagacccagcatggcgtat

SEQ ID NO: 395521 - DNA, 140 bp, Artificial Sequence
  Synthetic
atacgccatgctgggtctccgacactatgtggaaatgccttatacggctaaagcccatgctaacgggcccaacccccctgctgtacaggcttggacctgtcaacaatgagatcacgaccacgtacttgggagtcggccat

SEQ ID NO: 395522 - DNA, 140 bp, Artificial Sequence
  Synthetic
atggccgactcccaagtacgtggtcgtgatctcattgttgacaggtccaagcctgtacagcaggggggttgggcccgttagcatgggctttagccgtataaggcatttccacatagtgtcggagacccagcatggcgtat

SEQ ID NO: 395523 - DNA, 140 bp, Artificial Sequence
  Synthetic
atacgccatgctgggtctccggcgtactgcctgacagtaggtagcgttgtcatctgcggcaggattgtgacatcagggaaacctgtcccaatgccggatcgtgaggtcctttaccaacagcgtacttgggagtcggccat

SEQ ID NO: 395524 - DNA, 140 bp, Artificial Sequence
  Synthetic
atggccgactcccaagtacgctgttggtaaaggacctcacgatccggcattgggacaggtttccctgatgtcacaatcctgccgcagatgacaacgctacctactgtcaggcagtacgccggagacccagcatggcgtat

SEQ ID NO: 395525 - DNA, 140 bp, Artificial Sequence
  Synthetic
  misc_feature (73)..(73): n is a, c, g, or t
atacgccatgctgggtctccccacgaccaagcaagccgaagagcttaagccagcagttcaatcggcttggccnaaggtggaacagttctggcagaaacatctatggaactttgtcagcggcgtacttgggagtcggccat

SEQ ID NO: 395526 - DNA, 140 bp, Artificial Sequence
  Synthetic
  misc_feature (68)..(68): n is a, c, g, or t
atggccgactcccaagtacgccgctgacaaagttccatagatgtttctgccagaactgttccaccttnggccaagccgattgaactgctggcttaagctcttcggcttgcttggtcgtggggagacccagcatggcgtat

SEQ ID NO: 395527 - DNA, 140 bp, Artificial Sequence
  Synthetic
  misc_feature (23)..(23): n is a, c, g, or t
aggccctggctgctgatatgccnaaggtggaacagttctggcagaaacatctatggaactttgtcagcgggatacagtatctagcgggcctctccaccctgccgggcaaccccgccgttggaccttttgggacagcggtg

SEQ ID NO: 395528 - DNA, 140 bp, Artificial Sequence
  Synthetic
  misc_feature (118)..(118): n is a, c, g, or t
caccgctgtcccaaaaggtccaacggcggggttgcccggcagggtggagaggcccgctagatactgtatcccgctgacaaagttccatagatgtttctgccagaactgttccaccttnggcatatcagcagccagggcct

SEQ ID NO: 395529 - DNA, 140 bp, Artificial Sequence
  Synthetic
atacgccatgctgggtctcccccgcctacggcgtcgacggcctttgtcgttagcggcatggctggcgctgctgtgggcagcattgggttgggcagagtcattgttgacatcctggcaggtcgtacttgggagtcggccat

SEQ ID NO: 395530 - DNA, 140 bp, Artificial Sequence
  Synthetic
atggccgactcccaagtacgacctgccaggatgtcaacaatgactctgcccaacccaatgctgcccacagcagcgccagccatgccgctaacgacaaaggccgtcgacgccgtaggcgggggagacccagcatggcgtat

SEQ ID NO: 395531 - DNA, 140 bp, Artificial Sequence
  Synthetic
atacgccatgctgggtctcccgccgggcgccttagtcgtgggcgtggtgtgtgctgccgttttacggcgccatattgggccttcggagggggcaaatcagtggatgaacagactgatagccgtacttgggagtcggccat

SEQ ID NO: 395532 - DNA, 140 bp, Artificial Sequence
  Synthetic
atggccgactcccaagtacggctatcagtctgttcatccactgatttgccccctccgaaggcccaatatggcgccgtaaaacggcagcacacaccacgcccacgactaaggcgcccggcgggagacccagcatggcgtat

SEQ ID NO: 395533 - DNA, 140 bp, Artificial Sequence
  Synthetic
aggccctggctgctgatatggggcgaagcatatgtggaacttcatcagtgggatacaatacttggcgggcctgtcaacgttgcccggcaaccccgctattgcttcattgatggcttttacgaccttttgggacagcggtg

SEQ ID NO: 395534 - DNA, 140 bp, Artificial Sequence
  Synthetic
caccgctgtcccaaaaggtcgtaaaagccatcaatgaagcaatagcggggttgccgggcaacgttgacaggcccgccaagtattgtatcccactgatgaagttccacatatgcttcgccccatatcagcagccagggcct

SEQ ID NO: 395535 - DNA, 140 bp, Artificial Sequence
  Synthetic
atacgccatgctgggtctccagcctccttcggagactccacgagtggatcaacggagattggacaactccatgcgccacttcttggctaagagacatttgggactgggtttgtactgtcccgtacttgggagtcggccat

SEQ ID NO: 395536 - DNA, 140 bp, Artificial Sequence
  Synthetic
atggccgactcccaagtacgggacagtacaaacccagtcccaaatgtctcttagccaagaagtggcgcatggagttgtccaatctccgttgatccactcgtggagtctccgaaggaggctggagacccagcatggcgtat

SEQ ID NO: 395537 - DNA, 140 bp, Artificial Sequence
  Synthetic
aggccctggctgctgatatgggagcgccaccctctgttcggccctctacgtgggggacctgtgcgggtctgtctttcttgtcggtcaactgttcaccttctctcccaggcgccactggacgaccttttgggacagcggtg

SEQ ID NO: 395538 - DNA, 140 bp, Artificial Sequence
  Synthetic
caccgctgtcccaaaaggtcgtccagtggcgcctgggagagaaggtgaacagttgaccgacaagaaagacagacccgcacaggtcccccacgtagagggccgaacagagggtggcgctcccatatcagcagccagggcct

SEQ ID NO: 395539 - DNA, 140 bp, Artificial Sequence
  Synthetic
atacgccatgctgggtctccatgtgaagaacgggaccatgaagatcgtaggtcccaagacgtgcagcaatacctggcatggtacgttccccatcaacgccactaccaccggccccagcgtcgtacttgggagtcggccat

SEQ ID NO: 395540 - DNA, 140 bp, Artificial Sequence
  Synthetic
atggccgactcccaagtacgacgctggggccggtggtagtggcgttgatggggaacgtaccatgccaggtattgctgcacgtcttgggacctacgatcttcatggtcccgttcttcacatggagacccagcatggcgtat

SEQ ID NO: 395541 - DNA, 140 bp, Artificial Sequence
  Synthetic
atacgccatgctgggtctccgctacatcagacaacttgaaatgcccgtgtcaggtgccgtcccctgagtttttcaccgaggtggacggcatcagactgcacaggtatgcaccggcatgtccgtacttgggagtcggccat

SEQ ID NO: 395542 - DNA, 140 bp, Artificial Sequence
  Synthetic
atggccgactcccaagtacggacatgccggtgcatacctgtgcagtctgatgccgtccacctcggtgaaaaactcaggggacggcacctgacacgggcatttcaagttgtctgatgtagcggagacccagcatggcgtat

SEQ ID NO: 395543 - DNA, 140 bp, Artificial Sequence
  Synthetic
aggccctggctgctgatatgcggcggagatcctgcggaaatccaggaaatttcccccagcgatgcccatatgggcacgcccggattacaaccctccactgctagagtcctggaaggacccgaccttttgggacagcggtg

SEQ ID NO: 395544 - DNA, 140 bp, Artificial Sequence
  Synthetic
caccgctgtcccaaaaggtcgggtccttccaggactctagcagtggagggttgtaatccgggcgtgcccatatgggcatcgctgggggaaatttcctggatttccgcaggatctccgccgcatatcagcagccagggcct

SEQ ID NO: 395545 - DNA, 140 bp, Artificial Sequence
  Synthetic
aggccctggctgctgatatgtgggcacgcccggattacaaccctccactgctagagtcctggaaggacccggactacgtccctccggtggtacacgggtgcccattgccacctaccaagggaccttttgggacagcggtg

SEQ ID NO: 395546 - DNA, 140 bp, Artificial Sequence
  Synthetic
caccgctgtcccaaaaggtcccttggtaggtggcaatgggcacccgtgtaccaccggagggacgtagtccgggtccttccaggactctagcagtggagggttgtaatccgggcgtgcccacatatcagcagccagggcct

SEQ ID NO: 395547 - DNA, 140 bp, Artificial Sequence
  Synthetic
atacgccatgctgggtctccgacgtccatgctcacagatccagctcacatcaccgcagagacggcgggtcgacgcctcgcgagaggctccccaccgtcattggccagctcctctgcaagtcgtacttgggagtcggccat

SEQ ID NO: 395548 - DNA, 140 bp, Artificial Sequence
  Synthetic
atggccgactcccaagtacgacttgcagaggagctggccaatgacggtggggagcctctcgcgaggcgtcgacccgccgtctctgcggtgatgtgagctggatctgtgagcatggacgtcggagacccagcatggcgtat

SEQ ID NO: 395549 - DNA, 140 bp, Artificial Sequence
  Synthetic
atacgccatgctgggtctccgtgggaacatcactcgggtcgagtctgagaacaaagtaatagtgcttgactcattcgatcctctggtcgccgagacagacgacagagagatctcagtggccgtacttgggagtcggccat

SEQ ID NO: 395550 - DNA, 140 bp, Artificial Sequence
  Synthetic
atggccgactcccaagtacggccactgagatctctctgtcgtctgtctcggcgaccagaggatcgaatgagtcaagcactattactttgttctcagactcgacccgagtgatgttcccacggagacccagcatggcgtat

SEQ ID NO: 395551 - DNA, 140 bp, Artificial Sequence
  Synthetic
aggccctggctgctgatatgtcattcgatcctctggtcgccgagacagacgacagagagatctcagtggctgctgaatgccatagaccacccagacccaaatatccacctgccctacccagaccttttgggacagcggtg

SEQ ID NO: 395552 - DNA, 140 bp, Artificial Sequence
  Synthetic
caccgctgtcccaaaaggtctgggtagggcaggtggatatttgggtctgggtggtctatggcattcagcagccactgagatctctctgtcgtctgtctcggcgaccagaggatcgaatgacatatcagcagccagggcct

SEQ ID NO: 395553 - DNA, 140 bp, Artificial Sequence
  Synthetic
atacgccatgctgggtctccgcaaccgccggtcccccctcctaggaggaaaagaacggtgttgcttgatagctccactgtctcacaggcgctggccgagctcgcccagaagtccttcccacgtacttgggagtcggccat

SEQ ID NO: 395554 - DNA, 140 bp, Artificial Sequence
  Synthetic
atggccgactcccaagtacgtgggaaggacttctgggcgagctcggccagcgcctgtgagacagtggagctatcaagcaacaccgttcttttcctcctaggaggggggaccggcggttgcggagacccagcatggcgtat

SEQ ID NO: 395555 - DNA, 140 bp, Artificial Sequence
  Synthetic
atacgccatgctgggtctccccggctcgttcagctcaatgccaccacttgagggcgagcccggtgatccagacctgagttccgggtcatggtctacggtcagtgacgaggatgacgcaaacgtacttgggagtcggccat

SEQ ID NO: 395556 - DNA, 140 bp, Artificial Sequence
  Synthetic
atggccgactcccaagtacgtttgcgtcatcctcgtcactgaccgtagaccatgacccggaactcaggtctggatcaccgggctcgccctcaagtggtggcattgagctgaacgagccggggagacccagcatggcgtat

SEQ ID NO: 395557 - DNA, 140 bp, Artificial Sequence
  Synthetic
aggccctggctgctgatatggacctgagttccgggtcatggtctacggtcagtgacgaggatgacgcaaacagcagcgttgtctgctgctctatgtcatattcatggacgggagcactcagaccttttgggacagcggtg

SEQ ID NO: 395558 - DNA, 140 bp, Artificial Sequence
  Synthetic
caccgctgtcccaaaaggtctgagtgctcccgtccatgaatatgacatagagcagcagacaacgctgctgtttgcgtcatcctcgtcactgaccgtagaccatgacccggaactcaggtccatatcagcagccagggcct

SEQ ID NO: 395559 - DNA, 140 bp, Artificial Sequence
  Synthetic
atacgccatgctgggtctcccgcgtcccttcgtcaaaagaaagtgacctttgaccgtgtccagatcctggaccagcactattctgatgttcttaaggaggtaaaagcccgagcctcccagcgtacttgggagtcggccat

SEQ ID NO: 395560 - DNA, 140 bp, Artificial Sequence
  Synthetic
atggccgactcccaagtacgctgggaggctcgggcttttacctccttaagaacatcagaatagtgctggtccaggatctggacacggtcaaaggtcactttcttttgacgaagggacgcgggagacccagcatggcgtat

SEQ ID NO: 395561 - DNA, 140 bp, Artificial Sequence
  Synthetic
atacgccatgctgggtctccatgctagcaaggccattaaccacatcaactccgtgtgggaggacttgctagaggacaactctacacctatacctactaccataatggccaagaatgaggtcgtacttgggagtcggccat

SEQ ID NO: 395562 - DNA, 140 bp, Artificial Sequence
  Synthetic
atggccgactcccaagtacgacctcattcttggccattatggtagtaggtataggtgtagagttgtcctctagcaagtcctcccacacggagttgatgtggttaatggccttgctagcatggagacccagcatggcgtat

SEQ ID NO: 395563 - DNA, 140 bp, Artificial Sequence
  Synthetic
atacgccatgctgggtctccgtcacgcgcaagctgcccctggcggtaatgggaccagcttatggtttccagtactcgcctaagcagcgcgtagaacgtctcctccaaatgtggcgcgcaacgtacttgggagtcggccat

SEQ ID NO: 395564 - DNA, 140 bp, Artificial Sequence
  Synthetic
atggccgactcccaagtacgttgcgcgccacatttggaggagacgttctacgcgctgcttaggcgagtactggaaaccataagctggtcccattaccgccaggggcagcttgcgcgtgacggagacccagcatggcgtat

SEQ ID NO: 395565 - DNA, 140 bp, Artificial Sequence
  Synthetic
atacgccatgctgggtctccctggcataaccaaagtgccgtacttcgtgcgcgctcacgggctcattcgtgcatgcatgctggtgcggaaggtcgctgggggtcattatatccaaatggccgtacttgggagtcggccat

SEQ ID NO: 395566 - DNA, 140 bp, Artificial Sequence
  Synthetic
atggccgactcccaagtacggccatttggatataatgacccccagcgaccttccgcaccagcatgcatgcacgaatgagcccgtgagcgcgcacgaagtacggcactttggttatgccagggagacccagcatggcgtat

SEQ ID NO: 395567 - DNA, 140 bp, Artificial Sequence
  Synthetic
  misc_feature (72)..(72): n is a, c, g, or t
atacgccatgctgggtctccgttagacccggaagcaagaaaggccatcacatcactcaatgaacggctgtantgcggaggccccatgtttaattctcgcaatcaatcatgtggttatcgccgtacttgggagtcggccat

SEQ ID NO: 395568 - DNA, 140 bp, Artificial Sequence
  Synthetic
  misc_feature (69)..(69): n is a, c, g, or t
atggccgactcccaagtacggcgataaccacatgattgattgcgagaattaaacatggggcctccgcantacagccgttcattgagtgatgtgatggcctttcttgcttccgggtctaacggagacccagcatggcgtat

SEQ ID NO: 395569 - DNA, 140 bp, Artificial Sequence
  Synthetic
aggccctggctgctgatatgggccttgcctactattccatggtggggaactgggctaaggtcttgattgtgatgctactcttcgccggcgttgacgggagcacccgcgtgtcgggggggagaccttttgggacagcggtg

SEQ ID NO: 395570 - DNA, 140 bp, Artificial Sequence
  Synthetic
caccgctgtcccaaaaggtctcccccccgacacgcgggtgctcccgtcaacgccggcgaagagtagcatcacaatcaagaccttagcccagttccccaccatggaatagtaggcaaggcccatatcagcagccagggcct

SEQ ID NO: 395571 - DNA, 140 bp, Artificial Sequence
  Synthetic
atacgccatgctgggtctccatgacatgttggtctgcggggatgatctggtcgtgatttcggagagtgcgggagtcaccgaggatgccagtgcactgcgagctttcacggaggctatgaccgtacttgggagtcggccat

SEQ ID NO: 395572 - DNA, 140 bp, Artificial Sequence
  Synthetic
atggccgactcccaagtacggtcatagcctccgtgaaagctcgcagtgcactggcatcctcggtgactcccgcactctccgaaatcacgaccagatcatccccgcagaccaacatgtcatggagacccagcatggcgtat

SEQ ID NO: 395573 - DNA, 140 bp, Artificial Sequence
  Synthetic
atacgccatgctgggtctccgactgccctgaactgcaacgactccctccagactgggttcatcgccgcgctgttctacacacacaagttcaacgactccggatgcccagagcgcatggcccgtacttgggagtcggccat

SEQ ID NO: 395574 - DNA, 140 bp, Artificial Sequence
  Synthetic
atggccgactcccaagtacgggccatgcgctctgggcatccggagtcgttgaacttgtgtgtgtagaacagcgcggcgatgaacccagtctggagggagtcgttgcagttcagggcagtcggagacccagcatggcgtat

SEQ ID NO: 395575 - DNA, 140 bp, Artificial Sequence
  Synthetic
atacgccatgctgggtctccagcagcctgggaaacagcccgccacactccagtgaattcatggctgggcaacatcatcatgtacgcgcccactatatgggtgcgtatggtgttgatgacacgtacttgggagtcggccat

SEQ ID NO: 395576 - DNA, 140 bp, Artificial Sequence
  Synthetic
atggccgactcccaagtacgtgtcatcaacaccatacgcacccatatagtgggcgcgtacatgatgatgttgcccagccatgaattcactggagtgtggcgggctgtttcccaggctgctggagacccagcatggcgtat

SEQ ID NO: 395577 - DNA, 140 bp, Artificial Sequence
  Synthetic
atacgccatgctgggtctccagatcattcagagattgcacggaatggccgctttttcactccatggttattcgccaggggaactcaatcgcgtggcagcaggcctcagaaagcttggggccgtacttgggagtcggccat

SEQ ID NO: 395578 - DNA, 140 bp, Artificial Sequence
  Synthetic
atggccgactcccaagtacggccccaagctttctgaggcctgctgccacgcgattgagttcccctggcgaataaccatggagtgaaaaagcggccattccgtgcaatctctgaatgatctggagacccagcatggcgtat

SEQ ID NO: 395579 - DNA, 140 bp, Artificial Sequence
  Synthetic
atacgccatgctgggtctcctgggccgtgagaacaaagctcaaactcactcctctgcgtgacgcgcaccgcttcgacttgtcggagtggttcgtggcaggcggaagcgggggggacatatcgtacttgggagtcggccat

SEQ ID NO: 395580 - DNA, 140 bp, Artificial Sequence
  Synthetic
atggccgactcccaagtacgatatgtcccccccgcttccgcctgccacgaaccactccgacaagtcgaagcggtgcgcgtcacgcagaggagtgagtttgagctttgttctcacggcccaggagacccagcatggcgtat

SEQ ID NO: 395581 - DNA, 140 bp, Artificial Sequence
  Synthetic
atacgccatgctgggtctccctacttgcggtgggagtaggcatctttctgcttcctgctcgatagacagggagcataaataacactccatttttggttttttttttttttttttttttttcgtacttgggagtcggccat

SEQ ID NO: 395582 - DNA, 140 bp, Artificial Sequence
  Synthetic
atggccgactcccaagtacgaaaaaaaaaaaaaaaaaaaaaaaaccaaaaatggagtgttatttatgctccctgtctatcgagcaggaagcagaaagatgcctactcccaccgcaagtagggagacccagcatggcgtat

SEQ ID NO: 395583 - DNA, 140 bp, Artificial Sequence
  Synthetic
aggccctggctgctgatatgcgtcaagttcccgggcggtggtcagatcgttggtggagtatacttgttgccgcgcaggggcccccggttgggtgtgcgcgcgacgaggaagacttcagaagaccttttgggacagcggtg

SEQ ID NO: 395584 - DNA, 140 bp, Artificial Sequence
  Synthetic
caccgctgtcccaaaaggtcttctgaagtcttcctcgtcgcgcgcacacccaaccgggggcccctgcgcggcaacaagtatactccaccaacgatctgaccaccgcccgggaacttgacgcatatcagcagccagggcct

SEQ ID NO: 395585 - DNA, 140 bp, Artificial Sequence
  Synthetic
atacgccatgctgggtctcccacctggggcgtcccagaaagtccagcttgtaaacaccaatggcagctggcacatcaacaggactgccctgaactgcaatgactccctcaacactgggttcgtacttgggagtcggccat

SEQ ID NO: 395586 - DNA, 140 bp, Artificial Sequence
  Synthetic
atggccgactcccaagtacgaacccagtgttgagggagtcattgcagttcagggcagtcctgttgatgtgccagctgccattggtgtttacaagctggactttctgggacgccccaggtgggagacccagcatggcgtat

SEQ ID NO: 395587 - DNA, 140 bp, Artificial Sequence
  Synthetic
aggccctggctgctgatatgcacatcaacaggactgccctgaactgcaatgactccctcaacactgggtttcttgccgcgctgttctacacacacaagttcaacgcgtccggatgcccaggaccttttgggacagcggtg

SEQ ID NO: 395588 - DNA, 140 bp, Artificial Sequence
  Synthetic
caccgctgtcccaaaaggtcctgggcatccggacgcgttgaacttgtgtgtgtagaacagcgcggcaagaaacccagtgttgagggagtcattgcagttcagggcagtcctgttgatgtgcatatcagcagccagggcct

SEQ ID NO: 395589 - DNA, 140 bp, Artificial Sequence
  Synthetic
aggccctggctgctgatatggactgggcccacgcgggcctacgagacctcgcggtggcagttgagcccgtcatcttctctgacatggagaccaaggtcatcacctggggggcagacaccggaccttttgggacagcggtg

SEQ ID NO: 395590 - DNA, 140 bp, Artificial Sequence
  Synthetic
caccgctgtcccaaaaggtccggtgtctgccccccaggtgatgaccttggtctccatgtcagagaagatgacgggctcaactgccaccgcgaggtctcgtaggcccgcgtgggcccagtccatatcagcagccagggcct

SEQ ID NO: 395591 - DNA, 140 bp, Artificial Sequence
  Synthetic
atacgccatgctgggtctccgttgcatcatcaccagccttacgggccgagacaagaaccaggtcgagggagaggtgcaagtggtttccaccgcaacgcagtctttcctagcgacctgtgtcgtacttgggagtcggccat

SEQ ID NO: 395592 - DNA, 140 bp, Artificial Sequence
  Synthetic
atggccgactcccaagtacgacacaggtcgctaggaaagactgcgttgcggtggaaaccacttgcacctctccctcgacctggttcttgtctcggcccgtaaggctggtgatgatgcaacggagacccagcatggcgtat

SEQ ID NO: 395593 - DNA, 140 bp, Artificial Sequence
  Synthetic
atacgccatgctgggtctcccaacaggaccgcgctgaactgcaacgacagcctccacactgggttccttgctaacctgttttatgtccataaaatcaacgactcaggttgcccggaccgccgtacttgggagtcggccat

SEQ ID NO: 395594 - DNA, 140 bp, Artificial Sequence
  Synthetic
atggccgactcccaagtacggcggtccgggcaacctgagtcgttgattttatggacataaaacaggttagcaaggaacccagtgtggaggctgtcgttgcagttcagcgcggtcctgttgggagacccagcatggcgtat

SEQ ID NO: 395595 - DNA, 140 bp, Artificial Sequence
  Synthetic
aggccctggctgctgatatgcggtgcgccggcggggtgacagcagggggagcttactctcccccaggcccgtctcctacctgaagggctcttcgggcggtccactgctctgtccctcggggaccttttgggacagcggtg

SEQ ID NO: 395596 - DNA, 140 bp, Artificial Sequence
  Synthetic
caccgctgtcccaaaaggtccccgagggacagagcagtggaccgcccgaagagcccttcaggtaggagacgggcctgggggagagtaagctccccctgctgtcaccccgccggcgcaccgcatatcagcagccagggcct

SEQ ID NO: 395597 - DNA, 140 bp, Artificial Sequence
  Synthetic
atacgccatgctgggtctcccctaggtgtctggttgattacccctataggctgtggcactacccatgcactgtgaacttcaccttgcacaagattcgcatgtatgttggcggggttgagccgtacttgggagtcggccat

SEQ ID NO: 395598 - DNA, 140 bp, Artificial Sequence
  Synthetic
atggccgactcccaagtacggctcaaccccgccaacatacatgcgaatcttgtgcaaggtgaagttcacagtgcatgggtagtgccacagcctataggggtaatcaaccagacacctaggggagacccagcatggcgtat

SEQ ID NO: 395599 - DNA, 140 bp, Artificial Sequence
  Synthetic
atacgccatgctgggtctcccgctgtgatattactcacgtgcctcttccaccctgcacttggatttgacattaccaagatactccttgccatcctgggccccctgtacattctccaagcgcgtacttgggagtcggccat

SEQ ID NO: 395600 - DNA, 140 bp, Artificial Sequence
  Synthetic
atggccgactcccaagtacgcgcttggagaatgtacagggggcccaggatggcaaggagtatcttggtaatgtcaaatccaagtgcagggtggaagaggcacgtgagtaatatcacagcgggagacccagcatggcgtat

SEQ ID NO: 395601 - DNA, 140 bp, Artificial Sequence
  Synthetic
aggccctggctgctgatatgaaagaccctagccggcccaaaaggcccaatcacccaaatgtacaccaatgtagaccaggacctcgtcggctggcaggcgccccccggggcgcgttccttggaccttttgggacagcggtg

SEQ ID NO: 395602 - DNA, 140 bp, Artificial Sequence
  Synthetic
caccgctgtcccaaaaggtccaaggaacgcgccccggggggcgcctgccagccgacgaggtcctggtctacattggtgtacatttgggtgattgggccttttgggccggctagggtctttcatatcagcagccagggcct

SEQ ID NO: 395603 - DNA, 140 bp, Artificial Sequence
  Synthetic
aggccctggctgctgatatgccgatgtctgactgggcatgtgaagggctgcgcgacctcgcggttgcggtagagcccatcatattctcgcccatggagaagaaactgatcacctgggggggaccttttgggacagcggtg

SEQ ID NO: 395604 - DNA, 140 bp, Artificial Sequence
  Synthetic
caccgctgtcccaaaaggtcccccccaggtgatcagtttcttctccatgggcgagaatatgatgggctctaccgcaaccgcgaggtcgcgcagcccttcacatgcccagtcagacatcggcatatcagcagccagggcct

SEQ ID NO: 395605 - DNA, 140 bp, Artificial Sequence
  Synthetic
atacgccatgctgggtctccctatggcattgacccaaacatccggacgggtgtcagaacaaccactactgggggtgccattacctattccacatacggtaagtttttggcagacggcggccgtacttgggagtcggccat

SEQ ID NO: 395606 - DNA, 140 bp, Artificial Sequence
  Synthetic
atggccgactcccaagtacggccgccgtctgccaaaaacttaccgtatgtggaataggtaatggcacccccagtagtggttgttctgacacccgtccggatgtttgggtcaatgccatagggagacccagcatggcgtat

SEQ ID NO: 395607 - DNA, 140 bp, Artificial Sequence
  Synthetic
aggccctggctgctgatatgatcttgggcatcggcaccgtccttgaccaagcagagactgcgggggcgagactggttgtgctcgccaccgctacccctccgggctccgtcactgtgccccgaccttttgggacagcggtg

SEQ ID NO: 395608 - DNA, 140 bp, Artificial Sequence
  Synthetic
caccgctgtcccaaaaggtcggggcacagtgacggagcccggaggggtagcggtggcgagcacaaccagtctcgcccccgcagtctctgcttggtcaaggacggtgccgatgcccaagatcatatcagcagccagggcct

SEQ ID NO: 395609 - DNA, 140 bp, Artificial Sequence
  Synthetic
aggccctggctgctgatatgatgtgccacttcttggctaagagacatttgggactgggtttgcactgtcctgagtgacttcaagacatggctcaaagcaaaaatagcaccatctctcccggaccttttgggacagcggtg

SEQ ID NO: 395610 - DNA, 140 bp, Artificial Sequence
  Synthetic
caccgctgtcccaaaaggtccgggagagatggtgctatttttgctttgagccatgtcttgaagtcactcaggacagtgcaaacccagtcccaaatgtctcttagccaagaagtggcacatcatatcagcagccagggcct

SEQ ID NO: 395611 - DNA, 140 bp, Artificial Sequence
  Synthetic
aggccctggctgctgatatgcgcgcaggggcccgagattgggtgtgcgcgcgacgaggaagacttccgaacggtcccagcccagaggcaggcgccagcccataccaaaggcgcgcccgccgaccttttgggacagcggtg

SEQ ID NO: 395612 - DNA, 140 bp, Artificial Sequence
  Synthetic
caccgctgtcccaaaaggtcggcgggcgcgcctttggtatgggctggcgcctgcctctgggctgggaccgttcggaagtcttcctcgtcgcgcgcacacccaatctcgggcccctgcgcgcatatcagcagccagggcct

SEQ ID NO: 395613 - DNA, 140 bp, Artificial Sequence
  Synthetic
atacgccatgctgggtctccgctccggatcgtcggccgtcgatagcggcacggcgaccgcccctcccgaccaagcctccgacgacggcgacaaagaatccgacgttgagtcgtactcctccgtacttgggagtcggccat

SEQ ID NO: 395614 - DNA, 140 bp, Artificial Sequence
  Synthetic
atggccgactcccaagtacggaggagtacgactcaacgtcggattctttgtcgccgtcgtcggaggcttggtcgggaggggcggtcgccgtgccgctatcgacggccgacgatccggagcggagacccagcatggcgtat

SEQ ID NO: 395615 - DNA, 140 bp, Artificial Sequence
  Synthetic
atacgccatgctgggtctcccttgaaaaagccctagattgtcagatctacggggcctgttactccattgagccacttgacctacctcagatcattcaacgactccatggtcttagcgcatcgtacttgggagtcggccat

SEQ ID NO: 395616 - DNA, 140 bp, Artificial Sequence
  Synthetic
atggccgactcccaagtacgatgcgctaagaccatggagtcgttgaatgatctgaggtaggtcaagtggctcaatggagtaacaggccccgtagatctgacaatctagggctttttcaagggagacccagcatggcgtat

SEQ ID NO: 395617 - DNA, 140 bp, Artificial Sequence
  Synthetic
aggccctggctgctgatatggggatcacccccttctatggccagctcctcggccagccagctgtccgctccatctctcaaggcaacttgcaccaccaaccacgactcccccgacgccgaggaccttttgggacagcggtg

SEQ ID NO: 395618 - DNA, 140 bp, Artificial Sequence
  Synthetic
caccgctgtcccaaaaggtcctcggcgtcgggggagtcgtggttggtggtgcaagttgccttgagagatggagcggacagctggctggccgaggagctggccatagaagggggtgatccccatatcagcagccagggcct

SEQ ID NO: 395619 - DNA, 140 bp, Artificial Sequence
  Synthetic
aggccctggctgctgatatgcttatgaagtgcgcaacgtgtccgggatataccatgtcacgaatgactgctccaactcaagcatcgtgtatgaggcagcagatatcatcatgcatgccccgaccttttgggacagcggtg

SEQ ID NO: 395620 - DNA, 140 bp, Artificial Sequence
  Synthetic
caccgctgtcccaaaaggtcggggcatgcatgatgatatctgctgcctcatacacgatgcttgagttggagcagtcattcgtgacatggtatatcccggacacgttgcgcacttcataagcatatcagcagccagggcct

SEQ ID NO: 395621 - DNA, 140 bp, Artificial Sequence
  Synthetic
aggccctggctgctgatatgtcgttggggcggctgctttctgctccgctatgtacgtgggggatctctgcggatctgttttcctcgtctcccagctgttcaccttctcgcctcgccggcagaccttttgggacagcggtg

SEQ ID NO: 395622 - DNA, 140 bp, Artificial Sequence
  Synthetic
caccgctgtcccaaaaggtctgccggcgaggcgagaaggtgaacagctgggagacgaggaaaacagatccgcagagatcccccacgtacatagcggagcagaaagcagccgccccaacgacatatcagcagccagggcct

SEQ ID NO: 395623 - DNA, 140 bp, Artificial Sequence
  Synthetic
atacgccatgctgggtctccggcagttccgaacgcctcgacgcctctcaccgggttccgcaagcacgtggatctgatggtgggcgctgccgcgttttgttcagctatgtacataggtgaccgtacttgggagtcggccat

SEQ ID NO: 395624 - DNA, 140 bp, Artificial Sequence
  Synthetic
atggccgactcccaagtacggtcacctatgtacatagctgaacaaaacgcggcagcgcccaccatcagatccacgtgcttgcggaacccggtgagaggcgtcgaggcgttcggaactgccggagacccagcatggcgtat

SEQ ID NO: 395625 - DNA, 140 bp, Artificial Sequence
  Synthetic
aggccctggctgctgatatgggctcatatggtggttgcagtatttcatcaccagagccgaggcgcacttgcaagtgtggatcccccctctcaacgtccggggaggccgtgatgccatcatgaccttttgggacagcggtg

SEQ ID NO: 395626 - DNA, 140 bp, Artificial Sequence
  Synthetic
caccgctgtcccaaaaggtcatgatggcatcacggcctccccggacgttgagaggggggatccacacttgcaagtgcgcctcggctctggtgatgaaatactgcaaccaccatatgagcccatatcagcagccagggcct

SEQ ID NO: 395627 - DNA, 140 bp, Artificial Sequence
  Synthetic
atacgccatgctgggtctcccatttttgtcggaggtcattggggtgtgcttggggcgctgctgtattattctatggtagctaattgggccaaggtcatcgccgttctcatcttgtttgcgcgtacttgggagtcggccat

SEQ ID NO: 395628 - DNA, 140 bp, Artificial Sequence
  Synthetic
atggccgactcccaagtacgcgcaaacaagatgagaacggcgatgaccttggcccaattagctaccatagaataatacagcagcgccccaagcacaccccaatgacctccgacaaaaatgggagacccagcatggcgtat

SEQ ID NO: 395629 - DNA, 140 bp, Artificial Sequence
  Synthetic
atacgccatgctgggtctcccaggttcgcaggcctatttacaccagggcctcaacagcacttgcagctcattaatagcaatggcagctggcacatcaacaggaccgcgctgaactgcgaccgtacttgggagtcggccat

SEQ ID NO: 395630 - DNA, 140 bp, Artificial Sequence
  Synthetic
atggccgactcccaagtacggtcgcagttcagcgcggtcctgttgatgtgccagctgccattgctattaatgagctgcaagtgctgttgaggccctggtgtaaataggcctgcgaacctgggagacccagcatggcgtat

SEQ ID NO: 395631 - DNA, 140 bp, Artificial Sequence
  Synthetic
atacgccatgctgggtctccccaatggcagctggcacataaaccggaccgccctcaattgcaatgacagcttgcagacgggtttcatcgcttccctgttttacacccatagattcaacagcgtacttgggagtcggccat

SEQ ID NO: 395632 - DNA, 140 bp, Artificial Sequence
  Synthetic
atggccgactcccaagtacgctgttgaatctatgggtgtaaaacagggaagcgatgaaacccgtctgcaagctgtcattgcaattgagggcggtccggtttatgtgccagctgccattggggagacccagcatggcgtat

SEQ ID NO: 395633 - DNA, 140 bp, Artificial Sequence
  Synthetic
aggccctggctgctgatatgtctcatgataggccatattgctggcattatgctccaagaccttgcggcgttgagccagccaagagcgtttgtggccccgtttactgctttacaccatctcgaccttttgggacagcggtg

SEQ ID NO: 395634 - DNA, 140 bp, Artificial Sequence
  Synthetic
caccgctgtcccaaaaggtcgagatggtgtaaagcagtaaacggggccacaaacgctcttggctggctcaacgccgcaaggtcttggagcataatgccagcaatatggcctatcatgagacatatcagcagccagggcct

SEQ ID NO: 395635 - DNA, 140 bp, Artificial Sequence
  Synthetic
aggccctggctgctgatatgaatgagacggacgtgctgctcctcaacaacacgcggccgccgcaaggcaactggttcggctgtacatggatgaatggcactgggttcaccaagacgtgcggaccttttgggacagcggtg

SEQ ID NO: 395636 - DNA, 140 bp, Artificial Sequence
  Synthetic
caccgctgtcccaaaaggtccgcacgtcttggtgaacccagtgccattcatccatgtacagccgaaccagttgccttgcggcggccgcgtgttgttgaggagcagcacgtccgtctcattcatatcagcagccagggcct

SEQ ID NO: 395637 - DNA, 140 bp, Artificial Sequence
  Synthetic
atacgccatgctgggtctccgccgtccaaaatgagataataacaactcatccaataaccaaatacatcatgacctgtatgtctgcggatttggaggttatcaccagcacatgggtcctcgcgtacttgggagtcggccat

SEQ ID NO: 395638 - DNA, 140 bp, Artificial Sequence
  Synthetic
atggccgactcccaagtacgcgaggacccatgtgctggtgataacctccaaatccgcagacatacaggtcatgatgtatttggttattggatgagttgttattatctcattttggacggcggagacccagcatggcgtat

SEQ ID NO: 395639 - DNA, 140 bp, Artificial Sequence
  Synthetic
atacgccatgctgggtctccagcagattaatctgatcaacaccaacggcagttggcacatcaatagaacggccctgaactgcaatgacagcctccaaactggctggctagcagggcttttcgtacttgggagtcggccat

SEQ ID NO: 395640 - DNA, 140 bp, Artificial Sequence
  Synthetic
atggccgactcccaagtacgaaaagccctgctagccagccagtttggaggctgtcattgcagttcagggccgttctattgatgtgccaactgccgttggtgttgatcagattaatctgctggagacccagcatggcgtat

SEQ ID NO: 395641 - DNA, 140 bp, Artificial Sequence
  Synthetic
aggccctggctgctgatatgaacggaagcggccccgaccaacgcccctactgctggcactaccccccaaaaccttgcggtattgtgcccgcaaagagcgtgtgtggcccggtatattgctgaccttttgggacagcggtg

SEQ ID NO: 395642 - DNA, 140 bp, Artificial Sequence
  Synthetic
caccgctgtcccaaaaggtcagcaatataccgggccacacacgctctttgcgggcacaataccgcaaggttttggggggtagtgccagcagtaggggcgttggtcggggccgcttccgttcatatcagcagccagggcct

SEQ ID NO: 395643 - DNA, 140 bp, Artificial Sequence
  Synthetic
aggccctggctgctgatatgaggccgggacaagaaccaggtcgagggggaggttcaagtggtttccaccgcaacacaatctttcctggcgacctgcgtcaacggcgtgtgttggactgtcgaccttttgggacagcggtg

SEQ ID NO: 395644 - DNA, 140 bp, Artificial Sequence
  Synthetic
caccgctgtcccaaaaggtcgacagtccaacacacgccgttgacgcaggtcgccaggaaagattgtgttgcggtggaaaccacttgaacctccccctcgacctggttcttgtcccggcctcatatcagcagccagggcct

SEQ ID NO: 395645 - DNA, 140 bp, Artificial Sequence
  Synthetic
aggccctggctgctgatatgccggggcgcgttccttgacaccgtgcacctgcggcagctcggacctttacttggtcacgaggcatgctgatgtcattccggtgcgccggcggggcgacaggaccttttgggacagcggtg

SEQ ID NO: 395646 - DNA, 140 bp, Artificial Sequence
  Synthetic
caccgctgtcccaaaaggtcctgtcgccccgccggcgcaccggaatgacatcagcatgcctcgtgaccaagtaaaggtccgagctgccgcaggtgcacggtgtcaaggaacgcgccccggcatatcagcagccagggcct

SEQ ID NO: 395647 - DNA, 140 bp, Artificial Sequence
  Synthetic
aggccctggctgctgatatgcccctccggccgtaccgcagacattccaagtggcccatctacacgctcccactggcagcggcaagagcaccaaggtgccggctgcatatgcagcccaagggaccttttgggacagcggtg

SEQ ID NO: 395648 - DNA, 140 bp, Artificial Sequence
  Synthetic
caccgctgtcccaaaaggtcccttgggctgcatatgcagccggcaccttggtgctcttgccgctgccagtgggagcgtgtagatgggccacttggaatgtctgcggtacggccggaggggcatatcagcagccagggcct

SEQ ID NO: 395649 - DNA, 140 bp, Artificial Sequence
  Synthetic
aggccctggctgctgatatggtcctggaccaagcggagacggctggagcgcggctcgtcgtgctcgccaccgctacgcctccgggatcggtcaccgtgccacatcccaatatcgaggagggaccttttgggacagcggtg

SEQ ID NO: 395650 - DNA, 140 bp, Artificial Sequence
  Synthetic
caccgctgtcccaaaaggtccctcctcgatattgggatgtggcacggtgaccgatcccggaggcgtagcggtggcgagcacgacgagccgcgctccagccgtctccgcttggtccaggaccatatcagcagccagggcct

SEQ ID NO: 395651 - DNA, 140 bp, Artificial Sequence
  Synthetic
aggccctggctgctgatatgtagcgtactaccggggccttgatgtgtccgtcataccgaccagcggagacgtcgttgtcgtggcaacagacgctctaatgacgggctataccggcgacttgaccttttgggacagcggtg

SEQ ID NO: 395652 - DNA, 140 bp, Artificial Sequence
  Synthetic
caccgctgtcccaaaaggtcaagtcgccggtatagcccgtcattagagcgtctgttgccacgacaacgacgtctccgctggtcggtatgacggacacatcaaggccccggtagtacgctacatatcagcagccagggcct

SEQ ID NO: 395653 - DNA, 140 bp, Artificial Sequence
  Synthetic
aggccctggctgctgatatggatgctgtggccagaagtcaacggcgtggtcggactggacggggaaaaccgggggtgtataggtatgtctcgcagggagaacggccatctggcacgtttggaccttttgggacagcggtg

SEQ ID NO: 395654 - DNA, 140 bp, Artificial Sequence
  Synthetic
caccgctgtcccaaaaggtccaaacgtgccagatggccgttctccctgcgagacatacctatacacccccggttttccccgtccagtccgaccacgccgttgacttctggccacagcatccatatcagcagccagggcct

SEQ ID NO: 395655 - DNA, 140 bp, Artificial Sequence
  Synthetic
aggccctggctgctgatatggcccgtttgccaggaccatctggagttctgggagagcgtcttcacaggcctcacccacatagatgcccacttcttgtcccagaccaagcaggcaggggacgaccttttgggacagcggtg

SEQ ID NO: 395656 - DNA, 140 bp, Artificial Sequence
  Synthetic
caccgctgtcccaaaaggtcgtcccctgcctgcttggtctgggacaagaagtgggcatctatgtgggtgaggcctgtgaagacgctctcccagaactccagatggtcctggcaaacgggccatatcagcagccagggcct

SEQ ID NO: 395657 - DNA, 140 bp, Artificial Sequence
  Synthetic
aggccctggctgctgatatgtcacagctcccatgcgagcccgaaccggatgtagcagtgctcacttccatgctcaccgacccctcccacattacagcagagacggctaagcgtaggctgggaccttttgggacagcggtg

SEQ ID NO: 395658 - DNA, 140 bp, Artificial Sequence
  Synthetic
caccgctgtcccaaaaggtcccagcctacgcttagccgtctctgctgtaatgtgggaggggtcggtgagcatggaagtgagcactgctacatccggttcgggctcgcatgggagctgtgacatatcagcagccagggcct

SEQ ID NO: 395659 - DNA, 140 bp, Artificial Sequence
  Synthetic
aggccctggctgctgatatgacaccggaattgccaggacgaccgggtcctttcttggataaaacccgctcaatgcctggagatttgggcgtgcccccgcaagaccgctagccgagtagtggaccttttgggacagcggtg

SEQ ID NO: 395660 - DNA, 140 bp, Artificial Sequence
  Synthetic
caccgctgtcccaaaaggtccactactcggctagcggtcttgcgggggcacgcccaaatctccaggcattgagcgggttttatccaagaaaggacccggtcgtcctggcaattccggtgtcatatcagcagccagggcct

SEQ ID NO: 395661 - DNA, 140 bp, Artificial Sequence
  Synthetic
aggccctggctgctgatatggcatagcgtatttctccatggtggggaactgggcgaaggtcctggtagtgctgctgctatttgccggcgtcgacgcaggaacccacgtcaccgggggagcgaccttttgggacagcggtg

SEQ ID NO: 395662 - DNA, 140 bp, Artificial Sequence
  Synthetic
caccgctgtcccaaaaggtcgctcccccggtgacgtgggttcctgcgtcgacgccggcaaatagcagcagcactaccaggaccttcgcccagttccccaccatggagaaatacgctatgccatatcagcagccagggcct

SEQ ID NO: 395663 - DNA, 140 bp, Artificial Sequence
  Synthetic
aggccctggctgctgatatgagcaggacatccagctgatcaacaccaacggcagttggcacatcaacaggacagccttgaactgcaatgatagccttaacaccggctggatagcagggctgaccttttgggacagcggtg

SEQ ID NO: 395664 - DNA, 140 bp, Artificial Sequence
  Synthetic
caccgctgtcccaaaaggtcagccctgctatccagccggtgttaaggctatcattgcagttcaaggctgtcctgttgatgtgccaactgccgttggtgttgatcagctggatgtcctgctcatatcagcagccagggcct

SEQ ID NO: 395665 - DNA, 140 bp, Artificial Sequence
  Synthetic
aggccctggctgctgatatgaggtacgctccggcgtgcaaacctctcctacgggatgaggtcacattccaggtcgggctcaaccaatacgtggttgggtcacagctcccatgtgagcccggaccttttgggacagcggtg

SEQ ID NO: 395666 - DNA, 140 bp, Artificial Sequence
  Synthetic
caccgctgtcccaaaaggtccgggctcacatgggagctgtgacccaaccacgtattggttgagcccgacctggaatgtgacctcatcccgtaggagaggtttgcacgccggagcgtacctcatatcagcagccagggcct

SEQ ID NO: 395667 - DNA, 140 bp, Artificial Sequence
  Synthetic
aggccctggctgctgatatgggtcgggctcaaccaatacgtggttgggtcacagctcccatgtgagcccgaaccggatgtaacagtgctcacttccatgctcaccgacccctcccacattgaccttttgggacagcggtg

SEQ ID NO: 395668 - DNA, 140 bp, Artificial Sequence
  Synthetic
caccgctgtcccaaaaggtcaatgtgggaggggtcggtgagcatggaagtgagcactgttacatccggttcgggctcacatgggagctgtgacccaaccacgtattggttgagcccgacccatatcagcagccagggcct

SEQ ID NO: 395669 - DNA, 140 bp, Artificial Sequence
  Synthetic
aggccctggctgctgatatgcatcaacgcactgagcaactcgttgctacgccaccacaatctggtgtattccaccacctcacgcagtgcgtgccaaaggcagaagaaagtcacatttgacgaccttttgggacagcggtg

SEQ ID NO: 395670 - DNA, 140 bp, Artificial Sequence
  Synthetic
caccgctgtcccaaaaggtcgtcaaatgtgactttcttctgcctttggcacgcactgcgtgaggtggtggaatacaccagattgtggtggcgtagcaacgagttgctcagtgcgttgatgcatatcagcagccagggcct

SEQ ID NO: 395671 - DNA, 140 bp, Artificial Sequence
  Synthetic
aggccctggctgctgatatgtgttctacgcacacaagttcaacgggtccggatgcccagagcgtatggccagctgccgccgcattgacaagttcgctcaggggtggggtcccatcactcagaccttttgggacagcggtg

SEQ ID NO: 395672 - DNA, 140 bp, Artificial Sequence
  Synthetic
caccgctgtcccaaaaggtctgagtgatgggaccccacccctgagcgaacttgtcaatgcggcggcagctggccatacgctctgggcatccggacccgttgaacttgtgtgcgtagaacacatatcagcagccagggcct

SEQ ID NO: 395673 - DNA, 140 bp, Artificial Sequence
  Synthetic
atacgccatgctgggtctcctgtttcaccccgagccctgttgtagtggggacgaccgatcgttctggcgcccccacgtataattggggggagaatgagacggacgtgctagtccttaacacgtacttgggagtcggccat

SEQ ID NO: 395674 - DNA, 140 bp, Artificial Sequence
  Synthetic
atggccgactcccaagtacgtgttaaggactagcacgtccgtctcattctccccccaattatacgtgggggcgccagaacgatcggtcgtccccactacaacagggctcggggtgaaacaggagacccagcatggcgtat

SEQ ID NO: 395675 - DNA, 140 bp, Artificial Sequence
  Synthetic
aggccctggctgctgatatgcatatttcacagcgtgtcccaggctcggccccgcactttactcctgtgcctactcctacttaccgtaggggtaggcatctttctgcttcctgctcgataggaccttttgggacagcggtg

SEQ ID NO: 395676 - DNA, 140 bp, Artificial Sequence
  Synthetic
caccgctgtcccaaaaggtcctatcgagcaggaagcagaaagatgcctacccctacggtaagtaggagtaggcacaggagtaaagtgcggggccgagcctgggacacgctgtgaaatatgcatatcagcagccagggcct

SEQ ID NO: 395677 - DNA, 140 bp, Artificial Sequence
  Synthetic
atacgccatgctgggtctccaatgagggctgtgggtgggcagggtggctcctgtcccctcgcggctcccgcccgacgtggggccccaacgacccccggcgtagatcccgcaatttgggtacgtacttgggagtcggccat

SEQ ID NO: 395678 - DNA, 140 bp, Artificial Sequence
  Synthetic
atggccgactcccaagtacgtacccaaattgcgggatctacgccgggggtcgttggggccccacgtcgggcgggagccgcgaggggacaggagccaccctgcccacccacagccctcattggagacccagcatggcgtat

SEQ ID NO: 395679 - DNA, 140 bp, Artificial Sequence
  Synthetic
atacgccatgctgggtctcctgttcgggctgtggaagacgggatcaattacgcaacagggaatctacccggttgctctttctctatctttctcctggccctcctctcatgccttactgtgcgtacttgggagtcggccat

SEQ ID NO: 395680 - DNA, 140 bp, Artificial Sequence
  Synthetic
atggccgactcccaagtacgcacagtaaggcatgagaggagggccaggagaaagatagagaaagagcaaccgggtagattccctgttgcgtaattgatcccgtcttccacagcccgaacaggagacccagcatggcgtat

SEQ ID NO: 395681 - DNA, 140 bp, Artificial Sequence
  Synthetic
atacgccatgctgggtctccttcacttaccagggtgcgtgccgtgtgtcaaagtggccaataggtccaaatgctgggtccctgcgacgcccacgttggctgtccaggacgagtcaacacccgtacttgggagtcggccat

SEQ ID NO: 395682 - DNA, 140 bp, Artificial Sequence
  Synthetic
atggccgactcccaagtacgggtgttgactcgtcctggacagccaacgtgggcgtcgcagggacccagcatttggacctattggccactttgacacacggcacgcaccctggtaagtgaaggagacccagcatggcgtat

SEQ ID NO: 395683 - DNA, 140 bp, Artificial Sequence
  Synthetic
atacgccatgctgggtctccggccaactcttcaccttccgccctcgcctccaccataccgtgcaggactgtaattgctccatctaccctggccacgtcaccggccacagaatggcgtgggcgtacttgggagtcggccat

SEQ ID NO: 395684 - DNA, 140 bp, Artificial Sequence
  Synthetic
atggccgactcccaagtacgcccacgccattctgtggccggtgacgtggccagggtagatggagcaattacagtcctgcacggtatggtggaggcgagggcggaaggtgaagagttggccggagacccagcatggcgtat

SEQ ID NO: 395685 - DNA, 140 bp, Artificial Sequence
  Synthetic
atacgccatgctgggtctcctgtcattggtgctgtggtgtatttctctatggtaggcagttgggtaaaagttctcctcgtcctgctcctcttcgctggcgtggatgcatatcacacctcccgtacttgggagtcggccat

SEQ ID NO: 395686 - DNA, 140 bp, Artificial Sequence
  Synthetic
atggccgactcccaagtacgggaggtgtgatatgcatccacgccagcgaagaggagcaggacgaggagaacttttacccaactgcctaccatagagaaatacaccacagcaccaatgacaggagacccagcatggcgtat

SEQ ID NO: 395687 - DNA, 140 bp, Artificial Sequence
  Synthetic
aggccctggctgctgatatggtccagtgtattgcttcaccccaagccctgttgtggtggggacgaccgatcgtttcggcgcccctacgtatagctggggggagaatgagacggacgtgctgaccttttgggacagcggtg

SEQ ID NO: 395688 - DNA, 140 bp, Artificial Sequence
  Synthetic
caccgctgtcccaaaaggtcagcacgtccgtctcattctccccccagctatacgtaggggcgccgaaacgatcggtcgtccccaccacaacagggcttggggtgaagcaatacactggaccatatcagcagccagggcct

SEQ ID NO: 395689 - DNA, 140 bp, Artificial Sequence
  Synthetic
atacgccatgctgggtctccacatcaatcgtacagctctcaattgtaatgatagtctgaagactgggttcatcgcaggcctattttatgtccgcaagtttaattccaccggatgcccgcacgtacttgggagtcggccat

SEQ ID NO: 395690 - DNA, 140 bp, Artificial Sequence
  Synthetic
atggccgactcccaagtacgtgcgggcatccggtggaattaaacttgcggacataaaataggcctgcgatgaacccagtcttcagactatcattacaattgagagctgtacgattgatgtggagacccagcatggcgtat

SEQ ID NO: 395691 - DNA, 140 bp, Artificial Sequence
  Synthetic
atacgccatgctgggtctcctggcactaccccccccgcccgtgtgaagtggtaccggctgagacagtgtgtggcccagtctattgctttacacccagtccggtcgtggtcggcaccactgcgtacttgggagtcggccat

SEQ ID NO: 395692 - DNA, 140 bp, Artificial Sequence
  Synthetic
atggccgactcccaagtacgcagtggtgccgaccacgaccggactgggtgtaaagcaatagactgggccacacactgtctcagccggtaccacttcacacgggcggggggggtagtgccaggagacccagcatggcgtat

SEQ ID NO: 395693 - DNA, 140 bp, Artificial Sequence
  Synthetic
atacgccatgctgggtctccctggatgaacgcgacggggttcgttaagacctgcggtgctccgccgtgtaacatcagacccgtgccgaatgcctctgacccagcggagttgaggtgtccccgtacttgggagtcggccat

SEQ ID NO: 395694 - DNA, 140 bp, Artificial Sequence
  Synthetic
atggccgactcccaagtacggggacacctcaactccgctgggtcagaggcattcggcacgggtctgatgttacacggcggagcaccgcaggtcttaacgaaccccgtcgcgttcatccagggagacccagcatggcgtat

SEQ ID NO: 395695 - DNA, 140 bp, Artificial Sequence
  Synthetic
atacgccatgctgggtctccggcactatccatgcacagtcaattacaccatccacaccgtccgcatgtttgtggctggtctagagcataggttgaaagtggcgtgcaactggacccgcggcgtacttgggagtcggccat

SEQ ID NO: 395696 - DNA, 140 bp, Artificial Sequence
  Synthetic
atggccgactcccaagtacgccgcgggtccagttgcacgccactttcaacctatgctctagaccagccacaaacatgcggacggtgtggatggtgtaattgactgtgcatggatagtgccggagacccagcatggcgtat

SEQ ID NO: 395697 - DNA, 140 bp, Artificial Sequence
  Synthetic
aggccctggctgctgatatggatgctgctgatagctcaggctgaggccgccttggagaacttggtggtcctcaacgcggcgtctgtggccggagcgcatggcattctctccttccttgtggaccttttgggacagcggtg

SEQ ID NO: 395698 - DNA, 140 bp, Artificial Sequence
  Synthetic
caccgctgtcccaaaaggtccacaaggaaggagagaatgccatgcgctccggccacagacgccgcgttgaggaccaccaagttctccaaggcggcctcagcctgagctatcagcagcatccatatcagcagccagggcct

SEQ ID NO: 395699 - DNA, 140 bp, Artificial Sequence
  Synthetic
atacgccatgctgggtctcccctgcactgtcatccggactgatccacctccatcagaatgttgtggacgtgcaatacctatatggagtatccacgagcaccaccagctgggtgattaaatcgtacttgggagtcggccat

SEQ ID NO: 395700 - DNA, 140 bp, Artificial Sequence
  Synthetic
atggccgactcccaagtacgatttaatcacccagctggtggtgctcgtggatactccatataggtattgcacgtccacaacattctgatggaggtggatcagtccggatgacagtgcaggggagacccagcatggcgtat

SEQ ID NO: 395701 - DNA, 140 bp, Artificial Sequence
  Synthetic
atacgccatgctgggtctcctcggccctcggaatcaatgctgtggcgtactaccggggccttgatgtgtccgtcataccgacaagcggaaacgtcgttgtcgtggcaacagacgctctgacgtacttgggagtcggccat

SEQ ID NO: 395702 - DNA, 140 bp, Artificial Sequence
  Synthetic
atggccgactcccaagtacgtcagagcgtctgttgccacgacaacgacgtttccgcttgtcggtatgacggacacatcaaggccccggtagtacgccacagcattgattccgagggccgaggagacccagcatggcgtat

SEQ ID NO: 395703 - DNA, 140 bp, Artificial Sequence
  Synthetic
atacgccatgctgggtctccaaacctcatcagtctgaatgctgccgcggctgcgggtacccacaggtgggtgtggggtctagccttcatctgccttgcttggcatgtcagaggtagacttcgtacttgggagtcggccat

SEQ ID NO: 395704 - DNA, 140 bp, Artificial Sequence
  Synthetic
atggccgactcccaagtacgaagtctacctctgacatgccaagcaaggcagatgaaggctagaccccacacccacctgtgggtacccgcagccgcggcagcattcagactgatgaggtttggagacccagcatggcgtat

SEQ ID NO: 395705 - DNA, 140 bp, Artificial Sequence
  Synthetic
atacgccatgctgggtctcccatctctaggtgcagcggtcattgtcatcctgaccctcgtcactctcactccacattataaggctctgctcactgggtgcctctggtggatccagtatttcgtacttgggagtcggccat

SEQ ID NO: 395706 - DNA, 140 bp, Artificial Sequence
  Synthetic
atggccgactcccaagtacgaaatactggatccaccagaggcacccagtgagcagagccttataatgtggagtgagagtgacgagggtcaggatgacaatgaccgctgcacctagagatgggagacccagcatggcgtat

SEQ ID NO: 395707 - DNA, 140 bp, Artificial Sequence
  Synthetic
aggccctggctgctgatatgtttcatgaagctggccgcactgacaggtacgtacgtttatgaccatcttactccactgcgggactgggcccacgcgggcctgcgagacctcgcggtggcagaccttttgggacagcggtg

SEQ ID NO: 395708 - DNA, 140 bp, Artificial Sequence
  Synthetic
caccgctgtcccaaaaggtctgccaccgcgaggtctcgcaggcccgcgtgggcccagtcccgcagtggagtaagatggtcataaacgtacgtacctgtcagtgcggccagcttcatgaaacatatcagcagccagggcct

SEQ ID NO: 395709 - DNA, 140 bp, Artificial Sequence
  Synthetic
aggccctggctgctgatatgctccactgcgggactgggcccacgcgggcctgcgagacctcgcggtggcagttgagcctgttgtcttctctgacatggagaccaagatcatcacctgggggaccttttgggacagcggtg

SEQ ID NO: 395710 - DNA, 140 bp, Artificial Sequence
  Synthetic
caccgctgtcccaaaaggtcccccaggtgatgatcttggtctccatgtcagagaagacaacaggctcaactgccaccgcgaggtctcgcaggcccgcgtgggcccagtcccgcagtggagcatatcagcagccagggcct

SEQ ID NO: 395711 - DNA, 140 bp, Artificial Sequence
  Synthetic
atacgccatgctgggtctccactttggggtttgaggtcaccaagatacttcttgccttaattggcccgttgtacttgctccaagaaggtctgctgcgggtgccgtactacgtgcgggcaccgtacttgggagtcggccat

SEQ ID NO: 395712 - DNA, 140 bp, Artificial Sequence
  Synthetic
atggccgactcccaagtacggtgcccgcacgtagtacggcacccgcagcagaccttcttggagcaagtacaacgggccaattaaggcaagaagtatcttggtgacctcaaaccccaaagtggagacccagcatggcgtat

SEQ ID NO: 395713 - DNA, 140 bp, Artificial Sequence
  Synthetic
atacgccatgctgggtctccctatgaccatctatcgcctctcgccgactgggctagcgacggtttgcgcgacctcgctgtcgcggttgaaccggtcgttttttcaccgatggagaagaggcgtacttgggagtcggccat

SEQ ID NO: 395714 - DNA, 140 bp, Artificial Sequence
  Synthetic
atggccgactcccaagtacgcctcttctccatcggtgaaaaaacgaccggttcaaccgcgacagcgaggtcgcgcaaaccgtcgctagcccagtcggcgagaggcgatagatggtcatagggagacccagcatggcgtat

SEQ ID NO: 395715 - DNA, 140 bp, Artificial Sequence
  Synthetic
aggccctggctgctgatatgacaccatgcacctgcggcagctcggacctttacttggtcacgagacatgctgatgtcattccggtgcgccggcggggcgacagcagggggagcctactctgaccttttgggacagcggtg

SEQ ID NO: 395716 - DNA, 140 bp, Artificial Sequence
  Synthetic
caccgctgtcccaaaaggtcagagtaggctccccctgctgtcgccccgccggcgcaccggaatgacatcagcatgtctcgtgaccaagtaaaggtccgagctgccgcaggtgcatggtgtcatatcagcagccagggcct

SEQ ID NO: 395717 - DNA, 140 bp, Artificial Sequence
  Synthetic
atacgccatgctgggtctccatgacgtgaaggggaagggctggtccctcctagctcccatcacggcttatgctcagcaaacacggggcctactgggcaccatcgtcacaagcctcactggcgtacttgggagtcggccat

SEQ ID NO: 395718 - DNA, 140 bp, Artificial Sequence
  Synthetic
atggccgactcccaagtacgccagtgaggcttgtgacgatggtgcccagtaggccccgtgtttgctgagcataagccgtgatgggagctaggagggaccagcccttccccttcacgtcatggagacccagcatggcgtat

SEQ ID NO: 395719 - DNA, 140 bp, Artificial Sequence
  Synthetic
atacgccatgctgggtctcccacggagccgggtcgaagaccctggccggtccaaagaagcctttgtgccaaatgtacaccaatgtggaccaagacctggtaggatggcccgcccccccggcgtacttgggagtcggccat

SEQ ID NO: 395720 - DNA, 140 bp, Artificial Sequence
  Synthetic
atggccgactcccaagtacgccgggggggcgggccatcctaccaggtcttggtccacattggtgtacatttggcacaaaggcttctttggaccggccagggtcttcgacccggctccgtgggagacccagcatggcgtat

SEQ ID NO: 395721 - DNA, 140 bp, Artificial Sequence
  Synthetic
atacgccatgctgggtctcccgcagcactcctaagcccacgacctattagcactctaaaaggttcgtcgggcgggcccgtcctctgcccgtcagggcatgtggtgggcattttccgcgcgcgtacttgggagtcggccat

SEQ ID NO: 395722 - DNA, 140 bp, Artificial Sequence
  Synthetic
atggccgactcccaagtacgcgcgcggaaaatgcccaccacatgccctgacgggcagaggacgggcccgcccgacgaaccttttagagtgctaataggtcgtgggcttaggagtgctgcgggagacccagcatggcgtat

SEQ ID NO: 395723 - DNA, 140 bp, Artificial Sequence
  Synthetic
atacgccatgctgggtctcccgcccgctgtaccacagagttatcaggtgggctacctccacgctccgactggaagcgggaagagcactaaggtccctgcggcttacgccagccagggatacgtacttgggagtcggccat

SEQ ID NO: 395724 - DNA, 140 bp, Artificial Sequence
  Synthetic
atggccgactcccaagtacgtatccctggctggcgtaagccgcagggaccttagtgctcttcccgcttccagtcggagcgtggaggtagcccacctgataactctgtggtacagcgggcgggagacccagcatggcgtat

SEQ ID NO: 395725 - DNA, 140 bp, Artificial Sequence
  Synthetic
atacgccatgctgggtctccaggacaatcacgacaggcgcccccattacttactcaacctacggcaaattccttgccgacggcgggtgtagtgggggcgcgtatgacataatcatttgtgcgtacttgggagtcggccat

SEQ ID NO: 395726 - DNA, 140 bp, Artificial Sequence
  Synthetic
atggccgactcccaagtacgcacaaatgattatgtcatacgcgcccccactacacccgccgtcggcaaggaatttgccgtaggttgagtaagtaatgggggcgcctgtcgtgattgtcctggagacccagcatggcgtat

SEQ ID NO: 395727 - DNA, 140 bp, Artificial Sequence
  Synthetic
atacgccatgctgggtctccaacaccgcctggctccgtaactgtcccacacccgaacatacaagaagttgctttgcccacgacaggggaggtccccttctacggcaaggctatacccctacgtacttgggagtcggccat

SEQ ID NO: 395728 - DNA, 140 bp, Artificial Sequence
  Synthetic
atggccgactcccaagtacgtaggggtatagccttgccgtagaaggggacctcccctgtcgtgggcaaagcaacttcttgtatgttcgggtgtgggacagttacggagccaggcggtgttggagacccagcatggcgtat

SEQ ID NO: 395729 - DNA, 140 bp, Artificial Sequence
  Synthetic
atacgccatgctgggtctccccttctacagaggtatcgacgtttcagtcatccctacctccggcgatgtcgtcgtttgcgctacggacgcccttatgactggttatacgggcgatttcgacgtacttgggagtcggccat

SEQ ID NO: 395730 - DNA, 140 bp, Artificial Sequence
  Synthetic
atggccgactcccaagtacgtcgaaatcgcccgtataaccagtcataagggcgtccgtagcgcaaacgacgacatcgccggaggtagggatgactgaaacgtcgatacctctgtagaaggggagacccagcatggcgtat

SEQ ID NO: 395731 - DNA, 140 bp, Artificial Sequence
  Synthetic
atacgccatgctgggtctcctctcgcagtcaacggcgcggccgtacggggcgggggaaaccgggggtgtataggtacgtatcgcagggagagcgcccatcagggacgttcgacaccgtcacgtacttgggagtcggccat

SEQ ID NO: 395732 - DNA, 140 bp, Artificial Sequence
  Synthetic
atggccgactcccaagtacgtgacggtgtcgaacgtccctgatgggcgctctccctgcgatacgtacctatacacccccggtttcccccgccccgtacggccgcgccgttgactgcgagaggagacccagcatggcgtat

SEQ ID NO: 395733 - DNA, 140 bp, Artificial Sequence
  Synthetic
atacgccatgctgggtctcccgtatgccaggatcatcttgagttctgggaggcagtgttcactgggctcacccacattgatgcccattttctctctcagacaaagcaggcgggggaaaaccgtacttgggagtcggccat

SEQ ID NO: 395734 - DNA, 140 bp, Artificial Sequence
  Synthetic
atggccgactcccaagtacggttttcccccgcctgctttgtctgagagagaaaatgggcatcaatgtgggtgagcccagtgaacactgcctcccagaactcaagatgatcctggcatacgggagacccagcatggcgtat

SEQ ID NO: 395735 - DNA, 140 bp, Artificial Sequence
  Synthetic
atacgccatgctgggtctccctactctcacggggcctacgcccttgttgtacaggcttggagcggtgcagaatgacatcacaacaacacacccaatcaccaagtacatcatggcttgcatcgtacttgggagtcggccat

SEQ ID NO: 395736 - DNA, 140 bp, Artificial Sequence
  Synthetic
atggccgactcccaagtacgatgcaagccatgatgtacttggtgattgggtgtgttgttgtgatgtcattctgcaccgctccaagcctgtacaacaagggcgtaggccccgtgagagtagggagacccagcatggcgtat

SEQ ID NO: 395737 - DNA, 140 bp, Artificial Sequence
  Synthetic
atacgccatgctgggtctcctgcggcaggatcataaccagtggcaagcccgccgtcatgcccgaccgagagatcatgtaccagcagtatgatgagatggaagagtgcactagtcgcattccgtacttgggagtcggccat

SEQ ID NO: 395738 - DNA, 140 bp, Artificial Sequence
  Synthetic
atggccgactcccaagtacggaatgcgactagtgcactcttccatctcatcatactgctggtacatgatctctcggtcgggcatgacggcgggcttgccactggttatgatcctgccgcaggagacccagcatggcgtat

SEQ ID NO: 395739 - DNA, 140 bp, Artificial Sequence
  Synthetic
atacgccatgctgggtctcccgtcacttctgcctggccgaagattgagcaattctggcacaagcacatgtggaacttcatcagcggaatacagtatctggcggggttatccactttaccccgtacttgggagtcggccat

SEQ ID NO: 395740 - DNA, 140 bp, Artificial Sequence
  Synthetic
atggccgactcccaagtacggggtaaagtggataaccccgccagatactgtattccgctgatgaagttccacatgtgcttgtgccagaattgctcaatcttcggccaggcagaagtgacgggagacccagcatggcgtat

SEQ ID NO: 395741 - DNA, 140 bp, Artificial Sequence
  Synthetic
  misc_feature (100)..(100): n is a, c, g, or t
atacgccatgctgggtctcctggcttcacaactgggacccgccccagccgccacagcttttgtggcgagcggcctagcaggcgcggccataggcggcgtnggcctgggcaaggtcatcgtcgtacttgggagtcggccat

SEQ ID NO: 395742 - DNA, 140 bp, Artificial Sequence
  Synthetic
  misc_feature (41)..(41): n is a, c, g, or t
atggccgactcccaagtacgacgatgaccttgcccaggccnacgccgcctatggccgcgcctgctaggccgctcgccacaaaagctgtggcggctggggcgggtcccagttgtgaagccaggagacccagcatggcgtat

SEQ ID NO: 395743 - DNA, 140 bp, Artificial Sequence
  Synthetic
atacgccatgctgggtctccctaccagccctgttgagtcccggcgctctcgtcgtgggcgtcgtgtgcgctgccatcctccggcgacatgtgggcccctctgaaggagccgcccaatggacgtacttgggagtcggccat

SEQ ID NO: 395744 - DNA, 140 bp, Artificial Sequence
  Synthetic
atggccgactcccaagtacgtccattgggcggctccttcagaggggcccacatgtcgccggaggatggcagcgcacacgacgcccacgacgagagcgccgggactcaacagggctggtagggagacccagcatggcgtat

SEQ ID NO: 395745 - DNA, 140 bp, Artificial Sequence
  Synthetic
atacgccatgctgggtctccttccctcaccattactagtcttctccgcaagcttcatcagtggatccatgaagactatgcctcaccttgctcaacgtcttggttgagggatatctgggaccgtacttgggagtcggccat

SEQ ID NO: 395746 - DNA, 140 bp, Artificial Sequence
  Synthetic
atggccgactcccaagtacggtcccagatatccctcaaccaagacgttgagcaaggtgaggcatagtcttcatggatccactgatgaagcttgcggagaagactagtaatggtgagggaaggagacccagcatggcgtat

SEQ ID NO: 395747 - DNA, 140 bp, Artificial Sequence
  Synthetic
atacgccatgctgggtctccgggggatatggaggggcgacggagtcagccacactacgtgcccatgcggcgcggaaatagcgggccacgtaaagaacgggtctatgaagatcgtgggccccgtacttgggagtcggccat

SEQ ID NO: 395748 - DNA, 140 bp, Artificial Sequence
  Synthetic
atggccgactcccaagtacggggcccacgatcttcatagacccgttctttacgtggcccgctatttccgcgccgcatgggcacgtagtgtggctgactccgtcgcccctccatatcccccggagacccagcatggcgtat

SEQ ID NO: 395749 - DNA, 140 bp, Artificial Sequence
  Synthetic
atacgccatgctgggtctcctggagagtggccgcggaggagtatgttgagattctaagggttggggacagtcactacgtggtgggcgtcaccgctgacaacgtgaaatgcccctgccaagcgtacttgggagtcggccat

SEQ ID NO: 395750 - DNA, 140 bp, Artificial Sequence
  Synthetic
atggccgactcccaagtacgcttggcaggggcatttcacgttgtcagcggtgacgcccaccacgtagtgactgtccccaacccttagaatctcaacatactcctccgcggccactctccaggagacccagcatggcgtat

SEQ ID NO: 395751 - DNA, 140 bp, Artificial Sequence
  Synthetic
aggccctggctgctgatatgactctttcgacccgctccgagcggaggaggatgagagggaagtatccgttccggcggagatcctgcggaaatccaggaaattccctccagcgatgcccgtgaccttttgggacagcggtg

SEQ ID NO: 395752 - DNA, 140 bp, Artificial Sequence
  Synthetic
caccgctgtcccaaaaggtcacgggcatcgctggagggaatttcctggatttccgcaggatctccgccggaacggatacttccctctcatcctcctccgctcggagcgggtcgaaagagtcatatcagcagccagggcct

SEQ ID NO: 395753 - DNA, 140 bp, Artificial Sequence
  Synthetic
atacgccatgctgggtctccccggcggagatcctgcggaaatccaggaaattccctccagcgatgcccgtatgggcgcgcccagattacaaccctccactgatagagtcctggaaggacccgtacttgggagtcggccat

SEQ ID NO: 395754 - DNA, 140 bp, Artificial Sequence
  Synthetic
atggccgactcccaagtacgggtccttccaggactctatcagtggagggttgtaatctgggcgcgcccatacgggcatcgctggagggaatttcctggatttccgcaggatctccgccggggagacccagcatggcgtat

SEQ ID NO: 395755 - DNA, 140 bp, Artificial Sequence
  Synthetic
atacgccatgctgggtctccggggctcaacacatacgtagtggggtctcagctgccctgcgaccccgagccagatgtcttcgtggtaacatcaatgctgacagacccagatcacatcacacgtacttgggagtcggccat

SEQ ID NO: 395756 - DNA, 140 bp, Artificial Sequence
  Synthetic
atggccgactcccaagtacgtgtgatgtgatctgggtctgtcagcattgatgttaccacgaagacatctggctcggggtcgcagggcagctgagaccccactacgtatgtgttgagccccggagacccagcatggcgtat

SEQ ID NO: 395757 - DNA, 140 bp, Artificial Sequence
  Synthetic
atacgccatgctgggtctccccaccaactgtgtccatcccgacgctgaactcatcagcgccaatctcctgtggaggcaggagatgggtggaaccatcaccagggtggagtcagagaacaacgtacttgggagtcggccat

SEQ ID NO: 395758 - DNA, 140 bp, Artificial Sequence
  Synthetic
atggccgactcccaagtacgttgttctctgactccaccctggtgatggttccacccatctcctgcctccacaggagattggcgctgatgagttcagcgtcgggatggacacagttggtggggagacccagcatggcgtat

SEQ ID NO: 395759 - DNA, 140 bp, Artificial Sequence
  Synthetic
atacgccatgctgggtctccccggccgctcttcctgtgtgggcccgtccggactacaaccccccactcttggagccatggaaggcacctgactacaagcctcccacggtatccggatgtgcgtacttgggagtcggccat

SEQ ID NO: 395760 - DNA, 140 bp, Artificial Sequence
  Synthetic
atggccgactcccaagtacgcacatccggataccgtgggaggcttgtagtcaggtgccttccatggctccaagagtggggggttgtagtccggacgggcccacacaggaagagcggccggggagacccagcatggcgtat

SEQ ID NO: 395761 - DNA, 140 bp, Artificial Sequence
  Synthetic
atacgccatgctgggtctccatcccgggcgttctcaacacctccagagcagcccgacaacaattctgatccaggactaggacctggcgcgggggagcccgcggaccatgacgcagagggacgtacttgggagtcggccat

SEQ ID NO: 395762 - DNA, 140 bp, Artificial Sequence
  Synthetic
atggccgactcccaagtacgtccctctgcgtcatggtccgcgggctcccccgcgccaggtcctagtcctggatcagaattgttgtcgggctgctctggaggtgttgagaacgcccgggatggagacccagcatggcgtat

SEQ ID NO: 395763 - DNA, 140 bp, Artificial Sequence
  Synthetic
atacgccatgctgggtctccaggaaaccagcgtatgctgttccatgtcttactcatggacaggcgctcccatcaccccttgcgcagctgaggaggaaaagttgccaataagtcccctgagcgtacttgggagtcggccat

SEQ ID NO: 395764 - DNA, 140 bp, Artificial Sequence
  Synthetic
atggccgactcccaagtacgctcaggggacttattggcaacttttcctcctcagctgcgcaaggggtgatgggagcgcctgtccatgagtaagacatggaacagcatacgctggtttcctggagacccagcatggcgtat

SEQ ID NO: 395765 - DNA, 140 bp, Artificial Sequence
  Synthetic
atacgccatgctgggtctccgattcctattactatgacacagtcaaggagataaaaaccctggcatcaggagtgaaggccagactcctctccgtagaggaggcttgcgacctcacccccccgtacttgggagtcggccat

SEQ ID NO: 395766 - DNA, 140 bp, Artificial Sequence
  Synthetic
atggccgactcccaagtacgggggggtgaggtcgcaagcctcctctacggagaggagtctggccttcactcctgatgccagggtttttatctccttgactgtgtcatagtaataggaatcggagacccagcatggcgtat

SEQ ID NO: 395767 - DNA, 140 bp, Artificial Sequence
  Synthetic
atacgccatgctgggtctccggaagacaactcaacacctattcctaccactgtaatggccaaaaacgaagtgttctgtgtggacagctcgaaagggggccgaaagcccgcccgacttatccgtacttgggagtcggccat

SEQ ID NO: 395768 - DNA, 140 bp, Artificial Sequence
  Synthetic
atggccgactcccaagtacggataagtcgggcgggctttcggccccctttcgagctgtccacacagaacacttcgtttttggccattacagtggtaggaataggtgttgagttgtcttccggagacccagcatggcgtat

SEQ ID NO: 395769 - DNA, 140 bp, Artificial Sequence
  Synthetic
atacgccatgctgggtctccagtactcacctaatcagagagtggaatatctcctcaaggtgtggcgctccaagaaaactcctatggggttctcctatgacacccggtgttttgactcaaccgtacttgggagtcggccat

SEQ ID NO: 395770 - DNA, 140 bp, Artificial Sequence
  Synthetic
atggccgactcccaagtacggttgagtcaaaacaccgggtgtcataggagaaccccataggagttttcttggagcgccacaccttgaggagatattccactctctgattaggtgagtactggagacccagcatggcgtat

SEQ ID NO: 395771 - DNA, 140 bp, Artificial Sequence
  Synthetic
atacgccatgctgggtctccgactgctctgaattgtaatgactccctcaacacggggttccttgccgcgctgttctacacacacaggtttaactcgtccggatgtccggagcgcttagcccgtacttgggagtcggccat

SEQ ID NO: 395772 - DNA, 140 bp, Artificial Sequence
  Synthetic
atggccgactcccaagtacgggctaagcgctccggacatccggacgagttaaacctgtgtgtgtagaacagcgcggcaaggaaccccgtgttgagggagtcattacaattcagagcagtcggagacccagcatggcgtat

SEQ ID NO: 395773 - DNA, 140 bp, Artificial Sequence
  Synthetic
atacgccatgctgggtctcccggcgtccaggaggacataagtgccctgcgagccttcacggaggccatgaccaggtactctgcgccccctggcgacgaacctcacccagagtacgacctgcgtacttgggagtcggccat

SEQ ID NO: 395774 - DNA, 140 bp, Artificial Sequence
  Synthetic
atggccgactcccaagtacgcaggtcgtactctgggtgaggttcgtcgccagggggcgcagagtacctggtcatggcctccgtgaaggctcgcagggcacttatgtcctcctggacgccgggagacccagcatggcgtat

SEQ ID NO: 395775 - DNA, 140 bp, Artificial Sequence
  Synthetic
aggccctggctgctgatatgcacagcctgtctcgtgcccgaccccgctggttcatgtggtgcctactcctactttctgtaggggtaggcatctacctgctccccaaccgatgaacggggagaccttttgggacagcggtg

SEQ ID NO: 395776 - DNA, 140 bp, Artificial Sequence
  Synthetic
caccgctgtcccaaaaggtctccccgttcatcggttggggagcaggtagatgcctacccctacagaaagtaggagtaggcaccacatgaaccagcggggtcgggcacgagacaggctgtgcatatcagcagccagggcct

SEQ ID NO: 395777 - DNA, 140 bp, Artificial Sequence
  Synthetic
atacgccatgctgggtctccgggctgcttgggaaacagctcggcacactccagtaaactcgtggttggggaacattattatgtacgcccctgccatctgggtccgcatggttctcatgaccgtacttgggagtcggccat

SEQ ID NO: 395778 - DNA, 140 bp, Artificial Sequence
  Synthetic
atggccgactcccaagtacggtcatgagaaccatgcggacccagatggcaggggcgtacataataatgttccccaaccacgagtttactggagtgtgccgagctgtttcccaagcagcccggagacccagcatggcgtat

SEQ ID NO: 395779 - DNA, 140 bp, Artificial Sequence
  Synthetic
atacgccatgctgggtctcccagatcatacagcgcctacatggcatggctgctttttcactccatggttactctcccggcgaactcaatcgggtggcttcgtgtctcaggaagcttgggacgtacttgggagtcggccat

SEQ ID NO: 395780 - DNA, 140 bp, Artificial Sequence
  Synthetic
atggccgactcccaagtacgtcccaagcttcctgagacacgaagccacccgattgagttcgccgggagagtaaccatggagtgaaaaagcagccatgccatgtaggcgctgtatgatctgggagacccagcatggcgtat

SEQ ID NO: 395781 - DNA, 140 bp, Artificial Sequence
  Synthetic
atacgccatgctgggtctccacctccatcaaaacatcgtggacgtgcaatacctgtacggtatcgggtcagcggtggttccctttgcaattaaatgggagtatgtcctgttgttcttcctcgtacttgggagtcggccat

SEQ ID NO: 395782 - DNA, 140 bp, Artificial Sequence
  Synthetic
atggccgactcccaagtacgaggaagaacaacaggacatactcccatttaattgcaaagggaaccaccgctgacccgataccgtacaggtattgcacgtccacgatgttttgatggaggtggagacccagcatggcgtat

SEQ ID NO: 395783 - DNA, 140 bp, Artificial Sequence
  Synthetic
atacgccatgctgggtctcctttcacagcgtgtcctatgcccgaccccgcgtattactcctgtgcctactcctgctcaccgtaggggtaggcatcttcctgcttcctgctcggtaagcagcgtacttgggagtcggccat

SEQ ID NO: 395784 - DNA, 140 bp, Artificial Sequence
  Synthetic
atggccgactcccaagtacgctgcttaccgagcaggaagcaggaagatgcctacccctacggtgagcaggagtaggcacaggagtaatacgcggggtcgggcataggacacgctgtgaaaggagacccagcatggcgtat

SEQ ID NO: 395785 - DNA, 140 bp, Artificial Sequence
  Synthetic
aggccctggctgctgatatgctgctgggtagcgctcacccccacgctcgcggccaggaacgccagcgtccccaccacgacgatacgacgtcacgtcgatttgcttgttggggcggccgcagaccttttgggacagcggtg

SEQ ID NO: 395786 - DNA, 140 bp, Artificial Sequence
  Synthetic
caccgctgtcccaaaaggtctgcggccgccccaacaagcaaatcgacgtgacgtcgtatcgtcgtggtggggacgctggcgttcctggccgcgagcgtgggggtgagcgctacccagcagcatatcagcagccagggcct

SEQ ID NO: 395787 - DNA, 140 bp, Artificial Sequence
  Synthetic
aggccctggctgctgatatgggctcatatggtggttacaatatcttatcaccagagctgaggcgcacttacaagtgtgggttcccccccttaacgtcaggggaggtcgtgatgccattatgaccttttgggacagcggtg

SEQ ID NO: 395788 - DNA, 140 bp, Artificial Sequence
  Synthetic
caccgctgtcccaaaaggtcataatggcatcacgacctcccctgacgttaagggggggaacccacacttgtaagtgcgcctcagctctggtgataagatattgtaaccaccatatgagcccatatcagcagccagggcct

SEQ ID NO: 395789 - DNA, 140 bp, Artificial Sequence
  Synthetic
atacgccatgctgggtctccgaatcctgacgggcctcgcctactattccatggcggggaactgggctaaggccttaattgtgatgctactttttgccggcgttgacggggatacctatgtcgtacttgggagtcggccat

SEQ ID NO: 395790 - DNA, 140 bp, Artificial Sequence
  Synthetic
atggccgactcccaagtacgacataggtatccccgtcaacgccggcaaaaagtagcatcacaattaaggccttagcccagttccccgccatggaatagtaggcgaggcccgtcaggattcggagacccagcatggcgtat

SEQ ID NO: 395791 - DNA, 140 bp, Artificial Sequence
  Synthetic
atacgccatgctgggtctccagagtgccgtacttcgtgcgcgctcaagggctcatccgtgcgtgtatgctggtgcggaaagttgccgggggccattacatccaaatggccttcgtgaaaccgtacttgggagtcggccat

SEQ ID NO: 395792 - DNA, 140 bp, Artificial Sequence
  Synthetic
atggccgactcccaagtacggtttcacgaaggccatttggatgtaatggcccccggcaactttccgcaccagcatacacgcacggatgagcccttgagcgcgcacgaagtacggcactctggagacccagcatggcgtat

SEQ ID NO: 395793 - DNA, 140 bp, Artificial Sequence
  Synthetic
atacgccatgctgggtctccatgagggctgcggatgggcagggtggctcctgtctccccgcggctctcgcccgacgtggggcccaaacgacccccggcgtaggtctcgcaacttgggtaacgtacttgggagtcggccat

SEQ ID NO: 395794 - DNA, 140 bp, Artificial Sequence
  Synthetic
atggccgactcccaagtacgttacccaagttgcgagacctacgccgggggtcgtttgggccccacgtcgggcgagagccgcggggagacaggagccaccctgcccatccgcagccctcatggagacccagcatggcgtat

SEQ ID NO: 395795 - DNA, 140 bp, Artificial Sequence
  Synthetic
atacgccatgctgggtctcccgtcttctctgccatggagaccaagatcatcacatggggggcggacactgcggcgtgtggggacatcatcttaggcttgcccgtctccgcccgtaggggacgtacttgggagtcggccat

SEQ ID NO: 395796 - DNA, 140 bp, Artificial Sequence
  Synthetic
atggccgactcccaagtacgtcccctacgggcggagacgggcaagcctaagatgatgtccccacacgccgcagtgtccgccccccatgtgatgatcttggtctccatggcagagaagacgggagacccagcatggcgtat

SEQ ID NO: 395797 - DNA, 140 bp, Artificial Sequence
  Synthetic
atacgccatgctgggtctccccgtcatagggggccccttagggggcgtcgcagcagctctggcgcatggcgtcagggttattgaggacggggtaaattatgcaacagggaatcttcctggcgtacttgggagtcggccat

SEQ ID NO: 395798 - DNA, 140 bp, Artificial Sequence
  Synthetic
atggccgactcccaagtacgccaggaagattccctgttgcataatttaccccgtcctcaataaccctgacgccatgcgccagagctgctgcgacgccccctaaggggccccctatgacggggagacccagcatggcgtat

SEQ ID NO: 395799 - DNA, 140 bp, Artificial Sequence
  Synthetic
atacgccatgctgggtctcccagcctcagcggtcaattatgccaataagagcggcatttaccaccttaccaatgactgcccaaacagcagcatcgtgtacgaggctgagacagttatcctcgtacttgggagtcggccat

SEQ ID NO: 395800 - DNA, 140 bp, Artificial Sequence
  Synthetic
atggccgactcccaagtacgaggataactgtctcagcctcgtacacgatgctgctgtttgggcagtcattggtaaggtggtaaatgccgctcttattggcataattgaccgctgaggctgggagacccagcatggcgtat

SEQ ID NO: 395801 - DNA, 140 bp, Artificial Sequence
  Synthetic
aggccctggctgctgatatggtatttttccatggtggggaactgggcgaaggtcctggtagtgctgttgttatttgccagcgtcgacgcagacacccacgtcaccgggggaaatgtcgccgaccttttgggacagcggtg

SEQ ID NO: 395802 - DNA, 140 bp, Artificial Sequence
  Synthetic
caccgctgtcccaaaaggtcggcgacatttcccccggtgacgtgggtgtctgcgtcgacgctggcaaataacaacagcactaccaggaccttcgcccagttccccaccatggaaaaataccatatcagcagccagggcct

SEQ ID NO: 395803 - DNA, 140 bp, Artificial Sequence
  Synthetic
atacgccatgctgggtctccgttagcgggttccgccagcatatcgatctcatggttggcgctgccgcactctgttcggctatgtatgtgggcgatttgtgcggaggggtcttcctggtagcgtacttgggagtcggccat

SEQ ID NO: 395804 - DNA, 140 bp, Artificial Sequence
  Synthetic
atggccgactcccaagtacgctaccaggaagacccctccgcacaaatcgcccacatacatagccgaacagagtgcggcagcgccaaccatgagatcgatatgctggcggaacccgctaacggagacccagcatggcgtat

SEQ ID NO: 395805 - DNA, 140 bp, Artificial Sequence
  Synthetic
atacgccatgctgggtctcccggtgcgccggcggagtgatggtaggggaagcttactctcccccaggcccatctcctacttgaagggctcttcgggtggtccactgctttgcccttcgggcgtacttgggagtcggccat

SEQ ID NO: 395806 - DNA, 140 bp, Artificial Sequence
  Synthetic
atggccgactcccaagtacgcccgaagggcaaagcagtggaccacccgaagagcccttcaagtaggagatgggcctgggggagagtaagcttcccctaccatcactccgccggcgcaccgggagacccagcatggcgtat

SEQ ID NO: 395807 - DNA, 140 bp, Artificial Sequence
  Synthetic
atacgccatgctgggtctcctgaattgcaatgacagccttaagaccggctggatagcggggcttctctaccataacaaattcaactcatcaggctgtcccgaaaggttggccagctgccgcgtacttgggagtcggccat

SEQ ID NO: 395808 - DNA, 140 bp, Artificial Sequence
  Synthetic
atggccgactcccaagtacgcggcagctggccaacctttcgggacagcctgatgagttgaatttgttatggtagagaagccccgctatccagccggtcttaaggctgtcattgcaattcaggagacccagcatggcgtat

SEQ ID NO: 395809 - DNA, 140 bp, Artificial Sequence
  Synthetic
atacgccatgctgggtctcccatgatgatgaattggtcaccaaccgtcacattcgtgatttccagcgctctaagggcgccacagatcgtgtttgacatcttcgcgggcggccattggggccgtacttgggagtcggccat

SEQ ID NO: 395810 - DNA, 140 bp, Artificial Sequence
  Synthetic
atggccgactcccaagtacggccccaatggccgcccgcgaagatgtcaaacacgatctgtggcgcccttagagcgctggaaatcacgaatgtgacggttggtgaccaattcatcatcatgggagacccagcatggcgtat

SEQ ID NO: 395811 - DNA, 140 bp, Artificial Sequence
  Synthetic
aggccctggctgctgatatggactgccctgaactgcaatgactccctccaaaccgggttcattgccgcactgttctacgcacgcaggttcaactcgtccggctgcccacagcgcttggccgaccttttgggacagcggtg

SEQ ID NO: 395812 - DNA, 140 bp, Artificial Sequence
  Synthetic
caccgctgtcccaaaaggtcggccaagcgctgtgggcagccggacgagttgaacctgcgtgcgtagaacagtgcggcaatgaacccggtttggagggagtcattgcagttcagggcagtccatatcagcagccagggcct

SEQ ID NO: 395813 - DNA, 140 bp, Artificial Sequence
  Synthetic
  misc_feature (118)..(118): n is a, c, g, or t
atacgccatgctgggtctccgcagtgcagtcagccaaacctcatttcgtctcacgagcctgttcagccccggtgccaggcagaacctacagcttgtcaacaccaacggaagctggcanatcgtacttgggagtcggccat

SEQ ID NO: 395814 - DNA, 140 bp, Artificial Sequence
  Synthetic
  misc_feature (23)..(23): n is a, c, g, or t
atggccgactcccaagtacgatntgccagcttccgttggtgttgacaagctgtaggttctgcctggcaccggggctgaacaggctcgtgagacgaaatgaggtttggctgactgcactgcggagacccagcatggcgtat

SEQ ID NO: 395815 - DNA, 140 bp, Artificial Sequence
  Synthetic
atacgccatgctgggtctccatgtcctcgtgcaggcccctggacactttcgaccaaggctggggtcccatcacgtatgccaacatcagtggtcccgctatggacaagccctactgctggccgtacttgggagtcggccat

SEQ ID NO: 395816 - DNA, 140 bp, Artificial Sequence
  Synthetic
atggccgactcccaagtacggccagcagtagggcttgtccatagcgggaccactgatgttggcatacgtgatgggaccccagccttggtcgaaagtgtccaggggcctgcacgaggacatggagacccagcatggcgtat

SEQ ID NO: 395817 - DNA, 140 bp, Artificial Sequence
  Synthetic
atacgccatgctgggtctccttcagagtaggactccacgagtacccggtggggtcgcaactaccttgcgaacccgaaccggatgtggccgtgttgacgtccatgctcactgatccctccccgtacttgggagtcggccat

SEQ ID NO: 395818 - DNA, 140 bp, Artificial Sequence
  Synthetic
atggccgactcccaagtacggggagggatcagtgagcatggacgtcaacacggccacatccggttcgggttcgcaaggtagttgcgaccccaccgggtactcgtggagtcctactctgaaggagacccagcatggcgtat

SEQ ID NO: 395819 - DNA, 140 bp, Artificial Sequence
  Synthetic
atacgccatgctgggtctccactgcttccggaagcacccaggcgctacttatgccaagtgcgggtcggggccgtggctcacccctaggtgtttggtggattacccttatagactgtggcacgtacttgggagtcggccat

SEQ ID NO: 395820 - DNA, 140 bp, Artificial Sequence
  Synthetic
atggccgactcccaagtacgtgccacagtctataagggtaatccaccaaacacctaggggtgagccacggccccgacccgcacttggcataagtagcgcctgggtgcttccggaagcagtggagacccagcatggcgtat

SEQ ID NO: 395821 - DNA, 140 bp, Artificial Sequence
  Synthetic
atacgccatgctgggtctccctacccttgcaccataaattacaccctacacaaggtccggatgtatgtggctggcggtgagcataggttcatggctgcctgcaactggaccaggggagagcgtacttgggagtcggccat

SEQ ID NO: 395822 - DNA, 140 bp, Artificial Sequence
  Synthetic
atggccgactcccaagtacgctctcccctggtccagttgcaggcagccatgaacctatgctcaccgccagccacatacatccggaccttgtgtagggtgtaatttatggtgcaagggtagggagacccagcatggcgtat

SEQ ID NO: 395823 - DNA, 140 bp, Artificial Sequence
  Synthetic
atacgccatgctgggtctccccctgtccaccggcctgatacatctacaccagaacgtagtggatgtccaatacttgtatgggctctcgacttccatcgttaattggaccattaagtgggacgtacttgggagtcggccat

SEQ ID NO: 395824 - DNA, 140 bp, Artificial Sequence
  Synthetic
atggccgactcccaagtacgtcccacttaatggtccaattaacgatggaagtcgagagcccatacaagtattggacatccactacgttctggtgtagatgtatcaggccggtggacagggggagacccagcatggcgtat

SEQ ID NO: 395825 - DNA, 140 bp, Artificial Sequence
  Synthetic
atacgccatgctgggtctccctaatagtcctcaacgccgcttcggccgcagccactcgtggctgggagtgcttcctgctcttcatctgctgggcgtggtatgtgcggggtcgcgttgtcccgtacttgggagtcggccat

SEQ ID NO: 395826 - DNA, 140 bp, Artificial Sequence
  Synthetic
atggccgactcccaagtacgggacaacgcgaccccgcacataccacgcccagcagatgaagagcaggaagcactcccagccacgagtggctgcggccgaagcggcgttgaggactattagggagacccagcatggcgtat

SEQ ID NO: 395827 - DNA, 140 bp, Artificial Sequence
  Synthetic
atacgccatgctgggtctccgattggcgccgcggtcattatcgccctgaccatcttcacgctcacaccaacatacaagactttgctagcacatttcttgtggtggactcagtacttcatacgtacttgggagtcggccat

SEQ ID NO: 395828 - DNA, 140 bp, Artificial Sequence
  Synthetic
atggccgactcccaagtacgtatgaagtactgagtccaccacaagaaatgtgctagcaaagtcttgtatgttggtgtgagcgtgaagatggtcagggcgataatgaccgcggcgccaatcggagacccagcatggcgtat

SEQ ID NO: 395829 - DNA, 140 bp, Artificial Sequence
  Synthetic
atacgccatgctgggtctcctggggtttgaggtaacaaagatcttgctagcattaataggaccactgtacatcctgcatgccagcctcctgcgggtgccatactacgtacgagcacatgccgtacttgggagtcggccat

SEQ ID NO: 395830 - DNA, 140 bp, Artificial Sequence
  Synthetic
atggccgactcccaagtacggcatgtgctcgtacgtagtatggcacccgcaggaggctggcatgcaggatgtacagtggtcctattaatgctagcaagatctttgttacctcaaaccccaggagacccagcatggcgtat

SEQ ID NO: 395831 - DNA, 140 bp, Artificial Sequence
  Synthetic
atacgccatgctgggtctccgaccacctggcccctctacacacctgggctagcaacggcctacgtgatctcgccgtcgcagtagaacccgtcgtcttttcgcctatggaaaagaaggttacgtacttgggagtcggccat

SEQ ID NO: 395832 - DNA, 140 bp, Artificial Sequence
  Synthetic
atggccgactcccaagtacgtaaccttcttttccataggcgaaaagacgacgggttctactgcgacggcgagatcacgtaggccgttgctagcccaggtgtgtagaggggccaggtggtcggagacccagcatggcgtat

SEQ ID NO: 395833 - DNA, 140 bp, Artificial Sequence
  Synthetic
aggccctggctgctgatatgcgccgtcgcagtagaacccgtcgtcttttcgcctatggaaaagaaggttatcacgtggggggcggacactgcagcctgcggggacattctcgcgggcctcgaccttttgggacagcggtg

SEQ ID NO: 395834 - DNA, 140 bp, Artificial Sequence
  Synthetic
caccgctgtcccaaaaggtcgaggcccgcgagaatgtccccgcaggctgcagtgtccgccccccacgtgataaccttcttttccataggcgaaaagacgacgggttctactgcgacggcgcatatcagcagccagggcct

SEQ ID NO: 395835 - DNA, 140 bp, Artificial Sequence
  Synthetic
aggccctggctgctgatatgggggtggctggcgcactcgtggcctttaagatcatgagcggcgagatgccctccaccgaggacctggttaatttactccctgccatcctctctcctggcggaccttttgggacagcggtg

SEQ ID NO: 395836 - DNA, 140 bp, Artificial Sequence
  Synthetic
caccgctgtcccaaaaggtccgccaggagagaggatggcagggagtaaattaaccaggtcctcggtggagggcatctcgccgctcatgatcttaaaggccacgagtgcgccagccacccccatatcagcagccagggcct

SEQ ID NO: 395837 - DNA, 140 bp, Artificial Sequence
  Synthetic
atacgccatgctgggtctccaacagacacgcgggttgctaggtacaatagtcaccagccttaccggccgtgacaagaatgaggcggctggcgagatacaaatcctctcaacggccactcacgtacttgggagtcggccat

SEQ ID NO: 395838 - DNA, 140 bp, Artificial Sequence
  Synthetic
atggccgactcccaagtacgtgagtggccgttgagaggatttgtatctcgccagccgcctcattcttgtcacggccggtaaggctggtgactattgtacctagcaacccgcgtgtctgttggagacccagcatggcgtat

SEQ ID NO: 395839 - DNA, 140 bp, Artificial Sequence
  Synthetic
atacgccatgctgggtctccaactttcctggcaacctgtgttaacggcgtgtgctggactgtctaccatggtgcagggtcaaagaccttggcagggcccaaggggcccgtctgccagatgcgtacttgggagtcggccat

SEQ ID NO: 395840 - DNA, 140 bp, Artificial Sequence
  Synthetic
atggccgactcccaagtacgcatctggcagacgggccccttgggccctgccaaggtctttgaccctgcaccatggtagacagtccagcacacgccgttaacacaggttgccaggaaagttggagacccagcatggcgtat

SEQ ID NO: 395841 - DNA, 140 bp, Artificial Sequence
  Synthetic
aggccctggctgctgatatgtcaagacctggctccagtccaagctcctgccacggttaccgggagtccccttcttctcatgccaacgtgggtacaagggaatctggcggggggacggcatgaccttttgggacagcggtg

SEQ ID NO: 395842 - DNA, 140 bp, Artificial Sequence
  Synthetic
caccgctgtcccaaaaggtcatgccgtccccccgccagattcccttgtacccacgttggcatgagaagaaggggactcccggtaaccgtggcaggagcttggactggagccaggtcttgacatatcagcagccagggcct

SEQ ID NO: 395843 - DNA, 140 bp, Artificial Sequence
  Synthetic
atacgccatgctgggtctcccgcgacaagctgatgtcatcccagcacgtcgtcgcggcgacaatcgagccggtcttatcagcccgcggccgatatccactctcaaggggtcttcagggggcgtacttgggagtcggccat

SEQ ID NO: 395844 - DNA, 140 bp, Artificial Sequence
  Synthetic
atggccgactcccaagtacgccccctgaagaccccttgagagtggatatcggccgcgggctgataagaccggctcgattgtcgccgcgacgacgtgctgggatgacatcagcttgtcgcgggagacccagcatggcgtat

SEQ ID NO: 395845 - DNA, 140 bp, Artificial Sequence
  Synthetic
atacgccatgctgggtctcctctgcacccgtggtgtcgccaaggcgcttgagtttgtgccttgtgaggccatggaatcgaccacgcggtcccccaccttcactgacaactccacaccacccgtacttgggagtcggccat

SEQ ID NO: 395846 - DNA, 140 bp, Artificial Sequence
  Synthetic
atggccgactcccaagtacgggtggtgtggagttgtcagtgaaggtgggggaccgcgtggtcgattccatggcctcacaaggcacaaactcaagcgccttggcgacaccacgggtgcagaggagacccagcatggcgtat

SEQ ID NO: 395847 - DNA, 140 bp, Artificial Sequence
  Synthetic
atacgccatgctgggtctccgtgctcgtgctcaacccgtcggtggctgcgaccctgtcctttggtgcatacctcagcaaagcccatggcattgaccctaacatcaggactggggttaggacgtacttgggagtcggccat

SEQ ID NO: 395848 - DNA, 140 bp, Artificial Sequence
  Synthetic
atggccgactcccaagtacgtcctaaccccagtcctgatgttagggtcaatgccatgggctttgctgaggtatgcaccaaaggacagggtcgcagccaccgacgggttgagcacgagcacggagacccagcatggcgtat

SEQ ID NO: 395849 - DNA, 140 bp, Artificial Sequence
  Synthetic
atacgccatgctgggtctccgctctccgacccctctcacattacagcggagacggccaggcgtaggctagccagagggtctcccccctctttggccagctcttcggccagccaattgtcccgtacttgggagtcggccat

SEQ ID NO: 395850 - DNA, 140 bp, Artificial Sequence
  Synthetic
atggccgactcccaagtacgggacaattggctggccgaagagctggccaaagaggggggagaccctctggctagcctacgcctggccgtctccgctgtaatgtgagaggggtcggagagcggagacccagcatggcgtat

SEQ ID NO: 395851 - DNA, 140 bp, Artificial Sequence
  Synthetic
atacgccatgctgggtctccgtgccactccacggaccctactacggttctgggaataggtaccgtgctcgaccaggcggagacagcgggctgccgcctcacggtgttggccaccgctacacgtacttgggagtcggccat

SEQ ID NO: 395852 - DNA, 140 bp, Artificial Sequence
  Synthetic
atggccgactcccaagtacgtgtagcggtggccaacaccgtgaggcggcagcccgctgtctccgcctggtcgagcacggtacctattcccagaaccgtagtagggtccgtggagtggcacggagacccagcatggcgtat

SEQ ID NO: 395853 - DNA, 140 bp, Artificial Sequence
  Synthetic
atacgccatgctgggtctccccgcccggctctgttacggtcccgcatccaaacatacaagagatagcgcttcccttgacgggagagataccgttctatgggaaagccatccctctagaatcgtacttgggagtcggccat

SEQ ID NO: 395854 - DNA, 140 bp, Artificial Sequence
  Synthetic
atggccgactcccaagtacgattctagagggatggctttcccatagaacggtatctctcccgtcaagggaagcgctatctcttgtatgtttggatgcgggaccgtaacagagccgggcggggagacccagcatggcgtat

SEQ ID NO: 395855 - DNA, 140 bp, Artificial Sequence
  Synthetic
aggccctggctgctgatatgtcacccgcgtggagtcagagaataaggtagtaatcctggactctttcgtcccactccgaacagaggaggacgagagggaagtgtccgttccggcggagatgaccttttgggacagcggtg

SEQ ID NO: 395856 - DNA, 140 bp, Artificial Sequence
  Synthetic
caccgctgtcccaaaaggtcatctccgccggaacggacacttccctctcgtcctcctctgttcggagtgggacgaaagagtccaggattactaccttattctctgactccacgcgggtgacatatcagcagccagggcct

SEQ ID NO: 395857 - DNA, 140 bp, Artificial Sequence
  Synthetic
atacgccatgctgggtctccctacagaggcatagacgtctccgtcatccccacctcgggtgacgtagtcatctgtgccacagatgctctcatgacagggtatacaggcgacttcgacagccgtacttgggagtcggccat

SEQ ID NO: 395858 - DNA, 140 bp, Artificial Sequence
  Synthetic
atggccgactcccaagtacggctgtcgaagtcgcctgtataccctgtcatgagagcatctgtggcacagatgactacgtcacccgaggtggggatgacggagacgtctatgcctctgtagggagacccagcatggcgtat

SEQ ID NO: 395859 - DNA, 140 bp, Artificial Sequence
  Synthetic
aggccctggctgctgatatgcctcctgtggtacacgggtgtccattgccacctaccaaggcccccccagtgccacctccgcggagaaagaggacggttgtcctgacagagtccaccgtgtgaccttttgggacagcggtg

SEQ ID NO: 395860 - DNA, 140 bp, Artificial Sequence
  Synthetic
caccgctgtcccaaaaggtcacacggtggactctgtcaggacaaccgtcctctttctccgcggaggtggcactgggggggccttggtaggtggcaatggacacccgtgtaccacaggaggcatatcagcagccagggcct

SEQ ID NO: 395861 - DNA, 140 bp, Artificial Sequence
  Synthetic
  misc_feature (58)..(58): n is a, c, g, or t
atacgccatgctgggtctccgcagtcaacgtcgtggccggactggtagggggaagccnggggtgtatagatacgtctcacagggagaacggccgtcgggaatgttcgacacggtcgtcctcgtacttgggagtcggccat

SEQ ID NO: 395862 - DNA, 140 bp, Artificial Sequence
  Synthetic
  misc_feature (83)..(83): n is a, c, g, or t
atggccgactcccaagtacgaggacgaccgtgtcgaacattcccgacggccgttctccctgtgagacgtatctatacaccccnggcttccccctaccagtccggccacgacgttgactgcggagacccagcatggcgtat

SEQ ID NO: 395863 - DNA, 140 bp, Artificial Sequence
  Synthetic
atacgccatgctgggtctcctgccaggatcacctcgagttctgggaggcagtcttcactggacttacacatatagacgcccacttcctttcccaaacaaaacaaggaggggaaaacttcgcgtacttgggagtcggccat

SEQ ID NO: 395864 - DNA, 140 bp, Artificial Sequence
  Synthetic
atggccgactcccaagtacgcgaagttttcccctccttgttttgtttgggaaaggaagtgggcgtctatatgtgtaagtccagtgaagactgcctcccagaactcgaggtgatcctggcaggagacccagcatggcgtat

SEQ ID NO: 395865 - DNA, 140 bp, Artificial Sequence
  Synthetic
  misc_feature (90)..(90): n is a, c, g, or t
atacgccatgctgggtctcccgtacctggtggcctaccaggctaccgtctgcgcgagagccaaagctccccccccctcatgggatacgangtggaagtgtctactcaggcttaagcccaccgtacttgggagtcggccat

SEQ ID NO: 395866 - DNA, 140 bp, Artificial Sequence
  Synthetic
  misc_feature (51)..(51): n is a, c, g, or t
atggccgactcccaagtacggtgggcttaagcctgagtagacacttccacntcgtatcccatgagggggggggagctttggctctcgcgcagacggtagcctggtaggccaccaggtacgggagacccagcatggcgtat

SEQ ID NO: 395867 - DNA, 140 bp, Artificial Sequence
  Synthetic
atacgccatgctgggtctccgccgatctggaggtcatcaccagcacttgggtggtagccggtggtatcctcgctgcaatagctgcttactgcctaacagtgggcagcgttgtcatctgcgcgtacttgggagtcggccat

SEQ ID NO: 395868 - DNA, 140 bp, Artificial Sequence
  Synthetic
atggccgactcccaagtacgcgcagatgacaacgctgcccactgttaggcagtaagcagctattgcagcgaggataccaccggctaccacccaagtgctggtgatgacctccagatcggcggagacccagcatggcgtat

SEQ ID NO: 395869 - DNA, 140 bp, Artificial Sequence
  Synthetic
atacgccatgctgggtctcccctggttgaaggacagcaattagctgagcaattcaagcaaaaggtgctcggcttgatccaggttacgacgaagcaggcagaagaactcaaaccagccgtccgtacttgggagtcggccat

SEQ ID NO: 395870 - DNA, 140 bp, Artificial Sequence
  Synthetic
atggccgactcccaagtacggacggctggtttgagttcttctgcctgcttcgtcgtaacctggatcaagccgagcaccttttgcttgaattgctcagctaattgctgtccttcaaccaggggagacccagcatggcgtat

SEQ ID NO: 395871 - DNA, 140 bp, Artificial Sequence
  Synthetic
aggccctggctgctgatatgttttgaccagggctggggccctatcagtcatgccaacggaagcggccccgaccaacgcccctactgctggcactaccccccaaaaccttgtggtattgtggaccttttgggacagcggtg

SEQ ID NO: 395872 - DNA, 140 bp, Artificial Sequence
  Synthetic
caccgctgtcccaaaaggtccacaataccacaaggttttggggggtagtgccagcagtaggggcgttggtcggggccgcttccgttggcatgactgatagggccccagccctggtcaaaacatatcagcagccagggcct

SEQ ID NO: 395873 - DNA, 140 bp, Artificial Sequence
  Synthetic
atacgccatgctgggtctccaccctgccgtcgcagccctgatgtcattctcagcctcgctaaccagcccaatgacaacagcgcaaaccctcctcctcaacgtgttgggggggtgggtagccgtacttgggagtcggccat

SEQ ID NO: 395874 - DNA, 140 bp, Artificial Sequence
  Synthetic
atggccgactcccaagtacggctacccacccccccaacacgttgaggaggagggtttgcgctgttgtcattgggctggttagcgaggctgagaatgacatcagggctgcgacggcagggtggagacccagcatggcgtat

SEQ ID NO: 395875 - DNA, 140 bp, Artificial Sequence
  Synthetic
aggccctggctgctgatatggcacatcaacaggactgctctgaattgcaatgactcccttcagactgggtttattgccgcgctgttctacaaatacaagttcaactcgtccggatgcccagaccttttgggacagcggtg

SEQ ID NO: 395876 - DNA, 140 bp, Artificial Sequence
  Synthetic
caccgctgtcccaaaaggtctgggcatccggacgagttgaacttgtatttgtagaacagcgcggcaataaacccagtctgaagggagtcattgcaattcagagcagtcctgttgatgtgccatatcagcagccagggcct

SEQ ID NO: 395877 - DNA, 140 bp, Artificial Sequence
  Synthetic
atacgccatgctgggtctccatcctggctggatatggcgctggtgtttcaggagccctcgtagccttcaaaatcatgagcggcgagactccgtcaatcgaggacatggtgaacctactcccgtacttgggagtcggccat

SEQ ID NO: 395878 - DNA, 140 bp, Artificial Sequence
  Synthetic
atggccgactcccaagtacgggagtaggttcaccatgtcctcgattgacggagtctcgccgctcatgattttgaaggctacgagggctcctgaaacaccagcgccatatccagccaggatggagacccagcatggcgtat

SEQ ID NO: 395879 - DNA, 140 bp, Artificial Sequence
  Synthetic
aggccctggctgctgatatgaatcatgagcggcgagactccgtcaatcgaggacatggtgaacctactccctgcccttctgtcaccaggggcactggtagtgggggttgtttgtgccgccgaccttttgggacagcggtg

SEQ ID NO: 395880 - DNA, 140 bp, Artificial Sequence
  Synthetic
caccgctgtcccaaaaggtcggcggcacaaacaacccccactaccagtgcccctggtgacagaagggcagggagtaggttcaccatgtcctcgattgacggagtctcgccgctcatgattcatatcagcagccagggcct

SEQ ID NO: 395881 - DNA, 140 bp, Artificial Sequence
  Synthetic
atacgccatgctgggtctccatgtgcctgagacagatgcatcccgagcagtgaccgacatacttagttcccttaccatcactagtctcttgcgtaaactccatcactggattaccgaggacgtacttgggagtcggccat

SEQ ID NO: 395882 - DNA, 140 bp, Artificial Sequence
  Synthetic
atggccgactcccaagtacgtcctcggtaatccagtgatggagtttacgcaagagactagtgatggtaagggaactaagtatgtcggtcactgctcgggatgcatctgtctcaggcacatggagacccagcatggcgtat

SEQ ID NO: 395883 - DNA, 140 bp, Artificial Sequence
  Synthetic
  misc_feature (38)..(38): n is a, c, g, or t
atacgccatgctgggtctcccccaacctcccaggggtnccctttttctcgtgtcagcgaggctatagggggacctggagaggcgacgggatttgcaacactacgtgcccctgcggtgctacgtacttgggagtcggccat

SEQ ID NO: 395884 - DNA, 140 bp, Artificial Sequence
  Synthetic
  misc_feature (103)..(103): n is a, c, g, or t
atggccgactcccaagtacgtagcaccgcaggggcacgtagtgttgcaaatcccgtcgcctctccaggtccccctatagcctcgctgacacgagaaaaagggnacccctgggaggttgggggagacccagcatggcgtat

SEQ ID NO: 395885 - DNA, 140 bp, Artificial Sequence
  Synthetic
atacgccatgctgggtctcccggtccaagcatacccatcccggcgccaaactacaagaaagcgctgtggagggtaagtgctactgactacgtcgaagtcgtacgggtgggagactaccatcgtacttgggagtcggccat

SEQ ID NO: 395886 - DNA, 140 bp, Artificial Sequence
  Synthetic
atggccgactcccaagtacgatggtagtctcccacccgtacgacttcgacgtagtcagtagcacttaccctccacagcgctttcttgtagtttggcgccgggatgggtatgcttggaccgggagacccagcatggcgtat

SEQ ID NO: 395887 - DNA, 140 bp, Artificial Sequence
  Synthetic
aggccctggctgctgatatgcatcgtggacgtgcaatacctgtacggcatagggtcagcggttgtctcctttgcaatcaaatgggagtatatcgtgttgctcttccttctcctggcagacgaccttttgggacagcggtg

SEQ ID NO: 395888 - DNA, 140 bp, Artificial Sequence
  Synthetic
caccgctgtcccaaaaggtcgtctgccaggagaaggaagagcaacacgatatactcccatttgattgcaaaggagacaaccgctgaccctatgccgtacaggtattgcacgtccacgatgcatatcagcagccagggcct

SEQ ID NO: 395889 - DNA, 140 bp, Artificial Sequence
  Synthetic
atacgccatgctgggtctccggctccagagttcttcacggaggtggatggcgtgaggctacacaggtacgccccagaatgcaagcctatccttagggatgaggtaactttcagtgtggggcgtacttgggagtcggccat

SEQ ID NO: 395890 - DNA, 140 bp, Artificial Sequence
  Synthetic
atggccgactcccaagtacgccccacactgaaagttacctcatccctaaggataggcttgcattctggggcgtacctgtgtagcctcacgccatccacctccgtgaagaactctggagccggagacccagcatggcgtat

SEQ ID NO: 395891 - DNA, 140 bp, Artificial Sequence
  Synthetic
atacgccatgctgggtctccctgtccacctacgtggtgggatcgcaattaccctgtgagcctgagccagacgtgctggtagtgacatcaatgttgagggatcctgaccacatcaccgcggcgtacttgggagtcggccat

SEQ ID NO: 395892 - DNA, 140 bp, Artificial Sequence
  Synthetic
atggccgactcccaagtacgccgcggtgatgtggtcaggatccctcaacattgatgtcactaccagcacgtctggctcaggctcacagggtaattgcgatcccaccacgtaggtggacagggagacccagcatggcgtat

SEQ ID NO: 395893 - DNA, 140 bp, Artificial Sequence
  Synthetic
atacgccatgctgggtctcctcacgccgaccatccggacgctgagctcttggaagccaacctcttgtggaggcaggaaatggggggaaacatcacgagggtggagtcagaaaataagatccgtacttgggagtcggccat

SEQ ID NO: 395894 - DNA, 140 bp, Artificial Sequence
  Synthetic
atggccgactcccaagtacggatcttattttctgactccaccctcgtgatgtttccccccatttcctgcctccacaagaggttggcttccaagagctcagcgtccggatggtcggcgtgaggagacccagcatggcgtat

SEQ ID NO: 395895 - DNA, 140 bp, Artificial Sequence
  Synthetic
  misc_feature (27)..(27): n is a, c, g, or t
atacgccatgctgggtctccgatttcngtggccgcggagtgccataggccgccgaggcttaagtatcctcccgctctgcctgtgtgggcccgacctgattataacccgcctttgcttgagcgtacttgggagtcggccat

SEQ ID NO: 395896 - DNA, 140 bp, Artificial Sequence
  Synthetic
  misc_feature (114)..(114): n is a, c, g, or t
atggccgactcccaagtacgctcaagcaaaggcgggttataatcaggtcgggcccacacaggcagagcgggaggatacttaagcctcggcggcctatggcactccgcggccacngaaatcggagacccagcatggcgtat

SEQ ID NO: 395897 - DNA, 140 bp, Artificial Sequence
  Synthetic
atacgccatgctgggtctcctgcagctggatgactcagtcgtgggacacgtactggctcagctagctgaaaagagttttccagccacaccggaccaaccccacaccaattcagactctggcgtacttgggagtcggccat

SEQ ID NO: 395898 - DNA, 140 bp, Artificial Sequence
  Synthetic
atggccgactcccaagtacgccagagtctgaattggtgtggggttggtccggtgtggctggaaaactcttttcagctagctgagccagtacgtgtcccacgactgagtcatccagctgcaggagacccagcatggcgtat

SEQ ID NO: 395899 - DNA, 140 bp, Artificial Sequence
  Synthetic
atacgccatgctgggtctcctcatggcactaacggcgctgcatcgctaccatcagctgaagatgatgacgcctcagacgcagactcatatagctctatgccgcctcttgagggcgaaccccgtacttgggagtcggccat

SEQ ID NO: 395900 - DNA, 140 bp, Artificial Sequence
  Synthetic
atggccgactcccaagtacggggttcgccctcaagaggcggcatagagctatatgagtctgcgtctgaggcgtcatcatcttcagctgatggtagcgatgcagcgccgttagtgccatgaggagacccagcatggcgtat

SEQ ID NO: 395901 - DNA, 140 bp, Artificial Sequence
  Synthetic
atacgccatgctgggtctcccgggagctctcatcacaccgtgcgctgctgaggaggaaaagttgccaattagtcctttgagcaacactcttatccgacatcataatatggtttactccaccgtacttgggagtcggccat

SEQ ID NO: 395902 - DNA, 140 bp, Artificial Sequence
  Synthetic
atggccgactcccaagtacggtggagtaaaccatattatgatgtcggataagagtgttgctcaaaggactaattggcaacttttcctcctcagcagcgcacggtgtgatgagagctcccgggagacccagcatggcgtat

SEQ ID NO: 395903 - DNA, 140 bp, Artificial Sequence
  Synthetic
atacgccatgctgggtctccactcagaaaatccagcttgtaaacacaaatggcagctggcacatcaacaggactgccctgaactgcaatgactccctccaaactgggttccttgccgcgccgtacttgggagtcggccat

SEQ ID NO: 395904 - DNA, 140 bp, Artificial Sequence
  Synthetic
atggccgactcccaagtacggcgcggcaaggaacccagtttggagggagtcattgcagttcagggcagtcctgttgatgtgccagctgccatttgtgtttacaagctggattttctgagtggagacccagcatggcgtat

SEQ ID NO: 395905 - DNA, 140 bp, Artificial Sequence
  Synthetic
atacgccatgctgggtctcctacatcacgtagcgcagctctccgtcagaaaaaggtaacttttgacagacagcaggtcgttgaccaacattattatgacactcttaaggagataaaggcccgtacttgggagtcggccat

SEQ ID NO: 395906 - DNA, 140 bp, Artificial Sequence
  Synthetic
atggccgactcccaagtacgggcctttatctccttaagagtgtcataataatgttggtcaacgacctgctgtctgtcaaaagttacctttttctgacggagagctgcgctacgtgatgtaggagacccagcatggcgtat

SEQ ID NO: 395907 - DNA, 140 bp, Artificial Sequence
  Synthetic
atacgccatgctgggtctccacgtccgtggccatactagcaaagcccttaaccacatcaactccgtgtgggaggatttgctggaagacaatgtgacacctattcctactactataatggccgtacttgggagtcggccat

SEQ ID NO: 395908 - DNA, 140 bp, Artificial Sequence
  Synthetic
atggccgactcccaagtacggccattatagtagtaggaataggtgtcacattgtcttccagcaaatcctcccacacggagttgatgtggttaagggctttgctagtatggccacggacgtggagacccagcatggcgtat

SEQ ID NO: 395909 - DNA, 140 bp, Artificial Sequence
  Synthetic
atacgccatgctgggtctccgccttgtatgacgtcacacgcaaattgcccgtagccgtgatgggagcagcatatggctttcagtactcacctgctcaacgggtagagtacctcctcaagacgtacttgggagtcggccat

SEQ ID NO: 395910 - DNA, 140 bp, Artificial Sequence
  Synthetic
atggccgactcccaagtacgtcttgaggaggtactctacccgttgagcaggtgagtactgaaagccatatgctgctcccatcacggctacgggcaatttgcgtgtgacgtcatacaaggcggagacccagcatggcgtat

SEQ ID NO: 395911 - DNA, 140 bp, Artificial Sequence
  Synthetic
atacgccatgctgggtctcccctggcgctcgaagaagacacctatgggattttcctatgatactagctgctttgactccacagtgactgagcgtgacatccggacagaggagtccatatacgtacttgggagtcggccat

SEQ ID NO: 395912 - DNA, 140 bp, Artificial Sequence
  Synthetic
atggccgactcccaagtacgtatatggactcctctgtccggatgtcacgctcagtcactgtggagtcaaagcagctagtatcataggaaaatcccataggtgtcttcttcgagcgccaggggagacccagcatggcgtat

SEQ ID NO: 395913 - DNA, 140 bp, Artificial Sequence
  Synthetic
atacgccatgctgggtctcctgcggctaccgtcggtgtagggccagcggggtcctccccacgagcatgggcaacacactgacttgctatttaaaggccgcggcggcttgtaaagccgctgcgtacttgggagtcggccat

SEQ ID NO: 395914 - DNA, 140 bp, Artificial Sequence
  Synthetic
atggccgactcccaagtacgcagcggctttacaagccgccgcggcctttaaatagcaagtcagtgtgttgcccatgctcgtggggaggaccccgctggccctacaccgacggtagccgcaggagacccagcatggcgtat

SEQ ID NO: 395915 - DNA, 140 bp, Artificial Sequence
  Synthetic
atacgccatgctgggtctccggacgccatgaccaggtactcggcgcctcctggagatgaaccgcacccggagtatgacttggagcacattacatcctgctcatccaacgtatccgtggcccgtacttgggagtcggccat

SEQ ID NO: 395916 - DNA, 140 bp, Artificial Sequence
  Synthetic
atggccgactcccaagtacgggccacggatacgttggatgagcaggatgtaatgtgctccaagtcatactccgggtgcggttcatctccaggaggcgccgagtacctggtcatggcgtccggagacccagcatggcgtat

SEQ ID NO: 395917 - DNA, 140 bp, Artificial Sequence
  Synthetic
atacgccatgctgggtctcccctggttgggcaacatcattatgtacgcgcccactatatgggtgcgtatggtactgatgacacacttctttggaatactccagtctcaagagcagctccacgtacttgggagtcggccat

SEQ ID NO: 395918 - DNA, 140 bp, Artificial Sequence
  Synthetic
atggccgactcccaagtacgtggagctgctcttgagactggagtattccaaagaagtgtgtcatcagtaccatacgcacccatatagtgggcgcgtacataatgatgttgcccaaccaggggagacccagcatggcgtat

SEQ ID NO: 395919 - DNA, 140 bp, Artificial Sequence
  Synthetic
aggccctggctgctgatatgggctcatatggtggttacaatacttcatcaccagagccgaggcgctcttgcaagtgtgggtcccccccctcaacgtccggggaggtcgcgatgccatcatgaccttttgggacagcggtg

SEQ ID NO: 395920 - DNA, 140 bp, Artificial Sequence
  Synthetic
caccgctgtcccaaaaggtcatgatggcatcgcgacctccccggacgttgaggggggggacccacacttgcaagagcgcctcggctctggtgatgaagtattgtaaccaccatatgagcccatatcagcagccagggcct

SEQ ID NO: 395921 - DNA, 140 bp, Artificial Sequence
  Synthetic
atacgccatgctgggtctccctccatggttactctccaggtgagctcaatagggttggagcgtgcctcaggaagcttggggcccctcccttgcgggcctggagacatcgggctagggcagcgtacttgggagtcggccat

SEQ ID NO: 395922 - DNA, 140 bp, Artificial Sequence
  Synthetic
atggccgactcccaagtacgctgccctagcccgatgtctccaggcccgcaagggaggggccccaagcttcctgaggcacgctccaaccctattgagctcacctggagagtaaccatggagggagacccagcatggcgtat

SEQ ID NO: 395923 - DNA, 140 bp, Artificial Sequence
  Synthetic
aggccctggctgctgatatgtcctgctctccatactcggtccgctcatggtgctccaggctagcataatccgagtgccgtacttcgtacgcgctcaagggctcattcgtgcatgcatgttgaccttttgggacagcggtg

SEQ ID NO: 395924 - DNA, 140 bp, Artificial Sequence
  Synthetic
caccgctgtcccaaaaggtcaacatgcatgcacgaatgagcccttgagcgcgtacgaagtacggcactcggattatgctagcctggagcaccatgagcggaccgagtatggagagcaggacatatcagcagccagggcct

SEQ ID NO: 395925 - DNA, 140 bp, Artificial Sequence
  Synthetic
  misc_feature (86)..(86): n is a, c, g, or t
atacgccatgctgggtctcctacctcttcaactgggccgtaaaaactaagctcaaactcactccattgcgcgacgctcaccgcctngacttgtctgggtggtttgtggcgggctacagcgcgtacttgggagtcggccat

SEQ ID NO: 395926 - DNA, 140 bp, Artificial Sequence
  Synthetic
  misc_feature (55)..(55): n is a, c, g, or t
atggccgactcccaagtacgcgctgtagcccgccacaaaccacccagacaagtcnaggcggtgagcgtcgcgcaatggagtgagtttgagcttagtttttacggcccagttgaagaggtaggagacccagcatggcgtat

SEQ ID NO: 395927 - DNA, 140 bp, Artificial Sequence
  Synthetic
atacgccatgctgggtctccctgtgcctactcctactcacagtaggggtaggcatctttttgctccccgcccgataaacgggcggccttaagcaacactccatttccgctttttttttttcgtacttgggagtcggccat

SEQ ID NO: 395928 - DNA, 140 bp, Artificial Sequence
  Synthetic
atggccgactcccaagtacgaaaaaaaaaaagcggaaatggagtgttgcttaaggccgcccgtttatcgggcggggagcaaaaagatgcctacccctactgtgagtaggagtaggcacagggagacccagcatggcgtat

SEQ ID NO: 395929 - DNA, 140 bp, Artificial Sequence
  Synthetic
atacgccatgctgggtctcccagcctcggcagtcaattatgccaataagagcggcatctaccatcttaccaatgactgcccaaacagcagcatggtgtacgaggccgaggcaatcatcctcgtacttgggagtcggccat

SEQ ID NO: 395930 - DNA, 140 bp, Artificial Sequence
  Synthetic
atggccgactcccaagtacgaggatgattgcctcggcctcgtacaccatgctgctgtttgggcagtcattggtaagatggtagatgccgctcttattggcataattgactgccgaggctgggagacccagcatggcgtat

SEQ ID NO: 395931 - DNA, 140 bp, Artificial Sequence
  Synthetic
atacgccatgctgggtctccatgtccagctggttaacaccaacggcagctggcacatcaatagcacggccttgaactgcaatgatagccttcagaccggctggatagcagggctcatctacgtacttgggagtcggccat

SEQ ID NO: 395932 - DNA, 140 bp, Artificial Sequence
  Synthetic
atggccgactcccaagtacgtagatgagccctgctatccagccggtctgaaggctatcattgcagttcaaggccgtgctattgatgtgccagctgccgttggtgttaaccagctggacatggagacccagcatggcgtat

SEQ ID NO: 395933 - DNA, 140 bp, Artificial Sequence
  Synthetic
aggccctggctgctgatatgggaagcggccccgaccaacgcccctactgctggcattaccccccaaaaccttgtggtattgtgcccgcaaagaatgtgtgtggcccggtatattgcttcagaccttttgggacagcggtg

SEQ ID NO: 395934 - DNA, 140 bp, Artificial Sequence
  Synthetic
caccgctgtcccaaaaggtctgaagcaatataccgggccacacacattctttgcgggcacaataccacaaggttttggggggtaatgccagcagtaggggcgttggtcggggccgcttcccatatcagcagccagggcct

SEQ ID NO: 395935 - DNA, 140 bp, Artificial Sequence
  Synthetic
atacgccatgctgggtctcccatgatgatgaattggtcgccaaccgctacattcgtggtctccagcgctctacgggcgccacaggtcttgtttgacatctttgcgggcggccattggggtcgtacttgggagtcggccat

SEQ ID NO: 395936 - DNA, 140 bp, Artificial Sequence
  Synthetic
atggccgactcccaagtacgaccccaatggccgcccgcaaagatgtcaaacaagacctgtggcgcccgtagagcgctggagaccacgaatgtagcggttggcgaccaattcatcatcatgggagacccagcatggcgtat

SEQ ID NO: 395937 - DNA, 140 bp, Artificial Sequence
  Synthetic
atacgccatgctgggtctccccagttcagtcagccaagccacgtctggtctcgtgagcctgttctccgctggtgcccggcagaatctccagcttatcaacaccaacggaagctggcatatcgtacttgggagtcggccat

SEQ ID NO: 395938 - DNA, 140 bp, Artificial Sequence
  Synthetic
atggccgactcccaagtacgatatgccagcttccgttggtgttgataagctggagattctgccgggcaccagcggagaacaggctcacgagaccagacgtggcttggctgactgaactggggagacccagcatggcgtat

SEQ ID NO: 395939 - DNA, 140 bp, Artificial Sequence
  Synthetic
aggccctggctgctgatatgatgccatcattctcctcacgtgtgcagtccatccagagctaatctttgacatcaccaaactcctgctcgccatactcggtccgctcatggtgctccaggcgaccttttgggacagcggtg

SEQ ID NO: 395940 - DNA, 140 bp, Artificial Sequence
  Synthetic
caccgctgtcccaaaaggtcgcctggagcaccatgagcggaccgagtatggcgagcaggagtttggtgatgtcaaagattagctctggatggactgcacacgtgaggagaatgatggcatcatatcagcagccagggcct

SEQ ID NO: 395941 - DNA, 140 bp, Artificial Sequence
  Synthetic
atacgccatgctgggtctccttgtccgcgtgtaagaccttggactctttcgatcaaggttggggccccattacgtatgccaacatcagtggtcccgctgtggaaaagccttactgctggccgtacttgggagtcggccat

SEQ ID NO: 395942 - DNA, 140 bp, Artificial Sequence
  Synthetic
atggccgactcccaagtacggccagcagtaaggcttttccacagcgggaccactgatgttggcatacgtaatggggccccaaccttgatcgaaagagtccaaggtcttacacgcggacaaggagacccagcatggcgtat

SEQ ID NO: 395943 - DNA, 140 bp, Artificial Sequence
  Synthetic
atacgccatgctgggtctccattgcttccggaagcacccgggcgccacttatgcaaaatgtgggtcggggccgtggctcacccctaggtgtttggtggactacccttatagactgtggcacgtacttgggagtcggccat

SEQ ID NO: 395944 - DNA, 140 bp, Artificial Sequence
  Synthetic
atggccgactcccaagtacgtgccacagtctataagggtagtccaccaaacacctaggggtgagccacggccccgacccacattttgcataagtggcgcccgggtgcttccggaagcaatggagacccagcatggcgtat

SEQ ID NO: 395945 - DNA, 140 bp, Artificial Sequence
  Synthetic
atacgccatgctgggtctccctatccttgcactgtgaactataccctacacaaggtcaggatgtacatagctggcagtgagcataggttcacggctgcctgcaactggaccaggggggaacgtacttgggagtcggccat

SEQ ID NO: 395946 - DNA, 140 bp, Artificial Sequence
  Synthetic
atggccgactcccaagtacgttcccccctggtccagttgcaggcagccgtgaacctatgctcactgccagctatgtacatcctgaccttgtgtagggtatagttcacagtgcaaggatagggagacccagcatggcgtat

SEQ ID NO: 395947 - DNA, 140 bp, Artificial Sequence
  Synthetic
atacgccatgctgggtctccgatcggcgctgcggttatagccgccctgaccatcttcagcctcacaccagcatacaagactctgctagcacatttcctgtggtggacccagtacttcatacgtacttgggagtcggccat

SEQ ID NO: 395948 - DNA, 140 bp, Artificial Sequence
  Synthetic
atggccgactcccaagtacgtatgaagtactgggtccaccacaggaaatgtgctagcagagtcttgtatgctggtgtgaggctgaagatggtcagggcggctataaccgcagcgccgatcggagacccagcatggcgtat

SEQ ID NO: 395949 - DNA, 140 bp, Artificial Sequence
  Synthetic
atacgccatgctgggtctcctgggttttgaggtaacaaagatcttactagcattgataggaccgctgtacctcctgcacgccagcctcctgcgggtgccatactacgtacgtgcacatgccgtacttgggagtcggccat

SEQ ID NO: 395950 - DNA, 140 bp, Artificial Sequence
  Synthetic
atggccgactcccaagtacggcatgtgcacgtacgtagtatggcacccgcaggaggctggcgtgcaggaggtacagcggtcctatcaatgctagtaagatctttgttacctcaaaacccaggagacccagcatggcgtat

SEQ ID NO: 395951 - DNA, 140 bp, Artificial Sequence
  Synthetic
atacgccatgctgggtctccgaccacctggtccctctacgcacctgggccagcgacggcctacgtgatcttgctgtcgcagtggaacccgtcgtcttttcgcctatggagaagaaagttacgtacttgggagtcggccat

SEQ ID NO: 395952 - DNA, 140 bp, Artificial Sequence
  Synthetic
atggccgactcccaagtacgtaactttcttctccataggcgaaaagacgacgggttccactgcgacagcaagatcacgtaggccgtcgctggcccaggtgcgtagagggaccaggtggtcggagacccagcatggcgtat

SEQ ID NO: 395953 - DNA, 140 bp, Artificial Sequence
  Synthetic
aggccctggctgctgatatgtgctgtcgcagtggaacccgtcgtcttttcgcctatggagaagaaagttatcacgtggggggcggacactgcagcctgcggggacattctcgcaggtctcgaccttttgggacagcggtg

SEQ ID NO: 395954 - DNA, 140 bp, Artificial Sequence
  Synthetic
caccgctgtcccaaaaggtcgagacctgcgagaatgtccccgcaggctgcagtgtccgccccccacgtgataactttcttctccataggcgaaaagacgacgggttccactgcgacagcacatatcagcagccagggcct

SEQ ID NO: 395955 - DNA, 140 bp, Artificial Sequence
  Synthetic
atacgccatgctgggtctcctctgcacccgtggtgttgccaaggcgcttgattttgtgccttgtgaggccatggacgcgaccacgcggtctcccaccttcactgacaactccacaccgcccgtacttgggagtcggccat

SEQ ID NO: 395956 - DNA, 140 bp, Artificial Sequence
  Synthetic
atggccgactcccaagtacgggcggtgtggagttgtcagtgaaggtgggagaccgcgtggtcgcgtccatggcctcacaaggcacaaaatcaagcgccttggcaacaccacgggtgcagaggagacccagcatggcgtat

SEQ ID NO: 395957 - DNA, 140 bp, Artificial Sequence
  Synthetic
atacgccatgctgggtctccgtgccactctacagatcccactacagtcctgggaataggtaccgtgctcgaccaggcggagacagcaggctgccgccttacggtgttagccacagccacacgtacttgggagtcggccat

SEQ ID NO: 395958 - DNA, 140 bp, Artificial Sequence
  Synthetic
atggccgactcccaagtacgtgtggctgtggctaacaccgtaaggcggcagcctgctgtctccgcctggtcgagcacggtacctattcccaggactgtagtgggatctgtagagtggcacggagacccagcatggcgtat

SEQ ID NO: 395959 - DNA, 140 bp, Artificial Sequence
  Synthetic
atacgccatgctgggtctccccgcctggctctgttacggtccctcacccaaacatacaggagacggcacttcccctaacgggagaggtgccgttttatgggaaggccatccctctagaatcgtacttgggagtcggccat

SEQ ID NO: 395960 - DNA, 140 bp, Artificial Sequence
  Synthetic
atggccgactcccaagtacgattctagagggatggccttcccataaaacggcacctctcccgttaggggaagtgccgtctcctgtatgtttgggtgagggaccgtaacagagccaggcggggagacccagcatggcgtat

SEQ ID NO: 395961 - DNA, 140 bp, Artificial Sequence
  Synthetic
aggccctggctgctgatatgatgatgatgaactggtcccccacgacggcgctgataatggcccagctgctccggatcccacaagccatcttggatatgatcgctggtgctcactggggaggaccttttgggacagcggtg

SEQ ID NO: 395962 - DNA, 140 bp, Artificial Sequence
  Synthetic
caccgctgtcccaaaaggtcctccccagtgagcaccagcgatcatatccaagatggcttgtgggatccggagcagctgggccattatcagcgccgtcgtgggggaccagttcatcatcatcatatcagcagccagggcct

SEQ ID NO: 395963 - DNA, 140 bp, Artificial Sequence
  Synthetic
atacgccatgctgggtctcccgggcgccaggcagaacgtccagctcatcaactccaatggcagttggcacatcaatagcacggccttgaactgtaacgccagcctcgacaccggctggttcgtacttgggagtcggccat

SEQ ID NO: 395964 - DNA, 140 bp, Artificial Sequence
  Synthetic
atggccgactcccaagtacgaaccagccggtgtcgaggctggcgttacagttcaaggccgtgctattgatgtgccaactgccattggagttgatgagctggacgttctgcctggcgcccgggagacccagcatggcgtat

SEQ ID NO: 395965 - DNA, 140 bp, Artificial Sequence
  Synthetic
aggccctggctgctgatatgatcaatagcacggccttgaactgtaacgccagcctcgacaccggctggttagcagggctcttctactacaacaaattcaactcttcaggctgtcccgagagaccttttgggacagcggtg

SEQ ID NO: 395966 - DNA, 140 bp, Artificial Sequence
  Synthetic
caccgctgtcccaaaaggtctctcgggacagcctgaagagttgaatttgttgtagtagaagagccctgctaaccagccggtgtcgaggctggcgttacagttcaaggccgtgctattgatcatatcagcagccagggcct

SEQ ID NO: 395967 - DNA, 140 bp, Artificial Sequence
  Synthetic
aggccctggctgctgatatgcggtatattgcttcactcccagccccgtggcggtgggaacgaccgacaagtcgggcgcgcccacatacaactggggggaaaatgagacggacgtcttcgtgaccttttgggacagcggtg

SEQ ID NO: 395968 - DNA, 140 bp, Artificial Sequence
  Synthetic
caccgctgtcccaaaaggtcacgaagacgtccgtctcattttccccccagttgtatgtgggcgcgcccgacttgtcggtcgttcccaccgccacggggctgggagtgaagcaatataccgcatatcagcagccagggcct

SEQ ID NO: 395969 - DNA, 140 bp, Artificial Sequence
  Synthetic
aggccctggctgctgatatgcatcaagttaggggcgcttactggcacctatgtctataaccatctcactcccctcagggattgggcgcacaacggcctgcgagatctggccgtggctgtagaccttttgggacagcggtg

SEQ ID NO: 395970 - DNA, 140 bp, Artificial Sequence
  Synthetic
caccgctgtcccaaaaggtctacagccacggccagatctcgcaggccgttgtgcgcccaatccctgaggggagtgagatggttatagacataggtgccagtaagcgcccctaacttgatgcatatcagcagccagggcct

SEQ ID NO: 395971 - DNA, 140 bp, Artificial Sequence
  Synthetic
atacgccatgctgggtctccctgtccacttacgtggtggggtcacaattaccctgtgagcctgagccagacgtgctggtggtgacatcaatgttaagggaccctgaccacatcaccgcagcgtacttgggagtcggccat

SEQ ID NO: 395972 - DNA, 140 bp, Artificial Sequence
  Synthetic
atggccgactcccaagtacgctgcggtgatgtggtcagggtcccttaacattgatgtcaccaccagcacgtctggctcaggctcacagggtaattgtgaccccaccacgtaagtggacagggagacccagcatggcgtat

SEQ ID NO: 395973 - DNA, 140 bp, Artificial Sequence
  Synthetic
aggccctggctgctgatatgcccccagactccgacgctgagtcctattcttccatgccccccctggagggggagcctggggatccggatctcagcgacgggtcatggtcgacggtcagtagaccttttgggacagcggtg

SEQ ID NO: 395974 - DNA, 140 bp, Artificial Sequence
  Synthetic
caccgctgtcccaaaaggtctactgaccgtcgaccatgacccgtcgctgagatccggatccccaggctccccctccagggggggcatggaagaataggactcagcgtcggagtctgggggcatatcagcagccagggcct

SEQ ID NO: 395975 - DNA, 140 bp, Artificial Sequence
  Synthetic
aggccctggctgctgatatgccctgcacctgcggctcctcggacctttacctggtcacgaggcatgccgatgtcattcccgtgcgccggcggggtgatagcaggggcagcctgctttcgcgaccttttgggacagcggtg

SEQ ID NO: 395976 - DNA, 140 bp, Artificial Sequence
  Synthetic
caccgctgtcccaaaaggtcgcgaaagcaggctgcccctgctatcaccccgccggcgcacgggaatgacatcggcatgcctcgtgaccaggtaaaggtccgaggagccgcaggtgcagggcatatcagcagccagggcct

SEQ ID NO: 395977 - DNA, 140 bp, Artificial Sequence
  Synthetic
atacgccatgctgggtctcctcacggcactaacggcgctgcgtcgctaccatcagctgaagatgacgatgcctcagatgcagactcgtatagttctatgccgcctcttgagggcgagcctcgtacttgggagtcggccat

SEQ ID NO: 395978 - DNA, 140 bp, Artificial Sequence
  Synthetic
atggccgactcccaagtacgaggctcgccctcaagaggcggcatagaactatacgagtctgcatctgaggcatcgtcatcttcagctgatggtagcgacgcagcgccgttagtgccgtgaggagacccagcatggcgtat

SEQ ID NO: 395979 - DNA, 140 bp, Artificial Sequence
  Synthetic
atacgccatgctgggtctcccaaggtcccggctgcatacgcagctcagggctataaggtgctggtgctcaacccctctgttgctgcaacactgggttttggtgcttacatgtccaaggcccgtacttgggagtcggccat

SEQ ID NO: 395980 - DNA, 140 bp, Artificial Sequence
  Synthetic
atggccgactcccaagtacgggccttggacatgtaagcaccaaaacccagtgttgcagcaacagaggggttgagcaccagcaccttatagccctgagctgcgtatgcagccgggaccttgggagacccagcatggcgtat

SEQ ID NO: 395981 - DNA, 140 bp, Artificial Sequence
  Synthetic
aggccctggctgctgatatgaggccacttacacaaaatgtggctcggggccttggttgacacccaggtgcatggttgactacccatacaggctctggcactacccctgcactgtcaacttgaccttttgggacagcggtg

SEQ ID NO: 395982 - DNA, 140 bp, Artificial Sequence
  Synthetic
caccgctgtcccaaaaggtcaagttgacagtgcaggggtagtgccagagcctgtatgggtagtcaaccatgcacctgggtgtcaaccaaggccccgagccacattttgtgtaagtggcctcatatcagcagccagggcct

SEQ ID NO: 395983 - DNA, 140 bp, Artificial Sequence
  Synthetic
atacgccatgctgggtctccgccctgtacgacgtcacacgcaaattgcccgtagccgtgatgggagcagcatatggcttccagtactcacccagtcaacgggtagagtacctcctcaagacgtacttgggagtcggccat

SEQ ID NO: 395984 - DNA, 140 bp, Artificial Sequence
  Synthetic
atggccgactcccaagtacgtcttgaggaggtactctacccgttgactgggtgagtactggaagccatatgctgctcccatcacggctacgggcaatttgcgtgtgacgtcgtacagggcggagacccagcatggcgtat

SEQ ID NO: 395985 - DNA, 140 bp, Artificial Sequence
  Synthetic
atacgccatgctgggtctcctttggcgctcgaagaagacacctatggggttctcctatgataccaggtgttttgattcaacagtgactgagcgtgacatccggacagaggagtctatatacgtacttgggagtcggccat

SEQ ID NO: 395986 - DNA, 140 bp, Artificial Sequence
  Synthetic
atggccgactcccaagtacgtatatagactcctctgtccggatgtcacgctcagtcactgttgaatcaaaacacctggtatcataggagaaccccataggtgtcttcttcgagcgccaaaggagacccagcatggcgtat

SEQ ID NO: 395987 - DNA, 140 bp, Artificial Sequence
  Synthetic
aggccctggctgctgatatgatctgggccggctcagaagatccagcttgtaaacaccaacggcagctggcacatcaacaggactgccctgaactgcaatgactccctcaagaccgggttcgaccttttgggacagcggtg

SEQ ID NO: 395988 - DNA, 140 bp, Artificial Sequence
  Synthetic
caccgctgtcccaaaaggtcgaacccggtcttgagggagtcattgcagttcagggcagtcctgttgatgtgccagctgccgttggtgtttacaagctggatcttctgagccggcccagatcatatcagcagccagggcct

SEQ ID NO: 395989 - DNA, 140 bp, Artificial Sequence
  Synthetic
aggccctggctgctgatatgacatcaacaggactgccctgaactgcaatgactccctcaagaccgggttcatcgccgggctgatctacaagtacaagttcaactcgaccggatgcccagagaccttttgggacagcggtg

SEQ ID NO: 395990 - DNA, 140 bp, Artificial Sequence
  Synthetic
caccgctgtcccaaaaggtctctgggcatccggtcgagttgaacttgtacttgtagatcagcccggcgatgaacccggtcttgagggagtcattgcagttcagggcagtcctgttgatgtcatatcagcagccagggcct

SEQ ID NO: 395991 - DNA, 140 bp, Artificial Sequence
  Synthetic
atacgccatgctgggtctccctgtgcctactcctacttacagtaggggtaggcatcttttttctccccccccgataaacgggcggcctcaagcaacactccatttgccctttttttttttcgtacttgggagtcggccat

SEQ ID NO: 395992 - DNA, 140 bp, Artificial Sequence
  Synthetic
atggccgactcccaagtacgaaaaaaaaaaagggcaaatggagtgttgcttgaggccgcccgtttatcggggggggagaaaaaagatgcctacccctactgtaagtaggagtaggcacagggagacccagcatggcgtat

SEQ ID NO: 395993 - DNA, 140 bp, Artificial Sequence
  Synthetic
aggccctggctgctgatatgcttgtcggctggcaggcgccccccgggtcacgctccctgacaccatgcacctgcggtagctcggacctttatttggtcacgagacatgccgatgtcattcgaccttttgggacagcggtg

SEQ ID NO: 395994 - DNA, 140 bp, Artificial Sequence
  Synthetic
caccgctgtcccaaaaggtcgaatgacatcggcatgtctcgtgaccaaataaaggtccgagctaccgcaggtgcatggtgtcagggagcgtgacccggggggcgcctgccagccgacaagcatatcagcagccagggcct

SEQ ID NO: 395995 - DNA, 140 bp, Artificial Sequence
  Synthetic
atacgccatgctgggtctcccctaattggggcccaaatgacccccggcgaaggtctcgcaacttgggtaaggtcatcgataccctcacgtgcggcctagccgatctcatggggtacatcccgtacttgggagtcggccat

SEQ ID NO: 395996 - DNA, 140 bp, Artificial Sequence
  Synthetic
atggccgactcccaagtacgggatgtaccccatgagatcggctaggccgcacgtgagggtatcgatgaccttacccaagttgcgagaccttcgccgggggtcatttgggccccaattaggggagacccagcatggcgtat

SEQ ID NO: 395997 - DNA, 140 bp, Artificial Sequence
  Synthetic
atacgccatgctgggtctccttgctctttttctatcttcctcttggcactgttatcgtgccttactacaccagcctcagcaattcaagtcaggaatgcctctgggatctaccaccttacccgtacttgggagtcggccat

SEQ ID NO: 395998 - DNA, 140 bp, Artificial Sequence
  Synthetic
atggccgactcccaagtacgggtaaggtggtagatcccagaggcattcctgacttgaattgctgaggctggtgtagtaaggcacgataacagtgccaagaggaagatagaaaaagagcaaggagacccagcatggcgtat

SEQ ID NO: 395999 - DNA, 140 bp, Artificial Sequence
  Synthetic
atacgccatgctgggtctccgttggctctctgtctcgcctaccttggccgtccccaactcatcagtaccaatccacgggtttcgccggcacgtagatctcctcgtcggggccgcggcattcgtacttgggagtcggccat

SEQ ID NO: 396000 - DNA, 140 bp, Artificial Sequence
  Synthetic
atggccgactcccaagtacgaatgccgcggccccgacgaggagatctacgtgccggcgaaacccgtggattggtactgatgagttggggacggccaaggtaggcgagacagagagccaacggagacccagcatggcgtat

SEQ ID NO: 396001 - DNA, 140 bp, Artificial Sequence
  Synthetic
atacgccatgctgggtctccaactgctctatatatgctggccacatcacgggacacaggatggcatgggacatgatgctcaactggtcgcccacggtgagctatgtggtttctagtgccccgtacttgggagtcggccat

SEQ ID NO: 396002 - DNA, 140 bp, Artificial Sequence
  Synthetic
atggccgactcccaagtacggggcactagaaaccacatagctcaccgtgggcgaccagttgagcatcatgtcccatgccatcctgtgtcccgtgatgtggccagcatatatagagcagttggagacccagcatggcgtat

SEQ ID NO: 396003 - DNA, 140 bp, Artificial Sequence
  Synthetic
atacgccatgctgggtctcccatcgcggtcctcttcctctttgcaggagctgatgccacgacctacacgggcagcgccgtgagtagcaccaccggggccttcgtcagtcttttctcccctcgtacttgggagtcggccat

SEQ ID NO: 396004 - DNA, 140 bp, Artificial Sequence
  Synthetic
atggccgactcccaagtacgaggggagaaaagactgacgaaggccccggtggtgctactcacggcgctgcccgtgtaggtcgtggcatcagctcctgcaaagaggaagaggaccgcgatgggagacccagcatggcgtat

SEQ ID NO: 396005 - DNA, 140 bp, Artificial Sequence
  Synthetic
atacgccatgctgggtctcccaggactgtttgcccgctacaagttcaattctacggggtgcccggaacggatgagtaaatgtagaccattgcactcgttcgagcagggctgggggcctatcgtacttgggagtcggccat

SEQ ID NO: 396006 - DNA, 140 bp, Artificial Sequence
  Synthetic
atggccgactcccaagtacgataggcccccagccctgctcgaacgagtgcaatggtctacatttactcatccgttccgggcaccccgtagaattgaacttgtagcgggcaaacagtcctgggagacccagcatggcgtat

SEQ ID NO: 396007 - DNA, 140 bp, Artificial Sequence
  Synthetic
aggccctggctgctgatatgggcctacttggctgtatcatcactagcctcacaggccgggacaagaaccaggtcgagggggaggttcaagtggtctccaccgcaacacaatctttcctgggaccttttgggacagcggtg

SEQ ID NO: 396008 - DNA, 140 bp, Artificial Sequence
  Synthetic
caccgctgtcccaaaaggtcccaggaaagattgtgttgcggtggagaccacttgaacctccccctcgacctggttcttgtcccggcctgtgaggctagtgatgatacagccaagtaggcccatatcagcagccagggcct

SEQ ID NO: 396009 - DNA, 140 bp, Artificial Sequence
  Synthetic
atacgccatgctgggtctcccctgtctactgcttcacacctagccccgtggtagtgggaactaccgatcagagaggtatccccacttacacctggggagaaaatgtgtccgacgtgttcccgtacttgggagtcggccat

SEQ ID NO: 396010 - DNA, 140 bp, Artificial Sequence
  Synthetic
atggccgactcccaagtacgggaacacgtcggacacattttctccccaggtgtaagtggggatacctctctgatcggtagttcccactaccacggggctaggtgtgaagcagtagacaggggagacccagcatggcgtat

SEQ ID NO: 396011 - DNA, 140 bp, Artificial Sequence
  Synthetic
atacgccatgctgggtctccaaagcccaccatcaacgagaccgacctggtgtgccccactgattgcttccggaagcatccagacgcctcatttgtgaagtgcgggtcgggtccctggctccgtacttgggagtcggccat

SEQ ID NO: 396012 - DNA, 140 bp, Artificial Sequence
  Synthetic
atggccgactcccaagtacggagccagggacccgacccgcacttcacaaatgaggcgtctggatgcttccggaagcaatcagtggggcacaccaggtcggtctcgttgatggtgggctttggagacccagcatggcgtat

SEQ ID NO: 396013 - DNA, 140 bp, Artificial Sequence
  Synthetic
atacgccatgctgggtctccagcataggttcaacgctgcttgcaactggacccgaggcgatcggtgcgagcttgatgacagagacaggttcgagatgagcccgctcttgttctccaccaccgtacttgggagtcggccat

SEQ ID NO: 396014 - DNA, 140 bp, Artificial Sequence
  Synthetic
atggccgactcccaagtacggtggtggagaacaagagcgggctcatctcgaacctgtctctgtcatcaagctcgcaccgatcgcctcgggtccagttgcaagcagcgttgaacctatgctggagacccagcatggcgtat

SEQ ID NO: 396015 - DNA, 140 bp, Artificial Sequence
  Synthetic
atacgccatgctgggtctccggagtatccacggcagttgtgtcgtgggcaatgaagtgggaatacgtagtccttgcatttctggtcctggccgatgctcgcgtttgtgcgtgcttatggtcgtacttgggagtcggccat

SEQ ID NO: 396016 - DNA, 140 bp, Artificial Sequence
  Synthetic
atggccgactcccaagtacgaccataagcacgcacaaacgcgagcatcggccaggaccagaaatgcaaggactacgtattcccacttcattgcccacgacacaactgccgtggatactccggagacccagcatggcgtat

SEQ ID NO: 396017 - DNA, 140 bp, Artificial Sequence
  Synthetic
atacgccatgctgggtctcccttcatctgttgcgcttggcacgtgcggggccgggctgtccccgtgaccacctacgcgttactccagctttggccgctcttgttactaatactagccttacgtacttgggagtcggccat

SEQ ID NO: 396018 - DNA, 140 bp, Artificial Sequence
  Synthetic
atggccgactcccaagtacgtaaggctagtattagtaacaagagcggccaaagctggagtaacgcgtaggtggtcacggggacagcccggccccgcacgtgccaagcgcaacagatgaagggagacccagcatggcgtat

SEQ ID NO: 396019 - DNA, 140 bp, Artificial Sequence
  Synthetic
atacgccatgctgggtctccagcttctcataagcatgctctggtggatacagtatttcattgcactcactgaggcccaacttcatcagtgggtaccatccctgctggttaggggcggacgcgtacttgggagtcggccat

SEQ ID NO: 396020 - DNA, 140 bp, Artificial Sequence
  Synthetic
atggccgactcccaagtacgcgtccgcccctaaccagcagggatggtacccactgatgaagttgggcctcagtgagtgcaatgaaatactgtatccaccagagcatgcttatgagaagctggagacccagcatggcgtat

SEQ ID NO: 396021 - DNA, 140 bp, Artificial Sequence
  Synthetic
atacgccatgctgggtctcctacagcctgcttaagactccatatttcgtccgcgcgcatatcctcttgcgtgcatgcatgttcttccgtggcatggctcgtggcaggtatgctcaagccacgtacttgggagtcggccat

SEQ ID NO: 396022 - DNA, 140 bp, Artificial Sequence
  Synthetic
atggccgactcccaagtacgtggcttgagcatacctgccacgagccatgccacggaagaacatgcatgcacgcaagaggatatgcgcgcggacgaaatatggagtcttaagcaggctgtaggagacccagcatggcgtat

SEQ ID NO: 396023 - DNA, 140 bp, Artificial Sequence
  Synthetic
atacgccatgctgggtctcctgttgagcccgtcgtcttctccccaatggagaagaaggtcatcacatggggtgctgataccgctgcctgcggcgacatcatcgccggtcttcctgtcgctcgtacttgggagtcggccat

SEQ ID NO: 396024 - DNA, 140 bp, Artificial Sequence
  Synthetic
atggccgactcccaagtacgagcgacaggaagaccggcgatgatgtcgccgcaggcagcggtatcagcaccccatgtgatgaccttcttctccattggggagaagacgacgggctcaacaggagacccagcatggcgtat

SEQ ID NO: 396025 - DNA, 140 bp, Artificial Sequence
  Synthetic
atacgccatgctgggtctccaggccttttccttttttttttttttggttttttttgggtttttttttccccccccttccttttttttttttccccccaagggggggcccccttttccccccgtacttgggagtcggccat

SEQ ID NO: 396026 - DNA, 140 bp, Artificial Sequence
  Synthetic
atggccgactcccaagtacggggggaaaagggggcccccccttggggggaaaaaaaaaaaaggaaggggggggaaaaaaaaacccaaaaaaaaccaaaaaaaaaaaaaaggaaaaggcctggagacccagcatggcgtat

SEQ ID NO: 396027 - DNA, 140 bp, Artificial Sequence
  Synthetic
atacgccatgctgggtctccggggcatagtgggcaccatcgtcactagcctcaccggccgagacaagaatgaagtggagggggagattcaagtcgtttccacggccacacaatctttcctcgtacttgggagtcggccat

SEQ ID NO: 396028 - DNA, 140 bp, Artificial Sequence
  Synthetic
atggccgactcccaagtacgaggaaagattgtgtggccgtggaaacgacttgaatctccccctccacttcattcttgtctcggccggtgaggctagtgacgatggtgcccactatgccccggagacccagcatggcgtat

SEQ ID NO: 396029 - DNA, 140 bp, Artificial Sequence
  Synthetic
atacgccatgctgggtctccgttgaccaagatcttgtaggttggcccgcccctgcgggggcgcggtccctgacaccgtgctcctgtggctcaagtgacctctatctggtcacgagaaatgcgtacttgggagtcggccat

SEQ ID NO: 396030 - DNA, 140 bp, Artificial Sequence
  Synthetic
atggccgactcccaagtacgcatttctcgtgaccagatagaggtcacttgagccacaggagcacggtgtcagggaccgcgcccccgcaggggcgggccaacctacaagatcttggtcaacggagacccagcatggcgtat

SEQ ID NO: 396031 - DNA, 140 bp, Artificial Sequence
  Synthetic
atacgccatgctgggtctccatgcccttcgggccacgtcgcggggattttccgcgcggctgtgtgcaccaggggcgtagccaaatcactggacttcgcgcctgtggagagcatgcaatcccgtacttgggagtcggccat

SEQ ID NO: 396032 - DNA, 140 bp, Artificial Sequence
  Synthetic
atggccgactcccaagtacgggattgcatgctctccacaggcgcgaagtccagtgatttggctacgcccctggtgcacacagccgcgcggaaaatccccgcgacgtggcccgaagggcatggagacccagcatggcgtat

SEQ ID NO: 396033 - DNA, 140 bp, Artificial Sequence
  Synthetic
aggccctggctgctgatatgcacatcaacaggactgccctgaactgcaatgattccctccaaactgggtttcttgccgcgctgttctacgcacacaaattcaatgcgtccgggtgcccaggaccttttgggacagcggtg

SEQ ID NO: 396034 - DNA, 140 bp, Artificial Sequence
  Synthetic
caccgctgtcccaaaaggtcctgggcacccggacgcattgaatttgtgtgcgtagaacagcgcggcaagaaacccagtttggagggaatcattgcagttcagggcagtcctgttgatgtgcatatcagcagccagggcct

SEQ ID NO: 396035 - DNA, 140 bp, Artificial Sequence
  Synthetic
atacgccatgctgggtctccgcaccaaggtccccgctgcttacgcagctcaagggtacaaggtcctggtgctcaatccatcggtcgctgccaccctaggcttcggtagttacatgtctaccgtacttgggagtcggccat

SEQ ID NO: 396036 - DNA, 140 bp, Artificial Sequence
  Synthetic
atggccgactcccaagtacggtagacatgtaactaccgaagcctagggtggcagcgaccgatggattgagcaccaggaccttgtacccttgagctgcgtaagcagcggggaccttggtgcggagacccagcatggcgtat

SEQ ID NO: 396037 - DNA, 140 bp, Artificial Sequence
  Synthetic
atacgccatgctgggtctccgggtgctctggcggagcctatgatgtcatcatctgtgatgagtgtcactcgaccgatcctaccacggtctcgggaatagggaccgttcttgaccaggcggcgtacttgggagtcggccat

SEQ ID NO: 396038 - DNA, 140 bp, Artificial Sequence
  Synthetic
atggccgactcccaagtacgccgcctggtcaagaacggtccctattcccgagaccgtggtaggatcggtcgagtgacactcatcacagatgatgacatcataggctccgccagagcacccggagacccagcatggcgtat

SEQ ID NO: 396039 - DNA, 140 bp, Artificial Sequence
  Synthetic
atacgccatgctgggtctccgggtgagatccctttctacgggaaggcggttcccctcgaatacatcaaagggggcaggcacctcatattttgtcatcccaagaagaagtgtgacgagctccgtacttgggagtcggccat

SEQ ID NO: 396040 - DNA, 140 bp, Artificial Sequence
  Synthetic
atggccgactcccaagtacggagctcgtcacacttcttcttgggatgacaaaatatgaggtgcctgccccctttgatgtattcgaggggaaccgccttcccgtagaaagggatctcacccggagacccagcatggcgtat

SEQ ID NO: 396041 - DNA, 140 bp, Artificial Sequence
  Synthetic
aggccctggctgctgatatgccttgaactgcaatgatagccttaacaccggctggttagcagggcttttctatcaccacaaattcaactcttcaggctgtcccgagaggttggccagctggaccttttgggacagcggtg

SEQ ID NO: 396042 - DNA, 140 bp, Artificial Sequence
  Synthetic
caccgctgtcccaaaaggtccagctggccaacctctcgggacagcctgaagagttgaatttgtggtgatagaaaagccctgctaaccagccggtgttaaggctatcattgcagttcaaggcatatcagcagccagggcct

SEQ ID NO: 396043 - DNA, 140 bp, Artificial Sequence
  Synthetic
atacgccatgctgggtctccccgatgccctcatgaccggctacacaggtgactttgactccgtaatagactgtaatgttactgtcacacaggtcgtggactttagtctcgacccgacattcgtacttgggagtcggccat

SEQ ID NO: 396044 - DNA, 140 bp, Artificial Sequence
  Synthetic
atggccgactcccaagtacgaatgtcgggtcgagactaaagtccacgacctgtgtgacagtaacattacagtctattacggagtcaaagtcacctgtgtagccggtcatgagggcatcggggagacccagcatggcgtat

SEQ ID NO: 396045 - DNA, 140 bp, Artificial Sequence
  Synthetic
atacgccatgctgggtctcccagggagaacggccgtcgggtatgttcgacagtgtcatcctctgcgaggcgtacgacacagggtgcgcgtggtatgaactgacaccagcggagaccaccgcgtacttgggagtcggccat

SEQ ID NO: 396046 - DNA, 140 bp, Artificial Sequence
  Synthetic
atggccgactcccaagtacgcggtggtctccgctggtgtcagttcataccacgcgcaccctgtgtcgtacgcctcgcagaggatgacactgtcgaacatacccgacggccgttctccctgggagacccagcatggcgtat

SEQ ID NO: 396047 - DNA, 140 bp, Artificial Sequence
  Synthetic
atacgccatgctgggtctcctcatttcctctcacagacgaaacaggcagaggaaaacttcgcatatctcgtagcctatcaagctacggtctgtgccagagctaaggccccccccccctcccgtacttgggagtcggccat

SEQ ID NO: 396048 - DNA, 140 bp, Artificial Sequence
  Synthetic
atggccgactcccaagtacgggagggggggggggccttagctctggcacagaccgtagcttgataggctacgagatatgcgaagttttcctctgcctgtttcgtctgtgagaggaaatgaggagacccagcatggcgtat

SEQ ID NO: 396049 - DNA, 140 bp, Artificial Sequence
  Synthetic
aggccctggctgctgatatggcactacgcacctaaaccgtgcggcattgtgcccgcgtcgcaggtgtgtggtccagtgtattgcttcaccccaagccctgttgtggtggggacgaccgatgaccttttgggacagcggtg

SEQ ID NO: 396050 - DNA, 140 bp, Artificial Sequence
  Synthetic
caccgctgtcccaaaaggtcatcggtcgtccccaccacaacagggcttggggtgaagcaatacactggaccacacacctgcgacgcgggcacaatgccgcacggtttaggtgcgtagtgccatatcagcagccagggcct

SEQ ID NO: 396051 - DNA, 140 bp, Artificial Sequence
  Synthetic
atacgccatgctgggtctccccactcacccaatcactaaatacatcatgacttgcatgtctgcagaccttgaggtgatcacgagtacctgggtgttggtggggggggtcgtcgccgccctcgtacttgggagtcggccat

SEQ ID NO: 396052 - DNA, 140 bp, Artificial Sequence
  Synthetic
atggccgactcccaagtacgagggcggcgacgaccccccccaccaacacccaggtactcgtgatcacctcaaggtctgcagacatgcaagtcatgatgtatttagtgattgggtgagtggggagacccagcatggcgtat

SEQ ID NO: 396053 - DNA, 140 bp, Artificial Sequence
  Synthetic
atacgccatgctgggtctcccagttcgacgagatggaggagtgttctaggcacatcccctatctcgctgaaggtcatctcatcgctgagcagttcaaacaaaaagtccttggcctcataccgtacttgggagtcggccat

SEQ ID NO: 396054 - DNA, 140 bp, Artificial Sequence
  Synthetic
atggccgactcccaagtacggtatgaggccaaggactttttgtttgaactgctcagcgatgagatgaccttcagcgagataggggatgtgcctagaacactcctccatctcgtcgaactgggagacccagcatggcgtat

SEQ ID NO: 396055 - DNA, 140 bp, Artificial Sequence
  Synthetic
aggccctggctgctgatatgatgtggcctctcctcctgctcctgttggcgttgccccagcgggcatacgcgctggacacggagatggccgcgtcgtgtggtggcgttgttcttgtcgggtgaccttttgggacagcggtg

SEQ ID NO: 396056 - DNA, 140 bp, Artificial Sequence
  Synthetic
caccgctgtcccaaaaggtcacccgacaagaacaacgccaccacacgacgcggccatctccgtgtccagcgcgtatgcccgctggggcaacgccaacaggagcaggaggagaggccacatcatatcagcagccagggcct

SEQ ID NO: 396057 - DNA, 140 bp, Artificial Sequence
  Synthetic
atacgccatgctgggtctcccggcatccaatacctagcaggcctgtcaaccctgcccggcaacccggctattgcctctctcatgtctttctctgcctctctcactagcccgctgtcgacgcgtacttgggagtcggccat

SEQ ID NO: 396058 - DNA, 140 bp, Artificial Sequence
  Synthetic
atggccgactcccaagtacgcgtcgacagcgggctagtgagagaggcagagaaagacatgagagaggcaatagccgggttgccgggcagggttgacaggcctgctaggtattggatgccgggagacccagcatggcgtat

SEQ ID NO: 396059 - DNA, 140 bp, Artificial Sequence
  Synthetic
atacgccatgctgggtctccctgctgtgggaagcattggcttaggacgggtgatcgtggacgtcttagccggatacggtgctggcgtgtccggggcacttgtcgcatttaaaatcatgtgcgtacttgggagtcggccat

SEQ ID NO: 396060 - DNA, 140 bp, Artificial Sequence
  Synthetic
atggccgactcccaagtacgcacatgattttaaatgcgacaagtgccccggacacgccagcaccgtatccggctaagacgtccacgatcacccgtcctaagccaatgcttcccacagcagggagacccagcatggcgtat

SEQ ID NO: 396061 - DNA, 140 bp, Artificial Sequence
  Synthetic
atacgccatgctgggtctcccgccatgctggacctagtgagggagcaactcagtggatgaacaggctcatagcctttgcctctagaggcaatcatgtgtctccaacacattacgtccctgcgtacttgggagtcggccat

SEQ ID NO: 396062 - DNA, 140 bp, Artificial Sequence
  Synthetic
atggccgactcccaagtacgcagggacgtaatgtgttggagacacatgattgcctctagaggcaaaggctatgagcctgttcatccactgagttgctccctcactaggtccagcatggcgggagacccagcatggcgtat

SEQ ID NO: 396063 - DNA, 140 bp, Artificial Sequence
  Synthetic
atacgccatgctgggtctccgccgtgctccagctcgtggttgcgcgacatttgggattgggtgtgtgaggtgctctctgatttcaagacctggcttaaagcaaagctcgttccagcgctacgtacttgggagtcggccat

SEQ ID NO: 396064 - DNA, 140 bp, Artificial Sequence
  Synthetic
atggccgactcccaagtacgtagcgctggaacgagctttgctttaagccaggtcttgaaatcagagagcacctcacacacccaatcccaaatgtcgcgcaaccacgagctggagcacggcggagacccagcatggcgtat

SEQ ID NO: 396065 - DNA, 140 bp, Artificial Sequence
  Synthetic
aggccctggctgctgatatgggctcatatggtggttacaatattttatcaccagagccgaggcgcacttgcaagtgtggatcccccccctcaacgttcggggaggccgcgatgccatcatgaccttttgggacagcggtg

SEQ ID NO: 396066 - DNA, 140 bp, Artificial Sequence
  Synthetic
caccgctgtcccaaaaggtcatgatggcatcgcggcctccccgaacgttgaggggggggatccacacttgcaagtgcgcctcggctctggtgataaaatattgtaaccaccatatgagcccatatcagcagccagggcct

SEQ ID NO: 396067 - DNA, 140 bp, Artificial Sequence
  Synthetic
atacgccatgctgggtctccgacacgtcaaaaatgggaccatgaagatttccgggcctcgttggtgcagcaacgtctcgcaccggacctttcccatcaatgctaccacgacaggccctagcgtacttgggagtcggccat

SEQ ID NO: 396068 - DNA, 140 bp, Artificial Sequence
  Synthetic
atggccgactcccaagtacgctagggcctgtcgtggtagcattgatgggaaaggtccggtgcgagacgttgctgcaccaacgaggcccggaaatcttcatggtcccatttttgacgtgtcggagacccagcatggcgtat

SEQ ID NO: 396069 - DNA, 140 bp, Artificial Sequence
  Synthetic
atacgccatgctgggtctccggtgccactacggacaatctaaagtgtccgtgccaggttcctgctcccgagtttttcactgaggtcgatggggtgagactacatcggtacgcgccccgctcgtacttgggagtcggccat

SEQ ID NO: 396070 - DNA, 140 bp, Artificial Sequence
  Synthetic
atggccgactcccaagtacgagcggggcgcgtaccgatgtagtctcaccccatcgacctcagtgaaaaactcgggagcaggaacctggcacggacactttagattgtccgtagtggcaccggagacccagcatggcgtat

SEQ ID NO: 396071 - DNA, 140 bp, Artificial Sequence
  Synthetic
atacgccatgctgggtctcctgtaacgtccatgctcatcgacccctcacatgtaactgctgaggctgcggcacgacgcttagctcgcgggtcgccgccctctcttgccagctcatcggcacgtacttgggagtcggccat

SEQ ID NO: 396072 - DNA, 140 bp, Artificial Sequence
  Synthetic
atggccgactcccaagtacgtgccgatgagctggcaagagagggcggcgacccgcgagctaagcgtcgtgccgcagcctcagcagttacatgtgaggggtcgatgagcatggacgttacaggagacccagcatggcgtat

SEQ ID NO: 396073 - DNA, 140 bp, Artificial Sequence
  Synthetic
atacgccatgctgggtctcctgggtggtaacatcacccgcgtggagtccgagaataaggtcgttattcttgattcctttgatcccctcgtcccagaattcgaggagagggaaatgtccgtcgtacttgggagtcggccat

SEQ ID NO: 396074 - DNA, 140 bp, Artificial Sequence
  Synthetic
atggccgactcccaagtacgacggacatttccctctcctcgaattctgggacgaggggatcaaaggaatcaagaataacgaccttattctcggactccacgcgggtgatgttaccacccaggagacccagcatggcgtat

SEQ ID NO: 396075 - DNA, 140 bp, Artificial Sequence
  Synthetic
atacgccatgctgggtctcctcgccgacctatgaaccaccagtggttcatggctgtgctttgcccccatctggtcctcctcctattcccccaccaaggaggaagaaagtggtacagctcgcgtacttgggagtcggccat

SEQ ID NO: 396076 - DNA, 140 bp, Artificial Sequence
  Synthetic
atggccgactcccaagtacgcgagctgtaccactttcttcctccttggtgggggaataggaggaggaccagatgggggcaaagcacagccatgaaccactggtggttcataggtcggcgaggagacccagcatggcgtat

SEQ ID NO: 396077 - DNA, 140 bp, Artificial Sequence
  Synthetic
atacgccatgctgggtctcctagcactgagtcttcagaacacgacagggatgatggggttgcatctgaagctgaatcctacagctctatgccccccctcgagggcgaaccaggagatccccgtacttgggagtcggccat

SEQ ID NO: 396078 - DNA, 140 bp, Artificial Sequence
  Synthetic
atggccgactcccaagtacggggatctcctggttcgccctcgagggggggcatagagctgtaggattcagcttcagatgcaaccccatcatccctgtcgtgttctgaagactcagtgctaggagacccagcatggcgtat

SEQ ID NO: 396079 - DNA, 140 bp, Artificial Sequence
  Synthetic
atacgccatgctgggtctccgcgccgctgaagaggaaaaactgcccatcaatcctctaagcaactccctcatccgtcaccataacttggtatattccacttcatctagaagcgcggcgaccgtacttgggagtcggccat

SEQ ID NO: 396080 - DNA, 140 bp, Artificial Sequence
  Synthetic
atggccgactcccaagtacggtcgccgcgcttctagatgaagtggaatataccaagttatggtgacggatgagggagttgcttagaggattgatgggcagtttttcctcttcagcggcgcggagacccagcatggcgtat

SEQ ID NO: 396081 - DNA, 140 bp, Artificial Sequence
  Synthetic
atacgccatgctgggtctcccaacttctttcaacggaagaggcctgtgacttaacaccaccccattctgcccgatccaaatttgggtacggggcaaaggacgttcggagccatgccagcacgtacttgggagtcggccat

SEQ ID NO: 396082 - DNA, 140 bp, Artificial Sequence
  Synthetic
atggccgactcccaagtacgtgctggcatggctccgaacgtcctttgccccgtacccaaatttggatcgggcagaatggggtggtgttaagtcacaggcctcttccgttgaaagaagttgggagacccagcatggcgtat

SEQ ID NO: 396083 - DNA, 140 bp, Artificial Sequence
  Synthetic
atacgccatgctgggtctccagacgcatcgaagggcggacgtaagtcggctcggctaatcgtatacccggacctaggggtccgggtgtgtgagaagcgagcgctttttgatgtcactcgtcgtacttgggagtcggccat

SEQ ID NO: 396084 - DNA, 140 bp, Artificial Sequence
  Synthetic
atggccgactcccaagtacgacgagtgacatcaaaaagcgctcgcttctcacacacccggacccctaggtccgggtatacgattagccgagccgacttacgtccgcccttcgatgcgtctggagacccagcatggcgtat

SEQ ID NO: 396085 - DNA, 140 bp, Artificial Sequence
  Synthetic
atacgccatgctgggtctcccaatggggttctcttatgacaccagatgctttgactcaacagtcacggagcgcgatatacgcacagaacaagacatttacttatcctgccagcttgaccccgtacttgggagtcggccat

SEQ ID NO: 396086 - DNA, 140 bp, Artificial Sequence
  Synthetic
atggccgactcccaagtacggggtcaagctggcaggataagtaaatgtcttgttctgtgcgtatatcgcgctccgtgactgttgagtcaaagcatctggtgtcataagagaaccccattgggagacccagcatggcgtat

SEQ ID NO: 396087 - DNA, 140 bp, Artificial Sequence
  Synthetic
atacgccatgctgggtctccgcaagcggggtactccccacaagcatgggtaacactgtcacatgcttcctgaaggcaaccgccgcttgtcgggcagccggcttcacagattatgacatgtcgtacttgggagtcggccat

SEQ ID NO: 396088 - DNA, 140 bp, Artificial Sequence
  Synthetic
atggccgactcccaagtacgacatgtcataatctgtgaagccggctgcccgacaagcggcggttgccttcaggaagcatgtgacagtgttacccatgcttgtggggagtaccccgcttgcggagacccagcatggcgtat

SEQ ID NO: 396089 - DNA, 140 bp, Artificial Sequence
  Synthetic
atacgccatgctgggtctccagcgacccccggagatgagcccagccctacatacgacctagagctgataacatcatgctcatccaatgtttccgtggcccacgatggagacggcaggagacgtacttgggagtcggccat

SEQ ID NO: 396090 - DNA, 140 bp, Artificial Sequence
  Synthetic
atggccgactcccaagtacgtctcctgccgtctccatcgtgggccacggaaacattggatgagcatgatgttatcagctctaggtcgtatgtagggctgggctcatctccgggggtcgctggagacccagcatggcgtat

SEQ ID NO: 396091 - DNA, 140 bp, Artificial Sequence
  Synthetic
atacgccatgctgggtctccggagaccgctcgtcacactcctgtgaattcatggttagggaacatcattatgtatgctcccaccatttgggtacgtatggtactcatgacccatttctttcgtacttgggagtcggccat

SEQ ID NO: 396092 - DNA, 140 bp, Artificial Sequence
  Synthetic
atggccgactcccaagtacgaaagaaatgggtcatgagtaccatacgtacccaaatggtgggagcatacataatgatgttccctaaccatgaattcacaggagtgtgacgagcggtctccggagacccagcatggcgtat

SEQ ID NO: 396093 - DNA, 140 bp, Artificial Sequence
  Synthetic
atacgccatgctgggtctccaagaccaaacttagactcactccattgcgtggtgcatccgctctcgacttgtcggggtggtttacatcaggctacggcgggggggacgtatatcacagcgcgtacttgggagtcggccat

SEQ ID NO: 396094 - DNA, 140 bp, Artificial Sequence
  Synthetic
atggccgactcccaagtacgcgctgtgatatacgtcccccccgccgtagcctgatgtaaaccaccccgacaagtcgagagcggatgcaccacgcaatggagtgagtctaagtttggtcttggagacccagcatggcgtat

SEQ ID NO: 396095 - DNA, 140 bp, Artificial Sequence
  Synthetic
aggccctggctgctgatatgctcaggaaacttggggtaccacccttgcgagtctggagacatcgggccagaagtgttcgcgctaagctactgtcccagggggggagggccgccacttgtggaccttttgggacagcggtg

SEQ ID NO: 396096 - DNA, 140 bp, Artificial Sequence
  Synthetic
caccgctgtcccaaaaggtccacaagtggcggccctccccccctgggacagtagcttagcgcgaacacttctggcccgatgtctccagactcgcaagggtggtaccccaagtttcctgagcatatcagcagccagggcct

SEQ ID NO: 396097 - DNA, 140 bp, Artificial Sequence
  Synthetic
aggccctggctgctgatatgtttttcttttttttattctttcttggtggctccatcttagccctagtcacggctagctgtgaaaggtccgtgagccgcatgactgcagagagtgctgaacgaccttttgggacagcggtg

SEQ ID NO: 396098 - DNA, 140 bp, Artificial Sequence
  Synthetic
caccgctgtcccaaaaggtcgttcagcactctctgcagtcatgcggctcacggacctttcacagctagccgtgactagggctaagatggagccaccaagaaagaataaaaaaaagaaaaacatatcagcagccagggcct

SEQ ID NO: 396099 - DNA, 140 bp, Artificial Sequence
  Synthetic
atacgccatgctgggtctccgatgaggtgtcgttcagagtaggactacacgattacccggtggggtcgcaattaccttgcgagcctgaaccggacgtggccgtgttgacgtccatgctcacgtacttgggagtcggccat

SEQ ID NO: 396100 - DNA, 140 bp, Artificial Sequence
  Synthetic
atggccgactcccaagtacgtgagcatggacgtcaacacggccacgtccggttcaggctcgcaaggtaattgcgaccccaccgggtaatcgtgtagtcctactctgaacgacacctcatcggagacccagcatggcgtat

SEQ ID NO: 396101 - DNA, 140 bp, Artificial Sequence
  Synthetic
atacgccatgctgggtctccccgaattggggcccaaatgacccccggcgaaggtcgcgcaatttgggtaaggtcatcgataccctgacttgcggcctagccgacctcatggggtacatcccgtacttgggagtcggccat

SEQ ID NO: 396102 - DNA, 140 bp, Artificial Sequence
  Synthetic
atggccgactcccaagtacgggatgtaccccatgaggtcggctaggccgcaagtcagggtatcgatgaccttacccaaattgcgcgaccttcgccgggggtcatttgggccccaattcggggagacccagcatggcgtat

SEQ ID NO: 396103 - DNA, 140 bp, Artificial Sequence
  Synthetic
atacgccatgctgggtctccgttagagcaatcgaggacggggtcaattacgcaacagggaatcttcccggttgctctttctctatcttcattctggcacttctctcgtgcctcactaccccgtacttgggagtcggccat

SEQ ID NO: 396104 - DNA, 140 bp, Artificial Sequence
  Synthetic
atggccgactcccaagtacggggtagtgaggcacgagagaagtgccagaatgaagatagagaaagagcaaccgggaagattccctgttgcgtaattgaccccgtcctcgattgctctaacggagacccagcatggcgtat

SEQ ID NO: 396105 - DNA, 140 bp, Artificial Sequence
  Synthetic
atacgccatgctgggtctccaatgactgtcccaattccagcatcgtgtacgaggcagagagtataatcttgcaccttccgggatgcgtcccgtgcgtgcgatcaaagaacgtgtctcgatcgtacttgggagtcggccat

SEQ ID NO: 396106 - DNA, 140 bp, Artificial Sequence
  Synthetic
atggccgactcccaagtacgatcgagacacgttctttgatcgcacgcacgggacgcatcccggaaggtgcaagattatactctctgcctcgtacacgatgctggaattgggacagtcattggagacccagcatggcgtat

SEQ ID NO: 396107 - DNA, 140 bp, Artificial Sequence
  Synthetic
atacgccatgctgggtctcccgggtgcgtgccctgcgtccgggagggcaattcctcccgttgctgggtagcgctcactcccacgctcgcggccaggaacagcagcatccccactacgacacgtacttgggagtcggccat

SEQ ID NO: 396108 - DNA, 140 bp, Artificial Sequence
  Synthetic
atggccgactcccaagtacgtgtcgtagtggggatgctgctgttcctggccgcgagcgtgggagtgagcgctacccagcaacgggaggaattgccctcccggacgcagggcacgcacccgggagacccagcatggcgtat

SEQ ID NO: 396109 - DNA, 140 bp, Artificial Sequence
  Synthetic
atacgccatgctgggtctccttgttctgccatgtatattggagatctttgtggcggcgttttccttgtggggcaggtttttacccttagacccaagatccataccaccgtccaagattgccgtacttgggagtcggccat

SEQ ID NO: 396110 - DNA, 140 bp, Artificial Sequence
  Synthetic
atggccgactcccaagtacggcaatcttggacggtggtatggatcttgggtctaagggtaaaaacctgccccacaaggaaaacgccgccacaaagatctccaatatacatggcagaacaaggagacccagcatggcgtat

SEQ ID NO: 396111 - DNA, 140 bp, Artificial Sequence
  Synthetic
aggccctggctgctgatatggagcggtctacgccttctacgggatgtggcctctcctcctgctcctgttggcgttgccccagcgggcatacgcactggacacggaggtggccgcgtcgtggaccttttgggacagcggtg

SEQ ID NO: 396112 - DNA, 140 bp, Artificial Sequence
  Synthetic
caccgctgtcccaaaaggtccacgacgcggccacctccgtgtccagtgcgtatgcccgctggggcaacgccaacaggagcaggaggagaggccacatcccgtagaaggcgtagaccgctccatatcagcagccagggcct

SEQ ID NO: 396113 - DNA, 140 bp, Artificial Sequence
  Synthetic
  misc_feature (59)..(59): n is a, c, g, or t
atacgccatgctgggtctcccgagggccgcagcagaatttgcagcttattaactccaanggcagctggcacgtcaaccgcactgcgcttaactgcaatgactctctgcagacggggttctcgtacttgggagtcggccat

SEQ ID NO: 396114 - DNA, 140 bp, Artificial Sequence
  Synthetic
  misc_feature (82)..(82): n is a, c, g, or t
atggccgactcccaagtacgagaaccccgtctgcagagagtcattgcagttaagcgcagtgcggttgacgtgccagctgccnttggagttaataagctgcaaattctgctgcggccctcgggagacccagcatggcgtat

SEQ ID NO: 396115 - DNA, 140 bp, Artificial Sequence
  Synthetic
atacgccatgctgggtctccgctttcatacttcaacgtaagcggcccatctgaggaaaggccctactgctggcattacccgccgaggccctgtgaggttgtcccagcggaatcggtctgccgtacttgggagtcggccat

SEQ ID NO: 396116 - DNA, 140 bp, Artificial Sequence
  Synthetic
atggccgactcccaagtacggcagaccgattccgctgggacaacctcacagggcctcggcgggtaatgccagcagtagggcctttcctcagatgggccgcttacgttgaagtatgaaagcggagacccagcatggcgtat

SEQ ID NO: 396117 - DNA, 140 bp, Artificial Sequence
  Synthetic
atacgccatgctgggtctcctcctgcttgggagcgcacggcctccgcaggggtcttggttcggatgcacctggatgaacggtaccggctatgtcaagacatgtggggctcccccttgtttcgtacttgggagtcggccat

SEQ ID NO: 396118 - DNA, 140 bp, Artificial Sequence
  Synthetic
atggccgactcccaagtacgaaacaagggggagccccacatgtcttgacatagccggtaccgttcatccaggtgcatccgaaccaagacccctgcggaggccgtgcgctcccaagcaggaggagacccagcatggcgtat

SEQ ID NO: 396119 - DNA, 140 bp, Artificial Sequence
  Synthetic
atacgccatgctgggtctccttgactccaaggtgcttggtagactacccttaccggctgtggcactatccttgcactgtgaatttcaccatacacaaggtcaggatgttcgtgggcggcacgtacttgggagtcggccat

SEQ ID NO: 396120 - DNA, 140 bp, Artificial Sequence
  Synthetic
atggccgactcccaagtacgtgccgcccacgaacatcctgaccttgtgtatggtgaaattcacagtgcaaggatagtgccacagccggtaagggtagtctaccaagcaccttggagtcaaggagacccagcatggcgtat

SEQ ID NO: 396121 - DNA, 140 bp, Artificial Sequence
  Synthetic
atacgccatgctgggtctcccactcagatggcaattctcccctgtacattcactaccatgcctgcgctgtcgaccggcctaatccaccttcaccagaatatcgtggacgtgcaatacctccgtacttgggagtcggccat

SEQ ID NO: 396122 - DNA, 140 bp, Artificial Sequence
  Synthetic
atggccgactcccaagtacggaggtattgcacgtccacgatattctggtgaaggtggattaggccggtcgacagcgcaggcatggtagtgaatgtacaggggagaattgccatctgagtgggagacccagcatggcgtat

SEQ ID NO: 396123 - DNA, 140 bp, Artificial Sequence
  Synthetic
atacgccatgctgggtctcctacggaatttccacggcaattgtgtcgtgggcattgaagtgggagtatgtagtccttgctttcctggttctggctgactcgcgcttgtgtgcgtgtttgtcgtacttgggagtcggccat

SEQ ID NO: 396124 - DNA, 140 bp, Artificial Sequence
  Synthetic
atggccgactcccaagtacgacaaacacgcacacaagcgcgagtcagccagaaccaggaaagcaaggactacatactcccacttcaatgcccacgacacaattgccgtggaaattccgtaggagacccagcatggcgtat

SEQ ID NO: 396125 - DNA, 140 bp, Artificial Sequence
  Synthetic
aggccctggctgctgatatgtagcccaggctgaggccgccttagagaacctggtggtcctcaatgcggcgtccgtggccggagcgcatggcattctctccttccttgtgttcttctgtgcgaccttttgggacagcggtg

SEQ ID NO: 396126 - DNA, 140 bp, Artificial Sequence
  Synthetic
caccgctgtcccaaaaggtcgcacagaagaacacaaggaaggagagaatgccatgcgctccggccacggacgccgcattgaggaccaccaggttctctaaggcggcctcagcctgggctacatatcagcagccagggcct

SEQ ID NO: 396127 - DNA, 140 bp, Artificial Sequence
  Synthetic
aggccctggctgctgatatgatggcgtatggccgctgcttctgctcctgctggcgttaccaccacgagcatacgccatggaccgggagatggccgcatcatgcggaggcgcggttttcgtgaccttttgggacagcggtg

SEQ ID NO: 396128 - DNA, 140 bp, Artificial Sequence
  Synthetic
caccgctgtcccaaaaggtcacgaaaaccgcgcctccgcatgatgcggccatctcccggtccatggcgtatgctcgtggtggtaacgccagcaggagcagaagcagcggccatacgccatcatatcagcagccagggcct

SEQ ID NO: 396129 - DNA, 140 bp, Artificial Sequence
  Synthetic
atacgccatgctgggtctcctcttttagcactcggcatcattaccatctttactctcaccccagcctataaacaacttcttgtaggtgtgctgtggtggacccaatatttcatcgcacgtcgtacttgggagtcggccat

SEQ ID NO: 396130 - DNA, 140 bp, Artificial Sequence
  Synthetic
atggccgactcccaagtacgacgtgcgatgaaatattgggtccaccacagcacacctacaagaagttgtttataggctggggtgagagtaaagatggtaatgatgccgagtgctaaaagaggagacccagcatggcgtat

SEQ ID NO: 396131 - DNA, 140 bp, Artificial Sequence
  Synthetic
atacgccatgctgggtctcccctcctcacgtgcgcggcccacccggaaagaatttttgaaatcaccaaaatcttgctcgccatactcggaccgctcatggtgttccaggctggcctagcccgtacttgggagtcggccat

SEQ ID NO: 396132 - DNA, 140 bp, Artificial Sequence
  Synthetic
atggccgactcccaagtacgggctaggccagcctggaacaccatgagcggtccgagtatggcgagcaagattttggtgatttcaaaaattctttccgggtgggccgcgcacgtgaggaggggagacccagcatggcgtat

SEQ ID NO: 396133 - DNA, 140 bp, Artificial Sequence
  Synthetic
aggccctggctgctgatatgcactggggagtcctagcgggccttgcctactattccatggtggggaactgggctaaggttctgattgtgatgctgctctttgcaggcgttgacgggagcagaccttttgggacagcggtg

SEQ ID NO: 396134 - DNA, 140 bp, Artificial Sequence
  Synthetic
caccgctgtcccaaaaggtctgctcccgtcaacgcctgcaaagagcagcatcacaatcagaaccttagcccagttccccaccatggaatagtaggcaaggcccgctaggactccccagtgcatatcagcagccagggcct

SEQ ID NO: 396135 - DNA, 140 bp, Artificial Sequence
  Synthetic
atacgccatgctgggtctccctcaccccccttactgattgggcctgtgacgggttgcgagaccttgccgttgcagtggagccggtcgtcttctctccaatggagaagaaagtcatcacttcgtacttgggagtcggccat

SEQ ID NO: 396136 - DNA, 140 bp, Artificial Sequence
  Synthetic
atggccgactcccaagtacgaagtgatgactttcttctccattggagagaagacgaccggctccactgcaacggcaaggtctcgcaacccgtcacaggcccaatcagtaaggggggtgagggagacccagcatggcgtat

SEQ ID NO: 396137 - DNA, 140 bp, Artificial Sequence
  Synthetic
aggccctggctgctgatatgtgcagtggagccggtcgtcttctctccaatggagaagaaagtcatcacttggggcgccgacaccgccgcgtgcggtgacatcatcgaaggccttcccgtcgaccttttgggacagcggtg

SEQ ID NO: 396138 - DNA, 140 bp, Artificial Sequence
  Synthetic
caccgctgtcccaaaaggtcgacgggaaggccttcgatgatgtcaccgcacgcggcggtgtcggcgccccaagtgatgactttcttctccattggagagaagacgaccggctccactgcacatatcagcagccagggcct

SEQ ID NO: 396139 - DNA, 140 bp, Artificial Sequence
  Synthetic
aggccctggctgctgatatgcgtcttctctgacatggagaccaaggtcatcacctggggggcagacaccgcggcgtgtggggacatcatctcgggtctgcccgtctccgcccgaaggggggaccttttgggacagcggtg

SEQ ID NO: 396140 - DNA, 140 bp, Artificial Sequence
  Synthetic
caccgctgtcccaaaaggtccccccttcgggcggagacgggcagacccgagatgatgtccccacacgccgcggtgtctgccccccaggtgatgaccttggtctccatgtcagagaagacgcatatcagcagccagggcct

SEQ ID NO: 396141 - DNA, 140 bp, Artificial Sequence
  Synthetic
atacgccatgctgggtctcctctgacaccatgctcgtgcgggtcgagtgacctctatctggtcacaaggaacgctgatgtcattcccgccaggcgcaggggggatagccgagctgctctccgtacttgggagtcggccat

SEQ ID NO: 396142 - DNA, 140 bp, Artificial Sequence
  Synthetic
atggccgactcccaagtacggagagcagctcggctatcccccctgcgcctggcgggaatgacatcagcgttccttgtgaccagatagaggtcactcgacccgcacgagcatggtgtcagaggagacccagcatggcgtat

SEQ ID NO: 396143 - DNA, 140 bp, Artificial Sequence
  Synthetic
atacgccatgctgggtctccgctatgcccctcaggccatgttgcaggaattttccgagcagcagtatgcacaaggggcgtggccaagtcgctggattttgtgccggtggagaacatgcagcgtacttgggagtcggccat

SEQ ID NO: 396144 - DNA, 140 bp, Artificial Sequence
  Synthetic
atggccgactcccaagtacgctgcatgttctccaccggcacaaaatccagcgacttggccacgccccttgtgcatactgctgctcggaaaattcctgcaacatggcctgaggggcatagcggagacccagcatggcgtat

SEQ ID NO: 396145 - DNA, 140 bp, Artificial Sequence
  Synthetic
atacgccatgctgggtctccgccgcaaacctatcaggtagggtacctccacgctcccacggggagtgggaagagtacgaaagttccagcggcttatgcggctcagggatacaaagtcctgcgtacttgggagtcggccat

SEQ ID NO: 396146 - DNA, 140 bp, Artificial Sequence
  Synthetic
atggccgactcccaagtacgcaggactttgtatccctgagccgcataagccgctggaactttcgtactcttcccactccccgtgggagcgtggaggtaccctacctgataggtttgcggcggagacccagcatggcgtat

SEQ ID NO: 396147 - DNA, 140 bp, Artificial Sequence
  Synthetic
atacgccatgctgggtctcccagctgatcaaatccaacggcagttggcacatcaacagcacggccttgaattgcaatgaaagcttgaacaccggctggctagcggggcttctctatgctccgtacttgggagtcggccat

SEQ ID NO: 396148 - DNA, 140 bp, Artificial Sequence
  Synthetic
atggccgactcccaagtacggagcatagagaagccccgctagccagccggtgttcaagctttcattgcaattcaaggccgtgctgttgatgtgccaactgccgttggatttgatcagctgggagacccagcatggcgtat

SEQ ID NO: 396149 - DNA, 140 bp, Artificial Sequence
  Synthetic
aggccctggctgctgatatggccatgctccggctcgtggctaagggacgtttgggactggatatgcacggtgttgactgacttcaagacctggctccagtccaagctcctgccgcggttagaccttttgggacagcggtg

SEQ ID NO: 396150 - DNA, 140 bp, Artificial Sequence
  Synthetic
caccgctgtcccaaaaggtctaaccgcggcaggagcttggactggagccaggtcttgaagtcagtcaacaccgtgcatatccagtcccaaacgtcccttagccacgagccggagcatggccatatcagcagccagggcct

SEQ ID NO: 396151 - DNA, 140 bp, Artificial Sequence
  Synthetic
atacgccatgctgggtctcccaaccggcgggccgatcacctactctacttatgggaaattcctcgccgacggcgggtgctctggtggggcttatgacatcattatctgtgatgaatgccacgtacttgggagtcggccat

SEQ ID NO: 396152 - DNA, 140 bp, Artificial Sequence
  Synthetic
atggccgactcccaagtacgtggcattcatcacagataatgatgtcataagccccaccagagcacccgccgtcggcgaggaatttcccataagtagagtaggtgatcggcccgccggttgggagacccagcatggcgtat

SEQ ID NO: 396153 - DNA, 140 bp, Artificial Sequence
  Synthetic
atacgccatgctgggtctccggttcggttacggtccctcacccaaacatcacggaggaggccctgcccaccaccggcgagatccccttctacgggaaggggattccccttgacttcatcacgtacttgggagtcggccat

SEQ ID NO: 396154 - DNA, 140 bp, Artificial Sequence
  Synthetic
atggccgactcccaagtacgtgatgaagtcaaggggaatccccttcccgtagaaggggatctcgccggtggtgggcagggcctcctccgtgatgtttgggtgagggaccgtaaccgaaccggagacccagcatggcgtat

SEQ ID NO: 396155 - DNA, 140 bp, Artificial Sequence
  Synthetic
atacgccatgctgggtctccgggtgtagacgtctccgtaataccaacagacggtgacgtggtcgtctgcgccacggacgcattgatgaccggctacacaggcaacttcgacactgtgatacgtacttgggagtcggccat

SEQ ID NO: 396156 - DNA, 140 bp, Artificial Sequence
  Synthetic
atggccgactcccaagtacgtatcacagtgtcgaagttgcctgtgtagccggtcatcaatgcgtccgtggcgcagacgaccacgtcaccgtctgttggtattacggagacgtctacacccggagacccagcatggcgtat

SEQ ID NO: 396157 - DNA, 140 bp, Artificial Sequence
  Synthetic
atacgccatgctgggtctccagaggagaggcaggaccggcagagggaagcacggggtgtatcgatacgtctcgttaggggaacgaccgtcggggttattcgactccgtcgtcctctgcgacgtacttgggagtcggccat

SEQ ID NO: 396158 - DNA, 140 bp, Artificial Sequence
  Synthetic
atggccgactcccaagtacgtcgcagaggacgacggagtcgaataaccccgacggtcgttcccctaacgagacgtatcgatacaccccgtgcttccctctgccggtcctgcctctcctctggagacccagcatggcgtat

SEQ ID NO: 396159 - DNA, 140 bp, Artificial Sequence
  Synthetic
aggccctggctgctgatatgtcatgggacgtcatgtggaagtgtctcctacgcctcaagcccacgctcacagggcccactcccctgttgtacaggctaggggctgtacaaaatgaggtctgaccttttgggacagcggtg

SEQ ID NO: 396160 - DNA, 140 bp, Artificial Sequence
  Synthetic
caccgctgtcccaaaaggtcagacctcattttgtacagcccctagcctgtacaacaggggagtgggccctgtgagcgtgggcttgaggcgtaggagacacttccacatgacgtcccatgacatatcagcagccagggcct

SEQ ID NO: 396161 - DNA, 140 bp, Artificial Sequence
  Synthetic
atacgccatgctgggtctccgcaccacccaccccatcactaagtacatcatgacctgcatgtccgcggacttggaggtagtcacaagtacttgggtgctagtgggaggtgtccttgccgccgtacttgggagtcggccat

SEQ ID NO: 396162 - DNA, 140 bp, Artificial Sequence
  Synthetic
atggccgactcccaagtacggcggcaaggacacctcccactagcacccaagtacttgtgactacctccaagtccgcggacatgcaggtcatgatgtacttagtgatggggtgggtggtgcggagacccagcatggcgtat

SEQ ID NO: 396163 - DNA, 140 bp, Artificial Sequence
  Synthetic
aggccctggctgctgatatgccatgcccccccttgagggggagccgggggaccccgatctcagcgacgggtcttggtctaccgtgagtgaggaggctagtgaggacgtcgtctgctgctcgaccttttgggacagcggtg

SEQ ID NO: 396164 - DNA, 140 bp, Artificial Sequence
  Synthetic
caccgctgtcccaaaaggtcgagcagcagacgacgtcctcactagcctcctcactcacggtagaccaagacccgtcgctgagatcggggtcccccggctccccctcaagggggggcatggcatatcagcagccagggcct

SEQ ID NO: 396165 - DNA, 140 bp, Artificial Sequence
  Synthetic
atacgccatgctgggtctcccagtggtattcaatacctggctggcctgtcaacattgccaggtaacccggcaatagcttccctcatgtccttctcagcctctctcaccagcccgttatcccgtacttgggagtcggccat

SEQ ID NO: 396166 - DNA, 140 bp, Artificial Sequence
  Synthetic
atggccgactcccaagtacgggataacgggctggtgagagaggctgagaaggacatgagggaagctattgccgggttacctggcaatgttgacaggccagccaggtattgaataccactgggagacccagcatggcgtat

SEQ ID NO: 396167 - DNA, 140 bp, Artificial Sequence
  Synthetic
atacgccatgctgggtctccgagctgcagtgggcagcatcgggctcgggaaagtcatcgtggacgttcttgcgggatacggggcaggcatatctggggcacttgttggcttcaaaatcatcgtacttgggagtcggccat

SEQ ID NO: 396168 - DNA, 140 bp, Artificial Sequence
  Synthetic
atggccgactcccaagtacgatgattttgaagccaacaagtgccccagatatgcctgccccgtatcccgcaagaacgtccacgatgactttcccgagcccgatgctgcccactgcagctcggagacccagcatggcgtat

SEQ ID NO: 396169 - DNA, 140 bp, Artificial Sequence
  Synthetic
atacgccatgctgggtctcccgacgccacaccgggccctctgaaggggcaacccagtggatgaacaggctcatagcctttgcctctaggggcaaccacgtgtctccgacgcactacgtcccgtacttgggagtcggccat

SEQ ID NO: 396170 - DNA, 140 bp, Artificial Sequence
  Synthetic
atggccgactcccaagtacgggacgtagtgcgtcggagacacgtggttgcccctagaggcaaaggctatgagcctgttcatccactgggttgccccttcagagggcccggtgtggcgtcgggagacccagcatggcgtat

SEQ ID NO: 396171 - DNA, 140 bp, Artificial Sequence
  Synthetic
atacgccatgctgggtctccctgagactgacgcatctcaaagggtcacatccatactcagttccctcaccgtgaccagccttctacggaagctacatgcatggatcaacggtgattggtccgtacttgggagtcggccat

SEQ ID NO: 396172 - DNA, 140 bp, Artificial Sequence
  Synthetic
atggccgactcccaagtacggaccaatcaccgttgatccatgcatgtagcttccgtagaaggctggtcacggtgagggaactgagtatggatgtgaccctttgagatgcgtcagtctcagggagacccagcatggcgtat

SEQ ID NO: 396173 - DNA, 140 bp, Artificial Sequence
  Synthetic
aggccctggctgctgatatgtagcgtacccattcctgagcccaattatacccgggctctgtggagggtctctgctgaggactatgttgaggttaaaagggtgggggacagtcatttcgtggaccttttgggacagcggtg

SEQ ID NO: 396174 - DNA, 140 bp, Artificial Sequence
  Synthetic
caccgctgtcccaaaaggtccacgaaatgactgtcccccacccttttaacctcaacatagtcctcagcagagaccctccacagagcccgggtataattgggctcaggaatgggtacgctacatatcagcagccagggcct

SEQ ID NO: 396175 - DNA, 140 bp, Artificial Sequence
  Synthetic
aggccctggctgctgatatgtcctacgcaatggggtctcaactcccgtgtgagcccgagccggacgtcatggtcgtcacatccatgctaactgacccatcgcatgtgactgctgaggccggaccttttgggacagcggtg

SEQ ID NO: 396176 - DNA, 140 bp, Artificial Sequence
  Synthetic
caccgctgtcccaaaaggtccggcctcagcagtcacatgcgatgggtcagttagcatggatgtgacgaccatgacgtccggctcgggctcacacgggagttgagaccccattgcgtaggacatatcagcagccagggcct

SEQ ID NO: 396177 - DNA, 140 bp, Artificial Sequence
  Synthetic
atacgccatgctgggtctccccctcatcctgatgctgagctgatcgaagctaacctactgtggaggcaggagatgggtaacaacataactcgagtggagtctgagagcaaagtcatcattcgtacttgggagtcggccat

SEQ ID NO: 396178 - DNA, 140 bp, Artificial Sequence
  Synthetic
atggccgactcccaagtacgaatgatgactttgctctcagactccactcgagttatgttgttacccatctcctgcctccacagtaggttagcttcgatcagctcagcatcaggatgagggggagacccagcatggcgtat

SEQ ID NO: 396179 - DNA, 140 bp, Artificial Sequence
  Synthetic
aggccctggctgctgatatgagatgggtaacaacataactcgagtggagtctgagagcaaagtcatcattctcgactcttttgacccccttgtcccagaatatgatgacagagaaccatcgaccttttgggacagcggtg

SEQ ID NO: 396180 - DNA, 140 bp, Artificial Sequence
  Synthetic
caccgctgtcccaaaaggtcgatggttctctgtcatcatattctgggacaagggggtcaaaagagtcgagaatgatgactttgctctcagactccactcgagttatgttgttacccatctcatatcagcagccagggcct

SEQ ID NO: 396181 - DNA, 140 bp, Artificial Sequence
  Synthetic
atacgccatgctgggtctcctacccatttgggctaggcctgactacaacccgcctcttttggaaccatggaagtctcctgactataacccaccaatggtccatggctgcgccttgccccccgtacttgggagtcggccat

SEQ ID NO: 396182 - DNA, 140 bp, Artificial Sequence
  Synthetic
atggccgactcccaagtacggggggcaaggcgcagccatggaccattggtgggttatagtcaggagacttccatggttccaaaagaggcgggttgtagtcaggcctagcccaaatgggtaggagacccagcatggcgtat

SEQ ID NO: 396183 - DNA, 140 bp, Artificial Sequence
  Synthetic
atacgccatgctgggtctcctttccgcagcccgcgtctcttacgacagggtgcggatctggccaagctgctcatagcacggggtcgggggagcaatccgaggaggatggcgcggcctctgcgtacttgggagtcggccat

SEQ ID NO: 396184 - DNA, 140 bp, Artificial Sequence
  Synthetic
atggccgactcccaagtacgcagaggccgcgccatcctcctcggattgctcccccgaccccgtgctatgagcagcttggccagatccgcaccctgtcgtaagagacgcgggctgcggaaaggagacccagcatggcgtat

SEQ ID NO: 396185 - DNA, 140 bp, Artificial Sequence
  Synthetic
atacgccatgctgggtctccaggctgattcttacagttccatgccgcctcttgaaggcgagccgggcgaccctgacctcagctcagggtcatggtccacgattagtgaggagggcgacggcgtacttgggagtcggccat

SEQ ID NO: 396186 - DNA, 140 bp, Artificial Sequence
  Synthetic
atggccgactcccaagtacgccgtcgccctcctcactaatcgtggaccatgaccctgagctgaggtcagggtcgcccggctcgccttcaagaggcggcatggaactgtaagaatcagcctggagacccagcatggcgtat

SEQ ID NO: 396187 - DNA, 140 bp, Artificial Sequence
  Synthetic
atacgccatgctgggtctcccatgtgcagccgaagaggagaagctacccatcaatcctctgagcaactcccttattcggcaccataacctagtgtattccacctcctcaaaaagcgcaggcgtacttgggagtcggccat

SEQ ID NO: 396188 - DNA, 140 bp, Artificial Sequence
  Synthetic
atggccgactcccaagtacgcctgcgctttttgaggaggtggaatacactaggttatggtgccgaataagggagttgctcagaggattgatgggtagcttctcctcttcggctgcacatgggagacccagcatggcgtat

SEQ ID NO: 396189 - DNA, 140 bp, Artificial Sequence
  Synthetic
atacgccatgctgggtctccgctaggcttctcacgaccgaggaagcctgtgatctgaccccctcgcattcagctcgttccaagtttggatacggggcgaaggacgttcggagccataccccgtacttgggagtcggccat

SEQ ID NO: 396190 - DNA, 140 bp, Artificial Sequence
  Synthetic
atggccgactcccaagtacggggtatggctccgaacgtccttcgccccgtatccaaacttggaacgagctgaatgcgagggggtcagatcacaggcttcctcggtcgtgagaagcctagcggagacccagcatggcgtat

SEQ ID NO: 396191 - DNA, 140 bp, Artificial Sequence
  Synthetic
atacgccatgctgggtctcccgcaagctgccagtggccgtcatgggggacgcttacggcttccaatactcacccaagcagcgagtggaacgcttgctcaggatgtggcgctctaagaagacgtacttgggagtcggccat

SEQ ID NO: 396192 - DNA, 140 bp, Artificial Sequence
  Synthetic
atggccgactcccaagtacgtcttcttagagcgccacatcctgagcaagcgttccactcgctgcttgggtgagtattggaagccgtaagcgtcccccatgacggccactggcagcttgcgggagacccagcatggcgtat

SEQ ID NO: 396193 - DNA, 140 bp, Artificial Sequence
  Synthetic
atacgccatgctgggtctcccccagaagcccaacaggctatcaagtctcttaccgagaggctttatgttgggggccctatgtacaactcaaagggccagctctgcggccagcgcagatgccgtacttgggagtcggccat

SEQ ID NO: 396194 - DNA, 140 bp, Artificial Sequence
  Synthetic
atggccgactcccaagtacggcatctgcgctggccgcagagctggccctttgagttgtacatagggcccccaacataaagcctctcggtaagagacttgatagcctgttgggcttctgggggagacccagcatggcgtat

SEQ ID NO: 396195 - DNA, 140 bp, Artificial Sequence
  Synthetic
atacgccatgctgggtctcctctgaaagcgaaagccgcttgccgcgctgcgggcttcaccaactttgacatgttggtctgcggagacgacttggtggtcatctctgagagtgctggggtccgtacttgggagtcggccat

SEQ ID NO: 396196 - DNA, 140 bp, Artificial Sequence
  Synthetic
atggccgactcccaagtacggaccccagcactctcagagatgaccaccaagtcgtctccgcagaccaacatgtcaaagttggtgaagcccgcagcgcggcaagcggctttcgctttcagaggagacccagcatggcgtat

SEQ ID NO: 396197 - DNA, 140 bp, Artificial Sequence
  Synthetic
atacgccatgctgggtctcccacatcaacaggactgccctgaactgcaatgagtccctcaacaccgggtttcttgccgcgctgttctacgcaaatagcttcaatgcgtccggatgtccggcgtacttgggagtcggccat

SEQ ID NO: 396198 - DNA, 140 bp, Artificial Sequence
  Synthetic
atggccgactcccaagtacgccggacatccggacgcattgaagctatttgcgtagaacagcgcggcaagaaacccggtgttgagggactcattgcagttcagggcagtcctgttgatgtgggagacccagcatggcgtat

SEQ ID NO: 396199 - DNA, 140 bp, Artificial Sequence
  Synthetic
atacgccatgctgggtctccttctgcaacccccggggatctacccagcccgtcgtatgacctagagctgataacatcatgctcttcaaacgtttccgtggcccatgatggagacggcagacgtacttgggagtcggccat

SEQ ID NO: 396200 - DNA, 140 bp, Artificial Sequence
  Synthetic
atggccgactcccaagtacgtctgccgtctccatcatgggccacggaaacgtttgaagagcatgatgttatcagctctaggtcatacgacgggctgggtagatccccgggggttgcagaaggagacccagcatggcgtat

SEQ ID NO: 396201 - DNA, 140 bp, Artificial Sequence
  Synthetic
aggccctggctgctgatatgaccaacgcccctactgctggcactaccccccaagaccctgtggtattgtgcccgcaaagagcgtgtgtggcccggtatattgcttcactcccagccccgtgaccttttgggacagcggtg

SEQ ID NO: 396202 - DNA, 140 bp, Artificial Sequence
  Synthetic
caccgctgtcccaaaaggtcacggggctgggagtgaagcaatataccgggccacacacgctctttgcgggcacaataccacagggtcttggggggtagtgccagcagtaggggcgttggtcatatcagcagccagggcct

SEQ ID NO: 396203 - DNA, 140 bp, Artificial Sequence
  Synthetic
atacgccatgctgggtctccttgggagactgcccggcacactccagtcaactcgtggctgggaaacatcatcatgtacgctcctgctatttgggtccgtatggtgctgatgacccattttcgtacttgggagtcggccat

SEQ ID NO: 396204 - DNA, 140 bp, Artificial Sequence
  Synthetic
atggccgactcccaagtacgaaaatgggtcatcagcaccatacggacccaaatagcaggagcgtacatgatgatgtttcccagccacgagttgactggagtgtgccgggcagtctcccaaggagacccagcatggcgtat

SEQ ID NO: 396205 - DNA, 140 bp, Artificial Sequence
  Synthetic
aggccctggctgctgatatggaacatccagctgatcaacaccaacggcagttggcatatcaataggacggccttgaactgcaatgacagccttaacaccggctggatagcagggcttttggaccttttgggacagcggtg

SEQ ID NO: 396206 - DNA, 140 bp, Artificial Sequence
  Synthetic
caccgctgtcccaaaaggtccaaaagccctgctatccagccggtgttaaggctgtcattgcagttcaaggccgtcctattgatatgccaactgccgttggtgttgatcagctggatgttccatatcagcagccagggcct

SEQ ID NO: 396207 - DNA, 140 bp, Artificial Sequence
  Synthetic
aggccctggctgctgatatgtccaaagactccacggcatggccgcattttcactccatgggtactctcctggcgaactcaatcgcgtggcagcatgcctcaggaagcttggggctcccccgaccttttgggacagcggtg

SEQ ID NO: 396208 - DNA, 140 bp, Artificial Sequence
  Synthetic
caccgctgtcccaaaaggtcgggggagccccaagcttcctgaggcatgctgccacgcgattgagttcgccaggagagtacccatggagtgaaaatgcggccatgccgtggagtctttggacatatcagcagccagggcct

SEQ ID NO: 396209 - DNA, 140 bp, Artificial Sequence
  Synthetic
  misc_feature (111)..(111): n is a, c, g, or t
atacgccatgctgggtctccgtaaaaaccaagctcaaactcactccattgcgtggcgcgtccgacctggatttgtcaggctggttcgcggcaggcttcagcgggggggacntttatcacacgtacttgggagtcggccat

SEQ ID NO: 396210 - DNA, 140 bp, Artificial Sequence
  Synthetic
  misc_feature (30)..(30): n is a, c, g, or t
atggccgactcccaagtacgtgtgataaangtcccccccgctgaagcctgccgcgaaccagcctgacaaatccaggtcggacgcgccacgcaatggagtgagtttgagcttggtttttacggagacccagcatggcgtat

SEQ ID NO: 396211 - DNA, 140 bp, Artificial Sequence
  Synthetic
atacgccatgctgggtctccgcgcgtccagggctcgaccccgcatgttactcctgtgcctactcctacttacggtgggggtaggcatctttttgctcccagctcggtaggctgagagcttcgtacttgggagtcggccat

SEQ ID NO: 396212 - DNA, 140 bp, Artificial Sequence
  Synthetic
atggccgactcccaagtacgaagctctcagcctaccgagctgggagcaaaaagatgcctacccccaccgtaagtaggagtaggcacaggagtaacatgcggggtcgagccctggacgcgcggagacccagcatggcgtat

SEQ ID NO: 396213 - DNA, 140 bp, Artificial Sequence
  Synthetic
aggccctggctgctgatatgacggtgggggtaggcatctttttgctcccagctcggtaggctgagagcttaacactccaaacatctgtttttttttttgttgctttttttttttttttttgaccttttgggacagcggtg

SEQ ID NO: 396214 - DNA, 140 bp, Artificial Sequence
  Synthetic
caccgctgtcccaaaaggtcaaaaaaaaaaaaaaaaagcaacaaaaaaaaaaacagatgtttggagtgttaagctctcagcctaccgagctgggagcaaaaagatgcctacccccaccgtcatatcagcagccagggcct

SEQ ID NO: 396215 - DNA, 140 bp, Artificial Sequence
  Synthetic
atacgccatgctgggtctccttcttctgtgctgcctggtgcatcaagggcaggctggttcccggggcggcatatgctctctacggcgtgtggccgctgttcctgctcctgctggcgctgccgtacttgggagtcggccat

SEQ ID NO: 396216 - DNA, 140 bp, Artificial Sequence
  Synthetic
atggccgactcccaagtacggcagcgccagcaggagcaggaacagcggccacacgccgtagagagcatatgccgccccgggaaccagcctgcccttgatgcaccaggcagcacagaagaaggagacccagcatggcgtat

SEQ ID NO: 396217 - DNA, 140 bp, Artificial Sequence
  Synthetic
aggccctggctgctgatatggttcctcgccaagctcatatggtggttgcaatatcttatcaccagagccgaggcgcacttgcaagtgtggatcccccctctcaacgttcgggggggccgcgaccttttgggacagcggtg

SEQ ID NO: 396218 - DNA, 140 bp, Artificial Sequence
  Synthetic
caccgctgtcccaaaaggtcgcggcccccccgaacgttgagaggggggatccacacttgcaagtgcgcctcggctctggtgataagatattgcaaccaccatatgagcttggcgaggaaccatatcagcagccagggcct

SEQ ID NO: 396219 - DNA, 140 bp, Artificial Sequence
  Synthetic
atacgccatgctgggtctcccccaattccagcatcgtgtacgaggcagatactatgatcttacaccttccgggatgcgtcccgtgtgtgcaaacagggaacacgtctcgatgctggctcgcgtacttgggagtcggccat

SEQ ID NO: 396220 - DNA, 140 bp, Artificial Sequence
  Synthetic
atggccgactcccaagtacgcgagccagcatcgagacgtgttccctgtttgcacacacgggacgcatcccggaaggtgtaagatcatagtatctgcctcgtacacgatgctggaattgggggagacccagcatggcgtat

SEQ ID NO: 396221 - DNA, 140 bp, Artificial Sequence
  Synthetic
aggccctggctgctgatatgggccttgcctactattccatggtggggaactgggctaaggttttgattgtgatgctactctttgccggcgttgacgggcaaactcgcgtgtcaggggggagaccttttgggacagcggtg

SEQ ID NO: 396222 - DNA, 140 bp, Artificial Sequence
  Synthetic
caccgctgtcccaaaaggtctcccccctgacacgcgagtttgcccgtcaacgccggcaaagagtagcatcacaatcaaaaccttagcccagttccccaccatggaatagtaggcaaggcccatatcagcagccagggcct

SEQ ID NO: 396223 - DNA, 140 bp, Artificial Sequence
  Synthetic
atacgccatgctgggtctcctctcagaaaatccagcttgtgaacaccaatggcagttggcacatcaacaggactgccctgaactgcaatgactccctcaacactgggtttcttgccgcgccgtacttgggagtcggccat

SEQ ID NO: 396224 - DNA, 140 bp, Artificial Sequence
  Synthetic
atggccgactcccaagtacggcgcggcaagaaacccagtgttgagggagtcattgcagttcagggcagtcctgttgatgtgccaactgccattggtgttcacaagctggattttctgagaggagacccagcatggcgtat

SEQ ID NO: 396225 - DNA, 140 bp, Artificial Sequence
  Synthetic
aggccctggctgctgatatgcacagctgctccttgatattttcttgggggcacactggggcgtccttggggcagtggtgtactactgcatggtggcgaactgggccaaggtcatagtcgtgaccttttgggacagcggtg

SEQ ID NO: 396226 - DNA, 140 bp, Artificial Sequence
  Synthetic
caccgctgtcccaaaaggtcacgactatgaccttggcccagttcgccaccatgcagtagtacaccactgccccaaggacgccccagtgtgcccccaagaaaatatcaaggagcagctgtgcatatcagcagccagggcct

SEQ ID NO: 396227 - DNA, 140 bp, Artificial Sequence
  Synthetic
atacgccatgctgggtctcccggcagaacttgcagctcatcaacaccaatggcagttggcatatcaaccgcactgcgcttaactgcaatgactcccttaatacgggttttcttgctccgccgtacttgggagtcggccat

SEQ ID NO: 396228 - DNA, 140 bp, Artificial Sequence
  Synthetic
atggccgactcccaagtacggcggagcaagaaaacccgtattaagggagtcattgcagttaagcgcagtgcggttgatatgccaactgccattggtgttgatgagctgcaagttctgccgggagacccagcatggcgtat

SEQ ID NO: 396229 - DNA, 140 bp, Artificial Sequence
  Synthetic
atacgccatgctgggtctcctgccaacataagcggcccatcagaggagaggccctactgctggcattccccgccaaggccctgtagcatcgtcccagcgctatcggtctgcgggcccgtccgtacttgggagtcggccat

SEQ ID NO: 396230 - DNA, 140 bp, Artificial Sequence
  Synthetic
atggccgactcccaagtacggacgggcccgcagaccgatagcgctgggacgatgctacagggccttggcggggaatgccagcagtagggcctctcctctgatgggccgcttatgttggcaggagacccagcatggcgtat

SEQ ID NO: 396231 - DNA, 140 bp, Artificial Sequence
  Synthetic
atacgccatgctgggtctccaaagcgcgcggcccccacaggggtcttggttcggatgcacttggatgaatggcactggctatgtcaaaacatgtggggctcccccttgtgtgactcgacccgtacttgggagtcggccat

SEQ ID NO: 396232 - DNA, 140 bp, Artificial Sequence
  Synthetic
atggccgactcccaagtacgggtcgagtcacacaagggggagccccacatgttttgacatagccagtgccattcatccaagtgcatccgaaccaagacccctgtgggggccgcgcgctttggagacccagcatggcgtat

SEQ ID NO: 396233 - DNA, 140 bp, Artificial Sequence
  Synthetic
aggccctggctgctgatatggctgctctgggggcgcctacgacatcataatatgtgatgagtgccactcaactgactcgactaccatcctgggcatcggcacggtcctggaccaagcggagaccttttgggacagcggtg

SEQ ID NO: 396234 - DNA, 140 bp, Artificial Sequence
  Synthetic
caccgctgtcccaaaaggtctccgcttggtccaggaccgtgccgatgcccaggatggtagtcgagtcagttgagtggcactcatcacatattatgatgtcgtaggcgcccccagagcagccatatcagcagccagggcct

SEQ ID NO: 396235 - DNA, 140 bp, Artificial Sequence
  Synthetic
atacgccatgctgggtctcccgcctggtatataaagggtaggctggtccccggggcggcatatgccctctatggcgtatggccgttgctcctgcttttgctggcgttaccaccacgggctcgtacttgggagtcggccat

SEQ ID NO: 396236 - DNA, 140 bp, Artificial Sequence
  Synthetic
atggccgactcccaagtacgagcccgtggtggtaacgccagcaaaagcaggagcaacggccatacgccatagagggcatatgccgccccggggaccagcctaccctttatataccaggcgggagacccagcatggcgtat

SEQ ID NO: 396237 - DNA, 140 bp, Artificial Sequence
  Synthetic
atacgccatgctgggtctcctgagggttggggtaaccactccggccttttaggccattttctttttttttttcccttcccggttttttttttttttccctttttttggggttttttttttcgtacttgggagtcggccat

SEQ ID NO: 396238 - DNA, 140 bp, Artificial Sequence
  Synthetic
atggccgactcccaagtacgaaaaaaaaaaccccaaaaaaagggaaaaaaaaaaaaaaccgggaagggaaaaaaaaaaagaaaatggcctaaaaggccggagtggttaccccaaccctcaggagacccagcatggcgtat

SEQ ID NO: 396239 - DNA, 140 bp, Artificial Sequence
  Synthetic
atacgccatgctgggtctccacttggcatcattaccattttcactctcactccggcctataaacaacttcttgtaaatgtgctgtggtggaaccaatatttcatcgcacgtgtggaggcgcgtacttgggagtcggccat

SEQ ID NO: 396240 - DNA, 140 bp, Artificial Sequence
  Synthetic
atggccgactcccaagtacgcgcctccacacgtgcgatgaaatattggttccaccacagcacatttacaagaagttgtttataggccggagtgagagtgaaaatggtaatgatgccaagtggagacccagcatggcgtat

SEQ ID NO: 396241 - DNA, 140 bp, Artificial Sequence
  Synthetic
aggccctggctgctgatatgcttactgattgggcctgtgacgggttgcgagatcttgccgttgcagtggagccagtcgtcttctctccaatggagaagaaagtcatcacttggggcgctggaccttttgggacagcggtg

SEQ ID NO: 396242 - DNA, 140 bp, Artificial Sequence
  Synthetic
caccgctgtcccaaaaggtccagcgccccaagtgatgactttcttctccattggagagaagacgactggctccactgcaacggcaagatctcgcaacccgtcacaggcccaatcagtaagcatatcagcagccagggcct

SEQ ID NO: 396243 - DNA, 140 bp, Artificial Sequence
  Synthetic
atacgccatgctgggtctcccggtgcgccggcgaggtgacagcagggggagcctactttcccccaggcctatttcctacttgaagggctcttctggcggcccactgctctgcccctcgggcgtacttgggagtcggccat

SEQ ID NO: 396244 - DNA, 140 bp, Artificial Sequence
  Synthetic
atggccgactcccaagtacgcccgaggggcagagcagtgggccgccagaagagcccttcaagtaggaaataggcctgggggaaagtaggctccccctgctgtcacctcgccggcgcaccgggagacccagcatggcgtat

SEQ ID NO: 396245 - DNA, 140 bp, Artificial Sequence
  Synthetic
atacgccatgctgggtctcctacgggttgcgcgtggtatgagttaactccagctgagaccacggttcgactgcgcgcatacctcaacaccccagggcttcccgtctgccaggaccatcttcgtacttgggagtcggccat

SEQ ID NO: 396246 - DNA, 140 bp, Artificial Sequence
  Synthetic
atggccgactcccaagtacgaagatggtcctggcagacgggaagccctggggtgttgaggtatgcgcgcagtcgaaccgtggtctcagctggagttaactcataccacgcgcaacccgtaggagacccagcatggcgtat

SEQ ID NO: 396247 - DNA, 140 bp, Artificial Sequence
  Synthetic
aggccctggctgctgatatgcggactacgtccctccggtggtacacgggtgcccattaccacctactaaggcccctccagtgccacccccacggagaaagaggacggttgtcctgacagagaccttttgggacagcggtg

SEQ ID NO: 396248 - DNA, 140 bp, Artificial Sequence
  Synthetic
caccgctgtcccaaaaggtctctgtcaggacaaccgtcctctttctccgtgggggtggcactggaggggccttagtaggtggtaatgggcacccgtgtaccaccggagggacgtagtccgcatatcagcagccagggcct

SEQ ID NO: 396249 - DNA, 140 bp, Artificial Sequence
  Synthetic
atacgccatgctgggtctccatcaagctacagtgtgcgctagggcgaaagccccccccccctcatgggacgtcatgtggaagtgtctcctacgcctcaagcccatgctcacagggcccaccgtacttgggagtcggccat

SEQ ID NO: 396250 - DNA, 140 bp, Artificial Sequence
  Synthetic
atggccgactcccaagtacggtgggccctgtgagcatgggcttgaggcgtaggagacacttccacatgacgtcccatgagggggggggggctttcgccctagcgcacactgtagcttgatggagacccagcatggcgtat

SEQ ID NO: 396251 - DNA, 140 bp, Artificial Sequence
  Synthetic
aggccctggctgctgatatgtgcctctaggggcaaccacgtgtctccgacgcactacgtccctgagactgacgcatcccaaaaagtcacagctatactcagctccctcaccgtgaccagtgaccttttgggacagcggtg

SEQ ID NO: 396252 - DNA, 140 bp, Artificial Sequence
  Synthetic
caccgctgtcccaaaaggtcactggtcacggtgagggagctgagtatagctgtgactttttgggatgcgtcagtctcagggacgtagtgcgtcggagacacgtggttgcccctagaggcacatatcagcagccagggcct

SEQ ID NO: 396253 - DNA, 140 bp, Artificial Sequence
  Synthetic
aggccctggctgctgatatgcatgcaaaccacctgcccatgtggagcacagatcgccggacatgtcaaaaacggttccatgaggatcgttgggcctagaacctgcagcaacacgtggcatgaccttttgggacagcggtg

SEQ ID NO: 396254 - DNA, 140 bp, Artificial Sequence
  Synthetic
caccgctgtcccaaaaggtcatgccacgtgttgctgcaggttctaggcccaacgatcctcatggaaccgtttttgacatgtccggcgatctgtgctccacatgggcaggtggtttgcatgcatatcagcagccagggcct

SEQ ID NO: 396255 - DNA, 140 bp, Artificial Sequence
  Synthetic
atacgccatgctgggtctcccagacttcaaaacctggctcaaagcaaaactcgttccagcgctgccaggcgtcccctttttctcgtgccaacgaggattcaggggagtttggcgaggcgacgtacttgggagtcggccat

SEQ ID NO: 396256 - DNA, 140 bp, Artificial Sequence
  Synthetic
atggccgactcccaagtacgtcgcctcgccaaactcccctgaatcctcgttggcacgagaaaaaggggacgcctggcagcgctggaacgagttttgctttgagccaggttttgaagtctgggagacccagcatggcgtat

SEQ ID NO: 396257 - DNA, 140 bp, Artificial Sequence
  Synthetic
atacgccatgctgggtctcctggcacggtactttccccatcaatgcaaccacgaccggccccagcgtacccattcctgagcccaactatactcgggctctgtggagggtctctgctgaggcgtacttgggagtcggccat

SEQ ID NO: 396258 - DNA, 140 bp, Artificial Sequence
  Synthetic
atggccgactcccaagtacgcctcagcagagaccctccacagagcccgagtatagttgggctcaggaatgggtacgctggggccggtcgtggttgcattgatggggaaagtaccgtgccaggagacccagcatggcgtat

SEQ ID NO: 396259 - DNA, 140 bp, Artificial Sequence
  Synthetic
atacgccatgctgggtctcccactgaggttgatggtgtgcggctacatcgttacgcacccaagtgcaaaccactcttgagagacgagatcacattctccgtaggtatgtcctcctacgcgcgtacttgggagtcggccat

SEQ ID NO: 396260 - DNA, 140 bp, Artificial Sequence
  Synthetic
atggccgactcccaagtacgcgcgtaggaggacatacctacggagaatgtgatctcgtctctcaagagtggtttgcacttgggtgcgtaacgatgtagccgcacaccatcaacctcagtgggagacccagcatggcgtat

SEQ ID NO: 396261 - DNA, 140 bp, Artificial Sequence
  Synthetic
atacgccatgctgggtctccatggggtctcagctcccgtgcgagcctgagccggatgtcgtggtcgccacatccatgctaactgatccgtcgcatatgactgctgagaccgcggcacgaccgtacttgggagtcggccat

SEQ ID NO: 396262 - DNA, 140 bp, Artificial Sequence
  Synthetic
atggccgactcccaagtacggtcgtgccgcggtctcagcagtcatatgcgacggatcagttagcatggatgtggcgaccacgacatccggctcaggctcgcacgggagctgagaccccatggagacccagcatggcgtat

SEQ ID NO: 396263 - DNA, 140 bp, Artificial Sequence
  Synthetic
atacgccatgctgggtctccgaccagaggccttattgctggcactacccacctagccaatgtggaatcgtgcccgcgtcgcaggtgtgtggtccagtgtattgcttcaccccaagccctgcgtacttgggagtcggccat

SEQ ID NO: 396264 - DNA, 140 bp, Artificial Sequence
  Synthetic
atggccgactcccaagtacgcagggcttggggtgaagcaatacactggaccacacacctgcgacgcgggcacgattccacattggctaggtgggtagtgccagcaataaggcctctggtcggagacccagcatggcgtat

SEQ ID NO: 396265 - DNA, 140 bp, Artificial Sequence
  Synthetic
atacgccatgctgggtctccgggctaggcccgactacaatccacctattttggaaccttggaagtctcctgactataatccaccaatggtccacggctgcgccatgccccccccggacaacgtacttgggagtcggccat

SEQ ID NO: 396266 - DNA, 140 bp, Artificial Sequence
  Synthetic
atggccgactcccaagtacgttgtccggggggggcatggcgcagccgtggaccattggtggattatagtcaggagacttccaaggttccaaaataggtggattgtagtcgggcctagcccggagacccagcatggcgtat

SEQ ID NO: 396267 - DNA, 140 bp, Artificial Sequence
  Synthetic
aggccctggctgctgatatggaatatccagctgatcaacaccaacggcagttggcacatcaatcgcacggccttgaactgtaatgcgagcctcgacaccggctggctagcggggctcttcgaccttttgggacagcggtg

SEQ ID NO: 396268 - DNA, 140 bp, Artificial Sequence
  Synthetic
caccgctgtcccaaaaggtcgaagagccccgctagccagccggtgtcgaggctcgcattacagttcaaggccgtgcgattgatgtgccaactgccgttggtgttgatcagctggatattccatatcagcagccagggcct

SEQ ID NO: 396269 - DNA, 140 bp, Artificial Sequence
  Synthetic
aggccctggctgctgatatgccttgaactgtaatgcgagcctcgacaccggctggctagcggggctcttctattaccacaaattcaactcttcaggctgccccgagaggatggccagctggaccttttgggacagcggtg

SEQ ID NO: 396270 - DNA, 140 bp, Artificial Sequence
  Synthetic
caccgctgtcccaaaaggtccagctggccatcctctcggggcagcctgaagagttgaatttgtggtaatagaagagccccgctagccagccggtgtcgaggctcgcattacagttcaaggcatatcagcagccagggcct

SEQ ID NO: 396271 - DNA, 140 bp, Artificial Sequence
  Synthetic
atacgccatgctgggtctccggccccgcgactcggatcagaggccttattgctggcactacgcacctcaaccgtgcggtactatacccgcggcgcaggtgtgcggtccggtgtattgcttcgtacttgggagtcggccat

SEQ ID NO: 396272 - DNA, 140 bp, Artificial Sequence
  Synthetic
atggccgactcccaagtacgaagcaatacaccggaccgcacacctgcgccgcgggtatagtaccgcacggttgaggtgcgtagtgccagcaataaggcctctgatccgagtcgcggggccggagacccagcatggcgtat

SEQ ID NO: 396273 - DNA, 140 bp, Artificial Sequence
  Synthetic
aggccctggctgctgatatgcctacaactggggtgaaaatgacacggacgtcttcgtccttaataacaccaggccaccgttgggcaattggttcggttgcacctggatgaactcatctgggaccttttgggacagcggtg

SEQ ID NO: 396274 - DNA, 140 bp, Artificial Sequence
  Synthetic
caccgctgtcccaaaaggtcccagatgagttcatccaggtgcaaccgaaccaattgcccaacggtggcctggtgttattaaggacgaagacgtccgtgtcattttcaccccagttgtaggcatatcagcagccagggcct

SEQ ID NO: 396275 - DNA, 140 bp, Artificial Sequence
  Synthetic
aggccctggctgctgatatggttcaccaagacgtgcgggggccccccgtgtaacatcgggggggccggcaacaacaccttgacctgccccacggactgcttccggaagcaccccgaggccgaccttttgggacagcggtg

SEQ ID NO: 396276 - DNA, 140 bp, Artificial Sequence
  Synthetic
caccgctgtcccaaaaggtcggcctcggggtgcttccggaagcagtccgtggggcaggtcaaggtgttgttgccggcccccccgatgttacacggggggcccccgcacgtcttggtgaaccatatcagcagccagggcct

SEQ ID NO: 396277 - DNA, 140 bp, Artificial Sequence
  Synthetic
aggccctggctgctgatatgcagcgggggagacatatatcacagcctgtctcgtgcccgaccccgctggttcatgttgtgcctactcctactttctgtaggggtaggcatctacctgctcgaccttttgggacagcggtg

SEQ ID NO: 396278 - DNA, 140 bp, Artificial Sequence
  Synthetic
caccgctgtcccaaaaggtcgagcaggtagatgcctacccctacagaaagtaggagtaggcacaacatgaaccagcggggtcgggcacgagacaggctgtgatatatgtctcccccgctgcatatcagcagccagggcct

SEQ ID NO: 396279 - DNA, 140 bp, Artificial Sequence
  Synthetic
aggccctggctgctgatatgggatgagcgggagatctccgtacccgcagaaatcctgcggaagtctcggagattcgccccggccctgcccatttgggcgcggccggactacaaccccccggaccttttgggacagcggtg

SEQ ID NO: 396280 - DNA, 140 bp, Artificial Sequence
  Synthetic
caccgctgtcccaaaaggtccggggggttgtagtccggccgcgcccaaatgggcagggccggggcgaatctccgagacttccgcaggatttctgcgggtacggagatctcccgctcatcccatatcagcagccagggcct

SEQ ID NO: 396281 - DNA, 140 bp, Artificial Sequence
  Synthetic
aggccctggctgctgatatgtggcagacgcgcgcgtctgtgcctgcttgtggatgatgctgctgatagctcaggctgaggccgccttagagaacttggtggtcctcaatgcggcgtccgtgaccttttgggacagcggtg

SEQ ID NO: 396282 - DNA, 140 bp, Artificial Sequence
  Synthetic
caccgctgtcccaaaaggtcacggacgccgcattgaggaccaccaagttctctaaggcggcctcagcctgagctatcagcagcatcatccacaagcaggcacagacgcgcgcgtctgccacatatcagcagccagggcct

SEQ ID NO: 396283 - DNA, 140 bp, Artificial Sequence
  Synthetic
aggccctggctgctgatatgcgctcactcccacgcttgcggccaggaacagcagcatccccactacgacaatacgacgccacgtcgatttgctcgttggggcagctgctttctgttccgcgaccttttgggacagcggtg

SEQ ID NO: 396284 - DNA, 140 bp, Artificial Sequence
  Synthetic
caccgctgtcccaaaaggtcgcggaacagaaagcagctgccccaacgagcaaatcgacgtggcgtcgtattgtcgtagtggggatgctgctgttcctggccgcaagcgtgggagtgagcgcatatcagcagccagggcct

SEQ ID NO: 396285 - DNA, 140 bp, Artificial Sequence
  Synthetic
aggccctggctgctgatatggccgtacttcgtgcgcgctcaagggctcattcgtgcatgcatgctggtgcggaaagccgctgggggccattatgtccaaatggctctcatgaagctggccgaccttttgggacagcggtg

SEQ ID NO: 396286 - DNA, 140 bp, Artificial Sequence
  Synthetic
caccgctgtcccaaaaggtcggccagcttcatgagagccatttggacataatggcccccagcggctttccgcaccagcatgcatgcacgaatgagcccttgagcgcgcacgaagtacggccatatcagcagccagggcct

SEQ ID NO: 396287 - DNA, 140 bp, Artificial Sequence
  Synthetic
aggccctggctgctgatatggactgccctgaactgcaatgactccctccaaactgggttccttgccgcgctgttctacacacacaggttcaacgcgtccggatgcccagagcgtatggccgaccttttgggacagcggtg

SEQ ID NO: 396288 - DNA, 140 bp, Artificial Sequence
  Synthetic
caccgctgtcccaaaaggtcggccatacgctctgggcatccggacgcgttgaacctgtgtgtgtagaacagcgcggcaaggaacccagtttggagggagtcattgcagttcagggcagtccatatcagcagccagggcct

SEQ ID NO: 396289 - DNA, 140 bp, Artificial Sequence
  Synthetic
atacgccatgctgggtctcctgagaacgccacagttgctccttgagattttcttgggagcacactggggtgtccttggggcagtggtgtattactgcatggtggcgaactgggccaaggtcgtacttgggagtcggccat

SEQ ID NO: 396290 - DNA, 140 bp, Artificial Sequence
  Synthetic
atggccgactcccaagtacgaccttggcccagttcgccaccatgcagtaatacaccactgccccaaggacaccccagtgtgctcccaagaaaatctcaaggagcaactgtggcgttctcaggagacccagcatggcgtat

SEQ ID NO: 396291 - DNA, 140 bp, Artificial Sequence
  Synthetic
  misc_feature (86)..(86): n is a, c, g, or t
atacgccatgctgggtctccctagggccgcagcagaatttgcagcttattaacaccaatggcagttggcacatcaaccgcactgcncttaactgcaatgactccctacagacgggtttctcgtacttgggagtcggccat

SEQ ID NO: 396292 - DNA, 140 bp, Artificial Sequence
  Synthetic
  misc_feature (55)..(55): n is a, c, g, or t
atggccgactcccaagtacgagaaacccgtctgtagggagtcattgcagttaagngcagtgcggttgatgtgccaactgccattggtgttaataagctgcaaattctgctgcggccctagggagacccagcatggcgtat

SEQ ID NO: 396293 - DNA, 140 bp, Artificial Sequence
  Synthetic
atacgccatgctgggtctccgctttcatatgccaacataagcggcccatctgaggaaaaaccctactgctggcattacccgccaaggccctgtggtgttgtcccagcgcaatcggtctgccgtacttgggagtcggccat

SEQ ID NO: 396294 - DNA, 140 bp, Artificial Sequence
  Synthetic
atggccgactcccaagtacggcagaccgattgcgctgggacaacaccacagggccttggcgggtaatgccagcagtagggtttttcctcagatgggccgcttatgttggcatatgaaagcggagacccagcatggcgtat

SEQ ID NO: 396295 - DNA, 140 bp, Artificial Sequence
  Synthetic
  misc_feature (119)..(119): n is a, c, g, or t
atacgccatgctgggtctcctcctgctcgagagcgcacggcctccgcaggggtcttggttcggatgcacttggatgaacggcaccggctatgtcaagacatgtggggctcccccctgtntcgtacttgggagtcggccat

SEQ ID NO: 396296 - DNA, 140 bp, Artificial Sequence
  Synthetic
  misc_feature (22)..(22): n is a, c, g, or t
atggccgactcccaagtacganacaggggggagccccacatgtcttgacatagccggtgccgttcatccaagtgcatccgaaccaagacccctgcggaggccgtgcgctctcgagcaggaggagacccagcatggcgtat

SEQ ID NO: 396297 - DNA, 140 bp, Artificial Sequence
  Synthetic
aggccctggctgctgatatgggctttaccggcgacttcgactcagtgatcgactgtaacacatgtgtcacccagacggtcgatttcagcttggaccctaccttcaccattgagacgacgagaccttttgggacagcggtg

SEQ ID NO: 396298 - DNA, 140 bp, Artificial Sequence
  Synthetic
caccgctgtcccaaaaggtctcgtcgtctcaatggtgaaggtagggtccaagctgaaatcgaccgtctgggtgacacatgtgttacagtcgatcactgagtcgaagtcgccggtaaagcccatatcagcagccagggcct

SEQ ID NO: 396299 - DNA, 140 bp, Artificial Sequence
  Synthetic
aggccctggctgctgatatgcctggcgggccttgcctactattccatggtgggaaactgggctaaggttttgattgtgatgctgctctttgccggcgttgacggggctacctacgcagcggaccttttgggacagcggtg

SEQ ID NO: 396300 - DNA, 140 bp, Artificial Sequence
  Synthetic
caccgctgtcccaaaaggtccgctgcgtaggtagccccgtcaacgccggcaaagagcagcatcacaatcaaaaccttagcccagtttcccaccatggaatagtaggcaaggcccgccaggcatatcagcagccagggcct

SEQ ID NO: 396301 - DNA, 140 bp, Artificial Sequence
  Synthetic
atacgccatgctgggtctccgattttcatctgctgcgcctggcatgtgcgtgggcgcttcgtgcccctttccacctacgcagtcttgcagctatggccccttctgctgttagtgcttgcccgtacttgggagtcggccat

SEQ ID NO: 396302 - DNA, 140 bp, Artificial Sequence
  Synthetic
atggccgactcccaagtacgggcaagcactaacagcagaaggggccatagctgcaagactgcgtaggtggaaaggggcacgaagcgcccacgcacatgccaggcgcagcagatgaaaatcggagacccagcatggcgtat

SEQ ID NO: 396303 - DNA, 140 bp, Artificial Sequence
  Synthetic
atacgccatgctgggtctccctttctagcactcggcatcattaccatcttcactctcaccccggcctataaacaacttcttgtaggtgtgctgtggtggaaccaatatttcatcgcgcgtcgtacttgggagtcggccat

SEQ ID NO: 396304 - DNA, 140 bp, Artificial Sequence
  Synthetic
atggccgactcccaagtacgacgcgcgatgaaatattggttccaccacagcacacctacaagaagttgtttataggccggggtgagagtgaagatggtaatgatgccgagtgctagaaagggagacccagcatggcgtat

SEQ ID NO: 396305 - DNA, 140 bp, Artificial Sequence
  Synthetic
aggccctggctgctgatatgcagtacagtttccttaaaacaccatactttgtccgagcacacattctgctgcgcgcgtgcatgcttttccgcggtttagctcgcggaaggtacgtccaaggaccttttgggacagcggtg

SEQ ID NO: 396306 - DNA, 140 bp, Artificial Sequence
  Synthetic
caccgctgtcccaaaaggtccttggacgtaccttccgcgagctaaaccgcggaaaagcatgcacgcgcgcagcagaatgtgtgctcggacaaagtatggtgttttaaggaaactgtactgcatatcagcagccagggcct

SEQ ID NO: 396307 - DNA, 140 bp, Artificial Sequence
  Synthetic
atacgccatgctgggtctccaggcaaaggatggaggctcctcgctccgattactgcatacgcccagcagactcgaggcttgatgggcaccatcgtcaccagcctcacggggcgcgacaagcgtacttgggagtcggccat

SEQ ID NO: 396308 - DNA, 140 bp, Artificial Sequence
  Synthetic
atggccgactcccaagtacgcttgtcgcgccccgtgaggctggtgacgatggtgcccatcaagcctcgagtctgctgggcgtatgcagtaatcggagcgaggagcctccatcctttgcctggagacccagcatggcgtat

SEQ ID NO: 396309 - DNA, 140 bp, Artificial Sequence
  Synthetic
atacgccatgctgggtctccgctcgaagactctcgccggcccaaaaggccccatttgtcagatgtacaccaatgtcgagcaggacttggtgggctggcccgcaccccccgggtcgcgatccgtacttgggagtcggccat

SEQ ID NO: 396310 - DNA, 140 bp, Artificial Sequence
  Synthetic
atggccgactcccaagtacggatcgcgacccggggggtgcgggccagcccaccaagtcctgctcgacattggtgtacatctgacaaatggggccttttgggccggcgagagtcttcgagcggagacccagcatggcgtat

SEQ ID NO: 396311 - DNA, 140 bp, Artificial Sequence
  Synthetic
aggccctggctgctgatatgatcatcaacggcttgcccgtctccgcccgtaggggccaggagatactgctcggaccggccgatggaatggtctccaaggggtggaggttgctggcgcccagaccttttgggacagcggtg

SEQ ID NO: 396312 - DNA, 140 bp, Artificial Sequence
  Synthetic
caccgctgtcccaaaaggtctgggcgccagcaacctccaccccttggagaccattccatcggccggtccgagcagtatctcctggcccctacgggcggagacgggcaagccgttgatgatcatatcagcagccagggcct

SEQ ID NO: 396313 - DNA, 140 bp, Artificial Sequence
  Synthetic
aggccctggctgctgatatgcgccccggaaaaagcggacggtggtcctcaccgaatcaaccgtatctactgccttggccgagcttgccaccaagagctttggcagctcctcaacttccgggaccttttgggacagcggtg

SEQ ID NO: 396314 - DNA, 140 bp, Artificial Sequence
  Synthetic
caccgctgtcccaaaaggtcccggaagttgaggagctgccaaagctcttggtggcaagctcggccaaggcagtagatacggttgattcggtgaggaccaccgtccgctttttccggggcgcatatcagcagccagggcct

SEQ ID NO: 396315 - DNA, 140 bp, Artificial Sequence
  Synthetic
atacgccatgctgggtctcccaacagttcgatgagatggaggaatgttccagccatatcccttacctccctgaggcccaagccatcgctgagcaattcaagcagaaggttcttggcctcacgtacttgggagtcggccat

SEQ ID NO: 396316 - DNA, 140 bp, Artificial Sequence
  Synthetic
atggccgactcccaagtacgtgaggccaagaaccttctgcttgaattgctcagcgatggcttgggcctcagggaggtaagggatatggctggaacattcctccatctcatcgaactgttgggagacccagcatggcgtat

SEQ ID NO: 396317 - DNA, 140 bp, Artificial Sequence
  Synthetic
aggccctggctgctgatatgcatagcctttgcctctaggggcaaccacgtgtctccgacgcactacgtccctgagactgatgcatctcaaaaggtcacagctatactcagttccctcaccgaccttttgggacagcggtg

SEQ ID NO: 396318 - DNA, 140 bp, Artificial Sequence
  Synthetic
caccgctgtcccaaaaggtcggtgagggaactgagtatagctgtgaccttttgagatgcatcagtctcagggacgtagtgcgtcggagacacgtggttgcccctagaggcaaaggctatgcatatcagcagccagggcct

SEQ ID NO: 396319 - DNA, 140 bp, Artificial Sequence
  Synthetic
aggccctggctgctgatatgcctccggtggtacacgggtgcccattgccacctaccaaggcccctccaataccacctccacggaggaagaggacggttgtcctgacagaatccaccgtgtgaccttttgggacagcggtg

SEQ ID NO: 396320 - DNA, 140 bp, Artificial Sequence
  Synthetic
caccgctgtcccaaaaggtcacacggtggattctgtcaggacaaccgtcctcttcctccgtggaggtggtattggaggggccttggtaggtggcaatgggcacccgtgtaccaccggaggcatatcagcagccagggcct

SEQ ID NO: 396321 - DNA, 140 bp, Artificial Sequence
  Synthetic
aggccctggctgctgatatgccttcggggcacgctgtcggcatcttccgggctgctgtatgcacccggggggttgctaaggcagtggactttgtacctgttgagtctatggagactaccagaccttttgggacagcggtg

SEQ ID NO: 396322 - DNA, 140 bp, Artificial Sequence
  Synthetic
caccgctgtcccaaaaggtctggtagtctccatagactcaacaggtacaaagtccactgccttagcaaccccccgggtgcatacagcagcccggaagatgccgacagcgtgccccgaaggcatatcagcagccagggcct

SEQ ID NO: 396323 - DNA, 140 bp, Artificial Sequence
  Synthetic
aggccctggctgctgatatggagtcctggcgggtcttgcctactattccatggcggggaactgggctaaggtcctgattgtgatgctactctttgccggcgttgacggaaacacctatacgaccttttgggacagcggtg

SEQ ID NO: 396324 - DNA, 140 bp, Artificial Sequence
  Synthetic
caccgctgtcccaaaaggtcgtataggtgtttccgtcaacgccggcaaagagtagcatcacaatcaggaccttagcccagttccccgccatggaatagtaggcaagacccgccaggactccatatcagcagccagggcct

SEQ ID NO: 396325 - DNA, 140 bp, Artificial Sequence
  Synthetic
atacgccatgctgggtctcccacattaacaggactgccctgaactgcaatgattccatcaaaactgggttcttcgccgcgctgttctacatacacaagttcaacgcgtccggatgtccagcgtacttgggagtcggccat

SEQ ID NO: 396326 - DNA, 140 bp, Artificial Sequence
  Synthetic
atggccgactcccaagtacgctggacatccggacgcgttgaacttgtgtatgtagaacagcgcggcgaagaacccagttttgatggaatcattgcagttcagggcagtcctgttaatgtgggagacccagcatggcgtat

SEQ ID NO: 396327 - DNA, 140 bp, Artificial Sequence
  Synthetic
aggccctggctgctgatatgtactctcggtgcggctccggtccctggcttacacccaggtgcctggtcaactacccgtataggctttggcattatccttgtaccatcaactacaccatatgaccttttgggacagcggtg

SEQ ID NO: 396328 - DNA, 140 bp, Artificial Sequence
  Synthetic
caccgctgtcccaaaaggtcatatggtgtagttgatggtacaaggataatgccaaagcctatacgggtagttgaccaggcacctgggtgtaagccagggaccggagccgcaccgagagtacatatcagcagccagggcct

SEQ ID NO: 396329 - DNA, 140 bp, Artificial Sequence
  Synthetic
aggccctggctgctgatatgttcttctgtgctgcctggtacatcaaaggcaggttggtccctggggcggcatatgctctttatggcgtatggccgctgctcctgctcttgctggcactacgaccttttgggacagcggtg

SEQ ID NO: 396330 - DNA, 140 bp, Artificial Sequence
  Synthetic
caccgctgtcccaaaaggtcgtagtgccagcaagagcaggagcagcggccatacgccataaagagcatatgccgccccagggaccaacctgcctttgatgtaccaggcagcacagaagaacatatcagcagccagggcct

SEQ ID NO: 396331 - DNA, 140 bp, Artificial Sequence
  Synthetic
aggccctggctgctgatatgtcatcgtgttccccgacctgggtgtgcgcgtgtgcgagaagatggccctgtacgacgtggtcagcaagctccccctggccgtgatgggaagctcctacgggaccttttgggacagcggtg

SEQ ID NO: 396332 - DNA, 140 bp, Artificial Sequence
  Synthetic
caccgctgtcccaaaaggtcccgtaggagcttcccatcacggccagggggagcttgctgaccacgtcgtacagggccatcttctcgcacacgcgcacacccaggtcggggaacacgatgacatatcagcagccagggcct

SEQ ID NO: 396333 - DNA, 140 bp, Artificial Sequence
  Synthetic
atacgccatgctgggtctcctctcagaaactccagcttataaacaccaatggcagttggcacatcaacaggactgccctgaactgcaatgactcctaccacactgggtttcttgccgcgccgtacttgggagtcggccat

SEQ ID NO: 396334 - DNA, 140 bp, Artificial Sequence
  Synthetic
atggccgactcccaagtacggcgcggcaagaaacccagtgtggtaggagtcattgcagttcagggcagtcctgttgatgtgccaactgccattggtgtttataagctggagtttctgagaggagacccagcatggcgtat

SEQ ID NO: 396335 - DNA, 140 bp, Artificial Sequence
  Synthetic
atacgccatgctgggtctcctgctgagcctgccgacctggaccagaggccttattgctggcactacccacctcgacaatgtggtaccatacccgcatcgcaggtgtgtggtccagtgtaccgtacttgggagtcggccat

SEQ ID NO: 396336 - DNA, 140 bp, Artificial Sequence
  Synthetic
atggccgactcccaagtacggtacactggaccacacacctgcgatgcgggtatggtaccacattgtcgaggtgggtagtgccagcaataaggcctctggtccaggtcggcaggctcagcaggagacccagcatggcgtat

SEQ ID NO: 396337 - DNA, 140 bp, Artificial Sequence
  Synthetic
atacgccatgctgggtctccttgctccttttctatcttcattttggcactgctctcgtgcctcaccacccctgcatctgcaatccacgtcaggaatgcatcaggaatctaccatctcacccgtacttgggagtcggccat

SEQ ID NO: 396338 - DNA, 140 bp, Artificial Sequence
  Synthetic
atggccgactcccaagtacgggtgagatggtagattcctgatgcattcctgacgtggattgcagatgcaggggtggtgaggcacgagagcagtgccaaaatgaagatagaaaaggagcaaggagacccagcatggcgtat

SEQ ID NO: 396339 - DNA, 140 bp, Artificial Sequence
  Synthetic
  misc_feature (55)..(55): n is a, c, g, or t
atacgccatgctgggtctccgctggcttcctgtttcaccaaccttggcagttccnaacggttcagtgccgattcatgggtttcgcagacatgtggaccttctcgtcggtgctgcagccttcgtacttgggagtcggccat

SEQ ID NO: 396340 - DNA, 140 bp, Artificial Sequence
  Synthetic
  misc_feature (86)..(86): n is a, c, g, or t
atggccgactcccaagtacgaaggctgcagcaccgacgagaaggtccacatgtctgcgaaacccatgaatcggcactgaaccgttnggaactgccaaggttggtgaaacaggaagccagcggagacccagcatggcgtat

SEQ ID NO: 396341 - DNA, 140 bp, Artificial Sequence
  Synthetic
aggccctggctgctgatatgatgctgcatgcaattggactcgaggagagcgctgtaacttggaggacagggatagatcggagctcagcccgctgctgctgtctacaacagagtggcaggtgaccttttgggacagcggtg

SEQ ID NO: 396342 - DNA, 140 bp, Artificial Sequence
  Synthetic
caccgctgtcccaaaaggtcacctgccactctgttgtagacagcagcagcgggctgagctccgatctatccctgtcctccaagttacagcgctctcctcgagtccaattgcatgcagcatcatatcagcagccagggcct

SEQ ID NO: 396343 - DNA, 140 bp, Artificial Sequence
  Synthetic
atacgccatgctgggtctccaattgctccatctacaccggccacgttaccggccataggatggcatgggacatgatgatgaactggtctcccacggtggcgtatgcaatgtccagcgtttcgtacttgggagtcggccat

SEQ ID NO: 396344 - DNA, 140 bp, Artificial Sequence
  Synthetic
atggccgactcccaagtacgaaacgctggacattgcatacgccaccgtgggagaccagttcatcatcatgtcccatgccatcctatggccggtaacgtggccggtgtagatggagcaattggagacccagcatggcgtat

SEQ ID NO: 396345 - DNA, 140 bp, Artificial Sequence
  Synthetic
atacgccatgctgggtctcctgaggataccgcaggtgctccttgagattttcctgggggcacactggggcgttctcggagccgtagtatattactgcatggtggcgaactgggcgaaggtcgtacttgggagtcggccat

SEQ ID NO: 396346 - DNA, 140 bp, Artificial Sequence
  Synthetic
atggccgactcccaagtacgaccttcgcccagttcgccaccatgcagtaatatactacggctccgagaacgccccagtgtgcccccaggaaaatctcaaggagcacctgcggtatcctcaggagacccagcatggcgtat

SEQ ID NO: 396347 - DNA, 140 bp, Artificial Sequence
  Synthetic
atacgccatgctgggtctccatagggccccagcagaaattacacctcatcaacaccaacggcagctggcacatcaaccgtaccgcactgaattgcaatgattccctgcagacagggttcacgtacttgggagtcggccat

SEQ ID NO: 396348 - DNA, 140 bp, Artificial Sequence
  Synthetic
atggccgactcccaagtacgtgaaccctgtctgcagggaatcattgcaattcagtgcggtacggttgatgtgccagctgccgttggtgttgatgaggtgtaatttctgctggggccctatggagacccagcatggcgtat

SEQ ID NO: 396349 - DNA, 140 bp, Artificial Sequence
  Synthetic
aggccctggctgctgatatgcatcaaccgtaccgcactgaattgcaatgattccctgcagacagggttcattgccgggttgttatactattcgcggttcaattccacgggttgccccgccgaccttttgggacagcggtg

SEQ ID NO: 396350 - DNA, 140 bp, Artificial Sequence
  Synthetic
caccgctgtcccaaaaggtcggcggggcaacccgtggaattgaaccgcgaatagtataacaacccggcaatgaaccctgtctgcagggaatcattgcaattcagtgcggtacggttgatgcatatcagcagccagggcct

SEQ ID NO: 396351 - DNA, 140 bp, Artificial Sequence
  Synthetic
atacgccatgctgggtctccggcactacgcacctaggccttgctccgacgttcgtgcgagatcggtgtgcgggcccgtctactgctttacacccagcccggtggttgtcggcaccactgacgtacttgggagtcggccat

SEQ ID NO: 396352 - DNA, 140 bp, Artificial Sequence
  Synthetic
atggccgactcccaagtacgtcagtggtgccgacaaccaccgggctgggtgtaaagcagtagacgggcccgcacaccgatctcgcacgaacgtcggagcaaggcctaggtgcgtagtgccggagacccagcatggcgtat

SEQ ID NO: 396353 - DNA, 140 bp, Artificial Sequence
  Synthetic
aggccctggctgctgatatggggcccgtctactgctttacacccagcccggtggttgtcggcaccactgataagaagggccaccccacgtttaactggggggagaatgagaccgatgtgtgaccttttgggacagcggtg

SEQ ID NO: 396354 - DNA, 140 bp, Artificial Sequence
  Synthetic
caccgctgtcccaaaaggtcacacatcggtctcattctccccccagttaaacgtggggtggcccttcttatcagtggtgccgacaaccaccgggctgggtgtaaagcagtagacgggccccatatcagcagccagggcct

SEQ ID NO: 396355 - DNA, 140 bp, Artificial Sequence
  Synthetic
atacgccatgctgggtctcctaagaagggccaccccacgtttaactggggggagaatgagaccgatgtgttcttgctttccagcgcacgccctcctggcgggccctggttcggttgcacacgtacttgggagtcggccat

SEQ ID NO: 396356 - DNA, 140 bp, Artificial Sequence
  Synthetic
atggccgactcccaagtacgtgtgcaaccgaaccagggcccgccaggagggcgtgcgctggaaagcaagaacacatcggtctcattctccccccagttaaacgtggggtggcccttcttaggagacccagcatggcgtat

SEQ ID NO: 396357 - DNA, 140 bp, Artificial Sequence
  Synthetic
  misc_feature (31)..(31): n is a, c, g, or t
atacgccatgctgggtctccttcgcaaacanccggaagcgacctttgagaggtgcggctctgggccctggctcaccccacgatgcttggtggactacccatatcggctatggcattaccccgtacttgggagtcggccat

SEQ ID NO: 396358 - DNA, 140 bp, Artificial Sequence
  Synthetic
  misc_feature (110)..(110): n is a, c, g, or t
atggccgactcccaagtacggggtaatgccatagccgatatgggtagtccaccaagcatcgtggggtgagccagggcccagagccgcacctctcaaaggtcgcttccggntgtttgcgaaggagacccagcatggcgtat

SEQ ID NO: 396359 - DNA, 140 bp, Artificial Sequence
  Synthetic
  misc_feature (77)..(77): n is a, c, g, or t
aggccctggctgctgatatgctcaccccacgatgcttggtggactacccatatcggctatggcattacccttgcacngtgaattacaccatacacaaggtgaggatgttcgtggccggtggaccttttgggacagcggtg

SEQ ID NO: 396360 - DNA, 140 bp, Artificial Sequence
  Synthetic
  misc_feature (64)..(64): n is a, c, g, or t
caccgctgtcccaaaaggtccaccggccacgaacatcctcaccttgtgtatggtgtaattcacngtgcaagggtaatgccatagccgatatgggtagtccaccaagcatcgtggggtgagcatatcagcagccagggcct

SEQ ID NO: 396361 - DNA, 140 bp, Artificial Sequence
  Synthetic
  misc_feature (21)..(21): n is a, c, g, or t
atacgccatgctgggtctccnacccaattagctatcctcccatgcacatttaccaacatgcctgcattgtcaaccggcctgatccacctacaccagaacattgtggacgtgcaatacctccgtacttgggagtcggccat

SEQ ID NO: 396362 - DNA, 140 bp, Artificial Sequence
  Synthetic
  misc_feature (120)..(120): n is a, c, g, or t
atggccgactcccaagtacggaggtattgcacgtccacaatgttctggtgtaggtggatcaggccggttgacaatgcaggcatgttggtaaatgtgcatgggaggatagctaattgggtnggagacccagcatggcgtat

SEQ ID NO: 396363 - DNA, 140 bp, Artificial Sequence
  Synthetic
  misc_feature (37)..(37): n is a, c, g, or t
atacgccatgctgggtctccggctgatgttcttggtnggccaggcggaggctgctctggagaacttggtcgtcctcaacgcggcctctgcagctagctgccagggcatactttgggggttcgtacttgggagtcggccat

SEQ ID NO: 396364 - DNA, 140 bp, Artificial Sequence
  Synthetic
  misc_feature (104)..(104): n is a, c, g, or t
atggccgactcccaagtacgaacccccaaagtatgccctggcagctagctgcagaggccgcgttgaggacgaccaagttctccagagcagcctccgcctggccnaccaagaacatcagccggagacccagcatggcgtat

SEQ ID NO: 396365 - DNA, 140 bp, Artificial Sequence
  Synthetic
aggccctggctgctgatatgcaacgcagcttcgacgtcacatcgatctgcttgtcgggagcgccaccctctgctcggccctctatgtgggggacttgtgcgggtctgtctttcttgtcgggaccttttgggacagcggtg

SEQ ID NO: 396366 - DNA, 140 bp, Artificial Sequence
  Synthetic
caccgctgtcccaaaaggtcccgacaagaaagacagacccgcacaagtcccccacatagagggccgagcagagggtggcgctcccgacaagcagatcgatgtgacgtcgaagctgcgttgcatatcagcagccagggcct

SEQ ID NO: 396367 - DNA, 140 bp, Artificial Sequence
  Synthetic
atacgccatgctgggtctcctttcttagctctgggtctcattaccatcttcaccctcaccccggcctacaagtaccttcttgtaaacgcgctttggtggaatcaatacttcatcgcacgccgtacttgggagtcggccat

SEQ ID NO: 396368 - DNA, 140 bp, Artificial Sequence
  Synthetic
atggccgactcccaagtacggcgtgcgatgaagtattgattccaccaaagcgcgtttacaagaaggtacttgtaggccggggtgagggtgaagatggtaatgagacccagagctaagaaaggagacccagcatggcgtat

SEQ ID NO: 396369 - DNA, 140 bp, Artificial Sequence
  Synthetic
atacgccatgctgggtctccgcggaggcctcactccacgagtgggcatcgccccttcgggtcaggggtggccgtgatgcggtcatcctgctcacctgcttgttacatcctcaactcgggtcgtacttgggagtcggccat

SEQ ID NO: 396370 - DNA, 140 bp, Artificial Sequence
  Synthetic
atggccgactcccaagtacgacccgagttgaggatgtaacaagcaggtgagcaggatgaccgcatcacggccacccctgacccgaaggggcgatgcccactcgtggagtgaggcctccgcggagacccagcatggcgtat

SEQ ID NO: 396371 - DNA, 140 bp, Artificial Sequence
  Synthetic
aggccctggctgctgatatgcgggcgccaagcaggatatccagctgatcaacaccaacggcagttggcacatcaatcgcacggccttgaactgtaatgcgagcctcgacactggctgggtgaccttttgggacagcggtg

SEQ ID NO: 396372 - DNA, 140 bp, Artificial Sequence
  Synthetic
caccgctgtcccaaaaggtcacccagccagtgtcgaggctcgcattacagttcaaggccgtgcgattgatgtgccaactgccgttggtgttgatcagctggatatcctgcttggcgcccgcatatcagcagccagggcct

SEQ ID NO: 396373 - DNA, 140 bp, Artificial Sequence
  Synthetic
  misc_feature (27)..(27): n is a, c, g, or t
atacgccatgctgggtctccgcgggcntgcatgttcttccgtggcgtagtttgcggcaagtatgcccaggctatattgctgcggcttggggcgtggactggtacatacatctatgaccaccgtacttgggagtcggccat

SEQ ID NO: 396374 - DNA, 140 bp, Artificial Sequence
  Synthetic
  misc_feature (114)..(114): n is a, c, g, or t
atggccgactcccaagtacggtggtcatagatgtatgtaccagtccacgccccaagccgcagcaatatagcctgggcatacttgccgcaaactacgccacggaagaacatgcangcccgcggagacccagcatggcgtat

SEQ ID NO: 396375 - DNA, 140 bp, Artificial Sequence
  Synthetic
aggccctggctgctgatatgttaccccccaaagccttgtggtatcgtgccagcacagaacgtatgtggcccggtgtattgcttcactcccagccccgtggtggtgggaacgaccgacaaggaccttttgggacagcggtg

SEQ ID NO: 396376 - DNA, 140 bp, Artificial Sequence
  Synthetic
caccgctgtcccaaaaggtccttgtcggtcgttcccaccaccacggggctgggagtgaagcaatacaccgggccacatacgttctgtgctggcacgataccacaaggctttggggggtaacatatcagcagccagggcct

SEQ ID NO: 396377 - DNA, 140 bp, Artificial Sequence
  Synthetic
atacgccatgctgggtctccaacgtggtggaaggtgagattcaggtcgtatctacggccactcaatctttccttgccactgccgttaacggcgttctgtggacagtctatcatggggccgcgtacttgggagtcggccat

SEQ ID NO: 396378 - DNA, 140 bp, Artificial Sequence
  Synthetic
atggccgactcccaagtacgcggccccatgatagactgtccacagaacgccgttaacggcagtggcaaggaaagattgagtggccgtagatacgacctgaatctcaccttccaccacgttggagacccagcatggcgtat

SEQ ID NO: 396379 - DNA, 140 bp, Artificial Sequence
  Synthetic
aggccctggctgctgatatgggaggggtgggcaacaacaccttgcactgccccactgactgcttccgcaagcatccggaagccacatactctcggtgtggctccggtccctggatcacgcgaccttttgggacagcggtg

SEQ ID NO: 396380 - DNA, 140 bp, Artificial Sequence
  Synthetic
caccgctgtcccaaaaggtcgcgtgatccagggaccggagccacaccgagagtatgtggcttccggatgcttgcggaagcagtcagtggggcagtgcaaggtgttgttgcccacccctcccatatcagcagccagggcct

SEQ ID NO: 396381 - DNA, 140 bp, Artificial Sequence
  Synthetic
atacgccatgctgggtctccgctcgaagaccctcgccggcccaaaaggtcctgtttgccagatgtacaccaatgtcgaccaggaccttgtaggctggcccgcaccccccgggtcgcgctccgtacttgggagtcggccat

SEQ ID NO: 396382 - DNA, 140 bp, Artificial Sequence
  Synthetic
atggccgactcccaagtacggagcgcgacccggggggtgcgggccagcctacaaggtcctggtcgacattggtgtacatctggcaaacaggaccttttgggccggcgagggtcttcgagcggagacccagcatggcgtat

SEQ ID NO: 396383 - DNA, 140 bp, Artificial Sequence
  Synthetic
atacgccatgctgggtctccctcagcccacggcccataagcactctgaaaggatcttcgggaggtcccgtgctatgcccctctggccacgtcgcggggatcttccgcgcggcggtgtgcacgtacttgggagtcggccat

SEQ ID NO: 396384 - DNA, 140 bp, Artificial Sequence
  Synthetic
atggccgactcccaagtacgtgcacaccgccgcgcggaagatccccgcgacgtggccagaggggcatagcacgggacctcccgaagatcctttcagagtgcttatgggccgtgggctgagggagacccagcatggcgtat

SEQ ID NO: 396385 - DNA, 140 bp, Artificial Sequence
  Synthetic
atacgccatgctgggtctccaccacaaacctaccaggtgggatatcttcacgcacccacagggagcgggaagagcactaaagtcccggcggcttacgcagctcaagggtacaatgtcttacgtacttgggagtcggccat

SEQ ID NO: 396386 - DNA, 140 bp, Artificial Sequence
  Synthetic
atggccgactcccaagtacgtaagacattgtacccttgagctgcgtaagccgccgggactttagtgctcttcccgctccctgtgggtgcgtgaagatatcccacctggtaggtttgtggtggagacccagcatggcgtat

SEQ ID NO: 396387 - DNA, 140 bp, Artificial Sequence
  Synthetic
atacgccatgctgggtctccctaccggcggaaaaatcacctactccacttatggcaagtttctcgctgatggcgggtgctcaggcggggcttatgatgtcatcatctgtgatgagtgtcacgtacttgggagtcggccat

SEQ ID NO: 396388 - DNA, 140 bp, Artificial Sequence
  Synthetic
atggccgactcccaagtacgtgacactcatcacagatgatgacatcataagccccgcctgagcacccgccatcagcgagaaacttgccataagtggagtaggtgatttttccgccggtagggagacccagcatggcgtat

SEQ ID NO: 396389 - DNA, 140 bp, Artificial Sequence
  Synthetic
aggccctggctgctgatatgagcacctgggtgctggtaggcggagtccttgcagctttggccgcatattgcttgacaacaggcagtgtggtcattgtgggtaggatcatcttgtccgggagaccttttgggacagcggtg

SEQ ID NO: 396390 - DNA, 140 bp, Artificial Sequence
  Synthetic
caccgctgtcccaaaaggtctcccggacaagatgatcctacccacaatgaccacactgcctgttgtcaagcaatatgcggccaaagctgcaaggactccgcctaccagcacccaggtgctcatatcagcagccagggcct

SEQ ID NO: 396391 - DNA, 140 bp, Artificial Sequence
  Synthetic
atacgccatgctgggtctccggttcggtcacggtccctcaccccaacataacagaagaagccctaccttccaccggtgagatccccttttatgggagggcaatccccctcgattccatcacgtacttgggagtcggccat

SEQ ID NO: 396392 - DNA, 140 bp, Artificial Sequence
  Synthetic
atggccgactcccaagtacgtgatggaatcgagggggattgccctcccataaaaggggatctcaccggtggaaggtagggcttcttctgttatgttggggtgagggaccgtgaccgaaccggagacccagcatggcgtat

SEQ ID NO: 396393 - DNA, 140 bp, Artificial Sequence
  Synthetic
atacgccatgctgggtctccaaggggggaggcacctaattttttgccactctaaaaagaagtgcgacgagcttgccaagcaactcacgatgcaaggcatcaatgccgtcgcattctatagcgtacttgggagtcggccat

SEQ ID NO: 396394 - DNA, 140 bp, Artificial Sequence
  Synthetic
atggccgactcccaagtacgctatagaatgcgacggcattgatgccttgcatcgtgagttgcttggcaagctcgtcgcacttctttttagagtggcaaaaaattaggtgcctccccccttggagacccagcatggcgtat

SEQ ID NO: 396395 - DNA, 140 bp, Artificial Sequence
  Synthetic
aggccctggctgctgatatgcttgccaagcaactcacgatgcaaggcatcaatgccgtcgcattctatagaggtgtggatgtcgctgtcataccaactgacggcgacgtggtcgtctgtggaccttttgggacagcggtg

SEQ ID NO: 396396 - DNA, 140 bp, Artificial Sequence
  Synthetic
caccgctgtcccaaaaggtccacagacgaccacgtcgccgtcagttggtatgacagcgacatccacacctctatagaatgcgacggcattgatgccttgcatcgtgagttgcttggcaagcatatcagcagccagggcct

SEQ ID NO: 396397 - DNA, 140 bp, Artificial Sequence
  Synthetic
aggccctggctgctgatatgcccttcgggactgggcgcacaacggcctacgagatctggccgtggctgtagagccagtcgtcttttcccagatggagaccaagctcatcacgtggggggcgaccttttgggacagcggtg

SEQ ID NO: 396398 - DNA, 140 bp, Artificial Sequence
  Synthetic
caccgctgtcccaaaaggtcgccccccacgtgatgagcttggtctccatctgggaaaagacgactggctctacagccacggccagatctcgtaggccgttgtgcgcccagtcccgaagggcatatcagcagccagggcct

SEQ ID NO: 396399 - DNA, 140 bp, Artificial Sequence
  Synthetic
  misc_feature (27)..(27): n is a, c, g, or t
atacgccatgctgggtctccttttacnatagaaaccaccactatgccccaggatgctgtctcccgcagtcagaggagaggtagaacaggaagggggaaacatggggtatacaggtacgtccgtacttgggagtcggccat

SEQ ID NO: 396400 - DNA, 140 bp, Artificial Sequence
  Synthetic
  misc_feature (114)..(114): n is a, c, g, or t
atggccgactcccaagtacggacgtacctgtataccccatgtttcccccttcctgttctacctctcctctgactgcgggagacagcatcctggggcatagtggtggtttctatngtaaaaggagacccagcatggcgtat

SEQ ID NO: 396401 - DNA, 140 bp, Artificial Sequence
  Synthetic
  misc_feature (29)..(29): n is a, c, g, or t
atacgccatgctgggtctcccggttcgcntgcgcgcctacctaaacaccccaggacttcctgtgtgccaggaccaccttgagttctgggagggagtattcactggactgacccacattgacgtacttgggagtcggccat

SEQ ID NO: 396402 - DNA, 140 bp, Artificial Sequence
  Synthetic
  misc_feature (112)..(112): n is a, c, g, or t
atggccgactcccaagtacgtcaatgtgggtcagtccagtgaatactccctcccagaactcaaggtggtcctggcacacaggaagtcctggggtgtttaggtaggcgcgcangcgaaccgggagacccagcatggcgtat

SEQ ID NO: 396403 - DNA, 140 bp, Artificial Sequence
  Synthetic
atacgccatgctgggtctcctgcccattttctctcacagacgaaacaatcaggagagaattttgcgtaccttgttgcctatcaggccacagtatgcgccagggcgaaagcccccccaccccgtacttgggagtcggccat

SEQ ID NO: 396404 - DNA, 140 bp, Artificial Sequence
  Synthetic
atggccgactcccaagtacggggtgggggggctttcgccctggcgcatactgtggcctgataggcaacaaggtacgcaaaattctctcctgattgtttcgtctgtgagagaaaatgggcaggagacccagcatggcgtat

SEQ ID NO: 396405 - DNA, 140 bp, Artificial Sequence
  Synthetic
atacgccatgctgggtctccttaccacccatccaattaccaaatatattatgacctgcatgtctgcagacctagaggtggttactagcacgtgggtactagtggggggagtccttgctgccgtacttgggagtcggccat

SEQ ID NO: 396406 - DNA, 140 bp, Artificial Sequence
  Synthetic
atggccgactcccaagtacggcagcaaggactccccccactagtacccacgtgctagtaaccacctctaggtctgcagacatgcaggtcataatatatttggtaattggatgggtggtaaggagacccagcatggcgtat

SEQ ID NO: 396407 - DNA, 140 bp, Artificial Sequence
  Synthetic
aggccctggctgctgatatgctagaggtggttactagcacgtgggtactagtggggggagtccttgctgccctggcagcctactgtctgtcagtgggctgtgtggtcatctgcggcagaagaccttttgggacagcggtg

SEQ ID NO: 396408 - DNA, 140 bp, Artificial Sequence
  Synthetic
caccgctgtcccaaaaggtcttctgccgcagatgaccacacagcccactgacagacagtaggctgccagggcagcaaggactccccccactagtacccacgtgctagtaaccacctctagcatatcagcagccagggcct

SEQ ID NO: 396409 - DNA, 140 bp, Artificial Sequence
  Synthetic
atacgccatgctgggtctcctgaggcccaagccatagctgagcagttcaaacagaaagtcctcggtcttattcagtcctccgccaagcaggcggaggaactaaaaccagcagtcaatgcacgtacttgggagtcggccat

SEQ ID NO: 396410 - DNA, 140 bp, Artificial Sequence
  Synthetic
atggccgactcccaagtacgtgcattgactgctggttttagttcctccgcctgcttggcggaggactgaataagaccgaggactttctgtttgaactgctcagctatggcttgggcctcaggagacccagcatggcgtat

SEQ ID NO: 396411 - DNA, 140 bp, Artificial Sequence
  Synthetic
atacgccatgctgggtctcccaatagcttccctcatggccttctcggcctcgcttacaagcccactctctacttctgcaactttgttgcttaacatcttaggtgggtgggtagcatctcacgtacttgggagtcggccat

SEQ ID NO: 396412 - DNA, 140 bp, Artificial Sequence
  Synthetic
atggccgactcccaagtacgtgagatgctacccacccacctaagatgttaagcaacaaagttgcagaagtagagagtgggcttgtaagcgaggccgagaaggccatgagggaagctattgggagacccagcatggcgtat

SEQ ID NO: 396413 - DNA, 140 bp, Artificial Sequence
  Synthetic
atacgccatgctgggtctccgcgggatacggtgcaggcatatctggggcacttgtcgggtttaagatcatgagcggcgagaccccttctgccgaggacctagttaacctgctccctgctccgtacttgggagtcggccat

SEQ ID NO: 396414 - DNA, 140 bp, Artificial Sequence
  Synthetic
atggccgactcccaagtacggagcagggagcaggttaactaggtcctcggcagaaggggtctcgccgctcatgatcttaaacccgacaagtgccccagatatgcctgcaccgtatcccgcggagacccagcatggcgtat

SEQ ID NO: 396415 - DNA, 140 bp, Artificial Sequence
  Synthetic
aggccctggctgctgatatggagcggcgagaccccttctgccgaggacctagttaacctgctccctgctctcctgtcacctggagccctcgtagtcggagtggtttgcgccgcaatattggaccttttgggacagcggtg

SEQ ID NO: 396416 - DNA, 140 bp, Artificial Sequence
  Synthetic
caccgctgtcccaaaaggtccaatattgcggcgcaaaccactccgactacgagggctccaggtgacaggagagcagggagcaggttaactaggtcctcggcagaaggggtctcgccgctccatatcagcagccagggcct

SEQ ID NO: 396417 - DNA, 140 bp, Artificial Sequence
  Synthetic
atacgccatgctgggtctccccgaaacggacacctctcagaaaattaccaacatactcagttccctaaccgtgaccagtcttctgcggaagctgcacgcatggatcaacggcgattggtccgtacttgggagtcggccat

SEQ ID NO: 396418 - DNA, 140 bp, Artificial Sequence
  Synthetic
atggccgactcccaagtacggaccaatcgccgttgatccatgcgtgcagcttccgcagaagactggtcacggttagggaactgagtatgttggtaattttctgagaggtgtccgtttcggggagacccagcatggcgtat

SEQ ID NO: 396419 - DNA, 140 bp, Artificial Sequence
  Synthetic
aggccctggctgctgatatggagtgggtagtactcctgttcctgctcctagcggacgccagggtctgcgcctgcctgtggatgctcatcttgttgggacaggccgaggcagcattagagagaccttttgggacagcggtg

SEQ ID NO: 396420 - DNA, 140 bp, Artificial Sequence
  Synthetic
caccgctgtcccaaaaggtctctctaatgctgcctcggcctgtcccaacaagatgagcatccacaggcaggcgcagaccctggcgtccgctaggagcaggaacaggagtactacccactccatatcagcagccagggcct

SEQ ID NO: 396421 - DNA, 140 bp, Artificial Sequence
  Synthetic
  misc_feature (91)..(91): n is a, c, g, or t
  misc_feature (104)..(104): n is a, c, g, or t
atacgccatgctgggtctccctgccaggagtccctttcttctcgtgtcagcgaggatttagggggctctggcgaggtgacggaatctgccncaccacatgcccntgcggggcggacatcacgtacttgggagtcggccat

SEQ ID NO: 396422 - DNA, 140 bp, Artificial Sequence
  Synthetic
  misc_feature (37)..(37): n is a, c, g, or t
  misc_feature (50)..(50): n is a, c, g, or t
atggccgactcccaagtacgtgatgtccgccccgcangggcatgtggtgnggcagattccgtcacctcgccagagccccctaaatcctcgctgacacgagaagaaagggactcctggcagggagacccagcatggcgtat

SEQ ID NO: 396423 - DNA, 140 bp, Artificial Sequence
  Synthetic
atacgccatgctgggtctcctagcgttcccatccctgagcccaattacaccagggccctctggagggtatccgctgaggagtacgtcgaagtcaaaagggtgggggatagccactttgtgcgtacttgggagtcggccat

SEQ ID NO: 396424 - DNA, 140 bp, Artificial Sequence
  Synthetic
atggccgactcccaagtacgcacaaagtggctatcccccacccttttgacttcgacgtactcctcagcggataccctccagagggccctggtgtaattgggctcagggatgggaacgctaggagacccagcatggcgtat

SEQ ID NO: 396425 - DNA, 140 bp, Artificial Sequence
  Synthetic
atacgccatgctgggtctccagtgcaggccactcttgagggacgagatcacattttctgtgggcatgtccacctacgtgctggggtcccaactcccatgcgaacctgaaccagacgtcatcgtacttgggagtcggccat

SEQ ID NO: 396426 - DNA, 140 bp, Artificial Sequence
  Synthetic
atggccgactcccaagtacgatgacgtctggttcaggttcgcatgggagttgggaccccagcacgtaggtggacatgcccacagaaaatgtgatctcgtccctcaagagtggcctgcactggagacccagcatggcgtat

SEQ ID NO: 396427 - DNA, 140 bp, Artificial Sequence
  Synthetic
atacgccatgctgggtctccgcgagtcagctctcggcgccgtcgctaaaggctacgtgtacaacgcatggccctcacgtcgacgctgagctgatcgatgcgaatttgctgtggaggcaggcgtacttgggagtcggccat

SEQ ID NO: 396428 - DNA, 140 bp, Artificial Sequence
  Synthetic
atggccgactcccaagtacgcctgcctccacagcaaattcgcatcgatcagctcagcgtcgacgtgagggccatgcgttgtacacgtagcctttagcgacggcgccgagagctgactcgcggagacccagcatggcgtat

SEQ ID NO: 396429 - DNA, 140 bp, Artificial Sequence
  Synthetic
aggccctggctgctgatatgatgatgctcgccgagcagttcaagcagaaggcccttggcctcctgcagaccgcgtcccgccaggcagaggtcatcacccctgctgtccagaccaactggcgaccttttgggacagcggtg

SEQ ID NO: 396430 - DNA, 140 bp, Artificial Sequence
  Synthetic
caccgctgtcccaaaaggtcgccagttggtctggacagcaggggtgatgacctctgcctggcgggacgcggtctgcaggaggccaagggccttctgcttgaactgctcggcgagcatcatcatatcagcagccagggcct

SEQ ID NO: 396431 - DNA, 140 bp, Artificial Sequence
  Synthetic
atacgccatgctgggtctccagtgccagccgagtgccatcggccgaataggccgaaatatccaccggcactacccatctgggctaggcctgactacaacccgcctcttgtggagccgtggcgtacttgggagtcggccat

SEQ ID NO: 396432 - DNA, 140 bp, Artificial Sequence
  Synthetic
atggccgactcccaagtacgccacggctccacaagaggcgggttgtagtcaggcctagcccagatgggtagtgccggtggatatttcggcctattcggccgatggcactcggctggcactggagacccagcatggcgtat

SEQ ID NO: 396433 - DNA, 140 bp, Artificial Sequence
  Synthetic
  misc_feature (76)..(76): n is a, c, g, or t
aggccctggctgctgatatgtacccatctgggctaggcctgactacaacccgcctcttgtggagccgtggaagtcnccggactacgatcctcctgtggtccatggttgcgccttacccccgaccttttgggacagcggtg

SEQ ID NO: 396434 - DNA, 140 bp, Artificial Sequence
  Synthetic
  misc_feature (65)..(65): n is a, c, g, or t
caccgctgtcccaaaaggtcgggggtaaggcgcaaccatggaccacaggaggatcgtagtccggngacttccacggctccacaagaggcgggttgtagtcaggcctagcccagatgggtacatatcagcagccagggcct

SEQ ID NO: 396435 - DNA, 140 bp, Artificial Sequence
  Synthetic
  misc_feature (23)..(23): n is a, c, g, or t
  misc_feature (59)..(59): n is a, c, g, or t
  misc_feature (62)..(62): n is a, c, g, or t
  misc_feature (71)..(71): n is a, c, g, or t
atacgccatgctgggtctccttnccgcagcccgtgtcttcgacaacgggatacggatcngancaggccacncgcagcacgggttcaggggagcggtccgaggacgacggcgccgcatctgcgtacttgggagtcggccat

SEQ ID NO: 396436 - DNA, 140 bp, Artificial Sequence
  Synthetic
  misc_feature (70)..(70): n is a, c, g, or t
  misc_feature (79)..(79): n is a, c, g, or t
  misc_feature (82)..(82): n is a, c, g, or t
  misc_feature (118)..(118): n is a, c, g, or t
atggccgactcccaagtacgcagatgcggcgccgtcgtcctcggaccgctcccctgaacccgtgctgcgngtggcctgntcngatccgtatcccgttgtcgaagacacgggctgcggnaaggagacccagcatggcgtat

SEQ ID NO: 396437 - DNA, 140 bp, Artificial Sequence
  Synthetic
atacgccatgctgggtctcccatgatatgctgttcgtactcttacagctggacaggggcacctattacaccttgtgctgccgaagaagagaagttacctataaaccctctgagtaactctcgtacttgggagtcggccat

SEQ ID NO: 396438 - DNA, 140 bp, Artificial Sequence
  Synthetic
atggccgactcccaagtacgagagttactcagagggtttataggtaacttctcttcttcggcagcacaaggtgtaataggtgcccctgtccagctgtaagagtacgaacagcatatcatgggagacccagcatggcgtat

SEQ ID NO: 396439 - DNA, 140 bp, Artificial Sequence
  Synthetic
  misc_feature (22)..(22): n is a, c, g, or t
atacgccatgctgggtctccantactatgacactttacaggagattaagctccgggcctcacaggttcaggctaggctcctcactactgaggaagcttgcgacctgacccctccgcattccgtacttgggagtcggccat

SEQ ID NO: 396440 - DNA, 140 bp, Artificial Sequence
  Synthetic
  misc_feature (119)..(119): n is a, c, g, or t
atggccgactcccaagtacggaatgcggaggggtcaggtcgcaagcttcctcagtagtgaggagcctagcctgaacctgtgaggcccggagcttaatctcctgtaaagtgtcatagtantggagacccagcatggcgtat

SEQ ID NO: 396441 - DNA, 140 bp, Artificial Sequence
  Synthetic
atacgccatgctgggtctccaatgacacaccaatacctacaaccatcatggcaaaaaatgaggtcttctgcgtggacacgtcgaaggggggccgcaaaccagcgcggttgatcgtatacccgtacttgggagtcggccat

SEQ ID NO: 396442 - DNA, 140 bp, Artificial Sequence
  Synthetic
atggccgactcccaagtacgggtatacgatcaaccgcgctggtttgcggccccccttcgacgtgtccacgcagaagacctcattttttgccatgatggttgtaggtattggtgtgtcattggagacccagcatggcgtat

SEQ ID NO: 396443 - DNA, 140 bp, Artificial Sequence
  Synthetic
aggccctggctgctgatatgacaccaacggcagttggcacatcaatcgcacggccttgacctgcaatgcgagcctcgagactggctggttagcggggctcttctattacaacaaaatcaagaccttttgggacagcggtg

SEQ ID NO: 396444 - DNA, 140 bp, Artificial Sequence
  Synthetic
caccgctgtcccaaaaggtcttgattttgttgtaatagaagagccccgctaaccagccagtctcgaggctcgcattgcaggtcaaggccgtgcgattgatgtgccaactgccgttggtgtcatatcagcagccagggcct

SEQ ID NO: 396445 - DNA, 140 bp, Artificial Sequence
  Synthetic
atacgccatgctgggtctccctttacaggctgctccgagcggatggccagctgtagaccccttgcctatttcgaccagggctggggccctatcagctacgccaacgtaaccgacactgaacgtacttgggagtcggccat

SEQ ID NO: 396446 - DNA, 140 bp, Artificial Sequence
  Synthetic
atggccgactcccaagtacgttcagtgtcggttacgttggcgtagctgatagggccccagccctggtcgaaataggcaaggggtctacagctggccatccgctcggagcagcctgtaaagggagacccagcatggcgtat

SEQ ID NO: 396447 - DNA, 140 bp, Artificial Sequence
  Synthetic
  misc_feature (33)..(33): n is a, c, g, or t
atacgccatgctgggtctccacctaagcagcgngtggagcgcttgctaaaaatgtggaaatctaagaagaccccaatggggttctcctatgacaccagatgctttgactccacggtcacgcgtacttgggagtcggccat

SEQ ID NO: 396448 - DNA, 140 bp, Artificial Sequence
  Synthetic
  misc_feature (108)..(108): n is a, c, g, or t
atggccgactcccaagtacgcgtgaccgtggagtcaaagcatctggtgtcataggagaaccccattggggtcttcttagatttccacatttttagcaagcgctccacncgctgcttaggtggagacccagcatggcgtat

SEQ ID NO: 396449 - DNA, 140 bp, Artificial Sequence
  Synthetic
aggccctggctgctgatatgtggtgggaacgaccgacagggcgggcgcgcctacctacaactggggtagcaatgacacggacgttcttattcttaataacaccaggccaccgctgggcaagaccttttgggacagcggtg

SEQ ID NO: 396450 - DNA, 140 bp, Artificial Sequence
  Synthetic
caccgctgtcccaaaaggtcttgcccagcggtggcctggtgttattaagaataagaacgtccgtgtcattgctaccccagttgtaggtaggcgcgcccgccctgtcggtcgttcccaccacatatcagcagccagggcct

SEQ ID NO: 396451 - DNA, 140 bp, Artificial Sequence
  Synthetic
atacgccatgctgggtctccgggggcccatgtataactctaagggccagcactgtggtcagcgcaggtgccgagctagcggagtactcccgactagcatgggcaacacccttacctgcttcgtacttgggagtcggccat

SEQ ID NO: 396452 - DNA, 140 bp, Artificial Sequence
  Synthetic
atggccgactcccaagtacgaagcaggtaagggtgttgcccatgctagtcgggagtactccgctagctcggcacctgcgctgaccacagtgctggcccttagagttatacatgggcccccggagacccagcatggcgtat

SEQ ID NO: 396453 - DNA, 140 bp, Artificial Sequence
  Synthetic
  misc_feature (53)..(53): n is a, c, g, or t
atacgccatgctgggtctccaacgaggacgtcgccaacctgcgagccttcacngaggctatgaccaggtattcggcaactcccggtgatatacccagcccaacatacgacttggagctaacgtacttgggagtcggccat

SEQ ID NO: 396454 - DNA, 140 bp, Artificial Sequence
  Synthetic
  misc_feature (88)..(88): n is a, c, g, or t
atggccgactcccaagtacgttagctccaagtcgtatgttgggctgggtatatcaccgggagttgccgaatacctggtcatagcctcngtgaaggctcgcaggttggcgacgtcctcgttggagacccagcatggcgtat

SEQ ID NO: 396455 - DNA, 140 bp, Artificial Sequence
  Synthetic
aggccctggctgctgatatgcacactcgctgccactgtggagctgagatcactggacatgtcaaaaacgggacgatgaggatcgtcggtcctaagacctgcaggaacatgtggagtgggagaccttttgggacagcggtg

SEQ ID NO: 396456 - DNA, 140 bp, Artificial Sequence
  Synthetic
caccgctgtcccaaaaggtctcccactccacatgttcctgcaggtcttaggaccgacgatcctcatcgtcccgtttttgacatgtccagtgatctcagctccacagtggcagcgagtgtgcatatcagcagccagggcct

SEQ ID NO: 396457 - DNA, 140 bp, Artificial Sequence
  Synthetic
  misc_feature (63)..(63): n is a, c, g, or t
atacgccatgctgggtctccttgggagactgctcggcacactccagtaaactcgtggctgggnaacatcatcatgtacgctccagcgatatgggtccgcatgatacttatgacccatttccgtacttgggagtcggccat

SEQ ID NO: 396458 - DNA, 140 bp, Artificial Sequence
  Synthetic
  misc_feature (78)..(78): n is a, c, g, or t
atggccgactcccaagtacggaaatgggtcataagtatcatgcggacccatatcgctggagcgtacatgatgatgttncccagccacgagtttactggagtgtgccgagcagtctcccaaggagacccagcatggcgtat

SEQ ID NO: 396459 - DNA, 140 bp, Artificial Sequence
  Synthetic
  misc_feature (71)..(71): n is a, c, g, or t
  misc_feature (111)..(111): n is a, c, g, or t
  misc_feature (115)..(115): n is a, c, g, or t
atacgccatgctgggtctccgtaaaaaccaaactcaaactcactccattgcgtggcgcgtccgacctaganttatcaggatggttcgcggcaggcttcagcgggggggacntttntcacacgtacttgggagtcggccat

SEQ ID NO: 396460 - DNA, 140 bp, Artificial Sequence
  Synthetic
  misc_feature (26)..(26): n is a, c, g, or t
  misc_feature (30)..(30): n is a, c, g, or t
  misc_feature (70)..(70): n is a, c, g, or t
atggccgactcccaagtacgtgtganaaangtcccccccgctgaagcctgccgcgaaccatcctgataantctaggtcggacgcgccacgcaatggagtgagtttgagtttggtttttacggagacccagcatggcgtat

SEQ ID NO: 396461 - DNA, 140 bp, Artificial Sequence
  Synthetic
atacgccatgctgggtctccaacatccagcttgtaaaaacggaaggcaactggcacattaacaggactgccctgaactgcaatgactcccaccagactggattccttgccgcgctgttctcgtacttgggagtcggccat

SEQ ID NO: 396462 - DNA, 140 bp, Artificial Sequence
  Synthetic
atggccgactcccaagtacgagaacagcgcggcaaggaatccagtctggtgggagtcattgcagttcagggcagtcctgttaatgtgccagttgccttccgtttttacaagctggatgttggagacccagcatggcgtat

SEQ ID NO: 396463 - DNA, 140 bp, Artificial Sequence
  Synthetic
aggccctggctgctgatatgcctgaactgcaatgactcccaccagactggattccttgccgcgctgttctacgcacataagatcaacacgtccggatgcctagagcgcttgaccagctgcgaccttttgggacagcggtg

SEQ ID NO: 396464 - DNA, 140 bp, Artificial Sequence
  Synthetic
caccgctgtcccaaaaggtcgcagctggtcaagcgctctaggcatccggacgtgttgatcttatgtgcgtagaacagcgcggcaaggaatccagtctggtgggagtcattgcagttcaggcatatcagcagccagggcct

SEQ ID NO: 396465 - DNA, 140 bp, Artificial Sequence
  Synthetic
aggccctggctgctgatatgcgacctgcatcaacggcgtgtgctggactgtttatcatggcgccggcccaaagaccctagccggcccaagaggcccaatcacccagatgtacaccaatgtgaccttttgggacagcggtg

SEQ ID NO: 396466 - DNA, 140 bp, Artificial Sequence
  Synthetic
caccgctgtcccaaaaggtcacattggtgtacatctgggtgattgggcctcttgggccggctagggtctttgggccggcgccatgataaacagtccagcacacgccgttgatgcaggtcgcatatcagcagccagggcct

SEQ ID NO: 396467 - DNA, 140 bp, Artificial Sequence
  Synthetic
aggccctggctgctgatatgctgttccttcaccaccctaccggctctgtccactggtttgatccatctccatcagaacattgtggacgtgcaatacctgtacggtgtagggtcagcggttgaccttttgggacagcggtg

SEQ ID NO: 396468 - DNA, 140 bp, Artificial Sequence
  Synthetic
caccgctgtcccaaaaggtcaaccgctgaccctacaccgtacaggtattgcacgtccacaatgttctgatggagatggatcaaaccagtggacagagccggtagggtggtgaaggaacagcatatcagcagccagggcct

SEQ ID NO: 396469 - DNA, 140 bp, Artificial Sequence
  Synthetic
aggccctggctgctgatatgtatggccgctgctcctgctcctgctggcgctaccgccacgagcgtacgccatggaccgggagatggctgcatcgtgcggaggcgcggtttttgtgggtctgaccttttgggacagcggtg

SEQ ID NO: 396470 - DNA, 140 bp, Artificial Sequence
  Synthetic
caccgctgtcccaaaaggtcagacccacaaaaaccgcgcctccgcacgatgcagccatctcccggtccatggcgtacgctcgtggcggtagcgccagcaggagcaggagcagcggccatacatatcagcagccagggcct

SEQ ID NO: 396471 - DNA, 140 bp, Artificial Sequence
  Synthetic
  misc_feature (31)..(31): n is a, c, g, or t
  misc_feature (39)..(39): n is a, c, g, or t
atacgccatgctgggtctcctcaggggccangcagaacntacaactcatcaacaccaacggcagctggcatatcaaccgcaccgcactgaattgcaatgattccctgcagacagggttcacgtacttgggagtcggccat

SEQ ID NO: 396472 - DNA, 140 bp, Artificial Sequence
  Synthetic
  misc_feature (102)..(102): n is a, c, g, or t
  misc_feature (110)..(110): n is a, c, g, or t
atggccgactcccaagtacgtgaaccctgtctgcagggaatcattgcaattcagtgcggtgcggttgatatgccagctgccgttggtgttgatgagttgtangttctgcntggcccctgaggagacccagcatggcgtat

SEQ ID NO: 396473 - DNA, 140 bp, Artificial Sequence
  Synthetic
atacgccatgctgggtctcccgcatgagcagctgtaggcccttagattcattcgaccagggttggggccctatttcatatgacaacatcactggcccatctgaggacaggccttattgctcgtacttgggagtcggccat

SEQ ID NO: 396474 - DNA, 140 bp, Artificial Sequence
  Synthetic
atggccgactcccaagtacgagcaataaggcctgtcctcagatgggccagtgatgttgtcatatgaaatagggccccaaccctggtcgaatgaatctaagggcctacagctgctcatgcgggagacccagcatggcgtat

SEQ ID NO: 396475 - DNA, 140 bp, Artificial Sequence
  Synthetic
aggccctggctgctgatatggggaggcatctaatcttctgccattccaagaaaaagtgtgacgagctcgctgccaaactgtcaggcctcggacttaatgctgtagcatattaccggggtcgaccttttgggacagcggtg

SEQ ID NO: 396476 - DNA, 140 bp, Artificial Sequence
  Synthetic
caccgctgtcccaaaaggtcgaccccggtaatatgctacagcattaagtccgaggcctgacagtttggcagcgagctcgtcacactttttcttggaatggcagaagattagatgcctccccatatcagcagccagggcct

SEQ ID NO: 396477 - DNA, 140 bp, Artificial Sequence
  Synthetic
atacgccatgctgggtctcctaagaggggacaccccacgtacaactggggggagaacgagaccgatgtgtttttgctctccagcgcacgccctcctggcgggccgtggttcgggtgcacgcgtacttgggagtcggccat

SEQ ID NO: 396478 - DNA, 140 bp, Artificial Sequence
  Synthetic
atggccgactcccaagtacgcgtgcacccgaaccacggcccgccaggagggcgtgcgctggagagcaaaaacacatcggtctcgttctccccccagttgtacgtggggtgtcccctcttaggagacccagcatggcgtat

SEQ ID NO: 396479 - DNA, 140 bp, Artificial Sequence
  Synthetic
aggccctggctgctgatatgcgctgactctgtcaccatattataagcgctatatcagctggtgcttatggtggcttcagtattttctgaccagagtagaagcgcaactacacgtgtgggtgaccttttgggacagcggtg

SEQ ID NO: 396480 - DNA, 140 bp, Artificial Sequence
  Synthetic
caccgctgtcccaaaaggtcacccacacgtgtagttgcgcttctactctggtcagaaaatactgaagccaccataagcaccagctgatatagcgcttataatatggtgacagagtcagcgcatatcagcagccagggcct

SEQ ID NO: 396481 - DNA, 140 bp, Artificial Sequence
  Synthetic
aggccctggctgctgatatgagctgatcaacaccaacggcagttggcacatcaatagcacggccttgaactgcaatgatagccttaacaccggctggttagcaggactcttctatcacaagaccttttgggacagcggtg

SEQ ID NO: 396482 - DNA, 140 bp, Artificial Sequence
  Synthetic
caccgctgtcccaaaaggtcttgtgatagaagagtcctgctaaccagccggtgttaaggctatcattgcagttcaaggccgtgctattgatgtgccaactgccgttggtgttgatcagctcatatcagcagccagggcct

SEQ ID NO: 396483 - DNA, 140 bp, Artificial Sequence
  Synthetic
aggccctggctgctgatatgcttgccaagcaactcacgatgcaaggcgttaacgccgtcgcattctatagaggtgtggatgttgccgtcataccaactgacggcgacgtggtcgtctgcggaccttttgggacagcggtg

SEQ ID NO: 396484 - DNA, 140 bp, Artificial Sequence
  Synthetic
caccgctgtcccaaaaggtccgcagacgaccacgtcgccgtcagttggtatgacggcaacatccacacctctatagaatgcgacggcgttaacgccttgcatcgtgagttgcttggcaagcatatcagcagccagggcct

SEQ ID NO: 396485 - DNA, 140 bp, Artificial Sequence
  Synthetic
aggccctggctgctgatatggccttgggaaggtgcttgtggacattctggcgggctatggggcaggggtggcgggcgcactcgtggcctttaaggtcatgagtggcgagatgccctccacgaccttttgggacagcggtg

SEQ ID NO: 396486 - DNA, 140 bp, Artificial Sequence
  Synthetic
caccgctgtcccaaaaggtcgtggagggcatctcgccactcatgaccttaaaggccacgagtgcgcccgccacccctgccccatagcccgccagaatgtccacaagcaccttcccaaggccatatcagcagccagggcct

SEQ ID NO: 396487 - DNA, 140 bp, Artificial Sequence
  Synthetic
aggccctggctgctgatatggcgtggagtcagagaataaggtagtaattctggactctttcgacccgctccgagcggaggaggatgagagggaggtgtccgttccggcggagatcctgcggaccttttgggacagcggtg

SEQ ID NO: 396488 - DNA, 140 bp, Artificial Sequence
  Synthetic
caccgctgtcccaaaaggtccgcaggatctccgccggaacggacacctccctctcatcctcctccgctcggagcgggtcgaaagagtccagaattactaccttattctctgactccacgccatatcagcagccagggcct

SEQ ID NO: 396489 - DNA, 140 bp, Artificial Sequence
  Synthetic
aggccctggctgctgatatgtttgaccagggctggggccctatcagctacgccaacggaagcggccccgaccaacgcccctattgctggcactaccccccaaaaccttgtggtattgtgcgaccttttgggacagcggtg

SEQ ID NO: 396490 - DNA, 140 bp, Artificial Sequence
  Synthetic
caccgctgtcccaaaaggtcgcacaataccacaaggttttggggggtagtgccagcaataggggcgttggtcggggccgcttccgttggcgtagctgatagggccccagccctggtcaaacatatcagcagccagggcct

SEQ ID NO: 396491 - DNA, 140 bp, Artificial Sequence
  Synthetic
aggccctggctgctgatatgacaaccctccactgctagagtcctggaaggacccggactacgtccctccggtggtacacgggtgcccattgccacctaccaaggcccctccaataccaccgaccttttgggacagcggtg

SEQ ID NO: 396492 - DNA, 140 bp, Artificial Sequence
  Synthetic
caccgctgtcccaaaaggtcggtggtattggaggggccttggtaggtggcaatgggcacccgtgtaccaccggagggacgtagtccgggtccttccaggactctagcagtggagggttgtcatatcagcagccagggcct

SEQ ID NO: 396493 - DNA, 140 bp, Artificial Sequence
  Synthetic
aggccctggctgctgatatgttgctcttccttctcctggcagacgcgcgcgtctgcgcttgcttgtggatgatgctgctggtagctcaggctgaggccgccttagagaacttagtggtccgaccttttgggacagcggtg

SEQ ID NO: 396494 - DNA, 140 bp, Artificial Sequence
  Synthetic
caccgctgtcccaaaaggtcggaccactaagttctctaaggcggcctcagcctgagctaccagcagcatcatccacaagcaagcgcagacgcgcgcgtctgccaggagaaggaagagcaacatatcagcagccagggcct

SEQ ID NO: 396495 - DNA, 140 bp, Artificial Sequence
  Synthetic
aggccctggctgctgatatgggcttcagtattttctgaccagagtagaagcgcaactgcacgtgtgggttccccccctcaacgtccgaggggggcgcgacgccgtcatcttactcatgtggaccttttgggacagcggtg

SEQ ID NO: 396496 - DNA, 140 bp, Artificial Sequence
  Synthetic
caccgctgtcccaaaaggtccacatgagtaagatgacggcgtcgcgcccccctcggacgttgagggggggaacccacacgtgcagttgcgcttctactctggtcagaaaatactgaagcccatatcagcagccagggcct

SEQ ID NO: 396497 - DNA, 140 bp, Artificial Sequence
  Synthetic
aggccctggctgctgatatgccccccctcaacgtccgaggggggcgcgacgccgtcatcttactcatgtgtgttgtacacccgactttggtatttgacatcaccaaactactgctggccggaccttttgggacagcggtg

SEQ ID NO: 396498 - DNA, 140 bp, Artificial Sequence
  Synthetic
caccgctgtcccaaaaggtccggccagcagtagtttggtgatgtcaaataccaaagtcgggtgtacaacacacatgagtaagatgacggcgtcgcgcccccctcggacgttgagggggggcatatcagcagccagggcct

SEQ ID NO: 396499 - DNA, 140 bp, Artificial Sequence
  Synthetic
atacgccatgctgggtctccagctgccgccccatcgacaagttcgctcagggatggggtcccatcacttatgctgagcctgacagcccggaccagaggccttattgctggcactacgcaccgtacttgggagtcggccat

SEQ ID NO: 396500 - DNA, 140 bp, Artificial Sequence
  Synthetic
atggccgactcccaagtacggtgcgtagtgccagcaataaggcctctggtccgggctgtcaggctcagcataagtgatgggaccccatccctgagcgaacttgtcgatggggcggcagctggagacccagcatggcgtat

SEQ ID NO: 396501 - DNA, 140 bp, Artificial Sequence
  Synthetic
atacgccatgctgggtctcccaaggcccacggtattgacccaaacatccgcaccggggtgaggactattaccactggtggagctagcacctattctacctatggcaaattcctcgcagaccgtacttgggagtcggccat

SEQ ID NO: 396502 - DNA, 140 bp, Artificial Sequence
  Synthetic
atggccgactcccaagtacggtctgcgaggaatttgccataggtagaataggtgctagctccaccagtggtaatagtcctcaccccggtgcggatgtttgggtcaataccgtgggccttgggagacccagcatggcgtat

SEQ ID NO: 396503 - DNA, 140 bp, Artificial Sequence
  Synthetic
aggccctggctgctgatatgtgcaaccggaaaccttcctggttgctccttttctatcttcctcttggcacttctctcgtgcctcaccacgcccgcctcggcagtccattataagaacagtgaccttttgggacagcggtg

SEQ ID NO: 396504 - DNA, 140 bp, Artificial Sequence
  Synthetic
caccgctgtcccaaaaggtcactgttcttataatggactgccgaggcgggcgtggtgaggcacgagagaagtgccaagaggaagatagaaaaggagcaaccaggaaggtttccggttgcacatatcagcagccagggcct

SEQ ID NO: 396505 - DNA, 140 bp, Artificial Sequence
  Synthetic
atacgccatgctgggtctccaaactgggaacctgtctcggtgttgggtgccagtgacccctacccttgctgtggcaaatgcttccgtatcaacgagaggtttccgcactcacgtggatctcgtacttgggagtcggccat

SEQ ID NO: 396506 - DNA, 140 bp, Artificial Sequence
  Synthetic
atggccgactcccaagtacgagatccacgtgagtgcggaaacctctcgttgatacggaagcatttgccacagcaagggtaggggtcactggcacccaacaccgagacaggttcccagtttggagacccagcatggcgtat

SEQ ID NO: 396507 - DNA, 140 bp, Artificial Sequence
  Synthetic
aggccctggctgctgatatggtggcaaatgcttccgtatcaacgagaggtttccgcactcacgtggatctcctcgtcggttcggcagctttatgctcagcactttacatcggggacctctgaccttttgggacagcggtg

SEQ ID NO: 396508 - DNA, 140 bp, Artificial Sequence
  Synthetic
caccgctgtcccaaaaggtcagaggtccccgatgtaaagtgctgagcataaagctgccgaaccgacgaggagatccacgtgagtgcggaaacctctcgttgatacggaagcatttgccaccatatcagcagccagggcct

SEQ ID NO: 396509 - DNA, 140 bp, Artificial Sequence
  Synthetic
atacgccatgctgggtctcctttcttgaggggcactggggtgtcatcggcgccatattgtactacagtatggttgcgaactgggctaaagtcctcgctgtcttggtcctttttgctggggcgtacttgggagtcggccat

SEQ ID NO: 396510 - DNA, 140 bp, Artificial Sequence
  Synthetic
atggccgactcccaagtacgccccagcaaaaaggaccaagacagcgaggactttagcccagttcgcaaccatactgtagtacaatatggcgccgatgacaccccagtgcccctcaagaaaggagacccagcatggcgtat

SEQ ID NO: 396511 - DNA, 140 bp, Artificial Sequence
  Synthetic
aggccctggctgctgatatgtggccgcgctgacaggtacgtacgtctatgaccatcttactccactgcgggattgggcccacgcgggcctacgagaccttgcggtggcagtagagcccgtgaccttttgggacagcggtg

SEQ ID NO: 396512 - DNA, 140 bp, Artificial Sequence
  Synthetic
caccgctgtcccaaaaggtcacgggctctactgccaccgcaaggtctcgtaggcccgcgtgggcccaatcccgcagtggagtaagatggtcatagacgtacgtacctgtcagcgcggccacatatcagcagccagggcct

SEQ ID NO: 396513 - DNA, 140 bp, Artificial Sequence
  Synthetic
aggccctggctgctgatatggattgggcccacgcgggcctacgagaccttgcggtggcagtagagcccgttgtcttctctgacatggagaccaaggtcatcacctggggggcggacaccggaccttttgggacagcggtg

SEQ ID NO: 396514 - DNA, 140 bp, Artificial Sequence
  Synthetic
caccgctgtcccaaaaggtccggtgtccgccccccaggtgatgaccttggtctccatgtcagagaagacaacgggctctactgccaccgcaaggtctcgtaggcccgcgtgggcccaatccatatcagcagccagggcct

SEQ ID NO: 396515 - DNA, 140 bp, Artificial Sequence
  Synthetic
atacgccatgctgggtctcccactccaaaccggctttattgctggtttgttttacacccattccttcaactcttcgggttgccctgaacggttgagtaggtgtcggccgctaagtgcattcgtacttgggagtcggccat

SEQ ID NO: 396516 - DNA, 140 bp, Artificial Sequence
  Synthetic
atggccgactcccaagtacgaatgcacttagcggccgacacctactcaaccgttcagggcaacccgaagagttgaaggaatgggtgtaaaacaaaccagcaataaagccggtttggagtgggagacccagcatggcgtat

SEQ ID NO: 396517 - DNA, 140 bp, Artificial Sequence
  Synthetic
atacgccatgctgggtctcctgaccaaggttggggccctctgacatacgcgtccatggaggggtcgtccgaggacaggccctactgctggcactacgcgcccagaccctgtgacatcgtccgtacttgggagtcggccat

SEQ ID NO: 396518 - DNA, 140 bp, Artificial Sequence
  Synthetic
atggccgactcccaagtacggacgatgtcacagggtctgggcgcgtagtgccagcagtagggcctgtcctcggacgacccctccatggacgcgtatgtcagagggccccaaccttggtcaggagacccagcatggcgtat

SEQ ID NO: 396519 - DNA, 140 bp, Artificial Sequence
  Synthetic
atacgccatgctgggtctccaaaacgagtcagatgtgttcctgctgcaggggaccaggcccccccaagggccatggtttggctgcacctggatgaattctacagggtttgtcaagacatgcgtacttgggagtcggccat

SEQ ID NO: 396520 - DNA, 140 bp, Artificial Sequence
  Synthetic
atggccgactcccaagtacgcatgtcttgacaaaccctgtagaattcatccaggtgcagccaaaccatggcccttgggggggcctggtcccctgcagcaggaacacatctgactcgttttggagacccagcatggcgtat

SEQ ID NO: 396521 - DNA, 140 bp, Artificial Sequence
  Synthetic
atacgccatgctgggtctcctgcgggtccgggccatggctgactcctagatgcttggtggactatccctatagattgtggcattacccttgcaccgtaaatttcaccatccacaaggtgccgtacttgggagtcggccat

SEQ ID NO: 396522 - DNA, 140 bp, Artificial Sequence
  Synthetic
atggccgactcccaagtacggcaccttgtggatggtgaaatttacggtgcaagggtaatgccacaatctatagggatagtccaccaagcatctaggagtcagccatggcccggacccgcaggagacccagcatggcgtat

SEQ ID NO: 396523 - DNA, 140 bp, Artificial Sequence
  Synthetic
aggccctggctgctgatatgccctctgctacactcaacaacagagttggctatcttgccttgctcttttacaactatgcccgcgctatcaactgggctaatccacctgcaccagaacgttgaccttttgggacagcggtg

SEQ ID NO: 396524 - DNA, 140 bp, Artificial Sequence
  Synthetic
caccgctgtcccaaaaggtcaacgttctggtgcaggtggattagcccagttgatagcgcgggcatagttgtaaaagagcaaggcaagatagccaactctgttgttgagtgtagcagagggcatatcagcagccagggcct

SEQ ID NO: 396525 - DNA, 140 bp, Artificial Sequence
  Synthetic
  misc_feature (77)..(77): n is a, c, g, or t
aggccctggctgctgatatgtgtgaagtgggaatacgtcgtcttggcgttcttggtcctagctgatgcacgggtttntgcctgtttgtggctgatgttcttggttggccaagcggaggcagaccttttgggacagcggtg

SEQ ID NO: 396526 - DNA, 140 bp, Artificial Sequence
  Synthetic
  misc_feature (64)..(64): n is a, c, g, or t
caccgctgtcccaaaaggtctgcctccgcttggccaaccaagaacatcagccacaaacaggcanaaacccgtgcatcagctaggaccaagaacgccaagacgacgtattcccacttcacacatatcagcagccagggcct

SEQ ID NO: 396527 - DNA, 140 bp, Artificial Sequence
  Synthetic
atacgccatgctgggtctccgcaaatatgctcccatcactgtctacgctaccctacagatgtggcccttactcctactagtattggctctacctcatagggcttatgctagtaacggggacgtacttgggagtcggccat

SEQ ID NO: 396528 - DNA, 140 bp, Artificial Sequence
  Synthetic
atggccgactcccaagtacgtccccgttactagcataagccctatgaggtagagccaatactagtaggagtaagggccacatctgtagggtagcgtagacagtgatgggagcatatttgcggagacccagcatggcgtat

SEQ ID NO: 396529 - DNA, 140 bp, Artificial Sequence
  Synthetic
atacgccatgctgggtctcccaatacttcattgcacgagcggaagccattctgcatgtttgggtgcccccattgcaggttcgtggaggtcgcgatgcagtgatattgctcacctgcctgtcgtacttgggagtcggccat

SEQ ID NO: 396530 - DNA, 140 bp, Artificial Sequence
  Synthetic
atggccgactcccaagtacgacaggcaggtgagcaatatcactgcatcgcgacctccacgaacctgcaatgggggcacccaaacatgcagaatggcttccgctcgtgcaatgaagtattgggagacccagcatggcgtat

SEQ ID NO: 396531 - DNA, 140 bp, Artificial Sequence
  Synthetic
aggccctggctgctgatatgattgcaggttcgtggaggtcgcgatgcagtgatattgctcacctgcctgttgcacccacagttggggtttgaggttaccaagatcattttagctcttatagaccttttgggacagcggtg

SEQ ID NO: 396532 - DNA, 140 bp, Artificial Sequence
  Synthetic
caccgctgtcccaaaaggtctataagagctaaaatgatcttggtaacctcaaaccccaactgtgggtgcaacaggcaggtgagcaatatcactgcatcgcgacctccacgaacctgcaatcatatcagcagccagggcct

SEQ ID NO: 396533 - DNA, 140 bp, Artificial Sequence
  Synthetic
atacgccatgctgggtctccgcgggaagtacgtccaagctgcgcttttgcggctgggcgtgtggacgggcacctacatctatgaccatctgtctccactgtctgattgggcgtgtgatggcgtacttgggagtcggccat

SEQ ID NO: 396534 - DNA, 140 bp, Artificial Sequence
  Synthetic
atggccgactcccaagtacgccatcacacgcccaatcagacagtggagacagatggtcatagatgtaggtgcccgtccacacgcccagccgcaaaagcgcagcttggacgtacttcccgcggagacccagcatggcgtat

SEQ ID NO: 396535 - DNA, 140 bp, Artificial Sequence
  Synthetic
aggccctggctgctgatatgacctacatctatgaccatctgtctccactgtctgattgggcgtgtgatggcctacgagatctggctgtcgccgtcgaacctgttatcttctctccaatgggaccttttgggacagcggtg

SEQ ID NO: 396536 - DNA, 140 bp, Artificial Sequence
  Synthetic
caccgctgtcccaaaaggtcccattggagagaagataacaggttcgacggcgacagccagatctcgtaggccatcacacgcccaatcagacagtggagacagatggtcatagatgtaggtcatatcagcagccagggcct

SEQ ID NO: 396537 - DNA, 140 bp, Artificial Sequence
  Synthetic
atacgccatgctgggtctccccctgctgatgatatccggagtggaggctggcgcctccttgccccgatcacggcatatgcccagcagaccagaggcctggtaggcacaattgtcactagccgtacttgggagtcggccat

SEQ ID NO: 396538 - DNA, 140 bp, Artificial Sequence
  Synthetic
atggccgactcccaagtacggctagtgacaattgtgcctaccaggcctctggtctgctgggcatatgccgtgatcggggcaaggaggcgccagcctccactccggatatcatcagcagggggagacccagcatggcgtat

SEQ ID NO: 396539 - DNA, 140 bp, Artificial Sequence
  Synthetic
atacgccatgctgggtctcctacggccacgcagtccttccttgctaccactgtcaacggggtcctctggacggtctaccatggtgctggggcgaagacgttggccggcccgaaagggccccgtacttgggagtcggccat

SEQ ID NO: 396540 - DNA, 140 bp, Artificial Sequence
  Synthetic
atggccgactcccaagtacggggccctttcgggccggccaacgtcttcgccccagcaccatggtagaccgtccagaggaccccgttgacagtggtagcaaggaaggactgcgtggccgtaggagacccagcatggcgtat

SEQ ID NO: 396541 - DNA, 140 bp, Artificial Sequence
  Synthetic
atacgccatgctgggtctcctttacctagtgacgaggaatgctgacgtcatccccgccagacgcaggggtgacacccgcgcagcactcctcagcccaaggccaattagtactttgaagggcgtacttgggagtcggccat

SEQ ID NO: 396542 - DNA, 140 bp, Artificial Sequence
  Synthetic
atggccgactcccaagtacgcccttcaaagtactaattggccttgggctgaggagtgctgcgcgggtgtcacccctgcgtctggcggggatgacgtcagcattcctcgtcactaggtaaaggagacccagcatggcgtat

SEQ ID NO: 396543 - DNA, 140 bp, Artificial Sequence
  Synthetic
aggccctggctgctgatatggacacccgcgcagcactcctcagcccaaggccaattagtactttgaagggatcgtcgggtgggcctatgctatgtccctcgggccatgtcgcggggatttgaccttttgggacagcggtg

SEQ ID NO: 396544 - DNA, 140 bp, Artificial Sequence
  Synthetic
caccgctgtcccaaaaggtcaaatccccgcgacatggcccgagggacatagcataggcccacccgacgatcccttcaaagtactaattggccttgggctgaggagtgctgcgcgggtgtccatatcagcagccagggcct

SEQ ID NO: 396545 - DNA, 140 bp, Artificial Sequence
  Synthetic
aggccctggctgctgatatgagtcagagaacaaagtggtgattctggactccttcgatccgcttgtggcggaggaggatgagcgggagatctccgtgcccgcagaaatcctgcggaagtcgaccttttgggacagcggtg

SEQ ID NO: 396546 - DNA, 140 bp, Artificial Sequence
  Synthetic
caccgctgtcccaaaaggtcgacttccgcaggatttctgcgggcacggagatctcccgctcatcctcctccgccacaagcggatcgaaggagtccagaatcaccactttgttctctgactcatatcagcagccagggcct

SEQ ID NO: 396547 - DNA, 140 bp, Artificial Sequence
  Synthetic
aggccctggctgctgatatgcccctacaggtagtggtaagagtaccaaggtccctgctgcgtacgccgctcagggttacaaagttttggtgctcaatccctccgtggctgccaccctcgggaccttttgggacagcggtg

SEQ ID NO: 396548 - DNA, 140 bp, Artificial Sequence
  Synthetic
caccgctgtcccaaaaggtcccgagggtggcagccacggagggattgagcaccaaaactttgtaaccctgagcggcgtacgcagcagggaccttggtactcttaccactacctgtaggggcatatcagcagccagggcct

SEQ ID NO: 396549 - DNA, 140 bp, Artificial Sequence
  Synthetic
aggccctggctgctgatatgtgctgcttcggctttcgtgggcgccggcatcgccggcgcggccgttggcagcataggccttgggaaggtgcttgtggacatcctggcgggctatggggcagaccttttgggacagcggtg

SEQ ID NO: 396550 - DNA, 140 bp, Artificial Sequence
  Synthetic
caccgctgtcccaaaaggtctgccccatagcccgccaggatgtccacaagcaccttcccaaggcctatgctgccaacggccgcgccggcgatgccggcgcccacgaaagccgaagcagcacatatcagcagccagggcct

SEQ ID NO: 396551 - DNA, 140 bp, Artificial Sequence
  Synthetic
atacgccatgctgggtctccggcaaattcctcgctgatgggggctgctctggcggcgcctatgacatcatcatttgcgacgaatgccattcaacagatcctactactgtcctgggtatagcgtacttgggagtcggccat

SEQ ID NO: 396552 - DNA, 140 bp, Artificial Sequence
  Synthetic
atggccgactcccaagtacgctatacccaggacagtagtaggatctgttgaatggcattcgtcgcaaatgatgatgtcataggcgccgccagagcagcccccatcagcgaggaatttgccggagacccagcatggcgtat

SEQ ID NO: 396553 - DNA, 140 bp, Artificial Sequence
  Synthetic
aggccctggctgctgatatgtggaggttacgcgggtgggggatttccactacgtgacgggcatgaccactgacaacgtaaagtgcccatgccaggttccggcccccgaattcttcacggagaccttttgggacagcggtg

SEQ ID NO: 396554 - DNA, 140 bp, Artificial Sequence
  Synthetic
caccgctgtcccaaaaggtctccgtgaagaattcgggggccggaacctggcatgggcactttacgttgtcagtggtcatgcccgtcacgtagtggaaatcccccacccgcgtaacctccacatatcagcagccagggcct

SEQ ID NO: 396555 - DNA, 140 bp, Artificial Sequence
  Synthetic
aggccctggctgctgatatgcctgcgagatctggccgtggccgtagagccagtcgtcttctcccaaatggagaccaagctcatcacgtggggggcggacaccgccgcgtgcggtgacatcgaccttttgggacagcggtg

SEQ ID NO: 396556 - DNA, 140 bp, Artificial Sequence
  Synthetic
caccgctgtcccaaaaggtcgatgtcaccgcacgcggcggtgtccgccccccacgtgatgagcttggtctccatttgggagaagacgactggctctacggccacggccagatctcgcaggcatatcagcagccagggcct

SEQ ID NO: 396557 - DNA, 140 bp, Artificial Sequence
  Synthetic
atacgccatgctgggtctccttcctctcatgccaacgcgggtacaagggagtctggcggggggacggcatcatgcaaaccacctgcccatgtggagcacagatcaccggacatgtcaaaacgtacttgggagtcggccat

SEQ ID NO: 396558 - DNA, 140 bp, Artificial Sequence
  Synthetic
atggccgactcccaagtacgttttgacatgtccggtgatctgtgctccacatgggcaggtggtttgcatgatgccgtccccccgccagactcccttgtacccgcgttggcatgagaggaaggagacccagcatggcgtat

SEQ ID NO: 396559 - DNA, 140 bp, Artificial Sequence
  Synthetic
atacgccatgctgggtctccgattttgactcagtgattgattgtaacgtttcagttacccaggtagttgacttcagtttggaccctacatttaccatagagaccaccactgtgccccaagcgtacttgggagtcggccat

SEQ ID NO: 396560 - DNA, 140 bp, Artificial Sequence
  Synthetic
atggccgactcccaagtacgcttggggcacagtggtggtctctatggtaaatgtagggtccaaactgaagtcaactacctgggtaactgaaacgttacaatcaatcactgagtcaaaatcggagacccagcatggcgtat

SEQ ID NO: 396561 - DNA, 140 bp, Artificial Sequence
  Synthetic
aggccctggctgctgatatgcttcagtttggaccctacatttaccatagagaccaccactgtgccccaagactccgtttcgcggagtcagaggagaggtaggacagggagggggaaacacgaccttttgggacagcggtg

SEQ ID NO: 396562 - DNA, 140 bp, Artificial Sequence
  Synthetic
caccgctgtcccaaaaggtcgtgtttccccctccctgtcctacctctcctctgactccgcgaaacggagtcttggggcacagtggtggtctctatggtaaatgtagggtccaaactgaagcatatcagcagccagggcct

SEQ ID NO: 396563 - DNA, 140 bp, Artificial Sequence
  Synthetic
atacgccatgctgggtctcctgactccatccgaaacaactgtacgactacgcgcttatctgaatacaccaggactccccgtctgtcaagaccacctagaattttgggagggcgtgtttaccgtacttgggagtcggccat

SEQ ID NO: 396564 - DNA, 140 bp, Artificial Sequence
  Synthetic
atggccgactcccaagtacggtaaacacgccctcccaaaattctaggtggtcttgacagacggggagtcctggtgtattcagataagcgcgtagtcgtacagttgtttcggatggagtcaggagacccagcatggcgtat

SEQ ID NO: 396565 - DNA, 140 bp, Artificial Sequence
  Synthetic
atacgccatgctgggtctccgccaaagctccccccccttcctgggacactatgtggaaatgccttatccgcctcaagcctatgctcacagggcccacccccttgttgtatagacttggtgcgtacttgggagtcggccat

SEQ ID NO: 396566 - DNA, 140 bp, Artificial Sequence
  Synthetic
atggccgactcccaagtacgcaccaagtctatacaacaagggggtgggccctgtgagcataggcttgaggcggataaggcatttccacatagtgtcccaggaaggggggggagctttggcggagacccagcatggcgtat

SEQ ID NO: 396567 - DNA, 140 bp, Artificial Sequence
  Synthetic
  misc_feature (36)..(36): n is a, c, g, or t
aggccctggctgctgatatggggaggggtcctcgcngcactagctgcctactgtttatctgtgggttgcgtagtgatctgcggtaggattaccaccactggtaagccagtagtcatccctgaccttttgggacagcggtg

SEQ ID NO: 396568 - DNA, 140 bp, Artificial Sequence
  Synthetic
  misc_feature (105)..(105): n is a, c, g, or t
caccgctgtcccaaaaggtcagggatgactactggcttaccagtggtggtaatcctaccgcagatcactacgcaacccacagataaacagtaggcagctagtgcngcgaggacccctccccatatcagcagccagggcct

SEQ ID NO: 396569 - DNA, 140 bp, Artificial Sequence
  Synthetic
atacgccatgctgggtctccaaaaggttctcggcctcatccaaactactactaagcaggccgaagagcttaagcctgctgtccattctgcctggcccaaactcgaacagttctggcagaacgtacttgggagtcggccat

SEQ ID NO: 396570 - DNA, 140 bp, Artificial Sequence
  Synthetic
atggccgactcccaagtacgttctgccagaactgttcgagtttgggccaggcagaatggacagcaggcttaagctcttcggcctgcttagtagtagtttggatgaggccgagaaccttttggagacccagcatggcgtat

SEQ ID NO: 396571 - DNA, 140 bp, Artificial Sequence
  Synthetic
aggccctggctgctgatatgggaggttgctctgtccaccaccggagagatccctttttacggcaaggctatccccctcgaagtaatcaagggggggagacatctcattttctgtcactcagaccttttgggacagcggtg

SEQ ID NO: 396572 - DNA, 140 bp, Artificial Sequence
  Synthetic
caccgctgtcccaaaaggtctgagtgacagaaaatgagatgtctcccccccttgattacttcgagggggatagccttgccgtaaaaagggatctctccggtggtggacagagcaacctcccatatcagcagccagggcct

SEQ ID NO: 396573 - DNA, 140 bp, Artificial Sequence
  Synthetic
atacgccatgctgggtctccccttgccgggcaatccggcggtcgcctcattgatgtccttctcagcttccttgactagcccgctgtcgacctctacaaccctcctgctcaacatcctgggcgtacttgggagtcggccat

SEQ ID NO: 396574 - DNA, 140 bp, Artificial Sequence
  Synthetic
atggccgactcccaagtacgcccaggatgttgagcaggagggttgtagaggtcgacagcgggctagtcaaggaagctgagaaggacatcaatgaggcgaccgccggattgcccggcaaggggagacccagcatggcgtat

SEQ ID NO: 396575 - DNA, 140 bp, Artificial Sequence
  Synthetic
atacgccatgctgggtctcctagtgagtggtctggcgggagctgctgttggcagcatcggcttgggaagggtgctggtggacgttattgctggctacggtgcgggcgtgtccggggcactcgtacttgggagtcggccat

SEQ ID NO: 396576 - DNA, 140 bp, Artificial Sequence
  Synthetic
atggccgactcccaagtacgagtgccccggacacgcccgcaccgtagccagcaataacgtccaccagcacccttcccaagccgatgctgccaacagcagctcccgccagaccactcactaggagacccagcatggcgtat

SEQ ID NO: 396577 - DNA, 140 bp, Artificial Sequence
  Synthetic
atacgccatgctgggtctccgtgtgcgcggccatcctaaggcgccacgctggacccgcggaaggagctacacagtggatgaaccggttgatagcttttgcctccaggggtaaccatgtatcgtacttgggagtcggccat

SEQ ID NO: 396578 - DNA, 140 bp, Artificial Sequence
  Synthetic
atggccgactcccaagtacgatacatggttacccctggaggcaaaagctatcaaccggttcatccactgtgtagctccttccgcgggtccagcgtggcgccttaggatggccgcgcacacggagacccagcatggcgtat

SEQ ID NO: 396579 - DNA, 140 bp, Artificial Sequence
  Synthetic
atacgccatgctgggtctcctctgggactgggtgtgcactgtactctctgactttaaggtctggctcaaaacaaagctcgtgccggcactaccaggtttgcctttcctctcatgtcaacgcgtacttgggagtcggccat

SEQ ID NO: 396580 - DNA, 140 bp, Artificial Sequence
  Synthetic
atggccgactcccaagtacgcgttgacatgagaggaaaggcaaacctggtagtgccggcacgagctttgttttgagccagaccttaaagtcagagagtacagtgcacacccagtcccagaggagacccagcatggcgtat

SEQ ID NO: 396581 - DNA, 140 bp, Artificial Sequence
  Synthetic
atacgccatgctgggtctcctgctacgacgaccggtcctagcgtgcccatccctgagcccaactacaaaagggccctgtggcgggtgtccgcagaggagtacgtcgaggtggtgaggatgcgtacttgggagtcggccat

SEQ ID NO: 396582 - DNA, 140 bp, Artificial Sequence
  Synthetic
atggccgactcccaagtacgcatcctcaccacctcgacgtactcctctgcggacacccgccacagggcccttttgtagttgggctcagggatgggcacgctaggaccggtcgtcgtagcaggagacccagcatggcgtat

SEQ ID NO: 396583 - DNA, 140 bp, Artificial Sequence
  Synthetic
atacgccatgctgggtctccaggcgccaagcaggacgtccagctgatcaacaccaacggcagttggcacatcaatagcacagccttgaactgcaatactagcattgagaccggctggttgcgtacttgggagtcggccat

SEQ ID NO: 396584 - DNA, 140 bp, Artificial Sequence
  Synthetic
atggccgactcccaagtacgcaaccagccggtctcaatgctagtattgcagttcaaggctgtgctattgatgtgccaactgccgttggtgttgatcagctggacgtcctgcttggcgcctggagacccagcatggcgtat

SEQ ID NO: 396585 - DNA, 140 bp, Artificial Sequence
  Synthetic
  misc_feature (31)..(31): n is a, c, g, or t
atacgccatgctgggtctcctacatcgatangcgcctccttgcaaaccccttttaagggatgagatctctttttccgtagggctcaactcctacgcgatcgggtctcaattgccatgtgacgtacttgggagtcggccat

SEQ ID NO: 396586 - DNA, 140 bp, Artificial Sequence
  Synthetic
  misc_feature (110)..(110): n is a, c, g, or t
atggccgactcccaagtacgtcacatggcaattgagacccgatcgcgtaggagttgagccctacggaaaaagagatctcatcccttaaaaggggtttgcaaggaggcgcntatcgatgtaggagacccagcatggcgtat

SEQ ID NO: 396587 - DNA, 140 bp, Artificial Sequence
  Synthetic
atacgccatgctgggtctccaacttcattagcggcattcaatacctcgcaggactgtcaacactgccagggaaccccgctgtggcttccatgatggcattcagtgccgcactcaccagtccgtacttgggagtcggccat

SEQ ID NO: 396588 - DNA, 140 bp, Artificial Sequence
  Synthetic
atggccgactcccaagtacggactggtgagtgcggcactgaatgccatcatggaagccacagcggggttccctggcagtgttgacagtcctgcgaggtattgaatgccgctaatgaagttggagacccagcatggcgtat

SEQ ID NO: 396589 - DNA, 140 bp, Artificial Sequence
  Synthetic
atacgccatgctgggtctcctctctcgccagctcatcggcaagtcagctctcagccccatcgttgaaagcaacatgcaccacgcatggggtgcatgccgatgcggatctgatagaagcaacgtacttgggagtcggccat

SEQ ID NO: 396590 - DNA, 140 bp, Artificial Sequence
  Synthetic
atggccgactcccaagtacgttgcttctatcagatccgcatcggcatgcaccccatgcgtggtgcatgttgctttcaacgatggggctgagagctgacttgccgatgagctggcgagagaggagacccagcatggcgtat

SEQ ID NO: 396591 - DNA, 140 bp, Artificial Sequence
  Synthetic
aggccctggctgctgatatgactggggagtcctggcgggccttgcctactattccatggtggggaactgggctaaggtcttgattgtgatgctactctttgccggcgttgacgggaccacgaccttttgggacagcggtg

SEQ ID NO: 396592 - DNA, 140 bp, Artificial Sequence
  Synthetic
caccgctgtcccaaaaggtcgtggtcccgtcaacgccggcaaagagtagcatcacaatcaagaccttagcccagttccccaccatggaatagtaggcaaggcccgccaggactccccagtcatatcagcagccagggcct

SEQ ID NO: 396593 - DNA, 140 bp, Artificial Sequence
  Synthetic
atacgccatgctgggtctccgagaataaggtcatcattctcgactcgttcgacccgctggtacccgaatatgatgacagagagctatccgtgcctgcagagtgccataggccgcttaggccgtacttgggagtcggccat

SEQ ID NO: 396594 - DNA, 140 bp, Artificial Sequence
  Synthetic
atggccgactcccaagtacggcctaagcggcctatggcactctgcaggcacggatagctctctgtcatcatattcgggtaccagcgggtcgaacgagtcgagaatgatgaccttattctcggagacccagcatggcgtat

SEQ ID NO: 396595 - DNA, 140 bp, Artificial Sequence
  Synthetic
aggccctggctgctgatatgttgttggcactacgcgccccgaccgtgcggtattgtacccgcgtcgcaggtgtgcggtccagtgtactgcttcaccccgagccctgttgtggtggggacggaccttttgggacagcggtg

SEQ ID NO: 396596 - DNA, 140 bp, Artificial Sequence
  Synthetic
caccgctgtcccaaaaggtccgtccccaccacaacagggctcggggtgaagcagtacactggaccgcacacctgcgacgcgggtacaataccgcacggtcggggcgcgtagtgccaacaacatatcagcagccagggcct

SEQ ID NO: 396597 - DNA, 140 bp, Artificial Sequence
  Synthetic
atacgccatgctgggtctccagactcaggccatcctactgccagcaagagctcagacccaattgatgaggaggctgatgccgcctctgacgcggggtcctacagctctatgccaccacttcgtacttgggagtcggccat

SEQ ID NO: 396598 - DNA, 140 bp, Artificial Sequence
  Synthetic
atggccgactcccaagtacgaagtggtggcatagagctgtaggaccccgcgtcagaggcggcatcagcctcctcatcaattgggtctgagctcttgctggcagtaggatggcctgagtctggagacccagcatggcgtat

SEQ ID NO: 396599 - DNA, 140 bp, Artificial Sequence
  Synthetic
atacgccatgctgggtctcccaggggcgctaatcacaccttgcgcagccgaggaggagaaactgcctataaacccattgagcaattccctcattcgacaccacaatttggtgtactccaccgtacttgggagtcggccat

SEQ ID NO: 396600 - DNA, 140 bp, Artificial Sequence
  Synthetic
atggccgactcccaagtacggtggagtacaccaaattgtggtgtcgaatgagggaattgctcaatgggtttataggcagtttctcctcctcggctgcgcaaggtgtgattagcgcccctgggagacccagcatggcgtat

SEQ ID NO: 396601 - DNA, 140 bp, Artificial Sequence
  Synthetic
aggccctggctgctgatatgaacccattgagcaattccctcattcgacaccacaatttggtgtactccacaacatcccggagtgctgcaatgcggcagaagaaggtcacctttgaccgcggaccttttgggacagcggtg

SEQ ID NO: 396602 - DNA, 140 bp, Artificial Sequence
  Synthetic
caccgctgtcccaaaaggtccgcggtcaaaggtgaccttcttctgccgcattgcagcactccgggatgttgtggagtacaccaaattgtggtgtcgaatgagggaattgctcaatgggttcatatcagcagccagggcct

SEQ ID NO: 396603 - DNA, 140 bp, Artificial Sequence
  Synthetic
atacgccatgctgggtctccccttacccccccacactcagctcgctcgaagtttgggtatggagcgaaagatgtccggagtcatgctagcaaggccattaaccatatcaactccgtatggcgtacttgggagtcggccat

SEQ ID NO: 396604 - DNA, 140 bp, Artificial Sequence
  Synthetic
atggccgactcccaagtacgccatacggagttgatatggttaatggccttgctagcatgactccggacatctttcgctccatacccaaacttcgagcgagctgagtgtgggggggtaaggggagacccagcatggcgtat

SEQ ID NO: 396605 - DNA, 140 bp, Artificial Sequence
  Synthetic
aggccctggctgctgatatgatgtccggagtcatgctagcaaggccattaaccatatcaactccgtatggaaggacttgctagaagacaaccaatcaccaatccccacaaccatcatggcgaccttttgggacagcggtg

SEQ ID NO: 396606 - DNA, 140 bp, Artificial Sequence
  Synthetic
caccgctgtcccaaaaggtcgccatgatggttgtggggattggtgattggttgtcttctagcaagtccttccatacggagttgatatggttaatggccttgctagcatgactccggacatcatatcagcagccagggcct

SEQ ID NO: 396607 - DNA, 140 bp, Artificial Sequence
  Synthetic
  misc_feature (25)..(25): n is a, c, g, or t
  misc_feature (58)..(58): n is a, c, g, or t
atacgccatgctgggtctccctcgnctcgtcgtattcccggacctatcggtgcgggtntgcgagaagagggctttgtttgacatcacccgcaagttgccaaccgctatcatgggagatgccgtacttgggagtcggccat

SEQ ID NO: 396608 - DNA, 140 bp, Artificial Sequence
  Synthetic
  misc_feature (83)..(83): n is a, c, g, or t
  misc_feature (116)..(116): n is a, c, g, or t
atggccgactcccaagtacggcatctcccatgatagcggttggcaacttgcgggtgatgtcaaacaaagccctcttctcgcanacccgcaccgataggtccgggaatacgacgagncgagggagacccagcatggcgtat

SEQ ID NO: 396609 - DNA, 140 bp, Artificial Sequence
  Synthetic
atacgccatgctgggtctccttacggcttccagtactcacccaaacagcgggtggactacctgctcaagatgtggcgctccaagaagacccccatggggttttcctatgataccagctgccgtacttgggagtcggccat

SEQ ID NO: 396610 - DNA, 140 bp, Artificial Sequence
  Synthetic
atggccgactcccaagtacggcagctggtatcataggaaaaccccatgggggtcttcttggagcgccacatcttgagcaggtagtccacccgctgtttgggtgagtactggaagccgtaaggagacccagcatggcgtat

SEQ ID NO: 396611 - DNA, 140 bp, Artificial Sequence
  Synthetic
atacgccatgctgggtctccctgagcggctttacctaggaggccccatgtacaactcccggggccaattgtgtgggactcgcaggtgccgcgcaagcggggtgcttaccactagcttaggcgtacttgggagtcggccat

SEQ ID NO: 396612 - DNA, 140 bp, Artificial Sequence
  Synthetic
atggccgactcccaagtacgcctaagctagtggtaagcaccccgcttgcgcggcacctgcgagtcccacacaattggccccgggagttgtacatggggcctcctaggtaaagccgctcagggagacccagcatggcgtat

SEQ ID NO: 396613 - DNA, 140 bp, Artificial Sequence
  Synthetic
atacgccatgctgggtctccgccttaccaaatatgacatgttggtctgcggggatgacttggtggtcattgctgagagtgctggagtccaggaggacgcctctaacctgcgagctttcaccgtacttgggagtcggccat

SEQ ID NO: 396614 - DNA, 140 bp, Artificial Sequence
  Synthetic
atggccgactcccaagtacggtgaaagctcgcaggttagaggcgtcctcctggactccagcactctcagcaatgaccaccaagtcatccccgcagaccaacatgtcatatttggtaaggcggagacccagcatggcgtat

SEQ ID NO: 396615 - DNA, 140 bp, Artificial Sequence
  Synthetic
atacgccatgctgggtctcccatatgacttagagcttataacatcctgctcatccaacgtctccgtggcccacgaccacactggacagagatattactacctcacacgagaccctatcaccgtacttgggagtcggccat

SEQ ID NO: 396616 - DNA, 140 bp, Artificial Sequence
  Synthetic
atggccgactcccaagtacggtgatagggtctcgtgtgaggtagtaatatctctgtccagtgtggtcgtgggccacggagacgttggatgagcaggatgttataagctctaagtcatatgggagacccagcatggcgtat

SEQ ID NO: 396617 - DNA, 140 bp, Artificial Sequence
  Synthetic
atacgccatgctgggtctccgtgttgatgacccatttctttcagatactccaagcgcaggagcaactagatagggtacttgacttcgacatatacggagtcacatactcaattaatccaccgtacttgggagtcggccat

SEQ ID NO: 396618 - DNA, 140 bp, Artificial Sequence
  Synthetic
atggccgactcccaagtacggtggattaattgagtatgtgactccgtatatgtcgaagtcaagtaccctatctagttgctcctgcgcttggagtatctgaaagaaatgggtcatcaacacggagacccagcatggcgtat

SEQ ID NO: 396619 - DNA, 140 bp, Artificial Sequence
  Synthetic
atacgccatgctgggtctcctccaactcccagccattatccaaagactccatggtatggccgcgttttcactccatgggtactctccaggcgaactcaatcgggtggcatcatgcctcagcgtacttgggagtcggccat

SEQ ID NO: 396620 - DNA, 140 bp, Artificial Sequence
  Synthetic
atggccgactcccaagtacgctgaggcatgatgccacccgattgagttcgcctggagagtacccatggagtgaaaacgcggccataccatggagtctttggataatggctgggagttggaggagacccagcatggcgtat

SEQ ID NO: 396621 - DNA, 140 bp, Artificial Sequence
  Synthetic
aggccctggctgctgatatgagaaccaggtcgagggggaggttcaagtggtttccaccgcaacacaatctttcctggcgacctgcgtcaacggcgtgtgttggactgtctaccatggtgcgaccttttgggacagcggtg

SEQ ID NO: 396622 - DNA, 140 bp, Artificial Sequence
  Synthetic
caccgctgtcccaaaaggtcgcaccatggtagacagtccaacacacgccgttgacgcaggtcgccaggaaagattgtgttgcggtggaaaccacttgaacctccccctcgacctggttctcatatcagcagccagggcct

SEQ ID NO: 396623 - DNA, 140 bp, Artificial Sequence
  Synthetic
aggccctggctgctgatatggtaccgcagacattccaagtggcccatctacacgcccccactggcagcggcaagagcaccaaggtgccggctgcatacgcagcccaagggtacaaggtacgaccttttgggacagcggtg

SEQ ID NO: 396624 - DNA, 140 bp, Artificial Sequence
  Synthetic
caccgctgtcccaaaaggtcgtaccttgtacccttgggctgcgtatgcagccggcaccttggtgctcttgccgctgccagtgggggcgtgtagatgggccacttggaatgtctgcggtaccatatcagcagccagggcct

SEQ ID NO: 396625 - DNA, 140 bp, Artificial Sequence
  Synthetic
atacgccatgctgggtctcctgcaactgttccatctacagcggacacatcacagggcataggatggcgtgggacatgatgatgaactggtccccgaccctgacctttgtcacctcttcgccgtacttgggagtcggccat

SEQ ID NO: 396626 - DNA, 140 bp, Artificial Sequence
  Synthetic
atggccgactcccaagtacggcgaagaggtgacaaaggtcagggtcggggaccagttcatcatcatgtcccacgccatcctatgccctgtgatgtgtccgctgtagatggaacagttgcaggagacccagcatggcgtat

SEQ ID NO: 396627 - DNA, 140 bp, Artificial Sequence
  Synthetic
atacgccatgctgggtctccgagttagaggatagggatagggttgagatgagccctctgctacactcaacaacagagttggctatcttgccttgctcttttacaactatgcccgcgctatcgtacttgggagtcggccat

SEQ ID NO: 396628 - DNA, 140 bp, Artificial Sequence
  Synthetic
atggccgactcccaagtacgatagcgcgggcatagttgtaaaagagcaaggcaagatagccaactctgttgttgagtgtagcagagggctcatctcaaccctatccctatcctctaactcggagacccagcatggcgtat

SEQ ID NO: 396629 - DNA, 140 bp, Artificial Sequence
  Synthetic
aggccctggctgctgatatgccccccctggagggggagcctggggatccggatctcagcgacgggtcatggtcgacggtcagtagtggggccgacacggaggatgtcgtgtgctgctcaagaccttttgggacagcggtg

SEQ ID NO: 396630 - DNA, 140 bp, Artificial Sequence
  Synthetic
caccgctgtcccaaaaggtcttgagcagcacacgacatcctccgtgtcggccccactactgaccgtcgaccatgacccgtcgctgagatccggatccccaggctccccctccagggggggcatatcagcagccagggcct

SEQ ID NO: 396631 - DNA, 140 bp, Artificial Sequence
  Synthetic
aggccctggctgctgatatgggccttgcctactattccatggtggggaactgggctaaggtcttggttgtgatgctactcttcgccggtgttgacgggaataccgtcgtgtcaggggggcgaccttttgggacagcggtg

SEQ ID NO: 396632 - DNA, 140 bp, Artificial Sequence
  Synthetic
caccgctgtcccaaaaggtcgcccccctgacacgacggtattcccgtcaacaccggcgaagagtagcatcacaaccaagaccttagcccagttccccaccatggaatagtaggcaaggcccatatcagcagccagggcct

SEQ ID NO: 396633 - DNA, 140 bp, Artificial Sequence
  Synthetic
atacgccatgctgggtctcccacaggtgaggtgcctttctatggaaaggcgatcccccttgaatacatcaaagggggtaggcaccttatcttctgtcattctaagaagaaatgcgatgagcgtacttgggagtcggccat

SEQ ID NO: 396634 - DNA, 140 bp, Artificial Sequence
  Synthetic
atggccgactcccaagtacgctcatcgcatttcttcttagaatgacagaagataaggtgcctaccccctttgatgtattcaagggggatcgcctttccatagaaaggcacctcacctgtgggagacccagcatggcgtat

SEQ ID NO: 396635 - DNA, 140 bp, Artificial Sequence
  Synthetic
aggccctggctgctgatatgggctcatatggtggtcacaatatcttatcaccagggccgaggcgcatttgcaagtgtgggtcccccctctcaacgttcgggggggccgcgatgccatcatgaccttttgggacagcggtg

SEQ ID NO: 396636 - DNA, 140 bp, Artificial Sequence
  Synthetic
caccgctgtcccaaaaggtcatgatggcatcgcggcccccccgaacgttgagaggggggacccacacttgcaaatgcgcctcggccctggtgataagatattgtgaccaccatatgagcccatatcagcagccagggcct

SEQ ID NO: 396637 - DNA, 140 bp, Artificial Sequence
  Synthetic
  misc_feature (68)..(68): n is a, c, g, or t
atacgccatgctgggtctccttggaagtcataaccagtacctgggtcatagtgggaggggtcctcgcngcactagctgcctactgtttatctgtgggttgcgtagtgatctgcggtaggacgtacttgggagtcggccat

SEQ ID NO: 396638 - DNA, 140 bp, Artificial Sequence
  Synthetic
  misc_feature (73)..(73): n is a, c, g, or t
atggccgactcccaagtacgtcctaccgcagatcactacgcaacccacagataaacagtaggcagctagtgcngcgaggacccctcccactatgacccaggtactggttatgacttccaaggagacccagcatggcgtat

SEQ ID NO: 396639 - DNA, 140 bp, Artificial Sequence
  Synthetic
aggccctggctgctgatatggatagcttttgcctccaggggtaaccatgtatcgcccacacattatgtgccagagacagatacctctaggcaaatcatgaccatactcagttccctcaccgaccttttgggacagcggtg

SEQ ID NO: 396640 - DNA, 140 bp, Artificial Sequence
  Synthetic
caccgctgtcccaaaaggtcggtgagggaactgagtatggtcatgatttgcctagaggtatctgtctctggcacataatgtgtgggcgatacatggttacccctggaggcaaaagctatccatatcagcagccagggcct

SEQ ID NO: 396641 - DNA, 140 bp, Artificial Sequence
  Synthetic
atacgccatgctgggtctccgcgcaaacccacgtcaccggggggtctgtcggccgggacatgtctacatttactaaactcttctacccaggcccccagcagaaaatccaactgatcaacacgtacttgggagtcggccat

SEQ ID NO: 396642 - DNA, 140 bp, Artificial Sequence
  Synthetic
atggccgactcccaagtacgtgttgatcagttggattttctgctgggggcctgggtagaagagtttagtaaatgtagacatgtcccggccgacagaccccccggtgacgtgggtttgcgcggagacccagcatggcgtat

SEQ ID NO: 396643 - DNA, 140 bp, Artificial Sequence
  Synthetic
atacgccatgctgggtctcccatattaacaggactgctctgaactgcaacgagtccatcaacaccgggttcctcgccgcgctgttctacgtacggaagttcaacgcgtccggatgcccagcgtacttgggagtcggccat

SEQ ID NO: 396644 - DNA, 140 bp, Artificial Sequence
  Synthetic
atggccgactcccaagtacgctgggcatccggacgcgttgaacttccgtacgtagaacagcgcggcgaggaacccggtgttgatggactcgttgcagttcagagcagtcctgttaatatgggagacccagcatggcgtat

SEQ ID NO: 396645 - DNA, 140 bp, Artificial Sequence
  Synthetic
aggccctggctgctgatatgctgtgcttggtacgagctcacgcccgccgagacctcggttaggttgcgggcttacctgaacacaccagggttgcccgtctgccaggaccatctggagttcgaccttttgggacagcggtg

SEQ ID NO: 396646 - DNA, 140 bp, Artificial Sequence
  Synthetic
caccgctgtcccaaaaggtcgaactccagatggtcctggcagacgggcaaccctggtgtgttcaggtaagcccgcaacctaaccgaggtctcggcgggcgtgagctcgtaccaagcacagcatatcagcagccagggcct

SEQ ID NO: 396647 - DNA, 140 bp, Artificial Sequence
  Synthetic
aggccctggctgctgatatgtgcaaatggtcatcatcaagttaggggcgcttactggcacctatgtttataaccatctcactccccttcgggactgggcgcacaacggcctgcgagatctgaccttttgggacagcggtg

SEQ ID NO: 396648 - DNA, 140 bp, Artificial Sequence
  Synthetic
caccgctgtcccaaaaggtcagatctcgcaggccgttgtgcgcccagtcccgaaggggagtgagatggttataaacataggtgccagtaagcgcccctaacttgatgatgaccatttgcacatatcagcagccagggcct

SEQ ID NO: 396649 - DNA, 140 bp, Artificial Sequence
  Synthetic
aggccctggctgctgatatggtcacatttgacagactgcaagttctggacagccattaccaggacgtgcttaaggaggttaaggcagcggcgtcaaaagtgaaggctaacttgctatccggaccttttgggacagcggtg

SEQ ID NO: 396650 - DNA, 140 bp, Artificial Sequence
  Synthetic
caccgctgtcccaaaaggtccggatagcaagttagccttcacttttgacgccgctgccttaacctccttaagcacgtcctggtaatggctgtccagaacttgcagtctgtcaaatgtgaccatatcagcagccagggcct

SEQ ID NO: 396651 - DNA, 140 bp, Artificial Sequence
  Synthetic
aggccctggctgctgatatgttcctttcatgccaacgtgggtacaagggagtttggcggggagatggcgtcatgcaaaccacctgcccatgcggagcacaaattgctggacatgtcaagagaccttttgggacagcggtg

SEQ ID NO: 396652 - DNA, 140 bp, Artificial Sequence
  Synthetic
caccgctgtcccaaaaggtctcttgacatgtccagcaatttgtgctccgcatgggcaggtggtttgcatgacgccatctccccgccaaactcccttgtacccacgttggcatgaaaggaacatatcagcagccagggcct

SEQ ID NO: 396653 - DNA, 140 bp, Artificial Sequence
  Synthetic
aggccctggctgctgatatgtgtgaaagcgcggggacccaggaggacgcggcgaacctgcgagtcttcacggaggctatgaccaggtactctgccccccccggggacctgccccaaccgggaccttttgggacagcggtg

SEQ ID NO: 396654 - DNA, 140 bp, Artificial Sequence
  Synthetic
caccgctgtcccaaaaggtcccggttggggcaggtccccggggggggcagagtacctggtcatagcctccgtgaagactcgcaggttcgccgcgtcctcctgggtccccgcgctttcacacatatcagcagccagggcct

SEQ ID NO: 396655 - DNA, 140 bp, Artificial Sequence
  Synthetic
aggccctggctgctgatatggcgtgtcccgggctcgaccccgcatgttactctggtgcctactcctactttccgtaggagtaggcatctttttgctgcctgctcggtagacgggtagcttgaccttttgggacagcggtg

SEQ ID NO: 396656 - DNA, 140 bp, Artificial Sequence
  Synthetic
caccgctgtcccaaaaggtcaagctacccgtctaccgagcaggcagcaaaaagatgcctactcctacggaaagtaggagtaggcaccagagtaacatgcggggtcgagcccgggacacgccatatcagcagccagggcct

SEQ ID NO: 396657 - DNA, 140 bp, Artificial Sequence
  Synthetic
aggccctggctgctgatatgcggttaccgtgccacatccaaatatcgaggaggtggccctgtccaatactggagagatccccttctacggtaaagccatccccatcgaggccatcaaggggaccttttgggacagcggtg

SEQ ID NO: 396658 - DNA, 140 bp, Artificial Sequence
  Synthetic
caccgctgtcccaaaaggtccccttgatggcctcgatggggatggctttaccgtagaaggggatctctccagtattggacagggccacctcctcgatatttggatgtggcacggtaaccgcatatcagcagccagggcct

SEQ ID NO: 396659 - DNA, 140 bp, Artificial Sequence
  Synthetic
aggccctggctgctgatatgggagagatccccttctacggtaaagccatccccatcgaggccatcaaggggggaaggcatctcattttctgccattccaagaagaagtgtgacgagctcggaccttttgggacagcggtg

SEQ ID NO: 396660 - DNA, 140 bp, Artificial Sequence
  Synthetic
caccgctgtcccaaaaggtccgagctcgtcacacttcttcttggaatggcagaaaatgagatgccttccccccttgatggcctcgatggggatggctttaccgtagaaggggatctctcccatatcagcagccagggcct

SEQ ID NO: 396661 - DNA, 140 bp, Artificial Sequence
  Synthetic
aggccctggctgctgatatgcttgatgtgtccgtcataccgaccagcggagacgtcgttgtcgtggcaacagacgctctaatgacaggcttcactggcgactttgactcagtgatcgactgaccttttgggacagcggtg

SEQ ID NO: 396662 - DNA, 140 bp, Artificial Sequence
  Synthetic
caccgctgtcccaaaaggtcagtcgatcactgagtcaaagtcgccagtgaagcctgtcattagagcgtctgttgccacgacaacgacgtctccgctggtcggtatgacggacacatcaagcatatcagcagccagggcct

SEQ ID NO: 396663 - DNA, 140 bp, Artificial Sequence
  Synthetic
atacgccatgctgggtctcctgggcaggatggctcctgtccccccgcggctctcgccctaattggggccccaacgacccccggcgaagatcccgcaacatgggtaaggtcatcgattccccgtacttgggagtcggccat

SEQ ID NO: 396664 - DNA, 140 bp, Artificial Sequence
  Synthetic
atggccgactcccaagtacggggaatcgatgaccttacccatgttgcgggatcttcgccgggggtcgttggggccccaattagggcgagagccgcggggggacaggagccatcctgcccaggagacccagcatggcgtat

SEQ ID NO: 396665 - DNA, 140 bp, Artificial Sequence
  Synthetic
atacgccatgctgggtctccagacgggatcaactatgcaaccggaaaccttcctggttgctccttttctatcttccttctggcacttctctcgtgcctcaccacgcccgcctcggcagtccgtacttgggagtcggccat

SEQ ID NO: 396666 - DNA, 140 bp, Artificial Sequence
  Synthetic
atggccgactcccaagtacggactgccgaggcgggcgtggtgaggcacgagagaagtgccagaaggaagatagaaaaggagcaaccaggaaggtttccggttgcatagttgatcccgtctggagacccagcatggcgtat

SEQ ID NO: 396667 - DNA, 140 bp, Artificial Sequence
  Synthetic
aggccctggctgctgatatgcctggcgggcatagcgtatttctccatggtggggaactgggcgaaggtcctggtagtgctgctgctgtttgccggcgtcgacgcggaaacccacgtcaccgaccttttgggacagcggtg

SEQ ID NO: 396668 - DNA, 140 bp, Artificial Sequence
  Synthetic
caccgctgtcccaaaaggtcggtgacgtgggtttccgcgtcgacgccggcaaacagcagcagcactaccaggaccttcgcccagttccccaccatggagaaatacgctatgcccgccaggcatatcagcagccagggcct

SEQ ID NO: 396669 - DNA, 140 bp, Artificial Sequence
  Synthetic
atacgccatgctgggtctccgcgtcccgtgtgtaagatctggaaacgtgtctcggtgttgggtgccggtgacccccacccttgctgtggaaaatgtttccgtgtcgacgagaggcttccgcgtacttgggagtcggccat

SEQ ID NO: 396670 - DNA, 140 bp, Artificial Sequence
  Synthetic
atggccgactcccaagtacgcggaagcctctcgtcgacacggaaacattttccacagcaagggtgggggtcaccggcacccaacaccgagacacgtttccagatcttacacacgggacgcggagacccagcatggcgtat

SEQ ID NO: 396671 - DNA, 140 bp, Artificial Sequence
  Synthetic
aggccctggctgctgatatgacccccacccttgctgtggaaaatgtttccgtgtcgacgagaggcttccgcgctcacgtggatcttctcgtcggttcggcagctttatgctcagcactttgaccttttgggacagcggtg

SEQ ID NO: 396672 - DNA, 140 bp, Artificial Sequence
  Synthetic
caccgctgtcccaaaaggtcaaagtgctgagcataaagctgccgaaccgacgagaagatccacgtgagcgcggaagcctctcgtcgacacggaaacattttccacagcaagggtgggggtcatatcagcagccagggcct

SEQ ID NO: 396673 - DNA, 140 bp, Artificial Sequence
  Synthetic
atacgccatgctgggtctccgcaacttacgggaagtgcgggtcagggccgtggctcactcccaggtgcttagtggactatccctatagattgtggcactacccatgcaccgtgaatttcacgtacttgggagtcggccat

SEQ ID NO: 396674 - DNA, 140 bp, Artificial Sequence
  Synthetic
atggccgactcccaagtacgtgaaattcacggtgcatgggtagtgccacaatctatagggatagtccactaagcacctgggagtgagccacggccctgacccgcacttcccgtaagttgcggagacccagcatggcgtat

SEQ ID NO: 396675 - DNA, 140 bp, Artificial Sequence
  Synthetic
aggccctggctgctgatatgagtcgtgtcgtgggctgtgaagtgggaatacgtcgtcttggcgtttctggtcctagctgatgcacgggtttgtgcctgtttgtggttaatgttcctggttgaccttttgggacagcggtg

SEQ ID NO: 396676 - DNA, 140 bp, Artificial Sequence
  Synthetic
caccgctgtcccaaaaggtcaaccaggaacattaaccacaaacaggcacaaacccgtgcatcagctaggaccagaaacgccaagacgacgtattcccacttcacagcccacgacacgactcatatcagcagccagggcct

SEQ ID NO: 396677 - DNA, 140 bp, Artificial Sequence
  Synthetic
atacgccatgctgggtctcccctggtacattcgcggcaagtgtgcccctatcactctctatgctattctgcggatgtggcccttgctcctgctagtattggctctgcctcgtagggcatacgtacttgggagtcggccat

SEQ ID NO: 396678 - DNA, 140 bp, Artificial Sequence
  Synthetic
atggccgactcccaagtacgtatgccctacgaggcagagccaatactagcaggagcaagggccacatccgcagaatagcatagagagtgataggggcacacttgccgcgaatgtaccaggggagacccagcatggcgtat

SEQ ID NO: 396679 - DNA, 140 bp, Artificial Sequence
  Synthetic
atacgccatgctgggtctccacgctctggtggattcagtatttcattgcacgggcagaggccatcttgcatgtatgggtgcccccattgcaggttcgaggaggacgtgatgcggtgataccgtacttgggagtcggccat

SEQ ID NO: 396680 - DNA, 140 bp, Artificial Sequence
  Synthetic
atggccgactcccaagtacggtatcaccgcatcacgtcctcctcgaacctgcaatgggggcacccatacatgcaagatggcctctgcccgtgcaatgaaatactgaatccaccagagcgtggagacccagcatggcgtat

SEQ ID NO: 396681 - DNA, 140 bp, Artificial Sequence
  Synthetic
atacgccatgctgggtctcctgctcacctgcctactacacccacagttggggtttgaggttactaagatcattttagctctcatgggccccatctacattttgcagtacagcctgctcaacgtacttgggagtcggccat

SEQ ID NO: 396682 - DNA, 140 bp, Artificial Sequence
  Synthetic
atggccgactcccaagtacgttgagcaggctgtactgcaaaatgtagatggggcccatgagagctaaaatgatcttagtaacctcaaaccccaactgtgggtgtagtaggcaggtgagcaggagacccagcatggcgtat

SEQ ID NO: 396683 - DNA, 140 bp, Artificial Sequence
  Synthetic
aggccctggctgctgatatggccagacgcaggggtgacactcgcgcagcactcctcagcccaaggcctcttagtactttgaagggatcgtcaggcgggcccatgctgtgcccctcgggccgaccttttgggacagcggtg

SEQ ID NO: 396684 - DNA, 140 bp, Artificial Sequence
  Synthetic
caccgctgtcccaaaaggtcggcccgaggggcacagcatgggcccgcctgacgatcccttcaaagtactaagaggccttgggctgaggagtgctgcgcgagtgtcacccctgcgtctggccatatcagcagccagggcct

SEQ ID NO: 396685 - DNA, 140 bp, Artificial Sequence
  Synthetic
atacgccatgctgggtctccactgtttgcgcaagggccaaagccccccctccttcttgggacactatgtggaaatgccttattcgcctcaagcctatgcttacagggcctacccccttgccgtacttgggagtcggccat

SEQ ID NO: 396686 - DNA, 140 bp, Artificial Sequence
  Synthetic
atggccgactcccaagtacggcaagggggtaggccctgtaagcataggcttgaggcgaataaggcatttccacatagtgtcccaagaaggagggggggctttggcccttgcgcaaacagtggagacccagcatggcgtat

SEQ ID NO: 396687 - DNA, 140 bp, Artificial Sequence
  Synthetic
  misc_feature (75)..(75): n is a, c, g, or t
aggccctggctgctgatatgtgtctgtgggttgcgtagtgatctgcggtaggattaccaccactggcaagccagnaatcatccctgatcgagaggtgctctaccagcagtttgacgagatgaccttttgggacagcggtg

SEQ ID NO: 396688 - DNA, 140 bp, Artificial Sequence
  Synthetic
  misc_feature (66)..(66): n is a, c, g, or t
caccgctgtcccaaaaggtcatctcgtcaaactgctggtagagcacctctcgatcagggatgattnctggcttgccagtggtggtaatcctaccgcagatcactacgcaacccacagacacatatcagcagccagggcct

SEQ ID NO: 396689 - DNA, 140 bp, Artificial Sequence
  Synthetic
aggccctggctgctgatatggtggggaactgggcgaaggtcctggtagtgctgctgctatttgccggcgtcgacgcgggcacccacgtcactgggggaagcgacgcccgcgccacggccggaccttttgggacagcggtg

SEQ ID NO: 396690 - DNA, 140 bp, Artificial Sequence
  Synthetic
caccgctgtcccaaaaggtccggccgtggcgcgggcgtcgcttcccccagtgacgtgggtgcccgcgtcgacgccggcaaatagcagcagcactaccaggaccttcgcccagttccccaccatatcagcagccagggcct

SEQ ID NO: 396691 - DNA, 140 bp, Artificial Sequence
  Synthetic
atacgccatgctgggtctcctagcctccaaaccggctgggtagcagggcttttctatcgctccaatttcaactcttcgggctgttccgagaggttggctagctgccgaccccttgccgcccgtacttgggagtcggccat

SEQ ID NO: 396692 - DNA, 140 bp, Artificial Sequence
  Synthetic
atggccgactcccaagtacgggcggcaaggggtcggcagctagccaacctctcggaacagcccgaagagttgaaattggagcgatagaaaagccctgctacccagccggtttggaggctaggagacccagcatggcgtat

SEQ ID NO: 396693 - DNA, 140 bp, Artificial Sequence
  Synthetic
atacgccatgctgggtctccttctgattgtgatgctactttttgccggcgttgatggggggaacacccatgtgtcggggggggtgaccgcccgccaagcccacgggtttgcgtccctcttcgtacttgggagtcggccat

SEQ ID NO: 396694 - DNA, 140 bp, Artificial Sequence
  Synthetic
atggccgactcccaagtacgaagagggacgcaaacccgtgggcttggcgggcggtcaccccccccgacacatgggtgttccccccatcaacgccggcaaaaagtagcatcacaatcagaaggagacccagcatggcgtat

SEQ ID NO: 396695 - DNA, 140 bp, Artificial Sequence
  Synthetic
  misc_feature (37)..(37): n is a, c, g, or t
  misc_feature (50)..(50): n is a, c, g, or t
aggccctggctgctgatatgtcggcttgtggtctttnctcctcctagtcntagccttgccacagcaggcttatgctctggacgccaccgaacaaggggagttggggctggtcatattagcgaccttttgggacagcggtg

SEQ ID NO: 396696 - DNA, 140 bp, Artificial Sequence
  Synthetic
  misc_feature (91)..(91): n is a, c, g, or t
  misc_feature (104)..(104): n is a, c, g, or t
caccgctgtcccaaaaggtcgctaatatgaccagccccaactccccttgttcggtggcgtccagagcataagcctgctgtggcaaggctangactaggaggagnaaagaccacaagccgacatatcagcagccagggcct

SEQ ID NO: 396697 - DNA, 140 bp, Artificial Sequence
  Synthetic
atacgccatgctgggtctccgtcccatcacttatgctgaggatcacggctcggaccagaggccctactgctggcactacgcacctcgaaagtgtggtgttgtgcccgcgtcgcaggtgtgcgtacttgggagtcggccat

SEQ ID NO: 396698 - DNA, 140 bp, Artificial Sequence
  Synthetic
atggccgactcccaagtacgcacacctgcgacgcgggcacaacaccacactttcgaggtgcgtagtgccagcagtagggcctctggtccgagccgtgatcctcagcataagtgatgggacggagacccagcatggcgtat

SEQ ID NO: 396699 - DNA, 140 bp, Artificial Sequence
  Synthetic
atacgccatgctgggtctccgtcacactacatgtccatgtggtgctgacatagtcggccacgttaagaatggatccatgaggatctccggtccgcggtggtgcagtaacatctggcatggcgtacttgggagtcggccat

SEQ ID NO: 396700 - DNA, 140 bp, Artificial Sequence
  Synthetic
atggccgactcccaagtacgccatgccagatgttactgcaccaccgcggaccggagatcctcatggatccattcttaacgtggccgactatgtcagcaccacatggacatgtagtgtgacggagacccagcatggcgtat

SEQ ID NO: 396701 - DNA, 140 bp, Artificial Sequence
  Synthetic
atacgccatgctgggtctccagcccaactataagagggccctgtggagggtgtccgcagaggagtacgtcgaggtagtgaggatgggtgatagccacttcgtggtgggcgctacaaaccacgtacttgggagtcggccat

SEQ ID NO: 396702 - DNA, 140 bp, Artificial Sequence
  Synthetic
atggccgactcccaagtacgtggtttgtagcgcccaccacgaagtggctatcacccatcctcactacctcgacgtactcctctgcggacaccctccacagggccctcttatagttgggctggagacccagcatggcgtat

SEQ ID NO: 396703 - DNA, 140 bp, Artificial Sequence
  Synthetic
atacgccatgctgggtctccacccgcgtggagtctgagaataaggtcatcgttctcgactcattcgacccgctggtacctgaatatgatgacagagagccatctgtgcccgcggagtgcccgtacttgggagtcggccat

SEQ ID NO: 396704 - DNA, 140 bp, Artificial Sequence
  Synthetic
atggccgactcccaagtacgggcactccgcgggcacagatggctctctgtcatcatattcaggtaccagcgggtcgaatgagtcgagaacgatgaccttattctcagactccacgcgggtggagacccagcatggcgtat

SEQ ID NO: 396705 - DNA, 140 bp, Artificial Sequence
  Synthetic
aggccctggctgctgatatgcccgactttggtatttgacatcaccaaactactgctggccgtcttcggacccctttggattctccaagccagtttgctcaaagtaccctacttcgtgcgcgaccttttgggacagcggtg

SEQ ID NO: 396706 - DNA, 140 bp, Artificial Sequence
  Synthetic
caccgctgtcccaaaaggtcgcgcacgaagtagggtactttgagcaaactggcttggagaatccaaaggggtccgaagacggccagcagtagtttggtgatgtcaaataccaaagtcgggcatatcagcagccagggcct

SEQ ID NO: 396707 - DNA, 140 bp, Artificial Sequence
  Synthetic
atacgccatgctgggtctcccccaccgctggttcacgggtgcgccctgccccccgcagggcagcctccagtcccaccgcccaggaggaagaaagtggtgcacttggacgactccagcgtgcgtacttgggagtcggccat

SEQ ID NO: 396708 - DNA, 140 bp, Artificial Sequence
  Synthetic
atggccgactcccaagtacgcacgctggagtcgtccaagtgcaccactttcttcctcctgggcggtgggactggaggctgccctgcggggggcagggcgcacccgtgaaccagcggtgggggagacccagcatggcgtat

SEQ ID NO: 396709 - DNA, 140 bp, Artificial Sequence
  Synthetic
atacgccatgctgggtctccacccagatgttgagaaggccgatgccggctctgacgcggggtcctacagctctatgccgccacttgagggtgagccgggtgatccggaccttgattcgggcgtacttgggagtcggccat

SEQ ID NO: 396710 - DNA, 140 bp, Artificial Sequence
  Synthetic
atggccgactcccaagtacgcccgaatcaaggtccggatcacccggctcaccctcaagtggcggcatagagctgtaggaccccgcgtcagagccggcatcggccttctcaacatctgggtggagacccagcatggcgtat

SEQ ID NO: 396711 - DNA, 140 bp, Artificial Sequence
  Synthetic
aggccctggctgctgatatgctctatcttcctcttggctttgctgtcctgtttgaccatcccagcttccgcttacgaagtgcgcaacgtgtccggggtgtaccatgtcacgaacgactgcgaccttttgggacagcggtg

SEQ ID NO: 396712 - DNA, 140 bp, Artificial Sequence
  Synthetic
caccgctgtcccaaaaggtcgcagtcgttcgtgacatggtacaccccggacacgttgcgcacttcgtaagcggaagctgggatggtcaaacaggacagcaaagccaagaggaagatagagcatatcagcagccagggcct

SEQ ID NO: 396713 - DNA, 140 bp, Artificial Sequence
  Synthetic
atacgccatgctgggtctccgtgtgcgaaaagagggctttgtttgacgtcacccgcaagttgccagtcgctatcatgggagacgcttatggcttccaatactcacccaaacagcgggtggcgtacttgggagtcggccat

SEQ ID NO: 396714 - DNA, 140 bp, Artificial Sequence
  Synthetic
atggccgactcccaagtacgccacccgctgtttgggtgagtattggaagccataagcgtctcccatgatagcgactggcaacttgcgggtgacgtcaaacaaagccctcttttcgcacacggagacccagcatggcgtat

SEQ ID NO: 396715 - DNA, 140 bp, Artificial Sequence
  Synthetic
atacgccatgctgggtctccaccgtctgctcaaggtgtggcgctccaagaagacccctatggggttttcctatgacaccaggtgctttgactctacagtcactgagcatgacataaaaaccgtacttgggagtcggccat

SEQ ID NO: 396716 - DNA, 140 bp, Artificial Sequence
  Synthetic
atggccgactcccaagtacggtttttatgtcatgctcagtgactgtagagtcaaagcacctggtgtcataggaaaaccccataggggtcttcttggagcgccacaccttgagcagacggtggagacccagcatggcgtat

SEQ ID NO: 396717 - DNA, 140 bp, Artificial Sequence
  Synthetic
aggccctggctgctgatatgggccttgcctactattccatggtggggaactgggctaaggtcttgattgtgatgctactctttgccggcgttgacggggggggagggggtacccacgtgagaccttttgggacagcggtg

SEQ ID NO: 396718 - DNA, 140 bp, Artificial Sequence
  Synthetic
caccgctgtcccaaaaggtctcacgtgggtaccccctccccccccgtcaacgccggcaaagagtagcatcacaatcaagaccttagcccagttccccaccatggaatagtaggcaaggcccatatcagcagccagggcct

SEQ ID NO: 396719 - DNA, 140 bp, Artificial Sequence
  Synthetic
atacgccatgctgggtctcccggaggggttggcaacgacaccttgacctgccctacggattgcttccggaagcaccccgaggccacttacacaaaatgtggctcgggcccctggctgacacgtacttgggagtcggccat

SEQ ID NO: 396720 - DNA, 140 bp, Artificial Sequence
  Synthetic
atggccgactcccaagtacgtgtcagccaggggcccgagccacattttgtgtaagtggcctcggggtgcttccggaagcaatccgtagggcaggtcaaggtgtcgttgccaacccctccgggagacccagcatggcgtat

SEQ ID NO: 396721 - DNA, 140 bp, Artificial Sequence
  Synthetic
aggccctggctgctgatatgagcaccccgaggccacttacacaaaatgtggctcgggcccctggctgacacctaggtgcttggttgactacccatacagactttggcactacccttgcacgaccttttgggacagcggtg

SEQ ID NO: 396722 - DNA, 140 bp, Artificial Sequence
  Synthetic
caccgctgtcccaaaaggtcgtgcaagggtagtgccaaagtctgtatgggtagtcaaccaagcacctaggtgtcagccaggggcccgagccacattttgtgtaagtggcctcggggtgctcatatcagcagccagggcct

SEQ ID NO: 396723 - DNA, 140 bp, Artificial Sequence
  Synthetic
atacgccatgctgggtctccgccgcgcaggggccctagattgggtgtgcgcgcgacgaggaagacctccgaacggtcccagcccagaggtaggcgccagcccataccaaaggcgcgccagcgtacttgggagtcggccat

SEQ ID NO: 396724 - DNA, 140 bp, Artificial Sequence
  Synthetic
atggccgactcccaagtacgctggcgcgcctttggtatgggctggcgcctacctctgggctgggaccgttcggaggtcttcctcgtcgcgcgcacacccaatctagggcccctgcgcggcggagacccagcatggcgtat

SEQ ID NO: 396725 - DNA, 140 bp, Artificial Sequence
  Synthetic
aggccctggctgctgatatggcacatcaacaggactgccctaaattgcaatgactccctccacactgggttccttgccgcgctgttctacacacacaagttcaactcgtccgggtgcccggaccttttgggacagcggtg

SEQ ID NO: 396726 - DNA, 140 bp, Artificial Sequence
  Synthetic
caccgctgtcccaaaaggtccgggcacccggacgagttgaacttgtgtgtgtagaacagcgcggcaaggaacccagtgtggagggagtcattgcaatttagggcagtcctgttgatgtgccatatcagcagccagggcct

SEQ ID NO: 396727 - DNA, 140 bp, Artificial Sequence
  Synthetic
aggccctggctgctgatatggcctatttggctgtatcatcactagcctcacaggtcgggacaagaaccaggtcgagggggaggttcaggtggtctccaccgcaacgcagtctttcctggcgaccttttgggacagcggtg

SEQ ID NO: 396728 - DNA, 140 bp, Artificial Sequence
  Synthetic
caccgctgtcccaaaaggtcgccaggaaagactgcgttgcggtggagaccacctgaacctccccctcgacctggttcttgtcccgacctgtgaggctagtgatgatacagccaaataggccatatcagcagccagggcct

SEQ ID NO: 396729 - DNA, 140 bp, Artificial Sequence
  Synthetic
aggccctggctgctgatatgatgcggtctccggtcttcacggacaactcatctcccccggccgtaccgcaaacattccaagtggcccatctacacgctcccactggcagcggcaagagcagaccttttgggacagcggtg

SEQ ID NO: 396730 - DNA, 140 bp, Artificial Sequence
  Synthetic
caccgctgtcccaaaaggtctgctcttgccgctgccagtgggagcgtgtagatgggccacttggaatgtttgcggtacggccgggggagatgagttgtccgtgaagaccggagaccgcatcatatcagcagccagggcct

SEQ ID NO: 396731 - DNA, 140 bp, Artificial Sequence
  Synthetic
atacgccatgctgggtctccatggagtctcctcgacagtcgtgtcgtgggctgtgaagtgggaatacgtcgtcttggcgtttctggtcctagctgatgcacgggtttgtgcctgtttgtgcgtacttgggagtcggccat

SEQ ID NO: 396732 - DNA, 140 bp, Artificial Sequence
  Synthetic
atggccgactcccaagtacgcacaaacaggcacaaacccgtgcatcagctaggaccagaaacgccaagacgacgtattcccacttcacagcccacgacacgactgtcgaggagactccatggagacccagcatggcgtat

SEQ ID NO: 396733 - DNA, 140 bp, Artificial Sequence
  Synthetic
aggccctggctgctgatatgtcgaggaggttgctctgtccaccaccggagagatccctttttacggcaaggctatccccctcgaggtgatcaagggggggagacatctcatcttctgtcagaccttttgggacagcggtg

SEQ ID NO: 396734 - DNA, 140 bp, Artificial Sequence
  Synthetic
caccgctgtcccaaaaggtctgacagaagatgagatgtctcccccccttgatcacctcgagggggatagccttgccgtaaaaagggatctctccggtggtggacagagcaacctcctcgacatatcagcagccagggcct

SEQ ID NO: 396735 - DNA, 140 bp, Artificial Sequence
  Synthetic
aggccctggctgctgatatgctgttggcagcataggccttgggaaggtgcttgtggacatcctggcgggctatggagcgggggtggcaggcgcactcgtggcctttaaggtcatgagcgggaccttttgggacagcggtg

SEQ ID NO: 396736 - DNA, 140 bp, Artificial Sequence
  Synthetic
caccgctgtcccaaaaggtcccgctcatgaccttaaaggccacgagtgcgcctgccacccccgctccatagcccgccaggatgtccacaagcaccttcccaaggcctatgctgccaacagcatatcagcagccagggcct

SEQ ID NO: 396737 - DNA, 140 bp, Artificial Sequence
  Synthetic
atacgccatgctgggtctccccaccgcacgctctccttctttctcagacaatacaaccccacctgcagtcccacaaacataccaggtggggtatcttcatgcccctacaggtagtggtaacgtacttgggagtcggccat

SEQ ID NO: 396738 - DNA, 140 bp, Artificial Sequence
  Synthetic
atggccgactcccaagtacgttaccactacctgtaggggcatgaagataccccacctggtatgtttgtgggactgcaggtggggttgtattgtctgagaaagaaggagagcgtgcggtggggagacccagcatggcgtat

SEQ ID NO: 396739 - DNA, 140 bp, Artificial Sequence
  Synthetic
aggccctggctgctgatatgacactccggggtgtgtcccttgcgttcgcgagggtaacgcctcgaggtgttgggtggcggtgacccccacggtggccaccagggacggcaaactccccacgaccttttgggacagcggtg

SEQ ID NO: 396740 - DNA, 140 bp, Artificial Sequence
  Synthetic
caccgctgtcccaaaaggtcgtggggagtttgccgtccctggtggccaccgtgggggtcaccgccacccaacacctcgaggcgttaccctcgcgaacgcaagggacacaccccggagtgtcatatcagcagccagggcct

SEQ ID NO: 396741 - DNA, 140 bp, Artificial Sequence
  Synthetic
aggccctggctgctgatatgagggggtaggcacctgatcttctgtcattccaagaagaaatgcgatgagctagccaggcaacttacatctcttgggctcaatgcagtagcattctacagggaccttttgggacagcggtg

SEQ ID NO: 396742 - DNA, 140 bp, Artificial Sequence
  Synthetic
caccgctgtcccaaaaggtccctgtagaatgctactgcattgagcccaagagatgtaagttgcctggctagctcatcgcatttcttcttggaatgacagaagatcaggtgcctaccccctcatatcagcagccagggcct

SEQ ID NO: 396743 - DNA, 140 bp, Artificial Sequence
  Synthetic
atacgccatgctgggtctccgggggaactaccggccgcactgtgtctagttttactagtctcttcacccgaggcgcccagcagaacgtccaactgatcaacaccaacggcagttggcatacgtacttgggagtcggccat

SEQ ID NO: 396744 - DNA, 140 bp, Artificial Sequence
  Synthetic
atggccgactcccaagtacgtatgccaactgccgttggtgttgatcagttggacgttctgctgggcgcctcgggtgaagagactagtaaaactagacacagtgcggccggtagttcccccggagacccagcatggcgtat

SEQ ID NO: 396745 - DNA, 140 bp, Artificial Sequence
  Synthetic
aggccctggctgctgatatggcaattgctcaatctatcccggccacgtatcgggtcatcgcatggcttgggatatgatgatgaactggtcacctacagcagccttagtggtatcgcagttgaccttttgggacagcggtg

SEQ ID NO: 396746 - DNA, 140 bp, Artificial Sequence
  Synthetic
caccgctgtcccaaaaggtcaactgcgataccactaaggctgctgtaggtgaccagttcatcatcatatcccaagccatgcgatgacccgatacgtggccgggatagattgagcaattgccatatcagcagccagggcct

SEQ ID NO: 396747 - DNA, 140 bp, Artificial Sequence
  Synthetic
atacgccatgctgggtctccagcgcatggccagctgccgctccattgaccagtttgaccaggggtggggtcccatcacttacgccgagccgcccagctcggaccagaggccctattgctgcgtacttgggagtcggccat

SEQ ID NO: 396748 - DNA, 140 bp, Artificial Sequence
  Synthetic
atggccgactcccaagtacgcagcaatagggcctctggtccgagctgggcggctcggcgtaagtgatgggaccccacccctggtcaaactggtcaatggagcggcagctggccatgcgctggagacccagcatggcgtat

SEQ ID NO: 396749 - DNA, 140 bp, Artificial Sequence
  Synthetic
aggccctggctgctgatatggactccgacgctgagtcctgttcttccatgccccccctagagggggagcctggggatccggatctcagcgacgggtcatggtcgacggtcagtagtgggggaccttttgggacagcggtg

SEQ ID NO: 396750 - DNA, 140 bp, Artificial Sequence
  Synthetic
caccgctgtcccaaaaggtcccccactactgaccgtcgaccatgacccgtcgctgagatccggatccccaggctccccctctagggggggcatggaagaacaggactcagcgtcggagtccatatcagcagccagggcct

SEQ ID NO: 396751 - DNA, 140 bp, Artificial Sequence
  Synthetic
aggccctggctgctgatatggtgcatgccgatgcggatctgatagaagcaaacttgttgtggaggcaagaagtggggggcaacatcacccgcgtggagtctgagaataaggtcatcgttcgaccttttgggacagcggtg

SEQ ID NO: 396752 - DNA, 140 bp, Artificial Sequence
  Synthetic
caccgctgtcccaaaaggtcgaacgatgaccttattctcagactccacgcgggtgatgttgccccccacttcttgcctccacaacaagtttgcttctatcagatccgcatcggcatgcaccatatcagcagccagggcct

SEQ ID NO: 396753 - DNA, 140 bp, Artificial Sequence
  Synthetic
atacgccatgctgggtctccctagcataatcaaagtgccgtactttgtacgtgcccacgggctcattcgtgcatgcatgctggtgcggaagatcgctgggggtcactatgtccaaatggccgtacttgggagtcggccat

SEQ ID NO: 396754 - DNA, 140 bp, Artificial Sequence
  Synthetic
atggccgactcccaagtacggccatttggacatagtgacccccagcgatcttccgcaccagcatgcatgcacgaatgagcccgtgggcacgtacaaagtacggcactttgattatgctagggagacccagcatggcgtat

SEQ ID NO: 396755 - DNA, 140 bp, Artificial Sequence
  Synthetic
atacgccatgctgggtctcccacccagtcaccaaatacatcatgacatgcatgtcggctgacctggaggtcgtcacgagcacctgggtgctcgttggcggcgtcctggctgctttggccgcgtacttgggagtcggccat

SEQ ID NO: 396756 - DNA, 140 bp, Artificial Sequence
  Synthetic
atggccgactcccaagtacgcggccaaagcagccaggacgccgccaacgagcacccaggtgctcgtgacgacctccaggtcagccgacatgcatgtcatgatgtatttggtgactgggtgggagacccagcatggcgtat

SEQ ID NO: 396757 - DNA, 140 bp, Artificial Sequence
  Synthetic
atacgccatgctgggtctccccagggagggaacgcagcgatttgcggcaagtacctctttaattgggcggtaaggactaagctcaaactcactccattgcctggcgcagccaacctcgaccgtacttgggagtcggccat

SEQ ID NO: 396758 - DNA, 140 bp, Artificial Sequence
  Synthetic
atggccgactcccaagtacggtcgaggttggctgcgccaggcaatggagtgagtttgagcttagtccttaccgcccaattaaagaggtacttgccgcaaatcgctgcgttccctccctggggagacccagcatggcgtat

SEQ ID NO: 396759 - DNA, 140 bp, Artificial Sequence
  Synthetic
atacgccatgctgggtctccggttcggttgcacctggatgaactcaaccggattcaccaaagtgtgcggagcgcccccttgcgctatcggaggggtgggcaacaacaccttgctctgccccgtacttgggagtcggccat

SEQ ID NO: 396760 - DNA, 140 bp, Artificial Sequence
  Synthetic
atggccgactcccaagtacggggcagagcaaggtgttgttgcccacccctccgatagcgcaagggggcgctccgcacactttggtgaatccggttgagttcatccaggtgcaaccgaaccggagacccagcatggcgtat

SEQ ID NO: 396761 - DNA, 140 bp, Artificial Sequence
  Synthetic
atacgccatgctgggtctcccccaactggggccccaatgacccccggcggaggtcacgtaacttgggtaaggtcatcgataccctaacctgtggcttcgccgacctcatggggtacattccgtacttgggagtcggccat

SEQ ID NO: 396762 - DNA, 140 bp, Artificial Sequence
  Synthetic
atggccgactcccaagtacggaatgtaccccatgaggtcggcgaagccacaggttagggtatcgatgaccttacccaagttacgtgacctccgccgggggtcattggggccccagttgggggagacccagcatggcgtat

SEQ ID NO: 396763 - DNA, 140 bp, Artificial Sequence
  Synthetic
atacgccatgctgggtctccttgctccttttctatcttcctcttggcacttctctcgtgcctcactacacctgcctcggcagtccattataggaacatctctggtatttaccatctcacccgtacttgggagtcggccat

SEQ ID NO: 396764 - DNA, 140 bp, Artificial Sequence
  Synthetic
atggccgactcccaagtacgggtgagatggtaaataccagagatgttcctataatggactgccgaggcaggtgtagtgaggcacgagagaagtgccaagaggaagatagaaaaggagcaaggagacccagcatggcgtat

SEQ ID NO: 396765 - DNA, 140 bp, Artificial Sequence
  Synthetic
aggccctggctgctgatatgctggaggacggcgtgaactatgcaacagggaatttgcccggttgctctttctctatcttcctcttggctttgctgtcctgtttgaccatcccagcttccggaccttttgggacagcggtg

SEQ ID NO: 396766 - DNA, 140 bp, Artificial Sequence
  Synthetic
caccgctgtcccaaaaggtccggaagctgggatggtcaaacaggacagcaaagccaagaggaagatagagaaagagcaaccgggcaaattccctgttgcatagttcacgccgtcctccagcatatcagcagccagggcct

SEQ ID NO: 396767 - DNA, 140 bp, Artificial Sequence
  Synthetic
atacgccatgctgggtctccgttgggtgccagtagcacccacccttgctgtcgcgaacgcctctgttcctataagagggttccgcagtcatgtggaccttctggttggttcagcggccgccgtacttgggagtcggccat

SEQ ID NO: 396768 - DNA, 140 bp, Artificial Sequence
  Synthetic
atggccgactcccaagtacggcggccgctgaaccaaccagaaggtccacatgactgcggaaccctcttataggaacagaggcgttcgcgacagcaagggtgggtgctactggcacccaacggagacccagcatggcgtat

SEQ ID NO: 396769 - DNA, 140 bp, Artificial Sequence
  Synthetic
atacgccatgctgggtctccaactgttccatctacaccgggcatattacggggcacaggatggcatgggacatgatgatgaactggtcccccaccgtgactttcatcacctcttcgctgccgtacttgggagtcggccat

SEQ ID NO: 396770 - DNA, 140 bp, Artificial Sequence
  Synthetic
atggccgactcccaagtacggcagcgaagaggtgatgaaagtcacggtgggggaccagttcatcatcatgtcccatgccatcctgtgccccgtaatatgcccggtgtagatggaacagttggagacccagcatggcgtat

SEQ ID NO: 396771 - DNA, 140 bp, Artificial Sequence
  Synthetic
atacgccatgctgggtctccctttgccgtcttgctcctctttgccggggttgatgccactactcacattggtagtagtgcgtctgctacaacaaacagacttactagttttttcagcccccgtacttgggagtcggccat

SEQ ID NO: 396772 - DNA, 140 bp, Artificial Sequence
  Synthetic
atggccgactcccaagtacgggggctgaaaaaactagtaagtctgtttgttgtagcagacgcactactaccaatgtgagtagtggcatcaaccccggcaaagaggagcaagacggcaaagggagacccagcatggcgtat

SEQ ID NO: 396773 - DNA, 140 bp, Artificial Sequence
  Synthetic
atacgccatgctgggtctccctggtttgctttatgctcataggttcaactcttccggttgtcctgagcgcttgagcagctgtcggccactccacgcattcgagcagggttggggtcctctcgtacttgggagtcggccat

SEQ ID NO: 396774 - DNA, 140 bp, Artificial Sequence
  Synthetic
atggccgactcccaagtacgagaggaccccaaccctgctcgaatgcgtggagtggccgacagctgctcaagcgctcaggacaaccggaagagttgaacctatgagcataaagcaaaccagggagacccagcatggcgtat

SEQ ID NO: 396775 - DNA, 140 bp, Artificial Sequence
  Synthetic
atacgccatgctgggtctccgactgctctgaactgcaatgactccctccagacggggtttattgccgcactgttctacacacacaggttcaacgactctgggtgcacagagcgtttggcccgtacttgggagtcggccat

SEQ ID NO: 396776 - DNA, 140 bp, Artificial Sequence
  Synthetic
atggccgactcccaagtacgggccaaacgctctgtgcacccagagtcgttgaacctgtgtgtgtagaacagtgcggcaataaaccccgtctggagggagtcattgcagttcagagcagtcggagacccagcatggcgtat

SEQ ID NO: 396777 - DNA, 140 bp, Artificial Sequence
  Synthetic
atacgccatgctgggtctccccggtatattgcttcacacccagccctgtagtagtcggtactacagaccggaaagggctccccacatacacctggggggcaaatgagtctgatgtgttcccgtacttgggagtcggccat

SEQ ID NO: 396778 - DNA, 140 bp, Artificial Sequence
  Synthetic
atggccgactcccaagtacgggaacacatcagactcatttgccccccaggtgtatgtggggagccctttccggtctgtagtaccgactactacagggctgggtgtgaagcaatataccggggagacccagcatggcgtat

SEQ ID NO: 396779 - DNA, 140 bp, Artificial Sequence
  Synthetic
atacgccatgctgggtctcccaggccggtaggcagtggtaatgacaccttggtgtgtcctaccgactgtttccggaagcacccagaagccacatatgcgaggtgtgggtcaggcccttggcgtacttgggagtcggccat

SEQ ID NO: 396780 - DNA, 140 bp, Artificial Sequence
  Synthetic
atggccgactcccaagtacgccaagggcctgacccacacctcgcatatgtggcttctgggtgcttccggaaacagtcggtaggacacaccaaggtgtcattaccactgcctaccggcctgggagacccagcatggcgtat

SEQ ID NO: 396781 - DNA, 140 bp, Artificial Sequence
  Synthetic
atacgccatgctgggtctccttgagcatcggtttgaagctgcttgcaactggactcgtggggaacggtgcgagctggatgatagagacagggttgagatgagtccactgctgttttcaaccgtacttgggagtcggccat

SEQ ID NO: 396782 - DNA, 140 bp, Artificial Sequence
  Synthetic
atggccgactcccaagtacggttgaaaacagcagtggactcatctcaaccctgtctctatcatccagctcgcaccgttccccacgagtccagttgcaagcagcttcaaaccgatgctcaaggagacccagcatggcgtat

SEQ ID NO: 396783 - DNA, 140 bp, Artificial Sequence
  Synthetic
atacgccatgctgggtctcctatggagtctcttcggccgtagtgtcgtgggctgtgaagtgggaatacatcgtcttagcgttcttggtgttagctgttgcaagggtgtgcgcttgtctgtcgtacttgggagtcggccat

SEQ ID NO: 396784 - DNA, 140 bp, Artificial Sequence
  Synthetic
atggccgactcccaagtacgacagacaagcgcacacccttgcaacagctaacaccaagaacgctaagacgatgtattcccacttcacagcccacgacactacggccgaagagactccataggagacccagcatggcgtat

SEQ ID NO: 396785 - DNA, 140 bp, Artificial Sequence
  Synthetic
aggccctggctgctgatatgaactactgtcttcacgcagaaagcgtctagccatggcgttagtatgagtgtcgtacagcctccaggaccccccctcccgggagagccatagtggtctgcggaccttttgggacagcggtg

SEQ ID NO: 396786 - DNA, 140 bp, Artificial Sequence
  Synthetic
caccgctgtcccaaaaggtccgcagaccactatggctctcccgggagggggggtcctggaggctgtacgacactcatactaacgccatggctagacgctttctgcgtgaagacagtagttcatatcagcagccagggcct

SEQ ID NO: 396787 - DNA, 140 bp, Artificial Sequence
  Synthetic
atacgccatgctgggtctccggtctttatctgtgccgcctggtacatccgcggcagagctgcccccataactacctatgccatattgcagttgtggcccctccttttgttagtattggctcgtacttgggagtcggccat

SEQ ID NO: 396788 - DNA, 140 bp, Artificial Sequence
  Synthetic
atggccgactcccaagtacgagccaatactaacaaaaggaggggccacaactgcaatatggcataggtagttatgggggcagctctgccgcggatgtaccaggcggcacagataaagaccggagacccagcatggcgtat

SEQ ID NO: 396789 - DNA, 140 bp, Artificial Sequence
  Synthetic
atacgccatgctgggtctccagaccctcctcataagcacgctctggtggattcaatattacatcgcacgtgcagaggccatgttatatgtttgggtgccttcgctgcaggttcgcggtggcgtacttgggagtcggccat

SEQ ID NO: 396790 - DNA, 140 bp, Artificial Sequence
  Synthetic
atggccgactcccaagtacgccaccgcgaacctgcagcgaaggcacccaaacatataacatggcctctgcacgtgcgatgtaatattgaatccaccagagcgtgcttatgaggagggtctggagacccagcatggcgtat

SEQ ID NO: 396791 - DNA, 140 bp, Artificial Sequence
  Synthetic
atacgccatgctgggtctcccagtacagcctgcttaagacgccatatttcgtgcgagcgcacattctcctgcgcgtttgcatgttccttcgtggcgtcgcaggcggaaaatacgtccaggcgtacttgggagtcggccat

SEQ ID NO: 396792 - DNA, 140 bp, Artificial Sequence
  Synthetic
atggccgactcccaagtacgcctggacgtattttccgcctgcgacgccacgaaggaacatgcaaacgcgcaggagaatgtgcgctcgcacgaaatatggcgtcttaagcaggctgtactgggagacccagcatggcgtat

SEQ ID NO: 396793 - DNA, 140 bp, Artificial Sequence
  Synthetic
atacgccatgctgggtctcccgccgttgagcccgttgtcttctcccctatggagaagaaagtcatcacctggggtgccgacacggtcgcgtgcggcgatattatatctgggctcccagtacgtacttgggagtcggccat

SEQ ID NO: 396794 - DNA, 140 bp, Artificial Sequence
  Synthetic
atggccgactcccaagtacgtactgggagcccagatataatatcgccgcacgcgaccgtgtcggcaccccaggtgatgactttcttctccataggggagaagacaacgggctcaacggcgggagacccagcatggcgtat

SEQ ID NO: 396795 - DNA, 140 bp, Artificial Sequence
  Synthetic
atacgccatgctgggtctccccagaggcttagtgggaacaatcgtcaccagcctcacgggccgcgacaaaaatgaggtggagggggaaattcaggtcgtgtccactgccacgcaatctttcgtacttgggagtcggccat

SEQ ID NO: 396796 - DNA, 140 bp, Artificial Sequence
  Synthetic
atggccgactcccaagtacgaaagattgcgtggcagtggacacgacctgaatttccccctccacctcatttttgtcgcggcccgtgaggctggtgacgattgttcccactaagcctctggggagacccagcatggcgtat

SEQ ID NO: 396797 - DNA, 140 bp, Artificial Sequence
  Synthetic
atacgccatgctgggtctccaatgttgaccaggacctggtgggttggccagcgccacctggggcccgttcactcactccatgcacttgtggctcaagtgacctatatcttgtgacaaggacgtacttgggagtcggccat

SEQ ID NO: 396798 - DNA, 140 bp, Artificial Sequence
  Synthetic
atggccgactcccaagtacgtccttgtcacaagatataggtcacttgagccacaagtgcatggagtgagtgaacgggccccaggtggcgctggccaacccaccaggtcctggtcaacattggagacccagcatggcgtat

SEQ ID NO: 396799 - DNA, 140 bp, Artificial Sequence
  Synthetic
atacgccatgctgggtctccgctgtgtccctcgggtcatgttgctgggatcttccgcgcagcagtgtgcactagaggtgtggcaaaatcccttgattttgtgccagtggagaacatgcagcgtacttgggagtcggccat

SEQ ID NO: 396800 - DNA, 140 bp, Artificial Sequence
  Synthetic
atggccgactcccaagtacgctgcatgttctccactggcacaaaatcaagggattttgccacacctctagtgcacactgctgcgcggaagatcccagcaacatgacccgagggacacagcggagacccagcatggcgtat

SEQ ID NO: 396801 - DNA, 140 bp, Artificial Sequence
  Synthetic
atacgccatgctgggtctccaaagcactaaagtcccagcggcatatgctgctcagggctataaggttctagtgcttaacccctctgtagcggccacccttgggttcgggtcatacatgtccgtacttgggagtcggccat

SEQ ID NO: 396802 - DNA, 140 bp, Artificial Sequence
  Synthetic
atggccgactcccaagtacggacatgtatgacccgaacccaagggtggccgctacagaggggttaagcactagaaccttatagccctgagcagcatatgccgctgggactttagtgctttggagacccagcatggcgtat

SEQ ID NO: 396803 - DNA, 140 bp, Artificial Sequence
  Synthetic
atacgccatgctgggtctccgcacatcaacagtacggccctgaactgcaatgctagcctcgaaactggctggatagcaggtctcttctactaccacaggttcaactcttcaggctgtccccgtacttgggagtcggccat

SEQ ID NO: 396804 - DNA, 140 bp, Artificial Sequence
  Synthetic
atggccgactcccaagtacggggacagcctgaagagttgaacctgtggtagtagaagagacctgctatccagccagtttcgaggctagcattgcagttcagggccgtactgttgatgtgcggagacccagcatggcgtat

SEQ ID NO: 396805 - DNA, 140 bp, Artificial Sequence
  Synthetic
atacgccatgctgggtctccggcggctgctccggcggcgcttatgacatcattatctgcgatgagtgccattcaacagatcctaccacagtcttgggtataggcaccgtgttggatcaggcgtacttgggagtcggccat

SEQ ID NO: 396806 - DNA, 140 bp, Artificial Sequence
  Synthetic
atggccgactcccaagtacgcctgatccaacacggtgcctatacccaagactgtggtaggatctgttgaatggcactcatcgcagataatgatgtcataagcgccgccggagcagccgccggagacccagcatggcgtat

SEQ ID NO: 396807 - DNA, 140 bp, Artificial Sequence
  Synthetic
atacgccatgctgggtctcctaccggtgaggtgcctttctacgggaaggcaatcccccttgagtatatcaaggggggtagacacctgattttctgccactctaaaaagaagtgcgacgagcgtacttgggagtcggccat

SEQ ID NO: 396808 - DNA, 140 bp, Artificial Sequence
  Synthetic
atggccgactcccaagtacgctcgtcgcacttctttttagagtggcagaaaatcaggtgtctaccccccttgatatactcaagggggattgccttcccgtagaaaggcacctcaccggtaggagacccagcatggcgtat

SEQ ID NO: 396809 - DNA, 140 bp, Artificial Sequence
  Synthetic
atacgccatgctgggtctccctaccgacgcccttatgactggctatacaggagactttgactcggtgattgactgtaatgtttctgtcactcaggttgttgatttcagccttgacccaaccgtacttgggagtcggccat

SEQ ID NO: 396810 - DNA, 140 bp, Artificial Sequence
  Synthetic
atggccgactcccaagtacggttgggtcaaggctgaaatcaacaacctgagtgacagaaacattacagtcaatcaccgagtcaaagtctcctgtatagccagtcataagggcgtcggtagggagacccagcatggcgtat

SEQ ID NO: 396811 - DNA, 140 bp, Artificial Sequence
  Synthetic
atacgccatgctgggtctcctcgcagggcgaacggccgtcgggtatcttcgacaccgttgttctgtgcgaggcgtacgacacaggttgcgcatggtatgaactgactccatctgagacgacgtacttgggagtcggccat

SEQ ID NO: 396812 - DNA, 140 bp, Artificial Sequence
  Synthetic
atggccgactcccaagtacgtcgtctcagatggagtcagttcataccatgcgcaacctgtgtcgtacgcctcgcacagaacaacggtgtcgaagatacccgacggccgttcgccctgcgaggagacccagcatggcgtat

SEQ ID NO: 396813 - DNA, 140 bp, Artificial Sequence
  Synthetic
atacgccatgctgggtctcctgcccacctcctttcacagacgaagcaggggggagaaaatttcgcgtacctcgtagcctaccaggctactgtatgcgcgagagccaaagctccccccccccgtacttgggagtcggccat

SEQ ID NO: 396814 - DNA, 140 bp, Artificial Sequence
  Synthetic
atggccgactcccaagtacggggggggggagctttggctctcgcgcatacagtagcctggtaggctacgaggtacgcgaaattttctcccccctgcttcgtctgtgaaaggaggtgggcaggagacccagcatggcgtat

SEQ ID NO: 396815 - DNA, 140 bp, Artificial Sequence
  Synthetic
aggccctggctgctgatatgtaggactccacgagtacccggtggggtcgcaattaccttgcgagcccgaaccggacgtggccgtgttgacgtccatgctcactgatccctcccatataacgaccttttgggacagcggtg

SEQ ID NO: 396816 - DNA, 140 bp, Artificial Sequence
  Synthetic
caccgctgtcccaaaaggtcgttatatgggagggatcagtgagcatggacgtcaacacggccacgtccggttcgggctcgcaaggtaattgcgaccccaccgggtactcgtggagtcctacatatcagcagccagggcct

SEQ ID NO: 396817 - DNA, 140 bp, Artificial Sequence
  Synthetic
atacgccatgctgggtctccctacgacacacccgatcacaaagtacatcatgacctgcatgtctgcggacttggaagttataaccagtacctgggttctggtgggtggggtcctcgcggccgtacttgggagtcggccat

SEQ ID NO: 396818 - DNA, 140 bp, Artificial Sequence
  Synthetic
atggccgactcccaagtacggccgcgaggaccccacccaccagaacccaggtactggttataacttccaagtccgcagacatgcaggtcatgatgtactttgtgatcgggtgtgtcgtagggagacccagcatggcgtat

SEQ ID NO: 396819 - DNA, 140 bp, Artificial Sequence
  Synthetic
aggccctggctgctgatatggtccagtgtattgcttcaccccaagccctgttgtggtggggacgaccgatcggttcggcgtccctacgtacagctggggggagaatgagacggacgtgctgaccttttgggacagcggtg

SEQ ID NO: 396820 - DNA, 140 bp, Artificial Sequence
  Synthetic
caccgctgtcccaaaaggtcagcacgtccgtctcattctccccccagctgtacgtagggacgccgaaccgatcggtcgtccccaccacaacagggcttggggtgaagcaatacactggaccatatcagcagccagggcct

SEQ ID NO: 396821 - DNA, 140 bp, Artificial Sequence
  Synthetic
atacgccatgctgggtctcccaacaattcgatgagatggaggagtgttccagacacatcccctacctcgtcgaaggtcaacaccttgcagagcagttcaaacaaaaagtccttggcctcacgtacttgggagtcggccat

SEQ ID NO: 396822 - DNA, 140 bp, Artificial Sequence
  Synthetic
atggccgactcccaagtacgtgaggccaaggactttttgtttgaactgctctgcaaggtgttgaccttcgacgaggtaggggatgtgtctggaacactcctccatctcatcgaattgttgggagacccagcatggcgtat

SEQ ID NO: 396823 - DNA, 140 bp, Artificial Sequence
  Synthetic
atacgccatgctgggtctccgagtggcatacaatatttggctggcctatccacgctaccaggcaacccggcggtagcttcactgatgtcattctcagcctccttgactagcccactgtcacgtacttgggagtcggccat

SEQ ID NO: 396824 - DNA, 140 bp, Artificial Sequence
  Synthetic
atggccgactcccaagtacgtgacagtgggctagtcaaggaggctgagaatgacatcagtgaagctaccgccgggttgcctggtagcgtggataggccagccaaatattgtatgccactcggagacccagcatggcgtat

SEQ ID NO: 396825 - DNA, 140 bp, Artificial Sequence
  Synthetic
aggccctggctgctgatatgtggaggacagggacagatcagagcttagcccgctgctgctgtctacgacagagtggcagatattgccctgctccttcactaccctgccggctctgtccacgaccttttgggacagcggtg

SEQ ID NO: 396826 - DNA, 140 bp, Artificial Sequence
  Synthetic
caccgctgtcccaaaaggtcgtggacagagccggcagggtagtgaaggagcagggcaatatctgccactctgtcgtagacagcagcagcgggctaagctctgatctgtccctgtcctccacatatcagcagccagggcct

SEQ ID NO: 396827 - DNA, 140 bp, Artificial Sequence
  Synthetic
atacgccatgctgggtctccgcgccacagtcggcagtattggccttgggagagtcctagtggacataattgccggctatggagcgggtgtgtcaggagcgctcgtcgcctttaaaatcatcgtacttgggagtcggccat

SEQ ID NO: 396828 - DNA, 140 bp, Artificial Sequence
  Synthetic
atggccgactcccaagtacgatgattttaaaggcgacgagcgctcctgacacacccgctccatagccggcaattatgtccactaggactctcccaaggccaatactgccgactgtggcgcggagacccagcatggcgtat

SEQ ID NO: 396829 - DNA, 140 bp, Artificial Sequence
  Synthetic
atacgccatgctgggtctccagacgccacgccgggcccgctgagggggccacgcaatggatgaaccgactgatagcgtttgcctccagaggtaatcatgtgtcgcccactcactacgtgccgtacttgggagtcggccat

SEQ ID NO: 396830 - DNA, 140 bp, Artificial Sequence
  Synthetic
atggccgactcccaagtacggcacgtagtgagtgggcgacacatgattacctctggaggcaaacgctatcagtcggttcatccattgcgtggccccctcagcgggcccggcgtggcgtctggagacccagcatggcgtat

SEQ ID NO: 396831 - DNA, 140 bp, Artificial Sequence
  Synthetic
atacgccatgctgggtctcctactccatgctctgggtcatggttacgagacatctgggactgggtgtgtactgtcctctctgacttcaaagtctggctcaaatccaaacttgtgccagcacgtacttgggagtcggccat

SEQ ID NO: 396832 - DNA, 140 bp, Artificial Sequence
  Synthetic
atggccgactcccaagtacgtgctggcacaagtttggatttgagccagactttgaagtcagagaggacagtacacacccagtcccagatgtctcgtaaccatgacccagagcatggagtaggagacccagcatggcgtat

SEQ ID NO: 396833 - DNA, 140 bp, Artificial Sequence
  Synthetic
atacgccatgctgggtctccttggccacgtcaagaatgggtccatgaggatttcggggtcgcggtggtgtagtaacatctggcatggcaccttccccatcaacgcgacaacgactggtcccgtacttgggagtcggccat

SEQ ID NO: 396834 - DNA, 140 bp, Artificial Sequence
  Synthetic
atggccgactcccaagtacgggaccagtcgttgtcgcgttgatggggaaggtgccatgccagatgttactacaccaccgcgaccccgaaatcctcatggacccattcttgacgtggccaaggagacccagcatggcgtat

SEQ ID NO: 396835 - DNA, 140 bp, Artificial Sequence
  Synthetic
aggccctggctgctgatatgctggcataactaaggtgccgtactttgtacgtgcccacgggctcattcgtgcatgcatgttggtgcggaaagtcgccgggggtcattatgttcaaatggcgaccttttgggacagcggtg

SEQ ID NO: 396836 - DNA, 140 bp, Artificial Sequence
  Synthetic
caccgctgtcccaaaaggtcgccatttgaacataatgacccccggcgactttccgcaccaacatgcatgcacgaatgagcccgtgggcacgtacaaagtacggcaccttagttatgccagcatatcagcagccagggcct

SEQ ID NO: 396837 - DNA, 140 bp, Artificial Sequence
  Synthetic
atacgccatgctgggtctccgtgggtgccaccaaccaagacctcaaatgtccttgccaggtaccagccccagaattcttcactgaagtagacggcgtacggttgcaccgtttcgcacctgcgtacttgggagtcggccat

SEQ ID NO: 396838 - DNA, 140 bp, Artificial Sequence
  Synthetic
atggccgactcccaagtacgcaggtgcgaaacggtgcaaccgtacgccgtctacttcagtgaagaattctggggctggtacctggcaaggacatttgaggtcttggttggtggcacccacggagacccagcatggcgtat

SEQ ID NO: 396839 - DNA, 140 bp, Artificial Sequence
  Synthetic
atacgccatgctgggtctccagtggttacatcaatgctagtcgacccatcgcacttaactgcagaggctgctgctcgccgccttgcgcgtgggtcccccccgtcctgtgctagctcattacgtacttgggagtcggccat

SEQ ID NO: 396840 - DNA, 140 bp, Artificial Sequence
  Synthetic
atggccgactcccaagtacgtaatgagctagcacaggacgggggggacccacgcgcaaggcggcgagcagcagcctctgcagttaagtgcgatgggtcgactagcattgatgtaaccactggagacccagcatggcgtat

SEQ ID NO: 396841 - DNA, 140 bp, Artificial Sequence
  Synthetic
aggccctggctgctgatatgcctgtcgactggccttctccacctccaccaaaacatcgtggacgtacaatacatgtatggcctgtcgcctgccctcacaaaatacgtcgtccgatgggaggaccttttgggacagcggtg

SEQ ID NO: 396842 - DNA, 140 bp, Artificial Sequence
  Synthetic
caccgctgtcccaaaaggtcctcccatcggacgacgtattttgtgagggcaggcgacaggccatacatgtattgtacgtccacgatgttttggtggaggtggagaaggccagtcgacaggcatatcagcagccagggcct

SEQ ID NO: 396843 - DNA, 140 bp, Artificial Sequence
  Synthetic
atacgccatgctgggtctccaagtaggaggcaatatcacccgggtggagtctgagaacaaagtcatcgttctcgactcttttgaccctctggtgcctgaatatgatgacagagaaccatccgtacttgggagtcggccat

SEQ ID NO: 396844 - DNA, 140 bp, Artificial Sequence
  Synthetic
atggccgactcccaagtacggatggttctctgtcatcatattcaggcaccagagggtcaaaagagtcgagaacgatgactttgttctcagactccacccgggtgatattgcctcctacttggagacccagcatggcgtat

SEQ ID NO: 396845 - DNA, 140 bp, Artificial Sequence
  Synthetic
atacgccatgctgggtctccaagaaaccagactatgccccaccgctggttcacgggtgcgctttgccctctccagtgcaacctccagttccaccgccaaggaggaaaagcgtggtgcacccgtacttgggagtcggccat

SEQ ID NO: 396846 - DNA, 140 bp, Artificial Sequence
  Synthetic
atggccgactcccaagtacgggtgcaccacgcttttcctccttggcggtggaactggaggttgcactggagagggcaaagcgcacccgtgaaccagcggtggggcatagtctggtttcttggagacccagcatggcgtat

SEQ ID NO: 396847 - DNA, 140 bp, Artificial Sequence
  Synthetic
atacgccatgctgggtctcccaccagcaagagctcagaccaagcagatgagggggaagacaccccttctgaagcagggtcttacagctctatgccaccgcttgagggtgaaccaggtgaccgtacttgggagtcggccat

SEQ ID NO: 396848 - DNA, 140 bp, Artificial Sequence
  Synthetic
atggccgactcccaagtacggtcacctggttcaccctcaagcggtggcatagagctgtaagaccctgcttcagaaggggtgtcttccccctcatctgcttggtctgagctcttgctggtgggagacccagcatggcgtat

SEQ ID NO: 396849 - DNA, 140 bp, Artificial Sequence
  Synthetic
atacgccatgctgggtctcccatgcgcagccgaagaggagaagctgcctatcaatcctctaagcaattccctcattcgacaccacaatttggtgtactccactacaactcggagtgctgccgtacttgggagtcggccat

SEQ ID NO: 396850 - DNA, 140 bp, Artificial Sequence
  Synthetic
atggccgactcccaagtacggcagcactccgagttgtagtggagtacaccaaattgtggtgtcgaatgagggaattgcttagaggattgataggcagcttctcctcttcggctgcgcatgggagacccagcatggcgtat

SEQ ID NO: 396851 - DNA, 140 bp, Artificial Sequence
  Synthetic
atacgccatgctgggtctccgatgcggcaaaagaaggtcactttcgaccgattacagattctggaccaacactacaacaatgtagtgaaggaggtgaaactccgggcctcaggggtgacgcgtacttgggagtcggccat

SEQ ID NO: 396852 - DNA, 140 bp, Artificial Sequence
  Synthetic
atggccgactcccaagtacgcgtcacccctgaggcccggagtttcacctccttcactacattgttgtagtgttggtccagaatctgtaatcggtcgaaagtgaccttcttttgccgcatcggagacccagcatggcgtat

SEQ ID NO: 396853 - DNA, 140 bp, Artificial Sequence
  Synthetic
aggccctggctgctgatatggcaaggccattaaccacatcaactccgtgtgggaggacttgttagaagacaaccaaacaccaattcctacaaccatcatggcgaaaaatgaagtgttttggaccttttgggacagcggtg

SEQ ID NO: 396854 - DNA, 140 bp, Artificial Sequence
  Synthetic
caccgctgtcccaaaaggtccaaaacacttcatttttcgccatgatggttgtaggaattggtgtttggttgtcttctaacaagtcctcccacacggagttgatgtggttaatggccttgccatatcagcagccagggcct

SEQ ID NO: 396855 - DNA, 140 bp, Artificial Sequence
  Synthetic
atacgccatgctgggtctcccgcaaactaccaacagccatcatgggagatgcctacggctttcaatactcacccaaacaacgggtagaccaactgctcaagatgtggcgttccaagaagacgtacttgggagtcggccat

SEQ ID NO: 396856 - DNA, 140 bp, Artificial Sequence
  Synthetic
atggccgactcccaagtacgtcttcttggaacgccacatcttgagcagttggtctacccgttgtttgggtgagtattgaaagccgtaggcatctcccatgatggctgttggtagtttgcgggagacccagcatggcgtat

SEQ ID NO: 396857 - DNA, 140 bp, Artificial Sequence
  Synthetic
atacgccatgctgggtctccccctgtggctaggaaagccatagagtctctcaccgagaggctctatattggcggccctatgtacaactctcggggccaactatgcgggacccgcaggtgccgtacttgggagtcggccat

SEQ ID NO: 396858 - DNA, 140 bp, Artificial Sequence
  Synthetic
atggccgactcccaagtacggcacctgcgggtcccgcatagttggccccgagagttgtacatagggccgccaatatagagcctctcggtgagagactctatggctttcctagccacagggggagacccagcatggcgtat

SEQ ID NO: 396859 - DNA, 140 bp, Artificial Sequence
  Synthetic
atacgccatgctgggtctcctgttggtctgcggagacgacttagtagtcattgctgagagcgccggagttcaggaggatgcgtctaacctgcgagctttcacggaagctatgaccaggtacgtacttgggagtcggccat

SEQ ID NO: 396860 - DNA, 140 bp, Artificial Sequence
  Synthetic
atggccgactcccaagtacgtacctggtcatagcttccgtgaaagctcgcaggttagacgcatcctcctgaactccggcgctctcagcaatgactactaagtcgtctccgcagaccaacaggagacccagcatggcgtat

SEQ ID NO: 396861 - DNA, 140 bp, Artificial Sequence
  Synthetic
atacgccatgctgggtctccagatattactacctcacacgtgacccaaccacaccactgtcacgagctgcgtgggagacagctcggcacactccagtaaattcctggttggggaacataacgtacttgggagtcggccat

SEQ ID NO: 396862 - DNA, 140 bp, Artificial Sequence
  Synthetic
atggccgactcccaagtacgttatgttccccaaccaggaatttactggagtgtgccgagctgtctcccacgcagctcgtgacagtggtgtggttgggtcacgtgtgaggtagtaatatctggagacccagcatggcgtat

SEQ ID NO: 396863 - DNA, 140 bp, Artificial Sequence
  Synthetic
atacgccatgctgggtctcctatgtacggagtcacatattcagttagtccactccaactcccagccatcattcaaagactccatggtatggccgcgttttcactccatgggtactctccacgtacttgggagtcggccat

SEQ ID NO: 396864 - DNA, 140 bp, Artificial Sequence
  Synthetic
atggccgactcccaagtacgtggagagtacccatggagtgaaaacgcggccataccatggagtctttgaatgatggctgggagttggagtggactaactgaatatgtgactccgtacataggagacccagcatggcgtat

SEQ ID NO: 396865 - DNA, 140 bp, Artificial Sequence
  Synthetic
aggccctggctgctgatatgccgctgggcaattggttcggttgcacctggatgaactcaactggattcaccaaagtgtgcggagcgcccccttgtgtcatcggaggggtgggcaacaacagaccttttgggacagcggtg

SEQ ID NO: 396866 - DNA, 140 bp, Artificial Sequence
  Synthetic
caccgctgtcccaaaaggtctgttgttgcccacccctccgatgacacaagggggcgctccgcacactttggtgaatccagttgagttcatccaggtgcaaccgaaccaattgcccagcggcatatcagcagccagggcct

SEQ ID NO: 396867 - DNA, 140 bp, Artificial Sequence
  Synthetic
atacgccatgctgggtctccattgagagcgtggagacatcgagcccgcgcggtcagagctaagcttattgcccaagggggaggcgctgcaatttgcggcaagtacctcttcaactgggcacgtacttgggagtcggccat

SEQ ID NO: 396868 - DNA, 140 bp, Artificial Sequence
  Synthetic
atggccgactcccaagtacgtgcccagttgaagaggtacttgccgcaaattgcagcgcctcccccttgggcaataagcttagctctgaccgcgcgggctcgatgtctccacgctctcaatggagacccagcatggcgtat

SEQ ID NO: 396869 - DNA, 140 bp, Artificial Sequence
  Synthetic
aggccctggctgctgatatgcgcgcaggggccctagattgggtgtgcgcgcaacgaggaagacctccgagcggtcccagcccagaggtaggcgtcagcccataccaaaggcacgccagccgaccttttgggacagcggtg

SEQ ID NO: 396870 - DNA, 140 bp, Artificial Sequence
  Synthetic
caccgctgtcccaaaaggtcggctggcgtgcctttggtatgggctgacgcctacctctgggctgggaccgctcggaggtcttcctcgttgcgcgcacacccaatctagggcccctgcgcgcatatcagcagccagggcct

SEQ ID NO: 396871 - DNA, 140 bp, Artificial Sequence
  Synthetic
atacgccatgctgggtctcccctcactggggccccaatgacccccggcgaaggtcccgcaatcttggtaaagtcatcgataccataacctgcggcttcgccgacctcatggggtacatcccgtacttgggagtcggccat

SEQ ID NO: 396872 - DNA, 140 bp, Artificial Sequence
  Synthetic
atggccgactcccaagtacgggatgtaccccatgaggtcggcgaagccgcaggttatggtatcgatgactttaccaagattgcgggaccttcgccgggggtcattggggccccagtgaggggagacccagcatggcgtat

SEQ ID NO: 396873 - DNA, 140 bp, Artificial Sequence
  Synthetic
atacgccatgctgggtctccttgctccttttctatcttcctcttggcactactctcgtgcctcaccacccccgcctcggcagtacattacaggaatgcatctggtatttaccatctcacccgtacttgggagtcggccat

SEQ ID NO: 396874 - DNA, 140 bp, Artificial Sequence
  Synthetic
atggccgactcccaagtacgggtgagatggtaaataccagatgcattcctgtaatgtactgccgaggcgggggtggtgaggcacgagagtagtgccaagaggaagatagaaaaggagcaaggagacccagcatggcgtat

SEQ ID NO: 396875 - DNA, 140 bp, Artificial Sequence
  Synthetic
aggccctggctgctgatatgacacgcggccgccgcaaggcaactggttcggctgtacatggatgaatagcactgggttcaccaagacgtgcgggggccccccgtgtaacatcgggggggtgaccttttgggacagcggtg

SEQ ID NO: 396876 - DNA, 140 bp, Artificial Sequence
  Synthetic
caccgctgtcccaaaaggtcacccccccgatgttacacggggggcccccgcacgtcttggtgaacccagtgctattcatccatgtacagccgaaccagttgccttgcggcggccgcgtgtcatatcagcagccagggcct

SEQ ID NO: 396877 - DNA, 140 bp, Artificial Sequence
  Synthetic
atacgccatgctgggtctccgctggttacctgttgctcccacgctcgctatcccgaatgccaccgtgccggtaagagggttccgctctcatgtggatcttcttgtcggttcggcggcactcgtacttgggagtcggccat

SEQ ID NO: 396878 - DNA, 140 bp, Artificial Sequence
  Synthetic
atggccgactcccaagtacgagtgccgccgaaccgacaagaagatccacatgagagcggaaccctcttaccggcacggtggcattcgggatagcgagcgtgggagcaacaggtaaccagcggagacccagcatggcgtat

SEQ ID NO: 396879 - DNA, 140 bp, Artificial Sequence
  Synthetic
atacgccatgctgggtctccgctccgctgtaagtcgcaccacaggatcacttgcaggtatctttaacccggggcccaaacagaacatccagttgattaataccaatggcagttggcatgtcgtacttgggagtcggccat

SEQ ID NO: 396880 - DNA, 140 bp, Artificial Sequence
  Synthetic
atggccgactcccaagtacgacatgccaactgccattggtattaatcaactggatgttctgtttgggccccgggttaaagatacctgcaagtgatcctgtggtgcgacttacagcggagcggagacccagcatggcgtat

SEQ ID NO: 396881 - DNA, 140 bp, Artificial Sequence
  Synthetic
aggccctggctgctgatatgctcatacgccaacataagtggttcgtctcacgacagaccgtattgctggcattatccccctaagccctgtgagatcttgcgcgcagcaactgtctgtggtgaccttttgggacagcggtg

SEQ ID NO: 396882 - DNA, 140 bp, Artificial Sequence
  Synthetic
caccgctgtcccaaaaggtcaccacagacagttgctgcgcgcaagatctcacagggcttagggggataatgccagcaatacggtctgtcgtgagacgaaccacttatgttggcgtatgagcatatcagcagccagggcct

SEQ ID NO: 396883 - DNA, 140 bp, Artificial Sequence
  Synthetic
atacgccatgctgggtctcctgctgcaaagcaccaggccccccagtgggtcttggttcgggtgcacttggatgaactcctcggggttcgtgaagacatgcggcgcccccccctgcaacatcgtacttgggagtcggccat

SEQ ID NO: 396884 - DNA, 140 bp, Artificial Sequence
  Synthetic
atggccgactcccaagtacgatgttgcaggggggggcgccgcatgtcttcacgaaccccgaggagttcatccaagtgcacccgaaccaagacccactggggggcctggtgctttgcagcaggagacccagcatggcgtat

SEQ ID NO: 396885 - DNA, 140 bp, Artificial Sequence
  Synthetic
  misc_feature (32)..(32): n is a, c, g, or t
  misc_feature (86)..(86): n is a, c, g, or t
  misc_feature (90)..(90): n is a, c, g, or t
atacgccatgctgggtctcccttacacctcgntgtctggtagactacccttacaggctatggcactacccctgcaccgtgaacttnaccntccacaaggtgcggatgtatgtggccggcgcgtacttgggagtcggccat

SEQ ID NO: 396886 - DNA, 140 bp, Artificial Sequence
  Synthetic
  misc_feature (51)..(51): n is a, c, g, or t
  misc_feature (55)..(55): n is a, c, g, or t
  misc_feature (109)..(109): n is a, c, g, or t
atggccgactcccaagtacgcgccggccacatacatccgcaccttgtgganggtnaagttcacggtgcaggggtagtgccatagcctgtaagggtagtctaccagacancgaggtgtaagggagacccagcatggcgtat

SEQ ID NO: 396887 - DNA, 140 bp, Artificial Sequence
  Synthetic
  misc_feature (48)..(48): n is a, c, g, or t
  misc_feature (100)..(100): n is a, c, g, or t
atacgccatgctgggtctccaacacaacttgccatcttgccctgctcnttcacaaccatgccagctttgtccactggcctgatccatcttcaccagaacntcgtggacgtacagtacctccgtacttgggagtcggccat

SEQ ID NO: 396888 - DNA, 140 bp, Artificial Sequence
  Synthetic
  misc_feature (41)..(41): n is a, c, g, or t
  misc_feature (93)..(93): n is a, c, g, or t
atggccgactcccaagtacggaggtactgtacgtccacgangttctggtgaagatggatcaggccagtggacaaagctggcatggttgtgaangagcagggcaagatggcaagttgtgttggagacccagcatggcgtat

SEQ ID NO: 396889 - DNA, 140 bp, Artificial Sequence
  Synthetic
atacgccatgctgggtctccggctaatgcttctcattggccgagtggaagctgccttggagaaccttattgttcttaacgctacatccgctgccagcagtcaggggtgggtgtggggactcgtacttgggagtcggccat

SEQ ID NO: 396890 - DNA, 140 bp, Artificial Sequence
  Synthetic
atggccgactcccaagtacgagtccccacacccacccctgactgctggcagcggatgtagcgttaagaacaataaggttctccaaggcagcttccactcggccaatgagaagcattagccggagacccagcatggcgtat

SEQ ID NO: 396891 - DNA, 140 bp, Artificial Sequence
  Synthetic
atacgccatgctgggtctccttgccgcagagggcgttcgccttccaaggggaggaggcagcctccttggggggagtagtgatcgtcatcatcactgtgttcaccctcactccggcatacacgtacttgggagtcggccat

SEQ ID NO: 396892 - DNA, 140 bp, Artificial Sequence
  Synthetic
atggccgactcccaagtacgtgtatgccggagtgagggtgaacacagtgatgatgacgatcactactccccccaaggaggctgcctcctccccttggaaggcgaacgccctctgcggcaaggagacccagcatggcgtat

SEQ ID NO: 396893 - DNA, 140 bp, Artificial Sequence
  Synthetic
  misc_feature (21)..(21): n is a, c, g, or t
atacgccatgctgggtctccncgtgacgctgtcatcctgctcacttgcctattgcatccgcaattggggtttgatgtcactaagattgtgttggccctggcgggtcctctctacatgcttcgtacttgggagtcggccat

SEQ ID NO: 396894 - DNA, 140 bp, Artificial Sequence
  Synthetic
  misc_feature (120)..(120): n is a, c, g, or t
atggccgactcccaagtacgaagcatgtagagaggacccgccagggccaacacaatcttagtgacatcaaaccccaattgcggatgcaataggcaagtgagcaggatgacagcgtcacgnggagacccagcatggcgtat

SEQ ID NO: 396895 - DNA, 140 bp, Artificial Sequence
  Synthetic
  misc_feature (89)..(89): n is a, c, g, or t
  misc_feature (103)..(103): n is a, c, g, or t
  misc_feature (115)..(115): n is a, c, g, or t
aggccctggctgctgatatgttgatgtcactaagattgtgttggccctggcgggtcctctctacatgcttcagtatagcttgctcaaantaccatactttgtnagagcgagcatnttactgaccttttgggacagcggtg

SEQ ID NO: 396896 - DNA, 140 bp, Artificial Sequence
  Synthetic
  misc_feature (26)..(26): n is a, c, g, or t
  misc_feature (38)..(38): n is a, c, g, or t
  misc_feature (52)..(52): n is a, c, g, or t
caccgctgtcccaaaaggtcagtaanatgctcgctctnacaaagtatggtantttgagcaagctatactgaagcatgtagagaggacccgccagggccaacacaatcttagtgacatcaacatatcagcagccagggcct

SEQ ID NO: 396897 - DNA, 140 bp, Artificial Sequence
  Synthetic
atacgccatgctgggtctccggggtgctgacactgctgcatgtggagacatcataaacggtctccctgtctcggctaggagaggtaacctcgtactcctaggccccgctgatgatatgaacgtacttgggagtcggccat

SEQ ID NO: 396898 - DNA, 140 bp, Artificial Sequence
  Synthetic
atggccgactcccaagtacgttcatatcatcagcggggcctaggagtacgaggttacctctcctagccgagacagggagaccgtttatgatgtctccacatgcagcagtgtcagcaccccggagacccagcatggcgtat

SEQ ID NO: 396899 - DNA, 140 bp, Artificial Sequence
  Synthetic
atacgccatgctgggtctcccatatcaataggaccgctctgaactgcaatgagtcccacagcactgggtggcttgccgcgctgttctatgcgcgcaagttcaactcgtccggatgcccagcgtacttgggagtcggccat

SEQ ID NO: 396900 - DNA, 140 bp, Artificial Sequence
  Synthetic
atggccgactcccaagtacgctgggcatccggacgagttgaacttgcgcgcatagaacagcgcggcaagccacccagtgctgtgggactcattgcagttcagagcggtcctattgatatgggagacccagcatggcgtat

SEQ ID NO: 396901 - DNA, 140 bp, Artificial Sequence
  Synthetic
atacgccatgctgggtctccaatgaggtggagggtgagatccaggtcgtgtccacagccacgcagtccttccttgccacgactgtcaatggggtcctctggacggtttaccatggtgcggcgtacttgggagtcggccat

SEQ ID NO: 396902 - DNA, 140 bp, Artificial Sequence
  Synthetic
atggccgactcccaagtacgccgcaccatggtaaaccgtccagaggaccccattgacagtcgtggcaaggaaggactgcgtggctgtggacacgacctggatctcaccctccacctcattggagacccagcatggcgtat

SEQ ID NO: 396903 - DNA, 140 bp, Artificial Sequence
  Synthetic
aggccctggctgctgatatgccttgccacgactgtcaatggggtcctctggacggtttaccatggtgcggggtcaaagacgctagccggcccgaaaggaccggtgtgtcaaatgtacaccgaccttttgggacagcggtg

SEQ ID NO: 396904 - DNA, 140 bp, Artificial Sequence
  Synthetic
caccgctgtcccaaaaggtcggtgtacatttgacacaccggtcctttcgggccggctagcgtctttgaccccgcaccatggtaaaccgtccagaggaccccattgacagtcgtggcaaggcatatcagcagccagggcct

SEQ ID NO: 396905 - DNA, 140 bp, Artificial Sequence
  Synthetic
atacgccatgctgggtctccacatccagctgatcaacgccaatggcagttggcacattaatcgcacagccttgaactgcaatgatagccttcacaccggctggatagcagggctcctctacgtacttgggagtcggccat

SEQ ID NO: 396906 - DNA, 140 bp, Artificial Sequence
  Synthetic
atggccgactcccaagtacgtagaggagccctgctatccagccggtgtgaaggctatcattgcagttcaaggctgtgcgattaatgtgccaactgccattggcgttgatcagctggatgtggagacccagcatggcgtat

SEQ ID NO: 396907 - DNA, 140 bp, Artificial Sequence
  Synthetic
atacgccatgctgggtctccatgccgatgtcgtccctgcaagacgcaggggtgacagtcgtgcggccctcctcagtccgaggcctatcagcacactgaaggggtcgtcaggcggtcctatcgtacttgggagtcggccat

SEQ ID NO: 396908 - DNA, 140 bp, Artificial Sequence
  Synthetic
atggccgactcccaagtacgataggaccgcctgacgaccccttcagtgtgctgataggcctcggactgaggagggccgcacgactgtcacccctgcgtcttgcagggacgacatcggcatggagacccagcatggcgtat

SEQ ID NO: 396909 - DNA, 140 bp, Artificial Sequence
  Synthetic
atacgccatgctgggtctccacgaccgcacgctcaccatccttttcagacaactccactccaccagcagtcccacagacatatcaagtggggtacctccatgcacccacgggcagtggcacgtacttgggagtcggccat

SEQ ID NO: 396910 - DNA, 140 bp, Artificial Sequence
  Synthetic
atggccgactcccaagtacgtgccactgcccgtgggtgcatggaggtaccccacttgatatgtctgtgggactgctggtggagtggagttgtctgaaaaggatggtgagcgtgcggtcgtggagacccagcatggcgtat

SEQ ID NO: 396911 - DNA, 140 bp, Artificial Sequence
  Synthetic
aggccctggctgctgatatgcacatcaacaggactgccctgaactgcaatgactccctccacactgggttccttgccgcgctgttctacacacacaagttcaacgcgtccggatgcccaggaccttttgggacagcggtg

SEQ ID NO: 396912 - DNA, 140 bp, Artificial Sequence
  Synthetic
caccgctgtcccaaaaggtcctgggcatccggacgcgttgaacttgtgtgtgtagaacagcgcggcaaggaacccagtgtggagggagtcattgcagttcagggcagtcctgttgatgtgcatatcagcagccagggcct

SEQ ID NO: 396913 - DNA, 140 bp, Artificial Sequence
  Synthetic
atacgccatgctgggtctccggtggttgctcaggtggggcctatgacgtcatcatctgtgatgagtgccattcaactgatcctactactattctgggtatagggactgtgctggaccaggcgtacttgggagtcggccat

SEQ ID NO: 396914 - DNA, 140 bp, Artificial Sequence
  Synthetic
atggccgactcccaagtacgcctggtccagcacagtccctatacccagaatagtagtaggatcagttgaatggcactcatcacagatgatgacgtcataggccccacctgagcaaccaccggagacccagcatggcgtat

SEQ ID NO: 396915 - DNA, 140 bp, Artificial Sequence
  Synthetic
atacgccatgctgggtctcccccgtcacttacgctgagccgaacagctcggaccagaggccctattgttggcactacgcacctcgaccgtgcggtattatacccgcgtcgcaggtgtgtgcgtacttgggagtcggccat

SEQ ID NO: 396916 - DNA, 140 bp, Artificial Sequence
  Synthetic
atggccgactcccaagtacgcacacacctgcgacgcgggtataataccgcacggtcgaggtgcgtagtgccaacaatagggcctctggtccgagctgttcggctcagcgtaagtgacgggggagacccagcatggcgtat

SEQ ID NO: 396917 - DNA, 140 bp, Artificial Sequence
  Synthetic
  misc_feature (83)..(83): n is a, c, g, or t
atacgccatgctgggtctccggttccgtcacggttccacacccgaatattactgagtcagctttgcccactaccggcgagatncccttctatgggaaggcaatcccccttgaattaatcacgtacttgggagtcggccat

SEQ ID NO: 396918 - DNA, 140 bp, Artificial Sequence
  Synthetic
  misc_feature (58)..(58): n is a, c, g, or t
atggccgactcccaagtacgtgattaattcaagggggattgccttcccatagaagggnatctcgccggtagtgggcaaagctgactcagtaatattcgggtgtggaaccgtgacggaaccggagacccagcatggcgtat

SEQ ID NO: 396919 - DNA, 140 bp, Artificial Sequence
  Synthetic
atacgccatgctgggtctccgggcattgacgtggcggtcataccaacctcaggcgacgttgttgtctgcgccactgatgctctcatgacgggatacactggtgacttcgactccgtgattcgtacttgggagtcggccat

SEQ ID NO: 396920 - DNA, 140 bp, Artificial Sequence
  Synthetic
atggccgactcccaagtacgaatcacggagtcgaagtcaccagtgtatcccgtcatgagagcatcagtggcgcagacaacaacgtcgcctgaggttggtatgaccgccacgtcaatgcccggagacccagcatggcgtat

SEQ ID NO: 396921 - DNA, 140 bp, Artificial Sequence
  Synthetic
  misc_feature (94)..(94): n is a, c, g, or t
  misc_feature (106)..(106): n is a, c, g, or t
aggccctggctgctgatatgccactgatgctctcatgacgggatacactggtgacttcgactccgtgattgactgtaatgtttcagtcactcangttgttgacttnagccttgatcccacgaccttttgggacagcggtg

SEQ ID NO: 396922 - DNA, 140 bp, Artificial Sequence
  Synthetic
  misc_feature (35)..(35): n is a, c, g, or t
  misc_feature (47)..(47): n is a, c, g, or t
caccgctgtcccaaaaggtcgtgggatcaaggctnaagtcaacaacntgagtgactgaaacattacagtcaatcacggagtcgaagtcaccagtgtatcccgtcatgagagcatcagtggcatatcagcagccagggcct

SEQ ID NO: 396923 - DNA, 140 bp, Artificial Sequence
  Synthetic
aggccctggctgctgatatgcccccgctggtagagacgtggaaaaagcctgactacgaaccacctgtggtccatggctgcccgctaccacctccacggtcccctcctgtgcctccgcctcgaccttttgggacagcggtg

SEQ ID NO: 396924 - DNA, 140 bp, Artificial Sequence
  Synthetic
caccgctgtcccaaaaggtcgaggcggaggcacaggaggggaccgtggaggtggtagcgggcagccatggaccacaggtggttcgtagtcaggctttttccacgtctctaccagcgggggcatatcagcagccagggcct

SEQ ID NO: 396925 - DNA, 140 bp, Artificial Sequence
  Synthetic
  misc_feature (38)..(38): n is a, c, g, or t
  misc_feature (53)..(53): n is a, c, g, or t
atacgccatgctgggtctcctcgcagggagagcggccntcaggtatttttganaccgttgtcctgtgcgaggcgtacgatacagggtgcgcgtggtacgaactgactcctgcagaaacaacgtacttgggagtcggccat

SEQ ID NO: 396926 - DNA, 140 bp, Artificial Sequence
  Synthetic
  misc_feature (88)..(88): n is a, c, g, or t
  misc_feature (103)..(103): n is a, c, g, or t
atggccgactcccaagtacgttgtttctgcaggagtcagttcgtaccacgcgcaccctgtatcgtacgcctcgcacaggacaacggtntcaaaaatacctganggccgctctccctgcgaggagacccagcatggcgtat

SEQ ID NO: 396927 - DNA, 140 bp, Artificial Sequence
  Synthetic
atacgccatgctgggtctcccgctcatttcctctcgcagacaaagcaggcaggggagaacttcgcatatctcgttgcttaccaggcgacggtttgtgcaagggctaaagcccctcccccccgtacttgggagtcggccat

SEQ ID NO: 396928 - DNA, 140 bp, Artificial Sequence
  Synthetic
atggccgactcccaagtacgggggggaggggctttagcccttgcacaaaccgtcgcctggtaagcaacgagatatgcgaagttctcccctgcctgctttgtctgcgagaggaaatgagcgggagacccagcatggcgtat

SEQ ID NO: 396929 - DNA, 140 bp, Artificial Sequence
  Synthetic
  misc_feature (106)..(106): n is a, c, g, or t
atacgccatgctgggtctccccaccacacacccgatcacgaagtacatcatcacttgcatgtcggcagacctggaagtcataaccagcacctgggtgctgctaggnggggttctcgcagccgtacttgggagtcggccat

SEQ ID NO: 396930 - DNA, 140 bp, Artificial Sequence
  Synthetic
  misc_feature (35)..(35): n is a, c, g, or t
atggccgactcccaagtacggctgcgagaaccccncctagcagcacccaggtgctggttatgacttccaggtctgccgacatgcaagtgatgatgtacttcgtgatcgggtgtgtggtggggagacccagcatggcgtat

SEQ ID NO: 396931 - DNA, 140 bp, Artificial Sequence
  Synthetic
aggccctggctgctgatatgcaccacgagcatacgccatggaccgggagatggctgcatcgtgcggaggcgcggttttcataggtctggcactcttgaccttgtcaccacactataaagtgaccttttgggacagcggtg

SEQ ID NO: 396932 - DNA, 140 bp, Artificial Sequence
  Synthetic
caccgctgtcccaaaaggtcactttatagtgtggtgacaaggtcaagagtgccagacctatgaaaaccgcgcctccgcacgatgcagccatctcccggtccatggcgtatgctcgtggtgcatatcagcagccagggcct

SEQ ID NO: 396933 - DNA, 140 bp, Artificial Sequence
  Synthetic
  misc_feature (97)..(97): n is a, c, g, or t
atacgccatgctgggtctccgctagcagcttactgtttatcagtgggctgcgtggtaatctgcggtagaatcaccaccagtggcaaaccagtgatanttccagatcgggaagtactttaccgtacttgggagtcggccat

SEQ ID NO: 396934 - DNA, 140 bp, Artificial Sequence
  Synthetic
  misc_feature (44)..(44): n is a, c, g, or t
atggccgactcccaagtacggtaaagtacttcccgatctggaantatcactggtttgccactggtggtgattctaccgcagattaccacgcagcccactgataaacagtaagctgctagcggagacccagcatggcgtat

SEQ ID NO: 396935 - DNA, 140 bp, Artificial Sequence
  Synthetic
aggccctggctgctgatatgcgacggcgacaaagaatccgacgttgagtcgtactcctccatgcccccccttgagggagagccgggggaccccgatctcagcgacgggtcttggtctaccgaccttttgggacagcggtg

SEQ ID NO: 396936 - DNA, 140 bp, Artificial Sequence
  Synthetic
caccgctgtcccaaaaggtcggtagaccaagacccgtcgctgagatcggggtcccccggctctccctcaagggggggcatggaggagtacgactcaacgtcggattctttgtcgccgtcgcatatcagcagccagggcct

SEQ ID NO: 396937 - DNA, 140 bp, Artificial Sequence
  Synthetic
atacgccatgctgggtctccttcaggcctccgccaagcaggctgaagagctcaagcccgctgtccattccgcctggcccaagcttgaacaattctggcagaaacacctgtggaactttgtcgtacttgggagtcggccat

SEQ ID NO: 396938 - DNA, 140 bp, Artificial Sequence
  Synthetic
atggccgactcccaagtacgacaaagttccacaggtgtttctgccagaattgttcaagcttgggccaggcggaatggacagcgggcttgagctcttcagcctgcttggcggaggcctgaaggagacccagcatggcgtat

SEQ ID NO: 396939 - DNA, 140 bp, Artificial Sequence
  Synthetic
atacgccatgctgggtctccacttccacgaccctcctacttaacatcttgggggggtgggtggcctcacagttggcaacccctactgcttccacagcttttgtggtgagcgggttggcagcgtacttgggagtcggccat

SEQ ID NO: 396940 - DNA, 140 bp, Artificial Sequence
  Synthetic
atggccgactcccaagtacgctgccaacccgctcaccacaaaagctgtggaagcagtaggggttgccaactgtgaggccacccacccccccaagatgttaagtaggagggtcgtggaagtggagacccagcatggcgtat

SEQ ID NO: 396941 - DNA, 140 bp, Artificial Sequence
  Synthetic
atacgccatgctgggtctccgctggctatggggcgggtgtgtccggggctctcgttgcttttaagatcatgagcggcgagaccccttcagtagaggacatggtcaacctacttccggccccgtacttgggagtcggccat

SEQ ID NO: 396942 - DNA, 140 bp, Artificial Sequence
  Synthetic
atggccgactcccaagtacggggccggaagtaggttgaccatgtcctctactgaaggggtctcgccgctcatgatcttaaaagcaacgagagccccggacacacccgccccatagccagcggagacccagcatggcgtat

SEQ ID NO: 396943 - DNA, 140 bp, Artificial Sequence
  Synthetic
atacgccatgctgggtctccgggcttactcggctgtattgtcaccagcctcacaggccgggacaagaaccaggtcgagggggaggtccaggtggtttccaccgcaacgcaatccttcctgcgtacttgggagtcggccat

SEQ ID NO: 396944 - DNA, 140 bp, Artificial Sequence
  Synthetic
atggccgactcccaagtacgcaggaaggattgcgttgcggtggaaaccacctggacctccccctcgacctggttcttgtcccggcctgtgaggctggtgacaatacagccgagtaagcccggagacccagcatggcgtat

SEQ ID NO: 396945 - DNA, 140 bp, Artificial Sequence
  Synthetic
atacgccatgctgggtctccctgaaactgacacatctcgccagatcacaaccatactcagttccctcaccataaccagcctccttcgcaagctgcatgagtgggtcaacagtgattggtccgtacttgggagtcggccat

SEQ ID NO: 396946 - DNA, 140 bp, Artificial Sequence
  Synthetic
atggccgactcccaagtacggaccaatcactgttgacccactcatgcagcttgcgaaggaggctggttatggtgagggaactgagtatggttgtgatctggcgagatgtgtcagtttcagggagacccagcatggcgtat

SEQ ID NO: 396947 - DNA, 140 bp, Artificial Sequence
  Synthetic
  misc_feature (80)..(80): n is a, c, g, or t
aggccctggctgctgatatgataaccagcctccttcgcaagctgcatgagtgggtcaacagtgattggtcaactccatgngctggttcatggttgcgggacatctgggactgggtttgcagaccttttgggacagcggtg

SEQ ID NO: 396948 - DNA, 140 bp, Artificial Sequence
  Synthetic
  misc_feature (61)..(61): n is a, c, g, or t
caccgctgtcccaaaaggtctgcaaacccagtcccagatgtcccgcaaccatgaaccagcncatggagttgaccaatcactgttgacccactcatgcagcttgcgaaggaggctggttatcatatcagcagccagggcct

SEQ ID NO: 396949 - DNA, 140 bp, Artificial Sequence
  Synthetic
  misc_feature (30)..(30): n is a, c, g, or t
atacgccatgctgggtctccaactccatgngctggttcatggttgcgggacatctgggactgggtttgcactgtgctctccgatttcaagacctggcttaagactaagcttgtgccggcacgtacttgggagtcggccat

SEQ ID NO: 396950 - DNA, 140 bp, Artificial Sequence
  Synthetic
  misc_feature (111)..(111): n is a, c, g, or t
atggccgactcccaagtacgtgccggcacaagcttagtcttaagccaggtcttgaaatcggagagcacagtgcaaacccagtcccagatgtcccgcaaccatgaaccagcncatggagttggagacccagcatggcgtat

SEQ ID NO: 396951 - DNA, 140 bp, Artificial Sequence
  Synthetic
atacgccatgctgggtctcctgggccacgtgaagaacgggtccatgaggatctcaggctcgcggtggtgcagcaacatgtggcatggtaccttccccatcaacgccacgacgaccggccccgtacttgggagtcggccat

SEQ ID NO: 396952 - DNA, 140 bp, Artificial Sequence
  Synthetic
atggccgactcccaagtacggggccggtcgtcgtggcgttgatggggaaggtaccatgccacatgttgctgcaccaccgcgagcctgagatcctcatggacccgttcttcacgtggcccaggagacccagcatggcgtat

SEQ ID NO: 396953 - DNA, 140 bp, Artificial Sequence
  Synthetic
atacgccatgctgggtctccgtaggtgccactaatcaggacctaaaatgtccctgccaagttccggctccggaattcttcactgaggtggatggcgtgcgactacatcgctacgctcccccgtacttgggagtcggccat

SEQ ID NO: 396954 - DNA, 140 bp, Artificial Sequence
  Synthetic
atggccgactcccaagtacgggggagcgtagcgatgtagtcgcacgccatccacctcagtgaagaattccggagccggaacttggcagggacattttaggtcctgattagtggcacctacggagacccagcatggcgtat

SEQ ID NO: 396955 - DNA, 140 bp, Artificial Sequence
  Synthetic
aggccctggctgctgatatgggaattcttcactgaggtggatggcgtgcgactacatcgctacgctcccccctgcaagcccctcctgagggatgagatctccttttctgtggggcttaacgaccttttgggacagcggtg

SEQ ID NO: 396956 - DNA, 140 bp, Artificial Sequence
  Synthetic
caccgctgtcccaaaaggtcgttaagccccacagaaaaggagatctcatccctcaggaggggcttgcaggggggagcgtagcgatgtagtcgcacgccatccacctcagtgaagaattcccatatcagcagccagggcct

SEQ ID NO: 396957 - DNA, 140 bp, Artificial Sequence
  Synthetic
  misc_feature (64)..(64): n is a, c, g, or t
atacgccatgctgggtctccctgctcgtcgtcttggacgcggctcccccccctctcttgccagntcatcggcgagtcagctctcagctccgtcgttgaaggcgacgtgtactacgcacggcgtacttgggagtcggccat

SEQ ID NO: 396958 - DNA, 140 bp, Artificial Sequence
  Synthetic
  misc_feature (77)..(77): n is a, c, g, or t
atggccgactcccaagtacgccgtgcgtagtacacgtcgccttcaacgacggagctgagagctgactcgccgatganctggcaagagaggggggggagccgcgtccaagacgacgagcagggagacccagcatggcgtat

SEQ ID NO: 396959 - DNA, 140 bp, Artificial Sequence
  Synthetic
  misc_feature (24)..(24): n is a, c, g, or t
  misc_feature (39)..(39): n is a, c, g, or t
atacgccatgctgggtctcccgcncaccctgacgctganctgatagaggcaaacttgctgtggaggcaggaagtggggggtaacatcactcgggtggagtctgagaacaaagtcatcgttcgtacttgggagtcggccat

SEQ ID NO: 396960 - DNA, 140 bp, Artificial Sequence
  Synthetic
  misc_feature (102)..(102): n is a, c, g, or t
  misc_feature (117)..(117): n is a, c, g, or t
atggccgactcccaagtacgaacgatgactttgttctcagactccacccgagtgatgttaccccccacttcctgcctccacagcaagtttgcctctatcagntcagcgtcagggtgngcgggagacccagcatggcgtat

SEQ ID NO: 396961 - DNA, 140 bp, Artificial Sequence
  Synthetic
atacgccatgctgggtctccagtgcccgctgagtgtcataggcccaaaaggccgaaatatccaccggcactacctatatgggcgcggcctgattacaacccacctttacttgagacttggcgtacttgggagtcggccat

SEQ ID NO: 396962 - DNA, 140 bp, Artificial Sequence
  Synthetic
atggccgactcccaagtacgccaagtctcaagtaaaggtgggttgtaatcaggccgcgcccatataggtagtgccggtggatatttcggccttttgggcctatgacactcagcgggcactggagacccagcatggcgtat

SEQ ID NO: 396963 - DNA, 140 bp, Artificial Sequence
  Synthetic
aggccctggctgctgatatgtggatgactctacagtatcacaagcacttgcacaactagccgagaagtcctttccgacaccatcgacatccacaactgatcctgactcgggttgtccagcgaccttttgggacagcggtg

SEQ ID NO: 396964 - DNA, 140 bp, Artificial Sequence
  Synthetic
caccgctgtcccaaaaggtcgctggacaacccgagtcaggatcagttgtggatgtcgatggtgtcggaaaggacttctcggctagttgtgcaagtgcttgtgatactgtagagtcatccacatatcagcagccagggcct

SEQ ID NO: 396965 - DNA, 140 bp, Artificial Sequence
  Synthetic
aggccctggctgctgatatgggggagatccccttctatggcaaagccatccccattgagaccatcaagggggggaggcatctcattttctgccattccaagaagaaatgtgacgagctcggaccttttgggacagcggtg

SEQ ID NO: 396966 - DNA, 140 bp, Artificial Sequence
  Synthetic
caccgctgtcccaaaaggtccgagctcgtcacatttcttcttggaatggcagaaaatgagatgcctcccccccttgatggtctcaatggggatggctttgccatagaaggggatctcccccatatcagcagccagggcct

SEQ ID NO: 396967 - DNA, 140 bp, Artificial Sequence
  Synthetic
atacgccatgctgggtctcccctgcgcggctgaggaagagaagctgcccatcaaccctttgagcaactctctcatccgccatcataacctggtgtactccacgacatctcggagtgccgccgtacttgggagtcggccat

SEQ ID NO: 396968 - DNA, 140 bp, Artificial Sequence
  Synthetic
atggccgactcccaagtacggcggcactccgagatgtcgtggagtacaccaggttatgatggcggatgagagagttgctcaaagggttgatgggcagcttctcttcctcagccgcgcaggggagacccagcatggcgtat

SEQ ID NO: 396969 - DNA, 140 bp, Artificial Sequence
  Synthetic
atacgccatgctgggtctccgctagactcctctcagtagaggaggcatgtgacctcactcccccgcactccgcccgttcaaaattcgggtacggagcgaaggatgtccggagccacaccacgtacttgggagtcggccat

SEQ ID NO: 396970 - DNA, 140 bp, Artificial Sequence
  Synthetic
atggccgactcccaagtacgtggtgtggctccggacatccttcgctccgtacccgaattttgaacgggcggagtgcgggggagtgaggtcacatgcctcctctactgagaggagtctagcggagacccagcatggcgtat

SEQ ID NO: 396971 - DNA, 140 bp, Artificial Sequence
  Synthetic
atacgccatgctgggtctccgcaaggccgttaaccatatcaactccgtatggaaggacttgctggaggacaaacagaccccgattcccacaaccatcatggcaaagaacgaggtgttttgcgtacttgggagtcggccat

SEQ ID NO: 396972 - DNA, 140 bp, Artificial Sequence
  Synthetic
atggccgactcccaagtacgcaaaacacctcgttctttgccatgatggttgtgggaatcggggtctgtttgtcctccagcaagtccttccatacggagttgatatggttaacggccttgcggagacccagcatggcgtat

SEQ ID NO: 396973 - DNA, 140 bp, Artificial Sequence
  Synthetic
aggccctggctgctgatatgcggcaacaacaccttgatctgccccacggattgcttccggaagcaccccgaggccacttacacaaaatgtggctcggggccttggttgacacctaggtgcgaccttttgggacagcggtg

SEQ ID NO: 396974 - DNA, 140 bp, Artificial Sequence
  Synthetic
caccgctgtcccaaaaggtcgcacctaggtgtcaaccaaggccccgagccacattttgtgtaagtggcctcggggtgcttccggaagcaatccgtggggcagatcaaggtgttgttgccgcatatcagcagccagggcct

SEQ ID NO: 396975 - DNA, 140 bp, Artificial Sequence
  Synthetic
atacgccatgctgggtctcccgcaaactgcccttagccataatgggagatgcttacggcttccagtattcgcccaagcaacgggtggatcgactgctcagcatgtggcgctctaagaagacgtacttgggagtcggccat

SEQ ID NO: 396976 - DNA, 140 bp, Artificial Sequence
  Synthetic
atggccgactcccaagtacgtcttcttagagcgccacatgctgagcagtcgatccacccgttgcttgggcgaatactggaagccgtaagcatctcccattatggctaagggcagtttgcgggagacccagcatggcgtat

SEQ ID NO: 396977 - DNA, 140 bp, Artificial Sequence
  Synthetic
  misc_feature (111)..(111): n is a, c, g, or t
aggccctggctgctgatatggcccaagcaacgggtggatcgactgctcagcatgtggcgctctaagaagacacccatgggtttttcctatgacaccagatgctttgactcnacggtcactgaccttttgggacagcggtg

SEQ ID NO: 396978 - DNA, 140 bp, Artificial Sequence
  Synthetic
  misc_feature (30)..(30): n is a, c, g, or t
caccgctgtcccaaaaggtcagtgaccgtngagtcaaagcatctggtgtcataggaaaaacccatgggtgtcttcttagagcgccacatgctgagcagtcgatccacccgttgcttgggccatatcagcagccagggcct

SEQ ID NO: 396979 - DNA, 140 bp, Artificial Sequence
  Synthetic
atacgccatgctgggtctccgtggtcccatgtacaactcacggggccaattgtgcgggatgcgcaggtgccgagctagtggggttctcaccactagcttgggtaacaccatgacctgctacgtacttgggagtcggccat

SEQ ID NO: 396980 - DNA, 140 bp, Artificial Sequence
  Synthetic
atggccgactcccaagtacgtagcaggtcatggtgttacccaagctagtggtgagaaccccactagctcggcacctgcgcatcccgcacaattggccccgtgagttgtacatgggaccacggagacccagcatggcgtat

SEQ ID NO: 396981 - DNA, 140 bp, Artificial Sequence
  Synthetic
atacgccatgctgggtctcccaggaagacatagctgccctgcgagctttcacggaagctatgaccaggtactcagcacctcctggtgacgaaccgcgcccggaatatgacttggagctgacgtacttgggagtcggccat

SEQ ID NO: 396982 - DNA, 140 bp, Artificial Sequence
  Synthetic
atggccgactcccaagtacgtcagctccaagtcatattccgggcgcggttcgtcaccaggaggtgctgagtacctggtcatagcttccgtgaaagctcgcagggcagctatgtcttcctgggagacccagcatggcgtat

SEQ ID NO: 396983 - DNA, 140 bp, Artificial Sequence
  Synthetic
atacgccatgctgggtctccatgggagacagctagacacactccagtgaactcctggttggggaatataatcatgtatgcccctacgatctgggtacgcatggttctgatgacccatttccgtacttgggagtcggccat

SEQ ID NO: 396984 - DNA, 140 bp, Artificial Sequence
  Synthetic
atggccgactcccaagtacggaaatgggtcatcagaaccatgcgtacccagatcgtaggggcatacatgattatattccccaaccaggagttcactggagtgtgtctagctgtctcccatggagacccagcatggcgtat

SEQ ID NO: 396985 - DNA, 140 bp, Artificial Sequence
  Synthetic
atacgccatgctgggtctccattgagagcctggcgacatcgagcccgcgcggtcagagcaaaactcattgcccagggaggtgctgcagcaatatgcggcaagtacctctttaactgggcgcgtacttgggagtcggccat

SEQ ID NO: 396986 - DNA, 140 bp, Artificial Sequence
  Synthetic
atggccgactcccaagtacgcgcccagttaaagaggtacttgccgcatattgctgcagcacctccctgggcaatgagttttgctctgaccgcgcgggctcgatgtcgccaggctctcaatggagacccagcatggcgtat

SEQ ID NO: 396987 - DNA, 140 bp, Artificial Sequence
  Synthetic
aggccctggctgctgatatgtccgtaggggtaggcatcttcctgctccctgcccggtaggcagggagcataacactccatttccataactttgcttttttttttttttttttttttttttgaccttttgggacagcggtg

SEQ ID NO: 396988 - DNA, 140 bp, Artificial Sequence
  Synthetic
caccgctgtcccaaaaggtcaaaaaaaaaaaaaaaaaaaaaaaaaagcaaagttatggaaatggagtgttatgctccctgcctaccgggcagggagcaggaagatgcctacccctacggacatatcagcagccagggcct

SEQ ID NO: 396989 - DNA, 140 bp, Artificial Sequence
  Synthetic
atacgccatgctgggtctccctatgcggtggtgttttcctagtgggccaacttttcaccctccggcccagataccataccatcgttcaggagtgcaactgttccatctatacagggcacgcgtacttgggagtcggccat

SEQ ID NO: 396990 - DNA, 140 bp, Artificial Sequence
  Synthetic
atggccgactcccaagtacgcgtgccctgtatagatggaacagttgcactcctgaacgatggtatggtatctgggccggagggtgaaaagttggcccactaggaaaacaccaccgcatagggagacccagcatggcgtat

SEQ ID NO: 396991 - DNA, 140 bp, Artificial Sequence
  Synthetic
aggccctggctgctgatatgggaggccgcaagccagctcgccttatcgtattcccagatttgggggttcgtgtgtgcgagaaaatggccctttacgacgtggtctccacccttcctcagggaccttttgggacagcggtg

SEQ ID NO: 396992 - DNA, 140 bp, Artificial Sequence
  Synthetic
caccgctgtcccaaaaggtccctgaggaagggtggagaccacgtcgtaaagggccattttctcgcacacacgaacccccaaatctgggaatacgataaggcgagctggcttgcggcctcccatatcagcagccagggcct

SEQ ID NO: 396993 - DNA, 140 bp, Artificial Sequence
  Synthetic
atacgccatgctgggtctccgatctttctcgagggacactggggtgtcattggtgctgtgttgtactatagcatggttgcaaactgggctaaggtcttggcagttttagtgctatttgcgcgtacttgggagtcggccat

SEQ ID NO: 396994 - DNA, 140 bp, Artificial Sequence
  Synthetic
atggccgactcccaagtacgcgcaaatagcactaaaactgccaagaccttagcccagtttgcaaccatgctatagtacaacacagcaccaatgacaccccagtgtccctcgagaaagatcggagacccagcatggcgtat

SEQ ID NO: 396995 - DNA, 140 bp, Artificial Sequence
  Synthetic
atacgccatgctgggtctccggagttgacggaaccacgaccgttggctcctctatcggtagcactacacgcacatttgcaggtctttttagcacagggggcaaacagaacatccagttgacgtacttgggagtcggccat

SEQ ID NO: 396996 - DNA, 140 bp, Artificial Sequence
  Synthetic
atggccgactcccaagtacgtcaactggatgttctgtttgccccctgtgctaaaaagacctgcaaatgtgcgtgtagtgctaccgatagaggagccaacggtcgtggttccgtcaactccggagacccagcatggcgtat

SEQ ID NO: 396997 - DNA, 140 bp, Artificial Sequence
  Synthetic
atacgccatgctgggtctcccaactcctcgggctgtcccgataggatgagcagttgcaagccactacatgcatttgaccaaggctgggggcctctctcatatgccaacataagtggttcgcgtacttgggagtcggccat

SEQ ID NO: 396998 - DNA, 140 bp, Artificial Sequence
  Synthetic
atggccgactcccaagtacgcgaaccacttatgttggcatatgagagaggcccccagccttggtcaaatgcatgtagtggcttgcaactgctcatcctatcgggacagcccgaggagttgggagacccagcatggcgtat

SEQ ID NO: 396999 - DNA, 140 bp, Artificial Sequence
  Synthetic
atacgccatgctgggtctcctctcccgacaaaccgtattgttggcattatccccctaggccctgcaccatcgtgtctgcggcaactgtctgtggccctgtctactgcttcacccctagtccgtacttgggagtcggccat

SEQ ID NO: 397000 - DNA, 140 bp, Artificial Sequence
  Synthetic
atggccgactcccaagtacggactaggggtgaagcagtagacagggccacagacagttgccgcagacacgatggtgcagggcctagggggataatgccaacaatacggtttgtcgggagaggagacccagcatggcgtat

SEQ ID NO: 397001 - DNA, 140 bp, Artificial Sequence
  Synthetic
aggccctggctgctgatatgtactccattgaaccacttgacctacctcagatcattcaacgactccatggtcttagcgcattttcactccatagttactctccaggtgagatcaataggggaccttttgggacagcggtg

SEQ ID NO: 397002 - DNA, 140 bp, Artificial Sequence
  Synthetic
caccgctgtcccaaaaggtcccctattgatctcacctggagagtaactatggagtgaaaatgcgctaagaccatggagtcgttgaatgatctgaggtaggtcaagtggttcaatggagtacatatcagcagccagggcct

SEQ ID NO: 397003 - DNA, 140 bp, Artificial Sequence
  Synthetic
atacgccatgctgggtctcctgcaaagtgcgggtcaggaccgtggcttacacctcggtgtctggtagattacccttacaggctgtggcattacccctgcaccctgaactttaccatccaccgtacttgggagtcggccat

SEQ ID NO: 397004 - DNA, 140 bp, Artificial Sequence
  Synthetic
atggccgactcccaagtacggtggatggtaaagttcagggtgcaggggtaatgccacagcctgtaagggtaatctaccagacaccgaggtgtaagccacggtcctgacccgcactttgcaggagacccagcatggcgtat

SEQ ID NO: 397005 - DNA, 140 bp, Artificial Sequence
  Synthetic
aggccctggctgctgatatgacccttacaggctgtggcattacccctgcaccctgaactttaccatccacaaggtgcggatgtatgtggctggcattgagcacagattcaatgccgcctggaccttttgggacagcggtg

SEQ ID NO: 397006 - DNA, 140 bp, Artificial Sequence
  Synthetic
caccgctgtcccaaaaggtccaggcggcattgaatctgtgctcaatgccagccacatacatccgcaccttgtggatggtaaagttcagggtgcaggggtaatgccacagcctgtaagggtcatatcagcagccagggcct

SEQ ID NO: 397007 - DNA, 140 bp, Artificial Sequence
  Synthetic
atacgccatgctgggtctccgacgcgcgaatctgtgcgtgtctatggctgatgtttctcattggccaagtggaagccgccttggagaaccttatcgttcttaacgccacatccgctgctacgtacttgggagtcggccat

SEQ ID NO: 397008 - DNA, 140 bp, Artificial Sequence
  Synthetic
atggccgactcccaagtacgtagcagcggatgtggcgttaagaacgataaggttctccaaggcggcttccacttggccaatgagaaacatcagccatagacacgcacagattcgcgcgtcggagacccagcatggcgtat

SEQ ID NO: 397009 - DNA, 140 bp, Artificial Sequence
  Synthetic
aggccctggctgctgatatgggaagccgccttggagaaccttatcgttcttaacgccacatccgctgctagcagccaggggtggatgtggggactgattttcatctgctttgcctggcacgaccttttgggacagcggtg

SEQ ID NO: 397010 - DNA, 140 bp, Artificial Sequence
  Synthetic
caccgctgtcccaaaaggtcgtgccaggcaaagcagatgaaaatcagtccccacatccacccctggctgctagcagcggatgtggcgttaagaacgataaggttctccaaggcggcttcccatatcagcagccagggcct

SEQ ID NO: 397011 - DNA, 140 bp, Artificial Sequence
  Synthetic
aggccctggctgctgatatggatatgatgatgaactggtcacctacaacagccctagtggtatcgcagatactccggatcccacaagccatcgtggacatggtggcgggggcccactggggaccttttgggacagcggtg

SEQ ID NO: 397012 - DNA, 140 bp, Artificial Sequence
  Synthetic
caccgctgtcccaaaaggtccccagtgggcccccgccaccatgtccacgatggcttgtgggatccggagtatctgcgataccactagggctgttgtaggtgaccagttcatcatcatatccatatcagcagccagggcct

SEQ ID NO: 397013 - DNA, 140 bp, Artificial Sequence
  Synthetic
atacgccatgctgggtctccgaccggcacgtacatatatgaccacctggcgcccttgtcagactgggcgtgcaacggcctacgagatctggccgtcgccgtcgagcccgtcgtcttctcccgtacttgggagtcggccat

SEQ ID NO: 397014 - DNA, 140 bp, Artificial Sequence
  Synthetic
atggccgactcccaagtacgggagaagacgacgggctcgacggcgacggccagatctcgtaggccgttgcacgcccagtctgacaagggcgccaggtggtcatatatgtacgtgccggtcggagacccagcatggcgtat

SEQ ID NO: 397015 - DNA, 140 bp, Artificial Sequence
  Synthetic
atacgccatgctgggtctccgttcgccggttttttcactcagggcgccaagcaaaatgtccagctggtcaacaccaacggcagttggcacatcaatcgtacggccttgaactgtaatgcgcgtacttgggagtcggccat

SEQ ID NO: 397016 - DNA, 140 bp, Artificial Sequence
  Synthetic
atggccgactcccaagtacgcgcattacagttcaaggccgtacgattgatgtgccaactgccgttggtgttgaccagctggacattttgcttggcgccctgagtgaaaaaaccggcgaacggagacccagcatggcgtat

SEQ ID NO: 397017 - DNA, 140 bp, Artificial Sequence
  Synthetic
aggccctggctgctgatatggcactacgcacctcaaccgtgcggtattgtacccgcgtcgcaggtgtgtggcccagtgtattgcttcaccccaagcccagttgtggtggggacgaccgatgaccttttgggacagcggtg

SEQ ID NO: 397018 - DNA, 140 bp, Artificial Sequence
  Synthetic
caccgctgtcccaaaaggtcatcggtcgtccccaccacaactgggcttggggtgaagcaatacactgggccacacacctgcgacgcgggtacaataccgcacggttgaggtgcgtagtgccatatcagcagccagggcct

SEQ ID NO: 397019 - DNA, 140 bp, Artificial Sequence
  Synthetic
atacgccatgctgggtctccatcggagggtccgacaacgaaactttgacctgccccacggactgcttccggaagcatcccgaagccacttacaccaaatgtggctcggggccttggctgacgtacttgggagtcggccat

SEQ ID NO: 397020 - DNA, 140 bp, Artificial Sequence
  Synthetic
atggccgactcccaagtacgtcagccaaggccccgagccacatttggtgtaagtggcttcgggatgcttccggaagcagtccgtggggcaggtcaaagtttcgttgtcggaccctccgatggagacccagcatggcgtat

SEQ ID NO: 397021 - DNA, 140 bp, Artificial Sequence
  Synthetic
aggccctggctgctgatatggaagaagcggacggtggtcctcaccgaatcaaccgtgtctactgccttggctgaacttgccaccaaaagttttggcagctcctcaacttccggtatcacggaccttttgggacagcggtg

SEQ ID NO: 397022 - DNA, 140 bp, Artificial Sequence
  Synthetic
caccgctgtcccaaaaggtccgtgataccggaagttgaggagctgccaaaacttttggtggcaagttcagccaaggcagtagacacggttgattcggtgaggaccaccgtccgcttcttccatatcagcagccagggcct

SEQ ID NO: 397023 - DNA, 140 bp, Artificial Sequence
  Synthetic
aggccctggctgctgatatgcacgggtgacttcgactccgtgattgactgtaatgtctcagtcactcagattgtcgacttcagccttgatcccaccttcacaattgagactaccactgtggaccttttgggacagcggtg

SEQ ID NO: 397024 - DNA, 140 bp, Artificial Sequence
  Synthetic
caccgctgtcccaaaaggtccacagtggtagtctcaattgtgaaggtgggatcaaggctgaagtcgacaatctgagtgactgagacattacagtcaatcacggagtcgaagtcacccgtgcatatcagcagccagggcct

SEQ ID NO: 397025 - DNA, 140 bp, Artificial Sequence
  Synthetic
  misc_feature (86)..(86): n is a, c, g, or t
  misc_feature (92)..(92): n is a, c, g, or t
aggccctggctgctgatatggacatggtcaacctacttccggccctattatcaccaggtgcactggtagtgggcgtcgtgtgtgcnggcatnctgaggcgtcacgctggccctgctgagggaccttttgggacagcggtg

SEQ ID NO: 397026 - DNA, 140 bp, Artificial Sequence
  Synthetic
  misc_feature (49)..(49): n is a, c, g, or t
  misc_feature (55)..(55): n is a, c, g, or t
caccgctgtcccaaaaggtccctcagcagggccagcgtgacgcctcagnatgccngcacacacgacgcccactaccagtgcacctggtgataatagggccggaagtaggttgaccatgtccatatcagcagccagggcct

SEQ ID NO: 397027 - DNA, 140 bp, Artificial Sequence
  Synthetic
atacgccatgctgggtctcccgggacatctgggactggatttgcaccgtactctccgacttcaagagctggctaaagaccaagcttgtgccggcattgcccggagtcccctttttatcatcgtacttgggagtcggccat

SEQ ID NO: 397028 - DNA, 140 bp, Artificial Sequence
  Synthetic
atggccgactcccaagtacgatgataaaaaggggactccgggcaatgccggcacaagcttggtctttagccagctcttgaagtcggagagtacggtgcaaatccagtcccagatgtcccgggagacccagcatggcgtat

SEQ ID NO: 397029 - DNA, 140 bp, Artificial Sequence
  Synthetic
aggccctggctgctgatatgatggcgtatggccgctgctcctgctcctgttggcgttaccgccacgtgcttacgccatggaccgggagatggctgcatcgtgtggaggcgcggttttcgtgaccttttgggacagcggtg

SEQ ID NO: 397030 - DNA, 140 bp, Artificial Sequence
  Synthetic
caccgctgtcccaaaaggtcacgaaaaccgcgcctccacacgatgcagccatctcccggtccatggcgtaagcacgtggcggtaacgccaacaggagcaggagcagcggccatacgccatcatatcagcagccagggcct

SEQ ID NO: 397031 - DNA, 140 bp, Artificial Sequence
  Synthetic
aggccctggctgctgatatgcgtcttttctgacatggagaccaagatcatcacctggggggcagacaccgcggcgtgtggggacatcatcttgggcttgcccgtctccgcccgaaggggtgaccttttgggacagcggtg

SEQ ID NO: 397032 - DNA, 140 bp, Artificial Sequence
  Synthetic
caccgctgtcccaaaaggtcaccccttcgggcggagacgggcaagcccaagatgatgtccccacacgccgcggtgtctgccccccaggtgatgatcttggtctccatgtcagaaaagacgcatatcagcagccagggcct

SEQ ID NO: 397033 - DNA, 140 bp, Artificial Sequence
  Synthetic
atacgccatgctgggtctcctggtccatgggtgcgccttgcccccccccgggccggctccaataccgccacccaggcggaagaaagtcgtacatctggatgactctacagtatcacaagccgtacttgggagtcggccat

SEQ ID NO: 397034 - DNA, 140 bp, Artificial Sequence
  Synthetic
atggccgactcccaagtacggcttgtgatactgtagagtcatccagatgtacgactttcttccgcctgggtggcggtattggagccggcccgggggggggcaaggcgcacccatggaccaggagacccagcatggcgtat

SEQ ID NO: 397035 - DNA, 140 bp, Artificial Sequence
  Synthetic
aggccctggctgctgatatgcccaggcggaagaaagtcgtacatctggatgactctacagtatcacaagcacttgcacaactagcccaaaagtcctttccgacgccatcgacaaccgcaagaccttttgggacagcggtg

SEQ ID NO: 397036 - DNA, 140 bp, Artificial Sequence
  Synthetic
caccgctgtcccaaaaggtcttgcggttgtcgatggcgtcggaaaggacttttgggctagttgtgcaagtgcttgtgatactgtagagtcatccagatgtacgactttcttccgcctgggcatatcagcagccagggcct

SEQ ID NO: 397037 - DNA, 140 bp, Artificial Sequence
  Synthetic
atacgccatgctgggtctccaccacttgagggggaaccgggagatccggacctcagttcgggatcctggtccacggtcagtgaggagggcgacagtgtcgtctgccgttcgatgtcataccgtacttgggagtcggccat

SEQ ID NO: 397038 - DNA, 140 bp, Artificial Sequence
  Synthetic
atggccgactcccaagtacggtatgacatcgaacggcagacgacactgtcgccctcctcactgaccgtggaccaggatcccgaactgaggtccggatctcccggttccccctcaagtggtggagacccagcatggcgtat

SEQ ID NO: 397039 - DNA, 140 bp, Artificial Sequence
  Synthetic
aggccctggctgctgatatgcggctgcgtatgcagcccaagggtacaaggtactcgtcctgaacccgtccgttgccgccaccttaggttttggggcgtatatgtccaaggcatatggtacgaccttttgggacagcggtg

SEQ ID NO: 397040 - DNA, 140 bp, Artificial Sequence
  Synthetic
caccgctgtcccaaaaggtcgtaccatatgccttggacatatacgccccaaaacctaaggtggcggcaacggacgggttcaggacgagtaccttgtacccttgggctgcatacgcagccgcatatcagcagccagggcct

SEQ ID NO: 397041 - DNA, 140 bp, Artificial Sequence
  Synthetic
aggccctggctgctgatatgcttctatggcaaagccatccccatcgaggtcatcaaggggggaaggcatctcattttctgccattccaagaagaagtgcgacgagctcgccgcaaagctggaccttttgggacagcggtg

SEQ ID NO: 397042 - DNA, 140 bp, Artificial Sequence
  Synthetic
caccgctgtcccaaaaggtccagctttgcggcgagctcgtcgcacttcttcttggaatggcagaaaatgagatgccttccccccttgatgacctcgatggggatggctttgccatagaagcatatcagcagccagggcct

SEQ ID NO: 397043 - DNA, 140 bp, Artificial Sequence
  Synthetic
aggccctggctgctgatatgactctttcgacccgcttcgagcggaggaggacgagagggaagtatccgttccggcggagatcctgcggaaatccaggaagttccccccagcgttgcccgtgaccttttgggacagcggtg

SEQ ID NO: 397044 - DNA, 140 bp, Artificial Sequence
  Synthetic
caccgctgtcccaaaaggtcacgggcaacgctggggggaacttcctggatttccgcaggatctccgccggaacggatacttccctctcgtcctcctccgctcgaagcgggtcgaaagagtcatatcagcagccagggcct

SEQ ID NO: 397045 - DNA, 140 bp, Artificial Sequence
  Synthetic
atacgccatgctgggtctccttcagcgggggggacatttatcacagcgtgtcccgggctcgaccccgcatgttactcctgtgcctactcctactttccgtaggggtaggcatctttttgccgtacttgggagtcggccat

SEQ ID NO: 397046 - DNA, 140 bp, Artificial Sequence
  Synthetic
atggccgactcccaagtacggcaaaaagatgcctacccctacggaaagtaggagtaggcacaggagtaacatgcggggtcgagcccgggacacgctgtgataaatgtcccccccgctgaaggagacccagcatggcgtat

SEQ ID NO: 397047 - DNA, 140 bp, Artificial Sequence
  Synthetic
atacgccatgctgggtctcccgatcccagcctagaggcaggcgccagcccataccaaaggcgcgccagccgacgggccggcactgggctcagcctggttacccttggcccctttatggtacgtacttgggagtcggccat

SEQ ID NO: 397048 - DNA, 140 bp, Artificial Sequence
  Synthetic
atggccgactcccaagtacgtaccataaaggggccaagggtaaccaggctgagcccagtgccggcccgtcggctggcgcgcctttggtatgggctggcgcctgcctctaggctgggatcgggagacccagcatggcgtat

SEQ ID NO: 397049 - DNA, 140 bp, Artificial Sequence
  Synthetic
  misc_feature (54)..(54): n is a, c, g, or t
  misc_feature (114)..(114): n is a, c, g, or t
atacgccatgctgggtctccagtcatcgataccttaacgtgcggcttagccganctcatggggtacatccctgtcctaggggcaccacttggtggagtcgcagctgccctagcncatggccgtacttgggagtcggccat

SEQ ID NO: 397050 - DNA, 140 bp, Artificial Sequence
  Synthetic
  misc_feature (27)..(27): n is a, c, g, or t
  misc_feature (87)..(87): n is a, c, g, or t
atggccgactcccaagtacggccatgngctagggcagctgcgactccaccaagtggtgcccctaggacagggatgtaccccatgagntcggctaagccgcacgttaaggtatcgatgactggagacccagcatggcgtat

SEQ ID NO: 397051 - DNA, 140 bp, Artificial Sequence
  Synthetic
  misc_feature (115)..(115): n is a, c, g, or t
atacgccatgctgggtctccccgcctcggcggtccattacaagaacatctctgggatttaccatcttaccaatgactgccctaattctagcattgtttatgaggcggatgatatnattttcgtacttgggagtcggccat

SEQ ID NO: 397052 - DNA, 140 bp, Artificial Sequence
  Synthetic
  misc_feature (26)..(26): n is a, c, g, or t
atggccgactcccaagtacgaaaatnatatcatccgcctcataaacaatgctagaattagggcagtcattggtaagatggtaaatcccagagatgttcttgtaatggaccgccgaggcggggagacccagcatggcgtat

SEQ ID NO: 397053 - DNA, 140 bp, Artificial Sequence
  Synthetic
  misc_feature (65)..(65): n is a, c, g, or t
aggccctggctgctgatatgaatgactgccctaattctagcattgtttatgaggcggatgatatnattttacacctccctgggtgtgttccatgcgtcaccactgaaaacaaatcgcagtgaccttttgggacagcggtg

SEQ ID NO: 397054 - DNA, 140 bp, Artificial Sequence
  Synthetic
  misc_feature (76)..(76): n is a, c, g, or t
caccgctgtcccaaaaggtcactgcgatttgttttcagtggtgacgcatggaacacacccagggaggtgtaaaatnatatcatccgcctcataaacaatgctagaattagggcagtcattcatatcagcagccagggcct

SEQ ID NO: 397055 - DNA, 140 bp, Artificial Sequence
  Synthetic
atacgccatgctgggtctccgttatgcggtaggtcgcgccaccagcggcatcgccggcctcttcaccccaggtgccagccaaaacatccagctgattaacaccaacggcagttggcacatcgtacttgggagtcggccat

SEQ ID NO: 397056 - DNA, 140 bp, Artificial Sequence
  Synthetic
atggccgactcccaagtacgatgtgccaactgccgttggtgttaatcagctggatgttttggctggcacctggggtgaagaggccggcgatgccgctggtggcgcgacctaccgcataacggagacccagcatggcgtat

SEQ ID NO: 397057 - DNA, 140 bp, Artificial Sequence
  Synthetic
atacgccatgctgggtctccttaagctggtgcaggccactgcactcgtttgaccagggctggggtcccatcacgtatgccaacgtgagtggatcatctgatgataggccatactgctggccgtacttgggagtcggccat

SEQ ID NO: 397058 - DNA, 140 bp, Artificial Sequence
  Synthetic
atggccgactcccaagtacggccagcagtatggcctatcatcagatgatccactcacgttggcatacgtgatgggaccccagccctggtcaaacgagtgcagtggcctgcaccagcttaaggagacccagcatggcgtat

SEQ ID NO: 397059 - DNA, 140 bp, Artificial Sequence
  Synthetic
aggccctggctgctgatatgaccaaccgtcgcccacaggacgtcaagttcccgggtggcggtcagatcgttggtggagtttacttgttgccgcgcaggggccccaggttgggtgtgcgcggaccttttgggacagcggtg

SEQ ID NO: 397060 - DNA, 140 bp, Artificial Sequence
  Synthetic
caccgctgtcccaaaaggtccgcgcacacccaacctggggcccctgcgcggcaacaagtaaactccaccaacgatctgaccgccacccgggaacttgacgtcctgtgggcgacggttggtcatatcagcagccagggcct

SEQ ID NO: 397061 - DNA, 140 bp, Artificial Sequence
  Synthetic
atacgccatgctgggtctccttcgcaagcatccggatgctacctacgcaaagtgtgggtctgggccttggctcactccccgctgcttggtggactacccgtatcggttgtggcactaccccgtacttgggagtcggccat

SEQ ID NO: 397062 - DNA, 140 bp, Artificial Sequence
  Synthetic
atggccgactcccaagtacggggtagtgccacaaccgatacgggtagtccaccaagcagcggggagtgagccaaggcccagacccacactttgcgtaggtagcatccggatgcttgcgaaggagacccagcatggcgtat

SEQ ID NO: 397063 - DNA, 140 bp, Artificial Sequence
  Synthetic
  misc_feature (46)..(46): n is a, c, g, or t
atacgccatgctgggtctcctcgagcacaggttcgatgccgcttgnaattggactcgtggggagcggtgtgagctggatgatagagacagaatagaaatgagcccacttttgtttacgaccgtacttgggagtcggccat

SEQ ID NO: 397064 - DNA, 140 bp, Artificial Sequence
  Synthetic
  misc_feature (95)..(95): n is a, c, g, or t
atggccgactcccaagtacggtcgtaaacaaaagtgggctcatttctattctgtctctatcatccagctcacaccgctccccacgagtccaattncaagcggcatcgaacctgtgctcgaggagacccagcatggcgtat

SEQ ID NO: 397065 - DNA, 140 bp, Artificial Sequence
  Synthetic
  misc_feature (34)..(34): n is a, c, g, or t
atacgccatgctgggtctcccactgagctatctntattgccctgctccttcacaaccacgcctgcgctatcaactggcctaatccatctacaccagaatgttgtggacgtgcagtacctccgtacttgggagtcggccat

SEQ ID NO: 397066 - DNA, 140 bp, Artificial Sequence
  Synthetic
  misc_feature (107)..(107): n is a, c, g, or t
atggccgactcccaagtacggaggtactgcacgtccacaacattctggtgtagatggattaggccagttgatagcgcaggcgtggttgtgaaggagcagggcaatanagatagctcagtgggagacccagcatggcgtat

SEQ ID NO: 397067 - DNA, 140 bp, Artificial Sequence
  Synthetic
  misc_feature (112)..(112): n is a, c, g, or t
atacgccatgctgggtctccggttaatgtttttggtgggtcaagcagaggcggcattggagaatttaatcattctgaatgctgcctctgctgccagcaatcaagggttgttntgtggcttcgtacttgggagtcggccat

SEQ ID NO: 397068 - DNA, 140 bp, Artificial Sequence
  Synthetic
  misc_feature (29)..(29): n is a, c, g, or t
atggccgactcccaagtacgaagccacanaacaacccttgattgctggcagcagaggcagcattcagaatgattaaattctccaatgccgcctctgcttgacccaccaaaaacattaaccggagacccagcatggcgtat

SEQ ID NO: 397069 - DNA, 140 bp, Artificial Sequence
  Synthetic
atacgccatgctgggtctccgcttttcgtttgcttcgcatggtatgtccggggcagggctgtccccgggcttacatacgctttgcttcaattgtggccgcttttgcttttgctgttgtgccgtacttgggagtcggccat

SEQ ID NO: 397070 - DNA, 140 bp, Artificial Sequence
  Synthetic
atggccgactcccaagtacggcacaacagcaaaagcaaaagcggccacaattgaagcaaagcgtatgtaagcccggggacagccctgccccggacataccatgcgaagcaaacgaaaagcggagacccagcatggcgtat

SEQ ID NO: 397071 - DNA, 140 bp, Artificial Sequence
  Synthetic
atacgccatgctgggtctccggccttgcctactattccatggtggggaactgggctaaggtattgattgtgatgctactctttgccggcgttgatgggcacacccacacgacaggggggacgtacttgggagtcggccat

SEQ ID NO: 397072 - DNA, 140 bp, Artificial Sequence
  Synthetic
atggccgactcccaagtacgtcccccctgtcgtgtgggtgtgcccatcaacgccggcaaagagtagcatcacaatcaataccttagcccagttccccaccatggaatagtaggcaaggccggagacccagcatggcgtat

SEQ ID NO: 397073 - DNA, 140 bp, Artificial Sequence
  Synthetic
atacgccatgctgggtctccgatggggggaacggtagcccgcaacgcctacacgcttacgggcctcttcacctccgggccgactcagaagatccaacttgtaaacaccaacggcagctggcgtacttgggagtcggccat

SEQ ID NO: 397074 - DNA, 140 bp, Artificial Sequence
  Synthetic
atggccgactcccaagtacgccagctgccgttggtgtttacaagttggatcttctgagtcggcccggaggtgaagaggcccgtaagcgtgtaggcgttgcgggctaccgttccccccatcggagacccagcatggcgtat

SEQ ID NO: 397075 - DNA, 140 bp, Artificial Sequence
  Synthetic
atacgccatgctgggtctccagagtctgctcataagctcgctttggtggatccaatactttattgcacgtgctgaagcccagctacatgtttggataccatcgttgcgggctcgaggcggcgtacttgggagtcggccat

SEQ ID NO: 397076 - DNA, 140 bp, Artificial Sequence
  Synthetic
atggccgactcccaagtacgccgcctcgagcccgcaacgatggtatccaaacatgtagctgggcttcagcacgtgcaataaagtattggatccaccaaagcgagcttatgagcagactctggagacccagcatggcgtat

SEQ ID NO: 397077 - DNA, 140 bp, Artificial Sequence
  Synthetic
aggccctggctgctgatatgaacaccaatggcagttggcacatcaatagcacggccctgaactgcaatgaaagccttcacaccggctggttagcagggcttttctaccaccgtaatttcagaccttttgggacagcggtg

SEQ ID NO: 397078 - DNA, 140 bp, Artificial Sequence
  Synthetic
caccgctgtcccaaaaggtctgaaattacggtggtagaaaagccctgctaaccagccggtgtgaaggctttcattgcagttcagggccgtgctattgatgtgccaactgccattggtgttcatatcagcagccagggcct

SEQ ID NO: 397079 - DNA, 140 bp, Artificial Sequence
  Synthetic
atacgccatgctgggtctcccagtacagcttgctccgaacgccttattttgtgcgcgcacacatccttttacgcgcgtgcatggttctccgaggcattgtgggcgggaaatatgttcaggcgtacttgggagtcggccat

SEQ ID NO: 397080 - DNA, 140 bp, Artificial Sequence
  Synthetic
atggccgactcccaagtacgcctgaacatatttcccgcccacaatgcctcggagaaccatgcacgcgcgtaaaaggatgtgtgcgcgcacaaaataaggcgttcggagcaagctgtactgggagacccagcatggcgtat

SEQ ID NO: 397081 - DNA, 140 bp, Artificial Sequence
  Synthetic
atacgccatgctgggtctcccgctgttgaacctgtcatcttctcgcccatggagaagaaagttatcacatggggcgctgatactgttgcatgcggggacattctcgccggcttaccagtgcgtacttgggagtcggccat

SEQ ID NO: 397082 - DNA, 140 bp, Artificial Sequence
  Synthetic
atggccgactcccaagtacgcactggtaagccggcgagaatgtccccgcatgcaacagtatcagcgccccatgtgataactttcttctccatgggcgagaagatgacaggttcaacagcgggagacccagcatggcgtat

SEQ ID NO: 397083 - DNA, 140 bp, Artificial Sequence
  Synthetic
atacgccatgctgggtctccccagaggcctcttaggcaccattgttaccagccttacaggccgcgataagaacgtggtagagggcgagatccaggttgtttccactgctacgcagtccttcgtacttgggagtcggccat

SEQ ID NO: 397084 - DNA, 140 bp, Artificial Sequence
  Synthetic
atggccgactcccaagtacgaaggactgcgtagcagtggaaacaacctggatctcgccctctaccacgttcttatcgcggcctgtaaggctggtaacaatggtgcctaagaggcctctggggagacccagcatggcgtat

SEQ ID NO: 397085 - DNA, 140 bp, Artificial Sequence
  Synthetic
aggccctggctgctgatatgtggaggacagggataggtcagagcttagtccgctactgctgtctacaacagagtggcagatactgccctgttccttcaccaccctaccggctttgtccacgaccttttgggacagcggtg

SEQ ID NO: 397086 - DNA, 140 bp, Artificial Sequence
  Synthetic
caccgctgtcccaaaaggtcgtggacaaagccggtagggtggtgaaggaacagggcagtatctgccactctgttgtagacagcagtagcggactaagctctgacctatccctgtcctccacatatcagcagccagggcct

SEQ ID NO: 397087 - DNA, 140 bp, Artificial Sequence
  Synthetic
  misc_feature (50)..(50): n is a, c, g, or t
atacgccatgctgggtctccaacgtggaccaggatttggtggggtggccngcgccgcctggggcgcggtcattcacaccgtgctcttgtggcgcaagcgaccttttcctcatcactaggacgtacttgggagtcggccat

SEQ ID NO: 397088 - DNA, 140 bp, Artificial Sequence
  Synthetic
  misc_feature (91)..(91): n is a, c, g, or t
atggccgactcccaagtacgtcctagtgatgaggaaaaggtcgcttgcgccacaagagcacggtgtgaatgaccgcgccccaggcggcgcnggccaccccaccaaatcctggtccacgttggagacccagcatggcgtat

SEQ ID NO: 397089 - DNA, 140 bp, Artificial Sequence
  Synthetic
aggccctggctgctgatatgattcacaccgtgctcttgtggcgcaagcgaccttttcctcatcactaggagcgccgatgtcatccccgcgagacgcaggggtgacacccgtgcggccctcgaccttttgggacagcggtg

SEQ ID NO: 397090 - DNA, 140 bp, Artificial Sequence
  Synthetic
caccgctgtcccaaaaggtcgagggccgcacgggtgtcacccctgcgtctcgcggggatgacatcggcgctcctagtgatgaggaaaaggtcgcttgcgccacaagagcacggtgtgaatcatatcagcagccagggcct

SEQ ID NO: 397091 - DNA, 140 bp, Artificial Sequence
  Synthetic
  misc_feature (22)..(22): n is a, c, g, or t
atacgccatgctgggtctcccnagaggtgtggcaaagtcccttgacttcatacccgttgagagcatgcagtccaccgctcgctctccgtccttttcagacaacacatctccccccgctgtcgtacttgggagtcggccat

SEQ ID NO: 397092 - DNA, 140 bp, Artificial Sequence
  Synthetic
  misc_feature (119)..(119): n is a, c, g, or t
atggccgactcccaagtacgacagcggggggagatgtgttgtctgaaaaggacggagagcgagcggtggactgcatgctctcaacgggtatgaagtcaagggactttgccacacctctngggagacccagcatggcgtat

SEQ ID NO: 397093 - DNA, 140 bp, Artificial Sequence
  Synthetic
  misc_feature (44)..(44): n is a, c, g, or t
  misc_feature (47)..(47): n is a, c, g, or t
  misc_feature (65)..(65): n is a, c, g, or t
atacgccatgctgggtctccgtgctaaatccgtctgttgcggcnacnttggggtttggctcatanatgtcaacagctcatggcattgacccgaatgtgcgcactggtgtaaggaccatcacgtacttgggagtcggccat

SEQ ID NO: 397094 - DNA, 140 bp, Artificial Sequence
  Synthetic
  misc_feature (76)..(76): n is a, c, g, or t
  misc_feature (94)..(94): n is a, c, g, or t
  misc_feature (97)..(97): n is a, c, g, or t
atggccgactcccaagtacgtgatggtccttacaccagtgcgcacattcgggtcaatgccatgagctgttgacatntatgagccaaaccccaangtngccgcaacagacggatttagcacggagacccagcatggcgtat

SEQ ID NO: 397095 - DNA, 140 bp, Artificial Sequence
  Synthetic
atacgccatgctgggtctccattcctcgccaggctcatatggtggttacaatatcttatcaccagagccgaggcgcatttgcaagtgtggattccccctcttaatgttcgggggggccgccgtacttgggagtcggccat

SEQ ID NO: 397096 - DNA, 140 bp, Artificial Sequence
  Synthetic
atggccgactcccaagtacggcggcccccccgaacattaagagggggaatccacacttgcaaatgcgcctcggctctggtgataagatattgtaaccaccatatgagcctggcgaggaatggagacccagcatggcgtat

SEQ ID NO: 397097 - DNA, 140 bp, Artificial Sequence
  Synthetic
aggccctggctgctgatatgaggcgcatttgcaagtgtggattccccctcttaatgttcgggggggccgcgacgccatcatccttctcacatgtgcagtccatccagagctaatctttgagaccttttgggacagcggtg

SEQ ID NO: 397098 - DNA, 140 bp, Artificial Sequence
  Synthetic
caccgctgtcccaaaaggtctcaaagattagctctggatggactgcacatgtgagaaggatgatggcgtcgcggcccccccgaacattaagagggggaatccacacttgcaaatgcgcctcatatcagcagccagggcct

SEQ ID NO: 397099 - DNA, 140 bp, Artificial Sequence
  Synthetic
  misc_feature (57)..(57): n is a, c, g, or t
atacgccatgctgggtctccttcaacagaccccaccacagttttgggcatagggacngtcttggaccaggcggagactgcaggagtaaggcttgtggtcctcgccactgccacccctcctcgtacttgggagtcggccat

SEQ ID NO: 397100 - DNA, 140 bp, Artificial Sequence
  Synthetic
  misc_feature (84)..(84): n is a, c, g, or t
atggccgactcccaagtacgaggaggggtggcagtggcgaggaccacaagccttactcctgcagtctccgcctggtccaagacngtccctatgcccaaaactgtggtggggtctgttgaaggagacccagcatggcgtat

SEQ ID NO: 397101 - DNA, 140 bp, Artificial Sequence
  Synthetic
aggccctggctgctgatatgctggcataactagagtgccgtactttgtgcgcgctcaagggctcattcgtgcatgcatgctggtgcggaaagccgctgggggccattatgtccaaatggcgaccttttgggacagcggtg

SEQ ID NO: 397102 - DNA, 140 bp, Artificial Sequence
  Synthetic
caccgctgtcccaaaaggtcgccatttggacataatggcccccagcggctttccgcaccagcatgcatgcacgaatgagcccttgagcgcgcacaaagtacggcactctagttatgccagcatatcagcagccagggcct

SEQ ID NO: 397103 - DNA, 140 bp, Artificial Sequence
  Synthetic
  misc_feature (35)..(35): n is a, c, g, or t
  misc_feature (74)..(74): n is a, c, g, or t
atacgccatgctgggtctccggttctataacggtnccacatccaaacattacggagtcagccctacccactacnggggaagtacccttctatgggaaggcaatcccacttgaattcatcacgtacttgggagtcggccat

SEQ ID NO: 397104 - DNA, 140 bp, Artificial Sequence
  Synthetic
  misc_feature (67)..(67): n is a, c, g, or t
  misc_feature (106)..(106): n is a, c, g, or t
atggccgactcccaagtacgtgatgaattcaagtgggattgccttcccatagaagggtacttccccngtagtgggtagggctgactccgtaatgtttggatgtggnaccgttatagaaccggagacccagcatggcgtat

SEQ ID NO: 397105 - DNA, 140 bp, Artificial Sequence
  Synthetic
atacgccatgctgggtctcccccgaaggggaagggagatactcctaggaccggccgatagccttgaaggccaggggtggcggctccttgcgcctatcacggcctattcccaacagacgcgcgtacttgggagtcggccat

SEQ ID NO: 397106 - DNA, 140 bp, Artificial Sequence
  Synthetic
atggccgactcccaagtacgcgcgtctgttgggaataggccgtgataggcgcaaggagccgccacccctggccttcaaggctatcggccggtcctaggagtatctcccttccccttcgggggagacccagcatggcgtat

SEQ ID NO: 397107 - DNA, 140 bp, Artificial Sequence
  Synthetic
  misc_feature (82)..(82): n is a, c, g, or t
atacgccatgctgggtctccaacggagaggcagaacgggtagaggccggcacggggactatagatatgtctcgcagggtgancggccgtcaggcatttttgacaccgtcgttctatgtgacgtacttgggagtcggccat

SEQ ID NO: 397108 - DNA, 140 bp, Artificial Sequence
  Synthetic
  misc_feature (59)..(59): n is a, c, g, or t
atggccgactcccaagtacgtcacatagaacgacggtgtcaaaaatgcctgacggccgntcaccctgcgagacatatctatagtccccgtgccggcctctacccgttctgcctctccgttggagacccagcatggcgtat

SEQ ID NO: 397109 - DNA, 140 bp, Artificial Sequence
  Synthetic
atacgccatgctgggtctccgaccatcttgagttctgggagggggttttcactggactgacccatatcgatgcccattttctctcccagacgaagcaggcgggggaaaatttcgcgtacccgtacttgggagtcggccat

SEQ ID NO: 397110 - DNA, 140 bp, Artificial Sequence
  Synthetic
atggccgactcccaagtacgggtacgcgaaattttcccccgcctgcttcgtctgggagagaaaatgggcatcgatatgggtcagtccagtgaaaaccccctcccagaactcaagatggtcggagacccagcatggcgtat

SEQ ID NO: 397111 - DNA, 140 bp, Artificial Sequence
  Synthetic
aggccctggctgctgatatgtgcccctcggggcacgccgtgggcatcttccgggctgctgtgtgcacccggggggttgcgaaggcggtggacttcgtgcccgttgagtctatggaaactagaccttttgggacagcggtg

SEQ ID NO: 397112 - DNA, 140 bp, Artificial Sequence
  Synthetic
caccgctgtcccaaaaggtctagtttccatagactcaacgggcacgaagtccaccgccttcgcaaccccccgggtgcacacagcagcccggaagatgcccacggcgtgccccgaggggcacatatcagcagccagggcct

SEQ ID NO: 397113 - DNA, 140 bp, Artificial Sequence
  Synthetic
atacgccatgctgggtctccagggcccacacccctgttgtataggctcgggtcggtccaaaatgaaatcaccaccacgcacccgatcacaaaatacatcatgacatgcatgtcagcagaccgtacttgggagtcggccat

SEQ ID NO: 397114 - DNA, 140 bp, Artificial Sequence
  Synthetic
atggccgactcccaagtacggtctgctgacatgcatgtcatgatgtattttgtgatcgggtgcgtggtggtgatttcattttggaccgacccgagcctatacaacaggggtgtgggccctggagacccagcatggcgtat

SEQ ID NO: 397115 - DNA, 140 bp, Artificial Sequence
  Synthetic
atacgccatgctgggtctcctctctaccactggcaagcccgtgctaataccagatcgggaagtcatgtaccaacaatatgatgagatggaggaatgctctaagcatatcccctaccttgtcgtacttgggagtcggccat

SEQ ID NO: 397116 - DNA, 140 bp, Artificial Sequence
  Synthetic
atggccgactcccaagtacgacaaggtaggggatatgcttagagcattcctccatctcatcatattgttggtacatgacttcccgatctggtattagcacgggcttgccagtggtagagaggagacccagcatggcgtat

SEQ ID NO: 397117 - DNA, 140 bp, Artificial Sequence
  Synthetic
atacgccatgctgggtctccgcttggccgaagcttgaacagttttggcaaaaacatctgtggaattttgtgagcggtatacagtacctggctggcctttcaaccttaccaggcaacccggcgtacttgggagtcggccat

SEQ ID NO: 397118 - DNA, 140 bp, Artificial Sequence
  Synthetic
atggccgactcccaagtacgccgggttgcctggtaaggttgaaaggccagccaggtactgtataccgctcacaaaattccacagatgtttttgccaaaactgttcaagcttcggccaagcggagacccagcatggcgtat

SEQ ID NO: 397119 - DNA, 140 bp, Artificial Sequence
  Synthetic
aggccctggctgctgatatggagcggtatacagtacctggctggcctttcaaccttaccaggcaacccggctgttgcctccctaatgtctttttctgcttctctcaccagcccactatcggaccttttgggacagcggtg

SEQ ID NO: 397120 - DNA, 140 bp, Artificial Sequence
  Synthetic
caccgctgtcccaaaaggtccgatagtgggctggtgagagaagcagaaaaagacattagggaggcaacagccgggttgcctggtaaggttgaaaggccagccaggtactgtataccgctccatatcagcagccagggcct

SEQ ID NO: 397121 - DNA, 140 bp, Artificial Sequence
  Synthetic
atacgccatgctgggtctccgcgcggcggttgggagcattggccttgggagggtcttagtggacatcatcgctggatacggtgcgggcgtgtcgggagcactcgtcgcttttaagatcatcgtacttgggagtcggccat

SEQ ID NO: 397122 - DNA, 140 bp, Artificial Sequence
  Synthetic
atggccgactcccaagtacgatgatcttaaaagcgacgagtgctcccgacacgcccgcaccgtatccagcgatgatgtccactaagaccctcccaaggccaatgctcccaaccgccgcgcggagacccagcatggcgtat

SEQ ID NO: 397123 - DNA, 140 bp, Artificial Sequence
  Synthetic
  misc_feature (65)..(65): n is a, c, g, or t
atacgccatgctgggtctcccgccgcaacgtcggtcccactgagggggctacccagtggatgaanaggctaatcgcttttgcctctaggggcaaccacgtctcccccacacattatgtgccgtacttgggagtcggccat

SEQ ID NO: 397124 - DNA, 140 bp, Artificial Sequence
  Synthetic
  misc_feature (76)..(76): n is a, c, g, or t
atggccgactcccaagtacggcacataatgtgtgggggagacgtggttgcccctagaggcaaaagcgattagcctnttcatccactgggtagccccctcagtgggaccgacgttgcggcgggagacccagcatggcgtat

SEQ ID NO: 397125 - DNA, 140 bp, Artificial Sequence
  Synthetic
  misc_feature (84)..(84): n is a, c, g, or t
  misc_feature (96)..(96): n is a, c, g, or t
atacgccatgctgggtctcctaccccatgctccggttcgtggttgagggatatctgggactgggtttgcactgtgctatctganttcaagacctgnctcaaagcaaaacttgtaccatcgcgtacttgggagtcggccat

SEQ ID NO: 397126 - DNA, 140 bp, Artificial Sequence
  Synthetic
  misc_feature (45)..(45): n is a, c, g, or t
  misc_feature (57)..(57): n is a, c, g, or t
atggccgactcccaagtacgcgatggtacaagttttgctttgagncaggtcttgaantcagatagcacagtgcaaacccagtcccagatatccctcaaccacgaaccggagcatggggtaggagacccagcatggcgtat

SEQ ID NO: 397127 - DNA, 140 bp, Artificial Sequence
  Synthetic
  misc_feature (61)..(61): n is a, c, g, or t
  misc_feature (103)..(103): n is a, c, g, or t
atacgccatgctgggtctccctggccatgtacgtaacgggaccatgaagatctcggggtcncgatggtgcagcaatgtctggcatggtacgtttcctatcaangcatccacaacgggtcccgtacttgggagtcggccat

SEQ ID NO: 397128 - DNA, 140 bp, Artificial Sequence
  Synthetic
  misc_feature (38)..(38): n is a, c, g, or t
  misc_feature (80)..(80): n is a, c, g, or t
atggccgactcccaagtacgggacccgttgtggatgcnttgataggaaacgtaccatgccagacattgctgcaccatcgngaccccgagatcttcatggtcccgttacgtacatggccagggagacccagcatggcgtat

SEQ ID NO: 397129 - DNA, 140 bp, Artificial Sequence
  Synthetic
  misc_feature (53)..(53): n is a, c, g, or t
aggccctggctgctgatatgagcaatgtctggcatggtacgtttcctatcaangcatccacaacgggtcctagcgtgcccatccctgagcccaattacaagagggctctttggagggtaggaccttttgggacagcggtg

SEQ ID NO: 397130 - DNA, 140 bp, Artificial Sequence
  Synthetic
  misc_feature (88)..(88): n is a, c, g, or t
caccgctgtcccaaaaggtcctaccctccaaagagccctcttgtaattgggctcagggatgggcacgctaggacccgttgtggatgcnttgataggaaacgtaccatgccagacattgctcatatcagcagccagggcct

SEQ ID NO: 397131 - DNA, 140 bp, Artificial Sequence
  Synthetic
  misc_feature (42)..(42): n is a, c, g, or t
atacgccatgctgggtctccagagtttttcacggaagttganggggtacgtttacatcgatatgcccccccatgtaaacctctgttgagggatgaggtatccttttccgtaggtctctcccgtacttgggagtcggccat

SEQ ID NO: 397132 - DNA, 140 bp, Artificial Sequence
  Synthetic
  misc_feature (99)..(99): n is a, c, g, or t
atggccgactcccaagtacgggagagacctacggaaaaggatacctcatccctcaacagaggtttacatgggggggcatatcgatgtaaacgtaccccntcaacttccgtgaaaaactctggagacccagcatggcgtat

SEQ ID NO: 397133 - DNA, 140 bp, Artificial Sequence
  Synthetic
atacgccatgctgggtctcccaggacggcgcctcgcgcgcgggtcccccccgtctctcgccagctcatcagcaagtcagctctcagctccgtcattaaaggccacgtgtaccacgcatggcgtacttgggagtcggccat

SEQ ID NO: 397134 - DNA, 140 bp, Artificial Sequence
  Synthetic
atggccgactcccaagtacgccatgcgtggtacacgtggcctttaatgacggagctgagagctgacttgctgatgagctggcgagagacgggggggacccgcgcgcgaggcgccgtcctgggagacccagcatggcgtat

SEQ ID NO: 397135 - DNA, 140 bp, Artificial Sequence
  Synthetic
  misc_feature (94)..(94): n is a, c, g, or t
atacgccatgctgggtctcctccccatttgggcgcggcctgactacaacccgccgctgctcgagacatggagggctccagattatgaaccaccncaggtccatggatgtgcccttccccccgtacttgggagtcggccat

SEQ ID NO: 397136 - DNA, 140 bp, Artificial Sequence
  Synthetic
  misc_feature (47)..(47): n is a, c, g, or t
atggccgactcccaagtacggggggaagggcacatccatggacctgnggtggttcataatctggagccctccatgtctcgagcagcggcgggttgtagtcaggccgcgcccaaatggggaggagacccagcatggcgtat

SEQ ID NO: 397137 - DNA, 140 bp, Artificial Sequence
  Synthetic
atacgccatgctgggtctcccaatgacaatggttctgaggaggtcgccggggatgctgaacgtctctccgaagcagagtcctacagttccatgccaccacttgagggcgaacccggagaccgtacttgggagtcggccat

SEQ ID NO: 397138 - DNA, 140 bp, Artificial Sequence
  Synthetic
atggccgactcccaagtacggtctccgggttcgccctcaagtggtggcatggaactgtaggactctgcttcggagagacgttcagcatccccggcgacctcctcagaaccattgtcattgggagacccagcatggcgtat

SEQ ID NO: 397139 - DNA, 140 bp, Artificial Sequence
  Synthetic
  misc_feature (118)..(118): n is a, c, g, or t
atacgccatgctgggtctcccgtgtgcaccagaggaggaaaaattgccaattagcccgttgagcaattccctcattcgtcaccataatttggtgtactccacaacatcacggagtgcngccgtacttgggagtcggccat

SEQ ID NO: 397140 - DNA, 140 bp, Artificial Sequence
  Synthetic
  misc_feature (23)..(23): n is a, c, g, or t
atggccgactcccaagtacggcngcactccgtgatgttgtggagtacaccaaattatggtgacgaatgagggaattgctcaacgggctaattggcaatttttcctcctctggtgcacacgggagacccagcatggcgtat

SEQ ID NO: 397141 - DNA, 140 bp, Artificial Sequence
  Synthetic
atacgccatgctgggtctccaatgcgtcagaagaaagtgacgtttgaccgcatgcaggtgctggaccaacattatcatgatgtccttaaggagattaagctccgggcgtcccaggtgaagcgtacttgggagtcggccat

SEQ ID NO: 397142 - DNA, 140 bp, Artificial Sequence
  Synthetic
atggccgactcccaagtacgcttcacctgggacgcccggagcttaatctccttaaggacatcatgataatgttggtccagcacctgcatgcggtcaaacgtcactttcttctgacgcattggagacccagcatggcgtat

SEQ ID NO: 397143 - DNA, 140 bp, Artificial Sequence
  Synthetic
atacgccatgctgggtctccgtaaggccattaaccacatcaactccgtgtgggaggacttgctggaagacactcaaacaccaatccctacaaccatcatggccaagaatgaagtcttctgcgtacttgggagtcggccat

SEQ ID NO: 397144 - DNA, 140 bp, Artificial Sequence
  Synthetic
atggccgactcccaagtacgcagaagacttcattcttggccatgatggttgtagggattggtgtttgagtgtcttccagcaagtcctcccacacggagttgatgtggttaatggccttacggagacccagcatggcgtat

SEQ ID NO: 397145 - DNA, 140 bp, Artificial Sequence
  Synthetic
atacgccatgctgggtctcccgcaagttgccggtggcagtgatggggaaagcctacgggttccagtactcgcctaaacagcgagttgactatctgctcgaaatgtggcgctcaaagaagacgtacttgggagtcggccat

SEQ ID NO: 397146 - DNA, 140 bp, Artificial Sequence
  Synthetic
atggccgactcccaagtacgtcttctttgagcgccacatttcgagcagatagtcaactcgctgtttaggcgagtactggaacccgtaggctttccccatcactgccaccggcaacttgcgggagacccagcatggcgtat

SEQ ID NO: 397147 - DNA, 140 bp, Artificial Sequence
  Synthetic
  misc_feature (46)..(46): n is a, c, g, or t
atacgccatgctgggtctccgtggtcccatgtttaactcgcgaggncagctctgcgggacacgcagatgccgggcgagcggggttcttccaaccagcatgggcaataccctcacatgttacgtacttgggagtcggccat

SEQ ID NO: 397148 - DNA, 140 bp, Artificial Sequence
  Synthetic
  misc_feature (95)..(95): n is a, c, g, or t
atggccgactcccaagtacgtaacatgtgagggtattgcccatgctggttggaagaaccccgctcgcccggcatctgcgtgtcccgcagagctgncctcgcgagttaaacatgggaccacggagacccagcatggcgtat

SEQ ID NO: 397149 - DNA, 140 bp, Artificial Sequence
  Synthetic
aggccctggctgctgatatggcccctccaataccacctccacggaggaagaggacggttgtcctgtcagaatccaccgtgtcttctgccttggcggagctcgccacaaagacctttggtggaccttttgggacagcggtg

SEQ ID NO: 397150 - DNA, 140 bp, Artificial Sequence
  Synthetic
caccgctgtcccaaaaggtccaccaaaggtctttgtggcgagctccgccaaggcagaagacacggtggattctgacaggacaaccgtcctcttcctccgtggaggtggtattggaggggccatatcagcagccagggcct

SEQ ID NO: 397151 - DNA, 140 bp, Artificial Sequence
  Synthetic
atacgccatgctgggtctcctaacatcttgctcctccaatgtctccgtagcccacgacgggactggacagagatattactacctcacacgtgacccaaccggccccttagcccgcgcagccgtacttgggagtcggccat

SEQ ID NO: 397152 - DNA, 140 bp, Artificial Sequence
  Synthetic
atggccgactcccaagtacggctgcgcgggctaaggggccggttgggtcacgtgtgaggtagtaatatctctgtccagtcccgtcgtgggctacggagacattggaggagcaagatgttaggagacccagcatggcgtat

SEQ ID NO: 397153 - DNA, 140 bp, Artificial Sequence
  Synthetic
atacgccatgctgggtctccttccaaatactgcaagcgcaggagcagctccacaaagcactcgacttcgacatgtacggagtcacatactcaatcactccattggatctcccagaaatcacgtacttgggagtcggccat

SEQ ID NO: 397154 - DNA, 140 bp, Artificial Sequence
  Synthetic
atggccgactcccaagtacgtgatttctgggagatccaatggagtgattgagtatgtgactccgtacatgtcgaagtcgagtgctttgtggagctgctcctgcgcttgcagtatttggaaggagacccagcatggcgtat

SEQ ID NO: 397155 - DNA, 140 bp, Artificial Sequence
  Synthetic
  misc_feature (78)..(78): n is a, c, g, or t
  misc_feature (90)..(90): n is a, c, g, or t
atacgccatgctgggtctccgttgagagcctggagacacagagctcgagcggtcagagcaaagcttattgcccaaggngggaaagcagcnatatgcggtaagtacctcttcaactgggcacgtacttgggagtcggccat

SEQ ID NO: 397156 - DNA, 140 bp, Artificial Sequence
  Synthetic
  misc_feature (51)..(51): n is a, c, g, or t
  misc_feature (63)..(63): n is a, c, g, or t
atggccgactcccaagtacgtgcccagttgaagaggtacttaccgcatatngctgctttcccnccttgggcaataagctttgctctgaccgctcgagctctgtgtctccaggctctcaacggagacccagcatggcgtat

SEQ ID NO: 397157 - DNA, 140 bp, Artificial Sequence
  Synthetic
aggccctggctgctgatatggcgtgtcccgagctcgaccccgcattttactcctgtgcctactcctactctccgtaggggtaggcatcttcctgctccctgctcggtagacagggggcttgaccttttgggacagcggtg

SEQ ID NO: 397158 - DNA, 140 bp, Artificial Sequence
  Synthetic
caccgctgtcccaaaaggtcaagccccctgtctaccgagcagggagcaggaagatgcctacccctacggagagtaggagtaggcacaggagtaaaatgcggggtcgagctcgggacacgccatatcagcagccagggcct

SEQ ID NO: 397159 - DNA, 140 bp, Artificial Sequence
  Synthetic
  misc_feature (46)..(46): n is a, c, g, or t
  misc_feature (116)..(116): n is a, c, g, or t
aggccctggctgctgatatgaatgaaacggatgtattcttgttgcnaagtgccaggccccctcgtggcgcctggttcggatgcacatggatgaattccaccggatttgtcaaaacntgcggaccttttgggacagcggtg

SEQ ID NO: 397160 - DNA, 140 bp, Artificial Sequence
  Synthetic
  misc_feature (25)..(25): n is a, c, g, or t
  misc_feature (95)..(95): n is a, c, g, or t
caccgctgtcccaaaaggtccgcangttttgacaaatccggtggaattcatccatgtgcatccgaaccaggcgccacgagggggcctggcacttngcaacaagaatacatccgtttcattcatatcagcagccagggcct

SEQ ID NO: 397161 - DNA, 140 bp, Artificial Sequence
  Synthetic
aggccctggctgctgatatgaatgactgccctaattctagcattgtttatgaggcggatgatatcattctacaccttcctgggtgtgttccatgcgtcaccgctggaaatacatcacagtgaccttttgggacagcggtg

SEQ ID NO: 397162 - DNA, 140 bp, Artificial Sequence
  Synthetic
caccgctgtcccaaaaggtcactgtgatgtatttccagcggtgacgcatggaacacacccaggaaggtgtagaatgatatcatccgcctcataaacaatgctagaattagggcagtcattcatatcagcagccagggcct

SEQ ID NO: 397163 - DNA, 140 bp, Artificial Sequence
  Synthetic
aggccctggctgctgatatgttttgaccagggctggggccctatcagccatgccaacggaagcggccccgaccaacgcccctactgctggcactaccccccaaaaccttgcggtattgtggaccttttgggacagcggtg

SEQ ID NO: 397164 - DNA, 140 bp, Artificial Sequence
  Synthetic
caccgctgtcccaaaaggtccacaataccgcaaggttttggggggtagtgccagcagtaggggcgttggtcggggccgcttccgttggcatggctgatagggccccagccctggtcaaaacatatcagcagccagggcct

SEQ ID NO: 397165 - DNA, 140 bp, Artificial Sequence
  Synthetic
atacgccatgctgggtctcctgagagtgcctcaattgctcctcgatatcttccttgagggtcattggggtgttatcggtgctatactgtattacagtatggtaggcaactgggccaaggtcgtacttgggagtcggccat

SEQ ID NO: 397166 - DNA, 140 bp, Artificial Sequence
  Synthetic
atggccgactcccaagtacgaccttggcccagttgcctaccatactgtaatacagtatagcaccgataacaccccaatgaccctcaaggaagatatcgaggagcaattgaggcactctcaggagacccagcatggcgtat

SEQ ID NO: 397167 - DNA, 140 bp, Artificial Sequence
  Synthetic
  misc_feature (24)..(24): n is a, c, g, or t
  misc_feature (27)..(27): n is a, c, g, or t
  misc_feature (33)..(33): n is a, c, g, or t
  misc_feature (35)..(35): n is a, c, g, or t
  misc_feature (49)..(49): n is a, c, g, or t
  misc_feature (56)..(56): n is a, c, g, or t
atacgccatgctgggtctccggtnccnagcaananatccagctgattancaccaanggcagttggcacattaataggactgcccttaactgcaatgattccctgcaaacgggtttcatagcgtacttgggagtcggccat

SEQ ID NO: 397168 - DNA, 140 bp, Artificial Sequence
  Synthetic
  misc_feature (85)..(85): n is a, c, g, or t
  misc_feature (92)..(92): n is a, c, g, or t
  misc_feature (106)..(106): n is a, c, g, or t
  misc_feature (108)..(108): n is a, c, g, or t
  misc_feature (114)..(114): n is a, c, g, or t
  misc_feature (117)..(117): n is a, c, g, or t
atggccgactcccaagtacgctatgaaacccgtttgcagggaatcattgcagttaagggcagtcctattaatgtgccaactgccnttggtgntaatcagctggatntnttgctnggnaccggagacccagcatggcgtat

SEQ ID NO: 397169 - DNA, 140 bp, Artificial Sequence
  Synthetic
  misc_feature (113)..(113): n is a, c, g, or t
atacgccatgctgggtctccttaagctggtgcaggccactgcgcatgtttgaccagggctggggtcccatcacatatgccaatgtgagtgggtcgtctactgataggccatantgctggccgtacttgggagtcggccat

SEQ ID NO: 397170 - DNA, 140 bp, Artificial Sequence
  Synthetic
  misc_feature (28)..(28): n is a, c, g, or t
atggccgactcccaagtacggccagcantatggcctatcagtagacgacccactcacattggcatatgtgatgggaccccagccctggtcaaacatgcgcagtggcctgcaccagcttaaggagacccagcatggcgtat

SEQ ID NO: 397171 - DNA, 140 bp, Artificial Sequence
  Synthetic
atacgccatgctgggtctccgaagggcctccccacctacaactggggtgaaaatgaaacggatgtattcttgttgcaaagtgccaggcctcctcgtggcgcctggttcggatgcacatggcgtacttgggagtcggccat

SEQ ID NO: 397172 - DNA, 140 bp, Artificial Sequence
  Synthetic
atggccgactcccaagtacgccatgtgcatccgaaccaggcgccacgaggaggcctggcactttgcaacaagaatacatccgtttcattttcaccccagttgtaggtggggaggcccttcggagacccagcatggcgtat

SEQ ID NO: 397173 - DNA, 140 bp, Artificial Sequence
  Synthetic
aggccctggctgctgatatgactgccctgttccttcaccaccctaccggccctgtccactggtttaatccatctccatcagaacatcgtggacgtgcagtacctgtatggtatagggtcggaccttttgggacagcggtg

SEQ ID NO: 397174 - DNA, 140 bp, Artificial Sequence
  Synthetic
caccgctgtcccaaaaggtccgaccctataccatacaggtactgcacgtccacgatgttctgatggagatggattaaaccagtggacagggccggtagggtggtgaaggaacagggcagtcatatcagcagccagggcct

SEQ ID NO: 397175 - DNA, 140 bp, Artificial Sequence
  Synthetic
aggccctggctgctgatatgcgcggctcgtcgtgctcgccaccgctacgcctccgggatcggtcaccgtgccacaccccaatatcgaggaggtggccctgtccaacactggagagatcccgaccttttgggacagcggtg

SEQ ID NO: 397176 - DNA, 140 bp, Artificial Sequence
  Synthetic
caccgctgtcccaaaaggtcgggatctctccagtgttggacagggccacctcctcgatattggggtgtggcacggtgaccgatcccggaggcgtagcggtggcgagcacgacgagccgcgcatatcagcagccagggcct

SEQ ID NO: 397177 - DNA, 140 bp, Artificial Sequence
  Synthetic
aggccctggctgctgatatgcagacattccaagtggcccatctacatgcccccactggcagcggcaaaagcactaaggtgccggccgcgtatgcagcccaagggtacaaggtactcgtccgaccttttgggacagcggtg

SEQ ID NO: 397178 - DNA, 140 bp, Artificial Sequence
  Synthetic
caccgctgtcccaaaaggtcggacgagtaccttgtacccttgggctgcatacgcggccggcaccttagtgcttttgccgctgccagtgggggcatgtagatgggccacttggaatgtctgcatatcagcagccagggcct

SEQ ID NO: 397179 - DNA, 140 bp, Artificial Sequence
  Synthetic
aggccctggctgctgatatgtctgctcggccctctatgtgggggacttgtgcgggtctgtctttcttgtcggtcaactgttcactttctcccccaggcgccactggacaacgcaagactggaccttttgggacagcggtg

SEQ ID NO: 397180 - DNA, 140 bp, Artificial Sequence
  Synthetic
caccgctgtcccaaaaggtccagtcttgcgttgtccagtggcgcctgggggagaaagtgaacagttgaccgacaagaaagacagacccgcacaagtcccccacatagagggccgagcagacatatcagcagccagggcct

SEQ ID NO: 397181 - DNA, 140 bp, Artificial Sequence
  Synthetic
aggccctggctgctgatatgtatgacgcgggctgtgcttggtacgagctcacgcccgccgagacctcggttaggttgcgggcttacctaaatacaccagggttgcccgtctgccaggaccgaccttttgggacagcggtg

SEQ ID NO: 397182 - DNA, 140 bp, Artificial Sequence
  Synthetic
caccgctgtcccaaaaggtcggtcctggcagacgggcaaccctggtgtatttaggtaagcccgcaacctaaccgaggtctcggcgggcgtgagctcgtaccaagcacagcccgcgtcatacatatcagcagccagggcct

SEQ ID NO: 397183 - DNA, 140 bp, Artificial Sequence
  Synthetic
atacgccatgctgggtctccacctccacaaccctcctacttaacatcttaggggggtgggtcgcttcgcagttggctaatcctactgcatctacggcatttgtggtgagcggcctggcggcgtacttgggagtcggccat

SEQ ID NO: 397184 - DNA, 140 bp, Artificial Sequence
  Synthetic
atggccgactcccaagtacgccgccaggccgctcaccacaaatgccgtagatgcagtaggattagccaactgcgaagcgacccacccccctaagatgttaagtaggagggttgtggaggtggagacccagcatggcgtat

SEQ ID NO: 397185 - DNA, 140 bp, Artificial Sequence
  Synthetic
aggccctggctgctgatatgcttctggccctgctctcttgcctgactgtgcccgcgtcagcctaccaagtacgcaactcctcgggcctttaccatgtcaccaatgattgccctaactcgagaccttttgggacagcggtg

SEQ ID NO: 397186 - DNA, 140 bp, Artificial Sequence
  Synthetic
caccgctgtcccaaaaggtctcgagttagggcaatcattggtgacatggtaaaggcccgaggagttgcgtacttggtaggctgacgcgggcacagtcaggcaagagagcagggccagaagcatatcagcagccagggcct

SEQ ID NO: 397187 - DNA, 140 bp, Artificial Sequence
  Synthetic
aggccctggctgctgatatgcttggacatgatcgctggtgcccactggggagtcctagcgggcatagcgtatttctccatggtggggaactgggcgaaggtcttagtggtgctgttgctggaccttttgggacagcggtg

SEQ ID NO: 397188 - DNA, 140 bp, Artificial Sequence
  Synthetic
caccgctgtcccaaaaggtccagcaacagcaccactaagaccttcgcccagttccccaccatggagaaatacgctatgcccgctaggactccccagtgggcaccagcgatcatgtccaagcatatcagcagccagggcct

SEQ ID NO: 397189 - DNA, 140 bp, Artificial Sequence
  Synthetic
aggccctggctgctgatatggctccggttcctggctaagggacatctgggactggatatgcgaggtgctgagcgattttaagacctggctaaaagccaagctcatgccacaactgcctgggaccttttgggacagcggtg

SEQ ID NO: 397190 - DNA, 140 bp, Artificial Sequence
  Synthetic
caccgctgtcccaaaaggtcccaggcagttgtggcatgagcttggcttttagccaggtcttaaaatcgctcagcacctcgcatatccagtcccagatgtcccttagccaggaaccggagccatatcagcagccagggcct

SEQ ID NO: 397191 - DNA, 140 bp, Artificial Sequence
  Synthetic
aggccctggctgctgatatgccacaaattcaactcttcaggctgccccgagaggatggccagctgtagaccccttgccgatttcgaccagggctggggccctatcagctacgccaacggagaccttttgggacagcggtg

SEQ ID NO: 397192 - DNA, 140 bp, Artificial Sequence
  Synthetic
caccgctgtcccaaaaggtctccgttggcgtagctgatagggccccagccctggtcgaaatcggcaaggggtctacagctggccatcctctcggggcagcctgaagagttgaatttgtggcatatcagcagccagggcct

SEQ ID NO: 397193 - DNA, 140 bp, Artificial Sequence
  Synthetic
aggccctggctgctgatatgcccttgccgatttcgaccagggctggggccctatcagctacgccaacggaagcgggcccgaacaccgcccctactgctggcactaccccccaaagccttggaccttttgggacagcggtg

SEQ ID NO: 397194 - DNA, 140 bp, Artificial Sequence
  Synthetic
caccgctgtcccaaaaggtccaaggctttggggggtagtgccagcagtaggggcggtgttcgggcccgcttccgttggcgtagctgatagggccccagccctggtcgaaatcggcaagggcatatcagcagccagggcct

SEQ ID NO: 397195 - DNA, 140 bp, Artificial Sequence
  Synthetic
aggccctggctgctgatatgccaaagtgtgcggagcgcctccttgtgtcatcggagggacgggcaacaacaccttgcactgccccactgactgtttccgcaagcatccggaagccacatagaccttttgggacagcggtg

SEQ ID NO: 397196 - DNA, 140 bp, Artificial Sequence
  Synthetic
caccgctgtcccaaaaggtctatgtggcttccggatgcttgcggaaacagtcagtggggcagtgcaaggtgttgttgcccgtccctccgatgacacaaggaggcgctccgcacactttggcatatcagcagccagggcct

SEQ ID NO: 397197 - DNA, 140 bp, Artificial Sequence
  Synthetic
aggccctggctgctgatatgaccttgcactgccccactgactgtttccgcaagcatccggaagccacatactctcggtgtggctccggtccctggatcacgcccaggtgtctggtccactgaccttttgggacagcggtg

SEQ ID NO: 397198 - DNA, 140 bp, Artificial Sequence
  Synthetic
caccgctgtcccaaaaggtcagtggaccagacacctgggcgtgatccagggaccggagccacaccgagagtatgtggcttccggatgcttgcggaaacagtcagtggggcagtgcaaggtcatatcagcagccagggcct

SEQ ID NO: 397199 - DNA, 140 bp, Artificial Sequence
  Synthetic
aggccctggctgctgatatgcctgggccatcaagtgggagtacgtcatcctcttgtttctcctgcttgcagacgcgcgcatctgctcctgcttgtggatgatgttactcatatcccaagcgaccttttgggacagcggtg

SEQ ID NO: 397200 - DNA, 140 bp, Artificial Sequence
  Synthetic
caccgctgtcccaaaaggtcgcttgggatatgagtaacatcatccacaagcaggagcagatgcgcgcgtctgcaagcaggagaaacaagaggatgacgtactcccacttgatggcccaggcatatcagcagccagggcct

SEQ ID NO: 397201 - DNA, 140 bp, Artificial Sequence
  Synthetic
aggccctggctgctgatatgcagatggagaccaagctcatcacgtggggggcggacaccgccgcgtgcggcgacatcatcaacggcttgcccgtctctgcccgtaggggccgagagatacgaccttttgggacagcggtg

SEQ ID NO: 397202 - DNA, 140 bp, Artificial Sequence
  Synthetic
caccgctgtcccaaaaggtcgtatctctcggcccctacgggcagagacgggcaagccgttgatgatgtcgccgcacgcggcggtgtccgccccccacgtgatgagcttggtctccatctgcatatcagcagccagggcct

SEQ ID NO: 397203 - DNA, 140 bp, Artificial Sequence
  Synthetic
aggccctggctgctgatatgcccatcacggcgtatgcccagcagacaaggggcctcttgggatgcataattaccagcctgaccggccgggacaaaaaccaggtggagggtgaggttcagagaccttttgggacagcggtg

SEQ ID NO: 397204 - DNA, 140 bp, Artificial Sequence
  Synthetic
caccgctgtcccaaaaggtctctgaacctcaccctccacctggtttttgtcccggccggtcaggctggtaattatgcatcccaagaggccccttgtctgctgggcatacgccgtgatgggcatatcagcagccagggcct

SEQ ID NO: 397205 - DNA, 140 bp, Artificial Sequence
  Synthetic
aggccctggctgctgatatggacttccgagcggtcgcaacctcgtggaaggcgacaacctatccccaaggctcgccggcccgagggcaggacctgggctcagcccgggtacccttggcccgaccttttgggacagcggtg

SEQ ID NO: 397206 - DNA, 140 bp, Artificial Sequence
  Synthetic
caccgctgtcccaaaaggtcgggccaagggtacccgggctgagcccaggtcctgccctcgggccggcgagccttggggataggttgtcgccttccacgaggttgcgaccgctcggaagtccatatcagcagccagggcct

SEQ ID NO: 397207 - DNA, 140 bp, Artificial Sequence
  Synthetic
aggccctggctgctgatatgccactggggggttctggcggggctcgcctactattccatggtggggaactgggctaaggtcttgattgtgatgttactctttgccggcgttgacggaagcgaccttttgggacagcggtg

SEQ ID NO: 397208 - DNA, 140 bp, Artificial Sequence
  Synthetic
caccgctgtcccaaaaggtcgcttccgtcaacgccggcaaagagtaacatcacaatcaagaccttagcccagttccccaccatggaatagtaggcgagccccgccagaaccccccagtggcatatcagcagccagggcct

SEQ ID NO: 397209 - DNA, 140 bp, Artificial Sequence
  Synthetic
aggccctggctgctgatatggcagctggcacatcaacaggactgccctgaactgcaatgactccctccacactgggtttcttgctggtgttttctatcacaacaagttcaactcttccgggaccttttgggacagcggtg

SEQ ID NO: 397210 - DNA, 140 bp, Artificial Sequence
  Synthetic
caccgctgtcccaaaaggtcccggaagagttgaacttgttgtgatagaaaacaccagcaagaaacccagtgtggagggagtcattgcagttcagggcagtcctgttgatgtgccagctgccatatcagcagccagggcct

SEQ ID NO: 397211 - DNA, 140 bp, Artificial Sequence
  Synthetic
atacgccatgctgggtctccttgttcggccttgtacatcggggacctttgtggtggtgtcttcctggtgggacagcttttcaccttccgtcccaggaggcatcaaaccacccaggattgtcgtacttgggagtcggccat

SEQ ID NO: 397212 - DNA, 140 bp, Artificial Sequence
  Synthetic
atggccgactcccaagtacgacaatcctgggtggtttgatgcctcctgggacggaaggtgaaaagctgtcccaccaggaagacaccaccacaaaggtccccgatgtacaaggccgaacaaggagacccagcatggcgtat

SEQ ID NO: 397213 - DNA, 140 bp, Artificial Sequence
  Synthetic
atacgccatgctgggtctcctattgctggcactacgcgcctcgacagtgcggtatcgtacccgcgtcggatgtgtgtggtccggtatattgcttcactcccagccccgtcgttgtgtggacgtacttgggagtcggccat

SEQ ID NO: 397214 - DNA, 140 bp, Artificial Sequence
  Synthetic
atggccgactcccaagtacgtccacacaacgacggggctgggagtgaagcaatataccggaccacacacatccgacgcgggtacgataccgcactgtcgaggcgcgtagtgccagcaataggagacccagcatggcgtat

SEQ ID NO: 397215 - DNA, 140 bp, Artificial Sequence
  Synthetic
atacgccatgctgggtctccccaccgatcgtctcggtgtccctacgtacacctggggtgagaatgagacggacgtgctgctcctcaacaataccaggccgccgcatggtaattggtttggcgtacttgggagtcggccat

SEQ ID NO: 397216 - DNA, 140 bp, Artificial Sequence
  Synthetic
atggccgactcccaagtacgccaaaccaattaccatgcggcggcctggtattgttgaggagcagcacgtccgtctcattctcaccccaggtgtacgtagggacaccgagacgatcggtggggagacccagcatggcgtat

SEQ ID NO: 397217 - DNA, 140 bp, Artificial Sequence
  Synthetic
aggccctggctgctgatatgttgccggcgtcgacgcgaaaaccaccgtcaccgggggaactgccgcccacaccacgtctgggattgctggcctttttatgccaggcgcccggcagaacgtgaccttttgggacagcggtg

SEQ ID NO: 397218 - DNA, 140 bp, Artificial Sequence
  Synthetic
caccgctgtcccaaaaggtcacgttctgccgggcgcctggcataaaaaggccagcaatcccagacgtggtgtgggcggcagttcccccggtgacggtggttttcgcgtcgacgccggcaacatatcagcagccagggcct

SEQ ID NO: 397219 - DNA, 140 bp, Artificial Sequence
  Synthetic
aggccctggctgctgatatggctccggatcccacaagccgtcgtggacatggtggcgggggcccactggggagtcctggcgggccttgcctactattccatggtggggaactgggctaaggaccttttgggacagcggtg

SEQ ID NO: 397220 - DNA, 140 bp, Artificial Sequence
  Synthetic
caccgctgtcccaaaaggtccttagcccagttccccaccatggaatagtaggcaaggcccgccaggactccccagtgggcccccgccaccatgtccacgacggcttgtgggatccggagccatatcagcagccagggcct

SEQ ID NO: 397221 - DNA, 140 bp, Artificial Sequence
  Synthetic
aggccctggctgctgatatggagtcctggcgggccttgcctactattccatggtggggaactgggctaaggtcttgattgtgatgctactctttgccggcgttgacgggacaaccacggtgaccttttgggacagcggtg

SEQ ID NO: 397222 - DNA, 140 bp, Artificial Sequence
  Synthetic
caccgctgtcccaaaaggtcaccgtggttgtcccgtcaacgccggcaaagagtagcatcacaatcaagaccttagcccagttccccaccatggaatagtaggcaaggcccgccaggactccatatcagcagccagggcct

SEQ ID NO: 397223 - DNA, 140 bp, Artificial Sequence
  Synthetic
aggccctggctgctgatatgcacatcaacaggactgccctgaactgcaatgactccctcaacactgggttccttgccgcgctgttctacacacacaagttcaacgcgtctggatgcccaggaccttttgggacagcggtg

SEQ ID NO: 397224 - DNA, 140 bp, Artificial Sequence
  Synthetic
caccgctgtcccaaaaggtcctgggcatccagacgcgttgaacttgtgtgtgtagaacagcgcggcaaggaacccagtgttgagggagtcattgcagttcagggcagtcctgttgatgtgcatatcagcagccagggcct

SEQ ID NO: 397225 - DNA, 140 bp, Artificial Sequence
  Synthetic
aggccctggctgctgatatggggcgaagcatatgtggaacttcatcagtgggatacaatatctggcgggcctgtcaacgttgcctggtaatcccgctattgcatcattgatggcttttacgaccttttgggacagcggtg

SEQ ID NO: 397226 - DNA, 140 bp, Artificial Sequence
  Synthetic
caccgctgtcccaaaaggtcgtaaaagccatcaatgatgcaatagcgggattaccaggcaacgttgacaggcccgccagatattgtatcccactgatgaagttccacatatgcttcgccccatatcagcagccagggcct

SEQ ID NO: 397227 - DNA, 140 bp, Artificial Sequence
  Synthetic
atacgccatgctgggtctccgcctttgtgggcgctggtttagctggcgccgccatcggcagtgttggactggggaaggttctcgtggacatccttgcagggtatggcgcgggcgtggcggcgtacttgggagtcggccat

SEQ ID NO: 397228 - DNA, 140 bp, Artificial Sequence
  Synthetic
atggccgactcccaagtacgccgccacgcccgcgccataccctgcaaggatgtccacgagaaccttccccagtccaacactgccgatggcggcgccagctaaaccagcgcccacaaaggcggagacccagcatggcgtat

SEQ ID NO: 397229 - DNA, 140 bp, Artificial Sequence
  Synthetic
atacgccatgctgggtctcccactagtgtggaccaggacctcgtcggctggtgggagcgccccggtgcgcgttccctgacaccaggcacctgtggcagctcggtcctttacttggtcacgcgtacttgggagtcggccat

SEQ ID NO: 397230 - DNA, 140 bp, Artificial Sequence
  Synthetic
atggccgactcccaagtacgcgtgaccaagtaaaggaccgagctgccacaggtgcctggtgtcagggaacgcgcaccggggcgctcccaccagccgacgaggtcctggtccacactagtgggagacccagcatggcgtat

SEQ ID NO: 397231 - DNA, 140 bp, Artificial Sequence
  Synthetic
atacgccatgctgggtctcccatcaccaagattttgctcgccatactcggtccgctcatggtgctccaggccggcctaaccaaaatgccgtactttgtacgcgctcaaggccttatccgtcgtacttgggagtcggccat

SEQ ID NO: 397232 - DNA, 140 bp, Artificial Sequence
  Synthetic
atggccgactcccaagtacgacggataaggccttgagcgcgtacaaagtacggcattttggttaggccggcctggagcaccatgagcggaccgagtatggcgagcaaaatcttggtgatgggagacccagcatggcgtat

SEQ ID NO: 397233 - DNA, 140 bp, Artificial Sequence
  Synthetic
atacgccatgctgggtctcccaggggtggcgactcctcgcgcctatcacggcctattcccaacagacgcggggcctactcggctgcatcatcactagcctcacaggccgggacaagaacccgtacttgggagtcggccat

SEQ ID NO: 397234 - DNA, 140 bp, Artificial Sequence
  Synthetic
atggccgactcccaagtacgggttcttgtcccggcctgtgaggctagtgatgatgcagccgagtaggccccgcgtctgttgggaataggccgtgataggcgcgaggagtcgccacccctgggagacccagcatggcgtat

SEQ ID NO: 397235 - DNA, 140 bp, Artificial Sequence
  Synthetic
aggccctggctgctgatatgtgacctggaggtcgtcactagcacctgggtgctggtaggcggagtccttgcagctctggccgcatactgcctgacaacaggcagcgtggtcattgtgggtgaccttttgggacagcggtg

SEQ ID NO: 397236 - DNA, 140 bp, Artificial Sequence
  Synthetic
caccgctgtcccaaaaggtcacccacaatgaccacgctgcctgttgtcaggcagtatgcggccagagctgcaaggactccgcctaccagcacccaggtgctagtgacgacctccaggtcacatatcagcagccagggcct

SEQ ID NO: 397237 - DNA, 140 bp, Artificial Sequence
  Synthetic
aggccctggctgctgatatggctccacgccatgctccggctcgtggctaagggatgtttgggactggatatgcacggtgttgactgacttcaagacctggctccagtccaagctcctgccgaccttttgggacagcggtg

SEQ ID NO: 397238 - DNA, 140 bp, Artificial Sequence
  Synthetic
caccgctgtcccaaaaggtcggcaggagcttggactggagccaggtcttgaagtcagtcaacaccgtgcatatccagtcccaaacatcccttagccacgagccggagcatggcgtggagccatatcagcagccagggcct

SEQ ID NO: 397239 - DNA, 140 bp, Artificial Sequence
  Synthetic
atacgccatgctgggtctcccccacaccctgacgctgagttgattgaagcgaacttgctgtggaggcaggagatggggagtaacatcacccgggtagagtctgagagcaaagtcatcgtgcgtacttgggagtcggccat

SEQ ID NO: 397240 - DNA, 140 bp, Artificial Sequence
  Synthetic
atggccgactcccaagtacgcacgatgactttgctctcagactctacccgggtgatgttactccccatctcctgcctccacagcaagttcgcttcaatcaactcagcgtcagggtgtgggggagacccagcatggcgtat

SEQ ID NO: 397241 - DNA, 140 bp, Artificial Sequence
  Synthetic
aggccctggctgctgatatggtggccaccagggacggcaaactccccacgacgcagcttcgacgtcacatcgatctgcttgtcgggagcgccaccctctgttcggccctctatgtggggggaccttttgggacagcggtg

SEQ ID NO: 397242 - DNA, 140 bp, Artificial Sequence
  Synthetic
caccgctgtcccaaaaggtccccccacatagagggccgaacagagggtggcgctcccgacaagcagatcgatgtgacgtcgaagctgcgtcgtggggagtttgccgtccctggtggccaccatatcagcagccagggcct

SEQ ID NO: 397243 - DNA, 140 bp, Artificial Sequence
  Synthetic
aggccctggctgctgatatgagggctccagattatgaaccaccacaggtccatggatgtgcccttcccccccccgggaacactcctgttccaccacctaggaggaggaaggttgtacaacgaccttttgggacagcggtg

SEQ ID NO: 397244 - DNA, 140 bp, Artificial Sequence
  Synthetic
caccgctgtcccaaaaggtcgttgtacaaccttcctcctcctaggtggtggaacaggagtgttcccgggggggggaagggcacatccatggacctgtggtggttcataatctggagccctcatatcagcagccagggcct

SEQ ID NO: 397245 - DNA, 140 bp, Artificial Sequence
  Synthetic
aggccctggctgctgatatggctgatcaacaccaacggcagttggcacatcaatcgcacggccttgaactgtaatgcgagcctcgacaccggctgggtagcggggctcttctattaccacgaccttttgggacagcggtg

SEQ ID NO: 397246 - DNA, 140 bp, Artificial Sequence
  Synthetic
caccgctgtcccaaaaggtcgtggtaatagaagagccccgctacccagccggtgtcgaggctcgcattacagttcaaggccgtgcgattgatgtgccaactgccgttggtgttgatcagccatatcagcagccagggcct

SEQ ID NO: 397247 - DNA, 140 bp, Artificial Sequence
  Synthetic
aggccctggctgctgatatggacgtgctcaaggagatgaaggcgaaggcgtccacagttaaggctaaacttctatccgtagaagaagcctgcaagctgacgcccccacactcggccagatgaccttttgggacagcggtg

SEQ ID NO: 397248 - DNA, 140 bp, Artificial Sequence
  Synthetic
caccgctgtcccaaaaggtcatctggccgagtgtgggggcgtcagcttgcaggcttcttctacggatagaagtttagccttaactgtggacgccttcgccttcatctccttgagcacgtccatatcagcagccagggcct

SEQ ID NO: 397249 - DNA, 140 bp, Artificial Sequence
  Synthetic
atacgccatgctgggtctccccccgtggtggtgggaacgaccaacaagttgggcgcgcctacctacaactggggtggtaatgatacggacgtcctcgtccttaataacaccaggccaccgcgtacttgggagtcggccat

SEQ ID NO: 397250 - DNA, 140 bp, Artificial Sequence
  Synthetic
atggccgactcccaagtacgcggtggcctggtgttattaaggacgaggacgtccgtatcattaccaccccagttgtaggtaggcgcgcccaacttgttggtcgttcccaccaccacggggggagacccagcatggcgtat

SEQ ID NO: 397251 - DNA, 140 bp, Artificial Sequence
  Synthetic
atacgccatgctgggtctccgctccgaatcgtcggccgtcgacagcggcacggcgaccgcccctcctgaccagccctccgacgacggcggcgcgggatccgacgttgagtcgtactcctccgtacttgggagtcggccat

SEQ ID NO: 397252 - DNA, 140 bp, Artificial Sequence
  Synthetic
atggccgactcccaagtacggaggagtacgactcaacgtcggatcccgcgccgccgtcgtcggagggctggtcaggaggggcggtcgccgtgccgctgtcgacggccgacgattcggagcggagacccagcatggcgtat

SEQ ID NO: 397253 - DNA, 140 bp, Artificial Sequence
  Synthetic
aggccctggctgctgatatgtcaggatgtacgtgggaggggtcgagcacaggctggaagttgcttgcaactggacgcggggcgagcgttgtgatctggacgacagggacaggtccgagctgaccttttgggacagcggtg

SEQ ID NO: 397254 - DNA, 140 bp, Artificial Sequence
  Synthetic
caccgctgtcccaaaaggtcagctcggacctgtccctgtcgtccagatcacaacgctcgccccgcgtccagttgcaagcaacttccagcctgtgctcgacccctcccacgtacatcctgacatatcagcagccagggcct

SEQ ID NO: 397255 - DNA, 140 bp, Artificial Sequence
  Synthetic
aggccctggctgctgatatgtgtggtatcatacccgcgtcgggggtgtgtggtccagtgtattgcttcaccccaagccctgttgtggtggggacgaccgatcgtttcggcgcccccacatgaccttttgggacagcggtg

SEQ ID NO: 397256 - DNA, 140 bp, Artificial Sequence
  Synthetic
caccgctgtcccaaaaggtcatgtgggggcgccgaaacgatcggtcgtccccaccacaacagggcttggggtgaagcaatacactggaccacacacccccgacgcgggtatgataccacacatatcagcagccagggcct

SEQ ID NO: 397257 - DNA, 140 bp, Artificial Sequence
  Synthetic
atacgccatgctgggtctcctaatactcaacgcagcatccttggctgggacgcacggtcttgtgtccttcctcgtgttcttctgctttgcatggtatctgaagggtaggtgggtgcccggcgtacttgggagtcggccat

SEQ ID NO: 397258 - DNA, 140 bp, Artificial Sequence
  Synthetic
atggccgactcccaagtacgccgggcacccacctacccttcagataccatgcaaagcagaagaacacgaggaaggacacaagaccgtgcgtcccagccaaggatgctgcgttgagtattaggagacccagcatggcgtat

SEQ ID NO: 397259 - DNA, 140 bp, Artificial Sequence
  Synthetic
atacgccatgctgggtctccgttatgcagtaagtcgtgccaccagtggcctcaccggcctcttcaccccaggtgccaggcagaacatccagctgatcaacaccaacggcagttggcatatcgtacttgggagtcggccat

SEQ ID NO: 397260 - DNA, 140 bp, Artificial Sequence
  Synthetic
atggccgactcccaagtacgatatgccaactgccgttggtgttgatcagctggatgttctgcctggcacctggggtgaagaggccggtgaggccactggtggcacgacttactgcataacggagacccagcatggcgtat

SEQ ID NO: 397261 - DNA, 140 bp, Artificial Sequence
  Synthetic
aggccctggctgctgatatgagaacatccagctgatcaacaccaacggcagttggcacatcaataggacggccttgaactgcaatgagagcctcaacaccggctggctagcagggcttttgaccttttgggacagcggtg

SEQ ID NO: 397262 - DNA, 140 bp, Artificial Sequence
  Synthetic
caccgctgtcccaaaaggtcaaaagccctgctagccagccggtgttgaggctctcattgcagttcaaggccgtcctattgatgtgccaactgccgttggtgttgatcagctggatgttctcatatcagcagccagggcct

SEQ ID NO: 397263 - DNA, 140 bp, Artificial Sequence
  Synthetic
atacgccatgctgggtctcctcctatcacttatgctgagcctacaaaagacccggaccagaggccttattgctggcactacccacctcaacaatgtggtatcgtacctgcgtcgcaggtgcgtacttgggagtcggccat

SEQ ID NO: 397264 - DNA, 140 bp, Artificial Sequence
  Synthetic
atggccgactcccaagtacgcacctgcgacgcaggtacgataccacattgttgaggtgggtagtgccagcaataaggcctctggtccgggtcttttgtaggctcagcataagtgataggaggagacccagcatggcgtat

SEQ ID NO: 397265 - DNA, 140 bp, Artificial Sequence
  Synthetic
atacgccatgctgggtctccatctggaccgtctcagaaaatccagcttataaacaccaacggcagctggcacatcaacaggactgctctgaactgcaatgactccctccagactgggttccgtacttgggagtcggccat

SEQ ID NO: 397266 - DNA, 140 bp, Artificial Sequence
  Synthetic
atggccgactcccaagtacggaacccagtctggagggagtcattgcagttcagagcagtcctgttgatgtgccagctgccgttggtgtttataagctggattttctgagacggtccagatggagacccagcatggcgtat

SEQ ID NO: 397267 - DNA, 140 bp, Artificial Sequence
  Synthetic
atacgccatgctgggtctccaggtgttcctcgctaggctcctatggtggttacaatatcttatcaccagagctgaggcgcacttgcatgtgtgggttccccccctcaacgtccggggaggcgtacttgggagtcggccat

SEQ ID NO: 397268 - DNA, 140 bp, Artificial Sequence
  Synthetic
atggccgactcccaagtacgcctccccggacgttgagggggggaacccacacatgcaagtgcgcctcagctctggtgataagatattgtaaccaccataggagcctagcgaggaacacctggagacccagcatggcgtat

SEQ ID NO: 397269 - DNA, 140 bp, Artificial Sequence
  Synthetic
aggccctggctgctgatatgttcctcgctaagctcatatggtggttgcaatattttatcaccagggctgaggcgcatttgcaagtgtggaccccccccctcaacgttcgggggggccgcggaccttttgggacagcggtg

SEQ ID NO: 397270 - DNA, 140 bp, Artificial Sequence
  Synthetic
caccgctgtcccaaaaggtccgcggcccccccgaacgttgagggggggggtccacacttgcaaatgcgcctcagccctggtgataaaatattgcaaccaccatatgagcttagcgaggaacatatcagcagccagggcct

SEQ ID NO: 397271 - DNA, 140 bp, Artificial Sequence
  Synthetic
  misc_feature (95)..(95): n is a, c, g, or t
  misc_feature (101)..(101): n is a, c, g, or t
  misc_feature (117)..(117): n is a, c, g, or t
aggccctggctgctgatatgcacgtatgccaacgtgagtggatcatctgatgataggccatactgctggcactatgcgccccggccctgtgacancgtccnagccagctcggtctgnggggaccttttgggacagcggtg

SEQ ID NO: 397272 - DNA, 140 bp, Artificial Sequence
  Synthetic
  misc_feature (24)..(24): n is a, c, g, or t
  misc_feature (40)..(40): n is a, c, g, or t
  misc_feature (46)..(46): n is a, c, g, or t
caccgctgtcccaaaaggtccccncagaccgagctggctnggacgntgtcacagggccggggcgcatagtgccagcagtatggcctatcatcagatgatccactcacgttggcatacgtgcatatcagcagccagggcct

SEQ ID NO: 397273 - DNA, 140 bp, Artificial Sequence
  Synthetic
aggccctggctgctgatatgtgcccgcgtcagcctaccaagtacgcaactcctcgggcctctaccatgtcaccaatgattgccccaactcgagtattgtgtacgagacggccgataccatgaccttttgggacagcggtg

SEQ ID NO: 397274 - DNA, 140 bp, Artificial Sequence
  Synthetic
caccgctgtcccaaaaggtcatggtatcggccgtctcgtacacaatactcgagttggggcaatcattggtgacatggtagaggcccgaggagttgcgtacttggtaggctgacgcgggcacatatcagcagccagggcct

SEQ ID NO: 397275 - DNA, 140 bp, Artificial Sequence
  Synthetic
atacgccatgctgggtctccccagctgctgaaaaggctccaccagtggatcaatgaggactgcaccacaccgtgctccggctcctggctaagggatatctgggactggatatgcacagtgcgtacttgggagtcggccat

SEQ ID NO: 397276 - DNA, 140 bp, Artificial Sequence
  Synthetic
atggccgactcccaagtacgcactgtgcatatccagtcccagatatcccttagccaggagccggagcacggtgtggtgcagtcctcattgatccactggtggagccttttcagcagctggggagacccagcatggcgtat

SEQ ID NO: 397277 - DNA, 140 bp, Artificial Sequence
  Synthetic
atacgccatgctgggtctccgagcgcgacatacgcaacgagcacgacatctaccaatgttgtcaactggacccagaggccaggaaagccataacatctttgacagagaggctttaccttgcgtacttgggagtcggccat

SEQ ID NO: 397278 - DNA, 140 bp, Artificial Sequence
  Synthetic
atggccgactcccaagtacgcaaggtaaagcctctctgtcaaagatgttatggctttcctggcctctgggtccagttgacaacattggtagatgtcgtgctcgttgcgtatgtcgcgctcggagacccagcatggcgtat

SEQ ID NO: 397279 - DNA, 140 bp, Artificial Sequence
  Synthetic
atacgccatgctgggtctcccggttgtcctgacggactccaccgtgtcttctgttttggcggagctcgctaccaaaaccttcggcagctccgaattgtcggccgccgacagcggcacggccgtacttgggagtcggccat

SEQ ID NO: 397280 - DNA, 140 bp, Artificial Sequence
  Synthetic
atggccgactcccaagtacggccgtgccgctgtcggcggccgacaattcggagctgccgaaggttttggtagcgagctccgccaaaacagaagacacggtggagtccgtcaggacaaccgggagacccagcatggcgtat

SEQ ID NO: 397281 - DNA, 140 bp, Artificial Sequence
  Synthetic
  misc_feature (97)..(97): n is a, c, g, or t
atacgccatgctgggtctcctgttggtttgcggagatgatttggtggtcatcactgagagtgctggagtccccgaggatacggctaagctgcgagcnttcacggaagctatgaccagatacgtacttgggagtcggccat

SEQ ID NO: 397282 - DNA, 140 bp, Artificial Sequence
  Synthetic
  misc_feature (44)..(44): n is a, c, g, or t
atggccgactcccaagtacgtatctggtcatagcttccgtgaangctcgcagcttagccgtatcctcggggactccagcactctcagtgatgaccaccaaatcatctccgcaaaccaacaggagacccagcatggcgtat

SEQ ID NO: 397283 - DNA, 140 bp, Artificial Sequence
  Synthetic
aggccctggctgctgatatgagactatgtccccccagtggtacatgggtgcccattgccacctaccaaggcccctccaataccgcccccgcggcggaagaggacggttgtcctaacagaagaccttttgggacagcggtg

SEQ ID NO: 397284 - DNA, 140 bp, Artificial Sequence
  Synthetic
caccgctgtcccaaaaggtcttctgttaggacaaccgtcctcttccgccgcgggggcggtattggaggggccttggtaggtggcaatgggcacccatgtaccactggggggacatagtctcatatcagcagccagggcct

SEQ ID NO: 397285 - DNA, 140 bp, Artificial Sequence
  Synthetic
atacgccatgctgggtctcccgttaagttcccgggcggcggccagatcgtcggtggagtctacttattgccgcgcaggggcccacgtttgggtgtgcgcgcgacgaggaagacttctgaacgtacttgggagtcggccat

SEQ ID NO: 397286 - DNA, 140 bp, Artificial Sequence
  Synthetic
atggccgactcccaagtacgttcagaagtcttcctcgtcgcgcgcacacccaaacgtgggcccctgcgcggcaataagtagactccaccgacgatctggccgccgcccgggaacttaacgggagacccagcatggcgtat

SEQ ID NO: 397287 - DNA, 140 bp, Artificial Sequence
  Synthetic
atacgccatgctgggtctccagtcatcgataccataacttgcggcctcgccgacctcatggggtacatcccagtcctaggagcgccacttggtggtgttgcggctgccctagcgcatggccgtacttgggagtcggccat

SEQ ID NO: 397288 - DNA, 140 bp, Artificial Sequence
  Synthetic
atggccgactcccaagtacggccatgcgctagggcagccgcaacaccaccaagtggcgctcctaggactgggatgtaccccatgaggtcggcgaggccgcaagttatggtatcgatgactggagacccagcatggcgtat

SEQ ID NO: 397289 - DNA, 140 bp, Artificial Sequence
  Synthetic
atacgccatgctgggtctccccgcctcggcagtccattacagaaatgcctctgggatataccatctcaccaacgactgcccgaactccagcatcgtttatgaggcggacaccatgattttcgtacttgggagtcggccat

SEQ ID NO: 397290 - DNA, 140 bp, Artificial Sequence
  Synthetic
atggccgactcccaagtacgaaaatcatggtgtccgcctcataaacgatgctggagttcgggcagtcgttggtgagatggtatatcccagaggcatttctgtaatggactgccgaggcggggagacccagcatggcgtat

SEQ ID NO: 397291 - DNA, 140 bp, Artificial Sequence
  Synthetic
atacgccatgctgggtctccaactgttccatctatactggtcatgttacgggacacaggatggcctgggatatgatgatgaattggtccccgacagcggcctatgccatctctgctttaccgtacttgggagtcggccat

SEQ ID NO: 397292 - DNA, 140 bp, Artificial Sequence
  Synthetic
atggccgactcccaagtacggtaaagcagagatggcataggccgctgtcggggaccaattcatcatcatatcccaggccatcctgtgtcccgtaacatgaccagtatagatggaacagttggagacccagcatggcgtat

SEQ ID NO: 397293 - DNA, 140 bp, Artificial Sequence
  Synthetic
aggccctggctgctgatatggttctcggtgctttgctgtattacagcatggtggcaaattgggctaaagtcttggcagttctgctcctcttcgcgggtgtcgacgcgcatacttacaccagaccttttgggacagcggtg

SEQ ID NO: 397294 - DNA, 140 bp, Artificial Sequence
  Synthetic
caccgctgtcccaaaaggtctggtgtaagtatgcgcgtcgacacccgcgaagaggagcagaactgccaagactttagcccaatttgccaccatgctgtaatacagcaaagcaccgagaaccatatcagcagccagggcct

SEQ ID NO: 397295 - DNA, 140 bp, Artificial Sequence
  Synthetic
atacgccatgctgggtctcctataaacaggaccgccctcaactgcaatgatagtctccagaccggctttatcgcgggtctgttttactatcgcaatttcaactcgtcggggtgtcctgaacgtacttgggagtcggccat

SEQ ID NO: 397296 - DNA, 140 bp, Artificial Sequence
  Synthetic
atggccgactcccaagtacgttcaggacaccccgacgagttgaaattgcgatagtaaaacagacccgcgataaagccggtctggagactatcattgcagttgagggcggtcctgtttataggagacccagcatggcgtat

SEQ ID NO: 397297 - DNA, 140 bp, Artificial Sequence
  Synthetic
  misc_feature (38)..(38): n is a, c, g, or t
atacgccatgctgggtctcccatttcatatgccaacanatccggcccttccgaggacaagccgtactgctggcattattcgcccagaccctgtgacatagtgccagcaggagaggtttgccgtacttgggagtcggccat

SEQ ID NO: 397298 - DNA, 140 bp, Artificial Sequence
  Synthetic
  misc_feature (103)..(103): n is a, c, g, or t
atggccgactcccaagtacggcaaacctctcctgctggcactatgtcacagggtctgggcgaataatgccagcagtacggcttgtcctcggaagggccggatntgttggcatatgaaatgggagacccagcatggcgtat

SEQ ID NO: 397299 - DNA, 140 bp, Artificial Sequence
  Synthetic
atacgccatgctgggtctccgcaaacatccggacgcaacgtactcaagatgcgggtcggggccttggctcactccccggtgcttggtagactacccgtaccggctgtggcattacccgtgcgtacttgggagtcggccat

SEQ ID NO: 397300 - DNA, 140 bp, Artificial Sequence
  Synthetic
atggccgactcccaagtacgcacgggtaatgccacagccggtacgggtagtctaccaagcaccggggagtgagccaaggccccgacccgcatcttgagtacgttgcgtccggatgtttgcggagacccagcatggcgtat

SEQ ID NO: 397301 - DNA, 140 bp, Artificial Sequence
  Synthetic
aggccctggctgctgatatgagagttggccatcctaccctgctccttcacgaccatgccagcactgtcaaccggccttattcatcttcaccagaatatcgtggatacacagtacctctacgaccttttgggacagcggtg

SEQ ID NO: 397302 - DNA, 140 bp, Artificial Sequence
  Synthetic
caccgctgtcccaaaaggtcgtagaggtactgtgtatccacgatattctggtgaagatgaataaggccggttgacagtgctggcatggtcgtgaaggagcagggtaggatggccaactctcatatcagcagccagggcct

SEQ ID NO: 397303 - DNA, 140 bp, Artificial Sequence
  Synthetic
aggccctggctgctgatatgcactacgacaatacgacgccatgtcgacttgctcgttggggcggctgctttctgctccgctatgtacgtgggggatctctgcggatctgttttcctcgtcgaccttttgggacagcggtg

SEQ ID NO: 397304 - DNA, 140 bp, Artificial Sequence
  Synthetic
caccgctgtcccaaaaggtcgacgaggaaaacagatccgcagagatcccccacgtacatagcggagcagaaagcagccgccccaacgagcaagtcgacatggcgtcgtattgtcgtagtgcatatcagcagccagggcct

SEQ ID NO: 397305 - DNA, 140 bp, Artificial Sequence
  Synthetic
aggccctggctgctgatatgccagactatgttcccccagtggtgcacgggtgcccattgccacctaccaaggctcctccgataccacctccacggaggaagaggacggttgttctatcaggaccttttgggacagcggtg

SEQ ID NO: 397306 - DNA, 140 bp, Artificial Sequence
  Synthetic
caccgctgtcccaaaaggtcctgatagaacaaccgtcctcttcctccgtggaggtggtatcggaggagccttggtaggtggcaatgggcacccgtgcaccactgggggaacatagtctggcatatcagcagccagggcct

SEQ ID NO: 397307 - DNA, 140 bp, Artificial Sequence
  Synthetic
atacgccatgctgggtctccccccgtagggctttcgcttacaccaatgaggaggcagcctcttttgggtttcttgcacttgccattgtcaccgtgttcactctcaccccagcttacaaaccgtacttgggagtcggccat

SEQ ID NO: 397308 - DNA, 140 bp, Artificial Sequence
  Synthetic
atggccgactcccaagtacggtttgtaagctggggtgagagtgaacacggtgacaatggcaagtgcaagaaacccaaaagaggctgcctcctcattggtgtaagcgaaagccctacggggggagacccagcatggcgtat

SEQ ID NO: 397309 - DNA, 140 bp, Artificial Sequence
  Synthetic
aggccctggctgctgatatgccttgccgccctgtcctacacatacaggttcaactcgtccggatgcccggggcgcatggccagctgccgctccattgacaagttcgaccagggatggggtgaccttttgggacagcggtg

SEQ ID NO: 397310 - DNA, 140 bp, Artificial Sequence
  Synthetic
caccgctgtcccaaaaggtcaccccatccctggtcgaacttgtcaatggagcggcagctggccatgcgccccgggcatccggacgagttgaacctgtatgtgtaggacagggcggcaaggcatatcagcagccagggcct

SEQ ID NO: 397311 - DNA, 140 bp, Artificial Sequence
  Synthetic
aggccctggctgctgatatgaggttacaaagattctcctggctttgcttggccctctttacttgcttcagtatagcttgcttaagactccctattttgtgcgagcgcacatccttctgcggaccttttgggacagcggtg

SEQ ID NO: 397312 - DNA, 140 bp, Artificial Sequence
  Synthetic
caccgctgtcccaaaaggtccgcagaaggatgtgcgctcgcacaaaatagggagtcttaagcaagctatactgaagcaagtaaagagggccaagcaaagccaggagaatctttgtaacctcatatcagcagccagggcct

SEQ ID NO: 397313 - DNA, 140 bp, Artificial Sequence
  Synthetic
atacgccatgctgggtctcctatagcttgcttaagactccctattttgtgcgagcgcacatccttctgcgagcttgcatgaccctccgcactattgcaggcgggaagtatgctcaagcagcgtacttgggagtcggccat

SEQ ID NO: 397314 - DNA, 140 bp, Artificial Sequence
  Synthetic
atggccgactcccaagtacgctgcttgagcatacttcccgcctgcaatagtgcggagggtcatgcaagctcgcagaaggatgtgcgctcgcacaaaatagggagtcttaagcaagctataggagacccagcatggcgtat

SEQ ID NO: 397315 - DNA, 140 bp, Artificial Sequence
  Synthetic
aggccctggctgctgatatgcatgcatgctggtgcggaaagtcgctgggggccattatgtccaaatggctttcatgaaactggccgcgctgacaggtacgtacgtttatgaccacctcacgaccttttgggacagcggtg

SEQ ID NO: 397316 - DNA, 140 bp, Artificial Sequence
  Synthetic
caccgctgtcccaaaaggtcgtgaggtggtcataaacgtacgtacctgtcagcgcggccagtttcatgaaagccatttggacataatggcccccagcgactttccgcaccagcatgcatgcatatcagcagccagggcct

SEQ ID NO: 397317 - DNA, 140 bp, Artificial Sequence
  Synthetic
atacgccatgctgggtctcctcagggctggcgtctgctagccccgatcactgcctacactcagcagaccaggggtctattgggcacgatcgtcaccagccttaccggccgagacaagaatcgtacttgggagtcggccat

SEQ ID NO: 397318 - DNA, 140 bp, Artificial Sequence
  Synthetic
atggccgactcccaagtacgattcttgtctcggccggtaaggctggtgacgatcgtgcccaatagacccctggtctgctgagtgtaggcagtgatcggggctagcagacgccagccctgaggagacccagcatggcgtat

SEQ ID NO: 397319 - DNA, 140 bp, Artificial Sequence
  Synthetic
aggccctggctgctgatatggacgcgcgcgtctgctcctgcttgtggatgatgttactcatatcccaagcggaggcggctttggagaacctcgtaatactcaatgcagcatccctggccggaccttttgggacagcggtg

SEQ ID NO: 397320 - DNA, 140 bp, Artificial Sequence
  Synthetic
caccgctgtcccaaaaggtccggccagggatgctgcattgagtattacgaggttctccaaagccgcctccgcttgggatatgagtaacatcatccacaagcaggagcagacgcgcgcgtccatatcagcagccagggcct

SEQ ID NO: 397321 - DNA, 140 bp, Artificial Sequence
  Synthetic
atacgccatgctgggtctccgtgtccctccggccacgtggtaggtatcttccgcgcagccgtatgcaccaggggcgtggcaaagtctctcgattttgtacctgtggagagcatgcagtcccgtacttgggagtcggccat

SEQ ID NO: 397322 - DNA, 140 bp, Artificial Sequence
  Synthetic
atggccgactcccaagtacgggactgcatgctctccacaggtacaaaatcgagagactttgccacgcccctggtgcatacggctgcgcggaagatacctaccacgtggccggagggacacggagacccagcatggcgtat

SEQ ID NO: 397323 - DNA, 140 bp, Artificial Sequence
  Synthetic
atacgccatgctgggtctccgcaccaaagtcccagcagcgtatgctgcccaagggtacaaggtcctagtgctgaatccatcggtagcggccacgcttgggttcggggcatatatgtctcacgtacttgggagtcggccat

SEQ ID NO: 397324 - DNA, 140 bp, Artificial Sequence
  Synthetic
atggccgactcccaagtacgtgagacatatatgccccgaacccaagcgtggccgctaccgatggattcagcactaggaccttgtacccttgggcagcatacgctgctgggactttggtgcggagacccagcatggcgtat

SEQ ID NO: 397325 - DNA, 140 bp, Artificial Sequence
  Synthetic
atacgccatgctgggtctccggttgttctggcggggcttatgatgtcatcatctgtgacgagtgtcattcaacagatcctaccacagtcttaggcattgggactgtcttggaccaggcggcgtacttgggagtcggccat

SEQ ID NO: 397326 - DNA, 140 bp, Artificial Sequence
  Synthetic
atggccgactcccaagtacgccgcctggtccaagacagtcccaatgcctaagactgtggtaggatctgttgaatgacactcgtcacagatgatgacatcataagccccgccagaacaaccggagacccagcatggcgtat

SEQ ID NO: 397327 - DNA, 140 bp, Artificial Sequence
  Synthetic
aggccctggctgctgatatgtgtggagctgagatcactggacatgtcaaaaacgggacgatgaggatcgtcggtcccaggacctgcaggaacatgtggagtgggaccttccccatcaacggaccttttgggacagcggtg

SEQ ID NO: 397328 - DNA, 140 bp, Artificial Sequence
  Synthetic
caccgctgtcccaaaaggtccgttgatggggaaggtcccactccacatgttcctgcaggtcctgggaccgacgatcctcatcgtcccgtttttgacatgtccagtgatctcagctccacacatatcagcagccagggcct

SEQ ID NO: 397329 - DNA, 140 bp, Artificial Sequence
  Synthetic
atacgccatgctgggtctcctggagaaatacccttctatgggaaggcgatccccctggaattcatcaaagggggtagacatctcatcttttgccattccaagaagaagtgtgacgagctccgtacttgggagtcggccat

SEQ ID NO: 397330 - DNA, 140 bp, Artificial Sequence
  Synthetic
atggccgactcccaagtacggagctcgtcacacttcttcttggaatggcaaaagatgagatgtctaccccctttgatgaattccagggggatcgccttcccatagaagggtatttctccaggagacccagcatggcgtat

SEQ ID NO: 397331 - DNA, 140 bp, Artificial Sequence
  Synthetic
atacgccatgctgggtctccgctaaacagctaacgtcgcttggcctaaatgccgtggccttttataggggcgtggacgtgtcagtcattccgaccacaggtgatgtggtcgtgtgtgccacgtacttgggagtcggccat

SEQ ID NO: 397332 - DNA, 140 bp, Artificial Sequence
  Synthetic
atggccgactcccaagtacgtggcacacacgaccacatcacctgtggtcggaatgactgacacgtccacgcccctataaaaggccacggcatttaggccaagcgacgttagctgtttagcggagacccagcatggcgtat

SEQ ID NO: 397333 - DNA, 140 bp, Artificial Sequence
  Synthetic
atacgccatgctgggtctccctccatagagaccaccacagtaccccaggatgctgtctcccggagccaaaggaggggcaggacaggtagaggcaagcacggggagtacaggtacgtctcgcgtacttgggagtcggccat

SEQ ID NO: 397334 - DNA, 140 bp, Artificial Sequence
  Synthetic
atggccgactcccaagtacgcgagacgtacctgtactccccgtgcttgcctctacctgtcctgcccctcctttggctccgggagacagcatcctggggtactgtggtggtctctatggagggagacccagcatggcgtat

SEQ ID NO: 397335 - DNA, 140 bp, Artificial Sequence
  Synthetic
atacgccatgctgggtctcctcaggttacgtgcataccttaacactcctggcctccctgtgtgtcaggaccatcttgagttctgggagggagtttttactggacttacacatattgatgccgtacttgggagtcggccat

SEQ ID NO: 397336 - DNA, 140 bp, Artificial Sequence
  Synthetic
atggccgactcccaagtacggcatcaatatgtgtaagtccagtaaaaactccctcccagaactcaagatggtcctgacacacagggaggccaggagtgttaaggtatgcacgtaacctgaggagacccagcatggcgtat

SEQ ID NO: 397337 - DNA, 140 bp, Artificial Sequence
  Synthetic
aggccctggctgctgatatgatgagcgggagatctccgtacccgcagaaatcctgcggaagtctcggagattcgcccaggccctgcccgtttgggcgcggccggactacaaccccccgctgaccttttgggacagcggtg

SEQ ID NO: 397338 - DNA, 140 bp, Artificial Sequence
  Synthetic
caccgctgtcccaaaaggtcagcggggggttgtagtccggccgcgcccaaacgggcagggcctgggcgaatctccgagacttccgcaggatttctgcgggtacggagatctcccgctcatcatatcagcagccagggcct

SEQ ID NO: 397339 - DNA, 140 bp, Artificial Sequence
  Synthetic
atacgccatgctgggtctcccaacacatccaatcacaaaatacatcatgacctgtatgtcagcggacttggaggtcatcaccagcacctgggtgcttgtgggcggggtcctcgcagccctcgtacttgggagtcggccat

SEQ ID NO: 397340 - DNA, 140 bp, Artificial Sequence
  Synthetic
atggccgactcccaagtacgagggctgcgaggaccccgcccacaagcacccaggtgctggtgatgacctccaagtccgctgacatacaggtcatgatgtattttgtgattggatgtgttgggagacccagcatggcgtat

SEQ ID NO: 397341 - DNA, 140 bp, Artificial Sequence
  Synthetic
aggccctggctgctgatatggaggtcatcaccagcacctgggtgcttgtgggcggggtcctcgcagccctagcggcctattgcttgtcagtgggctgcgtcgtgatatgcggtaggatcagaccttttgggacagcggtg

SEQ ID NO: 397342 - DNA, 140 bp, Artificial Sequence
  Synthetic
caccgctgtcccaaaaggtctgatcctaccgcatatcacgacgcagcccactgacaagcaataggccgctagggctgcgaggaccccgcccacaagcacccaggtgctggtgatgacctccatatcagcagccagggcct

SEQ ID NO: 397343 - DNA, 140 bp, Artificial Sequence
  Synthetic
aggccctggctgctgatatgcacatggcatcgaccctaacatcagaactggggtaaggaccatcaccacgggcgcccccatcacgtactccacctatggcaagttccttgccgatggtgggaccttttgggacagcggtg

SEQ ID NO: 397344 - DNA, 140 bp, Artificial Sequence
  Synthetic
caccgctgtcccaaaaggtcccaccatcggcaaggaacttgccataggtggagtacgtgatgggggcgcccgtggtgatggtccttaccccagttctgatgttagggtcgatgccatgtgcatatcagcagccagggcct

SEQ ID NO: 397345 - DNA, 140 bp, Artificial Sequence
  Synthetic
atacgccatgctgggtctccttgcttctctcatgtctttttctgcttcccttactagcccgctatccacctccacaaccctcctgctcaacatcttaggagggtgggttgcgtcacaattcgtacttgggagtcggccat

SEQ ID NO: 397346 - DNA, 140 bp, Artificial Sequence
  Synthetic
atggccgactcccaagtacgaattgtgacgcaacccaccctcctaagatgttgagcaggagggttgtggaggtggatagcgggctagtaagggaagcagaaaaagacatgagagaagcaaggagacccagcatggcgtat

SEQ ID NO: 397347 - DNA, 140 bp, Artificial Sequence
  Synthetic
aggccctggctgctgatatgtccacaaccctcctgctcaacatcttaggagggtgggttgcgtcacaattggcaaacccaactgcttccacagccttcgtggtaagtggtttagcgggcggaccttttgggacagcggtg

SEQ ID NO: 397348 - DNA, 140 bp, Artificial Sequence
  Synthetic
caccgctgtcccaaaaggtccgcccgctaaaccacttaccacgaaggctgtggaagcagttgggtttgccaattgtgacgcaacccaccctcctaagatgttgagcaggagggttgtggacatatcagcagccagggcct

SEQ ID NO: 397349 - DNA, 140 bp, Artificial Sequence
  Synthetic
atacgccatgctgggtctcccggcgagacacccgcagccgaggacatggtgaatctgctcccagctcttttgtcacctggggccctagtagtgggcgttgtgtgtgcggccatattgcgccgtacttgggagtcggccat

SEQ ID NO: 397350 - DNA, 140 bp, Artificial Sequence
  Synthetic
atggccgactcccaagtacggcgcaatatggccgcacacacaacgcccactactagggccccaggtgacaaaagagctgggagcagattcaccatgtcctcggctgcgggtgtctcgccgggagacccagcatggcgtat

SEQ ID NO: 397351 - DNA, 140 bp, Artificial Sequence
  Synthetic
  misc_feature (88)..(88): n is a, c, g, or t
atacgccatgctgggtctccagacagacacttcacgccaaatcatgaccatcttaagttcccttaccataaccagcctactgcgtaanctgcatgagtggatcaattccgattggtctaccgtacttgggagtcggccat

SEQ ID NO: 397352 - DNA, 140 bp, Artificial Sequence
  Synthetic
  misc_feature (53)..(53): n is a, c, g, or t
atggccgactcccaagtacggtagaccaatcggaattgatccactcatgcagnttacgcagtaggctggttatggtaagggaacttaagatggtcatgatttggcgtgaagtgtctgtctggagacccagcatggcgtat

SEQ ID NO: 397353 - DNA, 140 bp, Artificial Sequence
  Synthetic
atacgccatgctgggtctcccccggggtccccttcctctcatgccaacgaggcttcagaggcacatggaggggtgatggaatatgccacactacctgcacctgtggagccatgatcgtagcgtacttgggagtcggccat

SEQ ID NO: 397354 - DNA, 140 bp, Artificial Sequence
  Synthetic
atggccgactcccaagtacgctacgatcatggctccacaggtgcaggtagtgtggcatattccatcacccctccatgtgcctctgaagcctcgttggcatgagaggaaggggaccccgggggagacccagcatggcgtat

SEQ ID NO: 397355 - DNA, 140 bp, Artificial Sequence
  Synthetic
aggccctggctgctgatatggtggagggtgaggtccagattgtgtcaactgctgcccaaactttcctggcaacgtgcatcaatggggtatgctggaccgtctaccatggggctggaacgagaccttttgggacagcggtg

SEQ ID NO: 397356 - DNA, 140 bp, Artificial Sequence
  Synthetic
caccgctgtcccaaaaggtctcgttccagccccatggtagacggtccagcataccccattgatgcacgttgccaggaaagtttgggcagcagttgacacaatctggacctcaccctccaccatatcagcagccagggcct

SEQ ID NO: 397357 - DNA, 140 bp, Artificial Sequence
  Synthetic
atacgccatgctgggtctcccgtgcccatcccagagcccaattatacaagggctctctggagggtgtccgctgaggagtatgttgaggttgtgcggaaaggggatagccatttcatagtgcgtacttgggagtcggccat

SEQ ID NO: 397358 - DNA, 140 bp, Artificial Sequence
  Synthetic
atggccgactcccaagtacgcactatgaaatggctatcccctttccgcacaacctcaacatactcctcagcggacaccctccagagagcccttgtataattgggctctgggatgggcacgggagacccagcatggcgtat

SEQ ID NO: 397359 - DNA, 140 bp, Artificial Sequence
  Synthetic
aggccctggctgctgatatgctgaggagtatgttgaggttgtgcggaaaggggatagccatttcatagtgggtgtaaccaaccaggaccttaaatgcccatgtcaagtaccggctccagagaccttttgggacagcggtg

SEQ ID NO: 397360 - DNA, 140 bp, Artificial Sequence
  Synthetic
caccgctgtcccaaaaggtctctggagccggtacttgacatgggcatttaaggtcctggttggttacacccactatgaaatggctatcccctttccgcacaacctcaacatactcctcagcatatcagcagccagggcct

SEQ ID NO: 397361 - DNA, 140 bp, Artificial Sequence
  Synthetic
atacgccatgctgggtctcctacgtagttggatcccaactcccttgtgaaccggagccggacgtcatggtcgtaacatcaatgctgacagatccatcacacataacagctgagtctgctgcgtacttgggagtcggccat

SEQ ID NO: 397362 - DNA, 140 bp, Artificial Sequence
  Synthetic
atggccgactcccaagtacgcagcagactcagctgttatgtgtgatggatctgtcagcattgatgttacgaccatgacgtccggctccggttcacaagggagttgggatccaactacgtaggagacccagcatggcgtat

SEQ ID NO: 397363 - DNA, 140 bp, Artificial Sequence
  Synthetic
aggccctggctgctgatatggtcgtgctcgccaccgctacgcctccggggtcggtcaccgtgccacatccaaatatcgaggaggtggccctgtccaatattggtgagatccccttctatggaccttttgggacagcggtg

SEQ ID NO: 397364 - DNA, 140 bp, Artificial Sequence
  Synthetic
caccgctgtcccaaaaggtccatagaaggggatctcaccaatattggacagggccacctcctcgatatttggatgtggcacggtgaccgaccccggaggcgtagcggtggcgagcacgaccatatcagcagccagggcct

SEQ ID NO: 397365 - DNA, 140 bp, Artificial Sequence
  Synthetic
atacgccatgctgggtctccacagccaccaagcaagcggaggctgctgctcccgtggtggagtccaagtggcgagcccttgaggccttctgggcgaagcacatgtggaatttcatcagcgcgtacttgggagtcggccat

SEQ ID NO: 397366 - DNA, 140 bp, Artificial Sequence
  Synthetic
atggccgactcccaagtacgcgctgatgaaattccacatgtgcttcgcccagaaggcctcaagggctcgccacttggactccaccacgggagcagcagcctccgcttgcttggtggctgtggagacccagcatggcgtat

SEQ ID NO: 397367 - DNA, 140 bp, Artificial Sequence
  Synthetic
atacgccatgctgggtctccacatcctgatgcggagctgattgaagcaaatctgctgtggaggcaggagatggggagtaatataactcgggtggagtctgagaccaaggtaattgtgctccgtacttgggagtcggccat

SEQ ID NO: 397368 - DNA, 140 bp, Artificial Sequence
  Synthetic
atggccgactcccaagtacggagcacaattaccttggtctcagactccacccgagttatattactccccatctcctgcctccacagcagatttgcttcaatcagctccgcatcaggatgtggagacccagcatggcgtat

SEQ ID NO: 397369 - DNA, 140 bp, Artificial Sequence
  Synthetic
atacgccatgctgggtctccgactcctttgaccccatcacccccgagtatgatgacagggagccgtccgtgccggcggagtgccataggcccagcagacctaagtaccctccagcacttccgtacttgggagtcggccat

SEQ ID NO: 397370 - DNA, 140 bp, Artificial Sequence
  Synthetic
atggccgactcccaagtacggaagtgctggagggtacttaggtctgctgggcctatggcactccgccggcacggacggctccctgtcatcatactcgggggtgatggggtcaaaggagtcggagacccagcatggcgtat

SEQ ID NO: 397371 - DNA, 140 bp, Artificial Sequence
  Synthetic
atacgccatgctgggtctccgaaggtaactcccattccaccacctaggaggaagaaaactatacaccttgaccaatccacgctgccacttgctctcgcgcagcttgctgagaagtcgtttcgtacttgggagtcggccat

SEQ ID NO: 397372 - DNA, 140 bp, Artificial Sequence
  Synthetic
atggccgactcccaagtacgaaacgacttctcagcaagctgcgcgagagcaagtggcagcgtggattggtcaaggtgtatagttttcttcctcctaggtggtggaatgggagttaccttcggagacccagcatggcgtat

SEQ ID NO: 397373 - DNA, 140 bp, Artificial Sequence
  Synthetic
atacgccatgctgggtctccccgggtcttatagctccatgccaccgcttgagggggagcccggagatcccgacctcagctcggggtcttggtctacggtcagtgaggagggcgacagcgtcgtacttgggagtcggccat

SEQ ID NO: 397374 - DNA, 140 bp, Artificial Sequence
  Synthetic
atggccgactcccaagtacgacgctgtcgccctcctcactgaccgtagaccaagaccccgagctgaggtcgggatctccgggctccccctcaagcggtggcatggagctataagacccggggagacccagcatggcgtat

SEQ ID NO: 397375 - DNA, 140 bp, Artificial Sequence
  Synthetic
atacgccatgctgggtctccatccgtcaccacaacctggtgtattccaccacttcccggagcgcagcaatgcgccagaagaaggtgactttcgatcgcatgcaagtgctagacaaacattcgtacttgggagtcggccat

SEQ ID NO: 397376 - DNA, 140 bp, Artificial Sequence
  Synthetic
atggccgactcccaagtacgaatgtttgtctagcacttgcatgcgatcgaaagtcaccttcttctggcgcattgctgcgctccgggaagtggtggaatacaccaggttgtggtgacggatggagacccagcatggcgtat

SEQ ID NO: 397377 - DNA, 140 bp, Artificial Sequence
  Synthetic
atacgccatgctgggtctccatgatgatgtccttaaggaggttaaactccgggcgtcgcgggtgacggcaaagctcctctcgattgaggatgcctgcgacctcacccccccacactcagccgtacttgggagtcggccat

SEQ ID NO: 397378 - DNA, 140 bp, Artificial Sequence
  Synthetic
atggccgactcccaagtacggctgagtgtgggggggtgaggtcgcaggcatcctcaatcgagaggagctttgccgtcacccgcgacgcccggagtttaacctccttaaggacatcatcatggagacccagcatggcgtat

SEQ ID NO: 397379 - DNA, 140 bp, Artificial Sequence
  Synthetic
aggccctggctgctgatatgaagctcctctcgattgaggatgcctgcgacctcacccccccacactcagctcgctcaaagtttgggtatggggcaaaagatgtccggagtcatactagcagaccttttgggacagcggtg

SEQ ID NO: 397380 - DNA, 140 bp, Artificial Sequence
  Synthetic
caccgctgtcccaaaaggtctgctagtatgactccggacatcttttgccccatacccaaactttgagcgagctgagtgtgggggggtgaggtcgcaggcatcctcaatcgagaggagcttcatatcagcagccagggcct

SEQ ID NO: 397381 - DNA, 140 bp, Artificial Sequence
  Synthetic
aggccctggctgctgatatgaggccattaaccacatcagctccgtgtgggaggacttgttagaagacaatcaaacaccaattcctacaaccatcatggccaagaacgaggtattctgtgtgaccttttgggacagcggtg

SEQ ID NO: 397382 - DNA, 140 bp, Artificial Sequence
  Synthetic
caccgctgtcccaaaaggtcacacagaatacctcgttcttggccatgatggttgtaggaattggtgtttgattgtcttctaacaagtcctcccacacggagctgatgtggttaatggcctcatatcagcagccagggcct

SEQ ID NO: 397383 - DNA, 140 bp, Artificial Sequence
  Synthetic
atacgccatgctgggtctccaagttaccgctggcaacaatgggagatgcttatggcttccaatactcacccaaacagcgagtggatcgtctgctcaaaatgtggcgcgcaaggaagaacccgtacttgggagtcggccat

SEQ ID NO: 397384 - DNA, 140 bp, Artificial Sequence
  Synthetic
atggccgactcccaagtacgggttcttccttgcgcgccacattttgagcagacgatccactcgctgtttgggtgagtattggaagccataagcatctcccattgttgccagcggtaacttggagacccagcatggcgtat

SEQ ID NO: 397385 - DNA, 140 bp, Artificial Sequence
  Synthetic
aggccctggctgctgatatgtcacttccatgctcaccgacccctcccacatcacagcagagacggctaagcgtaggctggccagggggtctcccccctccttggccagctcttcagctaggaccttttgggacagcggtg

SEQ ID NO: 397386 - DNA, 140 bp, Artificial Sequence
  Synthetic
caccgctgtcccaaaaggtcctagctgaagagctggccaaggaggggggagaccccctggccagcctacgcttagccgtctctgctgtgatgtgggaggggtcggtgagcatggaagtgacatatcagcagccagggcct

SEQ ID NO: 397387 - DNA, 140 bp, Artificial Sequence
  Synthetic
atacgccatgctgggtctcccgtaggctggccagggggtctcccccctccttggccagctcttcagctagccagctgtctgcgccttccttgaaggcgacatgcactacccatcatgactcgtacttgggagtcggccat

SEQ ID NO: 397388 - DNA, 140 bp, Artificial Sequence
  Synthetic
atggccgactcccaagtacgagtcatgatgggtagtgcatgtcgccttcaaggaaggcgcagacagctggctagctgaagagctggccaaggaggggggagaccccctggccagcctacgggagacccagcatggcgtat

SEQ ID NO: 397389 - DNA, 140 bp, Artificial Sequence
  Synthetic
atacgccatgctgggtctccagaagccaggaaggccataacatctttgactgagaggctgtactgcggtggccccatgtacaactcacggggtcaactctgcggaatacgcaggtgccgccgtacttgggagtcggccat

SEQ ID NO: 397390 - DNA, 140 bp, Artificial Sequence
  Synthetic
atggccgactcccaagtacggcggcacctgcgtattccgcagagttgaccccgtgagttgtacatggggccaccgcagtacagcctctcagtcaaagatgttatggccttcctggcttctggagacccagcatggcgtat

SEQ ID NO: 397391 - DNA, 140 bp, Artificial Sequence
  Synthetic
aggccctggctgctgatatggaggatgcagctaacctgcgagctttcacggaagccatgaccaggtattctgcccctccgggggatgaaccacagcccacctatgacttggagctgataagaccttttgggacagcggtg

SEQ ID NO: 397392 - DNA, 140 bp, Artificial Sequence
  Synthetic
caccgctgtcccaaaaggtcttatcagctccaagtcataggtgggctgtggttcatcccccggaggggcagaatacctggtcatggcttccgtgaaagctcgcaggttagctgcatcctccatatcagcagccagggcct

SEQ ID NO: 397393 - DNA, 140 bp, Artificial Sequence
  Synthetic
aggccctggctgctgatatgccaggtgcctggtcaactacccgtataggctttggcattatccttgtaccatcaactacaccatatttaaagtcaggatgtacgtgggaggggtcgagcagaccttttgggacagcggtg

SEQ ID NO: 397394 - DNA, 140 bp, Artificial Sequence
  Synthetic
caccgctgtcccaaaaggtctgctcgacccctcccacgtacatcctgactttaaatatggtgtagttgatggtacaaggataatgccaaagcctatacgggtagttgaccaggcacctggcatatcagcagccagggcct

SEQ ID NO: 397395 - DNA, 140 bp, Artificial Sequence
  Synthetic
atacgccatgctgggtctcctattactacctcacccgtgacccaaccggacctttggcacgagcagcatgggagactgcccggcacactccagtgaattcctggttggggaacattattacgtacttgggagtcggccat

SEQ ID NO: 397396 - DNA, 140 bp, Artificial Sequence
  Synthetic
atggccgactcccaagtacgtaataatgttccccaaccaggaattcactggagtgtgccgggcagtctcccatgctgctcgtgccaaaggtccggttgggtcacgggtgaggtagtaataggagacccagcatggcgtat

SEQ ID NO: 397397 - DNA, 140 bp, Artificial Sequence
  Synthetic
atacgccatgctgggtctccctacggagtcacgtattcaatcactccacttgatctcccagaaatcattcaaagactccatggcatggccgctttttcactccatgggtactctcccggccgtacttgggagtcggccat

SEQ ID NO: 397398 - DNA, 140 bp, Artificial Sequence
  Synthetic
atggccgactcccaagtacggccgggagagtacccatggagtgaaaaagcggccatgccatggagtctttgaatgatttctgggagatcaagtggagtgattgaatacgtgactccgtagggagacccagcatggcgtat

SEQ ID NO: 397399 - DNA, 140 bp, Artificial Sequence
  Synthetic
atacgccatgctgggtctccaaggggggaaagccgctatatgcggcaagtacctctttaactgggcggtaagaaccaagctcaaactcactccattgcgtggcgcggctaccctcgacttcgtacttgggagtcggccat

SEQ ID NO: 397400 - DNA, 140 bp, Artificial Sequence
  Synthetic
atggccgactcccaagtacgaagtcgagggtagccgcgccacgcaatggagtgagtttgagcttggttcttaccgcccagttaaagaggtacttgccgcatatagcggctttccccccttggagacccagcatggcgtat

SEQ ID NO: 397401 - DNA, 140 bp, Artificial Sequence
  Synthetic
aggccctggctgctgatatgtgtcccgagctcgaccccgcatattactcctgtgcctactcctactttccgtaggggtaggcatcttcctgctccccgcccgataggcggggagcctaacgaccttttgggacagcggtg

SEQ ID NO: 397402 - DNA, 140 bp, Artificial Sequence
  Synthetic
caccgctgtcccaaaaggtcgttaggctccccgcctatcgggcggggagcaggaagatgcctacccctacggaaagtaggagtaggcacaggagtaatatgcggggtcgagctcgggacacatatcagcagccagggcct

SEQ ID NO: 397403 - DNA, 140 bp, Artificial Sequence
  Synthetic
atacgccatgctgggtctccttccaaacgcctccgtgccagcgagggggttccgcactcatgtggacctccttgttggttcggctgcgctctgctcggccttgtacgtcggggacctctgcgtacttgggagtcggccat

SEQ ID NO: 397404 - DNA, 140 bp, Artificial Sequence
  Synthetic
atggccgactcccaagtacgcagaggtccccgacgtacaaggccgagcagagcgcagccgaaccaacaaggaggtccacatgagtgcggaaccccctcgctggcacggaggcgtttggaaggagacccagcatggcgtat

SEQ ID NO: 397405 - DNA, 140 bp, Artificial Sequence
  Synthetic
aggccctggctgctgatatgtccggctggttcgttgctggctacagcgggggagacatatatcacagcctgtctcgtgcccgaccccgctggttcatgctgtgcctactcctactttctggaccttttgggacagcggtg

SEQ ID NO: 397406 - DNA, 140 bp, Artificial Sequence
  Synthetic
caccgctgtcccaaaaggtccagaaagtaggagtaggcacagcatgaaccagcggggtcgggcacgagacaggctgtgatatatgtctcccccgctgtagccagcaacgaaccagccggacatatcagcagccagggcct

SEQ ID NO: 397407 - DNA, 140 bp, Artificial Sequence
  Synthetic
atacgccatgctgggtctcctactcgaggggcattggggcgttctcggtgctttgctgtattacagcatggtggcaaattgggctaaggtcttggcagttctgctcctctttgcgggtgtcgtacttgggagtcggccat

SEQ ID NO: 397408 - DNA, 140 bp, Artificial Sequence
  Synthetic
atggccgactcccaagtacgacacccgcaaagaggagcagaactgccaagaccttagcccaatttgccaccatgctgtaatacagcaaagcaccgagaacgccccaatgcccctcgagtaggagacccagcatggcgtat

SEQ ID NO: 397409 - DNA, 140 bp, Artificial Sequence
  Synthetic
atacgccatgctgggtctccggttgctctttctctatcttcctcttggccttgctgtcctgtttgaccatcccagcttccgcttatgaagtgcgcaacgtgtccggggtgtaccatgtcacgtacttgggagtcggccat

SEQ ID NO: 397410 - DNA, 140 bp, Artificial Sequence
  Synthetic
atggccgactcccaagtacgtgacatggtacaccccggacacgttgcgcacttcataagcggaagctgggatggtcaaacaggacagcaaggccaagaggaagatagagaaagagcaaccggagacccagcatggcgtat

SEQ ID NO: 397411 - DNA, 140 bp, Artificial Sequence
  Synthetic
aggccctggctgctgatatggggtcctagcgggccttgcctactattccatggcggggaactgggctaaggttttaattgtgttgctgctttttgccggcgttgacgggcacaccagcgtgaccttttgggacagcggtg

SEQ ID NO: 397412 - DNA, 140 bp, Artificial Sequence
  Synthetic
caccgctgtcccaaaaggtcacgctggtgtgcccgtcaacgccggcaaaaagcagcaacacaattaaaaccttagcccagttccccgccatggaatagtaggcaaggcccgctaggaccccatatcagcagccagggcct

SEQ ID NO: 397413 - DNA, 140 bp, Artificial Sequence
  Synthetic
atacgccatgctgggtctcccacatcaacaggaccgccctgaattgcaatgactctctccagactgggttccttgctgcgctgttctacgtacacaagttcaactcgtctggatgcccggcgtacttgggagtcggccat

SEQ ID NO: 397414 - DNA, 140 bp, Artificial Sequence
  Synthetic
atggccgactcccaagtacgccgggcatccagacgagttgaacttgtgtacgtagaacagcgcagcaaggaacccagtctggagagagtcattgcaattcagggcggtcctgttgatgtgggagacccagcatggcgtat

SEQ ID NO: 397415 - DNA, 140 bp, Artificial Sequence
  Synthetic
atacgccatgctgggtctccacatcaacagaaccgcattgaactgcaatgattccctccagactgggtttattgccgcgctgttctacgtacgcagtttcaactcgtccggatgcccagacgtacttgggagtcggccat

SEQ ID NO: 397416 - DNA, 140 bp, Artificial Sequence
  Synthetic
atggccgactcccaagtacgtctgggcatccggacgagttgaaactgcgtacgtagaacagcgcggcaataaacccagtctggagggaatcattgcagttcaatgcggttctgttgatgtggagacccagcatggcgtat

SEQ ID NO: 397417 - DNA, 140 bp, Artificial Sequence
  Synthetic
atacgccatgctgggtctccccacttctgttctccacgacagagttggccatcctaccctgctctttcacgaccatgccagcactgtcaaccggccttatccatcttcaccagaatatcgcgtacttgggagtcggccat

SEQ ID NO: 397418 - DNA, 140 bp, Artificial Sequence
  Synthetic
atggccgactcccaagtacgcgatattctggtgaagatggataaggccggttgacagtgctggcatggtcgtgaaagagcagggtaggatggccaactctgtcgtggagaacagaagtggggagacccagcatggcgtat

SEQ ID NO: 397419 - DNA, 140 bp, Artificial Sequence
  Synthetic
atacgccatgctgggtctcccatttgtgcgtgcatgtggttgatgttcttggtgggccaagcggaggccgcgctggagaatttgatcgtcctaaacgccacctctgccgttagcaatcagcgtacttgggagtcggccat

SEQ ID NO: 397420 - DNA, 140 bp, Artificial Sequence
  Synthetic
atggccgactcccaagtacgctgattgctaacggcagaggtggcgtttaggacgatcaaattctccagcgcggcctccgcttggcccaccaagaacatcaaccacatgcacgcacaaatgggagacccagcatggcgtat

SEQ ID NO: 397421 - DNA, 140 bp, Artificial Sequence
  Synthetic
aggccctggctgctgatatgcgctggagaatttgatcgtcctaaacgccacctctgccgttagcaatcagggcctgttatttgggttggttttcatctgcatcgcatggcacatacgggggaccttttgggacagcggtg

SEQ ID NO: 397422 - DNA, 140 bp, Artificial Sequence
  Synthetic
caccgctgtcccaaaaggtcccccgtatgtgccatgcgatgcagatgaaaaccaacccaaataacaggccctgattgctaacggcagaggtggcgtttaggacgatcaaattctccagcgcatatcagcagccagggcct

SEQ ID NO: 397423 - DNA, 140 bp, Artificial Sequence
  Synthetic
aggccctggctgctgatatgctcctcaacaacacgcggccgccgcagggcaactggttcggctgtacgtggatgaatagcactgggttcaccaagacatgcgggggccccccgtgtaaaagaccttttgggacagcggtg

SEQ ID NO: 397424 - DNA, 140 bp, Artificial Sequence
  Synthetic
caccgctgtcccaaaaggtcttttacacggggggcccccgcatgtcttggtgaacccagtgctattcatccacgtacagccgaaccagttgccctgcggcggccgcgtgttgttgaggagcatatcagcagccagggcct

SEQ ID NO: 397425 - DNA, 140 bp, Artificial Sequence
  Synthetic
aggccctggctgctgatatgacctaggtgcctagttgactacccatacaggctttggcactacccctgcactgtcaactttaccatcttcaaggttaggatgtatgtggggggcgtggaggaccttttgggacagcggtg

SEQ ID NO: 397426 - DNA, 140 bp, Artificial Sequence
  Synthetic
caccgctgtcccaaaaggtcctccacgccccccacatacatcctaaccttgaagatggtaaagttgacagtgcaggggtagtgccaaagcctgtatgggtagtcaactaggcacctaggtcatatcagcagccagggcct

SEQ ID NO: 397427 - DNA, 140 bp, Artificial Sequence
  Synthetic
aggccctggctgctgatatggatgctgctgatagcccaggccgaggccgccttagagaacctggtggtcctcaatgcggcgtccgtggccggagcgcatggcattctctccttccttgtggaccttttgggacagcggtg

SEQ ID NO: 397428 - DNA, 140 bp, Artificial Sequence
  Synthetic
caccgctgtcccaaaaggtccacaaggaaggagagaatgccatgcgctccggccacggacgccgcattgaggaccaccaggttctctaaggcggcctcggcctgggctatcagcagcatccatatcagcagccagggcct

SEQ ID NO: 397429 - DNA, 140 bp, Artificial Sequence
  Synthetic
aggccctggctgctgatatgtcaatgcggcgtccgtggccggagcgcatggcattctctccttccttgtgttcttctgtgctgcctggtacatcaaaggcaggctggtccctggggcggcgaccttttgggacagcggtg

SEQ ID NO: 397430 - DNA, 140 bp, Artificial Sequence
  Synthetic
caccgctgtcccaaaaggtcgccgccccagggaccagcctgcctttgatgtaccaggcagcacagaagaacacaaggaaggagagaatgccatgcgctccggccacggacgccgcattgacatatcagcagccagggcct

SEQ ID NO: 397431 - DNA, 140 bp, Artificial Sequence
  Synthetic
atacgccatgctgggtctcccatcaccaaactcttgctcgccattctcggtccgctcatggtactccaggctggtcttaccagggtgccgtactttgtacgtgcccaagggctcattcgtcgtacttgggagtcggccat

SEQ ID NO: 397432 - DNA, 140 bp, Artificial Sequence
  Synthetic
atggccgactcccaagtacgacgaatgagcccttgggcacgtacaaagtacggcaccctggtaagaccagcctggagtaccatgagcggaccgagaatggcgagcaagagtttggtgatgggagacccagcatggcgtat

SEQ ID NO: 397433 - DNA, 140 bp, Artificial Sequence
  Synthetic
aggccctggctgctgatatgacgtccatgctcaccgatccctcccatataacagcagaggcggccgggagaaggttggcgagaggatcgcctccttctgtggccagctcctcggctagccgaccttttgggacagcggtg

SEQ ID NO: 397434 - DNA, 140 bp, Artificial Sequence
  Synthetic
caccgctgtcccaaaaggtcggctagccgaggagctggccacagaaggaggcgatcctctcgccaaccttctcccggccgcctctgctgttatatgggagggatcggtgagcatggacgtcatatcagcagccagggcct

SEQ ID NO: 397435 - DNA, 140 bp, Artificial Sequence
  Synthetic
atacgccatgctgggtctccgggtgtcgatgtatcagtgatcccgaccacaggagacgtggttgtgtgtgctaccgacgcccttatgactggttacacgggcgattttgactccgtgatacgtacttgggagtcggccat

SEQ ID NO: 397436 - DNA, 140 bp, Artificial Sequence
  Synthetic
atggccgactcccaagtacgtatcacggagtcaaaatcgcccgtgtaaccagtcataagggcgtcggtagcacacacaaccacgtctcctgtggtcgggatcactgatacatcgacacccggagacccagcatggcgtat

SEQ ID NO: 397437 - DNA, 140 bp, Artificial Sequence
  Synthetic
atacgccatgctgggtctcccaggggtggcgactccttgcgcctatcacggcctactcccaacagacgcggggcctgcttggctgcatcatcactagcctcacgggccgggacaagaacccgtacttgggagtcggccat

SEQ ID NO: 397438 - DNA, 140 bp, Artificial Sequence
  Synthetic
atggccgactcccaagtacgggttcttgtcccggcccgtgaggctagtgatgatgcagccaagcaggccccgcgtctgttgggagtaggccgtgataggcgcaaggagtcgccacccctgggagacccagcatggcgtat

SEQ ID NO: 397439 - DNA, 140 bp, Artificial Sequence
  Synthetic
aggccctggctgctgatatgactacgaaccacctgtggtccatggctgcccgcttccacctccacagtcccctcctgtgcctccgcctcggaagaagcggacggtggtcctcaccgaatcgaccttttgggacagcggtg

SEQ ID NO: 397440 - DNA, 140 bp, Artificial Sequence
  Synthetic
caccgctgtcccaaaaggtcgattcggtgaggaccaccgtccgcttcttccgaggcggaggcacaggaggggactgtggaggtggaagcgggcagccatggaccacaggtggttcgtagtcatatcagcagccagggcct

SEQ ID NO: 397441 - DNA, 140 bp, Artificial Sequence
  Synthetic
  misc_feature (80)..(80): n is a, c, g, or t
atacgccatgctgggtctcccgaaagctccccccccctcttgggatacaatgtggaagtgcctcatacggctcaagcccntgctcacaggaccaacacccctgttgtacaggcttggggccgtacttgggagtcggccat

SEQ ID NO: 397442 - DNA, 140 bp, Artificial Sequence
  Synthetic
  misc_feature (61)..(61): n is a, c, g, or t
atggccgactcccaagtacggccccaagcctgtacaacaggggtgttggtcctgtgagcangggcttgagccgtatgaggcacttccacattgtatcccaagagggggggggagctttcgggagacccagcatggcgtat

SEQ ID NO: 397443 - DNA, 140 bp, Artificial Sequence
  Synthetic
atacgccatgctgggtctcccacatcccctatcttgctgagggccagctcatagcagagcagttcaaacaaaaggtcctcggtcttatccagactaccaccaagcaagcagaggagcttacgtacttgggagtcggccat

SEQ ID NO: 397444 - DNA, 140 bp, Artificial Sequence
  Synthetic
atggccgactcccaagtacgtaagctcctctgcttgcttggtggtagtctggataagaccgaggaccttttgtttgaactgctctgctatgagctggccctcagcaagataggggatgtgggagacccagcatggcgtat

SEQ ID NO: 397445 - DNA, 140 bp, Artificial Sequence
  Synthetic
aggccctggctgctgatatgaaaggtcctcggtcttatccagactaccaccaagcaagcagaggagcttaaaccggctgtccattccgcttggccgaagctcgagcagttttggcaaaaagaccttttgggacagcggtg

SEQ ID NO: 397446 - DNA, 140 bp, Artificial Sequence
  Synthetic
caccgctgtcccaaaaggtctttttgccaaaactgctcgagcttcggccaagcggaatggacagccggtttaagctcctctgcttgcttggtggtagtctggataagaccgaggacctttcatatcagcagccagggcct

SEQ ID NO: 397447 - DNA, 140 bp, Artificial Sequence
  Synthetic
aggccctggctgctgatatgctcagctgttgaagaggctccaccagtggattaacgaggactgctccacgccatgctccggctcgtggctaagggatgtttgggactggatatgcacggtgaccttttgggacagcggtg

SEQ ID NO: 397448 - DNA, 140 bp, Artificial Sequence
  Synthetic
caccgctgtcccaaaaggtcaccgtgcatatccagtcccaaacatcccttagccacgagccggagcatggcgtggagcagtcctcgttaatccactggtggagcctcttcaacagctgagcatatcagcagccagggcct

SEQ ID NO: 397449 - DNA, 140 bp, Artificial Sequence
  Synthetic
aggccctggctgctgatatgggagcgcccccttgtgccatcggaggggtgggcaacaacaccttgcactgccccactgattgcttccgcaagcatccggaagccacatactctcggtgcggaccttttgggacagcggtg

SEQ ID NO: 397450 - DNA, 140 bp, Artificial Sequence
  Synthetic
caccgctgtcccaaaaggtccgcaccgagagtatgtggcttccggatgcttgcggaagcaatcagtggggcagtgcaaggtgttgttgcccacccctccgatggcacaagggggcgctcccatatcagcagccagggcct

SEQ ID NO: 397451 - DNA, 140 bp, Artificial Sequence
  Synthetic
aggccctggctgctgatatggtacgtgggaggggtcgagcacaggctggaagctgcttgcaactggacacggggcgaacgttgcgatctgtcagacagggacaggtccgagctcagcccggaccttttgggacagcggtg

SEQ ID NO: 397452 - DNA, 140 bp, Artificial Sequence
  Synthetic
caccgctgtcccaaaaggtccgggctgagctcggacctgtccctgtctgacagatcgcaacgttcgccccgtgtccagttgcaagcagcttccagcctgtgctcgacccctcccacgtaccatatcagcagccagggcct

SEQ ID NO: 397453 - DNA, 140 bp, Artificial Sequence
  Synthetic
atacgccatgctgggtctcctgtccggagtcatactagcaaggccattaaccacatcagctccgtgtgggaggacttgttagaagacaatcaaacaccaatccctacaaccatcatggcccgtacttgggagtcggccat

SEQ ID NO: 397454 - DNA, 140 bp, Artificial Sequence
  Synthetic
atggccgactcccaagtacgggccatgatggttgtagggattggtgtttgattgtcttctaacaagtcctcccacacggagctgatgtggttaatggccttgctagtatgactccggacaggagacccagcatggcgtat

SEQ ID NO: 397455 - DNA, 140 bp, Artificial Sequence
  Synthetic
atacgccatgctgggtctcctcccgagctcgaccccgcatattactcctgtgcctactcctactcaccgtaggggtaggcatcttttcactacccgctcggtagacgggtagcttaacaccgtacttgggagtcggccat

SEQ ID NO: 397456 - DNA, 140 bp, Artificial Sequence
  Synthetic
atggccgactcccaagtacggtgttaagctacccgtctaccgagcgggtagtgaaaagatgcctacccctacggtgagtaggagtaggcacaggagtaatatgcggggtcgagctcgggaggagacccagcatggcgtat

SEQ ID NO: 397457 - DNA, 140 bp, Artificial Sequence
  Synthetic
aggccctggctgctgatatggttgctggttacagcgggggagacatatatcacagcgtgtctcatgcccgaccccgctgggccttgttctgcctactcctactttctgtaggggtaggcagaccttttgggacagcggtg

SEQ ID NO: 397458 - DNA, 140 bp, Artificial Sequence
  Synthetic
caccgctgtcccaaaaggtctgcctacccctacagaaagtaggagtaggcagaacaaggcccagcggggtcgggcatgagacacgctgtgatatatgtctcccccgctgtaaccagcaaccatatcagcagccagggcct

SEQ ID NO: 397459 - DNA, 140 bp, Artificial Sequence
  Synthetic
atacgccatgctgggtctccccacaccccaatatcgaggaggtggccctatccaacactggagagatccccttctacggcagggccatcccccttgaggtcatcaaggagggaagacatccgtacttgggagtcggccat

SEQ ID NO: 397460 - DNA, 140 bp, Artificial Sequence
  Synthetic
atggccgactcccaagtacggatgtcttccctccttgatgacctcaagggggatggccctgccgtagaaggggatctctccagtgttggatagggccacctcctcgatattggggtgtggggagacccagcatggcgtat

SEQ ID NO: 397461 - DNA, 140 bp, Artificial Sequence
  Synthetic
atacgccatgctgggtctccgagtcctggcgggccttgcttactattccatggtggggaactgggccaaggttttaattgtgatgctactctttgccggagttgacggtgagacccacgtcgtacttgggagtcggccat

SEQ ID NO: 397462 - DNA, 140 bp, Artificial Sequence
  Synthetic
atggccgactcccaagtacgacgtgggtctcaccgtcaactccggcaaagagtagcatcacaattaaaaccttggcccagttccccaccatggaatagtaagcaaggcccgccaggactcggagacccagcatggcgtat

SEQ ID NO: 397463 - DNA, 140 bp, Artificial Sequence
  Synthetic
atacgccatgctgggtctcccaacaccaacggcagctggcacatcaataggacggccttgaactgcaatgagagcctttccaccggctggctcgcagggcttttctatgccaaaaacttccgtacttgggagtcggccat

SEQ ID NO: 397464 - DNA, 140 bp, Artificial Sequence
  Synthetic
atggccgactcccaagtacggaagtttttggcatagaaaagccctgcgagccagccggtggaaaggctctcattgcagttcaaggccgtcctattgatgtgccagctgccgttggtgttgggagacccagcatggcgtat

SEQ ID NO: 397465 - DNA, 140 bp, Artificial Sequence
  Synthetic
atacgccatgctgggtctccgatgctactttttgccggcgtcgacggggggactcacacgataggggaggcgacggcccgtactgccagcgggctcgtgggcctctttgcgcctgggccacgtacttgggagtcggccat

SEQ ID NO: 397466 - DNA, 140 bp, Artificial Sequence
  Synthetic
atggccgactcccaagtacgtggcccaggcgcaaagaggcccacgagcccgctggcagtacgggccgtcgcctcccctatcgtgtgagtccccccgtcgacgccggcaaaaagtagcatcggagacccagcatggcgtat

SEQ ID NO: 397467 - DNA, 140 bp, Artificial Sequence
  Synthetic
atacgccatgctgggtctcccacatcaacaggactgccctgaactgtaatgactccatccatactgggttcttcgctgcgctgttctacgcgcacaagttcaactcatctggatgctcagcgtacttgggagtcggccat

SEQ ID NO: 397468 - DNA, 140 bp, Artificial Sequence
  Synthetic
atggccgactcccaagtacgctgagcatccagatgagttgaacttgtgcgcgtagaacagcgcagcgaagaacccagtatggatggagtcattacagttcagggcagtcctgttgatgtgggagacccagcatggcgtat

SEQ ID NO: 397469 - DNA, 140 bp, Artificial Sequence
  Synthetic
aggccctggctgctgatatggcatgtcggctgacctggaggtcgtcacgagcacctgggtgctcgttggcggcgtcctggctgctttggccgcgtattgcctgtccacgggctgcgtggtgaccttttgggacagcggtg

SEQ ID NO: 397470 - DNA, 140 bp, Artificial Sequence
  Synthetic
caccgctgtcccaaaaggtcaccacgcagcccgtggacaggcaatacgcggccaaagcagccaggacgccgccaacgagcacccaggtgctcgtgacgacctccaggtcagccgacatgccatatcagcagccagggcct

SEQ ID NO: 397471 - DNA, 140 bp, Artificial Sequence
  Synthetic
aggccctggctgctgatatggccccactgattgcttccgcaagcatccggaagccacgtactctcggtgcggctccggtccctggatcacacccaggtgcctggtcgactacccgtataggaccttttgggacagcggtg

SEQ ID NO: 397472 - DNA, 140 bp, Artificial Sequence
  Synthetic
caccgctgtcccaaaaggtcctatacgggtagtcgaccaggcacctgggtgtgatccagggaccggagccgcaccgagagtacgtggcttccggatgcttgcggaagcaatcagtggggccatatcagcagccagggcct

SEQ ID NO: 397473 - DNA, 140 bp, Artificial Sequence
  Synthetic
atacgccatgctgggtctcctgctggcattatccgcccagaccctgcggcatagtgccagcaagagaggtttgcggacctgtatattgctttacacctagccctgtggtcattggaactacgtacttgggagtcggccat

SEQ ID NO: 397474 - DNA, 140 bp, Artificial Sequence
  Synthetic
atggccgactcccaagtacgtagttccaatgaccacagggctaggtgtaaagcaatatacaggtccgcaaacctctcttgctggcactatgccgcagggtctgggcggataatgccagcaggagacccagcatggcgtat

SEQ ID NO: 397475 - DNA, 140 bp, Artificial Sequence
  Synthetic
aggccctggctgctgatatggctcactccccggtgcttggtagactacccataccggctgtggcattacccgtgcaccatcaacttcaccatccacaaagttcggatgtttttggggggcgaccttttgggacagcggtg

SEQ ID NO: 397476 - DNA, 140 bp, Artificial Sequence
  Synthetic
caccgctgtcccaaaaggtcgccccccaaaaacatccgaactttgtggatggtgaagttgatggtgcacgggtaatgccacagccggtatgggtagtctaccaagcaccggggagtgagccatatcagcagccagggcct

SEQ ID NO: 397477 - DNA, 140 bp, Artificial Sequence
  Synthetic
aggccctggctgctgatatgcgttggcggagtttacttgttgccgcgcaggggccccaggttgggtgtgcgcgcgactcggaagacttcggagcggtcgcaacctcgtgggagacgccaagaccttttgggacagcggtg

SEQ ID NO: 397478 - DNA, 140 bp, Artificial Sequence
  Synthetic
caccgctgtcccaaaaggtcttggcgtctcccacgaggttgcgaccgctccgaagtcttccgagtcgcgcgcacacccaacctggggcccctgcgcggcaacaagtaaactccgccaacgcatatcagcagccagggcct

SEQ ID NO: 397479 - DNA, 140 bp, Artificial Sequence
  Synthetic
aggccctggctgctgatatgtgtcaccatattacaagctctatatcagctggtgcttgtggtggcttcagtattttctgactagagcagaagcgcaactgcacgtgtgggttccccccctgaccttttgggacagcggtg

SEQ ID NO: 397480 - DNA, 140 bp, Artificial Sequence
  Synthetic
caccgctgtcccaaaaggtcagggggggaacccacacgtgcagttgcgcttctgctctagtcagaaaatactgaagccaccacaagcaccagctgatatagagcttgtaatatggtgacacatatcagcagccagggcct

SEQ ID NO: 397481 - DNA, 140 bp, Artificial Sequence
  Synthetic
atacgccatgctgggtctcctacaccacgggcccctgtaccccccttcctgcgccgaactatacgttcgcgctgtggagggtgtcggcagaggaatacgtggaaataaggcaggtgggggcgtacttgggagtcggccat

SEQ ID NO: 397482 - DNA, 140 bp, Artificial Sequence
  Synthetic
atggccgactcccaagtacgcccccacctgccttatttccacgtattcctctgccgacaccctccacagcgcgaacgtatagttcggcgcaggaaggggggtacaggggcccgtggtgtaggagacccagcatggcgtat

SEQ ID NO: 397483 - DNA, 140 bp, Artificial Sequence
  Synthetic
aggccctggctgctgatatgggtttctcgcacttgctattgttactgtgttcactctcaccccagcttacaaacaactgctcgtaagtgtgatttggtggctacaatatttcatcgcacggaccttttgggacagcggtg

SEQ ID NO: 397484 - DNA, 140 bp, Artificial Sequence
  Synthetic
caccgctgtcccaaaaggtccgtgcgatgaaatattgtagccaccaaatcacacttacgagcagttgtttgtaagctggggtgagagtgaacacagtaacaatagcaagtgcgagaaacccatatcagcagccagggcct

SEQ ID NO: 397485 - DNA, 140 bp, Artificial Sequence
  Synthetic
aggccctggctgctgatatgactccttgcgcccatcacggcctatgcccaacagacgcggggcctacttggctgcatcatcaccagcctcacaggccgggacaagaaccaggtcgagggggaccttttgggacagcggtg

SEQ ID NO: 397486 - DNA, 140 bp, Artificial Sequence
  Synthetic
caccgctgtcccaaaaggtccccctcgacctggttcttgtcccggcctgtgaggctggtgatgatgcagccaagtaggccccgcgtctgttgggcataggccgtgatgggcgcaaggagtcatatcagcagccagggcct

SEQ ID NO: 397487 - DNA, 140 bp, Artificial Sequence
  Synthetic
aggccctggctgctgatatgggctccaagacgctggctggcccgaagggccctgtgtgtcagatgtacaccaatgtcgaccaagacctggtaggctggccagccccacctggatcgcgctgaccttttgggacagcggtg

SEQ ID NO: 397488 - DNA, 140 bp, Artificial Sequence
  Synthetic
caccgctgtcccaaaaggtcagcgcgatccaggtggggctggccagcctaccaggtcttggtcgacattggtgtacatctgacacacagggcccttcgggccagccagcgtcttggagcccatatcagcagccagggcct

SEQ ID NO: 397489 - DNA, 140 bp, Artificial Sequence
  Synthetic
aggccctggctgctgatatgggagacggcatcatgcacaccacctgcccatgtggagcacagatcaccggacatgtcaaaaacggttccatgaggatcgttgggcctaagacctgcagcagaccttttgggacagcggtg

SEQ ID NO: 397490 - DNA, 140 bp, Artificial Sequence
  Synthetic
caccgctgtcccaaaaggtctgctgcaggtcttaggcccaacgatcctcatggaaccgtttttgacatgtccggtgatctgtgctccacatgggcaggtggtgtgcatgatgccgtctcccatatcagcagccagggcct

SEQ ID NO: 397491 - DNA, 140 bp, Artificial Sequence
  Synthetic
aggccctggctgctgatatgcgtatttctccatggtggggaactgggcgaaggtcctggtagtgctgctactattcgccagcgtcgacgcgacaacctacgtcaccgggggaagtgccgcgaccttttgggacagcggtg

SEQ ID NO: 397492 - DNA, 140 bp, Artificial Sequence
  Synthetic
caccgctgtcccaaaaggtcgcggcacttcccccggtgacgtaggttgtcgcgtcgacgctggcgaatagtagcagcactaccaggaccttcgcccagttccccaccatggagaaatacgcatatcagcagccagggcct

SEQ ID NO: 397493 - DNA, 140 bp, Artificial Sequence
  Synthetic
atacgccatgctgggtctccctgaactgcaatgatagccttaacaccggctggatagcagggctcttctatttccacaaattcaactcttcgggttgtcccgagaggttagccagctgcccgtacttgggagtcggccat

SEQ ID NO: 397494 - DNA, 140 bp, Artificial Sequence
  Synthetic
atggccgactcccaagtacgggcagctggctaacctctcgggacaacccgaagagttgaatttgtggaaatagaagagccctgctatccagccggtgttaaggctatcattgcagttcagggagacccagcatggcgtat

SEQ ID NO: 397495 - DNA, 140 bp, Artificial Sequence
  Synthetic
aggccctggctgctgatatgtttccacaaattcaactcttcgggttgtcccgagaggttagccagctgccgaccccttgccgattttgcccagggctggggccctatcagtcatgccgacgaccttttgggacagcggtg

SEQ ID NO: 397496 - DNA, 140 bp, Artificial Sequence
  Synthetic
caccgctgtcccaaaaggtcgtcggcatgactgatagggccccagccctgggcaaaatcggcaaggggtcggcagctggctaacctctcgggacaacccgaagagttgaatttgtggaaacatatcagcagccagggcct

SEQ ID NO: 397497 - DNA, 140 bp, Artificial Sequence
  Synthetic
aggccctggctgctgatatggggcgggaacatcacccgcgtggagtcagagaataaggtagtaattctggactctttcgatccgcttcgagcggaggaggacgagagggaggtgtccgttgaccttttgggacagcggtg

SEQ ID NO: 397498 - DNA, 140 bp, Artificial Sequence
  Synthetic
caccgctgtcccaaaaggtcaacggacacctccctctcgtcctcctccgctcgaagcggatcgaaagagtccagaattactaccttattctctgactccacgcgggtgatgttcccgccccatatcagcagccagggcct

SEQ ID NO: 397499 - DNA, 140 bp, Artificial Sequence
  Synthetic
aggccctggctgctgatatgccgggacgcacggtcttgtgtccttcctcgtgttcttctgctttgcatggtatctgaagggtaggtgggtgcccggagcggcctacgccctctacgggatgaccttttgggacagcggtg

SEQ ID NO: 397500 - DNA, 140 bp, Artificial Sequence
  Synthetic
caccgctgtcccaaaaggtcatcccgtagagggcgtaggccgctccgggcacccacctacccttcagataccatgcaaagcagaagaacacgaggaaggacacaagaccgtgcgtcccggcatatcagcagccagggcct

SEQ ID NO: 397501 - DNA, 140 bp, Artificial Sequence
  Synthetic
atacgccatgctgggtctccaaaatcagcctaatcaacagcaatggcagctggcatataaaccggaccgccctcaattgcaatgacagcttgcagacgggtttcatcgcttccctgttctcgtacttgggagtcggccat

SEQ ID NO: 397502 - DNA, 140 bp, Artificial Sequence
  Synthetic
atggccgactcccaagtacgagaacagggaagcgatgaaacccgtctgcaagctgtcattgcaattgagggcggtccggtttatatgccagctgccattgctgttgattaggctgattttggagacccagcatggcgtat

SEQ ID NO: 397503 - DNA, 140 bp, Artificial Sequence
  Synthetic
aggccctggctgctgatatgcgcacaacggcctgcgagatctggccgtggctgtggagccagtcgtcttctcccaaatggagaccaagctcatcacgtggggggcagacaccgccgcgtggaccttttgggacagcggtg

SEQ ID NO: 397504 - DNA, 140 bp, Artificial Sequence
  Synthetic
caccgctgtcccaaaaggtccacgcggcggtgtctgccccccacgtgatgagcttggtctccatttgggagaagacgactggctccacagccacggccagatctcgcaggccgttgtgcgcatatcagcagccagggcct

SEQ ID NO: 397505 - DNA, 140 bp, Artificial Sequence
  Synthetic
aggccctggctgctgatatgtggcttcatgcctcaggaaacttggggtaccacccttgcgagcctggagacatcgggccagaagtgtccgcgctaagctactgtcccagggggggagggcgaccttttgggacagcggtg

SEQ ID NO: 397506 - DNA, 140 bp, Artificial Sequence
  Synthetic
caccgctgtcccaaaaggtcgccctccccccctgggacagtagcttagcgcggacacttctggcccgatgtctccaggctcgcaagggtggtaccccaagtttcctgaggcatgaagccacatatcagcagccagggcct

SEQ ID NO: 397507 - DNA, 140 bp, Artificial Sequence
  Synthetic
atacgccatgctgggtctccttcccttttttttttcccccttttttttttttccctttttttttttttttccccccaaaaggggggggccccttttcccccccccccggggggttgggggcgtacttgggagtcggccat

SEQ ID NO: 397508 - DNA, 140 bp, Artificial Sequence
  Synthetic
atggccgactcccaagtacgcccccaaccccccgggggggggggaaaaggggccccccccttttggggggaaaaaaaaaaaaaaagggaaaaaaaaaaaagggggaaaaaaaaaagggaaggagacccagcatggcgtat

SEQ ID NO: 397509 - DNA, 140 bp, Artificial Sequence
  Synthetic
atacgccatgctgggtctccttctgattgtgatgctactctttgctggcgtcgacgggcacaccaccgtgacgggggggacagcagccagagacaccttcagttgggtgtccctcattcgcgtacttgggagtcggccat

SEQ ID NO: 397510 - DNA, 140 bp, Artificial Sequence
  Synthetic
atggccgactcccaagtacgcgaatgagggacacccaactgaaggtgtctctggctgctgtcccccccgtcacggtggtgtgcccgtcgacgccagcaaagagtagcatcacaatcagaaggagacccagcatggcgtat

SEQ ID NO: 397511 - DNA, 140 bp, Artificial Sequence
  Synthetic
aggccctggctgctgatatgattgccgcgttgttttacgcacacaggttcaactcgtccgggtgcccagagcgcatggctagctgccgccccatcgatgagttcgctcaggggtggggtcgaccttttgggacagcggtg

SEQ ID NO: 397512 - DNA, 140 bp, Artificial Sequence
  Synthetic
caccgctgtcccaaaaggtcgaccccacccctgagcgaactcatcgatggggcggcagctagccatgcgctctgggcacccggacgagttgaacctgtgtgcgtaaaacaacgcggcaatcatatcagcagccagggcct

SEQ ID NO: 397513 - DNA, 140 bp, Artificial Sequence
  Synthetic
atacgccatgctgggtctccccatttctcatgttgagcttaacaactcggaccagaggccttattgctggcactatgcgccacgcccgtgtggcatcatacccgcgtcgcaggtgtgtggcgtacttgggagtcggccat

SEQ ID NO: 397514 - DNA, 140 bp, Artificial Sequence
  Synthetic
atggccgactcccaagtacgccacacacctgcgacgcgggtatgatgccacacgggcgtggcgcatagtgccagcaataaggcctctggtccgagttgttaagctcaacatgagaaatggggagacccagcatggcgtat

SEQ ID NO: 397515 - DNA, 140 bp, Artificial Sequence
  Synthetic
aggccctggctgctgatatgcagttcaagcagaaggccctcggcctcctgcagaccgcgtcccgtcaggcagaggttatcgcccctgctgtccagaccaactggcaaaaactcgaggcctgaccttttgggacagcggtg

SEQ ID NO: 397516 - DNA, 140 bp, Artificial Sequence
  Synthetic
caccgctgtcccaaaaggtcaggcctcgagtttttgccagttggtctggacagcaggggcgataacctctgcctgacgggacgcggtctgcaggaggccgagggccttctgcttgaactgcatatcagcagccagggcct

SEQ ID NO: 397517 - DNA, 140 bp, Artificial Sequence
  Synthetic
atacgccatgctgggtctccagcgaaggccggtcctgggctcagcccgggtacccttggcccctctatggtaatgagggctgcgggtgggcagggtggctcctgtccccgcgcggctccccgtacttgggagtcggccat

SEQ ID NO: 397518 - DNA, 140 bp, Artificial Sequence
  Synthetic
atggccgactcccaagtacggggagccgcgcggggacaggagccaccctgcccacccgcagccctcattaccatagaggggccaagggtacccgggctgagcccaggaccggccttcgctggagacccagcatggcgtat

SEQ ID NO: 397519 - DNA, 140 bp, Artificial Sequence
  Synthetic
atacgccatgctgggtctcctggggtgggaacgtgagtgatgtgatcctgctgcaaaacgccagacctcctcgtggtgcctggtttgggtgtacgtggatgaattccaccggttatgtcacgtacttgggagtcggccat

SEQ ID NO: 397520 - DNA, 140 bp, Artificial Sequence
  Synthetic
atggccgactcccaagtacgtgacataaccggtggaattcatccacgtacacccaaaccaggcaccacgaggaggtctggcgttttgcagcaggatcacatcactcacgttcccaccccaggagacccagcatggcgtat

SEQ ID NO: 397521 - DNA, 140 bp, Artificial Sequence
  Synthetic
atacgccatgctgggtctccttcctcgctaggctcatatggtggttacaatatcttatcaccagagtcgaggcgcatctacaagtgtgggtcccccctcttaacgttcggggggcccgcgcgtacttgggagtcggccat

SEQ ID NO: 397522 - DNA, 140 bp, Artificial Sequence
  Synthetic
atggccgactcccaagtacgcgcgggccccccgaacgttaagaggggggacccacacttgtagatgcgcctcgactctggtgataagatattgtaaccaccatatgagcctagcgaggaaggagacccagcatggcgtat

SEQ ID NO: 397523 - DNA, 140 bp, Artificial Sequence
  Synthetic
atacgccatgctgggtctccgcggacaccgcggcgtgcggggacatcctctctggtctgcccgtctccgcccgaagggggggggagatacttctgggaccggccgacaggtttcaagagccgtacttgggagtcggccat

SEQ ID NO: 397524 - DNA, 140 bp, Artificial Sequence
  Synthetic
atggccgactcccaagtacggctcttgaaacctgtcggccggtcccagaagtatctcccccccccttcgggcggagacgggcagaccagagaggatgtccccgcacgccgcggtgtccgcggagacccagcatggcgtat

SEQ ID NO: 397525 - DNA, 140 bp, Artificial Sequence
  Synthetic
aggccctggctgctgatatgaccagggcctgctatttgggttggttttcatctgtatcgcgtggcacatacggggcagagctgcccccctatttgcctatgcttgtcttcagttgtggccgaccttttgggacagcggtg

SEQ ID NO: 397526 - DNA, 140 bp, Artificial Sequence
  Synthetic
caccgctgtcccaaaaggtcggccacaactgaagacaagcataggcaaataggggggcagctctgccccgtatgtgccacgcgatacagatgaaaaccaacccaaatagcaggccctggtcatatcagcagccagggcct

SEQ ID NO: 397527 - DNA, 140 bp, Artificial Sequence
  Synthetic
atacgccatgctgggtctccatgaggaggcagcttctcttgggtttcttgcacttgttattgtcactgtgtttactctcaccccagcctacaaacaactgctcgtaagtgtgatttggtgcgtacttgggagtcggccat

SEQ ID NO: 397528 - DNA, 140 bp, Artificial Sequence
  Synthetic
atggccgactcccaagtacgcaccaaatcacacttacgagcagttgtttgtaggctggggtgagagtaaacacagtgacaataacaagtgcaagaaacccaagagaagctgcctcctcatggagacccagcatggcgtat

SEQ ID NO: 397529 - DNA, 140 bp, Artificial Sequence
  Synthetic
atacgccatgctgggtctccacggcttgcgagacctcgctgttgccgttgagcccgtcatattttctccaatggagaaaaaggttatcacctggggtgctgacactgctgcatgtggagacgtacttgggagtcggccat

SEQ ID NO: 397530 - DNA, 140 bp, Artificial Sequence
  Synthetic
atggccgactcccaagtacgtctccacatgcagcagtgtcagcaccccaggtgataacctttttctccattggagaaaatatgacgggctcaacggcaacagcgaggtctcgcaagccgtggagacccagcatggcgtat

SEQ ID NO: 397531 - DNA, 140 bp, Artificial Sequence
  Synthetic
atacgccatgctgggtctcctctctacggccacgcagaccttcctcgctacctctgtcaacagagttctttggacggtctaccatggcgctggctccaaaacgctggctggcccgaagggcgtacttgggagtcggccat

SEQ ID NO: 397532 - DNA, 140 bp, Artificial Sequence
  Synthetic
atggccgactcccaagtacgcccttcgggccagccagcgttttggagccagcgccatggtagaccgtccaaagaactctgttgacagaggtagcgaggaaggtctgcgtggccgtagagaggagacccagcatggcgtat

SEQ ID NO: 397533 - DNA, 140 bp, Artificial Sequence
  Synthetic
aggccctggctgctgatatgggctcatatggtggttgcaatattttatcaccagagccgaggcgcacttgcaggtgtggatcccccccctcaacgttcgggggggccgcgatgccatcatgaccttttgggacagcggtg

SEQ ID NO: 397534 - DNA, 140 bp, Artificial Sequence
  Synthetic
caccgctgtcccaaaaggtcatgatggcatcgcggcccccccgaacgttgaggggggggatccacacctgcaagtgcgcctcggctctggtgataaaatattgcaaccaccatatgagcccatatcagcagccagggcct

SEQ ID NO: 397535 - DNA, 140 bp, Artificial Sequence
  Synthetic
aggccctggctgctgatatggctgtataggctaggagccgtccaaaatgaggtcaccctcacacaccccataaccaaattcatcatggcatgcatgtcggctgacctggaggtcgccacggaccttttgggacagcggtg

SEQ ID NO: 397536 - DNA, 140 bp, Artificial Sequence
  Synthetic
caccgctgtcccaaaaggtccgtggcgacctccaggtcagccgacatgcatgccatgatgaatttggttatggggtgtgtgagggtgacctcattttggacggctcctagcctatacagccatatcagcagccagggcct

SEQ ID NO: 397537 - DNA, 140 bp, Artificial Sequence
  Synthetic
aggccctggctgctgatatgagcacctgggtgctagtaggcggggtcctcgcagctctggccgcgtattgcctgacaacaggcagcgtggtcattgtaggcaggatcatcttgtccggaagaccttttgggacagcggtg

SEQ ID NO: 397538 - DNA, 140 bp, Artificial Sequence
  Synthetic
caccgctgtcccaaaaggtcttccggacaagatgatcctgcctacaatgaccacgctgcctgttgtcaggcaatacgcggccagagctgcgaggaccccgcctactagcacccaggtgctcatatcagcagccagggcct

SEQ ID NO: 397539 - DNA, 140 bp, Artificial Sequence
  Synthetic
atacgccatgctgggtctccccccggacgctgatctcatcgaggccaacctcctgtggcaggagatgggcggaaccatcacccgcatagagtcaaaaaacaaggtggtaattctggactccgtacttgggagtcggccat

SEQ ID NO: 397540 - DNA, 140 bp, Artificial Sequence
  Synthetic
atggccgactcccaagtacggagtccagaattaccaccttgttttttgactctatgcgggtgatggttccgcccatctcctgccacaggaggttggcctcgatgagatcagcgtccggggggagacccagcatggcgtat

SEQ ID NO: 397541 - DNA, 140 bp, Artificial Sequence
  Synthetic
aggccctggctgctgatatgatacggacgtcttcgtccttaacaacaccaggccaccgctgggcaattggttcggttgcacctggatgaactcaactggattcaccaaagtgtgcggagcgaccttttgggacagcggtg

SEQ ID NO: 397542 - DNA, 140 bp, Artificial Sequence
  Synthetic
caccgctgtcccaaaaggtcgctccgcacactttggtgaatccagttgagttcatccaggtgcaaccgaaccaattgcccagcggtggcctggtgttgttaaggacgaagacgtccgtatcatatcagcagccagggcct

SEQ ID NO: 397543 - DNA, 140 bp, Artificial Sequence
  Synthetic
aggccctggctgctgatatgcaccgtgcacctgcggcagctcggacctctatttggtcacgagacacgccgatgtcattccggtgcgccggcggggcgacagcagggggagcttactctcgaccttttgggacagcggtg

SEQ ID NO: 397544 - DNA, 140 bp, Artificial Sequence
  Synthetic
caccgctgtcccaaaaggtcgagagtaagctccccctgctgtcgccccgccggcgcaccggaatgacatcggcgtgtctcgtgaccaaatagaggtccgagctgccgcaggtgcacggtgcatatcagcagccagggcct

SEQ ID NO: 397545 - DNA, 140 bp, Artificial Sequence
  Synthetic
aggccctggctgctgatatggacacactccagtcaattcctggctaggcaacataatcatgtttgcccccacattgtgggcgagaatgatactgatgacccacttcttcagtgtcctcatgaccttttgggacagcggtg

SEQ ID NO: 397546 - DNA, 140 bp, Artificial Sequence
  Synthetic
caccgctgtcccaaaaggtcatgaggacactgaagaagtgggtcatcagtatcattctcgcccacaatgtgggggcaaacatgattatgttgcctagccaggaattgactggagtgtgtccatatcagcagccagggcct

SEQ ID NO: 397547 - DNA, 140 bp, Artificial Sequence
  Synthetic
atacgccatgctgggtctccgcaggcctcaccaactttgacatgctggtctgcggagacgatctagtagtcgtagctgagagcgttggcgttcctgaggatgcagccaacctgcgagcttcgtacttgggagtcggccat

SEQ ID NO: 397548 - DNA, 140 bp, Artificial Sequence
  Synthetic
atggccgactcccaagtacgaagctcgcaggttggctgcatcctcaggaacgccaacgctctcagctacgactactagatcgtctccgcagaccagcatgtcaaagttggtgaggcctgcggagacccagcatggcgtat

SEQ ID NO: 397549 - DNA, 140 bp, Artificial Sequence
  Synthetic
atacgccatgctgggtctccccggaatacgacttggagctaataacatcatgctcatcgaacgtttccgtggcccatgacaatactggacatgagatctattacctcaccagagacccaacgtacttgggagtcggccat

SEQ ID NO: 397550 - DNA, 140 bp, Artificial Sequence
  Synthetic
atggccgactcccaagtacgttgggtctctggtgaggtaatagatctcatgtccagtattgtcatgggccacggaaacgttcgatgagcatgatgttattagctccaagtcgtattccggggagacccagcatggcgtat

SEQ ID NO: 397551 - DNA, 140 bp, Artificial Sequence
  Synthetic
atacgccatgctgggtctcctcagaaagcttggggcaccaccgttgagagcctggaggcatcgggccagggcggtcagagccaaactcatagcccagggcgggaaagccgctatatgcggcgtacttgggagtcggccat

SEQ ID NO: 397552 - DNA, 140 bp, Artificial Sequence
  Synthetic
atggccgactcccaagtacgccgcatatagcggctttcccgccctgggctatgagtttggctctgaccgccctggcccgatgcctccaggctctcaacggtggtgccccaagctttctgaggagacccagcatggcgtat

SEQ ID NO: 397553 - DNA, 140 bp, Artificial Sequence
  Synthetic
aggccctggctgctgatatgcctggcgggcatagcgtatttctccatggtagggaactgggcaaaggtcatcgtagtgctgctactatttgccggcgttgacgcgagcacccacgtcactgaccttttgggacagcggtg

SEQ ID NO: 397554 - DNA, 140 bp, Artificial Sequence
  Synthetic
caccgctgtcccaaaaggtcagtgacgtgggtgctcgcgtcaacgccggcaaatagtagcagcactacgatgacctttgcccagttccctaccatggagaaatacgctatgcccgccaggcatatcagcagccagggcct

SEQ ID NO: 397555 - DNA, 140 bp, Artificial Sequence
  Synthetic
atacgccatgctgggtctcctcaataggacggccttgaactgcaacgatgcccttaacaccggctggatagcagggcttttgtattacaacaaattcaattcttcaggctgtcctgagagcgtacttgggagtcggccat

SEQ ID NO: 397556 - DNA, 140 bp, Artificial Sequence
  Synthetic
atggccgactcccaagtacgctctcaggacagcctgaagaattgaatttgttgtaatacaaaagccctgctatccagccggtgttaagggcatcgttgcagttcaaggccgtcctattgaggagacccagcatggcgtat

SEQ ID NO: 397557 - DNA, 140 bp, Artificial Sequence
  Synthetic
atacgccatgctgggtctccattggcgagctgccgacctctcacccattttgcccagggctggggccctatcagctatgccaatggaagcgacttcaatcatcgcccctactgctggcaccgtacttgggagtcggccat

SEQ ID NO: 397558 - DNA, 140 bp, Artificial Sequence
  Synthetic
atggccgactcccaagtacggtgccagcagtaggggcgatgattgaagtcgcttccattggcatagctgatagggccccagccctgggcaaaatgggtgagaggtcggcagctcgccaatggagacccagcatggcgtat

SEQ ID NO: 397559 - DNA, 140 bp, Artificial Sequence
  Synthetic
aggccctggctgctgatatgcactacgcgcctcaaccgtgcggtattgtacccgcgtcgcaggtgtgtggtccagtgtactgcttcaccccaagccctgtcgtggtggggacgaccgatcgaccttttgggacagcggtg

SEQ ID NO: 397560 - DNA, 140 bp, Artificial Sequence
  Synthetic
caccgctgtcccaaaaggtcgatcggtcgtccccaccacgacagggcttggggtgaagcagtacactggaccacacacctgcgacgcgggtacaataccgcacggttgaggcgcgtagtgcatatcagcagccagggcct

SEQ ID NO: 397561 - DNA, 140 bp, Artificial Sequence
  Synthetic
aggccctggctgctgatatgccggccgactcagaaacatccaaggggtggagactccttgcccccatcacggcgtacgcgcagcagacccgcggcttgttcagtaccatcataacgagccgaccttttgggacagcggtg

SEQ ID NO: 397562 - DNA, 140 bp, Artificial Sequence
  Synthetic
caccgctgtcccaaaaggtcggctcgttatgatggtactgaacaagccgcgggtctgctgcgcgtacgccgtgatgggggcaaggagtctccaccccttggatgtttctgagtcggccggcatatcagcagccagggcct

SEQ ID NO: 397563 - DNA, 140 bp, Artificial Sequence
  Synthetic
atacgccatgctgggtctccttgtgaattccaacggcagctggcatgtaaacaggaccgccctcaactgcaatgatagcctccagaccggctttattgcgggcctgttttactataacaacgtacttgggagtcggccat

SEQ ID NO: 397564 - DNA, 140 bp, Artificial Sequence
  Synthetic
atggccgactcccaagtacgttgttatagtaaaacaggcccgcaataaagccggtctggaggctatcattgcagttgagggcggtcctgtttacatgccagctgccgttggaattcacaaggagacccagcatggcgtat

SEQ ID NO: 397565 - DNA, 140 bp, Artificial Sequence
  Synthetic
aggccctggctgctgatatgaatgatagcctccagaccggctttattgcgggcctgttttactataacaaattcaactcgtcggggtgtcctgaacgcatgtcttcctgcaaaccgatcagaccttttgggacagcggtg

SEQ ID NO: 397566 - DNA, 140 bp, Artificial Sequence
  Synthetic
caccgctgtcccaaaaggtctgatcggtttgcaggaagacatgcgttcaggacaccccgacgagttgaatttgttatagtaaaacaggcccgcaataaagccggtctggaggctatcattcatatcagcagccagggcct

SEQ ID NO: 397567 - DNA, 140 bp, Artificial Sequence
  Synthetic
aggccctggctgctgatatgttcctcgctaagctcatatggtggttgcaatatttcatcaccagagccgaggcgcatttacaagtgtggatcccccccctcaacgtccgggggggccgcggaccttttgggacagcggtg

SEQ ID NO: 397568 - DNA, 140 bp, Artificial Sequence
  Synthetic
caccgctgtcccaaaaggtccgcggcccccccggacgttgaggggggggatccacacttgtaaatgcgcctcggctctggtgatgaaatattgcaaccaccatatgagcttagcgaggaacatatcagcagccagggcct

SEQ ID NO: 397569 - DNA, 140 bp, Artificial Sequence
  Synthetic
atacgccatgctgggtctcctggggcgagaacgtgagtgatgtgttcctgctgcagagcgccagacctcctcgtggtgcctggtttggatgtacctggatgaattccaccggctatgtcacgtacttgggagtcggccat

SEQ ID NO: 397570 - DNA, 140 bp, Artificial Sequence
  Synthetic
atggccgactcccaagtacgtgacatagccggtggaattcatccaggtacatccaaaccaggcaccacgaggaggtctggcgctctgcagcaggaacacatcactcacgttctcgccccaggagacccagcatggcgtat

SEQ ID NO: 397571 - DNA, 140 bp, Artificial Sequence
  Synthetic
aggccctggctgctgatatgagaccaggacctcgtcggctggcaggcgccccccggggcgcgctccttgacaccatgcacctgcggcagctcggacctttacttggtcacgaggcatgctgaccttttgggacagcggtg

SEQ ID NO: 397572 - DNA, 140 bp, Artificial Sequence
  Synthetic
caccgctgtcccaaaaggtcagcatgcctcgtgaccaagtaaaggtccgagctgccgcaggtgcatggtgtcaaggagcgcgccccggggggcgcctgccagccgacgaggtcctggtctcatatcagcagccagggcct

SEQ ID NO: 397573 - DNA, 140 bp, Artificial Sequence
  Synthetic
atacgccatgctgggtctcccatccttacaggttcggggtggccgcgatgctgtcatactccttgcttgcttgttgcacccgcagctgggttttgaggttacaaagattcttctggctttcgtacttgggagtcggccat

SEQ ID NO: 397574 - DNA, 140 bp, Artificial Sequence
  Synthetic
atggccgactcccaagtacgaaagccagaagaatctttgtaacctcaaaacccagctgcgggtgcaacaagcaagcaaggagtatgacagcatcgcggccaccccgaacctgtaaggatgggagacccagcatggcgtat

SEQ ID NO: 397575 - DNA, 140 bp, Artificial Sequence
  Synthetic
aggccctggctgctgatatgactaaggtgccggctgcatatgcagcccaagggtacaaggtactcgtcctgaacccgtccgttgccgccaccttaggttttggggcgtatatgtctaagggaccttttgggacagcggtg

SEQ ID NO: 397576 - DNA, 140 bp, Artificial Sequence
  Synthetic
caccgctgtcccaaaaggtcccttagacatatacgccccaaaacctaaggtggcggcaacggacgggttcaggacgagtaccttgtacccttgggctgcatatgcagccggcaccttagtcatatcagcagccagggcct

SEQ ID NO: 397577 - DNA, 140 bp, Artificial Sequence
  Synthetic
atacgccatgctgggtctccgacctctatcttgtcacgaggaatgccgatgtcgtccctgcaaggcgcagaggcgataatcgggcggctctcctcagtccacgacccattagcaccctcacgtacttgggagtcggccat

SEQ ID NO: 397578 - DNA, 140 bp, Artificial Sequence
  Synthetic
atggccgactcccaagtacgtgagggtgctaatgggtcgtggactgaggagagccgcccgattatcgcctctgcgccttgcagggacgacatcggcattcctcgtgacaagatagaggtcggagacccagcatggcgtat

SEQ ID NO: 397579 - DNA, 140 bp, Artificial Sequence
  Synthetic
atacgccatgctgggtctcctgcttgtcctcttgctcccccaacgggcgtatgcttggtcgggtgaagacagcgctactctcggcgctggggtcttggccctcttcggcttctttaccttcgtacttgggagtcggccat

SEQ ID NO: 397580 - DNA, 140 bp, Artificial Sequence
  Synthetic
atggccgactcccaagtacgaaggtaaagaagccgaagagggccaagaccccagcgccgagagtagcgctgtcttcacccgaccaagcatacgcccgttgggggagcaagaggacaagcaggagacccagcatggcgtat

SEQ ID NO: 397581 - DNA, 140 bp, Artificial Sequence
  Synthetic
aggccctggctgctgatatgcttagcgcattttcactccacagttactctccaggtgagatcaatagggtggcttcatgcctcaggaaacttggggtaccacccttgcgagtctggagacgaccttttgggacagcggtg

SEQ ID NO: 397582 - DNA, 140 bp, Artificial Sequence
  Synthetic
caccgctgtcccaaaaggtcgtctccagactcgcaagggtggtaccccaagtttcctgaggcatgaagccaccctattgatctcacctggagagtaactgtggagtgaaaatgcgctaagcatatcagcagccagggcct

SEQ ID NO: 397583 - DNA, 140 bp, Artificial Sequence
  Synthetic
aggccctggctgctgatatgagcgggggggacatttatcacagcgtgtcccgggctcgaccccgcatattactcctgtgcctactcctacttaccgtaggggtaggcatcttcctgctccgaccttttgggacagcggtg

SEQ ID NO: 397584 - DNA, 140 bp, Artificial Sequence
  Synthetic
caccgctgtcccaaaaggtcggagcaggaagatgcctacccctacggtaagtaggagtaggcacaggagtaatatgcggggtcgagcccgggacacgctgtgataaatgtcccccccgctcatatcagcagccagggcct

SEQ ID NO: 397585 - DNA, 140 bp, Artificial Sequence
  Synthetic
aggccctggctgctgatatgatcgttggtggagtctacttgctgccgcgcaggggcccgcgtttgggtgtgcgcgcgacgagaaagacttctgaacggtcccagcccagaggtaggcgccgaccttttgggacagcggtg

SEQ ID NO: 397586 - DNA, 140 bp, Artificial Sequence
  Synthetic
caccgctgtcccaaaaggtcggcgcctacctctgggctgggaccgttcagaagtctttctcgtcgcgcgcacacccaaacgcgggcccctgcgcggcagcaagtagactccaccaacgatcatatcagcagccagggcct

SEQ ID NO: 397587 - DNA, 140 bp, Artificial Sequence
  Synthetic
atacgccatgctgggtctccccatcacttacgctgggccgagcagctcagaccagaggccctattgttggcactacgcgcctcaaccgtgtggtatcgtacccgcgtcacaggtgtgtggcgtacttgggagtcggccat

SEQ ID NO: 397588 - DNA, 140 bp, Artificial Sequence
  Synthetic
atggccgactcccaagtacgccacacacctgtgacgcgggtacgataccacacggttgaggcgcgtagtgccaacaatagggcctctggtctgagctgctcggcccagcgtaagtgatggggagacccagcatggcgtat

SEQ ID NO: 397589 - DNA, 140 bp, Artificial Sequence
  Synthetic
atacgccatgctgggtctccgctcctgtccccccgcggctctcgcccaaattggggcccaaacgacccccggcggaggtcccgcaacttgggtaaagtcatcgacacccttacttgcggccgtacttgggagtcggccat

SEQ ID NO: 397590 - DNA, 140 bp, Artificial Sequence
  Synthetic
atggccgactcccaagtacggccgcaagtaagggtgtcgatgactttacccaagttgcgggacctccgccgggggtcgtttgggccccaatttgggcgagagccgcggggggacaggagcggagacccagcatggcgtat

SEQ ID NO: 397591 - DNA, 140 bp, Artificial Sequence
  Synthetic
atacgccatgctgggtctccattatgcaacagggaatctgcccggttgctctttctctatctttctcttggcacttctctcgtgcctcacgacgccagcctccgcggcgcattataccaacgtacttgggagtcggccat

SEQ ID NO: 397592 - DNA, 140 bp, Artificial Sequence
  Synthetic
atggccgactcccaagtacgttggtataatgcgccgcggaggctggcgtcgtgaggcacgagagaagtgccaagagaaagatagagaaagagcaaccgggcagattccctgttgcataatggagacccagcatggcgtat

SEQ ID NO: 397593 - DNA, 140 bp, Artificial Sequence
  Synthetic
aggccctggctgctgatatggcacttctctcgtgcctcacgacgccagcctccgcggcgcattataccaacaagtctggcctgtactatctcaccaatgactgccccaacagcagcatcggaccttttgggacagcggtg

SEQ ID NO: 397594 - DNA, 140 bp, Artificial Sequence
  Synthetic
caccgctgtcccaaaaggtccgatgctgctgttggggcagtcattggtgagatagtacaggccagacttgttggtataatgcgccgcggaggctggcgtcgtgaggcacgagagaagtgccatatcagcagccagggcct

SEQ ID NO: 397595 - DNA, 140 bp, Artificial Sequence
  Synthetic
atacgccatgctgggtctccggcagtgccgaacgcgtctacgccaatcactgggttccgcaaacatgtggatgtcatggtgggcgctgccgcgttctgctcagctatgtacgtgggggaccgtacttgggagtcggccat

SEQ ID NO: 397596 - DNA, 140 bp, Artificial Sequence
  Synthetic
atggccgactcccaagtacggtcccccacgtacatagctgagcagaacgcggcagcgcccaccatgacatccacatgtttgcggaacccagtgattggcgtagacgcgttcggcactgccggagacccagcatggcgtat

SEQ ID NO: 397597 - DNA, 140 bp, Artificial Sequence
  Synthetic
aggccctggctgctgatatgggcttgatccatctccatcagaacatcgtggacgtgcaatacctgtacggtatagggtcagcggttgtctcctttgcaatcaaatgggagtatatcctgtgaccttttgggacagcggtg

SEQ ID NO: 397598 - DNA, 140 bp, Artificial Sequence
  Synthetic
caccgctgtcccaaaaggtcacaggatatactcccatttgattgcaaaggagacaaccgctgaccctataccgtacaggtattgcacgtccacgatgttctgatggagatggatcaagcccatatcagcagccagggcct

SEQ ID NO: 397599 - DNA, 140 bp, Artificial Sequence
  Synthetic
aggccctggctgctgatatggttaccctggtcctgtcctacctggcacgcataccccaggtgatcgtcgatgtgttcatcggcggtcattggggcgtgctagcagggctgctatactatagaccttttgggacagcggtg

SEQ ID NO: 397600 - DNA, 140 bp, Artificial Sequence
  Synthetic
caccgctgtcccaaaaggtctatagtatagcagccctgctagcacgccccaatgaccgccgatgaacacatcgacgatcacctggggtatgcgtgccaggtaggacaggaccagggtaaccatatcagcagccagggcct

SEQ ID NO: 397601 - DNA, 140 bp, Artificial Sequence
  Synthetic
atacgccatgctgggtctccatgcggctttgcgtggctgtttactgcgggctctcgccagaatatccaactcatcaacaccaacggaagctggcacatcaacaggactgcgttgaattgccgtacttgggagtcggccat

SEQ ID NO: 397602 - DNA, 140 bp, Artificial Sequence
  Synthetic
atggccgactcccaagtacggcaattcaacgcagtcctgttgatgtgccagcttccgttggtgttgatgagttggatattctggcgagagcccgcagtaaacagccacgcaaagccgcatggagacccagcatggcgtat

SEQ ID NO: 397603 - DNA, 140 bp, Artificial Sequence
  Synthetic
aggccctggctgctgatatgatggttgactacccatacaggctttggcactacccctgcactgtcaactttaccatcttcaaggttaggatgtatgtggggggtgtggagcacaggctcagaccttttgggacagcggtg

SEQ ID NO: 397604 - DNA, 140 bp, Artificial Sequence
  Synthetic
caccgctgtcccaaaaggtctgagcctgtgctccacaccccccacatacatcctaaccttgaagatggtaaagttgacagtgcaggggtagtgccaaagcctgtatgggtagtcaaccatcatatcagcagccagggcct

SEQ ID NO: 397605 - DNA, 140 bp, Artificial Sequence
  Synthetic
atacgccatgctgggtctcctggggcgagaatgagtctgatgtgttcctgttggcaagcccgagaccccctgcagggtggtggtttggctgtacgtggatgaactccacagggtttactacgtacttgggagtcggccat

SEQ ID NO: 397606 - DNA, 140 bp, Artificial Sequence
  Synthetic
atggccgactcccaagtacgtagtaaaccctgtggagttcatccacgtacagccaaaccaccaccctgcagggggtctcgggcttgccaacaggaacacatcagactcattctcgccccaggagacccagcatggcgtat

SEQ ID NO: 397607 - DNA, 140 bp, Artificial Sequence
  Synthetic
aggccctggctgctgatatgggctcatatggtggttacaatactttatcaccagagccgaggcgcacttgcaggtgtggatcccccccctcaacgttcgggggggccgtgatgccatcatgaccttttgggacagcggtg

SEQ ID NO: 397608 - DNA, 140 bp, Artificial Sequence
  Synthetic
caccgctgtcccaaaaggtcatgatggcatcacggcccccccgaacgttgaggggggggatccacacctgcaagtgcgcctcggctctggtgataaagtattgtaaccaccatatgagcccatatcagcagccagggcct

SEQ ID NO: 397609 - DNA, 140 bp, Artificial Sequence
  Synthetic
atacgccatgctgggtctcccaaatgcggctcaggtccctggctcacgccaaggtgcctggtcgactacccgtataggctgtggcactacccctgtactgtcaatttcaccgtgcacaagcgtacttgggagtcggccat

SEQ ID NO: 397610 - DNA, 140 bp, Artificial Sequence
  Synthetic
atggccgactcccaagtacgcttgtgcacggtgaaattgacagtacaggggtagtgccacagcctatacgggtagtcgaccaggcaccttggcgtgagccagggacctgagccgcatttgggagacccagcatggcgtat

SEQ ID NO: 397611 - DNA, 140 bp, Artificial Sequence
  Synthetic
atacgccatgctgggtctcctgagccctcttctgcattccacgactgagctcgcaatccttccctgcactttcaccactatgccagccctttcctccgggttaatacatctgcatcaaaacgtacttgggagtcggccat

SEQ ID NO: 397612 - DNA, 140 bp, Artificial Sequence
  Synthetic
atggccgactcccaagtacgttttgatgcagatgtattaacccggaggaaagggctggcatagtggtgaaagtgcagggaaggattgcgagctcagtcgtggaatgcagaagagggctcaggagacccagcatggcgtat

SEQ ID NO: 397613 - DNA, 140 bp, Artificial Sequence
  Synthetic
aggccctggctgctgatatgtcacggaggctatgactaggtactctgccccccccggggacccgccccaaccagaatacgacttggagctgataacatcatgctcctccaatgtgtcggtgaccttttgggacagcggtg

SEQ ID NO: 397614 - DNA, 140 bp, Artificial Sequence
  Synthetic
caccgctgtcccaaaaggtcaccgacacattggaggagcatgatgttatcagctccaagtcgtattctggttggggcgggtccccggggggggcagagtacctagtcatagcctccgtgacatatcagcagccagggcct

SEQ ID NO: 397615 - DNA, 140 bp, Artificial Sequence
  Synthetic
atacgccatgctgggtctccgcgcgcgtctgcgcgtgcctgtggctcatgttactcataggccaggcggaggcggccttggagaacttaattgttctcaatgccgcttcagccgccagctcgtacttgggagtcggccat

SEQ ID NO: 397616 - DNA, 140 bp, Artificial Sequence
  Synthetic
atggccgactcccaagtacgagctggcggctgaagcggcattgagaacaattaagttctccaaggccgcctccgcctggcctatgagtaacatgagccacaggcacgcgcagacgcgcgcggagacccagcatggcgtat

SEQ ID NO: 397617 - DNA, 140 bp, Artificial Sequence
  Synthetic
atacgccatgctgggtctccacttttgctgctcgttctggccctgccacaacgcgccttcgcctatgatcaggaagcagcgggctctataggggctctggtcattccggttatcaccgtgcgtacttgggagtcggccat

SEQ ID NO: 397618 - DNA, 140 bp, Artificial Sequence
  Synthetic
atggccgactcccaagtacgcacggtgataaccggaatgaccagagcccctatagagcccgctgcttcctgatcataggcgaaggcgcgttgtggcagggccagaacgagcagcaaaagtggagacccagcatggcgtat

SEQ ID NO: 397619 - DNA, 140 bp, Artificial Sequence
  Synthetic
atacgccatgctgggtctcccaggtttatcggtgcgggggggccgtgatgcagtgatcctgctcacatgcctcctgcaccctgctctcgggtttgacatctccaaagtgctcttagccatcgtacttgggagtcggccat

SEQ ID NO: 397620 - DNA, 140 bp, Artificial Sequence
  Synthetic
atggccgactcccaagtacgatggctaagagcactttggagatgtcaaacccgagagcagggtgcaggaggcatgtgagcaggatcactgcatcacggcccccccgcaccgataaacctgggagacccagcatggcgtat

SEQ ID NO: 397621 - DNA, 140 bp, Artificial Sequence
  Synthetic
atacgccatgctgggtctcccatggggcctctctacctgctgcaggcgagcctgttgcgcgtaccgtattacgtgcgcgctcacgctctattgcgggtgtgtttggctgtccgcaggatgcgtacttgggagtcggccat

SEQ ID NO: 397622 - DNA, 140 bp, Artificial Sequence
  Synthetic
atggccgactcccaagtacgcatcctgcggacagccaaacacacccgcaatagagcgtgagcgcgcacgtaatacggtacgcgcaacaggctcgcctgcagcaggtagagaggccccatgggagacccagcatggcgtat

SEQ ID NO: 397623 - DNA, 140 bp, Artificial Sequence
  Synthetic
atacgccatgctgggtctccacggcttgcgcgaccttgccgttgcagttgagcccatcaccttctcccctatggagaagaagatcatcacatggggagccgacactgccgcttgcggcgacgtacttgggagtcggccat

SEQ ID NO: 397624 - DNA, 140 bp, Artificial Sequence
  Synthetic
atggccgactcccaagtacgtcgccgcaagcggcagtgtcggctccccatgtgatgatcttcttctccataggggagaaggtgatgggctcaactgcaacggcaaggtcgcgcaagccgtggagacccagcatggcgtat

SEQ ID NO: 397625 - DNA, 140 bp, Artificial Sequence
  Synthetic
atacgccatgctgggtctccatcacggcctacgcccagcagactcgcggtctgcttgggacgattgtcaccagtcttacgggtcgcgataagaacgaggtcgaaggcgaggtgcaggtaacgtacttgggagtcggccat

SEQ ID NO: 397626 - DNA, 140 bp, Artificial Sequence
  Synthetic
atggccgactcccaagtacgttacctgcacctcgccttcgacctcgttcttatcgcgacccgtaagactggtgacaatcgtcccaagcagaccgcgagtctgctgggcgtaggccgtgatggagacccagcatggcgtat

SEQ ID NO: 397627 - DNA, 140 bp, Artificial Sequence
  Synthetic
atacgccatgctgggtctccgcctgtgtgccagatgtacaccaacgtggatcaggacatggtaggctggccggcgcccgcgggcgccaggtcatttacaccatgcacctgtggtgccagccgtacttgggagtcggccat

SEQ ID NO: 397628 - DNA, 140 bp, Artificial Sequence
  Synthetic
atggccgactcccaagtacggctggcaccacaggtgcatggtgtaaatgacctggcgcccgcgggcgccggccagcctaccatgtcctgatccacgttggtgtacatctggcacacaggcggagacccagcatggcgtat

SEQ ID NO: 397629 - DNA, 140 bp, Artificial Sequence
  Synthetic
atacgccatgctgggtctccaacaccctcacttgctacatcaaggcccaggcagcctgtcgagccgcagggctccaggactgcaccatgctcgtgtgtggcgacgacttagtcgttatctcgtacttgggagtcggccat

SEQ ID NO: 397630 - DNA, 140 bp, Artificial Sequence
  Synthetic
atggccgactcccaagtacgagataacgactaagtcgtcgccacacacgagcatggtgcagtcctggagccctgcggctcgacaggctgcctgggccttgatgtagcaagtgagggtgttggagacccagcatggcgtat

SEQ ID NO: 397631 - DNA, 140 bp, Artificial Sequence
  Synthetic
atacgccatgctgggtctccctctttcgagctgctgtctgcacgcgaggtgtcgccaaggcgattgacttcgtgcctgtagaaagcatggagaccacaatgcggtccccggtctttactgcgtacttgggagtcggccat

SEQ ID NO: 397632 - DNA, 140 bp, Artificial Sequence
  Synthetic
atggccgactcccaagtacgcagtaaagaccggggaccgcattgtggtctccatgctttctacaggcacgaagtcaatcgccttggcgacacctcgcgtgcagacagcagctcgaaagagggagacccagcatggcgtat

SEQ ID NO: 397633 - DNA, 140 bp, Artificial Sequence
  Synthetic
aggccctggctgctgatatgacacaccccataaccaaatacatcatggcatgcatgtcggctgacctggaagtcgtcacgagcacctgggtgctggtaggcggggtcctcgcagctctgggaccttttgggacagcggtg

SEQ ID NO: 397634 - DNA, 140 bp, Artificial Sequence
  Synthetic
caccgctgtcccaaaaggtcccagagctgcgaggaccccgcctaccagcacccaggtgctcgtgacgacttccaggtcagccgacatgcatgccatgatgtatttggttatggggtgtgtcatatcagcagccagggcct

SEQ ID NO: 397635 - DNA, 140 bp, Artificial Sequence
  Synthetic
atacgccatgctgggtctccacaactccactccgcctgcggttccacaaacctatcaggtggggtacctgcacgctccaactggcagtggaaagagcacgaaggtaccggcagcgtatgccgtacttgggagtcggccat

SEQ ID NO: 397636 - DNA, 140 bp, Artificial Sequence
  Synthetic
atggccgactcccaagtacggcatacgctgccggtaccttcgtgctctttccactgccagttggagcgtgcaggtaccccacctgataggtttgtggaaccgcaggcggagtggagttgtggagacccagcatggcgtat

SEQ ID NO: 397637 - DNA, 140 bp, Artificial Sequence
  Synthetic
aggccctggctgctgatatgctatggcaagtttctggccgatggggggtgttcaggaggtgcttatgacatcatcatatgtgacgaatgccattctacggaccccacaacggtcctaggcgaccttttgggacagcggtg

SEQ ID NO: 397638 - DNA, 140 bp, Artificial Sequence
  Synthetic
caccgctgtcccaaaaggtcgcctaggaccgttgtggggtccgtagaatggcattcgtcacatatgatgatgtcataagcacctcctgaacaccccccatcggccagaaacttgccatagcatatcagcagccagggcct

SEQ ID NO: 397639 - DNA, 140 bp, Artificial Sequence
  Synthetic
atacgccatgctgggtctcccgccaagccgcccagctcggaccagaagccctattgttggcactacgcaccccaaccgtgcggtattgtacccgcgtcgcaggtgtgcggtccagtgtaccgtacttgggagtcggccat

SEQ ID NO: 397640 - DNA, 140 bp, Artificial Sequence
  Synthetic
atggccgactcccaagtacggtacactggaccgcacacctgcgacgcgggtacaataccgcacggttggggtgcgtagtgccaacaatagggcttctggtccgagctgggcggcttggcgggagacccagcatggcgtat

SEQ ID NO: 397641 - DNA, 140 bp, Artificial Sequence
  Synthetic
atacgccatgctgggtctccttccaagaagaagtgtgacgagctggccaagcagctacgcgtgcttggcgtcaacgccgtggccttctacaggggtgttgatgtgtcggtgatccccacacgtacttgggagtcggccat

SEQ ID NO: 397642 - DNA, 140 bp, Artificial Sequence
  Synthetic
atggccgactcccaagtacgtgtggggatcaccgacacatcaacacccctgtagaaggccacggcgttgacgccaagcacgcgtagctgcttggccagctcgtcacacttcttcttggaaggagacccagcatggcgtat

SEQ ID NO: 397643 - DNA, 140 bp, Artificial Sequence
  Synthetic
aggccctggctgctgatatgtttgtgctgcttggtacatcaagggcaggctagtccccggagcggcatatgctctttacggcgtatggccgctgctcctgctcctgctggcgttaccaccgaccttttgggacagcggtg

SEQ ID NO: 397644 - DNA, 140 bp, Artificial Sequence
  Synthetic
caccgctgtcccaaaaggtcggtggtaacgccagcaggagcaggagcagcggccatacgccgtaaagagcatatgccgctccggggactagcctgcccttgatgtaccaagcagcacaaacatatcagcagccagggcct

SEQ ID NO: 397645 - DNA, 140 bp, Artificial Sequence
  Synthetic
atacgccatgctgggtctccttacagggctcacgcacatcgatgcccacttcctctcacaaaccaaacaggggggggagaatttcgcgtacctcgtggcataccaagccacggtgtgtgccgtacttgggagtcggccat

SEQ ID NO: 397646 - DNA, 140 bp, Artificial Sequence
  Synthetic
atggccgactcccaagtacggcacacaccgtggcttggtatgccacgaggtacgcgaaattctcccccccctgtttggtttgtgagaggaagtgggcatcgatgtgcgtgagccctgtaaggagacccagcatggcgtat

SEQ ID NO: 397647 - DNA, 140 bp, Artificial Sequence
  Synthetic
atacgccatgctgggtctccggtgctgttcaaaatgagatcacgaccacccatccaattaccaagtacatcatgacctgcatgtcagctgacctcgaggtgatcactagcgcgtgggttacgtacttgggagtcggccat

SEQ ID NO: 397648 - DNA, 140 bp, Artificial Sequence
  Synthetic
atggccgactcccaagtacgtaacccacgcgctagtgatcacctcgaggtcagctgacatgcaggtcatgatgtacttggtaattggatgggtggtcgtgatctcattttgaacagcaccggagacccagcatggcgtat

SEQ ID NO: 397649 - DNA, 140 bp, Artificial Sequence
  Synthetic
aggccctggctgctgatatgcatgacctgcatgtcagctgacctcgaggtgatcactagcgcgtgggttatcacgggaggagttcttgctgcattggcagcgtattgcctgacgacaggtgaccttttgggacagcggtg

SEQ ID NO: 397650 - DNA, 140 bp, Artificial Sequence
  Synthetic
caccgctgtcccaaaaggtcacctgtcgtcaggcaatacgctgccaatgcagcaagaactcctcccgtgataacccacgcgctagtgatcacctcgaggtcagctgacatgcaggtcatgcatatcagcagccagggcct

SEQ ID NO: 397651 - DNA, 140 bp, Artificial Sequence
  Synthetic
atacgccatgctgggtctcctcacgggaggagttcttgctgcattggcagcgtattgcctgacgacaggtagcgctgtcatatgcggcaggatcataacttccggaaagcccgccgttatcgtacttgggagtcggccat

SEQ ID NO: 397652 - DNA, 140 bp, Artificial Sequence
  Synthetic
atggccgactcccaagtacgataacggcgggctttccggaagttatgatcctgccgcatatgacagcgctacctgtcgtcaggcaatacgctgccaatgcagcaagaactcctcccgtgaggagacccagcatggcgtat

SEQ ID NO: 397653 - DNA, 140 bp, Artificial Sequence
  Synthetic
aggccctggctgctgatatgaaacagaaggtcatgggcctcctgcaggccacggccaaacaggcggaggagttgaagccggcagttcactccgcctggcctagactcgagcaattttggcgaccttttgggacagcggtg

SEQ ID NO: 397654 - DNA, 140 bp, Artificial Sequence
  Synthetic
caccgctgtcccaaaaggtcgccaaaattgctcgagtctaggccaggcggagtgaactgccggcttcaactcctccgcctgtttggccgtggcctgcaggaggcccatgaccttctgtttcatatcagcagccagggcct

SEQ ID NO: 397655 - DNA, 140 bp, Artificial Sequence
  Synthetic
aggccctggctgctgatatgccagctggtcaacaccaacggcagttggcacatcaatagcacggccttgaactgcaatgcaagccttgacaccggctggttagcagggcttttctactacgaccttttgggacagcggtg

SEQ ID NO: 397656 - DNA, 140 bp, Artificial Sequence
  Synthetic
caccgctgtcccaaaaggtcgtagtagaaaagccctgctaaccagccggtgtcaaggcttgcattgcagttcaaggccgtgctattgatgtgccaactgccgttggtgttgaccagctggcatatcagcagccagggcct

SEQ ID NO: 397657 - DNA, 140 bp, Artificial Sequence
  Synthetic
atacgccatgctgggtctccgtctgtcactagcccactgcagacttccacgaccctcctccttaacatcttaggaggatgggtggcatcccaattggcaccgccgtcggcgtccacggctcgtacttgggagtcggccat

SEQ ID NO: 397658 - DNA, 140 bp, Artificial Sequence
  Synthetic
atggccgactcccaagtacgagccgtggacgccgacggcggtgccaattgggatgccacccatcctcctaagatgttaaggaggagggtcgtggaagtctgcagtgggctagtgacagacggagacccagcatggcgtat

SEQ ID NO: 397659 - DNA, 140 bp, Artificial Sequence
  Synthetic
aggccctggctgctgatatgggtattgtgcccgcaaagagcgtgtgtggcccggtatattgtttcactcccagccctgtggtggtgggaacgaccgacaggtcgggcgcgcctacctacagaccttttgggacagcggtg

SEQ ID NO: 397660 - DNA, 140 bp, Artificial Sequence
  Synthetic
caccgctgtcccaaaaggtctgtaggtaggcgcgcccgacctgtcggtcgttcccaccaccacagggctgggagtgaaacaatataccgggccacacacgctctttgcgggcacaatacccatatcagcagccagggcct

SEQ ID NO: 397661 - DNA, 140 bp, Artificial Sequence
  Synthetic
atacgccatgctgggtctccccctcgtcgccttcaaaatcatgagcggtgagacgccatccgtggaagacatggtcaatttgctgccagccattctatcgcctggcgctttggtcgtgggcgtacttgggagtcggccat

SEQ ID NO: 397662 - DNA, 140 bp, Artificial Sequence
  Synthetic
atggccgactcccaagtacgcccacgaccaaagcgccaggcgatagaatggctggcagcaaattgaccatgtcttccacggatggcgtctcaccgctcatgattttgaaggcgacgagggggagacccagcatggcgtat

SEQ ID NO: 397663 - DNA, 140 bp, Artificial Sequence
  Synthetic
atacgccatgctgggtctccgtctcaccaacgcattatgtgcctgagacggacgcctctaaaaatgtgatgaccatactcagttccttgacaatcaccagcttactccgcaagctccacgcgtacttgggagtcggccat

SEQ ID NO: 397664 - DNA, 140 bp, Artificial Sequence
  Synthetic
atggccgactcccaagtacgcgtggagcttgcggagtaagctggtgattgtcaaggaactgagtatggtcatcacatttttagaggcgtccgtctcaggcacataatgcgttggtgagacggagacccagcatggcgtat

SEQ ID NO: 397665 - DNA, 140 bp, Artificial Sequence
  Synthetic
atacgccatgctgggtctccgaaggtcaaactcctacccgctctaccgggcatccctttcctctcgtgtcaacgagggttcaggggagtctggcggggcgatggcatctgctatacaacacgtacttgggagtcggccat

SEQ ID NO: 397666 - DNA, 140 bp, Artificial Sequence
  Synthetic
atggccgactcccaagtacgtgttgtatagcagatgccatcgccccgccagactcccctgaaccctcgttgacacgagaggaaagggatgcccggtagagcgggtaggagtttgaccttcggagacccagcatggcgtat

SEQ ID NO: 397667 - DNA, 140 bp, Artificial Sequence
  Synthetic
atacgccatgctgggtctccaatcgtgggtcccaaaacatgcagcaacgtctggcacggcacatttcccatcaacgcctccaccactggccccagcgtgcctatcccggagcccaactaccgtacttgggagtcggccat

SEQ ID NO: 397668 - DNA, 140 bp, Artificial Sequence
  Synthetic
atggccgactcccaagtacggtagttgggctccgggataggcacgctggggccagtggtggaggcgttgatgggaaatgtgccgtgccagacgttgctgcatgttttgggacccacgattggagacccagcatggcgtat

SEQ ID NO: 397669 - DNA, 140 bp, Artificial Sequence
  Synthetic
aggccctggctgctgatatgttttcacggaggtggatggggtgcggttgcacaggtacgccccggcgtgcaagcccctcctacgggaggaggtcacattccaggtcggcctcaaccagtagaccttttgggacagcggtg

SEQ ID NO: 397670 - DNA, 140 bp, Artificial Sequence
  Synthetic
caccgctgtcccaaaaggtctactggttgaggccgacctggaatgtgacctcctcccgtaggaggggcttgcacgccggggcgtacctgtgcaaccgcaccccatccacctccgtgaaaacatatcagcagccagggcct

SEQ ID NO: 397671 - DNA, 140 bp, Artificial Sequence
  Synthetic
atacgccatgctgggtctccgcccctgccaagtgccagctccagagttcttcactgaggtggatggcgtgaggttgcaccggtatgccccggcgtgccggccattgctccgggaggaggtcgtacttgggagtcggccat

SEQ ID NO: 397672 - DNA, 140 bp, Artificial Sequence
  Synthetic
atggccgactcccaagtacgacctcctcccggagcaatggccggcacgccggggcataccggtgcaacctcacgccatccacctcagtgaagaactctggagctggcacttggcaggggcggagacccagcatggcgtat

SEQ ID NO: 397673 - DNA, 140 bp, Artificial Sequence
  Synthetic
atacgccatgctgggtctccgaccatatcaccgcggaggaggcgcgtcgacgcctcgcgcgaggttcccccccgtctctggccagctcctcagcgagccagctctcagctccatccctaacgtacttgggagtcggccat

SEQ ID NO: 397674 - DNA, 140 bp, Artificial Sequence
  Synthetic
atggccgactcccaagtacgttagggatggagctgagagctggctcgctgaggagctggccagagacgggggggaacctcgcgcgaggcgtcgacgcgcctcctccgcggtgatatggtcggagacccagcatggcgtat

SEQ ID NO: 397675 - DNA, 140 bp, Artificial Sequence
  Synthetic
atacgccatgctgggtctccgggctacatgcactgcagctggtgatcatcccgacgctgagctgatagaagctaatctcctgtggaggcaggaggtaggtggcaacatcacaagggttgacgtacttgggagtcggccat

SEQ ID NO: 397676 - DNA, 140 bp, Artificial Sequence
  Synthetic
atggccgactcccaagtacgtcaacccttgtgatgttgccacctacctcctgcctccacaggagattagcttctatcagctcagcgtcgggatgatcaccagctgcagtgcatgtagcccggagacccagcatggcgtat

SEQ ID NO: 397677 - DNA, 140 bp, Artificial Sequence
  Synthetic
aggccctggctgctgatatggaccttgtcgttatctgtgaaagcgcgggaacccaggaggatgcggcgagcctacgagtcttcacggaggctatgactaggtactctgccccccccgggggaccttttgggacagcggtg

SEQ ID NO: 397678 - DNA, 140 bp, Artificial Sequence
  Synthetic
caccgctgtcccaaaaggtcccccggggggggcagagtacctagtcatagcctccgtgaagactcgtaggctcgccgcatcctcctgggttcccgcgctttcacagataacgacaaggtccatatcagcagccagggcct

SEQ ID NO: 397679 - DNA, 140 bp, Artificial Sequence
  Synthetic
aggccctggctgctgatatgcccacctttactggagacttggaaagcccctgattacaatcccccgacggtgtcggggtgtgcccttcctcctaagggcctaccacctgtaccaccgcctgaccttttgggacagcggtg

SEQ ID NO: 397680 - DNA, 140 bp, Artificial Sequence
  Synthetic
caccgctgtcccaaaaggtcaggcggtggtacaggtggtaggcccttaggaggaagggcacaccccgacaccgtcgggggattgtaatcaggggctttccaagtctccagtaaaggtgggcatatcagcagccagggcct

SEQ ID NO: 397681 - DNA, 140 bp, Artificial Sequence
  Synthetic
aggccctggctgctgatatgtgggagggcgtcttcacaggcctcacccacatagatgcccactttttgtcccagactaagcaggcaggagacaacttcccctacttggtagcataccagggaccttttgggacagcggtg

SEQ ID NO: 397682 - DNA, 140 bp, Artificial Sequence
  Synthetic
caccgctgtcccaaaaggtccctggtatgctaccaagtaggggaagttgtctcctgcctgcttagtctgggacaaaaagtgggcatctatgtgggtgaggcctgtgaagacgccctcccacatatcagcagccagggcct

SEQ ID NO: 397683 - DNA, 140 bp, Artificial Sequence
  Synthetic
atacgccatgctgggtctccccacggtcagcgaggaaagtgacagtgtggtgtgctgttcatattcatactcctggacgggagctcttgtgacaccctgcgctgcggaagaggagaaattcgtacttgggagtcggccat

SEQ ID NO: 397684 - DNA, 140 bp, Artificial Sequence
  Synthetic
atggccgactcccaagtacgaatttctcctcttccgcagcgcagggtgtcacaagagctcccgtccaggagtatgaatatgaacagcacaccacactgtcactttcctcgctgaccgtggggagacccagcatggcgtat

SEQ ID NO: 397685 - DNA, 140 bp, Artificial Sequence
  Synthetic
atacgccatgctgggtctccatggaagagtgcgctacacacctcccttacattgaacaaggaatgcagctcgccgaacaattcaagcagaaggcactcgggttgttacagacagccaccacgtacttgggagtcggccat

SEQ ID NO: 397686 - DNA, 140 bp, Artificial Sequence
  Synthetic
atggccgactcccaagtacgtggtggctgtctgtaacaacccgagtgccttctgcttgaattgttcggcgagctgcattccttgttcaatgtaagggaggtgtgtagcgcactcttccatggagacccagcatggcgtat

SEQ ID NO: 397687 - DNA, 140 bp, Artificial Sequence
  Synthetic
atacgccatgctgggtctccgcaaaggaggtccgtagccatgccagcaaggccattaaccacatcaactccgtgtgggaggacttgctggaagacaatgcaactcccattccaacaaccacgtacttgggagtcggccat

SEQ ID NO: 397688 - DNA, 140 bp, Artificial Sequence
  Synthetic
atggccgactcccaagtacgtggttgttggaatgggagttgcattgtcttccagcaagtcctcccacacggagttgatgtggttaatggccttgctggcatggctacggacctcctttgcggagacccagcatggcgtat

SEQ ID NO: 397689 - DNA, 140 bp, Artificial Sequence
  Synthetic
atacgccatgctgggtctccgaagaaggctctgtatgacatcacgcgcaagctgccccaagcagtaatgggggccgcatatggcttccagtactcgcccaagcagcgggttgattacctccgtacttgggagtcggccat

SEQ ID NO: 397690 - DNA, 140 bp, Artificial Sequence
  Synthetic
atggccgactcccaagtacggaggtaatcaacccgctgcttgggcgagtactggaagccatatgcggcccccattactgcttggggcagcttgcgcgtgatgtcatacagagccttcttcggagacccagcatggcgtat

SEQ ID NO: 397691 - DNA, 140 bp, Artificial Sequence
  Synthetic
atacgccatgctgggtctccacatctaccaatgttgccaacttgacccagtagcacgcaaggcaatcacatccctgactgagcggctgtactgcggtgggcccatgacgaactctcgtggcgtacttgggagtcggccat

SEQ ID NO: 397692 - DNA, 140 bp, Artificial Sequence
  Synthetic
atggccgactcccaagtacgccacgagagttcgtcatgggcccaccgcagtacagccgctcagtcagggatgtgattgccttgcgtgctactgggtcaagttggcaacattggtagatgtggagacccagcatggcgtat

SEQ ID NO: 397693 - DNA, 140 bp, Artificial Sequence
  Synthetic
aggccctggctgctgatatgtccctgactgagcggctgtactgcggtgggcccatgacgaactctcgtggtcaatcgtgcggataccgtaggtgccgagccagtggcgtgcttaccacgagaccttttgggacagcggtg

SEQ ID NO: 397694 - DNA, 140 bp, Artificial Sequence
  Synthetic
caccgctgtcccaaaaggtctcgtggtaagcacgccactggctcggcacctacggtatccgcacgattgaccacgagagttcgtcatgggcccaccgcagtacagccgctcagtcagggacatatcagcagccagggcct

SEQ ID NO: 397695 - DNA, 140 bp, Artificial Sequence
  Synthetic
atacgccatgctgggtctcccgttatcgcggagagcggaggagtctctgaggatgttgatgcactgcgagcattcacggatgctatgaccaggtactcagctcccccaggggacgaaccacgtacttgggagtcggccat

SEQ ID NO: 397696 - DNA, 140 bp, Artificial Sequence
  Synthetic
atggccgactcccaagtacgtggttcgtcccctgggggagctgagtacctggtcatagcatccgtgaatgctcgcagtgcatcaacatcctcagagactcctccgctctccgcgataacgggagacccagcatggcgtat

SEQ ID NO: 397697 - DNA, 140 bp, Artificial Sequence
  Synthetic
aggccctggctgctgatatgagtcctggcgggcctcgcctactactccatggtggggaactgggctaaggtcttgattgtgatgctactttttgccggtgttgatgggaacacctacgtggaccttttgggacagcggtg

SEQ ID NO: 397698 - DNA, 140 bp, Artificial Sequence
  Synthetic
caccgctgtcccaaaaggtccacgtaggtgttcccatcaacaccggcaaaaagtagcatcacaatcaagaccttagcccagttccccaccatggagtagtaggcgaggcccgccaggactcatatcagcagccagggcct

SEQ ID NO: 397699 - DNA, 140 bp, Artificial Sequence
  Synthetic
atacgccatgctgggtctccatcaacaggactgccctgaactgcaatgacaccctccacactgggttcatcgccgcgctgttctacgcacacaaatttaactcgtccggatgcccagagccgtacttgggagtcggccat

SEQ ID NO: 397700 - DNA, 140 bp, Artificial Sequence
  Synthetic
atggccgactcccaagtacggctctgggcatccggacgagttaaatttgtgtgcgtagaacagcgcggcgatgaacccagtgtggagggtgtcattgcagttcagggcagtcctgttgatggagacccagcatggcgtat

SEQ ID NO: 397701 - DNA, 140 bp, Artificial Sequence
  Synthetic
aggccctggctgctgatatgccaaattggggcccaaacgacccccggcgaaggtcccgcaacttgggtaaggtcatcgataccattacgtgcggcttcgccgacctcatggggtacatccgaccttttgggacagcggtg

SEQ ID NO: 397702 - DNA, 140 bp, Artificial Sequence
  Synthetic
caccgctgtcccaaaaggtcggatgtaccccatgaggtcggcgaagccgcacgtaatggtatcgatgaccttacccaagttgcgggaccttcgccgggggtcgtttgggccccaatttggcatatcagcagccagggcct

SEQ ID NO: 397703 - DNA, 140 bp, Artificial Sequence
  Synthetic
  misc_feature (84)..(84): n is a, c, g, or t
atacgccatgctgggtctccttgctctttctctatcttcctcttggcacttctctcgtgccttacaacgccagcctccgcatcncattatgccaacaaatctggcctgtaccatctcactcgtacttgggagtcggccat

SEQ ID NO: 397704 - DNA, 140 bp, Artificial Sequence
  Synthetic
  misc_feature (57)..(57): n is a, c, g, or t
atggccgactcccaagtacgagtgagatggtacaggccagatttgttggcataatgngatgcggaggctggcgttgtaaggcacgagagaagtgccaagaggaagatagagaaagagcaaggagacccagcatggcgtat

SEQ ID NO: 397705 - DNA, 140 bp, Artificial Sequence
  Synthetic
  misc_feature (34)..(34): n is a, c, g, or t
  misc_feature (82)..(82): n is a, c, g, or t
aggccctggctgctgatatgcagcctccgcatcncattatgccaacaaatctggcctgtaccatctcactaacgattgcccnaacagcagcatcgtttatgaggcggagacgctgatcttgaccttttgggacagcggtg

SEQ ID NO: 397706 - DNA, 140 bp, Artificial Sequence
  Synthetic
  misc_feature (59)..(59): n is a, c, g, or t
  misc_feature (107)..(107): n is a, c, g, or t
caccgctgtcccaaaaggtcaagatcagcgtctccgcctcataaacgatgctgctgttngggcaatcgttagtgagatggtacaggccagatttgttggcataatgngatgcggaggctgcatatcagcagccagggcct

SEQ ID NO: 397707 - DNA, 140 bp, Artificial Sequence
  Synthetic
aggccctggctgctgatatgtatgctctctatggcgtatggccgctgctcctgctcctgctggcgttaccaccacgagcgtacgccatggaccgggagatggctgcatcgtgcggaggcggaccttttgggacagcggtg

SEQ ID NO: 397708 - DNA, 140 bp, Artificial Sequence
  Synthetic
caccgctgtcccaaaaggtccgcctccgcacgatgcagccatctcccggtccatggcgtacgctcgtggtggtaacgccagcaggagcaggagcagcggccatacgccatagagagcatacatatcagcagccagggcct

SEQ ID NO: 397709 - DNA, 140 bp, Artificial Sequence
  Synthetic
atacgccatgctgggtctcctatgatgatgaattggtcaccaactgttaccctggtcctgtcgtacctggcacgtataccccaggtgatcgtcgatgtgttcatcggcggtcattggggccgtacttgggagtcggccat

SEQ ID NO: 397710 - DNA, 140 bp, Artificial Sequence
  Synthetic
atggccgactcccaagtacggccccaatgaccgccgatgaacacatcgacgatcacctggggtatacgtgccaggtacgacaggaccagggtaacagttggtgaccaattcatcatcataggagacccagcatggcgtat

SEQ ID NO: 397711 - DNA, 140 bp, Artificial Sequence
  Synthetic
atacgccatgctgggtctccccggcagcggcgcaggccacagtgtaaggggcattacgtcgctgttcagtcagggctctaggcagaagatccaacttattaacaccaatggaagctggcacgtacttgggagtcggccat

SEQ ID NO: 397712 - DNA, 140 bp, Artificial Sequence
  Synthetic
atggccgactcccaagtacgtgccagcttccattggtgttaataagttggatcttctgcctagagccctgactgaacagcgacgtaatgccccttacactgtggcctgcgccgctgccggggagacccagcatggcgtat

SEQ ID NO: 397713 - DNA, 140 bp, Artificial Sequence
  Synthetic
  misc_feature (58)..(58): n is a, c, g, or t
  misc_feature (78)..(78): n is a, c, g, or t
atacgccatgctgggtctcccggctgagtgcttgcaagcccattacatacttctctcnagggtggggcccgatctcanacgcgaatgtgagcggttcatctgatgatagaccgtattgctcgtacttgggagtcggccat

SEQ ID NO: 397714 - DNA, 140 bp, Artificial Sequence
  Synthetic
  misc_feature (63)..(63): n is a, c, g, or t
  misc_feature (83)..(83): n is a, c, g, or t
atggccgactcccaagtacgagcaatacggtctatcatcagatgaaccgctcacattcgcgtntgagatcgggccccaccctngagagaagtatgtaatgggcttgcaagcactcagccgggagacccagcatggcgtat

SEQ ID NO: 397715 - DNA, 140 bp, Artificial Sequence
  Synthetic
  misc_feature (117)..(117): n is a, c, g, or t
atacgccatgctgggtctccccgtaggggtcttcccacctactcctggggtgtaaatgagtctgatgtattcctgctggaaagcccgaggccccctgcagggtggtggttcggctgnactcgtacttgggagtcggccat

SEQ ID NO: 397716 - DNA, 140 bp, Artificial Sequence
  Synthetic
  misc_feature (24)..(24): n is a, c, g, or t
atggccgactcccaagtacgagtncagccgaaccaccaccctgcagggggcctcgggctttccagcaggaatacatcagactcatttacaccccaggagtaggtgggaagacccctacggggagacccagcatggcgtat

SEQ ID NO: 397717 - DNA, 140 bp, Artificial Sequence
  Synthetic
  misc_feature (22)..(22): n is a, c, g, or t
  misc_feature (31)..(31): n is a, c, g, or t
  misc_feature (85)..(85): n is a, c, g, or t
  misc_feature (104)..(104): n is a, c, g, or t
  misc_feature (106)..(106): n is a, c, g, or t
atacgccatgctgggtctccgnaaacatccngaggcaacctacagcaaatgcggctcaggcccctggctcacgccaaggtgcttngtcgactacccgtataggntntggcattacccctgcgtacttgggagtcggccat

SEQ ID NO: 397718 - DNA, 140 bp, Artificial Sequence
  Synthetic
  misc_feature (35)..(35): n is a, c, g, or t
  misc_feature (37)..(37): n is a, c, g, or t
  misc_feature (56)..(56): n is a, c, g, or t
  misc_feature (110)..(110): n is a, c, g, or t
  misc_feature (119)..(119): n is a, c, g, or t
atggccgactcccaagtacgcaggggtaatgccanancctatacgggtagtcgacnaagcaccttggcgtgagccaggggcctgagccgcatttgctgtaggttgcctcnggatgtttncggagacccagcatggcgtat

SEQ ID NO: 397719 - DNA, 140 bp, Artificial Sequence
  Synthetic
atacgccatgctgggtctccctcgacgacagagatagggtcgaaatgagccctctcctgcactccacgaccgaactcgcaatccttccctgtaccttcaccactatgccggccctttccacgtacttgggagtcggccat

SEQ ID NO: 397720 - DNA, 140 bp, Artificial Sequence
  Synthetic
atggccgactcccaagtacgtggaaagggccggcatagtggtgaaggtacagggaaggattgcgagttcggtcgtggagtgcaggagagggctcatttcgaccctatctctgtcgtcgagggagacccagcatggcgtat

SEQ ID NO: 397721 - DNA, 140 bp, Artificial Sequence
  Synthetic
aggccctggctgctgatatgcttataggctttggcattatccttgtactgtcaactacaccttattcaaagtcaggatgtacgtgggaggggtcgagcacaggctggaagttgcttgcaagaccttttgggacagcggtg

SEQ ID NO: 397722 - DNA, 140 bp, Artificial Sequence
  Synthetic
caccgctgtcccaaaaggtcttgcaagcaacttccagcctgtgctcgacccctcccacgtacatcctgactttgaataaggtgtagttgacagtacaaggataatgccaaagcctataagcatatcagcagccagggcct

SEQ ID NO: 397723 - DNA, 140 bp, Artificial Sequence
  Synthetic
atacgccatgctgggtctcccctgatcttcctcgtgctggctgatgcgcgcgtctgcgcgtgcttatggcttatgttactcataggccaggcggaggcagctttggagaacttgatcgtgcgtacttgggagtcggccat

SEQ ID NO: 397724 - DNA, 140 bp, Artificial Sequence
  Synthetic
atggccgactcccaagtacgcacgatcaagttctccaaagctgcctccgcctggcctatgagtaacataagccataagcacgcgcagacgcgcgcatcagccagcacgaggaagatcaggggagacccagcatggcgtat

SEQ ID NO: 397725 - DNA, 140 bp, Artificial Sequence
  Synthetic
atacgccatgctgggtctcccatatggactattgcagctatggccactcttgctgcttgttctggctctgccgcaacgcgccttcgcttacgatcaagaagcagcgggttccataggggccgtacttgggagtcggccat

SEQ ID NO: 397726 - DNA, 140 bp, Artificial Sequence
  Synthetic
atggccgactcccaagtacggcccctatggaacccgctgcttcttgatcgtaagcgaaggcgcgttgcggcagagccagaacaagcagcaagagtggccatagctgcaatagtccatatgggagacccagcatggcgtat

SEQ ID NO: 397727 - DNA, 140 bp, Artificial Sequence
  Synthetic
atacgccatgctgggtctccgaggccgtaatacatcaatgggtcccaggtctacaggtacgggggggccgtgatgcagtgattctgctcacatgcctcttgcaccccgcccttggatttgcgtacttgggagtcggccat

SEQ ID NO: 397728 - DNA, 140 bp, Artificial Sequence
  Synthetic
atggccgactcccaagtacgcaaatccaagggcggggtgcaagaggcatgtgagcagaatcactgcatcacggcccccccgtacctgtagacctgggacccattgatgtattacggcctcggagacccagcatggcgtat

SEQ ID NO: 397729 - DNA, 140 bp, Artificial Sequence
  Synthetic
atacgccatgctgggtctccgcgagcctgttgcgcgtaccgtattacgtgcgcgctcatgccctattacgggtgtgtttggctgtccgcagactggcccatggtaagtacatgcaagcttcgtacttgggagtcggccat

SEQ ID NO: 397730 - DNA, 140 bp, Artificial Sequence
  Synthetic
atggccgactcccaagtacgaagcttgcatgtacttaccatgggccagtctgcggacagccaaacacacccgtaatagggcatgagcgcgcacgtaatacggtacgcgcaacaggctcgcggagacccagcatggcgtat

SEQ ID NO: 397731 - DNA, 140 bp, Artificial Sequence
  Synthetic
aggccctggctgctgatatgagttgagcccatcaccttctcccctatggagaagaaggtcatcacatggggggccgacaccgctgcttgcggcgacatacttcagggtctgccggtctctgaccttttgggacagcggtg

SEQ ID NO: 397732 - DNA, 140 bp, Artificial Sequence
  Synthetic
caccgctgtcccaaaaggtcagagaccggcagaccctgaagtatgtcgccgcaagcagcggtgtcggccccccatgtgatgaccttcttctccataggggagaaggtgatgggctcaactcatatcagcagccagggcct

SEQ ID NO: 397733 - DNA, 140 bp, Artificial Sequence
  Synthetic
atacgccatgctgggtctccgcggcctgcttgggacgatcgtcaccagtctcacgggtcgcgataagaacgaggccgagggcgaagtgcaggtcatctccaccgctacccagactttcctcgtacttgggagtcggccat

SEQ ID NO: 397734 - DNA, 140 bp, Artificial Sequence
  Synthetic
atggccgactcccaagtacgaggaaagtctgggtagcggtggagatgacctgcacttcgccctcggcctcgttcttatcgcgacccgtgagactggtgacgatcgtcccaagcaggccgcggagacccagcatggcgtat

SEQ ID NO: 397735 - DNA, 140 bp, Artificial Sequence
  Synthetic
atacgccatgctgggtctccgtggatcaggacatggtaggccggccggcgcccgcgggcaccaggtcgctcacgccatgcacctgtggtgccagcgacctctatctagtgacaaggaatgcgtacttgggagtcggccat

SEQ ID NO: 397736 - DNA, 140 bp, Artificial Sequence
  Synthetic
atggccgactcccaagtacgcattccttgtcactagatagaggtcgctggcaccacaggtgcatggcgtgagcgacctggtgcccgcgggcgccggccggcctaccatgtcctgatccacggagacccagcatggcgtat

SEQ ID NO: 397737 - DNA, 140 bp, Artificial Sequence
  Synthetic
aggccctggctgctgatatgcacgccatgcacctgtggtgccagcgacctctatctagtgacaaggaatgcagatgtgatccccgcgcggcgtaggggcgacacccgcgccagcctcttggaccttttgggacagcggtg

SEQ ID NO: 397738 - DNA, 140 bp, Artificial Sequence
  Synthetic
caccgctgtcccaaaaggtccaagaggctggcgcgggtgtcgcccctacgccgcgcggggatcacatctgcattccttgtcactagatagaggtcgctggcaccacaggtgcatggcgtgcatatcagcagccagggcct

SEQ ID NO: 397739 - DNA, 140 bp, Artificial Sequence
  Synthetic
aggccctggctgctgatatggagtcctggcgggcctcgcctactattccatggtggggaactgggctaaggtcttgattgtgatgctactctttgccggcgttgacgggacgacccacgtgaccttttgggacagcggtg

SEQ ID NO: 397740 - DNA, 140 bp, Artificial Sequence
  Synthetic
caccgctgtcccaaaaggtcacgtgggtcgtcccgtcaacgccggcaaagagtagcatcacaatcaagaccttagcccagttccccaccatggaatagtaggcgaggcccgccaggactccatatcagcagccagggcct

SEQ ID NO: 397741 - DNA, 140 bp, Artificial Sequence
  Synthetic
  misc_feature (105)..(105): n is a, c, g, or t
atacgccatgctgggtctccggcttatggggtcgacccgaacatcaggacaggcgttaggaccatcactacggggggccccattacatattccacctatggcaantttctggccgatgggcgtacttgggagtcggccat

SEQ ID NO: 397742 - DNA, 140 bp, Artificial Sequence
  Synthetic
  misc_feature (36)..(36): n is a, c, g, or t
atggccgactcccaagtacgcccatcggccagaaanttgccataggtggaatatgtaatggggccccccgtagtgatggtcctaacgcctgtcctgatgttcgggtcgaccccataagccggagacccagcatggcgtat

SEQ ID NO: 397743 - DNA, 140 bp, Artificial Sequence
  Synthetic
  misc_feature (55)..(55): n is a, c, g, or t
aggccctggctgctgatatgcggggggccccattacatattccacctatggcaantttctggccgatgggggatgctcagggggtgcttatgacatcatcatatgtgacgagtgccattcgaccttttgggacagcggtg

SEQ ID NO: 397744 - DNA, 140 bp, Artificial Sequence
  Synthetic
  misc_feature (86)..(86): n is a, c, g, or t
caccgctgtcccaaaaggtcgaatggcactcgtcacatatgatgatgtcataagcaccccctgagcatcccccatcggccagaaanttgccataggtggaatatgtaatggggccccccgcatatcagcagccagggcct

SEQ ID NO: 397745 - DNA, 140 bp, Artificial Sequence
  Synthetic
aggccctggctgctgatatggctgttggcagcataggccttgggaaggtgcttgtggacatcctggcgggttatggagcaggggtagctggcgcgctcgtggcctttaaggtcatgagcggaccttttgggacagcggtg

SEQ ID NO: 397746 - DNA, 140 bp, Artificial Sequence
  Synthetic
caccgctgtcccaaaaggtccgctcatgaccttaaaggccacgagcgcgccagctacccctgctccataacccgccaggatgtccacaagcaccttcccaaggcctatgctgccaacagccatatcagcagccagggcct

SEQ ID NO: 397747 - DNA, 140 bp, Artificial Sequence
  Synthetic
atacgccatgctgggtctcctctgtcacagtcccccatccgaacatctcagaagtagcattacccactactggggagattcccttctatgggagggcgatccccctagagtacatcaaggcgtacttgggagtcggccat

SEQ ID NO: 397748 - DNA, 140 bp, Artificial Sequence
  Synthetic
atggccgactcccaagtacgccttgatgtactctagggggatcgccctcccatagaagggaatctccccagtagtgggtaatgctacttctgagatgttcggatgggggactgtgacagaggagacccagcatggcgtat

SEQ ID NO: 397749 - DNA, 140 bp, Artificial Sequence
  Synthetic
atacgccatgctgggtctccgtggacgacatctcattttctgccactccaagaagaagtgcgacgagctggccaagcggctgcgcgcgcttggcgtcaacgccgtggccttctacaggggcgtacttgggagtcggccat

SEQ ID NO: 397750 - DNA, 140 bp, Artificial Sequence
  Synthetic
atggccgactcccaagtacgcccctgtagaaggccacggcgttgacgccaagcgcgcgcagccgcttggccagctcgtcgcacttcttcttggagtggcagaaaatgagatgtcgtccacggagacccagcatggcgtat

SEQ ID NO: 397751 - DNA, 140 bp, Artificial Sequence
  Synthetic
atacgccatgctgggtctcctgcaatgttgcggtcactcaggtagtcgacttcagcctagaccctactttcacaattgagaccaccactatcccgcaagacgctgtggcgagaagccaaccgtacttgggagtcggccat

SEQ ID NO: 397752 - DNA, 140 bp, Artificial Sequence
  Synthetic
atggccgactcccaagtacggttggcttctcgccacagcgtcttgcgggatagtggtggtctcaattgtgaaagtagggtctaggctgaagtcgactacctgagtgaccgcaacattgcaggagacccagcatggcgtat

SEQ ID NO: 397753 - DNA, 140 bp, Artificial Sequence
  Synthetic
atacgccatgctgggtctcccagggcgagaggccgtccggcacgttcgatactgtcgtcctttgtgaggcctatgatacaggatgcgcgtggtatgagctaacaccctcagagaccaccgcgtacttgggagtcggccat

SEQ ID NO: 397754 - DNA, 140 bp, Artificial Sequence
  Synthetic
atggccgactcccaagtacgcggtggtctctgagggtgttagctcataccacgcgcatcctgtatcataggcctcacaaaggacgacagtatcgaacgtgccggacggcctctcgccctgggagacccagcatggcgtat

SEQ ID NO: 397755 - DNA, 140 bp, Artificial Sequence
  Synthetic
atacgccatgctgggtctccccacttcctctcacaaactaagcaggggggggagaattttgcgtacctcgtggcataccaagccacggtgtgtgcgcgtgccagggccccccccccatcacgtacttgggagtcggccat

SEQ ID NO: 397756 - DNA, 140 bp, Artificial Sequence
  Synthetic
atggccgactcccaagtacgtgatggggggggggccctggcacgcgcacacaccgtggcttggtatgccacgaggtacgcaaaattctcccccccctgcttagtttgtgagaggaagtggggagacccagcatggcgtat

SEQ ID NO: 397757 - DNA, 140 bp, Artificial Sequence
  Synthetic
aggccctggctgctgatatggaggtgatcactagcgcgtgggtcatcacgggaggggttcttgctgcattggcagcatactgcctaacgacaggtagtgctgtcatatgcggcaggatcagaccttttgggacagcggtg

SEQ ID NO: 397758 - DNA, 140 bp, Artificial Sequence
  Synthetic
caccgctgtcccaaaaggtctgatcctgccgcatatgacagcactacctgtcgttaggcagtatgctgccaatgcagcaagaacccctcccgtgatgacccacgcgctagtgatcacctccatatcagcagccagggcct

SEQ ID NO: 397759 - DNA, 140 bp, Artificial Sequence
  Synthetic
aggccctggctgctgatatgggcagttggcacatcaatcgcacggccttgaactgcaatgcgagcctcgacactggctgggtagcggggctcttctattaccacaaattcaactcttcaggaccttttgggacagcggtg

SEQ ID NO: 397760 - DNA, 140 bp, Artificial Sequence
  Synthetic
caccgctgtcccaaaaggtcctgaagagttgaatttgtggtaatagaagagccccgctacccagccagtgtcgaggctcgcattgcagttcaaggccgtgcgattgatgtgccaactgcccatatcagcagccagggcct

SEQ ID NO: 397761 - DNA, 140 bp, Artificial Sequence
  Synthetic
atacgccatgctgggtctccgggtcaacatctcgccgaacaattcaaacagaaggtcatgggcctcctgcaggtcacagccaaacaggcggaggagttgaagccggcagttcactccgcccgtacttgggagtcggccat

SEQ ID NO: 397762 - DNA, 140 bp, Artificial Sequence
  Synthetic
atggccgactcccaagtacgggcggagtgaactgccggcttcaactcctccgcctgtttggctgtgacctgcaggaggcccatgaccttctgtttgaattgttcggcgagatgttgacccggagacccagcatggcgtat

SEQ ID NO: 397763 - DNA, 140 bp, Artificial Sequence
  Synthetic
  misc_feature (62)..(62): n is a, c, g, or t
atacgccatgctgggtctcctggcctccctcatggcattcaccgcgtccgtcacgagcccantgcagacttccacgaccctactccttaacatcttaggaggatgggtggcatcccaactcgtacttgggagtcggccat

SEQ ID NO: 397764 - DNA, 140 bp, Artificial Sequence
  Synthetic
  misc_feature (79)..(79): n is a, c, g, or t
atggccgactcccaagtacgagttgggatgccacccatcctcctaagatgttaaggagtagggtcgtggaagtctgcantgggctcgtgacggacgcggtgaatgccatgagggaggccaggagacccagcatggcgtat

SEQ ID NO: 397765 - DNA, 140 bp, Artificial Sequence
  Synthetic
  misc_feature (38)..(38): n is a, c, g, or t
  misc_feature (44)..(44): n is a, c, g, or t
  misc_feature (62)..(62): n is a, c, g, or t
atacgccatgctgggtctccggatacggcgccggagtntctggngctctcgtagcctttaanatcatgagcggcgagatgccatccatggaagacatggtcaatttgctgccggccattccgtacttgggagtcggccat

SEQ ID NO: 397766 - DNA, 140 bp, Artificial Sequence
  Synthetic
  misc_feature (79)..(79): n is a, c, g, or t
  misc_feature (97)..(97): n is a, c, g, or t
  misc_feature (103)..(103): n is a, c, g, or t
atggccgactcccaagtacggaatggccggcagcaaattgaccatgtcttccatggatggcatctcgccgctcatgatnttaaaggctacgagagcnccaganactccggcgccgtatccggagacccagcatggcgtat

SEQ ID NO: 397767 - DNA, 140 bp, Artificial Sequence
  Synthetic
atacgccatgctgggtctccagcatttgcctctaggggtaaccatgtgtcaccaacacactacgtgcctgagacggacgcctccaaaaatgtgatgaccatactcagttccctgacaatccgtacttgggagtcggccat

SEQ ID NO: 397768 - DNA, 140 bp, Artificial Sequence
  Synthetic
atggccgactcccaagtacggattgtcagggaactgagtatggtcatcacatttttggaggcgtccgtctcaggcacgtagtgtgttggtgacacatggttacccctagaggcaaatgctggagacccagcatggcgtat

SEQ ID NO: 397769 - DNA, 140 bp, Artificial Sequence
  Synthetic
aggccctggctgctgatatgagacggacgcctccaaaaatgtgatgaccatactcagttccctgacaatcaccagcttacctcgtaagcttcacgagtggatcaattcggactggtctgcgaccttttgggacagcggtg

SEQ ID NO: 397770 - DNA, 140 bp, Artificial Sequence
  Synthetic
caccgctgtcccaaaaggtcgcagaccagtccgaattgatccactcgtgaagcttacgaggtaagctggtgattgtcagggaactgagtatggtcatcacatttttggaggcgtccgtctcatatcagcagccagggcct

SEQ ID NO: 397771 - DNA, 140 bp, Artificial Sequence
  Synthetic
aggccctggctgctgatatggtttttcactgaggtggatggcgtgaggttgcaccggtatgccccggcatgccggccattgctccgggacgaagtgactttttccgtggtgcttgctagcgaccttttgggacagcggtg

SEQ ID NO: 397772 - DNA, 140 bp, Artificial Sequence
  Synthetic
caccgctgtcccaaaaggtcgctagcaagcaccacggaaaaagtcacttcgtcccggagcaatggccggcatgccggggcataccggtgcaacctcacgccatccacctcagtgaaaaaccatatcagcagccagggcct

SEQ ID NO: 397773 - DNA, 140 bp, Artificial Sequence
  Synthetic
  misc_feature (112)..(112): n is a, c, g, or t
atacgccatgctgggtctccgccgtcgtctcgcgcgaggctctcctccgtccctggccagctcctcagcgagccagctctcagctccgtctttaagggccacatgcaccacngctggtgccgtacttgggagtcggccat

SEQ ID NO: 397774 - DNA, 140 bp, Artificial Sequence
  Synthetic
  misc_feature (29)..(29): n is a, c, g, or t
atggccgactcccaagtacggcaccagcngtggtgcatgtggcccttaaagacggagctgagagctggctcgctgaggagctggccagggacggaggagagcctcgcgcgagacgacggcggagacccagcatggcgtat

SEQ ID NO: 397775 - DNA, 140 bp, Artificial Sequence
  Synthetic
atacgccatgctgggtctcctcatcccgacgcagagctgatagaagctaatctcctgtggaggcaggaggcgggtggcaacatcacaagggtcgagtctgagaataaggtcattgtcctccgtacttgggagtcggccat

SEQ ID NO: 397776 - DNA, 140 bp, Artificial Sequence
  Synthetic
atggccgactcccaagtacggaggacaatgaccttattctcagactcgacccttgtgatgttgccacccgcctcctgcctccacaggagattagcttctatcagctctgcgtcgggatgaggagacccagcatggcgtat

SEQ ID NO: 397777 - DNA, 140 bp, Artificial Sequence
  Synthetic
aggccctggctgctgatatgcctacgagtcttcacggaggctatgactaggtactctgccccccccggggacccgccccagccagaatacgacttggagctgataacatcatgttcctccgaccttttgggacagcggtg

SEQ ID NO: 397778 - DNA, 140 bp, Artificial Sequence
  Synthetic
caccgctgtcccaaaaggtcggaggaacatgatgttatcagctccaagtcgtattctggctggggcgggtccccggggggggcagagtacctagtcatagcctccgtgaagactcgtaggcatatcagcagccagggcct

SEQ ID NO: 397779 - DNA, 140 bp, Artificial Sequence
  Synthetic
aggccctggctgctgatatggactgggcccacgcgggcctgcgagaccttgcagtggcagttgagcccgtcgtcttctctgacatggagaccaagatcatcacctggggggcagacaccggaccttttgggacagcggtg

SEQ ID NO: 397780 - DNA, 140 bp, Artificial Sequence
  Synthetic
caccgctgtcccaaaaggtccggtgtctgccccccaggtgatgatcttggtctccatgtcagagaagacgacgggctcaactgccactgcaaggtctcgcaggcccgcgtgggcccagtccatatcagcagccagggcct

SEQ ID NO: 397781 - DNA, 140 bp, Artificial Sequence
  Synthetic
  misc_feature (59)..(59): n is a, c, g, or t
atacgccatgctgggtctccccaccaccttcggcacagtcacaggagagctcaggattnggatccacggctgctagttcccagggcccggagtcccccaatgaggcggatacggcatcggcgtacttgggagtcggccat

SEQ ID NO: 397782 - DNA, 140 bp, Artificial Sequence
  Synthetic
  misc_feature (82)..(82): n is a, c, g, or t
atggccgactcccaagtacgccgatgccgtatccgcctcattgggggactccgggccctgggaactagcagccgtggatccnaatcctgagctctcctgtgactgtgccgaaggtggtggggagacccagcatggcgtat

SEQ ID NO: 397783 - DNA, 140 bp, Artificial Sequence
  Synthetic
  misc_feature (66)..(66): n is a, c, g, or t
atacgccatgctgggtctcctgtggtgtgctgttcgtattcgtactcctggacgggagctcttgtnacaccttgcgctgcggaggaggagaaactgcccatcagtcccctgagcaactctcgtacttgggagtcggccat

SEQ ID NO: 397784 - DNA, 140 bp, Artificial Sequence
  Synthetic
  misc_feature (75)..(75): n is a, c, g, or t
atggccgactcccaagtacgagagttgctcaggggactgatgggcagtttctcctcctccgcagcgcaaggtgtnacaagagctcccgtccaggagtacgaatacgaacagcacaccacaggagacccagcatggcgtat

SEQ ID NO: 397785 - DNA, 140 bp, Artificial Sequence
  Synthetic
atacgccatgctgggtctccaattcgccagaagaaggtgacctttgacagggtccaactcttggaccagcattaccatgacaccctcaaggagattaaggaacgggcttccaccgtgagccgtacttgggagtcggccat

SEQ ID NO: 397786 - DNA, 140 bp, Artificial Sequence
  Synthetic
atggccgactcccaagtacggctcacggtggaagcccgttccttaatctccttgagggtgtcatggtaatgctggtccaagagttggaccctgtcaaaggtcaccttcttctggcgaattggagacccagcatggcgtat

SEQ ID NO: 397787 - DNA, 140 bp, Artificial Sequence
  Synthetic
aggccctggctgctgatatgccatggtggggaactgggcgaaggtcttggtagtgctgctgctatttgccggcgtcgacgcgcacacttacaccaccgggggagctaccgcccacaccacgaccttttgggacagcggtg

SEQ ID NO: 397788 - DNA, 140 bp, Artificial Sequence
  Synthetic
caccgctgtcccaaaaggtcgtggtgtgggcggtagctcccccggtggtgtaagtgtgcgcgtcgacgccggcaaatagcagcagcactaccaagaccttcgcccagttccccaccatggcatatcagcagccagggcct

SEQ ID NO: 397789 - DNA, 140 bp, Artificial Sequence
  Synthetic
  misc_feature (29)..(29): n is a, c, g, or t
aggccctggctgctgatatggcaaggccnttaaccacatcaactccgtgtgggaggacttgctggaggacaatgcaactcccattccaacaaccattatggcaaagaatgaggtgttttggaccttttgggacagcggtg

SEQ ID NO: 397790 - DNA, 140 bp, Artificial Sequence
  Synthetic
  misc_feature (112)..(112): n is a, c, g, or t
caccgctgtcccaaaaggtccaaaacacctcattctttgccataatggttgttggaatgggagttgcattgtcctccagcaagtcctcccacacggagttgatgtggttaanggccttgccatatcagcagccagggcct

SEQ ID NO: 397791 - DNA, 140 bp, Artificial Sequence
  Synthetic
atacgccatgctgggtctccaatgcaagccttgacgccggctggctagcagggcttttctatcactacaatttcaactcttcgggctgtccagagaggttggccagttgccgaccccttgcgtacttgggagtcggccat

SEQ ID NO: 397792 - DNA, 140 bp, Artificial Sequence
  Synthetic
atggccgactcccaagtacgcaaggggtcggcaactggccaacctctctggacagcccgaagagttgaaattgtagtgatagaaaagccctgctagccagccggcgtcaaggcttgcattggagacccagcatggcgtat

SEQ ID NO: 397793 - DNA, 140 bp, Artificial Sequence
  Synthetic
aggccctggctgctgatatgtttcaactcttcgggctgtccagagaggttggccagttgccgaccccttgccgattttgcccagggctggggccctatcagctatgccaatgggagtggcgaccttttgggacagcggtg

SEQ ID NO: 397794 - DNA, 140 bp, Artificial Sequence
  Synthetic
caccgctgtcccaaaaggtcgccactcccattggcatagctgatagggccccagccctgggcaaaatcggcaaggggtcggcaactggccaacctctctggacagcccgaagagttgaaacatatcagcagccagggcct

SEQ ID NO: 397795 - DNA, 140 bp, Artificial Sequence
  Synthetic
  misc_feature (113)..(113): n is a, c, g, or t
atacgccatgctgggtctcctgtaagctgcccgaagcagtaatgggggccgcgtatggcttccagtactcgcccaagcagcgggtagaccacctcctcaagatgtggcgctcnaagcacacgtacttgggagtcggccat

SEQ ID NO: 397796 - DNA, 140 bp, Artificial Sequence
  Synthetic
  misc_feature (28)..(28): n is a, c, g, or t
atggccgactcccaagtacgtgtgcttngagcgccacatcttgaggaggtggtctacccgctgcttgggcgagtactggaagccatacgcggcccccattactgcttcgggcagcttacaggagacccagcatggcgtat

SEQ ID NO: 397797 - DNA, 140 bp, Artificial Sequence
  Synthetic
atacgccatgctgggtctcccccggtggcacgcaaggccattacatccctgactgagcggctgtactgcggtgggcccatgatgaactctcgtggccaatcatgcggataccgtagatgccgtacttgggagtcggccat

SEQ ID NO: 397798 - DNA, 140 bp, Artificial Sequence
  Synthetic
atggccgactcccaagtacggcatctacggtatccgcatgattggccacgagagttcatcatgggcccaccgcagtacagccgctcagtcagggatgtaatggccttgcgtgccaccgggggagacccagcatggcgtat

SEQ ID NO: 397799 - DNA, 140 bp, Artificial Sequence
  Synthetic
aggccctggctgctgatatggtgggcccatgatgaactctcgtggccaatcatgcggataccgtagatgccgggccagtggcgtgctcaccacgagcttgggcaataccctaacatgctagaccttttgggacagcggtg

SEQ ID NO: 397800 - DNA, 140 bp, Artificial Sequence
  Synthetic
caccgctgtcccaaaaggtctagcatgttagggtattgcccaagctcgtggtgagcacgccactggcccggcatctacggtatccgcatgattggccacgagagttcatcatgggcccaccatatcagcagccagggcct

SEQ ID NO: 397801 - DNA, 140 bp, Artificial Sequence
  Synthetic
aggccctggctgctgatatgagtcctggcgggccttgcctactactccatggtggggaactgggctaaggttttgattgtgatgctgctctttgccggcgttgacggagacacctatgtggaccttttgggacagcggtg

SEQ ID NO: 397802 - DNA, 140 bp, Artificial Sequence
  Synthetic
caccgctgtcccaaaaggtccacataggtgtctccgtcaacgccggcaaagagcagcatcacaatcaaaaccttagcccagttccccaccatggagtagtaggcaaggcccgccaggactcatatcagcagccagggcct

SEQ ID NO: 397803 - DNA, 140 bp, Artificial Sequence
  Synthetic
atacgccatgctgggtctccccccatcgtgggaccagatgtggaagtgcttgatccgcctcaagcccaccctccatgggccaacacctctgctatacagactgggcgctgttcagaatgacgtacttgggagtcggccat

SEQ ID NO: 397804 - DNA, 140 bp, Artificial Sequence
  Synthetic
atggccgactcccaagtacgtcattctgaacagcgcccagtctgtatagcagaggtgttggcccatggagggtgggcttgaggcggatcaagcacttccacatctggtcccacgatggggggagacccagcatggcgtat

SEQ ID NO: 397805 - DNA, 140 bp, Artificial Sequence
  Synthetic
aggccctggctgctgatatggcgtgtcccgggcccgaccccgcactttactcctgtgcctactcctactcaccgtaggggtaggcatctttttgcttcccgctcggtaggcgggaggcccgaccttttgggacagcggtg

SEQ ID NO: 397806 - DNA, 140 bp, Artificial Sequence
  Synthetic
caccgctgtcccaaaaggtcgggcctcccgcctaccgagcgggaagcaaaaagatgcctacccctacggtgagtaggagtaggcacaggagtaaagtgcggggtcgggcccgggacacgccatatcagcagccagggcct

SEQ ID NO: 397807 - DNA, 140 bp, Artificial Sequence
  Synthetic
  misc_feature (57)..(57): n is a, c, g, or t
  misc_feature (62)..(62): n is a, c, g, or t
  misc_feature (69)..(69): n is a, c, g, or t
aggccctggctgctgatatgacggtcccaggccagaggtaggcgccaaccaataccnaaggngcgccanaaccaaggccgaacctgggctcagcctgggtacccctggcccctctatggggaccttttgggacagcggtg

SEQ ID NO: 397808 - DNA, 140 bp, Artificial Sequence
  Synthetic
  misc_feature (72)..(72): n is a, c, g, or t
  misc_feature (79)..(79): n is a, c, g, or t
  misc_feature (84)..(84): n is a, c, g, or t
caccgctgtcccaaaaggtccccatagaggggccaggggtacccaggctgagcccaggttcggccttggttntggcgcnccttnggtattggttggcgcctacctctggcctgggaccgtcatatcagcagccagggcct

SEQ ID NO: 397809 - DNA, 140 bp, Artificial Sequence
  Synthetic
aggccctggctgctgatatgaggtcatcgataccctaacctgcggcttcgccgacctcatggggtacatccctgtcgttggcgcccctcttggaggcgttgcggcggccctggcacacgggaccttttgggacagcggtg

SEQ ID NO: 397810 - DNA, 140 bp, Artificial Sequence
  Synthetic
caccgctgtcccaaaaggtcccgtgtgccagggccgccgcaacgcctccaagaggggcgccaacgacagggatgtaccccatgaggtcggcgaagccgcaggttagggtatcgatgacctcatatcagcagccagggcct

SEQ ID NO: 397811 - DNA, 140 bp, Artificial Sequence
  Synthetic
atacgccatgctgggtctcccctgcctccgcattaaattatgccaacaagtctgggctgtatcatctaaccaatgactgccccaacagcagcattgtgtatgaggcggatggcatgatcccgtacttgggagtcggccat

SEQ ID NO: 397812 - DNA, 140 bp, Artificial Sequence
  Synthetic
atggccgactcccaagtacgggatcatgccatccgcctcatacacaatgctgctgttggggcagtcattggttagatgatacagcccagacttgttggcataatttaatgcggaggcaggggagacccagcatggcgtat

SEQ ID NO: 397813 - DNA, 140 bp, Artificial Sequence
  Synthetic
  misc_feature (21)..(21): n is a, c, g, or t
atacgccatgctgggtctccngtcagggggatccgcgagcacgtggacctcttggtgggtgctgctgcgttctgttctgccatgtacgtgggcgacctgtgcggcgggctctttctcgtccgtacttgggagtcggccat

SEQ ID NO: 397814 - DNA, 140 bp, Artificial Sequence
  Synthetic
  misc_feature (120)..(120): n is a, c, g, or t
atggccgactcccaagtacggacgagaaagagcccgccgcacaggtcgcccacgtacatggcagaacagaacgcagcagcacccaccaagaggtccacgtgctcgcggatccccctgacnggagacccagcatggcgtat

SEQ ID NO: 397815 - DNA, 140 bp, Artificial Sequence
  Synthetic
  misc_feature (94)..(94): n is a, c, g, or t
  misc_feature (103)..(103): n is a, c, g, or t
atacgccatgctgggtctccacatgatgatgaattggtcaccaaccgtcaccttggccttgtcttactttatgcgcataccccaagtgatcatngacgtgttngtcggtggccactggggcgtacttgggagtcggccat

SEQ ID NO: 397816 - DNA, 140 bp, Artificial Sequence
  Synthetic
  misc_feature (38)..(38): n is a, c, g, or t
  misc_feature (47)..(47): n is a, c, g, or t
atggccgactcccaagtacgccccagtggccaccgacnaacacgtcnatgatcacttggggtatgcgcataaagtaagacaaggccaaggtgacggttggtgaccaattcatcatcatgtggagacccagcatggcgtat

SEQ ID NO: 397817 - DNA, 140 bp, Artificial Sequence
  Synthetic
aggccctggctgctgatatgaaccacgactcccctgacgccgagctcatagaggccaacctcctgtggaggcaggagatgggcggtaacatcaccagggttgagtcagagaacaaagtgggaccttttgggacagcggtg

SEQ ID NO: 397818 - DNA, 140 bp, Artificial Sequence
  Synthetic
caccgctgtcccaaaaggtcccactttgttctctgactcaaccctggtgatgttaccgcccatctcctgcctccacaggaggttggcctctatgagctcggcgtcaggggagtcgtggttcatatcagcagccagggcct

SEQ ID NO: 397819 - DNA, 140 bp, Artificial Sequence
  Synthetic
  misc_feature (50)..(50): n is a, c, g, or t
atacgccatgctgggtctccactggggctgtgacagggcatgccatgacnggtctcacgacccttttcactcaaggggccaagcagaacctccagctgatcaacaccaatggcagctggccgtacttgggagtcggccat

SEQ ID NO: 397820 - DNA, 140 bp, Artificial Sequence
  Synthetic
  misc_feature (91)..(91): n is a, c, g, or t
atggccgactcccaagtacggccagctgccattggtgttgatcagctggaggttctgcttggccccttgagtgaaaagggtcgtgagaccngtcatggcatgccctgtcacagccccagtggagacccagcatggcgtat

SEQ ID NO: 397821 - DNA, 140 bp, Artificial Sequence
  Synthetic
  misc_feature (33)..(33): n is a, c, g, or t
  misc_feature (45)..(45): n is a, c, g, or t
atacgccatgctgggtctccgcgcctgagctcntgcaagcccatngtctctttctctcagggatggggccccatcacatacgcaaacattagcggtccttcagatgatagaccgtactgtcgtacttgggagtcggccat

SEQ ID NO: 397822 - DNA, 140 bp, Artificial Sequence
  Synthetic
  misc_feature (96)..(96): n is a, c, g, or t
  misc_feature (108)..(108): n is a, c, g, or t
atggccgactcccaagtacgacagtacggtctatcatctgaaggaccgctaatgtttgcgtatgtgatggggccccatccctgagagaaagagacnatgggcttgcangagctcaggcgcggagacccagcatggcgtat

SEQ ID NO: 397823 - DNA, 140 bp, Artificial Sequence
  Synthetic
  misc_feature (58)..(58): n is a, c, g, or t
  misc_feature (91)..(91): n is a, c, g, or t
atacgccatgctgggtctccaccgcaagggtgttccaacttacacttggggtgaaaangagactgacgtgttccttctcgagagcttgcgnccaccgaagggaggatggtttggttgcaccgtacttgggagtcggccat

SEQ ID NO: 397824 - DNA, 140 bp, Artificial Sequence
  Synthetic
  misc_feature (50)..(50): n is a, c, g, or t
  misc_feature (83)..(83): n is a, c, g, or t
atggccgactcccaagtacggtgcaaccaaaccatcctcccttcggtggncgcaagctctcgagaaggaacacgtcagtctcnttttcaccccaagtgtaagttggaacacccttgcggtggagacccagcatggcgtat

SEQ ID NO: 397825 - DNA, 140 bp, Artificial Sequence
  Synthetic
  misc_feature (56)..(56): n is a, c, g, or t
atacgccatgctgggtctcccggaagaacccagaggcgacctatgccaagtgtggntcgggcccctggctcacgccgaggtgtctagttgactacccctatagactgtggcactatccgtcgtacttgggagtcggccat

SEQ ID NO: 397826 - DNA, 140 bp, Artificial Sequence
  Synthetic
  misc_feature (85)..(85): n is a, c, g, or t
atggccgactcccaagtacgacggatagtgccacagtctataggggtagtcaactagacacctcggcgtgagccaggggcccganccacacttggcataggtcgcctctgggttcttccgggagacccagcatggcgtat

SEQ ID NO: 397827 - DNA, 140 bp, Artificial Sequence
  Synthetic
atacgccatgctgggtctccgcttgaagacagggacaggtttgaaatgagccctcttctgcattcgacaactgagctcgcaatactcccatgtacattcaccaccatgccagccttatcacgtacttgggagtcggccat

SEQ ID NO: 397828 - DNA, 140 bp, Artificial Sequence
  Synthetic
atggccgactcccaagtacgtgataaggctggcatggtggtgaatgtacatgggagtattgcgagctcagttgtcgaatgcagaagagggctcatttcaaacctgtccctgtcttcaagcggagacccagcatggcgtat

SEQ ID NO: 397829 - DNA, 140 bp, Artificial Sequence
  Synthetic
atacgccatgctgggtctcctcctcgccttccttgtgctagctgacgcgcgcatctgtgcgtgtctttggcttatgttgctcataggcaaggcggaggccgcattagagaatctgatcaccgtacttgggagtcggccat

SEQ ID NO: 397830 - DNA, 140 bp, Artificial Sequence
  Synthetic
atggccgactcccaagtacggtgatcagattctctaatgcggcctccgccttgcctatgagcaacataagccaaagacacgcacagatgcgcgcgtcagctagcacaaggaaggcgaggaggagacccagcatggcgtat

SEQ ID NO: 397831 - DNA, 140 bp, Artificial Sequence
  Synthetic
atacgccatgctgggtctccacatacgggctcttgcagatatggccgctactattgcttgtcttggccctcccccagcgcgctttcgcttacgatcacgaaagcgcggcctctgtcggggcgtacttgggagtcggccat

SEQ ID NO: 397832 - DNA, 140 bp, Artificial Sequence
  Synthetic
atggccgactcccaagtacgccccgacagaggccgcgctttcgtgatcgtaagcgaaagcgcgctgggggagggccaagacaagcaatagtagcggccatatctgcaagagcccgtatgtggagacccagcatggcgtat

SEQ ID NO: 397833 - DNA, 140 bp, Artificial Sequence
  Synthetic
aggccctggctgctgatatgacttcttgtcccagactaaacaggcaggagaaaacttcccctacctggtggcataccaggccacagtgtgtgccagggctcaggccccacctccatcgtggaccttttgggacagcggtg

SEQ ID NO: 397834 - DNA, 140 bp, Artificial Sequence
  Synthetic
caccgctgtcccaaaaggtccacgatggaggtggggcctgagccctggcacacactgtggcctggtatgccaccaggtaggggaagttttctcctgcctgtttagtctgggacaagaagtcatatcagcagccagggcct

SEQ ID NO: 397835 - DNA, 140 bp, Artificial Sequence
  Synthetic
atacgccatgctgggtctccagaggctgctctgcaagtgtgggttccaagcttagcagtgaggagggggcgtgacgccgtcatattgctgacctgcctgatacatcctgcccttgggtttcgtacttgggagtcggccat

SEQ ID NO: 397836 - DNA, 140 bp, Artificial Sequence
  Synthetic
atggccgactcccaagtacgaaacccaagggcaggatgtatcaggcaggtcagcaatatgacggcgtcacgccccctcctcactgctaagcttggaacccacacttgcagagcagcctctggagacccagcatggcgtat

SEQ ID NO: 397837 - DNA, 140 bp, Artificial Sequence
  Synthetic
atacgccatgctgggtctccgggcgtgcttgcttgctcgccgccttgccggtggcaagtatgtgcaagcgtgtctcttgaaaatcggagcctggaccggtacgtacatctacaaccacctcgtacttgggagtcggccat

SEQ ID NO: 397838 - DNA, 140 bp, Artificial Sequence
  Synthetic
atggccgactcccaagtacgaggtggttgtagatgtacgtaccggtccaggctccgattttcaagagacacgcttgcacatacttgccaccggcaaggcggcgagcaagcaagcacgcccggagacccagcatggcgtat

SEQ ID NO: 397839 - DNA, 140 bp, Artificial Sequence
  Synthetic
atacgccatgctgggtctccggagccgacactgcggcttgcggtgacatactgcagggcttgcccgtctcggcgcggctcgggcgtcaagttctgctaggccctgcagatggcttggaggcgtacttgggagtcggccat

SEQ ID NO: 397840 - DNA, 140 bp, Artificial Sequence
  Synthetic
atggccgactcccaagtacgcctccaagccatctgcagggcctagcagaacttgacgcccgagccgcgccgagacgggcaagccctgcagtatgtcaccgcaagccgcagtgtcggctccggagacccagcatggcgtat

SEQ ID NO: 397841 - DNA, 140 bp, Artificial Sequence
  Synthetic
atacgccatgctgggtctcctgaggtcgagggcgagatacaaatagtctccacggccacccagacttttctggctacgactctaaatggggtcctctggacagtctaccacggggccggccgtacttgggagtcggccat

SEQ ID NO: 397842 - DNA, 140 bp, Artificial Sequence
  Synthetic
atggccgactcccaagtacggccggccccgtggtagactgtccagaggaccccatttagagtcgtagccagaaaagtctgggtggccgtggagactatttgtatctcgccctcgacctcaggagacccagcatggcgtat

SEQ ID NO: 397843 - DNA, 140 bp, Artificial Sequence
  Synthetic
atacgccatgctgggtctcctgactccatgctcctgtggcgccagcgatctctatttggtcaccaggaatgcggacgtcatccccgcaaggcgcaggggggacacccgcgccggactcctcgtacttgggagtcggccat

SEQ ID NO: 397844 - DNA, 140 bp, Artificial Sequence
  Synthetic
atggccgactcccaagtacgaggagtccggcgcgggtgtcccccctgcgccttgcggggatgacgtccgcattcctggtgaccaaatagagatcgctggcgccacaggagcatggagtcaggagacccagcatggcgtat

SEQ ID NO: 397845 - DNA, 140 bp, Artificial Sequence
  Synthetic
aggccctggctgctgatatgcaacttgcaccgccaaccacgactcccctgacgccgagctcatagaggctaacctcctatggaggcaggagatgggcggcaacatcaccagggttgagtcgaccttttgggacagcggtg

SEQ ID NO: 397846 - DNA, 140 bp, Artificial Sequence
  Synthetic
caccgctgtcccaaaaggtcgactcaaccctggtgatgttgccgcccatctcctgcctccataggaggttagcctctatgagctcggcgtcaggggagtcgtggttggcggtgcaagttgcatatcagcagccagggcct

SEQ ID NO: 397847 - DNA, 140 bp, Artificial Sequence
  Synthetic
aggccctggctgctgatatgacaggaggtcccatcacctactccacctatggcaagttcttggctgatggaggttgttccggcggggcgtatgatattatcatatgtgacgagtgccattgaccttttgggacagcggtg

SEQ ID NO: 397848 - DNA, 140 bp, Artificial Sequence
  Synthetic
caccgctgtcccaaaaggtcaatggcactcgtcacatatgataatatcatacgccccgccggaacaacctccatcagccaagaacttgccataggtggagtaggtgatgggacctcctgtcatatcagcagccagggcct

SEQ ID NO: 397849 - DNA, 140 bp, Artificial Sequence
  Synthetic
aggccctggctgctgatatgagttgccgccccattgacaagttcgctcaggggtggggtcccatcacttacattaagccgcccgtcttggaccagaagccctattgctggcactacgcacgaccttttgggacagcggtg

SEQ ID NO: 397850 - DNA, 140 bp, Artificial Sequence
  Synthetic
caccgctgtcccaaaaggtcgtgcgtagtgccagcaatagggcttctggtccaagacgggcggcttaatgtaagtgatgggaccccacccctgagcgaacttgtcaatggggcggcaactcatatcagcagccagggcct

SEQ ID NO: 397851 - DNA, 140 bp, Artificial Sequence
  Synthetic
atacgccatgctgggtctccatcagtcacggtgccgcatcctaacatctcggaagtcgccctacctactacaggggaaatccccttctatgggaggggaatccccctcgagtacatcaagcgtacttgggagtcggccat

SEQ ID NO: 397852 - DNA, 140 bp, Artificial Sequence
  Synthetic
atggccgactcccaagtacgcttgatgtactcgagggggattcccctcccatagaaggggatttcccctgtagtaggtagggcgacttccgagatgttaggatgcggcaccgtgactgatggagacccagcatggcgtat

SEQ ID NO: 397853 - DNA, 140 bp, Artificial Sequence
  Synthetic
atacgccatgctgggtctccgtgtggacgtgtcagtgatccctacagcgggggatgtcgtcgtctgcgccactgatgctctcatgactggctatacaggcgatttcgactccgtcatagacgtacttgggagtcggccat

SEQ ID NO: 397854 - DNA, 140 bp, Artificial Sequence
  Synthetic
atggccgactcccaagtacgtctatgacggagtcgaaatcgcctgtatagccagtcatgagagcatcagtggcgcagacgacgacatcccccgctgtagggatcactgacacgtccacacggagacccagcatggcgtat

SEQ ID NO: 397855 - DNA, 140 bp, Artificial Sequence
  Synthetic
aggccctggctgctgatatgactgatgctctcatgactggctatacaggcgatttcgactccgtcatagactgcaatgtcgcggttacacaggtagtcgatttcagcctggatcccacttgaccttttgggacagcggtg

SEQ ID NO: 397856 - DNA, 140 bp, Artificial Sequence
  Synthetic
caccgctgtcccaaaaggtcaagtgggatccaggctgaaatcgactacctgtgtaaccgcgacattgcagtctatgacggagtcgaaatcgcctgtatagccagtcatgagagcatcagtcatatcagcagccagggcct

SEQ ID NO: 397857 - DNA, 140 bp, Artificial Sequence
  Synthetic
aggccctggctgctgatatgtgcccctcggggcacgctgtgggcatcttccgggctgccgtgtgcacccggggggttgcgaaggcggtggacttcatacccgttgagtctatggaaactagaccttttgggacagcggtg

SEQ ID NO: 397858 - DNA, 140 bp, Artificial Sequence
  Synthetic
caccgctgtcccaaaaggtctagtttccatagactcaacgggtatgaagtccaccgccttcgcaaccccccgggtgcacacggcagcccggaagatgcccacagcgtgccccgaggggcacatatcagcagccagggcct

SEQ ID NO: 397859 - DNA, 140 bp, Artificial Sequence
  Synthetic
aggccctggctgctgatatgcctacgatgttggctgcgcgtggtatgagttaacaccatcagaaaccaccgttaggctgcgcgcgtaccttaacactcccgggctgcccgtgtgccaagagaccttttgggacagcggtg

SEQ ID NO: 397860 - DNA, 140 bp, Artificial Sequence
  Synthetic
caccgctgtcccaaaaggtctcttggcacacgggcagcccgggagtgttaaggtacgcgcgcagcctaacggtggtttctgatggtgttaactcataccacgcgcagccaacatcgtaggcatatcagcagccagggcct

SEQ ID NO: 397861 - DNA, 140 bp, Artificial Sequence
  Synthetic
  misc_feature (110)..(110): n is a, c, g, or t
aggccctggctgctgatatgaccactcatccaatcactaaatacatcatgacctgcatgtcagctgacctcgaagtgatcactagcgcctgggtgctcacggggggaatncttgctgcgtgaccttttgggacagcggtg

SEQ ID NO: 397862 - DNA, 140 bp, Artificial Sequence
  Synthetic
  misc_feature (31)..(31): n is a, c, g, or t
caccgctgtcccaaaaggtcacgcagcaagnattccccccgtgagcacccaggcgctagtgatcacttcgaggtcagctgacatgcaggtcatgatgtatttagtgattggatgagtggtcatatcagcagccagggcct

SEQ ID NO: 397863 - DNA, 140 bp, Artificial Sequence
  Synthetic
  misc_feature (60)..(60): n is a, c, g, or t
atacgccatgctgggtctccgcagtttgatgagatggaggagtgctcacaccgactcccntacttggttgagggccaacaaattgccgagcaattcaagcaaaaggtcctaggcctcctgcgtacttgggagtcggccat

SEQ ID NO: 397864 - DNA, 140 bp, Artificial Sequence
  Synthetic
  misc_feature (81)..(81): n is a, c, g, or t
atggccgactcccaagtacgcaggaggcctaggaccttttgcttgaattgctcggcaatttgttggccctcaaccaagtangggagtcggtgtgagcactcctccatctcatcaaactgcggagacccagcatggcgtat

SEQ ID NO: 397865 - DNA, 140 bp, Artificial Sequence
  Synthetic
atacgccatgctgggtctccgtgggattcaatacctggcaggcctgtcaacgctgcccggtaacccggctgtggcctccctaatgtccttctctgcggctctgacaagtcctttagccaccgtacttgggagtcggccat

SEQ ID NO: 397866 - DNA, 140 bp, Artificial Sequence
  Synthetic
atggccgactcccaagtacggtggctaaaggacttgtcagagccgcagagaaggacattagggaggccacagccgggttaccgggcagcgttgacaggcctgccaggtattgaatcccacggagacccagcatggcgtat

SEQ ID NO: 397867 - DNA, 140 bp, Artificial Sequence
  Synthetic
atacgccatgctgggtctccgctgccgtaggcagcatcggattaggccgcgtcatcgtcgacatcttggcgggctacggggcaggagtgtccggtgccctcgttgcttttaagatcatgacgtacttgggagtcggccat

SEQ ID NO: 397868 - DNA, 140 bp, Artificial Sequence
  Synthetic
atggccgactcccaagtacgtcatgatcttaaaagcaacgagggcaccggacactcctgccccgtagcccgccaagatgtcgacgatgacgcggcctaatccgatgctgcctacggcagcggagacccagcatggcgtat

SEQ ID NO: 397869 - DNA, 140 bp, Artificial Sequence
  Synthetic
atacgccatgctgggtctccccgccacgtcggtccctccgaaggggcgacccagtggatgaacaggctcatagcatttgcctcaaggggcaaccacgtatcaccgacacactacgtacctcgtacttgggagtcggccat

SEQ ID NO: 397870 - DNA, 140 bp, Artificial Sequence
  Synthetic
atggccgactcccaagtacgaggtacgtagtgtgtcggtgatacgtggttgccccttgaggcaaatgctatgagcctgttcatccactgggtcgccccttcggagggaccgacgtggcggggagacccagcatggcgtat

SEQ ID NO: 397871 - DNA, 140 bp, Artificial Sequence
  Synthetic
atacgccatgctgggtctcccaccatgttccacgagctggttaagagacatctgggactgggtctgtaccgtgctgtcagacttcaaaacctggcttaaggctaagcttgtgccttccctcgtacttgggagtcggccat

SEQ ID NO: 397872 - DNA, 140 bp, Artificial Sequence
  Synthetic
atggccgactcccaagtacgagggaaggcacaagcttagccttaagccaggttttgaagtctgacagcacggtacagacccagtcccagatgtctcttaaccagctcgtggaacatggtgggagacccagcatggcgtat

SEQ ID NO: 397873 - DNA, 140 bp, Artificial Sequence
  Synthetic
aggccctggctgctgatatggtgctgtcagacttcaaaacctggcttaaggctaagcttgtgccttccctgccaggcatcccctttctctcttgtcaacgggggttcaggggggtgtggcgaccttttgggacagcggtg

SEQ ID NO: 397874 - DNA, 140 bp, Artificial Sequence
  Synthetic
caccgctgtcccaaaaggtcgccacacccccctgaacccccgttgacaagagagaaaggggatgcctggcagggaaggcacaagcttagccttaagccaggttttgaagtctgacagcaccatatcagcagccagggcct

SEQ ID NO: 397875 - DNA, 140 bp, Artificial Sequence
  Synthetic
  misc_feature (90)..(90): n is a, c, g, or t
atacgccatgctgggtctccaggggctactaccgacaatctgaagtgcccctgccaggtaccagcaccagagttcttcactgaggtgganggagttaggctgcacagatacgcgcctgcgcgtacttgggagtcggccat

SEQ ID NO: 397876 - DNA, 140 bp, Artificial Sequence
  Synthetic
  misc_feature (51)..(51): n is a, c, g, or t
atggccgactcccaagtacgcgcaggcgcgtatctgtgcagcctaactccntccacctcagtgaagaactctggtgctggtacctggcaggggcacttcagattgtcggtagtagcccctggagacccagcatggcgtat

SEQ ID NO: 397877 - DNA, 140 bp, Artificial Sequence
  Synthetic
atacgccatgctgggtctcctgctcacgtccatgctctctgacccgagccatatcaccgcggagacagcagcccggcgcctcgcacgggggtcccctccatctttggctagttcctcggccgtacttgggagtcggccat

SEQ ID NO: 397878 - DNA, 140 bp, Artificial Sequence
  Synthetic
atggccgactcccaagtacggccgaggaactagccaaagatggaggggacccccgtgcgaggcgccgggctgctgtctccgcggtgatatggctcgggtcagagagcatggacgtgagcaggagacccagcatggcgtat

SEQ ID NO: 397879 - DNA, 140 bp, Artificial Sequence
  Synthetic
aggccctggctgctgatatgctggtaggggcaggacaggcatctacaggtttgtgactccaggagaacggccctcgggcatgttcgattcttcggtcctgtgtgagtgctatgacgcggggaccttttgggacagcggtg

SEQ ID NO: 397880 - DNA, 140 bp, Artificial Sequence
  Synthetic
caccgctgtcccaaaaggtccccgcgtcatagcactcacacaggaccgaagaatcgaacatgcccgagggccgttctcctggagtcacaaacctgtagatgcctgtcctgcccctaccagcatatcagcagccagggcct

SEQ ID NO: 397881 - DNA, 140 bp, Artificial Sequence
  Synthetic
aggccctggctgctgatatgggctccagactacaatccaccaacagtttcgggctgtgctctccctccgcagggtgtaccacccgtgccaccacctaggaggaagaaagttgtgcagctcgaccttttgggacagcggtg

SEQ ID NO: 397882 - DNA, 140 bp, Artificial Sequence
  Synthetic
caccgctgtcccaaaaggtcgagctgcacaactttcttcctcctaggtggtggcacgggtggtacaccctgcggagggagagcacagcccgaaactgttggtggattgtagtctggagcccatatcagcagccagggcct

SEQ ID NO: 397883 - DNA, 140 bp, Artificial Sequence
  Synthetic
atacgccatgctgggtctcctgatcaacaccaatggcagttggcacatcaatagaacggccctgaactgcaatgctagccacgacaccggctgggtggcagggctcttctaccaccacaacgtacttgggagtcggccat

SEQ ID NO: 397884 - DNA, 140 bp, Artificial Sequence
  Synthetic
atggccgactcccaagtacgttgtggtggtagaagagccctgccacccagccggtgtcgtggctagcattgcagttcagggccgttctattgatgtgccaactgccattggtgttgatcaggagacccagcatggcgtat

SEQ ID NO: 397885 - DNA, 140 bp, Artificial Sequence
  Synthetic
  misc_feature (58)..(58): n is a, c, g, or t
  misc_feature (118)..(118): n is a, c, g, or t
atacgccatgctgggtctccttcccacctccactgaggcacagtcctccgatgacgtngagacggcatctgacgctggttcatacagctctatgccgccgttggagggggaacctggngacgtacttgggagtcggccat

SEQ ID NO: 397886 - DNA, 140 bp, Artificial Sequence
  Synthetic
  misc_feature (23)..(23): n is a, c, g, or t
  misc_feature (83)..(83): n is a, c, g, or t
atggccgactcccaagtacgtcnccaggttccccctccaacggcggcatagagctgtatgaaccagcgtcagatgccgtctcnacgtcatcggaggactgtgcctcagtggaggtgggaaggagacccagcatggcgtat

SEQ ID NO: 397887 - DNA, 140 bp, Artificial Sequence
  Synthetic
aggccctggctgctgatatgcggctcgctctaagttcggatacggagcaaaagaagttcgtagccattctagcaaggccattaaccacatcaactccgtgtgggaggacttgctagaggagaccttttgggacagcggtg

SEQ ID NO: 397888 - DNA, 140 bp, Artificial Sequence
  Synthetic
caccgctgtcccaaaaggtctcctctagcaagtcctcccacacggagttgatgtggttaatggccttgctagaatggctacgaacttcttttgctccgtatccgaacttagagcgagccgcatatcagcagccagggcct

SEQ ID NO: 397889 - DNA, 140 bp, Artificial Sequence
  Synthetic
atacgccatgctgggtctcccctgatcttggtgtaagggtgtgcgaaaagagggctttgtacgatcttgcacagaaactacccgaggcaataatgggacccgcttacggcttccaatattcgtacttgggagtcggccat

SEQ ID NO: 397890 - DNA, 140 bp, Artificial Sequence
  Synthetic
atggccgactcccaagtacgaatattggaagccgtaagcgggtcccattattgcctcgggtagtttctgtgcaagatcgtacaaagccctcttttcgcacacccttacaccaagatcaggggagacccagcatggcgtat

SEQ ID NO: 397891 - DNA, 140 bp, Artificial Sequence
  Synthetic
  misc_feature (51)..(51): n is a, c, g, or t
atacgccatgctgggtctccggaacgtgacatccgcactgaacatgacatntaccagtgctgccaactagatccggtagcacggaaagccatcacatctcttactgagcggctgtactgccgtacttgggagtcggccat

SEQ ID NO: 397892 - DNA, 140 bp, Artificial Sequence
  Synthetic
  misc_feature (90)..(90): n is a, c, g, or t
atggccgactcccaagtacggcagtacagccgctcagtaagagatgtgatggctttccgtgctaccggatctagttggcagcactggtanatgtcatgttcagtgcggatgtcacgttccggagacccagcatggcgtat

SEQ ID NO: 397893 - DNA, 140 bp, Artificial Sequence
  Synthetic
atacgccatgctgggtctccacctgaaggctcaggcggcttgtagggcagcaaagctcaaaaactttgacatgttggtctgcggagacgacttggttgtcgttgctgagagcgggggagtcgtacttgggagtcggccat

SEQ ID NO: 397894 - DNA, 140 bp, Artificial Sequence
  Synthetic
atggccgactcccaagtacgactcccccgctctcagcaacgacaaccaagtcgtctccgcagaccaacatgtcaaagtttttgagctttgctgccctacaagccgcctgagccttcaggtggagacccagcatggcgtat

SEQ ID NO: 397895 - DNA, 140 bp, Artificial Sequence
  Synthetic
aggccctggctgctgatatgaagcaccccgaggccacttacaccaaatgcggttcggggccttggttgacacctaggtgcttagtgcactacccatacaggctttggcactacccctgcagaccttttgggacagcggtg

SEQ ID NO: 397896 - DNA, 140 bp, Artificial Sequence
  Synthetic
caccgctgtcccaaaaggtctgcaggggtagtgccaaagcctgtatgggtagtgcactaagcacctaggtgtcaaccaaggccccgaaccgcatttggtgtaagtggcctcggggtgcttcatatcagcagccagggcct

SEQ ID NO: 397897 - DNA, 140 bp, Artificial Sequence
  Synthetic
  misc_feature (38)..(38): n is a, c, g, or t
atacgccatgctgggtctccataacatcatgctcgtcnaacgtctccgtggcccacgatggctctggacagagatactactacctcactcgtgacccaaccgtaccattgacacgtgctgcgtacttgggagtcggccat

SEQ ID NO: 397898 - DNA, 140 bp, Artificial Sequence
  Synthetic
  misc_feature (103)..(103): n is a, c, g, or t
atggccgactcccaagtacgcagcacgtgtcaatggtacggttgggtcacgagtgaggtagtagtatctctgtccagagccatcgtgggccacggagacgttngacgagcatgatgttatggagacccagcatggcgtat

SEQ ID NO: 397899 - DNA, 140 bp, Artificial Sequence
  Synthetic
atacgccatgctgggtctcccctgggaaacagcacgccacactccagtgaattcatggttgggcaacatcatcatgttcgcgcctaccatttgggtgcgcatggtgctgatgacacacttcgtacttgggagtcggccat

SEQ ID NO: 397900 - DNA, 140 bp, Artificial Sequence
  Synthetic
atggccgactcccaagtacgaagtgtgtcatcagcaccatgcgcacccaaatggtaggcgcgaacatgatgatgttgcccaaccatgaattcactggagtgtggcgtgctgtttcccaggggagacccagcatggcgtat

SEQ ID NO: 397901 - DNA, 140 bp, Artificial Sequence
  Synthetic
aggccctggctgctgatatgtgctcttcctcctcctggcggacgcgcgcgtctgtgcctgtttgtggatgatgctgctgatagctcaggctgaggccgccttagagaacctggtggtcctgaccttttgggacagcggtg

SEQ ID NO: 397902 - DNA, 140 bp, Artificial Sequence
  Synthetic
caccgctgtcccaaaaggtcaggaccaccaggttctctaaggcggcctcagcctgagctatcagcagcatcatccacaaacaggcacagacgcgcgcgtccgccaggaggaggaagagcacatatcagcagccagggcct

SEQ ID NO: 397903 - DNA, 140 bp, Artificial Sequence
  Synthetic
aggccctggctgctgatatgaacagtaggggtaggcatctttttgcttcccgctcggtagacgggaagcccactgctacactccattaactgttttttttttttttttttttttttttttgaccttttgggacagcggtg

SEQ ID NO: 397904 - DNA, 140 bp, Artificial Sequence
  Synthetic
caccgctgtcccaaaaggtcaaaaaaaaaaaaaaaaaaaaaaaaaaaacagttaatggagtgtagcagtgggcttcccgtctaccgagcgggaagcaaaaagatgcctacccctactgttcatatcagcagccagggcct

SEQ ID NO: 397905 - DNA, 140 bp, Artificial Sequence
  Synthetic
atacgccatgctgggtctccggcgcacctgcacgtgtgggtcccccctctcaatgttcggggaggccgcgatgccatcatcctccttacgtgcgcgttccatccagagctagtatttgatcgtacttgggagtcggccat

SEQ ID NO: 397906 - DNA, 140 bp, Artificial Sequence
  Synthetic
atggccgactcccaagtacgatcaaatactagctctggatggaacgcgcacgtaaggaggatgatggcatcgcggcctccccgaacattgagaggggggacccacacgtgcaggtgcgccggagacccagcatggcgtat

SEQ ID NO: 397907 - DNA, 140 bp, Artificial Sequence
  Synthetic
  misc_feature (73)..(73): n is a, c, g, or t
  misc_feature (78)..(78): n is a, c, g, or t
  misc_feature (89)..(89): n is a, c, g, or t
aggccctggctgctgatatgccgcgcaggggccccaggttgggtgtgcgcgcgacgaggaagacttcagaacngtcgnagcccagaggnaggcgccagcccataccaaaggcgcgccgccgaccttttgggacagcggtg

SEQ ID NO: 397908 - DNA, 140 bp, Artificial Sequence
  Synthetic
  misc_feature (52)..(52): n is a, c, g, or t
  misc_feature (63)..(63): n is a, c, g, or t
  misc_feature (68)..(68): n is a, c, g, or t
caccgctgtcccaaaaggtcggcggcgcgcctttggtatgggctggcgcctncctctgggctncgacngttctgaagtcttcctcgtcgcgcgcacacccaacctggggcccctgcgcggcatatcagcagccagggcct

SEQ ID NO: 397909 - DNA, 140 bp, Artificial Sequence
  Synthetic
  misc_feature (57)..(57): n is a, c, g, or t
atacgccatgctgggtctcccccgcactggggccccaatgacccccggcggaggtcncgcaatttgggtaaagtcatcgataccctcacgtgtggcttcgccgacctcatggggtacattcgtacttgggagtcggccat

SEQ ID NO: 397910 - DNA, 140 bp, Artificial Sequence
  Synthetic
  misc_feature (84)..(84): n is a, c, g, or t
atggccgactcccaagtacgaatgtaccccatgaggtcggcgaagccacacgtgagggtatcgatgactttacccaaattgcgngacctccgccgggggtcattggggccccagtgcgggggagacccagcatggcgtat

SEQ ID NO: 397911 - DNA, 140 bp, Artificial Sequence
  Synthetic
  misc_feature (97)..(97): n is a, c, g, or t
atacgccatgctgggtctccgttgctctttctctatcttcctcttggcacttctctcatgcctcaccgtgcccgcttcggcggtgcactatgccaanaagtctggtctctatcatctgaccgtacttgggagtcggccat

SEQ ID NO: 397912 - DNA, 140 bp, Artificial Sequence
  Synthetic
  misc_feature (44)..(44): n is a, c, g, or t
atggccgactcccaagtacggtcagatgatagagaccagacttnttggcatagtgcaccgccgaagcgggcacggtgaggcatgagagaagtgccaagaggaagatagagaaagagcaacggagacccagcatggcgtat

SEQ ID NO: 397913 - DNA, 140 bp, Artificial Sequence
  Synthetic
  misc_feature (47)..(47): n is a, c, g, or t
  misc_feature (106)..(106): n is a, c, g, or t
  misc_feature (113)..(113): n is a, c, g, or t
  misc_feature (120)..(120): n is a, c, g, or t
aggccctggctgctgatatgcccgcttcggcggtgcactatgccaanaagtctggtctctatcatctgaccaacgactgccccaactccagcatcgtgtatgaggnagacacngtgatcngaccttttgggacagcggtg

SEQ ID NO: 397914 - DNA, 140 bp, Artificial Sequence
  Synthetic
  misc_feature (21)..(21): n is a, c, g, or t
  misc_feature (28)..(28): n is a, c, g, or t
  misc_feature (35)..(35): n is a, c, g, or t
  misc_feature (94)..(94): n is a, c, g, or t
caccgctgtcccaaaaggtcngatcacngtgtctncctcatacacgatgctggagttggggcagtcgttggtcagatgatagagaccagacttnttggcatagtgcaccgccgaagcgggcatatcagcagccagggcct

SEQ ID NO: 397915 - DNA, 140 bp, Artificial Sequence
  Synthetic
  misc_feature (69)..(69): n is a, c, g, or t
  misc_feature (111)..(111): n is a, c, g, or t
  misc_feature (120)..(120): n is a, c, g, or t
atacgccatgctgggtctcccgtccatgggttccgcagacatgtggacctcatggtgggggcggctacnttttgctctgctatgtacgtgggtgacctgtgcgggggtttnttcttggcncgtacttgggagtcggccat

SEQ ID NO: 397916 - DNA, 140 bp, Artificial Sequence
  Synthetic
  misc_feature (21)..(21): n is a, c, g, or t
  misc_feature (30)..(30): n is a, c, g, or t
  misc_feature (72)..(72): n is a, c, g, or t
atggccgactcccaagtacgngccaagaanaaacccccgcacaggtcacccacgtacatagcagagcaaaangtagccgcccccaccatgaggtccacatgtctgcggaacccatggacgggagacccagcatggcgtat

SEQ ID NO: 397917 - DNA, 140 bp, Artificial Sequence
  Synthetic
aggccctggctgctgatatgtcaatttttccatcttcaaggttaggatgtacgtggggggcgtggagcacaggctcaacgccgcatgcaattggactcgaggagagcgttgtgacttggagaccttttgggacagcggtg

SEQ ID NO: 397918 - DNA, 140 bp, Artificial Sequence
  Synthetic
caccgctgtcccaaaaggtctccaagtcacaacgctctcctcgagtccaattgcatgcggcgttgagcctgtgctccacgccccccacgtacatcctaaccttgaagatggaaaaattgacatatcagcagccagggcct

SEQ ID NO: 397919 - DNA, 140 bp, Artificial Sequence
  Synthetic
  misc_feature (79)..(79): n is a, c, g, or t
  misc_feature (92)..(92): n is a, c, g, or t
  misc_feature (105)..(105): n is a, c, g, or t
atacgccatgctgggtctccatatgatgatgaactggtctccgaccacgacgttgatcctgtcctacgtcatgcgcatnccccagctgatcnttgacatttttgncggtggtcattggggcgtacttgggagtcggccat

SEQ ID NO: 397920 - DNA, 140 bp, Artificial Sequence
  Synthetic
  misc_feature (36)..(36): n is a, c, g, or t
  misc_feature (49)..(49): n is a, c, g, or t
  misc_feature (62)..(62): n is a, c, g, or t
atggccgactcccaagtacgccccaatgaccaccgncaaaaatgtcaangatcagctggggnatgcgcatgacgtaggacaggatcaacgtcgtggtcggagaccagttcatcatcatatggagacccagcatggcgtat

SEQ ID NO: 397921 - DNA, 140 bp, Artificial Sequence
  Synthetic
  misc_feature (26)..(26): n is a, c, g, or t
  misc_feature (29)..(29): n is a, c, g, or t
  misc_feature (40)..(40): n is a, c, g, or t
  misc_feature (42)..(42): n is a, c, g, or t
  misc_feature (48)..(48): n is a, c, g, or t
  misc_feature (57)..(57): n is a, c, g, or t
  misc_feature (60)..(60): n is a, c, g, or t
  misc_feature (62)..(62): n is a, c, g, or t
  misc_feature (68)..(68): n is a, c, g, or t
  misc_feature (72)..(72): n is a, c, g, or t
  misc_feature (82)..(82): n is a, c, g, or t
atacgccatgctgggtctccaccggnggntcggctgctcncncaaccngtggcctcnccngnctcttntccnccgggcctangcagcacatccagttaatcaacagcaatgggagctggccgtacttgggagtcggccat

SEQ ID NO: 397922 - DNA, 140 bp, Artificial Sequence
  Synthetic
  misc_feature (59)..(59): n is a, c, g, or t
  misc_feature (69)..(69): n is a, c, g, or t
  misc_feature (73)..(73): n is a, c, g, or t
  misc_feature (79)..(79): n is a, c, g, or t
  misc_feature (81)..(81): n is a, c, g, or t
  misc_feature (84)..(84): n is a, c, g, or t
  misc_feature (93)..(93): n is a, c, g, or t
  misc_feature (99)..(99): n is a, c, g, or t
  misc_feature (101)..(101): n is a, c, g, or t
  misc_feature (112)..(112): n is a, c, g, or t
  misc_feature (115)..(115): n is a, c, g, or t
atggccgactcccaagtacggccagctcccattgctgttgattaactggatgtgctgcntaggcccggngganaagagncnggngaggccacnggttgngngagcagccganccnccggtggagacccagcatggcgtat

SEQ ID NO: 397923 - DNA, 140 bp, Artificial Sequence
  Synthetic
  misc_feature (36)..(36): n is a, c, g, or t
  misc_feature (81)..(81): n is a, c, g, or t
  misc_feature (87)..(87): n is a, c, g, or t
  misc_feature (97)..(97): n is a, c, g, or t
  misc_feature (111)..(111): n is a, c, g, or t
atacgccatgctgggtctccccgcatgagctcgtgnagccctcttgccgcctttgatcaaggctggggccccatctcatangccaanatctcagggnctcaggaggacaanccatactgccgtacttgggagtcggccat

SEQ ID NO: 397924 - DNA, 140 bp, Artificial Sequence
  Synthetic
  misc_feature (30)..(30): n is a, c, g, or t
  misc_feature (44)..(44): n is a, c, g, or t
  misc_feature (54)..(54): n is a, c, g, or t
  misc_feature (60)..(60): n is a, c, g, or t
  misc_feature (105)..(105): n is a, c, g, or t
atggccgactcccaagtacggcagtatggnttgtcctcctgagnccctgagatnttggcntatgagatggggccccagccttgatcaaaggcggcaagagggctncacgagctcatgcggggagacccagcatggcgtat

SEQ ID NO: 397925 - DNA, 140 bp, Artificial Sequence
  Synthetic
  misc_feature (29)..(29): n is a, c, g, or t
  misc_feature (68)..(68): n is a, c, g, or t
  misc_feature (71)..(71): n is a, c, g, or t
  misc_feature (81)..(81): n is a, c, g, or t
  misc_feature (98)..(98): n is a, c, g, or t
atacgccatgctgggtctccttcttgctngcctcccagagaccgcctaccggtgggtggtacgggtgnacntggatgaacnctacggggttcgtcaanacgtgtggggctcccccctgcacgtacttgggagtcggccat

SEQ ID NO: 397926 - DNA, 140 bp, Artificial Sequence
  Synthetic
  misc_feature (43)..(43): n is a, c, g, or t
  misc_feature (60)..(60): n is a, c, g, or t
  misc_feature (70)..(70): n is a, c, g, or t
  misc_feature (73)..(73): n is a, c, g, or t
  misc_feature (112)..(112): n is a, c, g, or t
atggccgactcccaagtacgtgcaggggggagccccacacgtnttgacgaaccccgtagngttcatccangtncacccgtaccacccaccggtaggcggtctctgggaggcnagcaagaaggagacccagcatggcgtat

SEQ ID NO: 397927 - DNA, 140 bp, Artificial Sequence
  Synthetic
aggccctggctgctgatatgcgcttccacctccacagtcccctcctgtgcctccgcctcggaagaagcggacggtggtcctcaccgaatcaaccgtatctactgccttggccgagcttgcgaccttttgggacagcggtg

SEQ ID NO: 397928 - DNA, 140 bp, Artificial Sequence
  Synthetic
caccgctgtcccaaaaggtcgcaagctcggccaaggcagtagatacggttgattcggtgaggaccaccgtccgcttcttccgaggcggaggcacaggaggggactgtggaggtggaagcgcatatcagcagccagggcct

SEQ ID NO: 397929 - DNA, 140 bp, Artificial Sequence
  Synthetic
aggccctggctgctgatatggagagatccccttctatggcaaagccatccccatcgagaccatcaagggggggaggcacctcattttctgccactccaagaagaaatgtgacgagctcgcgaccttttgggacagcggtg

SEQ ID NO: 397930 - DNA, 140 bp, Artificial Sequence
  Synthetic
caccgctgtcccaaaaggtcgcgagctcgtcacatttcttcttggagtggcagaaaatgaggtgcctcccccccttgatggtctcgatggggatggctttgccatagaaggggatctctccatatcagcagccagggcct

SEQ ID NO: 397931 - DNA, 140 bp, Artificial Sequence
  Synthetic
  misc_feature (45)..(45): n is a, c, g, or t
  misc_feature (54)..(54): n is a, c, g, or t
  misc_feature (66)..(66): n is a, c, g, or t
  misc_feature (93)..(93): n is a, c, g, or t
atacgccatgctgggtctccgactcccaggtgccttgtagactanccataccgnctatggcactanccgtgcaccgttaatttcaccattcanaaggtgcgcatgtttgtggggggggtacgtacttgggagtcggccat

SEQ ID NO: 397932 - DNA, 140 bp, Artificial Sequence
  Synthetic
  misc_feature (48)..(48): n is a, c, g, or t
  misc_feature (75)..(75): n is a, c, g, or t
  misc_feature (87)..(87): n is a, c, g, or t
  misc_feature (96)..(96): n is a, c, g, or t
atggccgactcccaagtacgtaccccccccacaaacatgcgcaccttntgaatggtgaaattaacggtgcacggntagtgccatagncggtatggntagtctacaaggcacctgggagtcggagacccagcatggcgtat

SEQ ID NO: 397933 - DNA, 140 bp, Artificial Sequence
  Synthetic
  misc_feature (61)..(61): n is a, c, g, or t
atacgccatgctgggtctccccgagctcgcaatccttccctgctctttcaccactatgccngccctgtcaactgggcttatacacttgcatcaaaatatagtggatgtccaatacctgtacgtacttgggagtcggccat

SEQ ID NO: 397934 - DNA, 140 bp, Artificial Sequence
  Synthetic
  misc_feature (80)..(80): n is a, c, g, or t
atggccgactcccaagtacgtacaggtattggacatccactatattttgatgcaagtgtataagcccagttgacagggcnggcatagtggtgaaagagcagggaaggattgcgagctcggggagacccagcatggcgtat

SEQ ID NO: 397935 - DNA, 140 bp, Artificial Sequence
  Synthetic
  misc_feature (56)..(56): n is a, c, g, or t
  misc_feature (117)..(117): n is a, c, g, or t
atacgccatgctgggtctcccttatgctactcataggccaggcggaggctgcgctngagaacctaatcgtcctcaacgcggcttccgccgccagtatccaggggtggggatggtgcntcccgtacttgggagtcggccat

SEQ ID NO: 397936 - DNA, 140 bp, Artificial Sequence
  Synthetic
  misc_feature (24)..(24): n is a, c, g, or t
  misc_feature (85)..(85): n is a, c, g, or t
atggccgactcccaagtacgggangcaccatccccacccctggatactggcggcggaagccgcgttgaggacgattaggttctcnagcgcagcctccgcctggcctatgagtagcataagggagacccagcatggcgtat

SEQ ID NO: 397937 - DNA, 140 bp, Artificial Sequence
  Synthetic
  misc_feature (27)..(27): n is a, c, g, or t
  misc_feature (36)..(36): n is a, c, g, or t
  misc_feature (82)..(82): n is a, c, g, or t
  misc_feature (99)..(99): n is a, c, g, or t
atacgccatgctgggtctcctccgccncgtgctttngcccaggaccaggagcaggcagcttgcatcggggtttcggtcatcntgttcattaccatcttnactctcaccccgcactacaagcgtacttgggagtcggccat

SEQ ID NO: 397938 - DNA, 140 bp, Artificial Sequence
  Synthetic
  misc_feature (42)..(42): n is a, c, g, or t
  misc_feature (59)..(59): n is a, c, g, or t
  misc_feature (105)..(105): n is a, c, g, or t
  misc_feature (114)..(114): n is a, c, g, or t
atggccgactcccaagtacgcttgtagtgcggggtgagagtnaagatggtaatgaacangatgaccgaaaccccgatgcaagctgcctgctcctggtcctgggcnaaagcacgnggcggaggagacccagcatggcgtat

SEQ ID NO: 397939 - DNA, 140 bp, Artificial Sequence
  Synthetic
  misc_feature (49)..(49): n is a, c, g, or t
  misc_feature (70)..(70): n is a, c, g, or t
  misc_feature (79)..(79): n is a, c, g, or t
  misc_feature (91)..(91): n is a, c, g, or t
atacgccatgctgggtctccgtgatgccatcatactcatcacctgtttnttgcatccatctctcgggttngatgtgacnaaggtactgttngccctcattggccccttctacctgctccacgtacttgggagtcggccat

SEQ ID NO: 397940 - DNA, 140 bp, Artificial Sequence
  Synthetic
  misc_feature (50)..(50): n is a, c, g, or t
  misc_feature (62)..(62): n is a, c, g, or t
  misc_feature (71)..(71): n is a, c, g, or t
  misc_feature (92)..(92): n is a, c, g, or t
atggccgactcccaagtacgtggagcaggtagaaggggccaatgagggcnaacagtaccttngtcacatcnaacccgagagatggatgcaanaaacaggtgatgagtatgatggcatcacggagacccagcatggcgtat

SEQ ID NO: 397941 - DNA, 140 bp, Artificial Sequence
  Synthetic
  misc_feature (32)..(32): n is a, c, g, or t
atacgccatgctgggtctcctgtttgctgagngttggagcatggactggcacttacatctatgaccatctctcccctttggccgattgggccagcgacggcttacgagaccttgccgttgcgtacttgggagtcggccat

SEQ ID NO: 397942 - DNA, 140 bp, Artificial Sequence
  Synthetic
  misc_feature (109)..(109): n is a, c, g, or t
atggccgactcccaagtacgcaacggcaaggtctcgtaagccgtcgctggcccaatcggccaaaggggagagatggtcatagatgtaagtgccagtccatgctccaacnctcagcaaacaggagacccagcatggcgtat

SEQ ID NO: 397943 - DNA, 140 bp, Artificial Sequence
  Synthetic
aggccctggctgctgatatgggctcatatggtggttacaatactttatcaccagagccgaggcgcacttgcatgtgtggatcccccccctcaacgttcgggggggccgcgacgccatcatgaccttttgggacagcggtg

SEQ ID NO: 397944 - DNA, 140 bp, Artificial Sequence
  Synthetic
caccgctgtcccaaaaggtcatgatggcgtcgcggcccccccgaacgttgaggggggggatccacacatgcaagtgcgcctcggctctggtgataaagtattgtaaccaccatatgagcccatatcagcagccagggcct

SEQ ID NO: 397945 - DNA, 140 bp, Artificial Sequence
  Synthetic
  misc_feature (52)..(52): n is a, c, g, or t
  misc_feature (82)..(82): n is a, c, g, or t
  misc_feature (101)..(101): n is a, c, g, or t
atacgccatgctgggtctcctggcatctaccatcaatggggtgctttggacngtctaccatggcgctgggtccaagaccttngcgggcccgaaagggcccntctgccagatgtacaccaacgtacttgggagtcggccat

SEQ ID NO: 397946 - DNA, 140 bp, Artificial Sequence
  Synthetic
  misc_feature (40)..(40): n is a, c, g, or t
  misc_feature (59)..(59): n is a, c, g, or t
  misc_feature (89)..(89): n is a, c, g, or t
atggccgactcccaagtacgttggtgtacatctggcagangggccctttcgggcccgcnaaggtcttggacccagcgccatggtagacngtccaaagcaccccattgatggtagatgccaggagacccagcatggcgtat

SEQ ID NO: 397947 - DNA, 140 bp, Artificial Sequence
  Synthetic
  misc_feature (29)..(29): n is a, c, g, or t
  misc_feature (69)..(69): n is a, c, g, or t
  misc_feature (84)..(84): n is a, c, g, or t
  misc_feature (89)..(89): n is a, c, g, or t
atacgccatgctgggtctccgccgatgtnatccctgcgagacgcaggggtgacactcgggccagcctcntcagtcccagaccantgagnaccctcaaagggtcatcgggagggcccgtcccgtacttgggagtcggccat

SEQ ID NO: 397948 - DNA, 140 bp, Artificial Sequence
  Synthetic
  misc_feature (52)..(52): n is a, c, g, or t
  misc_feature (57)..(57): n is a, c, g, or t
  misc_feature (72)..(72): n is a, c, g, or t
  misc_feature (112)..(112): n is a, c, g, or t
atggccgactcccaagtacgggacgggccctcccgatgaccctttgagggtnctcantggtctgggactgangaggctggcccgagtgtcacccctgcgtctcgcagggatnacatcggcggagacccagcatggcgtat

SEQ ID NO: 397949 - DNA, 140 bp, Artificial Sequence
  Synthetic
  misc_feature (56)..(56): n is a, c, g, or t
atacgccatgctgggtctcccacaatgcgatccccggtcttcaccgataactcatntccacccgccgtgccgcagacctaccaagtgggatatctacacgcacccactggcagtggtaagcgtacttgggagtcggccat

SEQ ID NO: 397950 - DNA, 140 bp, Artificial Sequence
  Synthetic
  misc_feature (85)..(85): n is a, c, g, or t
atggccgactcccaagtacgcttaccactgccagtgggtgcgtgtagatatcccacttggtaggtctgcggcacggcgggtgganatgagttatcggtgaagaccggggatcgcattgtgggagacccagcatggcgtat

SEQ ID NO: 397951 - DNA, 140 bp, Artificial Sequence
  Synthetic
  misc_feature (40)..(40): n is a, c, g, or t
  misc_feature (46)..(46): n is a, c, g, or t
  misc_feature (52)..(52): n is a, c, g, or t
  misc_feature (69)..(69): n is a, c, g, or t
  misc_feature (93)..(93): n is a, c, g, or t
  misc_feature (115)..(115): n is a, c, g, or t
  misc_feature (118)..(118): n is a, c, g, or t
atacgccatgctgggtctccaagcacatggaatagacccnaacatnaggacnggtgtaagaaccatcanaacgggagggccgattacatactncacctatgggaagttcctggcnganggcgtacttgggagtcggccat

SEQ ID NO: 397952 - DNA, 140 bp, Artificial Sequence
  Synthetic
  misc_feature (23)..(23): n is a, c, g, or t
  misc_feature (26)..(26): n is a, c, g, or t
  misc_feature (48)..(48): n is a, c, g, or t
  misc_feature (72)..(72): n is a, c, g, or t
  misc_feature (89)..(89): n is a, c, g, or t
  misc_feature (95)..(95): n is a, c, g, or t
  misc_feature (101)..(101): n is a, c, g, or t
atggccgactcccaagtacgccntcngccaggaacttcccataggtgnagtatgtaatcggccctcccgttntgatggttcttacaccngtcctnatgttngggtctattccatgtgcttggagacccagcatggcgtat

SEQ ID NO: 397953 - DNA, 140 bp, Artificial Sequence
  Synthetic
atacgccatgctgggtctccgagacagctggcgtacggctcaccgtactggccactgcgactcctcctggctcagtgacggttcctcacccgaacatcacagaggtcgcactgccgacaacgtacttgggagtcggccat

SEQ ID NO: 397954 - DNA, 140 bp, Artificial Sequence
  Synthetic
atggccgactcccaagtacgttgtcggcagtgcgacctctgtgatgttcgggtgaggaaccgtcactgagccaggaggagtcgcagtggccagtacggtgagccgtacgccagctgtctcggagacccagcatggcgtat

SEQ ID NO: 397955 - DNA, 140 bp, Artificial Sequence
  Synthetic
aggccctggctgctgatatggggctcagcccgggtacccttggcccctctatggcaatgagggctgcgggtgggcgggatggctcctgtccccccgcggctctcggcctagctggggcccgaccttttgggacagcggtg

SEQ ID NO: 397956 - DNA, 140 bp, Artificial Sequence
  Synthetic
caccgctgtcccaaaaggtcgggccccagctaggccgagagccgcggggggacaggagccatcccgcccacccgcagccctcattgccatagaggggccaagggtacccgggctgagccccatatcagcagccagggcct

SEQ ID NO: 397957 - DNA, 140 bp, Artificial Sequence
  Synthetic
atacgccatgctgggtctccggccggccagctccggacgcttggactcaacgctgtcgccttctacaggggcgtggacgtgtcagtcattcccacaagtggggatgttgtcgtctgcgcacgtacttgggagtcggccat

SEQ ID NO: 397958 - DNA, 140 bp, Artificial Sequence
  Synthetic
atggccgactcccaagtacgtgcgcagacgacaacatccccacttgtgggaatgactgacacgtccacgcccctgtagaaggcgacagcgttgagtccaagcgtccggagctggccggccggagacccagcatggcgtat

SEQ ID NO: 397959 - DNA, 140 bp, Artificial Sequence
  Synthetic
  misc_feature (22)..(22): n is a, c, g, or t
atacgccatgctgggtctcctnacaatcgagaccaccacagtcccacaggatgctgtggcaaggagtcagaggcgaggccgtactggtagggggaagcatggggtgtataggtacgtctccgtacttgggagtcggccat

SEQ ID NO: 397960 - DNA, 140 bp, Artificial Sequence
  Synthetic
  misc_feature (119)..(119): n is a, c, g, or t
atggccgactcccaagtacggagacgtacctatacaccccatgcttccccctaccagtacggcctcgcctctgactccttgccacagcatcctgtgggactgtggtggtctcgattgtnaggagacccagcatggcgtat

SEQ ID NO: 397961 - DNA, 140 bp, Artificial Sequence
  Synthetic
aggccctggctgctgatatgtcgtcacgagcacctgggtgctggtaggcggagtccttgcggctctggccgcgtactgcttgacaacgggcagcgtggtcattgtgggcaggatcatcttgaccttttgggacagcggtg

SEQ ID NO: 397962 - DNA, 140 bp, Artificial Sequence
  Synthetic
caccgctgtcccaaaaggtcaagatgatcctgcccacaatgaccacgctgcccgttgtcaagcagtacgcggccagagccgcaaggactccgcctaccagcacccaggtgctcgtgacgacatatcagcagccagggcct

SEQ ID NO: 397963 - DNA, 140 bp, Artificial Sequence
  Synthetic
atacgccatgctgggtctccgtcagactacgcgcataccttaacacccctggactgccagtgtgtcaggatcatcttgacttctgggagggcgtcttcacaggcctcactcacatcgacgcgtacttgggagtcggccat

SEQ ID NO: 397964 - DNA, 140 bp, Artificial Sequence
  Synthetic
atggccgactcccaagtacgcgtcgatgtgagtgaggcctgtgaagacgccctcccagaagtcaagatgatcctgacacactggcagtccaggggtgttaaggtatgcgcgtagtctgacggagacccagcatggcgtat

SEQ ID NO: 397965 - DNA, 140 bp, Artificial Sequence
  Synthetic
atacgccatgctgggtctccctgggacactatgtggaagtgcctcacacggctaaagcctatgctcacaggcccaacgcccttgttgtacaggcttggggccgtgcaaaatgagatcacccgtacttgggagtcggccat

SEQ ID NO: 397966 - DNA, 140 bp, Artificial Sequence
  Synthetic
atggccgactcccaagtacgggtgatctcattttgcacggccccaagcctgtacaacaagggcgttgggcctgtgagcataggctttagccgtgtgaggcacttccacatagtgtcccagggagacccagcatggcgtat

SEQ ID NO: 397967 - DNA, 140 bp, Artificial Sequence
  Synthetic
atacgccatgctgggtctcctggcggcctactgcctgtgcgtaggcagcgcagtcatctgcggccgaatcataacttccgggaaaccggcggtgatgccggaccgggagatcttgtatcacgtacttgggagtcggccat

SEQ ID NO: 397968 - DNA, 140 bp, Artificial Sequence
  Synthetic
atggccgactcccaagtacgtgatacaagatctcccggtccggcatcaccgccggtttcccggaagttatgattcggccgcagatgactgcgctgcctacgcacaggcagtaggccgccaggagacccagcatggcgtat

SEQ ID NO: 397969 - DNA, 140 bp, Artificial Sequence
  Synthetic
aggccctggctgctgatatgggatatccagctgattaacaccaacggcagttggcacatcaatcgcacggccttgaactgtaatgcgagcctcgacactggctgggtagcggggctcttcgaccttttgggacagcggtg

SEQ ID NO: 397970 - DNA, 140 bp, Artificial Sequence
  Synthetic
caccgctgtcccaaaaggtcgaagagccccgctacccagccagtgtcgaggctcgcattacagttcaaggccgtgcgattgatgtgccaactgccgttggtgttaatcagctggatatcccatatcagcagccagggcct

SEQ ID NO: 397971 - DNA, 140 bp, Artificial Sequence
  Synthetic
atacgccatgctgggtctcccagaacactgcaaagcaggctgaagagctcaagccggcggttcagtcggcatggccaaagctcgagcagttttggcagaaacacctctggaacttcatcacgtacttgggagtcggccat

SEQ ID NO: 397972 - DNA, 140 bp, Artificial Sequence
  Synthetic
atggccgactcccaagtacgtgatgaagttccagaggtgtttctgccaaaactgctcgagctttggccatgccgactgaaccgccggcttgagctcttcagcctgctttgcagtgttctgggagacccagcatggcgtat

SEQ ID NO: 397973 - DNA, 140 bp, Artificial Sequence
  Synthetic
aggccctggctgctgatatgccttgtggtatcgtgccagcacagagcgtatgtggcccagtgtattgcttcactcccagccccgtggtggtgggaacgaccaacaagttgggcgcgcctagaccttttgggacagcggtg

SEQ ID NO: 397974 - DNA, 140 bp, Artificial Sequence
  Synthetic
caccgctgtcccaaaaggtctaggcgcgcccaacttgttggtcgttcccaccaccacggggctgggagtgaagcaatacactgggccacatacgctctgtgctggcacgataccacaaggcatatcagcagccagggcct

SEQ ID NO: 397975 - DNA, 140 bp, Artificial Sequence
  Synthetic
  misc_feature (34)..(34): n is a, c, g, or t
  misc_feature (78)..(78): n is a, c, g, or t
atacgccatgctgggtctccgtcaaccaccctcntactcaacatcctgggggggtgggtagcgtctcagttggcgccnccctcggcgtccacggcgtttgtcgtgagcggcctagccggtcgtacttgggagtcggccat

SEQ ID NO: 397976 - DNA, 140 bp, Artificial Sequence
  Synthetic
  misc_feature (63)..(63): n is a, c, g, or t
  misc_feature (107)..(107): n is a, c, g, or t
atggccgactcccaagtacgaccggctaggccgctcacgacaaacgccgtggacgccgagggnggcgccaactgagacgctacccacccccccaggatgttgagtangagggtggttgacggagacccagcatggcgtat

SEQ ID NO: 397977 - DNA, 140 bp, Artificial Sequence
  Synthetic
  misc_feature (40)..(40): n is a, c, g, or t
  misc_feature (52)..(52): n is a, c, g, or t
  misc_feature (59)..(59): n is a, c, g, or t
  misc_feature (82)..(82): n is a, c, g, or t
  misc_feature (100)..(100): n is a, c, g, or t
atacgccatgctgggtctccgcggggaggctcctgccctngaggacatggtnaaccttntgcccgccttgttgtcacccggngcgcttgtggtaggcgtngtatgtgccgccgtgttgcgcgtacttgggagtcggccat

SEQ ID NO: 397978 - DNA, 140 bp, Artificial Sequence
  Synthetic
  misc_feature (41)..(41): n is a, c, g, or t
  misc_feature (59)..(59): n is a, c, g, or t
  misc_feature (82)..(82): n is a, c, g, or t
  misc_feature (89)..(89): n is a, c, g, or t
  misc_feature (101)..(101): n is a, c, g, or t
atggccgactcccaagtacgcgcaacacggcggcacatacnacgcctaccacaagcgcnccgggtgacaacaaggcgggcanaaggttnaccatgtcctcnagggcaggagcctccccgcggagacccagcatggcgtat

SEQ ID NO: 397979 - DNA, 140 bp, Artificial Sequence
  Synthetic
atacgccatgctgggtctccgagaccgacgcctccaaggctgtgactaccatactcagctccctgaccataactagcctcctccgtagactccatgagtggataaacggagattggacaacgtacttgggagtcggccat

SEQ ID NO: 397980 - DNA, 140 bp, Artificial Sequence
  Synthetic
atggccgactcccaagtacgttgtccaatctccgtttatccactcatggagtctacggaggaggctagttatggtcagggagctgagtatggtagtcacagccttggaggcgtcggtctcggagacccagcatggcgtat

SEQ ID NO: 397981 - DNA, 140 bp, Artificial Sequence
  Synthetic
atacgccatgctgggtctccaccgggcattcctttcctctcgtgccagcgggggtttaggggtgcctggcggggcgatggcatatgccataccacgtgcccttgtggagcaaacattacgcgtacttgggagtcggccat

SEQ ID NO: 397982 - DNA, 140 bp, Artificial Sequence
  Synthetic
atggccgactcccaagtacgcgtaatgtttgctccacaagggcacgtggtatggcatatgccatcgccccgccaggcacccctaaacccccgctggcacgagaggaaaggaatgcccggtggagacccagcatggcgtat

SEQ ID NO: 397983 - DNA, 140 bp, Artificial Sequence
  Synthetic
aggccctggctgctgatatgttgcagacgcgcgcatctgctcctgcttgtggatgatgctactcatatcccaagcggaggcagctttggagaaccttgtattactcaatgcggcgtctctgaccttttgggacagcggtg

SEQ ID NO: 397984 - DNA, 140 bp, Artificial Sequence
  Synthetic
caccgctgtcccaaaaggtcagagacgccgcattgagtaatacaaggttctccaaagctgcctccgcttgggatatgagtagcatcatccacaagcaggagcagatgcgcgcgtctgcaacatatcagcagccagggcct

SEQ ID NO: 397985 - DNA, 140 bp, Artificial Sequence
  Synthetic
atacgccatgctgggtctccgcgtgcccatcccagagcccaactatcggagggctctgtggagggtgtctgctgaggaatatgtcgaggtcgcccgtgtcaatgactgccattacatagtcgtacttgggagtcggccat

SEQ ID NO: 397986 - DNA, 140 bp, Artificial Sequence
  Synthetic
atggccgactcccaagtacgactatgtaatggcagtcattgacacgggcgacctcgacatattcctcagcagacaccctccacagagccctccgatagttgggctctgggatgggcacgcggagacccagcatggcgtat

SEQ ID NO: 397987 - DNA, 140 bp, Artificial Sequence
  Synthetic
atacgccatgctgggtctcctgccgtccacttatcagggatgaagtcacctttactgtggggttgtccagctacgtcatggggtcccaactcccatgcgagccagaacctgatgtgatggcgtacttgggagtcggccat

SEQ ID NO: 397988 - DNA, 140 bp, Artificial Sequence
  Synthetic
atggccgactcccaagtacgccatcacatcaggttctggctcgcatgggagttgggaccccatgacgtagctggacaaccccacagtaaaggtgacttcatccctgataagtggacggcaggagacccagcatggcgtat

SEQ ID NO: 397989 - DNA, 140 bp, Artificial Sequence
  Synthetic
aggccctggctgctgatatggtgggttccccccctcaacgtccgaggggggcgcgacgctgtcatcctactcatgtgtgttgtgcacccggccttggtatttgacatcaccaagctgctggaccttttgggacagcggtg

SEQ ID NO: 397990 - DNA, 140 bp, Artificial Sequence
  Synthetic
caccgctgtcccaaaaggtccagcagcttggtgatgtcaaataccaaggccgggtgcacaacacacatgagtaggatgacagcgtcgcgcccccctcggacgttgagggggggaacccaccatatcagcagccagggcct

SEQ ID NO: 397991 - DNA, 140 bp, Artificial Sequence
  Synthetic
atacgccatgctgggtctccaagccagctttccgccccatcactgaaggcgacctgtacaacggacgcccaacatcctgacgcggagctgctggaagctaatcttttgtggagacaagagcgtacttgggagtcggccat

SEQ ID NO: 397992 - DNA, 140 bp, Artificial Sequence
  Synthetic
atggccgactcccaagtacgctcttgtctccacaaaagattagcttccagcagctccgcgtcaggatgttgggcgtccgttgtacaggtcgccttcagtgatggggcggaaagctggcttggagacccagcatggcgtat

SEQ ID NO: 397993 - DNA, 140 bp, Artificial Sequence
  Synthetic
atacgccatgctgggtctcccggctgctgagtgtcaccgcccgccgagacaaaaatatccacccgccttgcccatatgggcgaggcctgactacaacccacctttaatagagacctggaacgtacttgggagtcggccat

SEQ ID NO: 397994 - DNA, 140 bp, Artificial Sequence
  Synthetic
atggccgactcccaagtacgttccaggtctctattaaaggtgggttgtagtcaggcctcgcccatatgggcaaggcgggtggatatttttgtctcggcgggcggtgacactcagcagccgggagacccagcatggcgtat

SEQ ID NO: 397995 - DNA, 140 bp, Artificial Sequence
  Synthetic
atacgccatgctgggtctccgatgagtcgtcggcgtcagcggctctcgcagcactggccttcaaggcgtttccacccgacggatcgggctcccaagccgagtctgggaagggtacctctacgtacttgggagtcggccat

SEQ ID NO: 397996 - DNA, 140 bp, Artificial Sequence
  Synthetic
atggccgactcccaagtacgtagaggtacccttcccagactcggcttgggagcccgatccgtcgggtggaaacgccttgaaggccagtgctgcgagagccgctgacgccgacgactcatcggagacccagcatggcgtat

SEQ ID NO: 397997 - DNA, 140 bp, Artificial Sequence
  Synthetic
  misc_feature (114)..(114): n is a, c, g, or t
atacgccatgctgggtctcctcctgacctgagctctggttcatggtctacagtcagtgaggagaccagcgtcgtgtgctgctcaatgtcctactcatggacggggataccagtnacacctcgtacttgggagtcggccat

SEQ ID NO: 397998 - DNA, 140 bp, Artificial Sequence
  Synthetic
  misc_feature (27)..(27): n is a, c, g, or t
atggccgactcccaagtacgaggtgtnactggtatccccgtccatgagtaggacattgagcagcacacgacgctggtctcctcactgactgtagaccatgaaccagagctcaggtcaggaggagacccagcatggcgtat

SEQ ID NO: 397999 - DNA, 140 bp, Artificial Sequence
  Synthetic
  misc_feature (59)..(59): n is a, c, g, or t
  misc_feature (97)..(97): n is a, c, g, or t
  misc_feature (109)..(109): n is a, c, g, or t
atacgccatgctgggtctcctgcgccagaaaaaagtgacttttgaccggctccaggtgntggaccaacattaccaagatgttcttaaggagattaangcccgggcttcngaagtgagtgccgtacttgggagtcggccat

SEQ ID NO: 398000 - DNA, 140 bp, Artificial Sequence
  Synthetic
  misc_feature (32)..(32): n is a, c, g, or t
  misc_feature (44)..(44): n is a, c, g, or t
  misc_feature (82)..(82): n is a, c, g, or t
atggccgactcccaagtacggcactcacttcngaagcccgggcnttaatctccttaagaacatcttggtaatgttggtccancacctggagccggtcaaaagtcacttttttctggcgcaggagacccagcatggcgtat

SEQ ID NO: 398001 - DNA, 140 bp, Artificial Sequence
  Synthetic
atacgccatgctgggtctccaaggccattaaccacatcaactccgtgtgggaggacttgctggaggacagttctacaccaattcctacaacaatcatggctaaaaatgaggtgttttgcgcgtacttgggagtcggccat

SEQ ID NO: 398002 - DNA, 140 bp, Artificial Sequence
  Synthetic
atggccgactcccaagtacgcgcaaaacacctcatttttagccatgattgttgtaggaattggtgtagaactgtcctccagcaagtcctcccacacggagttgatgtggttaatggccttggagacccagcatggcgtat

SEQ ID NO: 398003 - DNA, 140 bp, Artificial Sequence
  Synthetic
atacgccatgctgggtctccccatcacttacgctgggcagcgcggcttggatcagaggccctattgctggcactacgcgcctaaaccgtgcggtattgtacccgcgtcgcaggtgtgtggcgtacttgggagtcggccat

SEQ ID NO: 398004 - DNA, 140 bp, Artificial Sequence
  Synthetic
atggccgactcccaagtacgccacacacctgcgacgcgggtacaataccgcacggtttaggcgcgtagtgccagcaatagggcctctgatccaagccgcgctgcccagcgtaagtgatggggagacccagcatggcgtat

SEQ ID NO: 398005 - DNA, 140 bp, Artificial Sequence
  Synthetic
  misc_feature (27)..(27): n is a, c, g, or t
atacgccatgctgggtctccaaaactncccgtggcgttaatgggagccgcatacggcttccagtactcgcccaagcaaagggtagatcaactcctcaaaatgtggcgctcaaagaagacccgtacttgggagtcggccat

SEQ ID NO: 398006 - DNA, 140 bp, Artificial Sequence
  Synthetic
  misc_feature (114)..(114): n is a, c, g, or t
atggccgactcccaagtacgggtcttctttgagcgccacattttgaggagttgatctaccctttgcttgggcgagtactggaagccgtatgcggctcccattaacgccacgggnagttttggagacccagcatggcgtat

SEQ ID NO: 398007 - DNA, 140 bp, Artificial Sequence
  Synthetic
atacgccatgctgggtctcccggcagcacgcaaagtcatcacttcgctcactgaacggctgtactgcggtggccctatgtacaactctcgaggccaagcatgcgggacgcggagatgcagcgtacttgggagtcggccat

SEQ ID NO: 398008 - DNA, 140 bp, Artificial Sequence
  Synthetic
atggccgactcccaagtacgctgcatctccgcgtcccgcatgcttggcctcgagagttgtacatagggccaccgcagtacagccgttcagtgagcgaagtgatgactttgcgtgctgccgggagacccagcatggcgtat

SEQ ID NO: 398009 - DNA, 140 bp, Artificial Sequence
  Synthetic
  misc_feature (113)..(113): n is a, c, g, or t
  misc_feature (116)..(116): n is a, c, g, or t
  misc_feature (119)..(119): n is a, c, g, or t
atacgccatgctgggtctccttggtctgcggagacgatttggttatcatctcagagagtgtgggcgtgtccgaggacattggagcactgcgagccttcacggaggctatgacnagntantcgtacttgggagtcggccat

SEQ ID NO: 398010 - DNA, 140 bp, Artificial Sequence
  Synthetic
  misc_feature (22)..(22): n is a, c, g, or t
  misc_feature (25)..(25): n is a, c, g, or t
  misc_feature (28)..(28): n is a, c, g, or t
atggccgactcccaagtacgantanctngtcatagcctccgtgaaggctcgcagtgctccaatgtcctcggacacgcccacactctctgagatgataaccaaatcgtctccgcagaccaaggagacccagcatggcgtat

SEQ ID NO: 398011 - DNA, 140 bp, Artificial Sequence
  Synthetic
atacgccatgctgggtctccatactactacctcacaagagaccctaccacaccattggtccgagctgcttgggaaacagcgcggcatactccagtcaattcgtggttgggtaacatcatccgtacttgggagtcggccat

SEQ ID NO: 398012 - DNA, 140 bp, Artificial Sequence
  Synthetic
atggccgactcccaagtacggatgatgttacccaaccacgaattgactggagtatgccgcgctgtttcccaagcagctcggaccaatggtgtggtagggtctcttgtgaggtagtagtatggagacccagcatggcgtat

SEQ ID NO: 398013 - DNA, 140 bp, Artificial Sequence
  Synthetic
atacgccatgctgggtctcctatacggagtcacttactctatcactccactggacttgccacggatcatccagagactccatggcatggccgctttctcactccacggttactccccaggcgtacttgggagtcggccat

SEQ ID NO: 398014 - DNA, 140 bp, Artificial Sequence
  Synthetic
atggccgactcccaagtacgcctggggagtaaccgtggagtgagaaagcggccatgccatggagtctctggatgatccgtggcaagtccagtggagtgatagagtaagtgactccgtataggagacccagcatggcgtat

SEQ ID NO: 398015 - DNA, 140 bp, Artificial Sequence
  Synthetic
atacgccatgctgggtctcccaagggggaaaagccgctgaatgcggcaagtacctctttaattgggcggtgaagacaaagctcaaactcactccactgcgtggtgcaggcaccctcgactcgtacttgggagtcggccat

SEQ ID NO: 398016 - DNA, 140 bp, Artificial Sequence
  Synthetic
atggccgactcccaagtacgagtcgagggtgcctgcaccacgcagtggagtgagtttgagctttgtcttcaccgcccaattaaagaggtacttgccgcattcagcggcttttcccccttgggagacccagcatggcgtat

SEQ ID NO: 398017 - DNA, 140 bp, Artificial Sequence
  Synthetic
atacgccatgctgggtctccagtaggggtagggatctttttgctccctgctcggtaggcagggggcctaaagctacgctccattagcttttcattttttttgccttttttttttttttttcgtacttgggagtcggccat

SEQ ID NO: 398018 - DNA, 140 bp, Artificial Sequence
  Synthetic
atggccgactcccaagtacgaaaaaaaaaaaaaaaaggcaaaaaaaatgaaaagctaatggagcgtagctttaggccccctgcctaccgagcagggagcaaaaagatccctacccctactggagacccagcatggcgtat

SEQ ID NO: 398019 - DNA, 140 bp, Artificial Sequence
  Synthetic
aggccctggctgctgatatgttgagcccgttgtcttctctgacatggagaccaaggtcatcacctggggggcagacaccgcggcgtgtggggacatcatcttgggtctgcccgtctccgcgaccttttgggacagcggtg

SEQ ID NO: 398020 - DNA, 140 bp, Artificial Sequence
  Synthetic
caccgctgtcccaaaaggtcgcggagacgggcagacccaagatgatgtccccacacgccgcggtgtctgccccccaggtgatgaccttggtctccatgtcagagaagacaacgggctcaacatatcagcagccagggcct

SEQ ID NO: 398021 - DNA, 140 bp, Artificial Sequence
  Synthetic
  misc_feature (22)..(22): n is a, c, g, or t
  misc_feature (45)..(45): n is a, c, g, or t
  misc_feature (75)..(75): n is a, c, g, or t
  misc_feature (101)..(101): n is a, c, g, or t
  misc_feature (106)..(106): n is a, c, g, or t
atacgccatgctgggtctcccnccgtcccagcctccaaggtatgnggcccggtgtactgctttaccccgagcccngtggttgtgggaaccaccgacagcangggcnacccaacatacacccgtacttgggagtcggccat

SEQ ID NO: 398022 - DNA, 140 bp, Artificial Sequence
  Synthetic
  misc_feature (35)..(35): n is a, c, g, or t
  misc_feature (40)..(40): n is a, c, g, or t
  misc_feature (66)..(66): n is a, c, g, or t
  misc_feature (96)..(96): n is a, c, g, or t
  misc_feature (119)..(119): n is a, c, g, or t
atggccgactcccaagtacgggtgtatgttgggtngcccntgctgtcggtggttcccacaaccacngggctcggggtaaagcagtacaccgggccncataccttggaggctgggacggngggagacccagcatggcgtat

SEQ ID NO: 398023 - DNA, 140 bp, Artificial Sequence
  Synthetic
aggccctggctgctgatatgactatgcaacagggaatcttcccggttgctccttttctatcttcctcttggcacttctttcgtgcctgactacccctgcctccgcggtgcattatgccaagaccttttgggacagcggtg

SEQ ID NO: 398024 - DNA, 140 bp, Artificial Sequence
  Synthetic
caccgctgtcccaaaaggtcttggcataatgcaccgcggaggcaggggtagtcaggcacgaaagaagtgccaagaggaagatagaaaaggagcaaccgggaagattccctgttgcatagtcatatcagcagccagggcct

SEQ ID NO: 398025 - DNA, 140 bp, Artificial Sequence
  Synthetic
atacgccatgctgggtctccgcacttctttcgtgcctgactacccctgcctccgcggtgcattatgccaacaagtctgggatctatcatctcaccaatgactgtcccaacagcagcatcgcgtacttgggagtcggccat

SEQ ID NO: 398026 - DNA, 140 bp, Artificial Sequence
  Synthetic
atggccgactcccaagtacgcgatgctgctgttgggacagtcattggtgagatgatagatcccagacttgttggcataatgcaccgcggaggcaggggtagtcaggcacgaaagaagtgcggagacccagcatggcgtat

SEQ ID NO: 398027 - DNA, 140 bp, Artificial Sequence
  Synthetic
atacgccatgctgggtctcctgtatgaggcgaaggacatcattctgcacctccctggctgtgtaccttgtgtcaaaactggcaacatcagcaagtgttggacgccggcctcgcccacgttcgtacttgggagtcggccat

SEQ ID NO: 398028 - DNA, 140 bp, Artificial Sequence
  Synthetic
atggccgactcccaagtacgaacgtgggcgaggccggcgtccaacacttgctgatgttgccagttttgacacaaggtacacagccagggaggtgcagaatgatgtccttcgcctcatacaggagacccagcatggcgtat

SEQ ID NO: 398029 - DNA, 140 bp, Artificial Sequence
  Synthetic
atacgccatgctgggtctcctcaccggccacagaatggcgtgggacatgatgatgaattggtcacctaccgccacgttgattacatcctacgtgctgcgcattccccaagtgatcatcgacgtacttgggagtcggccat

SEQ ID NO: 398030 - DNA, 140 bp, Artificial Sequence
  Synthetic
atggccgactcccaagtacgtcgatgatcacttggggaatgcgcagcacgtaggatgtaatcaacgtggcggtaggtgaccaattcatcatcatgtcccacgccattctgtggccggtgaggagacccagcatggcgtat

SEQ ID NO: 398031 - DNA, 140 bp, Artificial Sequence
  Synthetic
atacgccatgctgggtctccggtgtcgacgcatacacccataccatcggggggactacgggccagcaagcatacgggctcgcatccctttttaatccaggggcgaggcagaacatccagccgtacttgggagtcggccat

SEQ ID NO: 398032 - DNA, 140 bp, Artificial Sequence
  Synthetic
atggccgactcccaagtacggctggatgttctgcctcgcccctggattaaaaagggatgcgagcccgtatgcttgctggcccgtagtccccccgatggtatgggtgtatgcgtcgacaccggagacccagcatggcgtat

SEQ ID NO: 398033 - DNA, 140 bp, Artificial Sequence
  Synthetic
atacgccatgctgggtctccgttcaactcctctggttgccctgctcgcctatcatcttgcaaaccgctcactgcgtttggccagggatggggccctataacgtatgccaatataaccggtcgtacttgggagtcggccat

SEQ ID NO: 398034 - DNA, 140 bp, Artificial Sequence
  Synthetic
atggccgactcccaagtacgaccggttatattggcatacgttatagggccccatccctggccaaacgcagtgagcggtttgcaagatgataggcgagcagggcaaccagaggagttgaacggagacccagcatggcgtat

SEQ ID NO: 398035 - DNA, 140 bp, Artificial Sequence
  Synthetic
aggccctggctgctgatatgctgcgtttggccagggatggggccctataacgtatgccaatataaccggttcgtcgcaagacaagccgtattgctggcactatgccccacgaccgtgtacgaccttttgggacagcggtg

SEQ ID NO: 398036 - DNA, 140 bp, Artificial Sequence
  Synthetic
caccgctgtcccaaaaggtcgtacacggtcgtggggcatagtgccagcaatacggcttgtcttgcgacgaaccggttatattggcatacgttatagggccccatccctggccaaacgcagcatatcagcagccagggcct

SEQ ID NO: 398037 - DNA, 140 bp, Artificial Sequence
  Synthetic
atacgccatgctgggtctcctggggtgagaatgagactgacgtgttcatcctagacagcctgcggccgccctccggtgggtggttcggatgcacctggatgaattctacggggttcaccacgtacttgggagtcggccat

SEQ ID NO: 398038 - DNA, 140 bp, Artificial Sequence
  Synthetic
atggccgactcccaagtacgtggtgaaccccgtagaattcatccaggtgcatccgaaccacccaccggagggcggccgcaggctgtctaggatgaacacgtcagtctcattctcaccccaggagacccagcatggcgtat

SEQ ID NO: 398039 - DNA, 140 bp, Artificial Sequence
  Synthetic
aggccctggctgctgatatgctccggtgggtggttcggatgcacctggatgaattctacggggttcaccaagacatgtggggcgcccccctgtatcatcgggccaaaagacaacaactccgaccttttgggacagcggtg

SEQ ID NO: 398040 - DNA, 140 bp, Artificial Sequence
  Synthetic
caccgctgtcccaaaaggtcggagttgttgtcttttggcccgatgatacaggggggcgccccacatgtcttggtgaaccccgtagaattcatccaggtgcatccgaaccacccaccggagcatatcagcagccagggcct

SEQ ID NO: 398041 - DNA, 140 bp, Artificial Sequence
  Synthetic
atacgccatgctgggtctcccctacaggctatggcactatccgtgcaccgtcaattttaccatccacaaggtgcgcattttcctcggagggctcgagcacaggttcgaagctgcatgtaacgtacttgggagtcggccat

SEQ ID NO: 398042 - DNA, 140 bp, Artificial Sequence
  Synthetic
atggccgactcccaagtacgttacatgcagcttcgaacctgtgctcgagccctccgaggaaaatgcgcaccttgtggatggtaaaattgacggtgcacggatagtgccatagcctgtaggggagacccagcatggcgtat

SEQ ID NO: 398043 - DNA, 140 bp, Artificial Sequence
  Synthetic
aggccctggctgctgatatggtgcgcattttcctcggagggctcgagcacaggttcgaagctgcatgtaactggacgcgcggagatcgttgcgagctcgacgatcgtgatcgggttgaaagaccttttgggacagcggtg

SEQ ID NO: 398044 - DNA, 140 bp, Artificial Sequence
  Synthetic
caccgctgtcccaaaaggtctttcaacccgatcacgatcgtcgagctcgcaacgatctccgcgcgtccagttacatgcagcttcgaacctgtgctcgagccctccgaggaaaatgcgcaccatatcagcagccagggcct

SEQ ID NO: 398045 - DNA, 140 bp, Artificial Sequence
  Synthetic
aggccctggctgctgatatgcatagtggatgtccagtatttgtacgggctctccccagtctacgtttcttgggtcatcaagtgggagtacgtagtactcgcattcctactgctggctgacgaccttttgggacagcggtg

SEQ ID NO: 398046 - DNA, 140 bp, Artificial Sequence
  Synthetic
caccgctgtcccaaaaggtcgtcagccagcagtaggaatgcgagtactacgtactcccacttgatgacccaagaaacgtagactggggagagcccgtacaaatactggacatccactatgcatatcagcagccagggcct

SEQ ID NO: 398047 - DNA, 140 bp, Artificial Sequence
  Synthetic
aggccctggctgctgatatgggcggcgctggagaaccttatcgtcctcaacgctgcctcagcagccagtaagtgtggctggggttggtgtcttgtatttctgtgttgtgcctggtacatcgaccttttgggacagcggtg

SEQ ID NO: 398048 - DNA, 140 bp, Artificial Sequence
  Synthetic
caccgctgtcccaaaaggtcgatgtaccaggcacaacacagaaatacaagacaccaaccccagccacacttactggctgctgaggcagcgttgaggacgataaggttctccagcgccgcccatatcagcagccagggcct

SEQ ID NO: 398049 - DNA, 140 bp, Artificial Sequence
  Synthetic
aggccctggctgctgatatgagtgtggctggggttggtgtcttgtatttctgtgttgtgcctggtacatcaagggtaggctcgtgcccgcggctacttatggactgctgcagctgtggccgaccttttgggacagcggtg

SEQ ID NO: 398050 - DNA, 140 bp, Artificial Sequence
  Synthetic
caccgctgtcccaaaaggtcggccacagctgcagcagtccataagtagccgcgggcacgagcctacccttgatgtaccaggcacaacacagaaatacaagacaccaaccccagccacactcatatcagcagccagggcct

SEQ ID NO: 398051 - DNA, 140 bp, Artificial Sequence
  Synthetic
atacgccatgctgggtctcctttaccctgacaccgcattacaagcagttgcttgtgcagctcttggggtggacccaatacttcatagcgcggctagaagccatgctacacgtatgggtcccgtacttgggagtcggccat

SEQ ID NO: 398052 - DNA, 140 bp, Artificial Sequence
  Synthetic
atggccgactcccaagtacgggacccatacgtgtagcatggcttctagccgcgctatgaagtattgggtccaccccaagagctgcacaagcaactgcttgtaatgcggtgtcagggtaaaggagacccagcatggcgtat

SEQ ID NO: 398053 - DNA, 140 bp, Artificial Sequence
  Synthetic
atacgccatgctgggtctcccgggcctttccgtgcggggaggccgtgacgcggtcatcttgctcacctgcctgcttcacccttccctcgggttcgacgtcacaaaagtgctcttggccctcgtacttgggagtcggccat

SEQ ID NO: 398054 - DNA, 140 bp, Artificial Sequence
  Synthetic
atggccgactcccaagtacgagggccaagagcacttttgtgacgtcgaacccgagggaagggtgaagcaggcaggtgagcaagatgaccgcgtcacggcctccccgcacggaaaggcccgggagacccagcatggcgtat

SEQ ID NO: 398055 - DNA, 140 bp, Artificial Sequence
  Synthetic
aggccctggctgctgatatgctgcttcacccttccctcgggttcgacgtcacaaaagtgctcttggccctcctagggccactgtaccttttccaagccagcgtattccgcataccgtattgaccttttgggacagcggtg

SEQ ID NO: 398056 - DNA, 140 bp, Artificial Sequence
  Synthetic
caccgctgtcccaaaaggtcaatacggtatgcggaatacgctggcttggaaaaggtacagtggccctaggagggccaagagcacttttgtgacgtcgaacccgagggaagggtgaagcagcatatcagcagccagggcct

SEQ ID NO: 398057 - DNA, 140 bp, Artificial Sequence
  Synthetic
aggccctggctgctgatatgcgtaggctggccagggggtctcccccctccttggccagctcttcagctagccagttgtctgcgccttccttgaaggcgacatgcactacccatcatgactgaccttttgggacagcggtg

SEQ ID NO: 398058 - DNA, 140 bp, Artificial Sequence
  Synthetic
caccgctgtcccaaaaggtcagtcatgatgggtagtgcatgtcgccttcaaggaaggcgcagacaactggctagctgaagagctggccaaggaggggggagaccccctggccagcctacgcatatcagcagccagggcct

SEQ ID NO: 398059 - DNA, 140 bp, Artificial Sequence
  Synthetic
atacgccatgctgggtctccttggcccagctgatgacgcccgggaatttgggtggaagctactagcccccattactgcataccaccaacagacccgtggcttactggggacaatcgtcaccgtacttgggagtcggccat

SEQ ID NO: 398060 - DNA, 140 bp, Artificial Sequence
  Synthetic
atggccgactcccaagtacggtgacgattgtccccagtaagccacgggtctgttggtggtatgcagtaatgggggctagtagcttccacccaaattcccgggcgtcatcagctgggccaaggagacccagcatggcgtat

SEQ ID NO: 398061 - DNA, 140 bp, Artificial Sequence
  Synthetic
atacgccatgctgggtctcctggaccgtcttccatggtgccggctctaaaacgttggccggcccgaaagggccggtttgccagatgtacaccaatgtagaccaagacttggtagggtggccgtacttgggagtcggccat

SEQ ID NO: 398062 - DNA, 140 bp, Artificial Sequence
  Synthetic
atggccgactcccaagtacggccaccctaccaagtcttggtctacattggtgtacatctggcaaaccggccctttcgggccggccaacgttttagagccggcaccatggaagacggtccaggagacccagcatggcgtat

SEQ ID NO: 398063 - DNA, 140 bp, Artificial Sequence
  Synthetic
atacgccatgctgggtctcccggctccaccgggtgccagatctctgacgccttgcacctgcggcgggtgcgacctctatttagtgacccgcaccgccgatgtcattcccgcgaggcgcagcgtacttgggagtcggccat

SEQ ID NO: 398064 - DNA, 140 bp, Artificial Sequence
  Synthetic
atggccgactcccaagtacgctgcgcctcgcgggaatgacatcggcggtgcgggtcactaaatagaggtcgcacccgccgcaggtgcaaggcgtcagagatctggcacccggtggagccgggagacccagcatggcgtat

SEQ ID NO: 398065 - DNA, 140 bp, Artificial Sequence
  Synthetic
aggccctggctgctgatatggacctctatttagtgacccgcaccgccgatgtcattcccgcgaggcgcagaggtgacactcgtgccagccttctaagccctaggcccttgagttgtcttagaccttttgggacagcggtg

SEQ ID NO: 398066 - DNA, 140 bp, Artificial Sequence
  Synthetic
caccgctgtcccaaaaggtctaagacaactcaagggcctagggcttagaaggctggcacgagtgtcacctctgcgcctcgcgggaatgacatcggcggtgcgggtcactaaatagaggtccatatcagcagccagggcct

SEQ ID NO: 398067 - DNA, 140 bp, Artificial Sequence
  Synthetic
aggccctggctgctgatatgtcccaaaacatccagcttgtaaacaccaacggcagctggcacatcaacaggactgccctgaactgcaatgactccctcaacactgggttccttgccgcgcgaccttttgggacagcggtg

SEQ ID NO: 398068 - DNA, 140 bp, Artificial Sequence
  Synthetic
caccgctgtcccaaaaggtcgcgcggcaaggaacccagtgttgagggagtcattgcagttcagggcagtcctgttgatgtgccagctgccgttggtgtttacaagctggatgttttgggacatatcagcagccagggcct

SEQ ID NO: 398069 - DNA, 140 bp, Artificial Sequence
  Synthetic
aggccctggctgctgatatgtctccatggtggggaactgggcgaaggtcctggtagtgctgctgctatttgccggcgtcgacgcggaaacccacgtcaccgggggaagtgtcgcccgcgcgaccttttgggacagcggtg

SEQ ID NO: 398070 - DNA, 140 bp, Artificial Sequence
  Synthetic
caccgctgtcccaaaaggtcgcgcgggcgacacttcccccggtgacgtgggtttccgcgtcgacgccggcaaatagcagcagcactaccaggaccttcgcccagttccccaccatggagacatatcagcagccagggcct

SEQ ID NO: 398071 - DNA, 140 bp, Artificial Sequence
  Synthetic
atacgccatgctgggtctccgctcgccacggcgacaccgccgggctcggtgacaatcccgcatccgaacatcacagaaacagctctgtccacgacgggggagattcccttctatgggaagcgtacttgggagtcggccat

SEQ ID NO: 398072 - DNA, 140 bp, Artificial Sequence
  Synthetic
atggccgactcccaagtacgcttcccatagaagggaatctcccccgtcgtggacagagctgtttctgtgatgttcggatgcgggattgtcaccgagcccggcggtgtcgccgtggcgagcggagacccagcatggcgtat

SEQ ID NO: 398073 - DNA, 140 bp, Artificial Sequence
  Synthetic
aggccctggctgctgatatgttaatgccgtcgccttctacagaggcgttgacgtggcggtcatccccactagtggggacgttgtcatctgcgccaccgatgcccttatgactggatacacgaccttttgggacagcggtg

SEQ ID NO: 398074 - DNA, 140 bp, Artificial Sequence
  Synthetic
caccgctgtcccaaaaggtcgtgtatccagtcataagggcatcggtggcgcagatgacaacgtccccactagtggggatgaccgccacgtcaacgcctctgtagaaggcgacggcattaacatatcagcagccagggcct

SEQ ID NO: 398075 - DNA, 140 bp, Artificial Sequence
  Synthetic
atacgccatgctgggtctcccaagacgccgtggttagaagccagcggcgtggtcgcacgggcagaggaaaacccgggatatacaggtacgtctcgcagggcgagcgaccgtctggcatgtcgtacttgggagtcggccat

SEQ ID NO: 398076 - DNA, 140 bp, Artificial Sequence
  Synthetic
atggccgactcccaagtacgacatgccagacggtcgctcgccctgcgagacgtacctgtatatcccgggttttcctctgcccgtgcgaccacgccgctggcttctaaccacggcgtcttgggagacccagcatggcgtat

SEQ ID NO: 398077 - DNA, 140 bp, Artificial Sequence
  Synthetic
aggccctggctgctgatatgacccgggatatacaggtacgtctcgcagggcgagcgaccgtctggcatgtttgactccattgtcctctgcgaggcatatgacactggctgtgcctggtatgaccttttgggacagcggtg

SEQ ID NO: 398078 - DNA, 140 bp, Artificial Sequence
  Synthetic
caccgctgtcccaaaaggtcataccaggcacagccagtgtcatatgcctcgcagaggacaatggagtcaaacatgccagacggtcgctcgccctgcgagacgtacctgtatatcccgggtcatatcagcagccagggcct

SEQ ID NO: 398079 - DNA, 140 bp, Artificial Sequence
  Synthetic
atacgccatgctgggtctcctccagggctgcctgtgtgccaggatcatcttgaattctgggagggggtattcactgggctcacgcacattgatgcccacttcctctcacaaacaaaacagcgtacttgggagtcggccat

SEQ ID NO: 398080 - DNA, 140 bp, Artificial Sequence
  Synthetic
atggccgactcccaagtacgctgttttgtttgtgagaggaagtgggcatcaatgtgcgtgagcccagtgaataccccctcccagaattcaagatgatcctggcacacaggcagccctggaggagacccagcatggcgtat

SEQ ID NO: 398081 - DNA, 140 bp, Artificial Sequence
  Synthetic
aggccctggctgctgatatgtcactgggctcacgcacattgatgcccacttcctctcacaaacaaaacaggggggggaaaattttgcgtacctggttgcttaccaggcgaccgtgtgtgcgaccttttgggacagcggtg

SEQ ID NO: 398082 - DNA, 140 bp, Artificial Sequence
  Synthetic
caccgctgtcccaaaaggtcgcacacacggtcgcctggtaagcaaccaggtacgcaaaattttcccccccctgttttgtttgtgagaggaagtgggcatcaatgtgcgtgagcccagtgacatatcagcagccagggcct

SEQ ID NO: 398083 - DNA, 140 bp, Artificial Sequence
  Synthetic
aggccctggctgctgatatgcatgacctgtatgtctgctgacctcgaggtgataactagcatgtgggttctcgcaggtgggatcatggccgctctggcagcgtactgcctcaccatgggcgaccttttgggacagcggtg

SEQ ID NO: 398084 - DNA, 140 bp, Artificial Sequence
  Synthetic
caccgctgtcccaaaaggtcgcccatggtgaggcagtacgctgccagagcggccatgatcccacctgcgagaacccacatgctagttatcacctcgaggtcagcagacatacaggtcatgcatatcagcagccagggcct

SEQ ID NO: 398085 - DNA, 140 bp, Artificial Sequence
  Synthetic
atacgccatgctgggtctcccacagcgcataccctacctcgtcgagggacagcacctggcagagcagttcaagcagaagatcatgggcctgctacaaagtacagcgaagcaggccgaggacgtacttgggagtcggccat

SEQ ID NO: 398086 - DNA, 140 bp, Artificial Sequence
  Synthetic
atggccgactcccaagtacgtcctcggcctgcttcgctgtactttgtagcaggcccatgatcttctgcttgaactgctctgccaggtgctgtccctcgacgaggtagggtatgcgctgtgggagacccagcatggcgtat

SEQ ID NO: 398087 - DNA, 140 bp, Artificial Sequence
  Synthetic
  misc_feature (120)..(120): n is a, c, g, or t
aggccctggctgctgatatgaagcagaagatcatgggcctgctacaaagtacagcgaagcaggccgaggacctcaagccagcggtgcactctgcctggcccaaagtcgaacagttctggngaccttttgggacagcggtg

SEQ ID NO: 398088 - DNA, 140 bp, Artificial Sequence
  Synthetic
  misc_feature (21)..(21): n is a, c, g, or t
caccgctgtcccaaaaggtcnccagaactgttcgactttgggccaggcagagtgcaccgctggcttgaggtcctcggcctgcttcgctgtactttgtagcaggcccatgatcttctgcttcatatcagcagccagggcct

SEQ ID NO: 398089 - DNA, 140 bp, Artificial Sequence
  Synthetic
  misc_feature (96)..(96): n is a, c, g, or t
atacgccatgctgggtctccggccttgactagcccactggcgacctcaacgaccctcctccttaacatcttaggaggatgggtggcgtctcagctngcgccaccttcagcctccacggctcgtacttgggagtcggccat

SEQ ID NO: 398090 - DNA, 140 bp, Artificial Sequence
  Synthetic
  misc_feature (45)..(45): n is a, c, g, or t
atggccgactcccaagtacgagccgtggaggctgaaggtggcgcnagctgagacgccacccatcctcctaagatgttaaggaggagggtcgttgaggtcgccagtgggctagtcaaggccggagacccagcatggcgtat

SEQ ID NO: 398091 - DNA, 140 bp, Artificial Sequence
  Synthetic
atacgccatgctgggtctcccaaggtcatcgtggacatcttggccggctacggggcgggtgtctctggtgctttggtggccttcaagatcatgagtggagaggcgccagcaatcgaagaccgtacttgggagtcggccat

SEQ ID NO: 398092 - DNA, 140 bp, Artificial Sequence
  Synthetic
atggccgactcccaagtacggtcttcgattgctggcgcctctccactcatgatcttgaaggccaccaaagcaccagagacacccgccccgtagccggccaagatgtccacgatgaccttgggagacccagcatggcgtat

SEQ ID NO: 398093 - DNA, 140 bp, Artificial Sequence
  Synthetic
atacgccatgctgggtctccggcgtcgacgcggaaacgcacgtcaccgggggaagtgccgcccgcgacgcggctacattcgcaaggctcttctcagtaggcgccaagcagaacatccagccgtacttgggagtcggccat

SEQ ID NO: 398094 - DNA, 140 bp, Artificial Sequence
  Synthetic
atggccgactcccaagtacggctggatgttctgcttggcgcctactgagaagagccttgcgaatgtagccgcgtcgcgggcggcacttcccccggtgacgtgcgtttccgcgtcgacgccggagacccagcatggcgtat

SEQ ID NO: 398095 - DNA, 140 bp, Artificial Sequence
  Synthetic
aggccctggctgctgatatgctgctcagtggatgaacaggctcatagcgttcgcctctaggggcaaccacgtgtcacccacgcactatgtgcccgagacggacgcctctcgagccgtcacgaccttttgggacagcggtg

SEQ ID NO: 398096 - DNA, 140 bp, Artificial Sequence
  Synthetic
caccgctgtcccaaaaggtcgtgacggctcgagaggcgtccgtctcgggcacatagtgcgtgggtgacacgtggttgcccctagaggcgaacgctatgagcctgttcatccactgagcagcatatcagcagccagggcct

SEQ ID NO: 398097 - DNA, 140 bp, Artificial Sequence
  Synthetic
aggccctggctgctgatatgcaaagccaagctcgtgccctccctgccgggcattcccttcttctcgtgccaacgggggtttaggggagtctggcgcggagatggcgtatgttacaccaccgaccttttgggacagcggtg

SEQ ID NO: 398098 - DNA, 140 bp, Artificial Sequence
  Synthetic
caccgctgtcccaaaaggtcggtggtgtaacatacgccatctccgcgccagactcccctaaacccccgttggcacgagaagaagggaatgcccggcagggagggcacgagcttggctttgcatatcagcagccagggcct

SEQ ID NO: 398099 - DNA, 140 bp, Artificial Sequence
  Synthetic
aggccctggctgctgatatgcgtacggctctgtggagggtgtccgctgaggattacgtcgaggttatgcgtattaatgactgccactacgtggtgggggccacggctgacaacttgaagtgaccttttgggacagcggtg

SEQ ID NO: 398100 - DNA, 140 bp, Artificial Sequence
  Synthetic
caccgctgtcccaaaaggtcacttcaagttgtcagccgtggcccccaccacgtagtggcagtcattaatacgcataacctcgacgtaatcctcagcggacaccctccacagagccgtacgcatatcagcagccagggcct

SEQ ID NO: 398101 - DNA, 140 bp, Artificial Sequence
  Synthetic
aggccctggctgctgatatggtgaaccagagcccgatgttgtgacggtcacctccatgctcgttgacccagcccatatcacggcggagtcggcacgccgacgtcttaatcggggctccccgaccttttgggacagcggtg

SEQ ID NO: 398102 - DNA, 140 bp, Artificial Sequence
  Synthetic
caccgctgtcccaaaaggtcggggagccccgattaagacgtcggcgtgccgactccgccgtgatatgggctgggtcaacgagcatggaggtgaccgtcacaacatcgggctctggttcaccatatcagcagccagggcct

SEQ ID NO: 398103 - DNA, 140 bp, Artificial Sequence
  Synthetic
aggccctggctgctgatatggccaacctgctttggcgccaggaggtcggaggtaacatcacgcgggtcgagtctgagaacaaggtcatagttctcgactcgttcgaccccctggtagcgggaccttttgggacagcggtg

SEQ ID NO: 398104 - DNA, 140 bp, Artificial Sequence
  Synthetic
caccgctgtcccaaaaggtcccgctaccagggggtcgaacgagtcgagaactatgaccttgttctcagactcgacccgcgtgatgttacctccgacctcctggcgccaaagcaggttggccatatcagcagccagggcct

SEQ ID NO: 398105 - DNA, 140 bp, Artificial Sequence
  Synthetic
  misc_feature (37)..(37): n is a, c, g, or t
  misc_feature (82)..(82): n is a, c, g, or t
  misc_feature (88)..(88): n is a, c, g, or t
atacgccatgctgggtctccaggtggatgacaggganatctctacggcggccgagtgccacaggccgcctagacctaaatanccaccngcgttgcccatatgggcaaggcctgactacaacgtacttgggagtcggccat

SEQ ID NO: 398106 - DNA, 140 bp, Artificial Sequence
  Synthetic
  misc_feature (53)..(53): n is a, c, g, or t
  misc_feature (59)..(59): n is a, c, g, or t
  misc_feature (104)..(104): n is a, c, g, or t
atggccgactcccaagtacgttgtagtcaggccttgcccatatgggcaacgcnggtggntatttaggtctaggcggcctgtggcactcggccgccgtagagatntccctgtcatccacctggagacccagcatggcgtat

SEQ ID NO: 398107 - DNA, 140 bp, Artificial Sequence
  Synthetic
  misc_feature (23)..(23): n is a, c, g, or t
aggccctggctgctgatatgcgnaggaagaaggtcgtgcaacttgatgactcagctgctgcagctgcgctcgcagagcttgctcgcaagagctttccaccagaaccattagactcacagggaccttttgggacagcggtg

SEQ ID NO: 398108 - DNA, 140 bp, Artificial Sequence
  Synthetic
  misc_feature (118)..(118): n is a, c, g, or t
caccgctgtcccaaaaggtccctgtgagtctaatggttctggtggaaagctcttgcgagcaagctctgcgagcgcagctgcagcagctgagtcatcaagttgcacgaccttcttcctncgcatatcagcagccagggcct

SEQ ID NO: 398109 - DNA, 140 bp, Artificial Sequence
  Synthetic
  misc_feature (96)..(96): n is a, c, g, or t
  misc_feature (100)..(100): n is a, c, g, or t
atacgccatgctgggtctccgccacttgagggagagccgggagacccagacctcagttcggggtcgtggtctacggttagtgaggagggcgacagngtgntctgctgctcctactcatatcgtacttgggagtcggccat

SEQ ID NO: 398110 - DNA, 140 bp, Artificial Sequence
  Synthetic
  misc_feature (41)..(41): n is a, c, g, or t
  misc_feature (45)..(45): n is a, c, g, or t
atggccgactcccaagtacgatatgagtaggagcagcagancacnctgtcgccctcctcactaaccgtagaccacgaccccgaactgaggtctgggtctcccggctctccctcaagtggcggagacccagcatggcgtat

SEQ ID NO: 398111 - DNA, 140 bp, Artificial Sequence
  Synthetic
aggccctggctgctgatatgcgtgtgggaggacttgctggaagacagttccacacctatacctacaaccattatggctaagaatgaggtgttctgcgtggaccccaggaagggtggtcgtgaccttttgggacagcggtg

SEQ ID NO: 398112 - DNA, 140 bp, Artificial Sequence
  Synthetic
caccgctgtcccaaaaggtcacgaccacccttcctggggtccacgcagaacacctcattcttagccataatggttgtaggtataggtgtggaactgtcttccagcaagtcctcccacacgcatatcagcagccagggcct

SEQ ID NO: 398113 - DNA, 140 bp, Artificial Sequence
  Synthetic
aggccctggctgctgatatgaaagaaggccttgtacgacataactcagaagctgcccaaggcggttatgggaccatcatatgggttccagtactcgccgaaacaacgggtggattacctcgaccttttgggacagcggtg

SEQ ID NO: 398114 - DNA, 140 bp, Artificial Sequence
  Synthetic
caccgctgtcccaaaaggtcgaggtaatccacccgttgtttcggcgagtactggaacccatatgatggtcccataaccgccttgggcagcttctgagttatgtcgtacaaggccttctttcatatcagcagccagggcct

SEQ ID NO: 398115 - DNA, 140 bp, Artificial Sequence
  Synthetic
atacgccatgctgggtctccacatctatgcgtgctgcaaactagaccctgcagcacgcaaagccatcacagcactcaccgagcggctgtattgcggtggccctatgttcaactccaagggcgtacttgggagtcggccat

SEQ ID NO: 398116 - DNA, 140 bp, Artificial Sequence
  Synthetic
atggccgactcccaagtacgcccttggagttgaacatagggccaccgcaatacagccgctcggtgagtgctgtgatggctttgcgtgctgcagggtctagtttgcagcacgcatagatgtggagacccagcatggcgtat

SEQ ID NO: 398117 - DNA, 140 bp, Artificial Sequence
  Synthetic
aggccctggctgctgatatggaccgtcttggggcccaaatgatccccggcggaggtcccgcaatttgggtaaggtcatcgataccctaacctgcggcttcgccgacctcatgggatacatgaccttttgggacagcggtg

SEQ ID NO: 398118 - DNA, 140 bp, Artificial Sequence
  Synthetic
caccgctgtcccaaaaggtcatgtatcccatgaggtcggcgaagccgcaggttagggtatcgatgaccttacccaaattgcgggacctccgccggggatcatttgggccccaagacggtccatatcagcagccagggcct

SEQ ID NO: 398119 - DNA, 140 bp, Artificial Sequence
  Synthetic
atacgccatgctgggtctccccttcacggaggctatgaccagatactcggctcctccgggggacgaaccgcacccagaatacgacctggagctgataacatcatgctcatcaaacgtatccgtacttgggagtcggccat

SEQ ID NO: 398120 - DNA, 140 bp, Artificial Sequence
  Synthetic
atggccgactcccaagtacggatacgtttgatgagcatgatgttatcagctccaggtcgtattctgggtgcggttcgtcccccggaggagccgagtatctggtcatagcctccgtgaaggggagacccagcatggcgtat

SEQ ID NO: 398121 - DNA, 140 bp, Artificial Sequence
  Synthetic
atacgccatgctgggtctccctgtctttccctagtcttggtgtcaggcaagtgctcaaagtcaggataagcaaactctccttcctgggactctgaggaaaggctcattgatgggggaaatcgtacttgggagtcggccat

SEQ ID NO: 398122 - DNA, 140 bp, Artificial Sequence
  Synthetic
atggccgactcccaagtacgatttcccccatcaatgagcctttcctcagagtcccaggaaggagagtttgcttatcctgactttgagcacttgcctgacaccaagactagggaaagacagggagacccagcatggcgtat

SEQ ID NO: 398123 - DNA, 140 bp, Artificial Sequence
  Synthetic
atacgccatgctgggtctccagggcggtcagagctaagcttatcgctcaaggaggaaaagccgctatatgtggcaagtacctcttcaattgggcggtgagaaccaagctcaaactcactccgtacttgggagtcggccat

SEQ ID NO: 398124 - DNA, 140 bp, Artificial Sequence
  Synthetic
atggccgactcccaagtacggagtgagtttgagcttggttctcaccgcccaattgaagaggtacttgccacatatagcggcttttcctccttgagcgataagcttagctctgaccgccctggagacccagcatggcgtat

SEQ ID NO: 398125 - DNA, 140 bp, Artificial Sequence
  Synthetic
aggccctggctgctgatatggatagatcagagcttagcccgctgctgctgtctacaacagagtggcaggtattgccctgttccttcaccaccctaccggctctgtccaccggtttgatccgaccttttgggacagcggtg

SEQ ID NO: 398126 - DNA, 140 bp, Artificial Sequence
  Synthetic
caccgctgtcccaaaaggtcggatcaaaccggtggacagagccggtagggtggtgaaggaacagggcaatacctgccactctgttgtagacagcagcagcgggctaagctctgatctatccatatcagcagccagggcct

SEQ ID NO: 398127 - DNA, 140 bp, Artificial Sequence
  Synthetic
atacgccatgctgggtctcccgtcaagttcccgggcggcggccagatcgttggtggagtttacttgttgccgcgcaggggcccgcgtttgggtgtgcgcgcgacgaggaagacttcagaacgtacttgggagtcggccat

SEQ ID NO: 398128 - DNA, 140 bp, Artificial Sequence
  Synthetic
atggccgactcccaagtacgttctgaagtcttcctcgtcgcgcgcacacccaaacgcgggcccctgcgcggcaacaagtaaactccaccaacgatctggccgccgcccgggaacttgacgggagacccagcatggcgtat

SEQ ID NO: 398129 - DNA, 140 bp, Artificial Sequence
  Synthetic
aggccctggctgctgatatgggtcaccgtgccacaccccaacatcgaggaggtggccctgtccaacactggagaggtccccttctatggcaaagccatccccattgagaccatcaagggggaccttttgggacagcggtg

SEQ ID NO: 398130 - DNA, 140 bp, Artificial Sequence
  Synthetic
caccgctgtcccaaaaggtcccccttgatggtctcaatggggatggctttgccatagaaggggacctctccagtgttggacagggccacctcctcgatgttggggtgtggcacggtgacccatatcagcagccagggcct

SEQ ID NO: 398131 - DNA, 140 bp, Artificial Sequence
  Synthetic
atacgccatgctgggtctccacgagggctgtggctgggcggggtggctcctgtccccccgcggctctcgcccacattggggccccaatgacccccggcggaggtctcgcaatctgggtaacgtacttgggagtcggccat

SEQ ID NO: 398132 - DNA, 140 bp, Artificial Sequence
  Synthetic
atggccgactcccaagtacgttacccagattgcgagacctccgccgggggtcattggggccccaatgtgggcgagagccgcggggggacaggagccaccccgcccagccacagccctcgtggagacccagcatggcgtat

SEQ ID NO: 398133 - DNA, 140 bp, Artificial Sequence
  Synthetic
aggccctggctgctgatatgtcttgctcgccatactcggcccgctcatggtgctccaggctggcataaccagggtgccgtacttcgtgcgcgcccatgggctcattcgtgcatgcatgctgaccttttgggacagcggtg

SEQ ID NO: 398134 - DNA, 140 bp, Artificial Sequence
  Synthetic
caccgctgtcccaaaaggtcagcatgcatgcacgaatgagcccatgggcgcgcacgaagtacggcaccctggttatgccagcctggagcaccatgagcgggccgagtatggcgagcaagacatatcagcagccagggcct

SEQ ID NO: 398135 - DNA, 140 bp, Artificial Sequence
  Synthetic
atacgccatgctgggtctccgttggacaccggcctcgcccacgttggcggtcccgaacgcgtcaacgcctgtgcgggggtttcgcgatcacgtggacctcctggtgggcgcggctacgttcgtacttgggagtcggccat

SEQ ID NO: 398136 - DNA, 140 bp, Artificial Sequence
  Synthetic
atggccgactcccaagtacgaacgtagccgcgcccaccaggaggtccacgtgatcgcgaaacccccgcacaggcgttgacgcgttcgggaccgccaacgtgggcgaggccggtgtccaacggagacccagcatggcgtat

SEQ ID NO: 398137 - DNA, 140 bp, Artificial Sequence
  Synthetic
atacgccatgctgggtctccccgacacggaggatgtcgtgtgctgctcaatgtcttatacctggacaggcgcactcgtcaccccgtgcgccgcggaggaacaaaaactgcccatcaacgccgtacttgggagtcggccat

SEQ ID NO: 398138 - DNA, 140 bp, Artificial Sequence
  Synthetic
atggccgactcccaagtacggcgttgatgggcagtttttgttcctccgcggcgcacggggtgacgagtgcgcctgtccaggtataagacattgagcagcacacgacatcctccgtgtcggggagacccagcatggcgtat

SEQ ID NO: 398139 - DNA, 140 bp, Artificial Sequence
  Synthetic
atacgccatgctgggtctccaactgctccatctacgctggccacgtcaccggccaccgaatggcatgggacatgatgatgaattggtcacccaccgccacgttggccgtgtcgtacatgccgtacttgggagtcggccat

SEQ ID NO: 398140 - DNA, 140 bp, Artificial Sequence
  Synthetic
atggccgactcccaagtacggcatgtacgacacggccaacgtggcggtgggtgaccaattcatcatcatgtcccatgccattcggtggccggtgacgtggccagcgtagatggagcagttggagacccagcatggcgtat

SEQ ID NO: 398141 - DNA, 140 bp, Artificial Sequence
  Synthetic
  misc_feature (105)..(105): n is a, c, g, or t
atacgccatgctgggtctcctatcgccatcttgttgctgttcactggcgtggacgcagagacccgcaccgtcggggcgtctgcgggccgtacgacacaagggttngcatctctctttacccgtacttgggagtcggccat

SEQ ID NO: 398142 - DNA, 140 bp, Artificial Sequence
  Synthetic
  misc_feature (36)..(36): n is a, c, g, or t
atggccgactcccaagtacgggtaaagagagatgcnaacccttgtgtcgtacggcccgcagacgccccgacggtgcgggtctctgcgtccacgccagtgaacagcaacaagatggcgataggagacccagcatggcgtat

SEQ ID NO: 398143 - DNA, 140 bp, Artificial Sequence
  Synthetic
aggccctggctgctgatatgtgggcaggatggctcctgtcaccccgtggctcccggcctagttggggccccacagacccccggcgtaggtcgcgcaatttgggtaaggtcatcgatacccgaccttttgggacagcggtg

SEQ ID NO: 398144 - DNA, 140 bp, Artificial Sequence
  Synthetic
caccgctgtcccaaaaggtcgggtatcgatgaccttacccaaattgcgcgacctacgccgggggtctgtggggccccaactaggccgggagccacggggtgacaggagccatcctgcccacatatcagcagccagggcct

SEQ ID NO: 398145 - DNA, 140 bp, Artificial Sequence
  Synthetic
  misc_feature (37)..(37): n is a, c, g, or t
  misc_feature (100)..(100): n is a, c, g, or t
  misc_feature (105)..(105): n is a, c, g, or t
atacgccatgctgggtctcctgacagcgctgttctanagccacaaattcaactcctctggttgtcctgagcgcttatcatcttgcaagccgctcactgcntttgnccaggggtggggccccgtacttgggagtcggccat

SEQ ID NO: 398146 - DNA, 140 bp, Artificial Sequence
  Synthetic
  misc_feature (36)..(36): n is a, c, g, or t
  misc_feature (41)..(41): n is a, c, g, or t
  misc_feature (104)..(104): n is a, c, g, or t
atggccgactcccaagtacggggccccacccctggncaaangcagtgagcggcttgcaagatgataagcgctcaggacaaccagaggagttgaatttgtggctntagaacagcgctgtcaggagacccagcatggcgtat

SEQ ID NO: 398147 - DNA, 140 bp, Artificial Sequence
  Synthetic
aggccctggctgctgatatggtctcctacttgaagggctcttcgggtggtccactgctctgcccctcggggcacgctgtgggcatcttccgggctgctgtgtgcacccggggggttgcgagaccttttgggacagcggtg

SEQ ID NO: 398148 - DNA, 140 bp, Artificial Sequence
  Synthetic
caccgctgtcccaaaaggtctcgcaaccccccgggtgcacacagcagcccggaagatgcccacagcgtgccccgaggggcagagcagtggaccacccgaagagcccttcaagtaggagaccatatcagcagccagggcct

SEQ ID NO: 398149 - DNA, 140 bp, Artificial Sequence
  Synthetic
atacgccatgctgggtctccggccctgtctattgcttcaccccaagtccggttgtggtggggaccactgatcggaaggggaacccaacgtacacctggggtgagaatgagaccgacgtgtcgtacttgggagtcggccat

SEQ ID NO: 398150 - DNA, 140 bp, Artificial Sequence
  Synthetic
atggccgactcccaagtacgacacgtcggtctcattctcaccccaggtgtacgttgggttccccttccgatcagtggtccccaccacaaccggacttggggtgaagcaatagacagggccggagacccagcatggcgtat

SEQ ID NO: 398151 - DNA, 140 bp, Artificial Sequence
  Synthetic
atacgccatgctgggtctcctggatgaattcctcggggttcaccaagacgtgcggggcgcccccttgtaacatcgggccaagaggcaacaacaccctcgtctgccccaccgactgtttcccgtacttgggagtcggccat

SEQ ID NO: 398152 - DNA, 140 bp, Artificial Sequence
  Synthetic
atggccgactcccaagtacgggaaacagtcggtggggcagacgagggtgttgttgcctcttggcccgatgttacaagggggcgccccgcacgtcttggtgaaccccgaggaattcatccaggagacccagcatggcgtat

SEQ ID NO: 398153 - DNA, 140 bp, Artificial Sequence
  Synthetic
aggccctggctgctgatatgggcgcctatgacatcataatatgtgatgagtgccactcaactgactcgaccaccatcttgggcatcggcacagtcctggaccaagcggagacggctggaggaccttttgggacagcggtg

SEQ ID NO: 398154 - DNA, 140 bp, Artificial Sequence
  Synthetic
caccgctgtcccaaaaggtcctccagccgtctccgcttggtccaggactgtgccgatgcccaagatggtggtcgagtcagttgagtggcactcatcacatattatgatgtcataggcgcccatatcagcagccagggcct

SEQ ID NO: 398155 - DNA, 140 bp, Artificial Sequence
  Synthetic
aggccctggctgctgatatgcaccgtcaactttaccatccacaaggtgcgcattttccttggagggctcgagcacaggttcgaggcagcatgtaactggacacgcggggaacgttgcgaggaccttttgggacagcggtg

SEQ ID NO: 398156 - DNA, 140 bp, Artificial Sequence
  Synthetic
caccgctgtcccaaaaggtcctcgcaacgttccccgcgtgtccagttacatgctgcctcgaacctgtgctcgagccctccaaggaaaatgcgcaccttgtggatggtaaagttgacggtgcatatcagcagccagggcct

SEQ ID NO: 398157 - DNA, 140 bp, Artificial Sequence
  Synthetic
atacgccatgctgggtctccctggtttgatacatctccatcagaacatagtggatgtccagtacttgtacgggatctccccagcctacatttcttgggtcatcaaatgggagtacgtagtcgtacttgggagtcggccat

SEQ ID NO: 398158 - DNA, 140 bp, Artificial Sequence
  Synthetic
atggccgactcccaagtacgactacgtactcccatttgatgacccaagaaatgtaggctggggagatcccgtacaagtactggacatccactatgttctgatggagatgtatcaaaccagggagacccagcatggcgtat

SEQ ID NO: 398159 - DNA, 140 bp, Artificial Sequence
  Synthetic
atacgccatgctgggtctcctgatgttactcataggccaggctgaggcggcgctggagaacctcatcgttctcaacgccgcctcggcagccagtaagtgtggctggggttggtgtcttgtcgtacttgggagtcggccat

SEQ ID NO: 398160 - DNA, 140 bp, Artificial Sequence
  Synthetic
atggccgactcccaagtacgacaagacaccaaccccagccacacttactggctgccgaggcggcgttgagaacgatgaggttctccagcgccgcctcagcctggcctatgagtaacatcaggagacccagcatggcgtat

SEQ ID NO: 398161 - DNA, 140 bp, Artificial Sequence
  Synthetic
atacgccatgctgggtctccgtttctgtgttgtgcttggtacatcaagggtaggctcgtgcccggggtcacttatggactgctgcagctgtggccgctcctgctccttgtattggcgttgcgtacttgggagtcggccat

SEQ ID NO: 398162 - DNA, 140 bp, Artificial Sequence
  Synthetic
atggccgactcccaagtacgcaacgccaatacaaggagcaggagcggccacagctgcagcagtccataagtgaccccgggcacgagcctacccttgatgtaccaagcacaacacagaaacggagacccagcatggcgtat

SEQ ID NO: 398163 - DNA, 140 bp, Artificial Sequence
  Synthetic
atacgccatgctgggtctccagttgcttgtacagctcatgtggtggacccaatacttcatagcgcggatggaagctgcgctacaagtatgggtcccgagcctctccgtacgggggggtcgcgtacttgggagtcggccat

SEQ ID NO: 398164 - DNA, 140 bp, Artificial Sequence
  Synthetic
atggccgactcccaagtacgcgacccccccgtacggagaggctcgggacccatacttgtagcgcagcttccatccgcgctatgaagtattgggtccaccacatgagctgtacaagcaactggagacccagcatggcgtat

SEQ ID NO: 398165 - DNA, 140 bp, Artificial Sequence
  Synthetic
  misc_feature (106)..(106): n is a, c, g, or t
atacgccatgctgggtctccatgtcacaaaggtacttttggccctcctagggccactataccttttccaagccagcctactccgcataccatattacgtgcgagcncacgcccttctgcgcgtacttgggagtcggccat

SEQ ID NO: 398166 - DNA, 140 bp, Artificial Sequence
  Synthetic
  misc_feature (35)..(35): n is a, c, g, or t
atggccgactcccaagtacgcgcagaagggcgtgngctcgcacgtaatatggtatgcggagtaggctggcttggaaaaggtatagtggccctaggagggccaaaagtacctttgtgacatggagacccagcatggcgtat

SEQ ID NO: 398167 - DNA, 140 bp, Artificial Sequence
  Synthetic
aggccctggctgctgatatgcggcggagatcctgcggaaatccaggaaattcccccgagcgatacccatatgggcacggccggattacaaccctccgctgctagagtcctggaaagatccgaccttttgggacagcggtg

SEQ ID NO: 398168 - DNA, 140 bp, Artificial Sequence
  Synthetic
caccgctgtcccaaaaggtcggatctttccaggactctagcagcggagggttgtaatccggccgtgcccatatgggtatcgctcgggggaatttcctggatttccgcaggatctccgccgcatatcagcagccagggcct

SEQ ID NO: 398169 - DNA, 140 bp, Artificial Sequence
  Synthetic
atacgccatgctgggtctccccttgggtggaagttgctagcccccatcactgcataccatcagcagacccgtggcttgctagggacgatcgtcactagcctcacgggccgtgacaaaaaccgtacttgggagtcggccat

SEQ ID NO: 398170 - DNA, 140 bp, Artificial Sequence
  Synthetic
atggccgactcccaagtacggtttttgtcacggcccgtgaggctagtgacgatcgtccctagcaagccacgggtctgctgatggtatgcagtgatgggggctagcaacttccacccaaggggagacccagcatggcgtat

SEQ ID NO: 398171 - DNA, 140 bp, Artificial Sequence
  Synthetic
aggccctggctgctgatatgctaagacgttggccggcccgaaagggccggtttgccagatgtacaccaatgtagaccaagacttggtggggtggccggctccaccgggtgccagatctctgaccttttgggacagcggtg

SEQ ID NO: 398172 - DNA, 140 bp, Artificial Sequence
  Synthetic
caccgctgtcccaaaaggtcagagatctggcacccggtggagccggccaccccaccaagtcttggtctacattggtgtacatctggcaaaccggccctttcgggccggccaacgtcttagcatatcagcagccagggcct

SEQ ID NO: 398173 - DNA, 140 bp, Artificial Sequence
  Synthetic
aggccctggctgctgatatggacgccttgcacctgcggcgggtgcgacctttatttggtgacccgcaccgccgatgtcattccagcgaggcgcaggggtgacactcgtgccagtctcctagaccttttgggacagcggtg

SEQ ID NO: 398174 - DNA, 140 bp, Artificial Sequence
  Synthetic
caccgctgtcccaaaaggtctaggagactggcacgagtgtcacccctgcgcctcgctggaatgacatcggcggtgcgggtcaccaaataaaggtcgcacccgccgcaggtgcaaggcgtccatatcagcagccagggcct

SEQ ID NO: 398175 - DNA, 140 bp, Artificial Sequence
  Synthetic
atacgccatgctgggtctccgaggtgttgctaaggcaattgatttcgtgcctgtggagaatatggagaccacaatgaggtccccatcattcactgacaactcgtctccccccgcagtacccgtacttgggagtcggccat

SEQ ID NO: 398176 - DNA, 140 bp, Artificial Sequence
  Synthetic
atggccgactcccaagtacgggtactgcggggggagacgagttgtcagtgaatgatggggacctcattgtggtctccatattctccacaggcacgaaatcaattgccttagcaacacctcggagacccagcatggcgtat

SEQ ID NO: 398177 - DNA, 140 bp, Artificial Sequence
  Synthetic
atacgccatgctgggtctccacgcgaaaacctacgtcaccgggggaagtgccgggcacaccacggctggatttactagtctattcagacaaggccccaagcagaacatccaactgatcaacgtacttgggagtcggccat

SEQ ID NO: 398178 - DNA, 140 bp, Artificial Sequence
  Synthetic
atggccgactcccaagtacgttgatcagttggatgttctgcttggggccttgtctgaatagactagtaaatccagccgtggtgtgcccggcacttcccccggtgacgtaggttttcgcgtggagacccagcatggcgtat

SEQ ID NO: 398179 - DNA, 140 bp, Artificial Sequence
  Synthetic
  misc_feature (52)..(52): n is a, c, g, or t
atacgccatgctgggtctccccggaggggccattacatactcaacatatggnaaatttttggcagatggggggtgctctggaggggcttatgacgtcatcatatgtgacgaatgccactccgtacttgggagtcggccat

SEQ ID NO: 398180 - DNA, 140 bp, Artificial Sequence
  Synthetic
  misc_feature (89)..(89): n is a, c, g, or t
atggccgactcccaagtacggagtggcattcgtcacatatgatgacgtcataagcccctccagagcaccccccatctgccaaaaatttnccatatgttgagtatgtaatggcccctccggggagacccagcatggcgtat

SEQ ID NO: 398181 - DNA, 140 bp, Artificial Sequence
  Synthetic
aggccctggctgctgatatgtcggtgacagtcccacacccgaacatcacagaaacagctctgtccacgacgggggagattcccttttatgggaaggccatccccctagagtgcatcaagggaccttttgggacagcggtg

SEQ ID NO: 398182 - DNA, 140 bp, Artificial Sequence
  Synthetic
caccgctgtcccaaaaggtcccttgatgcactctagggggatggccttcccataaaagggaatctcccccgtcgtggacagagctgtttctgtgatgttcgggtgtgggactgtcaccgacatatcagcagccagggcct

SEQ ID NO: 398183 - DNA, 140 bp, Artificial Sequence
  Synthetic
atacgccatgctgggtctccccggcgtcgacgcgactacctacaccaccgggggacaagccagccacaccgtgtctagtcttgttagtctcatcacaccaggctccaagcagaacatccacgtacttgggagtcggccat

SEQ ID NO: 398184 - DNA, 140 bp, Artificial Sequence
  Synthetic
atggccgactcccaagtacgtggatgttctgcttggagcctggtgtgatgagactaacaagactagacacggtgtggctggcttgtcccccggtggtgtaggtagtcgcgtcgacgccggggagacccagcatggcgtat

SEQ ID NO: 398185 - DNA, 140 bp, Artificial Sequence
  Synthetic
atacgccatgctgggtctcccggggtacagtatctcgccggcttgtcaacactgccaggtaatccggctgtggcctccttgatggccttctcggcggccttgactagcccactggcgacccgtacttgggagtcggccat

SEQ ID NO: 398186 - DNA, 140 bp, Artificial Sequence
  Synthetic
atggccgactcccaagtacgggtcgccagtgggctagtcaaggccgccgagaaggccatcaaggaggccacagccggattacctggcagtgttgacaagccggcgagatactgtaccccgggagacccagcatggcgtat

SEQ ID NO: 398187 - DNA, 140 bp, Artificial Sequence
  Synthetic
atacgccatgctgggtctccctgctgtgggcagcattggcctgggcaaggtcatcgtggatatcttagccggatacggggcaggtgtctctggtgctttagtggcctttaagatcatgagcgtacttgggagtcggccat

SEQ ID NO: 398188 - DNA, 140 bp, Artificial Sequence
  Synthetic
atggccgactcccaagtacgctcatgatcttaaaggccactaaagcaccagagacacctgccccgtatccggctaagatatccacgatgaccttgcccaggccaatgctgcccacagcagggagacccagcatggcgtat

SEQ ID NO: 398189 - DNA, 140 bp, Artificial Sequence
  Synthetic
atacgccatgctgggtctcccggcacattggcccaactgagggggctactcagtggatgaacaggctcatagcgttcgcctctagaggcaaccacgtgtcacccacgcactacgtgcccgcgtacttgggagtcggccat

SEQ ID NO: 398190 - DNA, 140 bp, Artificial Sequence
  Synthetic
atggccgactcccaagtacgcgggcacgtagtgcgtgggtgacacgtggttgcctctagaggcgaacgctatgagcctgttcatccactgagtagccccctcagttgggccaatgtgccgggagacccagcatggcgtat

SEQ ID NO: 398191 - DNA, 140 bp, Artificial Sequence
  Synthetic
aggccctggctgctgatatgagcgttcgcctctagaggcaaccacgtgtcacccacgcactacgtgcccgagacggacgcctctcgagctgtcaccactatactgagctcccttactattgaccttttgggacagcggtg

SEQ ID NO: 398192 - DNA, 140 bp, Artificial Sequence
  Synthetic
caccgctgtcccaaaaggtcaatagtaagggagctcagtatagtggtgacagctcgagaggcgtccgtctcgggcacgtagtgcgtgggtgacacgtggttgcctctagaggcgaacgctcatatcagcagccagggcct

SEQ ID NO: 398193 - DNA, 140 bp, Artificial Sequence
  Synthetic
atacgccatgctgggtctccctggcactacgcgcctcggccgtgcgggattgtgccagcatccagtgtgtgtggccccgtgtattgtttcactcccagccctgtcgtggtcggtactactcgtacttgggagtcggccat

SEQ ID NO: 398194 - DNA, 140 bp, Artificial Sequence
  Synthetic
atggccgactcccaagtacgagtagtaccgaccacgacagggctgggagtgaaacaatacacggggccacacacactggatgctggcacaatcccgcacggccgaggcgcgtagtgccagggagacccagcatggcgtat

SEQ ID NO: 398195 - DNA, 140 bp, Artificial Sequence
  Synthetic
  misc_feature (94)..(94): n is a, c, g, or t
atacgccatgctgggtctcctgctctctgatttcaagacctggctcaaagccaagctcgtgccctccttgccgggcattcccttcctctcgtgncagcgggggtttaggggggtttggcgcgtacttgggagtcggccat

SEQ ID NO: 398196 - DNA, 140 bp, Artificial Sequence
  Synthetic
  misc_feature (47)..(47): n is a, c, g, or t
atggccgactcccaagtacgcgccaaacccccctaaacccccgctgncacgagaggaagggaatgcccggcaaggagggcacgagcttggctttgagccaggtcttgaaatcagagagcaggagacccagcatggcgtat

SEQ ID NO: 398197 - DNA, 140 bp, Artificial Sequence
  Synthetic
atacgccatgctgggtctccaatgtctggcatggcaggtttcccatcaacgctaccacgaccggccccagcgtacccatccccgagcctaactaccgtacggctctgtggagggtgtctgcgtacttgggagtcggccat

SEQ ID NO: 398198 - DNA, 140 bp, Artificial Sequence
  Synthetic
atggccgactcccaagtacgcagacaccctccacagagccgtacggtagttaggctcggggatgggtacgctggggccggtcgtggtagcgttgatgggaaacctgccatgccagacattggagacccagcatggcgtat

SEQ ID NO: 398199 - DNA, 140 bp, Artificial Sequence
  Synthetic
atacgccatgctgggtctccattcttcaccatggtggatggcgtacgactgcacaggtatgctccagactgccgcccattgctccgagatgaagtgactttctctgtcgggctctcgacccgtacttgggagtcggccat

SEQ ID NO: 398200 - DNA, 140 bp, Artificial Sequence
  Synthetic
atggccgactcccaagtacgggtcgagagcccgacagagaaagtcacttcatctcggagcaatgggcggcagtctggagcatacctgtgcagtcgtacgccatccaccatggtgaagaatggagacccagcatggcgtat

SEQ ID NO: 398201 - DNA, 140 bp, Artificial Sequence
  Synthetic
atacgccatgctgggtctccgcgtttggccagctgccgctccatcgacaagttcgctcaggggtggggtcccatcagttatggcgagcctagcgactcggaccagaggccctattgctggcgtacttgggagtcggccat

SEQ ID NO: 398202 - DNA, 140 bp, Artificial Sequence
  Synthetic
atggccgactcccaagtacgccagcaatagggcctctggtccgagtcgctaggctcgccataactgatgggaccccacccctgagcgaacttgtcgatggagcggcagctggccaaacgcggagacccagcatggcgtat

SEQ ID NO: 398203 - DNA, 140 bp, Artificial Sequence
  Synthetic
atacgccatgctgggtctccggtcacctccatgctcgttgacccagcccacatcacggcggagtcggcacgccgacgccttgatcgaggctccccgccgtctctcgccagctcatctgcgcgtacttgggagtcggccat

SEQ ID NO: 398204 - DNA, 140 bp, Artificial Sequence
  Synthetic
atggccgactcccaagtacgcgcagatgagctggcgagagacggcggggagcctcgatcaaggcgtcggcgtgccgactccgccgtgatgtgggctgggtcaacgagcatggaggtgaccggagacccagcatggcgtat

SEQ ID NO: 398205 - DNA, 140 bp, Artificial Sequence
  Synthetic
atacgccatgctgggtctccggcgtcccagaaaatccagcttgtaaacaccaacggcagctggcacattaacaggaccgccttgaactgcaatgactccctccacactgggttccttgcccgtacttgggagtcggccat

SEQ ID NO: 398206 - DNA, 140 bp, Artificial Sequence
  Synthetic
atggccgactcccaagtacgggcaaggaacccagtgtggagggagtcattgcagttcaaggcggtcctgttaatgtgccagctgccgttggtgtttacaagctggattttctgggacgccggagacccagcatggcgtat

SEQ ID NO: 398207 - DNA, 140 bp, Artificial Sequence
  Synthetic
aggccctggctgctgatatgtcggaggtaacatcacgcgggtcgagtcagagaacaaggtaataatcctcgactcgtttgaccccctggtagcggaagtggatgacagggagatctccacgaccttttgggacagcggtg

SEQ ID NO: 398208 - DNA, 140 bp, Artificial Sequence
  Synthetic
caccgctgtcccaaaaggtcgtggagatctccctgtcatccacttccgctaccagggggtcaaacgagtcgaggattattaccttgttctctgactcgacccgcgtgatgttacctccgacatatcagcagccagggcct

SEQ ID NO: 398209 - DNA, 140 bp, Artificial Sequence
  Synthetic
  misc_feature (59)..(59): n is a, c, g, or t
  misc_feature (86)..(86): n is a, c, g, or t
  misc_feature (119)..(119): n is a, c, g, or t
atacgccatgctgggtctcctctccaacgtacgaccctcccctcgtgtccggttgtgcnctccccccaaaagggttgccgccggtncctccaccgcggaggaagaaggtcgtgcagctnacgtacttgggagtcggccat

SEQ ID NO: 398210 - DNA, 140 bp, Artificial Sequence
  Synthetic
  misc_feature (22)..(22): n is a, c, g, or t
  misc_feature (55)..(55): n is a, c, g, or t
  misc_feature (82)..(82): n is a, c, g, or t
atggccgactcccaagtacgtnagctgcacgaccttcttcctccgcggtggaggnaccggcggcaacccttttggggggagngcacaaccggacacgaggggagggtcgtacgttggagaggagacccagcatggcgtat

SEQ ID NO: 398211 - DNA, 140 bp, Artificial Sequence
  Synthetic
  misc_feature (40)..(40): n is a, c, g, or t
atacgccatgctgggtctcctccaagttccgacgcggcgncaagccaagtcgaggatgacacagggtcggacgccggttcgtacagttcaatgccaccacttgagggagagccgggagaccgtacttgggagtcggccat

SEQ ID NO: 398212 - DNA, 140 bp, Artificial Sequence
  Synthetic
  misc_feature (101)..(101): n is a, c, g, or t
atggccgactcccaagtacggtctcccggctctccctcaagtggtggcattgaactgtacgaaccggcgtccgaccctgtgtcatcctcgacttggcttgncgccgcgtcggaacttggaggagacccagcatggcgtat

SEQ ID NO: 398213 - DNA, 140 bp, Artificial Sequence
  Synthetic
aggccctggctgctgatatgacgccggttcgtacagttcaatgccaccacttgagggagagccgggagacccagacctcagttcggggtcatggtctacggttagtgaggagaatgacaggaccttttgggacagcggtg

SEQ ID NO: 398214 - DNA, 140 bp, Artificial Sequence
  Synthetic
caccgctgtcccaaaaggtcctgtcattctcctcactaaccgtagaccatgaccccgaactgaggtctgggtctcccggctctccctcaagtggtggcattgaactgtacgaaccggcgtcatatcagcagccagggcct

SEQ ID NO: 398215 - DNA, 140 bp, Artificial Sequence
  Synthetic
  misc_feature (89)..(89): n is a, c, g, or t
atacgccatgctgggtctccggggagatccccttctatgggaaagccatccctctggacctcatcaaaggaggtagacacctcatcttntgccattccaagaaaaagtgtgacgagttggcgtacttgggagtcggccat

SEQ ID NO: 398216 - DNA, 140 bp, Artificial Sequence
  Synthetic
  misc_feature (52)..(52): n is a, c, g, or t
atggccgactcccaagtacgccaactcgtcacactttttcttggaatggcanaagatgaggtgtctacctcctttgatgaggtccagagggatggctttcccatagaaggggatctccccggagacccagcatggcgtat

SEQ ID NO: 398217 - DNA, 140 bp, Artificial Sequence
  Synthetic
atacgccatgctgggtctccctcatacgccaccacaatctggtgtatgctaccacctcacgtagtgcttccctccgtcaacggaaggtgacattcgaccgcgtccaactacttgatcaaccgtacttgggagtcggccat

SEQ ID NO: 398218 - DNA, 140 bp, Artificial Sequence
  Synthetic
atggccgactcccaagtacggttgatcaagtagttggacgcggtcgaatgtcaccttccgttgacggagggaagcactacgtgaggtggtagcatacaccagattgtggtggcgtatgagggagacccagcatggcgtat

SEQ ID NO: 398219 - DNA, 140 bp, Artificial Sequence
  Synthetic
atacgccatgctgggtctcccagacctaggggtgagggtgtgcgaaaagaaggccttgtacgacataactcagaagctgcccagggcggttatgggatcatcgtatgggttccaatactccgtacttgggagtcggccat

SEQ ID NO: 398220 - DNA, 140 bp, Artificial Sequence
  Synthetic
atggccgactcccaagtacggagtattggaacccatacgatgatcccataaccgccctgggcagcttctgagttatgtcgtacaaggccttcttttcgcacaccctcacccctaggtctgggagacccagcatggcgtat

SEQ ID NO: 398221 - DNA, 140 bp, Artificial Sequence
  Synthetic
atacgccatgctgggtctcctccctatgggattttcctatgacaccagatgctttgactcgacagtcacagagcgcgacatccgcactgagcacgacatctacatgtgctgcaaactagacgtacttgggagtcggccat

SEQ ID NO: 398222 - DNA, 140 bp, Artificial Sequence
  Synthetic
atggccgactcccaagtacgtctagtttgcagcacatgtagatgtcgtgctcagtgcggatgtcgcgctctgtgactgtcgagtcaaagcatctggtgtcataggaaaatcccatagggaggagacccagcatggcgtat

SEQ ID NO: 398223 - DNA, 140 bp, Artificial Sequence
  Synthetic
aggccctggctgctgatatggtggacattcttgcagggtatggcgcgggcgtggcgggagctcttgtagcattcaagatcatgagcggtgaggtcccctccacggaggacctggtcaatcgaccttttgggacagcggtg

SEQ ID NO: 398224 - DNA, 140 bp, Artificial Sequence
  Synthetic
caccgctgtcccaaaaggtcgattgaccaggtcctccgtggaggggacctcaccgctcatgatcttgaatgctacaagagctcccgccacgcccgcgccataccctgcaagaatgtccaccatatcagcagccagggcct

SEQ ID NO: 398225 - DNA, 140 bp, Artificial Sequence
  Synthetic
aggccctggctgctgatatgcataaaagcccaagcggcttgcaaagcagccaagctcgagaactttgacatgttggtttgcggagacgacttggtcgttatttcggagagcaagggagtcgaccttttgggacagcggtg

SEQ ID NO: 398226 - DNA, 140 bp, Artificial Sequence
  Synthetic
caccgctgtcccaaaaggtcgactcccttgctctccgaaataacgaccaagtcgtctccgcaaaccaacatgtcaaagttctcgagcttggctgctttgcaagccgcttgggcttttatgcatatcagcagccagggcct

SEQ ID NO: 398227 - DNA, 140 bp, Artificial Sequence
  Synthetic
aggccctggctgctgatatgcgacctgcatcaacggcgtgtgttggactgtctatcatggcgccggctcaaagaccctagccggcccaaagggcccaatcacccaaatgtacaccaatgtgaccttttgggacagcggtg

SEQ ID NO: 398228 - DNA, 140 bp, Artificial Sequence
  Synthetic
caccgctgtcccaaaaggtcacattggtgtacatttgggtgattgggccctttgggccggctagggtctttgagccggcgccatgatagacagtccaacacacgccgttgatgcaggtcgcatatcagcagccagggcct

SEQ ID NO: 398229 - DNA, 140 bp, Artificial Sequence
  Synthetic
aggccctggctgctgatatggtattgcttcaccccgagtcctgtcgtagtggggacgaccgatcggttcggcgtccctacgtacagttggggggagaatgagacggacgtgctgcttctcgaccttttgggacagcggtg

SEQ ID NO: 398230 - DNA, 140 bp, Artificial Sequence
  Synthetic
caccgctgtcccaaaaggtcgagaagcagcacgtccgtctcattctccccccaactgtacgtagggacgccgaaccgatcggtcgtccccactacgacaggactcggggtgaagcaataccatatcagcagccagggcct

SEQ ID NO: 398231 - DNA, 140 bp, Artificial Sequence
  Synthetic
atacgccatgctgggtctcccacttgtggcaagtacctcttcaactgggcagtgaagaccaaactcaaactcactccaatcccggctgcgtcccagctggacttgtccggctggttcgttcgtacttgggagtcggccat

SEQ ID NO: 398232 - DNA, 140 bp, Artificial Sequence
  Synthetic
atggccgactcccaagtacgaacgaaccagccggacaagtccagctgggacgcagccgggattggagtgagtttgagtttggtcttcactgcccagttgaagaggtacttgccacaagtgggagacccagcatggcgtat

SEQ ID NO: 398233 - DNA, 140 bp, Artificial Sequence
  Synthetic
aggccctggctgctgatatgaggttggcgaggggatcacccccctctctggccagctcctcggctagccagctgtctgctccatctctcaaggcaacttgcaccgccaaccatgactcccgaccttttgggacagcggtg

SEQ ID NO: 398234 - DNA, 140 bp, Artificial Sequence
  Synthetic
caccgctgtcccaaaaggtcgggagtcatggttggcggtgcaagttgccttgagagatggagcagacagctggctagccgaggagctggccagagaggggggtgatcccctcgccaacctcatatcagcagccagggcct

SEQ ID NO: 398235 - DNA, 140 bp, Artificial Sequence
  Synthetic
  misc_feature (70)..(70): n is a, c, g, or t
aggccctggctgctgatatgtccgtaggggtaggcatcttcctgcttcccgctcggtaagcgggaagccnaaagcaacactccaataattcgccttttcgctttttttttttttttttttgaccttttgggacagcggtg

SEQ ID NO: 398236 - DNA, 140 bp, Artificial Sequence
  Synthetic
  misc_feature (71)..(71): n is a, c, g, or t
caccgctgtcccaaaaggtcaaaaaaaaaaaaaaaaaaagcgaaaaggcgaattattggagtgttgctttnggcttcccgcttaccgagcgggaagcaggaagatgcctacccctacggacatatcagcagccagggcct

SEQ ID NO: 398237 - DNA, 140 bp, Artificial Sequence
  Synthetic
atacgccatgctgggtctcctgtgccaagaccacctggaattctgggaggccgtgttcactggcctcacacatatagatgcccatttcctctcccagacgaagcaggcaggggagggtttcgtacttgggagtcggccat

SEQ ID NO: 398238 - DNA, 140 bp, Artificial Sequence
  Synthetic
atggccgactcccaagtacgaaaccctcccctgcctgcttcgtctgggagaggaaatgggcatctatatgtgtgaggccagtgaacacggcctcccagaattccaggtggtcttggcacaggagacccagcatggcgtat

SEQ ID NO: 398239 - DNA, 140 bp, Artificial Sequence
  Synthetic
atacgccatgctgggtctccaatgactgtcctaacagcagcatcgtgtatgaggcggaagacatcattctgcatctccctggctgtgtaccttgcgtcaaaactggtaacaccagcaagtcgtacttgggagtcggccat

SEQ ID NO: 398240 - DNA, 140 bp, Artificial Sequence
  Synthetic
atggccgactcccaagtacgacttgctggtgttaccagttttgacgcaaggtacacagccagggagatgcagaatgatgtcttccgcctcatacacgatgctgctgttaggacagtcattggagacccagcatggcgtat

SEQ ID NO: 398241 - DNA, 140 bp, Artificial Sequence
  Synthetic
atacgccatgctgggtctccctgctctgccatgtacatcggagatttgtgcggcggtatcttcctgctcggccagttggtcactttcagaccacggatgcaccaggtcgtgcaggactgccgtacttgggagtcggccat

SEQ ID NO: 398242 - DNA, 140 bp, Artificial Sequence
  Synthetic
atggccgactcccaagtacggcagtcctgcacgacctggtgcatccgtggtctgaaagtgaccaactggccgagcaggaagataccgccgcacaaatctccgatgtacatggcagagcagggagacccagcatggcgtat

SEQ ID NO: 398243 - DNA, 140 bp, Artificial Sequence
  Synthetic
aggccctggctgctgatatgcgaactatacgttcgcgctgtggagggtgtctgcagaggaatacgtggagataaggcgggtgggggacttccactacgtgacgggtatgactactgacaagaccttttgggacagcggtg

SEQ ID NO: 398244 - DNA, 140 bp, Artificial Sequence
  Synthetic
caccgctgtcccaaaaggtcttgtcagtagtcatacccgtcacgtagtggaagtcccccacccgccttatctccacgtattcctctgcagacaccctccacagcgcgaacgtatagttcgcatatcagcagccagggcct

SEQ ID NO: 398245 - DNA, 140 bp, Artificial Sequence
  Synthetic
atacgccatgctgggtctcctgcgcattccccaagtgatcgtcgacgttttcgtcggaggtcactggggggtgatcgcaggtatactgtactacagcatggtggctaactgggccaaggtcgtacttgggagtcggccat

SEQ ID NO: 398246 - DNA, 140 bp, Artificial Sequence
  Synthetic
atggccgactcccaagtacgaccttggcccagttagccaccatgctgtagtacagtatacctgcgatcaccccccagtgacctccgacgaaaacgtcgacgatcacttggggaatgcgcaggagacccagcatggcgtat

SEQ ID NO: 398247 - DNA, 140 bp, Artificial Sequence
  Synthetic
atacgccatgctgggtctccgcagggtcgcggcagaacatccagttaatcaattctaatgggagctggcacatcaataggactgcgcttaactgcaacgatagcctgaacaccggctttacgtacttgggagtcggccat

SEQ ID NO: 398248 - DNA, 140 bp, Artificial Sequence
  Synthetic
atggccgactcccaagtacgtaaagccggtgttcaggctatcgttgcagttaagcgcagtcctattgatgtgccagctcccattagaattgattaactggatgttctgccgcgaccctgcggagacccagcatggcgtat

SEQ ID NO: 398249 - DNA, 140 bp, Artificial Sequence
  Synthetic
  misc_feature (51)..(51): n is a, c, g, or t
  misc_feature (57)..(57): n is a, c, g, or t
  misc_feature (105)..(105): n is a, c, g, or t
atacgccatgctgggtctcctataacatatgccaatataagcggcccgtcnccaganaagccgtattgctggcactatcccccgcggccatgtgggaccatatcngcaagagatgtctgtcgtacttgggagtcggccat

SEQ ID NO: 398250 - DNA, 140 bp, Artificial Sequence
  Synthetic
  misc_feature (36)..(36): n is a, c, g, or t
  misc_feature (84)..(84): n is a, c, g, or t
  misc_feature (90)..(90): n is a, c, g, or t
atggccgactcccaagtacgacagacatctcttgcngatatggtcccacatggccgcgggggatagtgccagcaatacggcttntctggngacgggccgcttatattggcatatgttataggagacccagcatggcgtat

SEQ ID NO: 398251 - DNA, 140 bp, Artificial Sequence
  Synthetic
atacgccatgctgggtctcctcatcctaggcagcctgcggccgcccgttggcgggtggttcggatgtacctggatgaattctacggggttcgtcaagacgtgcggggcgcctccctgtaacgtacttgggagtcggccat

SEQ ID NO: 398252 - DNA, 140 bp, Artificial Sequence
  Synthetic
atggccgactcccaagtacgttacagggaggcgccccgcacgtcttgacgaaccccgtagaattcatccaggtacatccgaaccacccgccaacgggcggccgcaggctgcctaggatgaggagacccagcatggcgtat

SEQ ID NO: 398253 - DNA, 140 bp, Artificial Sequence
  Synthetic
aggccctggctgctgatatgtggatgaattctacggggttcgtcaagacgtgcggggcgcctccctgtaacatcgggccaagaggcaacaactccctcacctgccctactgactgtttccgaccttttgggacagcggtg

SEQ ID NO: 398254 - DNA, 140 bp, Artificial Sequence
  Synthetic
caccgctgtcccaaaaggtcggaaacagtcagtagggcaggtgagggagttgttgcctcttggcccgatgttacagggaggcgccccgcacgtcttgacgaaccccgtagaattcatccacatatcagcagccagggcct

SEQ ID NO: 398255 - DNA, 140 bp, Artificial Sequence
  Synthetic
atacgccatgctgggtctccgtagcgcggtaggtcacgccaccagaggcatcgctaaaatgttcatgccaggtgcccagcaaaacatccagctgattaacaccaacggcagttggcacatcgtacttgggagtcggccat

SEQ ID NO: 398256 - DNA, 140 bp, Artificial Sequence
  Synthetic
atggccgactcccaagtacgatgtgccaactgccgttggtgttaatcagctggatgttttgctgggcacctggcatgaacattttagcgatgcctctggtggcgtgacctaccgcgctacggagacccagcatggcgtat

SEQ ID NO: 398257 - DNA, 140 bp, Artificial Sequence
  Synthetic
atacgccatgctgggtctcccaccgtcaactttaccatccacaaggtgcgcatgttccttggagggctcgagcacaggttccaagcagcatgcaactggacgcgcggggaccgttgcgagcgtacttgggagtcggccat

SEQ ID NO: 398258 - DNA, 140 bp, Artificial Sequence
  Synthetic
atggccgactcccaagtacgctcgcaacggtccccgcgcgtccagttgcatgctgcttggaacctgtgctcgagccctccaaggaacatgcgcaccttgtggatggtaaagttgacggtgggagacccagcatggcgtat

SEQ ID NO: 398259 - DNA, 140 bp, Artificial Sequence
  Synthetic
atacgccatgctgggtctccctggcttaatacacctccatcagaacatagtggatgtccagtacttgtacgggctttccccagcttacgtctcttgggtcatcaagtgggagtacgtggtcgtacttgggagtcggccat

SEQ ID NO: 398260 - DNA, 140 bp, Artificial Sequence
  Synthetic
atggccgactcccaagtacgaccacgtactcccacttgatgacccaagagacgtaagctggggaaagcccgtacaagtactggacatccactatgttctgatggaggtgtattaagccagggagacccagcatggcgtat

SEQ ID NO: 398261 - DNA, 140 bp, Artificial Sequence
  Synthetic
aggccctggctgctgatatgtccgggttctggaagacggcgtgaactatgcaacagggaaccttcctggttgctctttctctatcttccttctggccctgctctcttgcctgactgtgccgaccttttgggacagcggtg

SEQ ID NO: 398262 - DNA, 140 bp, Artificial Sequence
  Synthetic
caccgctgtcccaaaaggtcggcacagtcaggcaagagagcagggccagaaggaagatagagaaagagcaaccaggaaggttccctgttgcatagttcacgccgtcttccagaacccggacatatcagcagccagggcct

SEQ ID NO: 398263 - DNA, 140 bp, Artificial Sequence
  Synthetic
atacgccatgctgggtctccgaagctatgctacatgtatgggtcccgagcctctccgtgcgggggggccgtgatgcagtcatcttgctcacctgcctgctccacccttccctcgggtttgcgtacttgggagtcggccat

SEQ ID NO: 398264 - DNA, 140 bp, Artificial Sequence
  Synthetic
atggccgactcccaagtacgcaaacccgagggaagggtggagcaggcaggtgagcaagatgactgcatcacggcccccccgcacggagaggctcgggacccatacatgtagcatagcttcggagacccagcatggcgtat

SEQ ID NO: 398265 - DNA, 140 bp, Artificial Sequence
  Synthetic
aggccctggctgctgatatgtgatgcagtcatcttgctcacctgcctgctccacccttccctcgggtttgacatcacaaaagtgcttttggccctcttagggccgctgtacctctttcaggaccttttgggacagcggtg

SEQ ID NO: 398266 - DNA, 140 bp, Artificial Sequence
  Synthetic
caccgctgtcccaaaaggtcctgaaagaggtacagcggccctaagagggccaaaagcacttttgtgatgtcaaacccgagggaagggtggagcaggcaggtgagcaagatgactgcatcacatatcagcagccagggcct

SEQ ID NO: 398267 - DNA, 140 bp, Artificial Sequence
  Synthetic
aggccctggctgctgatatgggactacgtccctccagtggtgcacgggtgcccattgccacctaccaaggcccccccagtgccacctccacggaggaagaggacggttgtcctgacagaagaccttttgggacagcggtg

SEQ ID NO: 398268 - DNA, 140 bp, Artificial Sequence
  Synthetic
caccgctgtcccaaaaggtcttctgtcaggacaaccgtcctcttcctccgtggaggtggcactgggggggccttggtaggtggcaatgggcacccgtgcaccactggagggacgtagtcccatatcagcagccagggcct

SEQ ID NO: 398269 - DNA, 140 bp, Artificial Sequence
  Synthetic
aggccctggctgctgatatggtcagcggttgtctcctttgcaatcaaatgggagtatgtcctgttgctcttcctcctcctggcggacgcgcgcgtctgtgcctgcttgtggatgatgctggaccttttgggacagcggtg

SEQ ID NO: 398270 - DNA, 140 bp, Artificial Sequence
  Synthetic
caccgctgtcccaaaaggtccagcatcatccacaagcaggcacagacgcgcgcgtccgccaggaggaggaagagcaacaggacatactcccatttgattgcaaaggagacaaccgctgaccatatcagcagccagggcct

SEQ ID NO: 398271 - DNA, 140 bp, Artificial Sequence
  Synthetic
aggccctggctgctgatatgtcctggcgggcatagcgtatttctccatggtggggaactgggcgaaggtcctggtagtgctgctgctatttgccggcgtcgacgcggaaacccacgtcacgaccttttgggacagcggtg

SEQ ID NO: 398272 - DNA, 140 bp, Artificial Sequence
  Synthetic
caccgctgtcccaaaaggtcgtgacgtgggtttccgcgtcgacgccggcaaatagcagcagcactaccaggaccttcgcccagttccccaccatggagaaatacgctatgcccgccaggacatatcagcagccagggcct

SEQ ID NO: 398273 - DNA, 140 bp, Artificial Sequence
  Synthetic
atacgccatgctgggtctccccttgggtggaagctgctagctcccatcacagcatatcatcagcagacccgtggcctactggggacaatcgtcaccagcctcacaggtcgtgacaaaaatcgtacttgggagtcggccat

SEQ ID NO: 398274 - DNA, 140 bp, Artificial Sequence
  Synthetic
atggccgactcccaagtacgatttttgtcacgacctgtgaggctggtgacgattgtccccagtaggccacgggtctgctgatgatatgctgtgatgggagctagcagcttccacccaaggggagacccagcatggcgtat

SEQ ID NO: 398275 - DNA, 140 bp, Artificial Sequence
  Synthetic
aggccctggctgctgatatgggttggccagctgccgacgccttaccgattttgcccagggctggggccctatcagtcatgccaacggaagcggccccgacgaacggccctactgctggcagaccttttgggacagcggtg

SEQ ID NO: 398276 - DNA, 140 bp, Artificial Sequence
  Synthetic
caccgctgtcccaaaaggtctgccagcagtagggccgttcgtcggggccgcttccgttggcatgactgatagggccccagccctgggcaaaatcggtaaggcgtcggcagctggccaacccatatcagcagccagggcct

SEQ ID NO: 398277 - DNA, 140 bp, Artificial Sequence
  Synthetic
aggccctggctgctgatatggtagaccaagacttggtggggtggccggctccaccgggtgccaagtctctgacgccatgcacttgcggtgggtgcgacctttaccttgtgacccgcggtggaccttttgggacagcggtg

SEQ ID NO: 398278 - DNA, 140 bp, Artificial Sequence
  Synthetic
caccgctgtcccaaaaggtccaccgcgggtcacaaggtaaaggtcgcacccaccgcaagtgcatggcgtcagagacttggcacccggtggagccggccaccccaccaagtcttggtctaccatatcagcagccagggcct

SEQ ID NO: 398279 - DNA, 140 bp, Artificial Sequence
  Synthetic
atacgccatgctgggtctccgtgctcatctggccatgtcgtgggtttgttccgtgcagccgtatgcactcgaggtgttgccaaggcaattgacttcgtgcctgtggagaatatggagacccgtacttgggagtcggccat

SEQ ID NO: 398280 - DNA, 140 bp, Artificial Sequence
  Synthetic
atggccgactcccaagtacgggtctccatattctccacaggcacgaagtcaattgccttggcaacacctcgagtgcatacggctgcacggaacaaacccacgacatggccagatgagcacggagacccagcatggcgtat

SEQ ID NO: 398281 - DNA, 140 bp, Artificial Sequence
  Synthetic
atacgccatgctgggtctccgcacgaaggtgccggcagcgtacgcctctcaaggctacaaggtgctggtgctcaatccatctgtagccgccaccctcgggtttggtgcctacatgagcaacgtacttgggagtcggccat

SEQ ID NO: 398282 - DNA, 140 bp, Artificial Sequence
  Synthetic
atggccgactcccaagtacgttgctcatgtaggcaccaaacccgagggtggcggctacagatggattgagcaccagcaccttgtagccttgagaggcgtacgctgccggcaccttcgtgcggagacccagcatggcgtat

SEQ ID NO: 398283 - DNA, 140 bp, Artificial Sequence
  Synthetic
  misc_feature (84)..(84): n is a, c, g, or t
  misc_feature (108)..(108): n is a, c, g, or t
  misc_feature (114)..(114): n is a, c, g, or t
aggccctggctgctgatatgaaccgaccccaccactatcttgggcatcggtacagtcctggaccaggcggagacggctggcgtncgcctaaccgtgctcgccacggcnacaccncctggcgaccttttgggacagcggtg

SEQ ID NO: 398284 - DNA, 140 bp, Artificial Sequence
  Synthetic
  misc_feature (27)..(27): n is a, c, g, or t
  misc_feature (33)..(33): n is a, c, g, or t
  misc_feature (57)..(57): n is a, c, g, or t
caccgctgtcccaaaaggtcgccaggnggtgtngccgtggcgagcacggttaggcgnacgccagccgtctccgcctggtccaggactgtaccgatgcccaagatagtggtggggtcggttcatatcagcagccagggcct

SEQ ID NO: 398285 - DNA, 140 bp, Artificial Sequence
  Synthetic
atacgccatgctgggtctccggggcaggcatctgatcttctgccattccaagaagaagtgcgatgaattggccaagcaactacggtcgctgggccttaatgccgtcgccttctacaggggcgtacttgggagtcggccat

SEQ ID NO: 398286 - DNA, 140 bp, Artificial Sequence
  Synthetic
atggccgactcccaagtacgcccctgtagaaggcgacggcattaaggcccagcgaccgtagttgcttggccaattcatcgcacttcttcttggaatggcagaagatcagatgcctgccccggagacccagcatggcgtat

SEQ ID NO: 398287 - DNA, 140 bp, Artificial Sequence
  Synthetic
aggccctggctgctgatatgctggtgcccactggggagtcctagcgggcatagcgtatttctccatggtggggaactgggcgaaggtcctagtggtgctgttgctgttcgccggcgtcgagaccttttgggacagcggtg

SEQ ID NO: 398288 - DNA, 140 bp, Artificial Sequence
  Synthetic
caccgctgtcccaaaaggtctcgacgccggcgaacagcaacagcaccactaggaccttcgcccagttccccaccatggagaaatacgctatgcccgctaggactccccagtgggcaccagcatatcagcagccagggcct

SEQ ID NO: 398289 - DNA, 140 bp, Artificial Sequence
  Synthetic
  misc_feature (58)..(58): n is a, c, g, or t
atacgccatgctgggtctcccagggtgagcggccgtccggcatgttcgataccgtcgncctctgtgaggcgtacgacactggttgtgcctggtatgagttgacaccatcagagaccactgcgtacttgggagtcggccat

SEQ ID NO: 398290 - DNA, 140 bp, Artificial Sequence
  Synthetic
  misc_feature (83)..(83): n is a, c, g, or t
atggccgactcccaagtacgcagtggtctctgatggtgtcaactcataccaggcacaaccagtgtcgtacgcctcacagaggncgacggtatcgaacatgccggacggccgctcaccctgggagacccagcatggcgtat

SEQ ID NO: 398291 - DNA, 140 bp, Artificial Sequence
  Synthetic
atacgccatgctgggtctccgcttcccaaattgctccccctgcaggggccactggcttcgtcgtcagtggtctagtaggggccgctgtgggtagcataggcctagggaagatactggtggcgtacttgggagtcggccat

SEQ ID NO: 398292 - DNA, 140 bp, Artificial Sequence
  Synthetic
atggccgactcccaagtacgccaccagtatcttccctaggcctatgctacccacagcggcccctactagaccactgacgacgaagccagtggcccctgcagggggagcaatttgggaagcggagacccagcatggcgtat

SEQ ID NO: 398293 - DNA, 140 bp, Artificial Sequence
  Synthetic
aggccctggctgctgatatgtctagtaggggccgctgtgggtagcataggcctagggaagatactggtggatgtattggccgggtatggcgcgggtatttcgggggctctcgttgctttcgaccttttgggacagcggtg

SEQ ID NO: 398294 - DNA, 140 bp, Artificial Sequence
  Synthetic
caccgctgtcccaaaaggtcgaaagcaacgagagcccccgaaatacccgcgccatacccggccaatacatccaccagtatcttccctaggcctatgctacccacagcggcccctactagacatatcagcagccagggcct

SEQ ID NO: 398295 - DNA, 140 bp, Artificial Sequence
  Synthetic
atacgccatgctgggtctccccgctgtgggcagcattgggctgggtaaggtcatcgtggacatcttagcgggctacggggcaggtgtctcaggtgctttggtggccttcaaaatcatgagcgtacttgggagtcggccat

SEQ ID NO: 398296 - DNA, 140 bp, Artificial Sequence
  Synthetic
atggccgactcccaagtacgctcatgattttgaaggccaccaaagcacctgagacacctgccccgtagcccgctaagatgtccacgatgaccttacccagcccaatgctgcccacagcggggagacccagcatggcgtat

SEQ ID NO: 398297 - DNA, 140 bp, Artificial Sequence
  Synthetic
atacgccatgctgggtctccaacggggggtacggcagcccataccacccacgggtttgcgggcctcttcacgctcgggccacaacagaaaatccagcttataaacaccaacggcagctggcgtacttgggagtcggccat

SEQ ID NO: 398298 - DNA, 140 bp, Artificial Sequence
  Synthetic
atggccgactcccaagtacgccagctgccgttggtgtttataagctggattttctgttgtggcccgagcgtgaagaggcccgcaaacccgtgggtggtatgggctgccgtaccccccgttggagacccagcatggcgtat

SEQ ID NO: 398299 - DNA, 140 bp, Artificial Sequence
  Synthetic
aggccctggctgctgatatgctccgacaacggcgacacaggatccgacgatgggtcgtactcctccatgcccccccttgagggagagccgggggaccccgatctcagcgacgggtcttgggaccttttgggacagcggtg

SEQ ID NO: 398300 - DNA, 140 bp, Artificial Sequence
  Synthetic
caccgctgtcccaaaaggtcccaagacccgtcgctgagatcggggtcccccggctctccctcaagggggggcatggaggagtacgacccatcgtcggatcctgtgtcgccgttgtcggagcatatcagcagccagggcct

SEQ ID NO: 398301 - DNA, 140 bp, Artificial Sequence
  Synthetic
atacgccatgctgggtctccgtcacgtgaaaaatgggtctatgaagattgcgggtcccaggacatgcagcaacgtctggcatggcaggtttcccatcaacgctaccacgactggccccagcgtacttgggagtcggccat

SEQ ID NO: 398302 - DNA, 140 bp, Artificial Sequence
  Synthetic
atggccgactcccaagtacgctggggccagtcgtggtagcgttgatgggaaacctgccatgccagacgttgctgcatgtcctgggacccgcaatcttcatagacccatttttcacgtgacggagacccagcatggcgtat

SEQ ID NO: 398303 - DNA, 140 bp, Artificial Sequence
  Synthetic
aggccctggctgctgatatgacacccctgctatacagactgggcgctgttcagaatgaagtcaccctgacgcacccaatcaccaaatacatcatgacatgcatgtcggctgacctggagggaccttttgggacagcggtg

SEQ ID NO: 398304 - DNA, 140 bp, Artificial Sequence
  Synthetic
caccgctgtcccaaaaggtccctccaggtcagccgacatgcatgtcatgatgtatttggtgattgggtgcgtcagggtgacttcattctgaacagcgcccagtctgtatagcaggggtgtcatatcagcagccagggcct

SEQ ID NO: 398305 - DNA, 140 bp, Artificial Sequence
  Synthetic
atacgccatgctgggtctccgccgcccgctgatccgagatgaagtgactttctctgtcgggctctcgacctatgccatagggtcacaactaccttgtgaaccagaacccgatgttgtgaccgtacttgggagtcggccat

SEQ ID NO: 398306 - DNA, 140 bp, Artificial Sequence
  Synthetic
atggccgactcccaagtacggtcacaacatcgggttctggttcacaaggtagttgtgaccctatggcataggtcgagagcccgacagagaaagtcacttcatctcggatcagcgggcggcggagacccagcatggcgtat

SEQ ID NO: 398307 - DNA, 140 bp, Artificial Sequence
  Synthetic
atacgccatgctgggtctccagccagttgtcagctccgtcactcaaggcaacgtgcaccaccgccggggcccatccggacgcggagttaattgaggccaacctgctttggcgccaggaggcgtacttgggagtcggccat

SEQ ID NO: 398308 - DNA, 140 bp, Artificial Sequence
  Synthetic
atggccgactcccaagtacgcctcctggcgccaaagcaggttggcctcaattaactccgcgtccggatgggccccggcggtggtgcacgttgccttgagtgacggagctgacaactggctggagacccagcatggcgtat

SEQ ID NO: 398309 - DNA, 140 bp, Artificial Sequence
  Synthetic
aggccctggctgctgatatgtccccgacgtacgaccctcccctcgtgtccggatgtgcactccccccaaaggggttgccgccgataccaccaccacggaggaagaaggttgtgcaacttggaccttttgggacagcggtg

SEQ ID NO: 398310 - DNA, 140 bp, Artificial Sequence
  Synthetic
caccgctgtcccaaaaggtccaagttgcacaaccttcttcctccgtggtggtggtatcggcggcaacccctttggggggagtgcacatccggacacgaggggagggtcgtacgtcggggacatatcagcagccagggcct

SEQ ID NO: 398311 - DNA, 140 bp, Artificial Sequence
  Synthetic
atacgccatgctgggtctcctccaagttccgacgcggcgtcgagccaagtcgaggatgacatagagtcggacgccggctcgtacagctcaatgccgccactggagggagagcctggagaccgtacttgggagtcggccat

SEQ ID NO: 398312 - DNA, 140 bp, Artificial Sequence
  Synthetic
atggccgactcccaagtacggtctccaggctctccctccagtggcggcattgagctgtacgagccggcgtccgactctatgtcatcctcgacttggctcgacgccgcgtcggaacttggaggagacccagcatggcgtat

SEQ ID NO: 398313 - DNA, 140 bp, Artificial Sequence
  Synthetic
aggccctggctgctgatatgacgccggctcgtacagctcaatgccgccactggagggagagcctggagacccggacctcagttcggggtcatggtctacagttagtgaggagggcgacaggaccttttgggacagcggtg

SEQ ID NO: 398314 - DNA, 140 bp, Artificial Sequence
  Synthetic
caccgctgtcccaaaaggtcctgtcgccctcctcactaactgtagaccatgaccccgaactgaggtccgggtctccaggctctccctccagtggcggcattgagctgtacgagccggcgtcatatcagcagccagggcct

SEQ ID NO: 398315 - DNA, 140 bp, Artificial Sequence
  Synthetic
aggccctggctgctgatatgcaggggtggcgactccttgcgcctatcacggcctattcccaacagacgcggggcctgcttggctgcatcatcactagcctcacaggccgggacaagaaccgaccttttgggacagcggtg

SEQ ID NO: 398316 - DNA, 140 bp, Artificial Sequence
  Synthetic
caccgctgtcccaaaaggtcggttcttgtcccggcctgtgaggctagtgatgatgcagccaagcaggccccgcgtctgttgggaataggccgtgataggcgcaaggagtcgccacccctgcatatcagcagccagggcct

SEQ ID NO: 398317 - DNA, 140 bp, Artificial Sequence
  Synthetic
atacgccatgctgggtctccgccgaaacaacgggtagattacctcctgggcgtatggcgctcaaagagagtccctatggggttctcctacgacaccaggtgctttgactcgacagtcacacgtacttgggagtcggccat

SEQ ID NO: 398318 - DNA, 140 bp, Artificial Sequence
  Synthetic
atggccgactcccaagtacgtgtgactgtcgagtcaaagcacctggtgtcgtaggagaaccccatagggactctctttgagcgccatacgcccaggaggtaatctacccgttgtttcggcggagacccagcatggcgtat

SEQ ID NO: 398319 - DNA, 140 bp, Artificial Sequence
  Synthetic
aggccctggctgctgatatgtccctatggggttctcctacgacaccaggtgctttgactcgacagtcacagagcgtgacatccgcactgaacatgacatttttatgtgctgcaaactagagaccttttgggacagcggtg

SEQ ID NO: 398320 - DNA, 140 bp, Artificial Sequence
  Synthetic
caccgctgtcccaaaaggtctctagtttgcagcacataaaaatgtcatgttcagtgcggatgtcacgctctgtgactgtcgagtcaaagcacctggtgtcgtaggagaaccccatagggacatatcagcagccagggcct

SEQ ID NO: 398321 - DNA, 140 bp, Artificial Sequence
  Synthetic
atacgccatgctgggtctccgatgctactttttgccggcgtcgatggggatacacacgtggtggggggggagacggcccgtagtgccttcagctttgcgcgcttctttagcgttgggccgcgtacttgggagtcggccat

SEQ ID NO: 398322 - DNA, 140 bp, Artificial Sequence
  Synthetic
atggccgactcccaagtacgcggcccaacgctaaagaagcgcgcaaagctgaaggcactacgggccgtctccccccccaccacgtgtgtatccccatcgacgccggcaaaaagtagcatcggagacccagcatggcgtat

SEQ ID NO: 398323 - DNA, 140 bp, Artificial Sequence
  Synthetic
atacgccatgctgggtctcctgttctacgcccacaggttcaactcgtccggatgcccggagcgcatggccagctgccgccccattgacaagttcgctcaggggtggggtcccatcacttacgtacttgggagtcggccat

SEQ ID NO: 398324 - DNA, 140 bp, Artificial Sequence
  Synthetic
atggccgactcccaagtacgtaagtgatgggaccccacccctgagcgaacttgtcaatggggcggcagctggccatgcgctccgggcatccggacgagttgaacctgtgggcgtagaacaggagacccagcatggcgtat

SEQ ID NO: 398325 - DNA, 140 bp, Artificial Sequence
  Synthetic
aggccctggctgctgatatgagctgccgccccattgacaagttcgctcaggggtggggtcccatcacttacgctaagccggccagcttggaccagaggccctattgttggcactacgcacgaccttttgggacagcggtg

SEQ ID NO: 398326 - DNA, 140 bp, Artificial Sequence
  Synthetic
caccgctgtcccaaaaggtcgtgcgtagtgccaacaatagggcctctggtccaagctggccggcttagcgtaagtgatgggaccccacccctgagcgaacttgtcaatggggcggcagctcatatcagcagccagggcct

SEQ ID NO: 398327 - DNA, 140 bp, Artificial Sequence
  Synthetic
aggccctggctgctgatatggcgcgtcccaggcccgaccccgcatgttactcctgtgcctactcctactctctgtaggggtaggcatcttcctgctccccgctcgataagcgaggagcctgaccttttgggacagcggtg

SEQ ID NO: 398328 - DNA, 140 bp, Artificial Sequence
  Synthetic
caccgctgtcccaaaaggtcaggctcctcgcttatcgagcggggagcaggaagatgcctacccctacagagagtaggagtaggcacaggagtaacatgcggggtcgggcctgggacgcgccatatcagcagccagggcct

SEQ ID NO: 398329 - DNA, 140 bp, Artificial Sequence
  Synthetic
atacgccatgctgggtctcccccctggggggcgtagcggcggcccttgcacatggtgtcagggccatcgaggacgggatcaactacgcaacagggaaccttcccggttgctccttttctacgtacttgggagtcggccat

SEQ ID NO: 398330 - DNA, 140 bp, Artificial Sequence
  Synthetic
atggccgactcccaagtacgtagaaaaggagcaaccgggaaggttccctgttgcgtagttgatcccgtcctcgatggccctgacaccatgtgcaagggccgccgctacgccccccaggggggagacccagcatggcgtat

SEQ ID NO: 398331 - DNA, 140 bp, Artificial Sequence
  Synthetic
aggccctggctgctgatatgtctacctcctccccaaccgatgaacctagtcacggctatctgtgaggccatagctgtttcctgaccttccaagattctgatgtactatgatgtccatatagaccttttgggacagcggtg

SEQ ID NO: 398332 - DNA, 140 bp, Artificial Sequence
  Synthetic
caccgctgtcccaaaaggtctatatggacatcatagtacatcagaatcttggaaggtcaggaaacagctatggcctcacagatagccgtgactaggttcatcggttggggaggaggtagacatatcagcagccagggcct

SEQ ID NO: 398333 - DNA, 140 bp, Artificial Sequence
  Synthetic
  misc_feature (63)..(63): n is a, c, g, or t
atacgccatgctgggtctcccggtcacgtagacctcctagtaggcacagctgcgttctgctcngccatgtacgtcggtgatttgtgcggcggcatattcctgctcggccagttgatcactcgtacttgggagtcggccat

SEQ ID NO: 398334 - DNA, 140 bp, Artificial Sequence
  Synthetic
  misc_feature (78)..(78): n is a, c, g, or t
atggccgactcccaagtacgagtgatcaactggccgagcaggaatatgccgccgcacaaatcaccgacgtacatggcngagcagaacgcagctgtgcctactaggaggtctacgtgaccgggagacccagcatggcgtat

SEQ ID NO: 398335 - DNA, 140 bp, Artificial Sequence
  Synthetic
aggccctggctgctgatatgggtcacctaccgccacgttggtcacatcgtacgtgctgcgcattccccaagtgatcatcgacattttcgtcggaggtcattggggagtgattgcaggcatgaccttttgggacagcggtg

SEQ ID NO: 398336 - DNA, 140 bp, Artificial Sequence
  Synthetic
caccgctgtcccaaaaggtcatgcctgcaatcactccccaatgacctccgacgaaaatgtcgatgatcacttggggaatgcgcagcacgtacgatgtgaccaacgtggcggtaggtgacccatatcagcagccagggcct

SEQ ID NO: 398337 - DNA, 140 bp, Artificial Sequence
  Synthetic
  misc_feature (24)..(24): n is a, c, g, or t
  misc_feature (75)..(75): n is a, c, g, or t
  misc_feature (86)..(86): n is a, c, g, or t
atacgccatgctgggtctccggcngtgcaacacaagggctcacggctctcttcaggccaggatcgcagcagaacntccagctggtnaagactaatgggagctggcacatcaataggacagcgtacttgggagtcggccat

SEQ ID NO: 398338 - DNA, 140 bp, Artificial Sequence
  Synthetic
  misc_feature (55)..(55): n is a, c, g, or t
  misc_feature (66)..(66): n is a, c, g, or t
  misc_feature (117)..(117): n is a, c, g, or t
atggccgactcccaagtacgctgtcctattgatgtgccagctcccattagtcttnaccagctggangttctgctgcgatcctggcctgaagagagccgtgagcccttgtgttgcacngccggagacccagcatggcgtat

SEQ ID NO: 398339 - DNA, 140 bp, Artificial Sequence
  Synthetic
  misc_feature (105)..(105): n is a, c, g, or t
atacgccatgctgggtctcccaaaccgctcactgagttcgaccagggatggggccctataacatatgccaatataagcgggtcgtcgcaagacaagccgtattgntggcactatgccccacgtacttgggagtcggccat

SEQ ID NO: 398340 - DNA, 140 bp, Artificial Sequence
  Synthetic
  misc_feature (36)..(36): n is a, c, g, or t
atggccgactcccaagtacgtggggcatagtgccancaatacggcttgtcttgcgacgacccgcttatattggcatatgttatagggccccatccctggtcgaactcagtgagcggtttgggagacccagcatggcgtat

SEQ ID NO: 398341 - DNA, 140 bp, Artificial Sequence
  Synthetic
  misc_feature (55)..(55): n is a, c, g, or t
aggccctggctgctgatatgatataagcgggtcgtcgcaagacaagccgtattgntggcactatgccccacgaccatgtgggatcatacctgcaagggatgtctgtggccccgtctattggaccttttgggacagcggtg

SEQ ID NO: 398342 - DNA, 140 bp, Artificial Sequence
  Synthetic
  misc_feature (86)..(86): n is a, c, g, or t
caccgctgtcccaaaaggtccaatagacggggccacagacatcccttgcaggtatgatcccacatggtcgtggggcatagtgccancaatacggcttgtcttgcgacgacccgcttatatcatatcagcagccagggcct

SEQ ID NO: 398343 - DNA, 140 bp, Artificial Sequence
  Synthetic
  misc_feature (111)..(111): n is a, c, g, or t
  misc_feature (120)..(120): n is a, c, g, or t
aggccctggctgctgatatgggggttcaccaagacgtgcggggcacctccctgtatcattgggccaagaggcaacaagtccctcacctgccctactgattgtttccggaancatccggangaccttttgggacagcggtg

SEQ ID NO: 398344 - DNA, 140 bp, Artificial Sequence
  Synthetic
  misc_feature (21)..(21): n is a, c, g, or t
  misc_feature (30)..(30): n is a, c, g, or t
caccgctgtcccaaaaggtcntccggatgnttccggaaacaatcagtagggcaggtgagggacttgttgcctcttggcccaatgatacagggaggtgccccgcacgtcttggtgaacccccatatcagcagccagggcct

SEQ ID NO: 398345 - DNA, 140 bp, Artificial Sequence
  Synthetic
aggccctggctgctgatatggacgaccgtgccccaagacgcggtgtcgcgctcgcagcggcgaggcaggactggtaggggcagggcaggcatctacaggtttgtgactccaggagaacgggaccttttgggacagcggtg

SEQ ID NO: 398346 - DNA, 140 bp, Artificial Sequence
  Synthetic
caccgctgtcccaaaaggtcccgttctcctggagtcacaaacctgtagatgcctgccctgcccctaccagtcctgcctcgccgctgcgagcgcgacaccgcgtcttggggcacggtcgtccatatcagcagccagggcct

SEQ ID NO: 398347 - DNA, 140 bp, Artificial Sequence
  Synthetic
aggccctggctgctgatatgacctgggtgctagtaggcggagtccttgcagctctggccgcgtattgcctgacaacaggcagcgtggtcattgtgggcagaatcatcttgtccgggaagcgaccttttgggacagcggtg

SEQ ID NO: 398348 - DNA, 140 bp, Artificial Sequence
  Synthetic
caccgctgtcccaaaaggtcgcttcccggacaagatgattctgcccacaatgaccacgctgcctgttgtcaggcaatacgcggccagagctgcaaggactccgcctactagcacccaggtcatatcagcagccagggcct

SEQ ID NO: 398349 - DNA, 140 bp, Artificial Sequence
  Synthetic
atacgccatgctgggtctccgacacggaggtgttggcatccatgctgacagacccgtcccacattacggccgaggcggcggcgagacgcctggcccggggctcacccccctctgcggctacgtacttgggagtcggccat

SEQ ID NO: 398350 - DNA, 140 bp, Artificial Sequence
  Synthetic
atggccgactcccaagtacgtagccgcagaggggggtgagccccgggccaggcgtctcgccgccgcctcggccgtaatgtgggacgggtctgtcagcatggatgccaacacctccgtgtcggagacccagcatggcgtat

SEQ ID NO: 398351 - DNA, 140 bp, Artificial Sequence
  Synthetic
atacgccatgctgggtctcctccgtcgtgtggcttgtggtaagtatgtgcaggcctgtctcctacggttaggagcttggactggcacttatatctatgaccacctagcacccctctctgacgtacttgggagtcggccat

SEQ ID NO: 398352 - DNA, 140 bp, Artificial Sequence
  Synthetic
atggccgactcccaagtacgtcagagaggggtgctaggtggtcatagatataagtgccagtccaagctcctaaccgtaggagacaggcctgcacatacttaccacaagccacacgacggaggagacccagcatggcgtat

SEQ ID NO: 398353 - DNA, 140 bp, Artificial Sequence
  Synthetic
aggccctggctgctgatatgggagcttggactggcacttatatctatgaccacctagcacccctctctgactgggccagcgatggtttgcgcgagcttgccgttgccgttgagccagtcagaccttttgggacagcggtg

SEQ ID NO: 398354 - DNA, 140 bp, Artificial Sequence
  Synthetic
caccgctgtcccaaaaggtctgactggctcaacggcaacggcaagctcgcgcaaaccatcgctggcccagtcagagaggggtgctaggtggtcatagatataagtgccagtccaagctcccatatcagcagccagggcct

SEQ ID NO: 398355 - DNA, 140 bp, Artificial Sequence
  Synthetic
aggccctggctgctgatatgctgggccagcgatggtttgcgcgagcttgccgttgccgttgagccagtcattttctcgcccatggagaagaaggtcatcacctggggggcggacacggccgaccttttgggacagcggtg

SEQ ID NO: 398356 - DNA, 140 bp, Artificial Sequence
  Synthetic
caccgctgtcccaaaaggtcggccgtgtccgccccccaggtgatgaccttcttctccatgggcgagaaaatgactggctcaacggcaacggcaagctcgcgcaaaccatcgctggcccagcatatcagcagccagggcct

SEQ ID NO: 398357 - DNA, 140 bp, Artificial Sequence
  Synthetic
atacgccatgctgggtctcctctactattagttggcccggccgatgacgctcgaggccttgggtggaagctgctagcccccatcactgcataccatcagcagacccgtggcctactggggcgtacttgggagtcggccat

SEQ ID NO: 398358 - DNA, 140 bp, Artificial Sequence
  Synthetic
atggccgactcccaagtacgccccagtaggccacgggtctgctgatggtatgcagtgatgggggctagcagcttccacccaaggcctcgagcgtcatcggccgggccaactaatagtagaggagacccagcatggcgtat

SEQ ID NO: 398359 - DNA, 140 bp, Artificial Sequence
  Synthetic
aggccctggctgctgatatgtgctagcccccatcactgcataccatcagcagacccgtggcctactggggactatcgtcactagcctcacgggccgtgacaaaaatgaagttgagggtgagaccttttgggacagcggtg

SEQ ID NO: 398360 - DNA, 140 bp, Artificial Sequence
  Synthetic
caccgctgtcccaaaaggtctcaccctcaacttcatttttgtcacggcccgtgaggctagtgacgatagtccccagtaggccacgggtctgctgatggtatgcagtgatgggggctagcacatatcagcagccagggcct

SEQ ID NO: 398361 - DNA, 140 bp, Artificial Sequence
  Synthetic
aggccctggctgctgatatgggcccgaaagggccggtttgccagatgtacaccaatgtagaccaagacttggtggggtggccggctccaccgggtgccaagtccctgacgccttgcacttgaccttttgggacagcggtg

SEQ ID NO: 398362 - DNA, 140 bp, Artificial Sequence
  Synthetic
caccgctgtcccaaaaggtcaagtgcaaggcgtcagggacttggcacccggtggagccggccaccccaccaagtcttggtctacattggtgtacatctggcaaaccggccctttcgggcccatatcagcagccagggcct

SEQ ID NO: 398363 - DNA, 140 bp, Artificial Sequence
  Synthetic
atacgccatgctgggtctccgagcatcctcaaggggtcgtcgggcggaccagtcttgtgttcatctggccatgtcgtcggcttgttccgtgcggccgtgtgcacccgaggtgttgctaagcgtacttgggagtcggccat

SEQ ID NO: 398364 - DNA, 140 bp, Artificial Sequence
  Synthetic
atggccgactcccaagtacgcttagcaacacctcgggtgcacacggccgcacggaacaagccgacgacatggccagatgaacacaagactggtccgcccgacgaccccttgaggatgctcggagacccagcatggcgtat

SEQ ID NO: 398365 - DNA, 140 bp, Artificial Sequence
  Synthetic
atacgccatgctgggtctcctggggtatttacatgccccgactggtagcgggaagagcacgaaagtgccagcagcgtacgccgctcagggctacaaggtgctggtgcttaatccatctgtcgtacttgggagtcggccat

SEQ ID NO: 398366 - DNA, 140 bp, Artificial Sequence
  Synthetic
atggccgactcccaagtacgacagatggattaagcaccagcaccttgtagccctgagcggcgtacgctgctggcactttcgtgctcttcccgctaccagtcggggcatgtaaataccccaggagacccagcatggcgtat

SEQ ID NO: 398367 - DNA, 140 bp, Artificial Sequence
  Synthetic
atacgccatgctgggtctccacatattcaacatatggcaaattcctagcagatggggggtgctccggaggggcttatgacatcatcatatgtgacgagtgccactcaaccgaccccaccacgtacttgggagtcggccat

SEQ ID NO: 398368 - DNA, 140 bp, Artificial Sequence
  Synthetic
atggccgactcccaagtacgtggtggggtcggttgagtggcactcgtcacatatgatgatgtcataagcccctccggagcaccccccatctgctaggaatttgccatatgttgaatatgtggagacccagcatggcgtat

SEQ ID NO: 398369 - DNA, 140 bp, Artificial Sequence
  Synthetic
atacgccatgctgggtctccactggatacaccggcgacttcgactctgtgatagattgcaatgtggcagtcactcaggtagtcgattttagcctggaccctacctttacaattgagactacgtacttgggagtcggccat

SEQ ID NO: 398370 - DNA, 140 bp, Artificial Sequence
  Synthetic
atggccgactcccaagtacgtagtctcaattgtaaaggtagggtccaggctaaaatcgactacctgagtgactgccacattgcaatctatcacagagtcgaagtcgccggtgtatccagtggagacccagcatggcgtat

SEQ ID NO: 398371 - DNA, 140 bp, Artificial Sequence
  Synthetic
aggccctggctgctgatatgccccgctggttctggttttgcctactcctgcttgctgcaggggtaggcatctacctcctccccaaccgatgaaggttggggtaaacactccggcctcttagaccttttgggacagcggtg

SEQ ID NO: 398372 - DNA, 140 bp, Artificial Sequence
  Synthetic
caccgctgtcccaaaaggtctaagaggccggagtgtttaccccaaccttcatcggttggggaggaggtagatgcctacccctgcagcaagcaggagtaggcaaaaccagaaccagcggggcatatcagcagccagggcct

SEQ ID NO: 398373 - DNA, 140 bp, Artificial Sequence
  Synthetic
aggccctggctgctgatatgggagggggtattcactgggctcacgcacattgatgcccacttcctctcacaaacaaaacaggggggggaaaattttgcatacttggttgcttatcaggcggaccttttgggacagcggtg

SEQ ID NO: 398374 - DNA, 140 bp, Artificial Sequence
  Synthetic
caccgctgtcccaaaaggtccgcctgataagcaaccaagtatgcaaaattttcccccccctgttttgtttgtgagaggaagtgggcatcaatgtgcgtgagcccagtgaataccccctcccatatcagcagccagggcct

SEQ ID NO: 398375 - DNA, 140 bp, Artificial Sequence
  Synthetic
atacgccatgctgggtctcctgtacagacttggagccgtacagaatgagattaccaccacacacccaatcacaaaatacatcatgacctgtatgtctgctgacctcgaggtgataactagcgtacttgggagtcggccat

SEQ ID NO: 398376 - DNA, 140 bp, Artificial Sequence
  Synthetic
atggccgactcccaagtacgctagttatcacctcgaggtcagcagacatacaggtcatgatgtattttgtgattgggtgtgtggtggtaatctcattctgtacggctccaagtctgtacaggagacccagcatggcgtat

SEQ ID NO: 398377 - DNA, 140 bp, Artificial Sequence
  Synthetic
atacgccatgctgggtctcccacatcaaccgcaccgctctgaactgcaatgactccctccagactggatttattgctgcgctgttctacgcgcacaagttcaactcgtctggatgtcctgcgtacttgggagtcggccat

SEQ ID NO: 398378 - DNA, 140 bp, Artificial Sequence
  Synthetic
atggccgactcccaagtacgcaggacatccagacgagttgaacttgtgcgcgtagaacagcgcagcaataaatccagtctggagggagtcattgcagttcagagcggtgcggttgatgtgggagacccagcatggcgtat

SEQ ID NO: 398379 - DNA, 140 bp, Artificial Sequence
  Synthetic
atacgccatgctgggtctcccgtctctggtgctttggtggccttcaaaatcatgagtggagaggcaccagcagtcgaagacatggtcaacctcctgcccgccctgttgtcgcctggagcccgtacttgggagtcggccat

SEQ ID NO: 398380 - DNA, 140 bp, Artificial Sequence
  Synthetic
atggccgactcccaagtacgggctccaggcgacaacagggcgggcaggaggttgaccatgtcttcgactgctggtgcctctccactcatgattttgaaggccaccaaagcaccagagacgggagacccagcatggcgtat

SEQ ID NO: 398381 - DNA, 140 bp, Artificial Sequence
  Synthetic
atacgccatgctgggtctcccttggctgagggacatctgggattgggtttgcaccgtactctctgactttaagacctggctcaaagccaagctcgtgccctccctgccaggcattcccttcgtacttgggagtcggccat

SEQ ID NO: 398382 - DNA, 140 bp, Artificial Sequence
  Synthetic
atggccgactcccaagtacgaagggaatgcctggcagggagggcacgagcttggctttgagccaggtcttaaagtcagagagtacggtgcaaacccaatcccagatgtccctcagccaagggagacccagcatggcgtat

SEQ ID NO: 398383 - DNA, 140 bp, Artificial Sequence
  Synthetic
  misc_feature (25)..(25): n is a, c, g, or t
  misc_feature (61)..(61): n is a, c, g, or t
  misc_feature (85)..(85): n is a, c, g, or t
  misc_feature (88)..(88): n is a, c, g, or t
  misc_feature (91)..(91): n is a, c, g, or t
  misc_feature (106)..(106): n is a, c, g, or t
atacgccatgctgggtctccgctanaccacctgcggctgcggagccaatatcacgggtcangtgaaaaatgggaccatgaagatngcnggncctaggacctgcagnaacgtctggcatggcgtacttgggagtcggccat

SEQ ID NO: 398384 - DNA, 140 bp, Artificial Sequence
  Synthetic
  misc_feature (35)..(35): n is a, c, g, or t
  misc_feature (50)..(50): n is a, c, g, or t
  misc_feature (53)..(53): n is a, c, g, or t
  misc_feature (56)..(56): n is a, c, g, or t
  misc_feature (80)..(80): n is a, c, g, or t
  misc_feature (116)..(116): n is a, c, g, or t
atggccgactcccaagtacgccatgccagacgttnctgcaggtcctaggnccngcnatcttcatggtcccatttttcacntgacccgtgatattggctccgcagccgcaggtggtntagcggagacccagcatggcgtat

SEQ ID NO: 398385 - DNA, 140 bp, Artificial Sequence
  Synthetic
atacgccatgctgggtctccgaggttatgcgtattaatgactgccattacgtggtaggggctacagctgacaacttgaagtgcccctgccaggtaccagcgccagaattcttcaccatggcgtacttgggagtcggccat

SEQ ID NO: 398386 - DNA, 140 bp, Artificial Sequence
  Synthetic
atggccgactcccaagtacgccatggtgaagaattctggcgctggtacctggcaggggcacttcaagttgtcagctgtagcccctaccacgtaatggcagtcattaatacgcataacctcggagacccagcatggcgtat

SEQ ID NO: 398387 - DNA, 140 bp, Artificial Sequence
  Synthetic
aggccctggctgctgatatgaatcaccaaactcctgctcgccatactcggcccgctcgtggtgctccaggctggcatgatcagggtgccatacttcgtgcgcgcccaggggctcattcgtgaccttttgggacagcggtg

SEQ ID NO: 398388 - DNA, 140 bp, Artificial Sequence
  Synthetic
caccgctgtcccaaaaggtcacgaatgagcccctgggcgcgcacgaagtatggcaccctgatcatgccagcctggagcaccacgagcgggccgagtatggcgagcaggagtttggtgattcatatcagcagccagggcct

SEQ ID NO: 398389 - DNA, 140 bp, Artificial Sequence
  Synthetic
aggccctggctgctgatatgcctgactacaatccaccgttgttggaggtctggaagtccccgacgtacgaccctcccctcgtgtccggttgcgcactccccccaaaggggttgccgccgagaccttttgggacagcggtg

SEQ ID NO: 398390 - DNA, 140 bp, Artificial Sequence
  Synthetic
caccgctgtcccaaaaggtctcggcggcaacccctttggggggagtgcgcaaccggacacgaggggagggtcgtacgtcggggacttccagacctccaacaacggtggattgtagtcaggcatatcagcagccagggcct

SEQ ID NO: 398391 - DNA, 140 bp, Artificial Sequence
  Synthetic
aggccctggctgctgatatgcaatctggtgtatgccaccacctcacgtagtgcttcccttcgtcaacggaaggtgacatttgaccgcgtccaactacttgatcaacactatcatgacactgaccttttgggacagcggtg

SEQ ID NO: 398392 - DNA, 140 bp, Artificial Sequence
  Synthetic
caccgctgtcccaaaaggtcagtgtcatgatagtgttgatcaagtagttggacgcggtcaaatgtcaccttccgttgacgaagggaagcactacgtgaggtggtggcatacaccagattgcatatcagcagccagggcct

SEQ ID NO: 398393 - DNA, 140 bp, Artificial Sequence
  Synthetic
  misc_feature (112)..(112): n is a, c, g, or t
atacgccatgctgggtctcctcgggtacggggcaaaggatgttcgcgaccatgccagcaaggccattaaccacatcaactccgtgtgggaggacttgctggaagacagttcnacacctatcgtacttgggagtcggccat

SEQ ID NO: 398394 - DNA, 140 bp, Artificial Sequence
  Synthetic
  misc_feature (29)..(29): n is a, c, g, or t
atggccgactcccaagtacgataggtgtngaactgtcttccagcaagtcctcccacacggagttgatgtggttaatggccttgctggcatggtcgcgaacatcctttgccccgtacccgaggagacccagcatggcgtat

SEQ ID NO: 398395 - DNA, 140 bp, Artificial Sequence
  Synthetic
aggccctggctgctgatatgtggattacctcctgggcgtatggcgttcaaagaaagtccctatgggattctcttacgacaccagatgctttgactcaacagtcacagagagagacatccggaccttttgggacagcggtg

SEQ ID NO: 398396 - DNA, 140 bp, Artificial Sequence
  Synthetic
caccgctgtcccaaaaggtccggatgtctctctctgtgactgttgagtcaaagcatctggtgtcgtaagagaatcccatagggactttctttgaacgccatacgcccaggaggtaatccacatatcagcagccagggcct

SEQ ID NO: 398397 - DNA, 140 bp, Artificial Sequence
  Synthetic
atacgccatgctgggtctccaactccaagggccagtcatgtgggtatcgcagatgccgggccagtggcgtcctcaccactagccttggcaataccctgacatgctacataaaagcccaagcgtacttgggagtcggccat

SEQ ID NO: 398398 - DNA, 140 bp, Artificial Sequence
  Synthetic
atggccgactcccaagtacgcttgggcttttatgtagcatgtcagggtattgccaaggctagtggtgaggacgccactggcccggcatctgcgatacccacatgactggcccttggagttggagacccagcatggcgtat

SEQ ID NO: 398399 - DNA, 140 bp, Artificial Sequence
  Synthetic
aggccctggctgctgatatgctcgtggacatccttgcagggtatggcgcgggcgtggcgggggctctcgtagcattcaagatcatgagcggtgaggtcccctccacagaagacctggtcagaccttttgggacagcggtg

SEQ ID NO: 398400 - DNA, 140 bp, Artificial Sequence
  Synthetic
caccgctgtcccaaaaggtctgaccaggtcttctgtggaggggacctcaccgctcatgatcttgaatgctacgagagcccccgccacgcccgcgccataccctgcaaggatgtccacgagcatatcagcagccagggcct

SEQ ID NO: 398401 - DNA, 140 bp, Artificial Sequence
  Synthetic
atacgccatgctgggtctccggcacactccagtgaactcgtggttgggaaacatcatcatgtacgcgcccacgatatgggtgcggatggtgttgatgactcatttcttcagtatactccacgtacttgggagtcggccat

SEQ ID NO: 398402 - DNA, 140 bp, Artificial Sequence
  Synthetic
atggccgactcccaagtacgtggagtatactgaagaaatgagtcatcaacaccatccgcacccatatcgtgggcgcgtacatgatgatgtttcccaaccacgagttcactggagtgtgccggagacccagcatggcgtat

SEQ ID NO: 398403 - DNA, 140 bp, Artificial Sequence
  Synthetic
atacgccatgctgggtctcccatactccatcactccattggacttaccgcaaatcatccagcggttacatggcatggccgccttttcactccacggttactctccaggagagctcaatcgcgtacttgggagtcggccat

SEQ ID NO: 398404 - DNA, 140 bp, Artificial Sequence
  Synthetic
atggccgactcccaagtacgcgattgagctctcctggagagtaaccgtggagtgaaaaggcggccatgccatgtaaccgctggatgatttgcggtaagtccaatggagtgatggagtatgggagacccagcatggcgtat

SEQ ID NO: 398405 - DNA, 140 bp, Artificial Sequence
  Synthetic
atacgccatgctgggtctcctcgtggccggcggaagcgggggggacgtatttcacagcgcgccccaggcccgaccccgcatgttactcctgtgcctactcctactctccgtaggggtaggcgtacttgggagtcggccat

SEQ ID NO: 398406 - DNA, 140 bp, Artificial Sequence
  Synthetic
atggccgactcccaagtacgcctacccctacggagagtaggagtaggcacaggagtaacatgcggggtcgggcctggggcgcgctgtgaaatacgtcccccccgcttccgccggccacgaggagacccagcatggcgtat

SEQ ID NO: 398407 - DNA, 140 bp, Artificial Sequence
  Synthetic
aggccctggctgctgatatgcgaccccgcatgttactcctgtgcctactcctactctccgtaggggtaggcattttcctgctccccgctcgataggcgggaagcccaacgcaacactccagaccttttgggacagcggtg

SEQ ID NO: 398408 - DNA, 140 bp, Artificial Sequence
  Synthetic
caccgctgtcccaaaaggtctggagtgttgcgttgggcttcccgcctatcgagcggggagcaggaaaatgcctacccctacggagagtaggagtaggcacaggagtaacatgcggggtcgcatatcagcagccagggcct

SEQ ID NO: 398409 - DNA, 140 bp, Artificial Sequence
  Synthetic
atacgccatgctgggtctcccgtgcaccatgagcacgaatcctaaacctcaaagattaaccaaaagaaacaccgtccgtcgcccacagaacgttaagttcccgggtggcgggcagatcgtcgtacttgggagtcggccat

SEQ ID NO: 398410 - DNA, 140 bp, Artificial Sequence
  Synthetic
atggccgactcccaagtacgacgatctgcccgccacccgggaacttaacgttctgtgggcgacggacggtgtttcttttggttaatctttgaggtttaggattcgtgctcatggtgcacgggagacccagcatggcgtat

SEQ ID NO: 398411 - DNA, 140 bp, Artificial Sequence
  Synthetic
atacgccatgctgggtctccatccccaaagctgcctcttcacagggtaaagcctggggcaagcccgggtacccttggcccctgtatggtaacgagggctgtggctgggcagggtggctcccgtacttgggagtcggccat

SEQ ID NO: 398412 - DNA, 140 bp, Artificial Sequence
  Synthetic
atggccgactcccaagtacgggagccaccctgcccagccacagccctcgttaccatacaggggccaagggtacccgggcttgccccaggctttaccctgtgaagaggcagctttggggatggagacccagcatggcgtat

SEQ ID NO: 398413 - DNA, 140 bp, Artificial Sequence
  Synthetic
atacgccatgctgggtctcccgacctcatggggtacatccctgtcctaggcgcccccctagggggcgttgccagggctctggcacatggtgttagagttctggaggacggggtcaactatcgtacttgggagtcggccat

SEQ ID NO: 398414 - DNA, 140 bp, Artificial Sequence
  Synthetic
atggccgactcccaagtacgatagttgaccccgtcctccagaactctaacaccatgtgccagagccctggcaacgccccctaggggggcgcctaggacagggatgtaccccatgaggtcgggagacccagcatggcgtat

SEQ ID NO: 398415 - DNA, 140 bp, Artificial Sequence
  Synthetic
aggccctggctgctgatatgttgggtggcggtgacccccacggtggccaccagggacggcaaactccccacaacgcagcttcgacgtcacatcgatctgcttgtcgggagtgccaccctcgaccttttgggacagcggtg

SEQ ID NO: 398416 - DNA, 140 bp, Artificial Sequence
  Synthetic
caccgctgtcccaaaaggtcgagggtggcactcccgacaagcagatcgatgtgacgtcgaagctgcgttgtggggagtttgccgtccctggtggccaccgtgggggtcaccgccacccaacatatcagcagccagggcct

SEQ ID NO: 398417 - DNA, 140 bp, Artificial Sequence
  Synthetic
  misc_feature (25)..(25): n is a, c, g, or t
atacgccatgctgggtctccgtggngtctatcatctcaccaatgactgccccaacgctagtatagtctatgaaacagacaacgccatcctacacgagcctgggtgcgtgccttgcgttcgcgtacttgggagtcggccat

SEQ ID NO: 398418 - DNA, 140 bp, Artificial Sequence
  Synthetic
  misc_feature (116)..(116): n is a, c, g, or t
atggccgactcccaagtacgcgaacgcaaggcacgcacccaggctcgtgtaggatggcgttgtctgtttcatagactatactagcgttggggcagtcattggtgagatgatagacnccacggagacccagcatggcgtat

SEQ ID NO: 398419 - DNA, 140 bp, Artificial Sequence
  Synthetic
atacgccatgctgggtctccgtggtggcgtcagctaccctgtgctccgccttgtacgtgggggacatttgtggagccatcttcattgccagccaagctgttctctggaagcccgggggggcgtacttgggagtcggccat

SEQ ID NO: 398420 - DNA, 140 bp, Artificial Sequence
  Synthetic
atggccgactcccaagtacgcccccccgggcttccagagaacagcttggctggcaatgaagatggctccacaaatgtcccccacgtacaaggcggagcacagggtagctgacgccaccacggagacccagcatggcgtat

SEQ ID NO: 398421 - DNA, 140 bp, Artificial Sequence
  Synthetic
atacgccatgctgggtctccaatggttgccgcttacgctgtgagagtgcccggtgtcatcattaccactgtagcgggcggccactggggtgtgttatttggcctcgcttactttggtatgcgtacttgggagtcggccat

SEQ ID NO: 398422 - DNA, 140 bp, Artificial Sequence
  Synthetic
atggccgactcccaagtacgcataccaaagtaagcgaggccaaataacacaccccagtggccgcccgctacagtggtaatgatgacaccgggcactctcacagcgtaagcggcaaccattggagacccagcatggcgtat

SEQ ID NO: 398423 - DNA, 140 bp, Artificial Sequence
  Synthetic
atacgccatgctgggtctcccccttgtcagcctgctcaatccagggcccagtcagcgcctgcagctgatcaacaccaatgggtcatggcacatcaaccggaccgctttgaactgcaatgacgtacttgggagtcggccat

SEQ ID NO: 398424 - DNA, 140 bp, Artificial Sequence
  Synthetic
atggccgactcccaagtacgtcattgcagttcaaagcggtccggttgatgtgccatgacccattggtgttgatcagctgcaggcgctgactgggccctggattgagcaggctgacaagggggagacccagcatggcgtat

SEQ ID NO: 398425 - DNA, 140 bp, Artificial Sequence
  Synthetic
atacgccatgctgggtctcctttgaccaggggtggggcccgctgtggtacaattcaacagaaagaccttcggaccagcgaccctattgctggcactacgcgccatcgccgtgtggtattgcgtacttgggagtcggccat

SEQ ID NO: 398426 - DNA, 140 bp, Artificial Sequence
  Synthetic
atggccgactcccaagtacgcaataccacacggcgatggcgcgtagtgccagcaatagggtcgctggtccgaaggtctttctgttgaattgtaccacagcgggccccacccctggtcaaaggagacccagcatggcgtat

SEQ ID NO: 398427 - DNA, 140 bp, Artificial Sequence
  Synthetic
  misc_feature (43)..(43): n is a, c, g, or t
atacgccatgctgggtctcctgaaaatgagtctgatgtcttcntgctcaacagcacaaggccgccgcaaggcagttggtttgggtgctcatggatgaacacaacggggttcacgaagacccgtacttgggagtcggccat

SEQ ID NO: 398428 - DNA, 140 bp, Artificial Sequence
  Synthetic
  misc_feature (98)..(98): n is a, c, g, or t
atggccgactcccaagtacgggtcttcgtgaaccccgttgtgttcatccatgagcacccaaaccaactgccttgcggcggccttgtgctgttgagcangaagacatcagactcattttcaggagacccagcatggcgtat

SEQ ID NO: 398429 - DNA, 140 bp, Artificial Sequence
  Synthetic
atacgccatgctgggtctccactccgcttgcggatctggtccgtggttgacacctagatgcatggtccattacccctatagactgtggcactacccgtgtacagtcaacttcaccatacacgtacttgggagtcggccat

SEQ ID NO: 398430 - DNA, 140 bp, Artificial Sequence
  Synthetic
atggccgactcccaagtacgtgtatggtgaagttgactgtacacgggtagtgccacagtctataggggtaatggaccatgcatctaggtgtcaaccacggaccagatccgcaagcggagtggagacccagcatggcgtat

SEQ ID NO: 398431 - DNA, 140 bp, Artificial Sequence
  Synthetic
atacgccatgctgggtctccgacatgtcccccctgctccattccactacggagctcgcaatacttccgtgttcctttgtgccgcttccggccttatctacgggactgatccacctgcacccgtacttgggagtcggccat

SEQ ID NO: 398432 - DNA, 140 bp, Artificial Sequence
  Synthetic
atggccgactcccaagtacgggtgcaggtggatcagtcccgtagataaggccggaagcggcacaaaggaacacggaagtattgcgagctccgtagtggaatggagcaggggggacatgtcggagacccagcatggcgtat

SEQ ID NO: 398433 - DNA, 140 bp, Artificial Sequence
  Synthetic
atacgccatgctgggtctccggacgcgcggatctgcgcctgcctttggatgatgatgcttatggcccaggctgaagccgctctggagaacttgatccacctcaacgcggccagccttgcgcgtacttgggagtcggccat

SEQ ID NO: 398434 - DNA, 140 bp, Artificial Sequence
  Synthetic
atggccgactcccaagtacgcgcaaggctggccgcgttgaggtggatcaagttctccagagcggcttcagcctgggccataagcatcatcatccaaaggcaggcgcagatccgcgcgtccggagacccagcatggcgtat

SEQ ID NO: 398435 - DNA, 140 bp, Artificial Sequence
  Synthetic
atacgccatgctgggtctccggcccttcttcctcatgttgctgagcctccccccacgagcgtatgctctggacagggaagtgagcgcagcgttgggaacgggcatgctcgccatcatcctcgtacttgggagtcggccat

SEQ ID NO: 398436 - DNA, 140 bp, Artificial Sequence
  Synthetic
atggccgactcccaagtacgaggatgatggcgagcatgcccgttcccaacgctgcgctcacttccctgtccagagcatacgctcgtggggggaggctcagcaacatgaggaagaagggccggagacccagcatggcgtat

SEQ ID NO: 398437 - DNA, 140 bp, Artificial Sequence
  Synthetic
atacgccatgctgggtctccgtccctcctctcaaccctcgggggggcagggacggtttcatcctgtgtgtgctgctgtgctatccaggccttgtctttgacatcacaaaatggttgctggcgtacttgggagtcggccat

SEQ ID NO: 398438 - DNA, 140 bp, Artificial Sequence
  Synthetic
atggccgactcccaagtacgccagcaaccattttgtgatgtcaaagacaaggcctggatagcacagcagcacacacaggatgaaaccgtccctgcccccccgagggttgagaggagggacggagacccagcatggcgtat

SEQ ID NO: 398439 - DNA, 140 bp, Artificial Sequence
  Synthetic
atacgccatgctgggtctccgctagctgggggacggtacgtgcaggccgcgctgctcactattggccgctggaccggcacttatatttataaccatctcgcccccctggaaacatgggcccgtacttgggagtcggccat

SEQ ID NO: 398440 - DNA, 140 bp, Artificial Sequence
  Synthetic
atggccgactcccaagtacgggcccatgtttccaggggggcgagatggttataaatataagtgccggtccagcggccaatagtgagcagcgcggcctgcacgtaccgtcccccagctagcggagacccagcatggcgtat

SEQ ID NO: 398441 - DNA, 140 bp, Artificial Sequence
  Synthetic
atacgccatgctgggtctccgcgacattctttgtggcctgcctgtctcagctcggctcggcagggaagtcctgctagggcccgcggatgactacaggtccatgggatggcaactcctggccgtacttgggagtcggccat

SEQ ID NO: 398442 - DNA, 140 bp, Artificial Sequence
  Synthetic
atggccgactcccaagtacggccaggagttgccatcccatggacctgtagtcatccgcgggccctagcaggacttccctgccgagccgagctgagacaggcaggccacaaagaatgtcgcggagacccagcatggcgtat

SEQ ID NO: 398443 - DNA, 140 bp, Artificial Sequence
  Synthetic
atacgccatgctgggtctccgtgttgtccacctcaacgcagaccttcctggggaccaatgtgggcggtgtcatgtggggaccttatcacggagcgggcacgcggactgtggccggccgggcgtacttgggagtcggccat

SEQ ID NO: 398444 - DNA, 140 bp, Artificial Sequence
  Synthetic
atggccgactcccaagtacgcccggccggccacagtccgcgtgcccgctccgtgataaggtccccacatgacaccgcccacattggtccccaggaaggtctgcgttgaggtggacaacacggagacccagcatggcgtat

SEQ ID NO: 398445 - DNA, 140 bp, Artificial Sequence
  Synthetic
atacgccatgctgggtctccagcagacctttacttggtgacgcgcaatgctgacgtccttcctcttaggaggaagggtgacggtacagcgtccctactgtccccgcgccctgtgtcctcccgtacttgggagtcggccat

SEQ ID NO: 398446 - DNA, 140 bp, Artificial Sequence
  Synthetic
atggccgactcccaagtacgggaggacacagggcgcggggacagtagggacgctgtaccgtcacccttcctcctaagaggaaggacgtcagcattgcgcgtcaccaagtaaaggtctgctggagacccagcatggcgtat

SEQ ID NO: 398447 - DNA, 140 bp, Artificial Sequence
  Synthetic
atacgccatgctgggtctccagtttgttcccatcgagaagatgcaggtggcccagaggtcgccatcattcagtgacaatagcacccctccagcggtgcccagcacctatcaagtaggctacgtacttgggagtcggccat

SEQ ID NO: 398448 - DNA, 140 bp, Artificial Sequence
  Synthetic
atggccgactcccaagtacgtagcctacttgataggtgctgggcaccgctggaggggtgctattgtcactgaatgatggcgacctctgggccacctgcatcttctcgatgggaacaaactggagacccagcatggcgtat

SEQ ID NO: 398449 - DNA, 140 bp, Artificial Sequence
  Synthetic
aggccctggctgctgatatgccccactgactgtttccgcaagcatccggaagccacatactctcggtgtggctccggtccctggatcacgcccaggtgcctagtccactatccttacagggaccttttgggacagcggtg

SEQ ID NO: 398450 - DNA, 140 bp, Artificial Sequence
  Synthetic
caccgctgtcccaaaaggtccctgtaaggatagtggactaggcacctgggcgtgatccagggaccggagccacaccgagagtatgtggcttccggatgcttgcggaaacagtcagtggggcatatcagcagccagggcct

SEQ ID NO: 398451 - DNA, 140 bp, Artificial Sequence
  Synthetic
atacgccatgctgggtctccacccttgggtttggtgcctacatgtccaaggcttatggaattgatccaagtgtgcgcaccggcgcgcgcacggtgaccacgggggctcccataacttactcgtacttgggagtcggccat

SEQ ID NO: 398452 - DNA, 140 bp, Artificial Sequence
  Synthetic
atggccgactcccaagtacgagtaagttatgggagcccccgtggtcaccgtgcgcgcgccggtgcgcacacttggatcaattccataagccttggacatgtaggcaccaaacccaagggtggagacccagcatggcgtat

SEQ ID NO: 398453 - DNA, 140 bp, Artificial Sequence
  Synthetic
atacgccatgctgggtctcccggcataggcaccgtgttggaccaggcagagactagtggtgtccgacttgtggtgctagctacggccaccccccccggaagcgttacggtgccccacccccgtacttgggagtcggccat

SEQ ID NO: 398454 - DNA, 140 bp, Artificial Sequence
  Synthetic
atggccgactcccaagtacgggggtggggcaccgtaacgcttccggggggggtggccgtagctagcaccacaagtcggacaccactagtctctgcctggtccaacacggtgcctatgccgggagacccagcatggcgtat

SEQ ID NO: 398455 - DNA, 140 bp, Artificial Sequence
  Synthetic
atacgccatgctgggtctccgtcattccaaaaagaaatgtgatgagcttgccgggaagctcacctcattggggctgactgccgttgcttactatagggggttggatgtttcggtgatccccgtacttgggagtcggccat

SEQ ID NO: 398456 - DNA, 140 bp, Artificial Sequence
  Synthetic
atggccgactcccaagtacggggatcaccgaaacatccaaccccctatagtaagcaacggcagtcagccccaatgaggtgagcttcccggcaagctcatcacatttctttttggaatgacggagacccagcatggcgtat

SEQ ID NO: 398457 - DNA, 140 bp, Artificial Sequence
  Synthetic
aggccctggctgctgatatggctgcgtcgtgtggcggcgttgtccttgtcgggttaatgatgatgactctgtcaccgcactacaagcgccatatcagctggtgcatttggtggcttcagtgaccttttgggacagcggtg

SEQ ID NO: 398458 - DNA, 140 bp, Artificial Sequence
  Synthetic
caccgctgtcccaaaaggtcactgaagccaccaaatgcaccagctgatatggcgcttgtagtgcggtgacagagtcatcatcattaacccgacaaggacaacgccgccacacgacgcagccatatcagcagccagggcct

SEQ ID NO: 398459 - DNA, 140 bp, Artificial Sequence
  Synthetic
atacgccatgctgggtctccactgtagacttctccttggaccccaccttcactattgagaccaccacagtcccgcaagattctgtctcgcgctctcagagacgtgggaggacaggtagggcgtacttgggagtcggccat

SEQ ID NO: 398460 - DNA, 140 bp, Artificial Sequence
  Synthetic
atggccgactcccaagtacgccctacctgtcctcccacgtctctgagagcgcgagacagaatcttgcgggactgtggtggtctcaatagtgaaggtggggtccaaggagaagtctacagtggagacccagcatggcgtat

SEQ ID NO: 398461 - DNA, 140 bp, Artificial Sequence
  Synthetic
atacgccatgctgggtctcccacattaataggactgccctgaactgcaatgactcccttaagaccgggtttgtggccgcgctgttctactataacaagttcaactcgtccggatgcccagcgtacttgggagtcggccat

SEQ ID NO: 398462 - DNA, 140 bp, Artificial Sequence
  Synthetic
atggccgactcccaagtacgctgggcatccggacgagttgaacttgttatagtagaacagcgcggccacaaacccggtcttaagggagtcattgcagttcagggcagtcctattaatgtgggagacccagcatggcgtat

SEQ ID NO: 398463 - DNA, 140 bp, Artificial Sequence
  Synthetic
atacgccatgctgggtctccgtatgaactaacgcccagtgaaaccaccacgcgcctcagagcctacctcaattgccctggtcttccagtgtgccaagaccatctggagttctgggagggccgtacttgggagtcggccat

SEQ ID NO: 398464 - DNA, 140 bp, Artificial Sequence
  Synthetic
atggccgactcccaagtacggccctcccagaactccagatggtcttggcacactggaagaccagggcaattgaggtaggctctgaggcgcgtggtggtttcactgggcgttagttcatacggagacccagcatggcgtat

SEQ ID NO: 398465 - DNA, 140 bp, Artificial Sequence
  Synthetic
atacgccatgctgggtctccgcgcccgggcgaaagcccccccgccctcctgggacgtccagtggaagtgtctccaaagactaaagccactgttagtagggcccacgcccttgctatacagcgtacttgggagtcggccat

SEQ ID NO: 398466 - DNA, 140 bp, Artificial Sequence
  Synthetic
atggccgactcccaagtacgctgtatagcaagggcgtgggccctactaacagtggctttagtctttggagacacttccactggacgtcccaggagggcgggggggctttcgcccgggcgcggagacccagcatggcgtat

SEQ ID NO: 398467 - DNA, 140 bp, Artificial Sequence
  Synthetic
  misc_feature (69)..(69): n is a, c, g, or t
  misc_feature (84)..(84): n is a, c, g, or t
aggccctggctgctgatatgtgcttgcctatggatgatgtttatggtatctcaggttgaggcggctctntccaacctaattaanatcaatgctgcttcagccgctggcacccacggctttgaccttttgggacagcggtg

SEQ ID NO: 398468 - DNA, 140 bp, Artificial Sequence
  Synthetic
  misc_feature (57)..(57): n is a, c, g, or t
  misc_feature (72)..(72): n is a, c, g, or t
caccgctgtcccaaaaggtcaaagccgtgggtgccagcggctgaagcagcattgatnttaattaggttgganagagccgcctcaacctgagataccataaacatcatccataggcaagcacatatcagcagccagggcct

SEQ ID NO: 398469 - DNA, 140 bp, Artificial Sequence
  Synthetic
atacgccatgctgggtctccgtgatcgtaggtggcgtcctcgccgccgtggccgcatattgcatgtctactggcagtgttgttgtggttggccgtgtggtccttggatccaacgtggtgacgtacttgggagtcggccat

SEQ ID NO: 398470 - DNA, 140 bp, Artificial Sequence
  Synthetic
atggccgactcccaagtacgtcaccacgttggatccaaggaccacacggccaaccacaacaacactgccagtagacatgcaatatgcggccacggcggcgaggacgccacctacgatcacggagacccagcatggcgtat

SEQ ID NO: 398471 - DNA, 140 bp, Artificial Sequence
  Synthetic
atacgccatgctgggtctccgttcaaggacaaggccctcgccgtcttggatacgctcaagccggccgcccaggctgctgttcccattgtggagaccaacttccaaaaggtggagaagctgcgtacttgggagtcggccat

SEQ ID NO: 398472 - DNA, 140 bp, Artificial Sequence
  Synthetic
atggccgactcccaagtacgcagcttctccaccttttggaagttggtctccacaatgggaacagcagcctgggcggccggcttgagcgtatccaagacggcgagggccttgtccttgaacggagacccagcatggcgtat

SEQ ID NO: 398473 - DNA, 140 bp, Artificial Sequence
  Synthetic
atacgccatgctgggtctccccgcctcagttactagcccccttgctacatcgaccacactactagtcaacatcctgggtgggtggttcgcaagccagttagcgccgccgtctgctgccaccgtacttgggagtcggccat

SEQ ID NO: 398474 - DNA, 140 bp, Artificial Sequence
  Synthetic
atggccgactcccaagtacggtggcagcagacggcggcgctaactggcttgcgaaccacccacccaggatgttgactagtagtgtggtcgatgtagcaagggggctagtaactgaggcggggagacccagcatggcgtat

SEQ ID NO: 398475 - DNA, 140 bp, Artificial Sequence
  Synthetic
atacgccatgctgggtctccggcgccctggtggccttcaaaatcatgtctggagaggtccctagcacagaggatctggcaaacctcttacctgccatactctcacctggagctttagttgcgtacttgggagtcggccat

SEQ ID NO: 398476 - DNA, 140 bp, Artificial Sequence
  Synthetic
atggccgactcccaagtacgcaactaaagctccaggtgagagtatggcaggtaagaggtttgccagatcctctgtgctagggacctctccagacatgattttgaaggccaccagggcgccggagacccagcatggcgtat

SEQ ID NO: 398477 - DNA, 140 bp, Artificial Sequence
  Synthetic
atacgccatgctgggtctcctcacgtgtcgccgacccactacatacaggatgatgatgcgtcaaaacgcgtcatggggatactcagctcccttaccatcaccagcctcataaaacgagtacgtacttgggagtcggccat

SEQ ID NO: 398478 - DNA, 140 bp, Artificial Sequence
  Synthetic
atggccgactcccaagtacgtactcgttttatgaggctggtgatggtaagggagctgagtatccccatgacgcgttttgacgcatcatcatcctgtatgtagtgggtcggcgacacgtgaggagacccagcatggcgtat

SEQ ID NO: 398479 - DNA, 140 bp, Artificial Sequence
  Synthetic
atacgccatgctgggtctccaggcgcttttacaagtgtggatcccccctctcaacgtccgggggggccgcgatgccatcatcctcctcacgtgcgcggtccaccctgagctgatctttgacgtacttgggagtcggccat

SEQ ID NO: 398480 - DNA, 140 bp, Artificial Sequence
  Synthetic
atggccgactcccaagtacgtcaaagatcagctcagggtggaccgcgcacgtgaggaggatgatggcatcgcggcccccccggacgttgagaggggggatccacacttgtaaaagcgcctggagacccagcatggcgtat

SEQ ID NO: 398481 - DNA, 140 bp, Artificial Sequence
  Synthetic
atacgccatgctgggtctccggttgaaggccaaggtacttcccagccttccagggatcccattcctatcctgtcagaaagggtataaaggtgagtggcggaacgatggcatcatgaacaccgtacttgggagtcggccat

SEQ ID NO: 398482 - DNA, 140 bp, Artificial Sequence
  Synthetic
atggccgactcccaagtacggtgttcatgatgccatcgttccgccactcacctttataccctttctgacaggataggaatgggatccctggaaggctgggaagtaccttggccttcaaccggagacccagcatggcgtat

SEQ ID NO: 398483 - DNA, 140 bp, Artificial Sequence
  Synthetic
  misc_feature (68)..(68): n is a, c, g, or t
  misc_feature (101)..(101): n is a, c, g, or t
atacgccatgctgggtctcccctattaattcccataccacgggaccaagttctcctgtaccctcccantgttatcaaagggccttgtggagggtatctgcnacggagtacgtcgagatcccgtacttgggagtcggccat

SEQ ID NO: 398484 - DNA, 140 bp, Artificial Sequence
  Synthetic
  misc_feature (40)..(40): n is a, c, g, or t
  misc_feature (73)..(73): n is a, c, g, or t
atggccgactcccaagtacgggatctcgacgtactccgtngcagataccctccacaaggccctttgataacantgggagggtacaggagaacttggtcccgtggtatgggaattaataggggagacccagcatggcgtat

SEQ ID NO: 398485 - DNA, 140 bp, Artificial Sequence
  Synthetic
atacgccatgctgggtctccggtgcggatacacagattcgcccctgaacccaagcccatgatccgggaagaagccgctttcgtggtgggtctgcactcatatgtggtggggtctcagctccgtacttgggagtcggccat

SEQ ID NO: 398486 - DNA, 140 bp, Artificial Sequence
  Synthetic
atggccgactcccaagtacggagctgagaccccaccacatatgagtgcagacccaccacgaaagcggcttcttcccggatcatgggcttgggttcaggggcgaatctgtgtatccgcaccggagacccagcatggcgtat

SEQ ID NO: 398487 - DNA, 140 bp, Artificial Sequence
  Synthetic
atacgccatgctgggtctcccccccccatccaacgccagttcttctgctagtcaactctcagctccatctctaaaagccacccacacaactctgccacaacatcctgacgcagaactgatcgtacttgggagtcggccat

SEQ ID NO: 398488 - DNA, 140 bp, Artificial Sequence
  Synthetic
atggccgactcccaagtacgatcagttctgcgtcaggatgttgtggcagagttgtgtgggtggcttttagagatggagctgagagttgactagcagaagaactggcgttggatgggggggggagacccagcatggcgtat

SEQ ID NO: 398489 - DNA, 140 bp, Artificial Sequence
  Synthetic
  misc_feature (23)..(23): n is a, c, g, or t
atacgccatgctgggtctccgtngaggatgacatggaaccgtccaccgccgcggagtgtctgcgtacgcgtaaggtcttcccaccggccatgcccatatgggcgaggccagactacaatccgtacttgggagtcggccat

SEQ ID NO: 398490 - DNA, 140 bp, Artificial Sequence
  Synthetic
  misc_feature (118)..(118): n is a, c, g, or t
atggccgactcccaagtacggattgtagtctggcctcgcccatatgggcatggccggtgggaagaccttacgcgtacgcagacactccgcggcggtggacggttccatgtcatcctcnacggagacccagcatggcgtat

SEQ ID NO: 398491 - DNA, 140 bp, Artificial Sequence
  Synthetic
atacgccatgctgggtctccgcggaagcgggcggttatccaactcacagagtccgcggtttccacggcactggcggaactcgctgagaggtccttcccaaaggaggaggcaccccccagccgtacttgggagtcggccat

SEQ ID NO: 398492 - DNA, 140 bp, Artificial Sequence
  Synthetic
atggccgactcccaagtacggctggggggtgcctcctcctttgggaaggacctctcagcgagttccgccagtgccgtggaaaccgcggactctgtgagttggataaccgcccgcttccgcggagacccagcatggcgtat

SEQ ID NO: 398493 - DNA, 140 bp, Artificial Sequence
  Synthetic
atacgccatgctgggtctccgggagccgggtgatccagacttgtctgatggctcttggtcaacagtcagcaccagatctgacgtgatttgctgttccatgtcctactcatggacgggagccgtacttgggagtcggccat

SEQ ID NO: 398494 - DNA, 140 bp, Artificial Sequence
  Synthetic
atggccgactcccaagtacggctcccgtccatgagtaggacatggaacagcaaatcacgtcagatctggtgctgactgttgaccaagagccatcagacaagtctggatcacccggctcccggagacccagcatggcgtat

SEQ ID NO: 398495 - DNA, 140 bp, Artificial Sequence
  Synthetic
atacgccatgctgggtctcccgctcagcttcacaaagagcaaaaaaagtgacttttgacagattgcaagtcctagacgaccactacaaaagggcgctcgccgacgtgaaagcggatgcttcgtacttgggagtcggccat

SEQ ID NO: 398496 - DNA, 140 bp, Artificial Sequence
  Synthetic
atggccgactcccaagtacgaagcatccgctttcacgtcggcgagcgcccttttgtagtggtcgtctaggacttgcaatctgtcaaaagtcactttttttgctctttgtgaagctgagcgggagacccagcatggcgtat

SEQ ID NO: 398497 - DNA, 140 bp, Artificial Sequence
  Synthetic
atacgccatgctgggtctccatctcttgcgcccaaggcaatgtctcacatcaaagaggtctggaaggacttgctacaggacatgaccaccccgataccgaccaccataatggccaagaatcgtacttgggagtcggccat

SEQ ID NO: 398498 - DNA, 140 bp, Artificial Sequence
  Synthetic
atggccgactcccaagtacgattcttggccattatggtggtcggtatcggggtggtcatgtcctgtagcaagtccttccagacctctttgatgtgagacattgccttgggcgcaagagatggagacccagcatggcgtat

SEQ ID NO: 398499 - DNA, 140 bp, Artificial Sequence
  Synthetic
  misc_feature (100)..(100): n is a, c, g, or t
  misc_feature (104)..(104): n is a, c, g, or t
atacgccatgctgggtctccacgacatagctcaaaagcttccgaaggccataatggggcaggcgtacgggttccaatattcaccatcgcagcgggtcgantacntagttaagacgtggaacgtacttgggagtcggccat

SEQ ID NO: 398500 - DNA, 140 bp, Artificial Sequence
  Synthetic
  misc_feature (37)..(37): n is a, c, g, or t
  misc_feature (41)..(41): n is a, c, g, or t
atggccgactcccaagtacgttccacgtcttaactangtantcgacccgctgcgatggtgaatattggaacccgtacgcctgccccattatggccttcggaagcttttgagctatgtcgtggagacccagcatggcgtat

SEQ ID NO: 398501 - DNA, 140 bp, Artificial Sequence
  Synthetic
aggccctggctgctgatatgggaccccccctcccgggagagccatagtggtctgcggaaccggtgagtacaccggaattgccaggacgaccgggtcctttcttggataaacccgctcaatgaccttttgggacagcggtg

SEQ ID NO: 398502 - DNA, 140 bp, Artificial Sequence
  Synthetic
caccgctgtcccaaaaggtcattgagcgggtttatccaagaaaggacccggtcgtcctggcaattccggtgtactcaccggttccgcagaccactatggctctcccgggagggggggtcccatatcagcagccagggcct

SEQ ID NO: 398503 - DNA, 140 bp, Artificial Sequence
  Synthetic
atacgccatgctgggtctcctgcaacctcgaccccgaggctcgcaccatcattaacgcccttaccgagaggttgtacgtggggggacccatgttcaactctaaaggtcagagggtcggttcgtacttgggagtcggccat

SEQ ID NO: 398504 - DNA, 140 bp, Artificial Sequence
  Synthetic
atggccgactcccaagtacgaaccgaccctctgacctttagagttgaacatgggtccccccacgtacaacctctcggtaagggcgttaatgatggtgcgagcctcggggtcgaggttgcaggagacccagcatggcgtat

SEQ ID NO: 398505 - DNA, 140 bp, Artificial Sequence
  Synthetic
atacgccatgctgggtctccggcctactcctgctttgcgtaggggtaggcatcttcctactccccgctcggtagagcggcacatttagctacactccatagctaattgttccctttttttcgtacttgggagtcggccat

SEQ ID NO: 398506 - DNA, 140 bp, Artificial Sequence
  Synthetic
atggccgactcccaagtacgaaaaaaagggaacaattagctatggagtgtagctaaatgtgccgctctaccgagcggggagtaggaagatgcctacccctacgcaaagcaggagtaggccggagacccagcatggcgtat

SEQ ID NO: 398507 - DNA, 140 bp, Artificial Sequence
  Synthetic
atacgccatgctgggtctccgagcactgatttcctggtctgcggcgatgacttggtggtcatttgcgagagcaagggagtcgaacgggatagggcggacctgcaagcctttgcagcggcacgtacttgggagtcggccat

SEQ ID NO: 398508 - DNA, 140 bp, Artificial Sequence
  Synthetic
atggccgactcccaagtacgtgccgctgcaaaggcttgcaggtccgccctatcccgttcgactcccttgctctcgcaaatgaccaccaagtcatcgccgcagaccaggaaatcagtgctcggagacccagcatggcgtat

SEQ ID NO: 398509 - DNA, 140 bp, Artificial Sequence
  Synthetic
atacgccatgctgggtctccactcggggaaaagagtctactacctcactagagaccctaccaacccactatccagggcagcttgggagaccgcccgtcactcacctgtaaactcctgggtcgtacttgggagtcggccat

SEQ ID NO: 398510 - DNA, 140 bp, Artificial Sequence
  Synthetic
atggccgactcccaagtacgacccaggagtttacaggtgagtgacgggcggtctcccaagctgccctggatagtgggttggtagggtctctagtgaggtagtagactcttttccccgagtggagacccagcatggcgtat

SEQ ID NO: 398511 - DNA, 140 bp, Artificial Sequence
  Synthetic
atacgccatgctgggtctccgtgagttttgagatgtatggtgcaacctacacggtctgcccaacagacttaccagacattatacaaagactccatgggctccgcgcatttgaactccatacgtacttgggagtcggccat

SEQ ID NO: 398512 - DNA, 140 bp, Artificial Sequence
  Synthetic
atggccgactcccaagtacgtatggagttcaaatgcgcggagcccatggagtctttgtataatgtctggtaagtctgttgggcagaccgtgtaggttgcaccatacatctcaaaactcacggagacccagcatggcgtat

SEQ ID NO: 398513 - DNA, 140 bp, Artificial Sequence
  Synthetic
aggccctggctgctgatatgccacttccgcctccacagtcccctcctgtgcctccgcctcggaagaagcggacggtagtcctcactgaatcaactgtatccactgccttggccgagcttggaccttttgggacagcggtg

SEQ ID NO: 398514 - DNA, 140 bp, Artificial Sequence
  Synthetic
caccgctgtcccaaaaggtccaagctcggccaaggcagtggatacagttgattcagtgaggactaccgtccgcttcttccgaggcggaggcacaggaggggactgtggaggcggaagtggcatatcagcagccagggcct

SEQ ID NO: 398515 - DNA, 140 bp, Artificial Sequence
  Synthetic
atacgccatgctgggtctccggggctgataggccaggggggcagggctcgcatatgcggtctctacctcttcaactgggctgtcaggaccaagatcaaactcactccacttgcaggcgctcgtacttgggagtcggccat

SEQ ID NO: 398516 - DNA, 140 bp, Artificial Sequence
  Synthetic
atggccgactcccaagtacgagcgcctgcaagtggagtgagtttgatcttggtcctgacagcccagttgaagaggtagagaccgcatatgcgagccctgcccccctggcctatcagccccggagacccagcatggcgtat

SEQ ID NO: 398517 - DNA, 140 bp, Artificial Sequence
  Synthetic
aggccctggctgctgatatgcacaagccgtcgtggacatggtggcgggggcccactggggagtcctggcgggcctcgcctactattccatggtggggaactgggctaaggttttgattgtgaccttttgggacagcggtg

SEQ ID NO: 398518 - DNA, 140 bp, Artificial Sequence
  Synthetic
caccgctgtcccaaaaggtcacaatcaaaaccttagcccagttccccaccatggaatagtaggcgaggcccgccaggactccccagtgggcccccgccaccatgtccacgacggcttgtgcatatcagcagccagggcct

SEQ ID NO: 398519 - DNA, 140 bp, Artificial Sequence
  Synthetic
atacgccatgctgggtctcccgtggatcacagcacgcccagagcccatcctcgcccattactcctgtgcctactcctacttgccgtaggggtaggcattttcctcctacccgctcggtaacgtacttgggagtcggccat

SEQ ID NO: 398520 - DNA, 140 bp, Artificial Sequence
  Synthetic
atggccgactcccaagtacgttaccgagcgggtaggaggaaaatgcctacccctacggcaagtaggagtaggcacaggagtaatgggcgaggatgggctctgggcgtgctgtgatccacgggagacccagcatggcgtat

SEQ ID NO: 398521 - DNA, 140 bp, Artificial Sequence
  Synthetic
aggccctggctgctgatatgagccatcttggacatgatcgctggtgcccactggggagtcctggcgggcatagcgtatttctccatggtggggaactgggcgaaggtcctggtagtgctggaccttttgggacagcggtg

SEQ ID NO: 398522 - DNA, 140 bp, Artificial Sequence
  Synthetic
caccgctgtcccaaaaggtccagcactaccaggaccttcgcccagttccccaccatggagaaatacgctatgcccgccaggactccccagtgggcaccagcgatcatgtccaagatggctcatatcagcagccagggcct

SEQ ID NO: 398523 - DNA, 140 bp, Artificial Sequence
  Synthetic
aggccctggctgctgatatgagaacatccagctgatcaacaccaacggcagttggcacatcaatagaacggccttgaactgcaatgaaagccttaacaccggctggttagcagggcttttgaccttttgggacagcggtg

SEQ ID NO: 398524 - DNA, 140 bp, Artificial Sequence
  Synthetic
caccgctgtcccaaaaggtcaaaagccctgctaaccagccggtgttaaggctttcattgcagttcaaggccgttctattgatgtgccaactgccgttggtgttgatcagctggatgttctcatatcagcagccagggcct

SEQ ID NO: 398525 - DNA, 140 bp, Artificial Sequence
  Synthetic
aggccctggctgctgatatgactgggttcaccaagacgtgcgggggccccccgtgcaacatcgggggggtcggtaatgacaccttgatctgccccacggattgcttccggaagcaccccggaccttttgggacagcggtg

SEQ ID NO: 398526 - DNA, 140 bp, Artificial Sequence
  Synthetic
caccgctgtcccaaaaggtccggggtgcttccggaagcaatccgtggggcagatcaaggtgtcattaccgacccccccgatgttgcacggggggcccccgcacgtcttggtgaacccagtcatatcagcagccagggcct

SEQ ID NO: 398527 - DNA, 140 bp, Artificial Sequence
  Synthetic
aggccctggctgctgatatgtgcctgcaactggacgcggggcgaacgttgcgatctggaagacagggacaggtccgagctcagcccgctgctgctgtccaccacacagtggcaggtccttgaccttttgggacagcggtg

SEQ ID NO: 398528 - DNA, 140 bp, Artificial Sequence
  Synthetic
caccgctgtcccaaaaggtcaaggacctgccactgtgtggtggacagcagcagcgggctgagctcggacctgtccctgtcttccagatcgcaacgttcgccccgcgtccagttgcaggcacatatcagcagccagggcct

SEQ ID NO: 398529 - DNA, 140 bp, Artificial Sequence
  Synthetic
aggccctggctgctgatatggggcgcacaacggcctgcgagatctggccgtggccgtagagccagtcgtcttctcccgaatggagaccaagctcatcacgtggggggcggacaccgccgcgaccttttgggacagcggtg

SEQ ID NO: 398530 - DNA, 140 bp, Artificial Sequence
  Synthetic
caccgctgtcccaaaaggtcgcggcggtgtccgccccccacgtgatgagcttggtctccattcgggagaagacgactggctctacggccacggccagatctcgcaggccgttgtgcgccccatatcagcagccagggcct

SEQ ID NO: 398531 - DNA, 140 bp, Artificial Sequence
  Synthetic
aggccctggctgctgatatgcagctgatcaactccaacggcagttggcacatcaatcgcacggccttgaactgtaatgcgagcctcgacactggctgggtggcgggactcttctattaccgaccttttgggacagcggtg

SEQ ID NO: 398532 - DNA, 140 bp, Artificial Sequence
  Synthetic
caccgctgtcccaaaaggtcggtaatagaagagtcccgccacccagccagtgtcgaggctcgcattacagttcaaggccgtgcgattgatgtgccaactgccgttggagttgatcagctgcatatcagcagccagggcct

SEQ ID NO: 398533 - DNA, 140 bp, Artificial Sequence
  Synthetic
aggccctggctgctgatatgaacatcacccgcgtggagtcagagaataaggtagtaattctggactctttcgagccgcttcgagcggaggaggatgagagggaagtatccgttccggcgggaccttttgggacagcggtg

SEQ ID NO: 398534 - DNA, 140 bp, Artificial Sequence
  Synthetic
caccgctgtcccaaaaggtcccgccggaacggatacttccctctcatcctcctccgctcgaagcggctcgaaagagtccagaattactaccttattctctgactccacgcgggtgatgttcatatcagcagccagggcct

SEQ ID NO: 398535 - DNA, 140 bp, Artificial Sequence
  Synthetic
aggccctggctgctgatatgacaaagcagagtggggagaaccttccttacctggtagcgtaccaagccaccgtgtgcgctagggctcaagcccctcccccatcgtgggaccagatgtggagaccttttgggacagcggtg

SEQ ID NO: 398536 - DNA, 140 bp, Artificial Sequence
  Synthetic
caccgctgtcccaaaaggtctccacatctggtcccacgatgggggaggggcttgagccctagcgcacacggtggcttggtacgctaccaggtaaggaaggttctccccactctgctttgtcatatcagcagccagggcct

SEQ ID NO: 398537 - DNA, 140 bp, Artificial Sequence
  Synthetic
aggccctggctgctgatatgcacatcaacaggactgccctgaactgcaacgactccctccacactgggtttcttgccgcgctgttctatgtacataagttcaacgcgtccggatgcccgggaccttttgggacagcggtg

SEQ ID NO: 398538 - DNA, 140 bp, Artificial Sequence
  Synthetic
caccgctgtcccaaaaggtcccgggcatccggacgcgttgaacttatgtacatagaacagcgcggcaagaaacccagtgtggagggagtcgttgcagttcagggcagtcctgttgatgtgcatatcagcagccagggcct

SEQ ID NO: 398539 - DNA, 140 bp, Artificial Sequence
  Synthetic
atacgccatgctgggtctccggggttttcgtgggtctggtgctcttgaccttatcaccacactacaaactgttcctcgctaagctcatgtggtggttgcaatacttctccaccagagctgcgtacttgggagtcggccat

SEQ ID NO: 398540 - DNA, 140 bp, Artificial Sequence
  Synthetic
atggccgactcccaagtacgcagctctggtggagaagtattgcaaccaccacatgagcttagcgaggaacagtttgtagtgtggtgataaggtcaagagcaccagacccacgaaaaccccggagacccagcatggcgtat

SEQ ID NO: 398541 - DNA, 140 bp, Artificial Sequence
  Synthetic
aggccctggctgctgatatgggatcgtcggtcctaagacctgcaggaacatgtggagtgggaccttccccatcaacgcctacaccacgggcccctgtaccccccttcctgcgccgaactagaccttttgggacagcggtg

SEQ ID NO: 398542 - DNA, 140 bp, Artificial Sequence
  Synthetic
caccgctgtcccaaaaggtctagttcggcgcaggaaggggggtacaggggcccgtggtgtaggcgttgatggggaaggtcccactccacatgttcctgcaggtcttaggaccgacgatcccatatcagcagccagggcct

SEQ ID NO: 398543 - DNA, 140 bp, Artificial Sequence
  Synthetic
atacgccatgctgggtctcccaacggcagctggcacatcaatcgcacggccttgaactgcaatgagagccacgaaactggctggatagcggggctcttctatcaccacagattcaactctcgtacttgggagtcggccat

SEQ ID NO: 398544 - DNA, 140 bp, Artificial Sequence
  Synthetic
atggccgactcccaagtacgagagttgaatctgtggtgatagaagagccccgctatccagccagtttcgtggctctcattgcagttcaaggccgtgcgattgatgtgccagctgccgttgggagacccagcatggcgtat

SEQ ID NO: 398545 - DNA, 140 bp, Artificial Sequence
  Synthetic
atacgccatgctgggtctccgcccctactgctggcactaccccccaagaccttgtggtatcgtgccagcacagaccgtatgtggcccggtgtattgcttcactcccagcccagtggtggtcgtacttgggagtcggccat

SEQ ID NO: 398546 - DNA, 140 bp, Artificial Sequence
  Synthetic
atggccgactcccaagtacgaccaccactgggctgggagtgaagcaatacaccgggccacatacggtctgtgctggcacgataccacaaggtcttggggggtagtgccagcagtaggggcggagacccagcatggcgtat

SEQ ID NO: 398547 - DNA, 140 bp, Artificial Sequence
  Synthetic
aggccctggctgctgatatgcatggctgcccacttccacctccacagtcccctcctgtgcctccgccccggaagaagcggacggtggtcctcaccgaatcaaccgtatctactgccttgggaccttttgggacagcggtg

SEQ ID NO: 398548 - DNA, 140 bp, Artificial Sequence
  Synthetic
caccgctgtcccaaaaggtcccaaggcagtagatacggttgattcggtgaggaccaccgtccgcttcttccggggcggaggcacaggaggggactgtggaggtggaagtgggcagccatgcatatcagcagccagggcct

SEQ ID NO: 398549 - DNA, 140 bp, Artificial Sequence
  Synthetic
atacgccatgctgggtctccatcaatagtacagccctgaactgcaatgctagccttgacaccggctggctggcagggcttttctattacaaccaattcaactcttcgggctgtcccgagccgtacttgggagtcggccat

SEQ ID NO: 398550 - DNA, 140 bp, Artificial Sequence
  Synthetic
atggccgactcccaagtacggctcgggacagcccgaagagttgaattggttgtaatagaaaagccctgccagccagccggtgtcaaggctagcattgcagttcagggctgtactattgatggagacccagcatggcgtat

SEQ ID NO: 398551 - DNA, 140 bp, Artificial Sequence
  Synthetic
aggccctggctgctgatatggccccgaacaccgcccctactgttggcactaccccccaaaaccttgtggtatcgtgccagcacagagtgtatgtggcccagtgtattgcttcactcccaggaccttttgggacagcggtg

SEQ ID NO: 398552 - DNA, 140 bp, Artificial Sequence
  Synthetic
caccgctgtcccaaaaggtcctgggagtgaagcaatacactgggccacatacactctgtgctggcacgataccacaaggttttggggggtagtgccaacagtaggggcggtgttcggggccatatcagcagccagggcct

SEQ ID NO: 398553 - DNA, 140 bp, Artificial Sequence
  Synthetic
aggccctggctgctgatatgtgcgcgctagcgcggaagatggccggaggccattacgtgcaaatggtcatcatcaagttaggggcgcttactggcacctatgtttataaccatctcactcgaccttttgggacagcggtg

SEQ ID NO: 398554 - DNA, 140 bp, Artificial Sequence
  Synthetic
caccgctgtcccaaaaggtcgagtgagatggttataaacataggtgccagtaagcgcccctaacttgatgatgaccatttgcacgtaatggcctccggccatcttccgcgctagcgcgcacatatcagcagccagggcct

SEQ ID NO: 398555 - DNA, 140 bp, Artificial Sequence
  Synthetic
atacgccatgctgggtctccatatgacacccgctgttttgactcaacggtcactgagaatgacatccgtgttgaggagtcaatttaccaatgttgtgacttggcccccgaagccagacagcgtacttgggagtcggccat

SEQ ID NO: 398556 - DNA, 140 bp, Artificial Sequence
  Synthetic
atggccgactcccaagtacgctgtctggcttcgggggccaagtcacaacattggtaaattgactcctcaacacggatgtcattctcagtgaccgttgagtcaaaacagcgggtgtcatatggagacccagcatggcgtat

SEQ ID NO: 398557 - DNA, 140 bp, Artificial Sequence
  Synthetic
aggccctggctgctgatatggggtggaggttgctggcgcccatcacggcgtacgcccagcagacaaggggcctcctagggtgtataatcaccagcctgactggccgggacaaaaaccaaggaccttttgggacagcggtg

SEQ ID NO: 398558 - DNA, 140 bp, Artificial Sequence
  Synthetic
caccgctgtcccaaaaggtccttggtttttgtcccggccagtcaggctggtgattatacaccctaggaggccccttgtctgctgggcgtacgccgtgatgggcgccagcaacctccaccccatatcagcagccagggcct

SEQ ID NO: 398559 - DNA, 140 bp, Artificial Sequence
  Synthetic
atacgccatgctgggtctccacctcgggccgtctcagagaatccagctcgtaaacaccaacggcagctggcatatcaacagaaccgccctgaactgcaatgacaccctccagaccggattcgtacttgggagtcggccat

SEQ ID NO: 398560 - DNA, 140 bp, Artificial Sequence
  Synthetic
atggccgactcccaagtacgaatccggtctggagggtgtcattgcagttcagggcggttctgttgatatgccagctgccgttggtgtttacgagctggattctctgagacggcccgaggtggagacccagcatggcgtat

SEQ ID NO: 398561 - DNA, 140 bp, Artificial Sequence
  Synthetic
aggccctggctgctgatatggcactacgcgcctcgaccgtgtggtatcgtacccgcgtcggaggtgtgtggtccagtgtattgcttcaccccaagccctgttgtggtggggacgaccgatgaccttttgggacagcggtg

SEQ ID NO: 398562 - DNA, 140 bp, Artificial Sequence
  Synthetic
caccgctgtcccaaaaggtcatcggtcgtccccaccacaacagggcttggggtgaagcaatacactggaccacacacctccgacgcgggtacgataccacacggtcgaggcgcgtagtgccatatcagcagccagggcct

SEQ ID NO: 398563 - DNA, 140 bp, Artificial Sequence
  Synthetic
atacgccatgctgggtctcctgctgcccagactttcctagcatcctgcatcaacggggtgtgctggagtatctaccacggggccggaacaaggactctcgcgtcatccaagggtcccattcgtacttgggagtcggccat

SEQ ID NO: 398564 - DNA, 140 bp, Artificial Sequence
  Synthetic
atggccgactcccaagtacgaatgggacccttggatgacgcgagagtccttgttccggccccgtggtagatactccagcacaccccgttgatgcaggatgctaggaaagtctgggcagcaggagacccagcatggcgtat

SEQ ID NO: 398565 - DNA, 140 bp, Artificial Sequence
  Synthetic
atacgccatgctgggtctccgcggtcttcgtaggcctggtgctcttgaccttgtcaccgcactacaaagtgttcctcgttaggctcatatggtggttacaataccttatcaccagagccgcgtacttgggagtcggccat

SEQ ID NO: 398566 - DNA, 140 bp, Artificial Sequence
  Synthetic
atggccgactcccaagtacgcggctctggtgataaggtattgtaaccaccatatgagcctaacgaggaacactttgtagtgcggtgacaaggtcaagagcaccaggcctacgaagaccgcggagacccagcatggcgtat

SEQ ID NO: 398567 - DNA, 140 bp, Artificial Sequence
  Synthetic
aggccctggctgctgatatgcctgacgccgagctcatagaggctaacctcctatggaggcaggagatgggcggtaacatcaccagggttgagtcagagaacaaagtggtgattctggactgaccttttgggacagcggtg

SEQ ID NO: 398568 - DNA, 140 bp, Artificial Sequence
  Synthetic
caccgctgtcccaaaaggtcagtccagaatcaccactttgttctctgactcaaccctggtgatgttaccgcccatctcctgcctccataggaggttagcctctatgagctcggcgtcaggcatatcagcagccagggcct

SEQ ID NO: 398569 - DNA, 140 bp, Artificial Sequence
  Synthetic
aggccctggctgctgatatgtggaccaggacctcgtcggctggcaggcgccccccggggcgcgttctctgacaccatgcacctgcggcagctcggacctttacttggtcacgaggcatgcgaccttttgggacagcggtg

SEQ ID NO: 398570 - DNA, 140 bp, Artificial Sequence
  Synthetic
caccgctgtcccaaaaggtcgcatgcctcgtgaccaagtaaaggtccgagctgccgcaggtgcatggtgtcagagaacgcgccccggggggcgcctgccagccgacgaggtcctggtccacatatcagcagccagggcct

SEQ ID NO: 398571 - DNA, 140 bp, Artificial Sequence
  Synthetic
aggccctggctgctgatatgcggattacaaccctccactggtagagtcctggaaggacccggactacgtccctccagtggtacatgggtgcccattgccacctactaaggcccctccaatgaccttttgggacagcggtg

SEQ ID NO: 398572 - DNA, 140 bp, Artificial Sequence
  Synthetic
caccgctgtcccaaaaggtcattggaggggccttagtaggtggcaatgggcacccatgtaccactggagggacgtagtccgggtccttccaggactctaccagtggagggttgtaatccgcatatcagcagccagggcct

SEQ ID NO: 398573 - DNA, 140 bp, Artificial Sequence
  Synthetic
atacgccatgctgggtctcccagtcaccgtgccacaccctaatattgaagaagtggccctgtccaacaccggggagatcccattctatggcaaagccatccccctcgagaccatcaagggcgtacttgggagtcggccat

SEQ ID NO: 398574 - DNA, 140 bp, Artificial Sequence
  Synthetic
atggccgactcccaagtacgcccttgatggtctcgagggggatggctttgccatagaatgggatctccccggtgttggacagggccacttcttcaatattagggtgtggcacggtgactgggagacccagcatggcgtat

SEQ ID NO: 398575 - DNA, 140 bp, Artificial Sequence
  Synthetic
aggccctggctgctgatatgcttgatgtgtccgtcataccgaccagcggagacgtcgttgtcgtggcaacggacgctctaatgacgggcttcaccggcgactttgactcagtgatcgactgaccttttgggacagcggtg

SEQ ID NO: 398576 - DNA, 140 bp, Artificial Sequence
  Synthetic
caccgctgtcccaaaaggtcagtcgatcactgagtcaaagtcgccggtgaagcccgtcattagagcgtccgttgccacgacaacgacgtctccgctggtcggtatgacggacacatcaagcatatcagcagccagggcct

SEQ ID NO: 398577 - DNA, 140 bp, Artificial Sequence
  Synthetic
aggccctggctgctgatatgcgctgtggagggtgtctgcggaggaatacgtggaaataaggcaggtgggggacttccactacgtgacgggcatgactgctgacaatctcaaatgcccatggaccttttgggacagcggtg

SEQ ID NO: 398578 - DNA, 140 bp, Artificial Sequence
  Synthetic
caccgctgtcccaaaaggtccatgggcatttgagattgtcagcagtcatgcccgtcacgtagtggaagtcccccacctgccttatttccacgtattcctccgcagacaccctccacagcgcatatcagcagccagggcct

SEQ ID NO: 398579 - DNA, 140 bp, Artificial Sequence
  Synthetic
atacgccatgctgggtctccgagtcctggcgggccttgcctactattccatggtggggaactgggctaaggttttgattgtcttgctgctctttaccggcgttgatgggaccacccacaccgtacttgggagtcggccat

SEQ ID NO: 398580 - DNA, 140 bp, Artificial Sequence
  Synthetic
atggccgactcccaagtacggtgtgggtggtcccatcaacgccggtaaagagcagcaagacaatcaaaaccttagcccagttccccaccatggaatagtaggcaaggcccgccaggactcggagacccagcatggcgtat

SEQ ID NO: 398581 - DNA, 140 bp, Artificial Sequence
  Synthetic
aggccctggctgctgatatgttcttcacggaagtggatggggtacggctgcacaggtacgccccggcgtgcaagcctctcctacgggatgaggtcacattccaggtcgggctcaaccaatgaccttttgggacagcggtg

SEQ ID NO: 398582 - DNA, 140 bp, Artificial Sequence
  Synthetic
caccgctgtcccaaaaggtcattggttgagcccgacctggaatgtgacctcatcccgtaggagaggcttgcacgccggggcgtacctgtgcagccgtaccccatccacttccgtgaagaacatatcagcagccagggcct

SEQ ID NO: 398583 - DNA, 140 bp, Artificial Sequence
  Synthetic
aggccctggctgctgatatggctataaggtcgctcacagagcggctttacatcgggggtcccctgactaattcaaaagggcagaactgcggctatcgccggtgccgcgcgagcggcgtgcgaccttttgggacagcggtg

SEQ ID NO: 398584 - DNA, 140 bp, Artificial Sequence
  Synthetic
caccgctgtcccaaaaggtcgcacgccgctcgcgcggcaccggcgatagccgcagttctgcccttttgaattagtcaggggacccccgatgtaaagccgctctgtgagcgaccttatagccatatcagcagccagggcct

SEQ ID NO: 398585 - DNA, 140 bp, Artificial Sequence
  Synthetic
aggccctggctgctgatatgctagggacggcaagctccccacaacgcagcttcgacggcatatcgatctgcttgtcgggagtgccaccctctgctcggccctctacgtgggggatctgtggaccttttgggacagcggtg

SEQ ID NO: 398586 - DNA, 140 bp, Artificial Sequence
  Synthetic
caccgctgtcccaaaaggtccacagatcccccacgtagagggccgagcagagggtggcactcccgacaagcagatcgatatgccgtcgaagctgcgttgtggggagcttgccgtccctagcatatcagcagccagggcct

SEQ ID NO: 398587 - DNA, 140 bp, Artificial Sequence
  Synthetic
aggccctggctgctgatatgccagcccactaaccactagccaaaccctcctcttcaacatattgggggggtgggtggctgcccagctcgccgcccccggtgccgctaccgcctttgtggggaccttttgggacagcggtg

SEQ ID NO: 398588 - DNA, 140 bp, Artificial Sequence
  Synthetic
caccgctgtcccaaaaggtccccacaaaggcggtagcggcaccgggggcggcgagctgggcagccacccacccccccaatatgttgaagaggagggtttggctagtggttagtgggctggcatatcagcagccagggcct

SEQ ID NO: 398589 - DNA, 140 bp, Artificial Sequence
  Synthetic
atacgccatgctgggtctccgtaggggggagtacggcccgtgccgcccaaggcttaacgagcctcttttatcgtgggccggcccagagtctccagcttgtgaacaccaacggcagctggccgtacttgggagtcggccat

SEQ ID NO: 398590 - DNA, 140 bp, Artificial Sequence
  Synthetic
atggccgactcccaagtacggccagctgccgttggtgttcacaagctggagactctgggccggcccacgataaaagaggctcgttaagccttgggcggcacgggccgtactcccccctacggagacccagcatggcgtat

SEQ ID NO: 398591 - DNA, 140 bp, Artificial Sequence
  Synthetic
aggccctggctgctgatatggcattcaagatcatgagcggtgaggtcccctccacggaggacctggtcaatctactgcccgccatcctctcgcctggagccctcgtagtcggtgtggtctgaccttttgggacagcggtg

SEQ ID NO: 398592 - DNA, 140 bp, Artificial Sequence
  Synthetic
caccgctgtcccaaaaggtcagaccacaccgactacgagggctccaggcgagaggatggcgggcagtagattgaccaggtcctccgtggaggggacctcaccgctcatgatcttgaatgccatatcagcagccagggcct

SEQ ID NO: 398593 - DNA, 140 bp, Artificial Sequence
  Synthetic
aggccctggctgctgatatgctataaagtgttagtgcttaacccctcggttgcggccacactgggttttggggcgtacatgtccaaggcatacggcattgacccaaacatccggtcaggagaccttttgggacagcggtg

SEQ ID NO: 398594 - DNA, 140 bp, Artificial Sequence
  Synthetic
caccgctgtcccaaaaggtctcctgaccggatgtttgggtcaatgccgtatgccttggacatgtacgccccaaaacccagtgtggccgcaaccgaggggttaagcactaacactttatagcatatcagcagccagggcct

SEQ ID NO: 398595 - DNA, 140 bp, Artificial Sequence
  Synthetic
aggccctggctgctgatatgtgctcttcctcctcctggcggacgcgcgcgtctgcgcctgcttgtggatgatgctgctgatagcccaggctgaggccgccctagagaacctggtggtcctgaccttttgggacagcggtg

SEQ ID NO: 398596 - DNA, 140 bp, Artificial Sequence
  Synthetic
caccgctgtcccaaaaggtcaggaccaccaggttctctagggcggcctcagcctgggctatcagcagcatcatccacaagcaggcgcagacgcgcgcgtccgccaggaggaggaagagcacatatcagcagccagggcct

SEQ ID NO: 398597 - DNA, 140 bp, Artificial Sequence
  Synthetic
aggccctggctgctgatatgtcttctgtgctgcctggtacatcaagggcaggctggtccctggggcggcatacgccttctacggcgtatggccgctgctcctgctcctgctggcgctgccgaccttttgggacagcggtg

SEQ ID NO: 398598 - DNA, 140 bp, Artificial Sequence
  Synthetic
caccgctgtcccaaaaggtcggcagcgccagcaggagcaggagcagcggccatacgccgtagaaggcgtatgccgccccagggaccagcctgcccttgatgtaccaggcagcacagaagacatatcagcagccagggcct

SEQ ID NO: 398599 - DNA, 140 bp, Artificial Sequence
  Synthetic
aggccctggctgctgatatgtcccagaaaatccagcttatgaataccaacggcagctggcacatcaacaggactgccctgaactgcaatgactccctcaacactgggttccttgctgcgcgaccttttgggacagcggtg

SEQ ID NO: 398600 - DNA, 140 bp, Artificial Sequence
  Synthetic
caccgctgtcccaaaaggtcgcgcagcaaggaacccagtgttgagggagtcattgcagttcagggcagtcctgttgatgtgccagctgccgttggtattcataagctggattttctgggacatatcagcagccagggcct

SEQ ID NO: 398601 - DNA, 140 bp, Artificial Sequence
  Synthetic
aggccctggctgctgatatgatgccatcatcctcctcacgtgcgcggtccacccagagctaatctttgaaatcaccaaaatcttgctcgccatacttggtccgctcatggtgctccaggcgaccttttgggacagcggtg

SEQ ID NO: 398602 - DNA, 140 bp, Artificial Sequence
  Synthetic
caccgctgtcccaaaaggtcgcctggagcaccatgagcggaccaagtatggcgagcaagattttggtgatttcaaagattagctctgggtggaccgcgcacgtgaggaggatgatggcatcatatcagcagccagggcct

SEQ ID NO: 398603 - DNA, 140 bp, Artificial Sequence
  Synthetic
aggccctggctgctgatatggctgcatcatcaccagcctcacaggccgggacaagaaccaggtcgagggggaggttcaagtggtttccaccgcaacacaatctttcctggcgacctgcatgaccttttgggacagcggtg

SEQ ID NO: 398604 - DNA, 140 bp, Artificial Sequence
  Synthetic
caccgctgtcccaaaaggtcatgcaggtcgccaggaaagattgtgttgcggtggaaaccacttgaacctccccctcgacctggttcttgtcccggcctgtgaggctggtgatgatgcagccatatcagcagccagggcct

SEQ ID NO: 398605 - DNA, 140 bp, Artificial Sequence
  Synthetic
aggccctggctgctgatatggacgctctaatgacgggctttaccggcgacttcgactcagtgatcgactgtaatacatgtgtcacccagacagttgatttcagcttggaccctaccttcagaccttttgggacagcggtg

SEQ ID NO: 398606 - DNA, 140 bp, Artificial Sequence
  Synthetic
caccgctgtcccaaaaggtctgaaggtagggtccaagctgaaatcaactgtctgggtgacacatgtattacagtcgatcactgagtcgaagtcgccggtaaagcccgtcattagagcgtccatatcagcagccagggcct

SEQ ID NO: 398607 - DNA, 140 bp, Artificial Sequence
  Synthetic
aggccctggctgctgatatgcatgtcaaaaacggttccatgaggatcgttgggcctaaaacctgcagcaacacgtggcatggaacattccccatcaacgcatacaccacgggcccctgcagaccttttgggacagcggtg

SEQ ID NO: 398608 - DNA, 140 bp, Artificial Sequence
  Synthetic
caccgctgtcccaaaaggtctgcaggggcccgtggtgtatgcgttgatggggaatgttccatgccacgtgttgctgcaggttttaggcccaacgatcctcatggaaccgtttttgacatgcatatcagcagccagggcct

SEQ ID NO: 398609 - DNA, 140 bp, Artificial Sequence
  Synthetic
aggccctggctgctgatatgaaacctctcctacgggatgaggtcacattccaggtcgggctcaaccaatacccggttgggtcacaactcccgtgtgagcccgaaccggacgtaacagtgcgaccttttgggacagcggtg

SEQ ID NO: 398610 - DNA, 140 bp, Artificial Sequence
  Synthetic
caccgctgtcccaaaaggtcgcactgttacgtccggttcgggctcacacgggagttgtgacccaaccgggtattggttgagcccgacctggaatgtgacctcatcccgtaggagaggtttcatatcagcagccagggcct

SEQ ID NO: 398611 - DNA, 140 bp, Artificial Sequence
  Synthetic
aggccctggctgctgatatgccttaccgattttgaccaaggctggggccctatcagtcatgccaacggaagcggccccgaccaacgcccctactgctggcactaccctccaaaaccttgtgaccttttgggacagcggtg

SEQ ID NO: 398612 - DNA, 140 bp, Artificial Sequence
  Synthetic
caccgctgtcccaaaaggtcacaaggttttggagggtagtgccagcagtaggggcgttggtcggggccgcttccgttggcatgactgatagggccccagccttggtcaaaatcggtaaggcatatcagcagccagggcct

SEQ ID NO: 398613 - DNA, 140 bp, Artificial Sequence
  Synthetic
atacgccatgctgggtctccgcatgggcttgaacgcagtggcttattacagagggcttgacgtctcggtgataccaacacagggagacgtggtggtcgtggccaccgacgccctcatgaccgtacttgggagtcggccat

SEQ ID NO: 398614 - DNA, 140 bp, Artificial Sequence
  Synthetic
atggccgactcccaagtacggtcatgagggcgtcggtggccacgaccaccacgtctccctgtgttggtatcaccgagacgtcaagccctctgtaataagccactgcgttcaagcccatgcggagacccagcatggcgtat

SEQ ID NO: 398615 - DNA, 140 bp, Artificial Sequence
  Synthetic
aggccctggctgctgatatgtgctcctgttggcgttgccccagcgggcatacgcgctggacacggaggtggccgcgtcgtgtggcggcgttgttcttgtcgggttaatggcgctgactctgaccttttgggacagcggtg

SEQ ID NO: 398616 - DNA, 140 bp, Artificial Sequence
  Synthetic
caccgctgtcccaaaaggtcagagtcagcgccattaacccgacaagaacaacgccgccacacgacgcggccacctccgtgtccagcgcgtatgcccgctggggcaacgccaacaggagcacatatcagcagccagggcct

SEQ ID NO: 398617 - DNA, 140 bp, Artificial Sequence
  Synthetic
atacgccatgctgggtctccggactacgtccctccggtggtacacgggtgtccgttgccaccaaccaaagctcctccaataccacccccgcggaggaagaggacggtcgtcctgacagaacgtacttgggagtcggccat

SEQ ID NO: 398618 - DNA, 140 bp, Artificial Sequence
  Synthetic
atggccgactcccaagtacgttctgtcaggacgaccgtcctcttcctccgcgggggtggtattggaggagctttggttggtggcaacggacacccgtgtaccaccggagggacgtagtccggagacccagcatggcgtat

SEQ ID NO: 398619 - DNA, 140 bp, Artificial Sequence
  Synthetic
aggccctggctgctgatatggaggccgcaagccagctcgccttatcgtattcccagacttgggggtccgtgtatgcgagaaaatggccctttacgacgtggtctccacccttcctcaggcgaccttttgggacagcggtg

SEQ ID NO: 398620 - DNA, 140 bp, Artificial Sequence
  Synthetic
caccgctgtcccaaaaggtcgcctgaggaagggtggagaccacgtcgtaaagggccattttctcgcatacacggacccccaagtctgggaatacgataaggcgagctggcttgcggcctccatatcagcagccagggcct

SEQ ID NO: 398621 - DNA, 140 bp, Artificial Sequence
  Synthetic
aggccctggctgctgatatggtatgcgagaaaatggccctttacgacgtggtctccacccttcctcaggccgtgatgggctcctcatacggattccagtactctcctggacagcgggtcggaccttttgggacagcggtg

SEQ ID NO: 398622 - DNA, 140 bp, Artificial Sequence
  Synthetic
caccgctgtcccaaaaggtccgacccgctgtccaggagagtactggaatccgtatgaggagcccatcacggcctgaggaagggtggagaccacgtcgtaaagggccattttctcgcataccatatcagcagccagggcct

SEQ ID NO: 398623 - DNA, 140 bp, Artificial Sequence
  Synthetic
atacgccatgctgggtctccaccgttccccaggatgctgtctcgcgtagccagcgtcggggtaggaccggtcgagggagacatggcatatacaggtatgtttcctccggtgaacgaccttcgtacttgggagtcggccat

SEQ ID NO: 398624 - DNA, 140 bp, Artificial Sequence
  Synthetic
atggccgactcccaagtacgaaggtcgttcaccggaggaaacatacctgtatatgccatgtctccctcgaccggtcctaccccgacgctggctacgcgagacagcatcctggggaacggtggagacccagcatggcgtat

SEQ ID NO: 398625 - DNA, 140 bp, Artificial Sequence
  Synthetic
atacgccatgctgggtctcccgatgcggcgacctacaccaccggggggagtgctgctcagaccacgtcggcaatcgtcagcctactccaacctggcgccaagcagaacatccagctggtccgtacttgggagtcggccat

SEQ ID NO: 398626 - DNA, 140 bp, Artificial Sequence
  Synthetic
atggccgactcccaagtacggaccagctggatgttctgcttggcgccaggttggagtaggctgacgattgccgacgtggtctgagcagcactccccccggtggtgtaggtcgccgcatcgggagacccagcatggcgtat

SEQ ID NO: 398627 - DNA, 140 bp, Artificial Sequence
  Synthetic
aggccctggctgctgatatgtgggtggctgcccagctcgccgcccccggtgccgctaccgcctttgtgggcgctggcttagctggcgccgccatcggcagtgttggactggggaaggttcgaccttttgggacagcggtg

SEQ ID NO: 398628 - DNA, 140 bp, Artificial Sequence
  Synthetic
caccgctgtcccaaaaggtcgaaccttccccagtccaacactgccgatggcggcgccagctaagccagcgcccacaaaggcggtagcggcaccgggggcggcgagctgggcagccacccacatatcagcagccagggcct

SEQ ID NO: 398629 - DNA, 140 bp, Artificial Sequence
  Synthetic
atacgccatgctgggtctccttttgattgtgatgctactctttgccggcgttgacggggggacccgcaccatggggggaacggcagcccacgctaccagcgggtttgtgtccctcttctccgtacttgggagtcggccat

SEQ ID NO: 398630 - DNA, 140 bp, Artificial Sequence
  Synthetic
atggccgactcccaagtacggagaagagggacacaaacccgctggtagcgtgggctgccgttccccccatggtgcgggtccccccgtcaacgccggcaaagagtagcatcacaatcaaaaggagacccagcatggcgtat

SEQ ID NO: 398631 - DNA, 140 bp, Artificial Sequence
  Synthetic
aggccctggctgctgatatgcttgccgcgctgttctacgcacacaagttcaacgcgtccggatgcccggagcgcatggccagctgccgccccatcagtgagttcgctcaggggtggggtcgaccttttgggacagcggtg

SEQ ID NO: 398632 - DNA, 140 bp, Artificial Sequence
  Synthetic
caccgctgtcccaaaaggtcgaccccacccctgagcgaactcactgatggggcggcagctggccatgcgctccgggcatccggacgcgttgaacttgtgtgcgtagaacagcgcggcaagcatatcagcagccagggcct

SEQ ID NO: 398633 - DNA, 140 bp, Artificial Sequence
  Synthetic
atacgccatgctgggtctccttcctcgctaggctcatatggtggttgcaataccttatcaccagagccgaggcgcacttgaacgtgtggattcccccccttagtgttcgggggggccgcgcgtacttgggagtcggccat

SEQ ID NO: 398634 - DNA, 140 bp, Artificial Sequence
  Synthetic
atggccgactcccaagtacgcgcggcccccccgaacactaagggggggaatccacacgttcaagtgcgcctcggctctggtgataaggtattgcaaccaccatatgagcctagcgaggaaggagacccagcatggcgtat

SEQ ID NO: 398635 - DNA, 140 bp, Artificial Sequence
  Synthetic
aggccctggctgctgatatgacatgtcaaaaacgggacgatgaggatcgtcggtcctaggacctgcaggaacatgtggagtgggaccttccccattaacgcctacaccacgggcccctgtgaccttttgggacagcggtg

SEQ ID NO: 398636 - DNA, 140 bp, Artificial Sequence
  Synthetic
caccgctgtcccaaaaggtcacaggggcccgtggtgtaggcgttaatggggaaggtcccactccacatgttcctgcaggtcctaggaccgacgatcctcatcgtcccgtttttgacatgtcatatcagcagccagggcct

SEQ ID NO: 398637 - DNA, 140 bp, Artificial Sequence
  Synthetic
aggccctggctgctgatatgcatgccccccctggagggggagcctggggatccggatctcagcgacggatcatggtcgacggtcagtagtgaggccggcacggaggatgtcgtgtgctgcgaccttttgggacagcggtg

SEQ ID NO: 398638 - DNA, 140 bp, Artificial Sequence
  Synthetic
caccgctgtcccaaaaggtcgcagcacacgacatcctccgtgccggcctcactactgaccgtcgaccatgatccgtcgctgagatccggatccccaggctccccctccagggggggcatgcatatcagcagccagggcct

SEQ ID NO: 398639 - DNA, 140 bp, Artificial Sequence
  Synthetic
aggccctggctgctgatatgcccactggggagtcctagcgggcatagcgtatttctccatggtggggaactgggcgaaggtcctgctagtgctgctgctgtttgccggcgtcgatgcggagaccttttgggacagcggtg

SEQ ID NO: 398640 - DNA, 140 bp, Artificial Sequence
  Synthetic
caccgctgtcccaaaaggtctccgcatcgacgccggcaaacagcagcagcactagcaggaccttcgcccagttccccaccatggagaaatacgctatgcccgctaggactccccagtgggcatatcagcagccagggcct

SEQ ID NO: 398641 - DNA, 140 bp, Artificial Sequence
  Synthetic
atacgccatgctgggtctcctggccgtgatgggaagctcctacggattccaatactcaccaggacagcgggttgaattcctcgtgcaagcgtggaagtccaagaagaccccaatggggttcgtacttgggagtcggccat

SEQ ID NO: 398642 - DNA, 140 bp, Artificial Sequence
  Synthetic
atggccgactcccaagtacgaaccccattggggtcttcttggacttccacgcttgcacgaggaattcaacccgctgtcctggtgagtattggaatccgtaggagcttcccatcacggccaggagacccagcatggcgtat

SEQ ID NO: 398643 - DNA, 140 bp, Artificial Sequence
  Synthetic
aggccctggctgctgatatgctccccccagcgctgcttcggcttttgtgggcgccggcatcgctggcgccgctgttggcagcataggccttgggaaggtgcttgtggacatcttggcggggaccttttgggacagcggtg

SEQ ID NO: 398644 - DNA, 140 bp, Artificial Sequence
  Synthetic
caccgctgtcccaaaaggtccccgccaagatgtccacaagcaccttcccaaggcctatgctgccaacagcggcgccagcgatgccggcgcccacaaaagccgaagcagcgctggggggagcatatcagcagccagggcct

SEQ ID NO: 398645 - DNA, 140 bp, Artificial Sequence
  Synthetic
aggccctggctgctgatatggctgttggcagcataggccttgggaaggtgcttgtggacatcttggcgggctatggagcaggggtggcaggcgcactcgtggcctttaaggtcatgagcggaccttttgggacagcggtg

SEQ ID NO: 398646 - DNA, 140 bp, Artificial Sequence
  Synthetic
caccgctgtcccaaaaggtccgctcatgaccttaaaggccacgagtgcgcctgccacccctgctccatagcccgccaagatgtccacaagcaccttcccaaggcctatgctgccaacagccatatcagcagccagggcct

SEQ ID NO: 398647 - DNA, 140 bp, Artificial Sequence
  Synthetic
atacgccatgctgggtctccagcgacgccgcagcgcgtgtcactcagatcctctccagccttaccatcactcagctgctgaagaggctccaccagtggattaatgaggactgctccacgccgtacttgggagtcggccat

SEQ ID NO: 398648 - DNA, 140 bp, Artificial Sequence
  Synthetic
atggccgactcccaagtacggcgtggagcagtcctcattaatccactggtggagcctcttcagcagctgagtgatggtaaggctggagaggatctgagtgacacgcgctgcggcgtcgctggagacccagcatggcgtat

SEQ ID NO: 398649 - DNA, 140 bp, Artificial Sequence
  Synthetic
aggccctggctgctgatatggaggagtacgtggaggtcacgcgagtgggggatttccactacgtgacgggcatgaccactgacaacataaagtgcccatgccaggttccggcccccgaatgaccttttgggacagcggtg

SEQ ID NO: 398650 - DNA, 140 bp, Artificial Sequence
  Synthetic
caccgctgtcccaaaaggtcattcgggggccggaacctggcatgggcactttatgttgtcagtggtcatgcccgtcacgtagtggaaatcccccactcgcgtgacctccacgtactcctccatatcagcagccagggcct

SEQ ID NO: 398651 - DNA, 140 bp, Artificial Sequence
  Synthetic
atacgccatgctgggtctcccaaaaccagaaccagcggggccgggcatgagacacgctgtgataaatgtctcccccgctgtagccagccgtaaaccagccggacaaatccagccggctagcgtacttgggagtcggccat

SEQ ID NO: 398652 - DNA, 140 bp, Artificial Sequence
  Synthetic
atggccgactcccaagtacgctagccggctggatttgtccggctggtttacggctggctacagcgggggagacatttatcacagcgtgtctcatgcccggccccgctggttctggttttgggagacccagcatggcgtat

SEQ ID NO: 398653 - DNA, 140 bp, Artificial Sequence
  Synthetic
aggccctggctgctgatatgtagctcaggctgaggccgccttagagaacttggtggtcctcaatgcggcgtccgtggccggaacgcatggcattctctccttccttgtgttcttctgtgcgaccttttgggacagcggtg

SEQ ID NO: 398654 - DNA, 140 bp, Artificial Sequence
  Synthetic
caccgctgtcccaaaaggtcgcacagaagaacacaaggaaggagagaatgccatgcgttccggccacggacgccgcattgaggaccaccaagttctctaaggcggcctcagcctgagctacatatcagcagccagggcct

SEQ ID NO: 398655 - DNA, 140 bp, Artificial Sequence
  Synthetic
atacgccatgctgggtctccttcgatgaggataacagggccaaaaacttgcatgaacacttggcagggaaccttccccatcaactgttacacagagggccagtgtgtgccaaaaccggcgcgtacttgggagtcggccat

SEQ ID NO: 398656 - DNA, 140 bp, Artificial Sequence
  Synthetic
atggccgactcccaagtacgcgccggttttggcacacactggccctctgtgtaacagttgatggggaaggttccctgccaagtgttcatgcaagtttttggccctgttatcctcatcgaaggagacccagcatggcgtat

SEQ ID NO: 398657 - DNA, 140 bp, Artificial Sequence
  Synthetic
atacgccatgctgggtctccgcccgctttgtcaaccggccttctccacctccaccaaaacatcgtggacgtccagtacatgtacggcctgtcacccgctctcacaaagtatatcgtccgacgtacttgggagtcggccat

SEQ ID NO: 398658 - DNA, 140 bp, Artificial Sequence
  Synthetic
atggccgactcccaagtacgtcggacgatatactttgtgagagcgggtgacaggccgtacatgtactggacgtccacgatgttttggtggaggtggagaaggccggttgacaaagcgggcggagacccagcatggcgtat

SEQ ID NO: 398659 - DNA, 140 bp, Artificial Sequence
  Synthetic
atacgccatgctgggtctcccacatcaacaggactgccctgaactgcaatgattccctcaacactgggttcatcgctgcgctgttctacgtacgcaacttcaactcgtccgggtgcctagcgtacttgggagtcggccat

SEQ ID NO: 398660 - DNA, 140 bp, Artificial Sequence
  Synthetic
atggccgactcccaagtacgctaggcacccggacgagttgaagttgcgtacgtagaacagcgcagcgatgaacccagtgttgagggaatcattgcagttcagggcagtcctgttgatgtgggagacccagcatggcgtat

SEQ ID NO: 398661 - DNA, 140 bp, Artificial Sequence
  Synthetic
aggccctggctgctgatatgtacatgtccaaggcccatggggtcgatcctaacatcaggaccggggtgagaacaattaccactggcagccccatcacgtactccacctacggcaagttccgaccttttgggacagcggtg

SEQ ID NO: 398662 - DNA, 140 bp, Artificial Sequence
  Synthetic
caccgctgtcccaaaaggtcggaacttgccgtaggtggagtacgtgatggggctgccagtggtaattgttctcaccccggtcctgatgttaggatcgaccccatgggccttggacatgtacatatcagcagccagggcct

SEQ ID NO: 398663 - DNA, 140 bp, Artificial Sequence
  Synthetic
atacgccatgctgggtctccaactgttcgccaggctcaaggcgcgcatgcccgacggcgaggatctcgtcgtgacccatggcgatgcctgcttgccgaatatcatggtggaaaatggccgcgtacttgggagtcggccat

SEQ ID NO: 398664 - DNA, 140 bp, Artificial Sequence
  Synthetic
atggccgactcccaagtacgcggccattttccaccatgatattcggcaagcaggcatcgccatgggtcacgacgagatcctcgccgtcgggcatgcgcgccttgagcctggcgaacagttggagacccagcatggcgtat

SEQ ID NO: 398665 - DNA, 140 bp, Artificial Sequence
  Synthetic
aggccctggctgctgatatgaatcaccaaagtcttgctcgccatactcggtccgctcatggtgctccaggctgccgtaaccaaaatgccgtacttcgtgcgtgctcaagggctcattcgtgaccttttgggacagcggtg

SEQ ID NO: 398666 - DNA, 140 bp, Artificial Sequence
  Synthetic
caccgctgtcccaaaaggtcacgaatgagcccttgagcacgcacgaagtacggcattttggttacggcagcctggagcaccatgagcggaccgagtatggcgagcaagactttggtgattcatatcagcagccagggcct

SEQ ID NO: 398667 - DNA, 140 bp, Artificial Sequence
  Synthetic
atacgccatgctgggtctccctccgatgcgggactgggcccactcgggcctacgagatctcgcggtggcagttgagcccgttgtcttttccgacatggagaccaagattatcacctggggcgtacttgggagtcggccat

SEQ ID NO: 398668 - DNA, 140 bp, Artificial Sequence
  Synthetic
atggccgactcccaagtacgccccaggtgataatcttggtctccatgtcggaaaagacaacgggctcaactgccaccgcgagatctcgtaggcccgagtgggcccagtcccgcatcggagggagacccagcatggcgtat

SEQ ID NO: 398669 - DNA, 140 bp, Artificial Sequence
  Synthetic
atacgccatgctgggtctccaggttgagggggaggtccaagtggtttccaccgcaacacagtctttcctggcgacctgcgtcaacggcgtgtgttggaccgtctaccatggagccggctccgtacttgggagtcggccat

SEQ ID NO: 398670 - DNA, 140 bp, Artificial Sequence
  Synthetic
atggccgactcccaagtacggagccggctccatggtagacggtccaacacacgccgttgacgcaggtcgccaggaaagactgtgttgcggtggaaaccacttggacctccccctcaacctggagacccagcatggcgtat

SEQ ID NO: 398671 - DNA, 140 bp, Artificial Sequence
  Synthetic
aggccctggctgctgatatgggggtctggcgaggagacggcatcatgcacactcgctgccactgtggagctgagatcactggacatgtcaaaaacgggacgatgaggatcgtcggtcctagaccttttgggacagcggtg

SEQ ID NO: 398672 - DNA, 140 bp, Artificial Sequence
  Synthetic
caccgctgtcccaaaaggtctaggaccgacgatcctcatcgtcccgtttttgacatgtccagtgatctcagctccacagtggcagcgagtgtgcatgatgccgtctcctcgccagacccccatatcagcagccagggcct

SEQ ID NO: 398673 - DNA, 140 bp, Artificial Sequence
  Synthetic
aggccctggctgctgatatgacgggcccctgtactccccttcccgcgccgaactataagttcgcgctgtggagggtgtctgcagaggaatacgtggaaataaggcaggtgggggacttccgaccttttgggacagcggtg

SEQ ID NO: 398674 - DNA, 140 bp, Artificial Sequence
  Synthetic
caccgctgtcccaaaaggtcggaagtcccccacctgccttatttccacgtattcctctgcagacaccctccacagcgcgaacttatagttcggcgcgggaaggggagtacaggggcccgtcatatcagcagccagggcct

SEQ ID NO: 398675 - DNA, 140 bp, Artificial Sequence
  Synthetic
aggccctggctgctgatatggatcaacaccaatggcagttggcacatcaatcgcactgccttgaactgcaatgcgagcctcgacaccggctgggtagcggggctcttctattaccacaaagaccttttgggacagcggtg

SEQ ID NO: 398676 - DNA, 140 bp, Artificial Sequence
  Synthetic
caccgctgtcccaaaaggtctttgtggtaatagaagagccccgctacccagccggtgtcgaggctcgcattgcagttcaaggcagtgcgattgatgtgccaactgccattggtgttgatccatatcagcagccagggcct

SEQ ID NO: 398677 - DNA, 140 bp, Artificial Sequence
  Synthetic
aggccctggctgctgatatgatgcgagcctcgacaccggctgggtagcggggctcttctattaccacaaattcaactcttcaggctgccccgaaaggatggctagctgcaggccccttgcgaccttttgggacagcggtg

SEQ ID NO: 398678 - DNA, 140 bp, Artificial Sequence
  Synthetic
caccgctgtcccaaaaggtcgcaaggggcctgcagctagccatcctttcggggcagcctgaagagttgaatttgtggtaatagaagagccccgctacccagccggtgtcgaggctcgcatcatatcagcagccagggcct

SEQ ID NO: 398679 - DNA, 140 bp, Artificial Sequence
  Synthetic
atacgccatgctgggtctccgggtctactaccttacccgtgaccctacaactcccctcgcgagagcagcgtgggagacagcaagacacactccagtcaattcctggctaggcaacataatcgtacttgggagtcggccat

SEQ ID NO: 398680 - DNA, 140 bp, Artificial Sequence
  Synthetic
atggccgactcccaagtacgattatgttgcctagccaggaattgactggagtgtgtcttgctgtctcccacgctgctctcgcgaggggagttgtagggtcacgggtaaggtagtagacccggagacccagcatggcgtat

SEQ ID NO: 398681 - DNA, 140 bp, Artificial Sequence
  Synthetic
atacgccatgctgggtctccagcctgacgcccccacactcagccagatccaagtttggctatggggcaaaagacgtccgttgccacgccagaaaggccgtaaaccacatcaactccgtgtcgtacttgggagtcggccat

SEQ ID NO: 398682 - DNA, 140 bp, Artificial Sequence
  Synthetic
atggccgactcccaagtacgacacggagttgatgtggtttacggcctttctggcgtggcaacggacgtcttttgccccatagccaaacttggatctggctgagtgtgggggcgtcaggctggagacccagcatggcgtat

SEQ ID NO: 398683 - DNA, 140 bp, Artificial Sequence
  Synthetic
aggccctggctgctgatatgggacccctttggattcttcaaaccagtctgctcaaagtgccctacttcgtgcgcgtccagggccttctccggctctgcgcgctagtgcgcaagatggccggaccttttgggacagcggtg

SEQ ID NO: 398684 - DNA, 140 bp, Artificial Sequence
  Synthetic
caccgctgtcccaaaaggtccggccatcttgcgcactagcgcgcagagccggagaaggccctggacgcgcacgaagtagggcactttgagcagactggtttgaagaatccaaaggggtcccatatcagcagccagggcct

SEQ ID NO: 398685 - DNA, 140 bp, Artificial Sequence
  Synthetic
atacgccatgctgggtctcccttacaagatctggctgtggctgtggaaccagtcgtcttttcccggatggaggtcaagctcattacgtggggggcggacaccgccgcatgcggtgacatccgtacttgggagtcggccat

SEQ ID NO: 398686 - DNA, 140 bp, Artificial Sequence
  Synthetic
atggccgactcccaagtacggatgtcaccgcatgcggcggtgtccgccccccacgtaatgagcttgacctccatccgggaaaagacgactggttccacagccacagccagatcttgtaagggagacccagcatggcgtat

SEQ ID NO: 398687 - DNA, 140 bp, Artificial Sequence
  Synthetic
aggccctggctgctgatatgtgcctggtacatcaagggcaggctggtccctggggcggcatatgccttctatggcgtatggccgctgctcctgctcctgctggcgttgccaccacgagcagaccttttgggacagcggtg

SEQ ID NO: 398688 - DNA, 140 bp, Artificial Sequence
  Synthetic
caccgctgtcccaaaaggtctgctcgtggtggcaacgccagcaggagcaggagcagcggccatacgccatagaaggcatatgccgccccagggaccagcctgcccttgatgtaccaggcacatatcagcagccagggcct

SEQ ID NO: 398689 - DNA, 140 bp, Artificial Sequence
  Synthetic
  misc_feature (29)..(29): n is a, c, g, or t
atacgccatgctgggtctcctttggctanggggcaaaagatgttcgaagcctagcccgcaaggccgttaaccacatcaactccgtgtgggaggacttgctggaggacaatgttacccctacgtacttgggagtcggccat

SEQ ID NO: 398690 - DNA, 140 bp, Artificial Sequence
  Synthetic
  misc_feature (112)..(112): n is a, c, g, or t
atggccgactcccaagtacgtaggggtaacattgtcctccagcaagtcctcccacacggagttgatgtggttaacggccttgcgggctaggcttcgaacatcttttgccccntagccaaaggagacccagcatggcgtat

SEQ ID NO: 398691 - DNA, 140 bp, Artificial Sequence
  Synthetic
aggccctggctgctgatatgcagggctataaggtgctggtgctcaacccttctgttgctgcaacactgggctttggtgcttacatgtccaaggcccatgggattgatcctaacatcaggagaccttttgggacagcggtg

SEQ ID NO: 398692 - DNA, 140 bp, Artificial Sequence
  Synthetic
caccgctgtcccaaaaggtctcctgatgttaggatcaatcccatgggccttggacatgtaagcaccaaagcccagtgttgcagcaacagaagggttgagcaccagcaccttatagccctgcatatcagcagccagggcct

SEQ ID NO: 398693 - DNA, 140 bp, Artificial Sequence
  Synthetic
atacgccatgctgggtctcccaggaactaccgtcaccgggggggccgctgctcacagcacgtcgaggttcactgcctttttcagtcagggtgctaggcagaacatccagctggttaactccgtacttgggagtcggccat

SEQ ID NO: 398694 - DNA, 140 bp, Artificial Sequence
  Synthetic
atggccgactcccaagtacggagttaaccagctggatgttctgcctagcaccctgactgaaaaaggcagtgaacctcgacgtgctgtgagcagcggcccccccggtgacggtagttcctgggagacccagcatggcgtat

SEQ ID NO: 398695 - DNA, 140 bp, Artificial Sequence
  Synthetic
aggccctggctgctgatatggttcaaggccttctccggatctgcgcgctagcgcggaagatggttggaggccattacgtgcaaatggtcatcatcaagttaggggcgcttactggcacctgaccttttgggacagcggtg

SEQ ID NO: 398696 - DNA, 140 bp, Artificial Sequence
  Synthetic
caccgctgtcccaaaaggtcaggtgccagtaagcgcccctaacttgatgatgaccatttgcacgtaatggcctccaaccatcttccgcgctagcgcgcagatccggagaaggccttgaaccatatcagcagccagggcct

SEQ ID NO: 398697 - DNA, 140 bp, Artificial Sequence
  Synthetic
aggccctggctgctgatatgcacatcaacaggactgccctgaactgcaatgactcccttcaaactgggtttctcgccgcgctgttctacacgcacaggttcaacgcgtccgggtgtccaggaccttttgggacagcggtg

SEQ ID NO: 398698 - DNA, 140 bp, Artificial Sequence
  Synthetic
caccgctgtcccaaaaggtcctggacacccggacgcgttgaacctgtgcgtgtagaacagcgcggcgagaaacccagtttgaagggagtcattgcagttcagggcagtcctgttgatgtgcatatcagcagccagggcct

SEQ ID NO: 398699 - DNA, 140 bp, Artificial Sequence
  Synthetic
atacgccatgctgggtctccgcacatcaacaggactgctctgaattgcgatgactccctccacaccgggttccttgctgcgctgttttacgcgcacaagttcaactcgtccggatgctcgcgtacttgggagtcggccat

SEQ ID NO: 398700 - DNA, 140 bp, Artificial Sequence
  Synthetic
atggccgactcccaagtacgcgagcatccggacgagttgaacttgtgcgcgtaaaacagcgcagcaaggaacccggtgtggagggagtcatcgcaattcagagcagtcctgttgatgtgcggagacccagcatggcgtat

SEQ ID NO: 398701 - DNA, 140 bp, Artificial Sequence
  Synthetic
atacgccatgctgggtctccctggaataacaaaaatgccgtacttcgtacgcgctcaagggctcatccgcgtgtgcatgttagtgcgggaagtcgtcgggggccattacgtccaaatggccgtacttgggagtcggccat

SEQ ID NO: 398702 - DNA, 140 bp, Artificial Sequence
  Synthetic
atggccgactcccaagtacggccatttggacgtaatggcccccgacgacttcccgcactaacatgcacacgcggatgagcccttgagcgcgtacgaagtacggcatttttgttattccagggagacccagcatggcgtat

SEQ ID NO: 398703 - DNA, 140 bp, Artificial Sequence
  Synthetic
aggccctggctgctgatatgagagtggcagatactgccctgttccttcaccaccctaccggctctgtccactggtttgatccacctccaccagaacatcgtggacgtgcaatacctgtacgaccttttgggacagcggtg

SEQ ID NO: 398704 - DNA, 140 bp, Artificial Sequence
  Synthetic
caccgctgtcccaaaaggtcgtacaggtattgcacgtccacgatgttctggtggaggtggatcaaaccagtggacagagccggtagggtggtgaaggaacagggcagtatctgccactctcatatcagcagccagggcct

SEQ ID NO: 398705 - DNA, 140 bp, Artificial Sequence
  Synthetic
aggccctggctgctgatatgcatatgctttctatggcgtgtggccgctgctcctgctcctgctggcattaccaccacgagcatacgccatggaccgggagatggctgcatcatgcggagggaccttttgggacagcggtg

SEQ ID NO: 398706 - DNA, 140 bp, Artificial Sequence
  Synthetic
caccgctgtcccaaaaggtccctccgcatgatgcagccatctcccggtccatggcgtatgctcgtggtggtaatgccagcaggagcaggagcagcggccacacgccatagaaagcatatgcatatcagcagccagggcct

SEQ ID NO: 398707 - DNA, 140 bp, Artificial Sequence
  Synthetic
aggccctggctgctgatatgtaggttgcgggcttacctaaatacaccagggttgcccgtctgccaggaccacttggagttctgggagagcgtcttcacaggcctcacccatatagatgccgaccttttgggacagcggtg

SEQ ID NO: 398708 - DNA, 140 bp, Artificial Sequence
  Synthetic
caccgctgtcccaaaaggtcggcatctatatgggtgaggcctgtgaagacgctctcccagaactccaagtggtcctggcagacgggcaaccctggtgtatttaggtaagcccgcaacctacatatcagcagccagggcct

SEQ ID NO: 398709 - DNA, 140 bp, Artificial Sequence
  Synthetic
aggccctggctgctgatatgggtggtcgtcgccaccgacgccctcatgacggggtacactggggactttgactccgtgatcgactgtaacgtagcggtcactcaagttgtagacttcagcgaccttttgggacagcggtg

SEQ ID NO: 398710 - DNA, 140 bp, Artificial Sequence
  Synthetic
caccgctgtcccaaaaggtcgctgaagtctacaacttgagtgaccgctacgttacagtcgatcacggagtcaaagtccccagtgtaccccgtcatgagggcgtcggtggcgacgaccacccatatcagcagccagggcct

SEQ ID NO: 398711 - DNA, 140 bp, Artificial Sequence
  Synthetic
aggccctggctgctgatatggaacaccgcccctactgctggcactaccccccaaagccttgtggcatcgtgccggcacagagcgtatgtggcccagtgtattgcttcacccctagccctggaccttttgggacagcggtg

SEQ ID NO: 398712 - DNA, 140 bp, Artificial Sequence
  Synthetic
caccgctgtcccaaaaggtccagggctaggggtgaagcaatacactgggccacatacgctctgtgccggcacgatgccacaaggctttggggggtagtgccagcagtaggggcggtgttccatatcagcagccagggcct

SEQ ID NO: 398713 - DNA, 140 bp, Artificial Sequence
  Synthetic
aggccctggctgctgatatgggacatgtcaaaaacggttccatgaggatcgttgggcctaggacctgcagcaacacgtggcatggaacattccccatcaacgcgtacaccacgggcccctgaccttttgggacagcggtg

SEQ ID NO: 398714 - DNA, 140 bp, Artificial Sequence
  Synthetic
caccgctgtcccaaaaggtcaggggcccgtggtgtacgcgttgatggggaatgttccatgccacgtgttgctgcaggtcctaggcccaacgatcctcatggaaccgtttttgacatgtcccatatcagcagccagggcct

SEQ ID NO: 398715 - DNA, 140 bp, Artificial Sequence
  Synthetic
aggccctggctgctgatatgcggccgatggaatggtctctaaggggtggaggttgctggcgcccatcacggcgtatgcccagcagacgaggggcctcttgggatgcataattaccagcttgaccttttgggacagcggtg

SEQ ID NO: 398716 - DNA, 140 bp, Artificial Sequence
  Synthetic
caccgctgtcccaaaaggtcaagctggtaattatgcatcccaagaggcccctcgtctgctgggcatacgccgtgatgggcgccagcaacctccaccccttagagaccattccatcggccgcatatcagcagccagggcct

SEQ ID NO: 398717 - DNA, 140 bp, Artificial Sequence
  Synthetic
aggccctggctgctgatatgtgtgtggcccggtgtattgtttcactcccagccccgtggtggtgggaacgaccgacaggtcgggcgcacctacctacagctggggtgcgaatgatacggagaccttttgggacagcggtg

SEQ ID NO: 398718 - DNA, 140 bp, Artificial Sequence
  Synthetic
caccgctgtcccaaaaggtctccgtatcattcgcaccccagctgtaggtaggtgcgcccgacctgtcggtcgttcccaccaccacggggctgggagtgaaacaatacaccgggccacacacatatcagcagccagggcct

SEQ ID NO: 398719 - DNA, 140 bp, Artificial Sequence
  Synthetic
aggccctggctgctgatatgggccggcataactagagtgccgtacttcgtgcgcgcacaagggctcattcgtgcatgcatgttggcgcggaaagtcgtggggggtcattacgtccaaatggaccttttgggacagcggtg

SEQ ID NO: 398720 - DNA, 140 bp, Artificial Sequence
  Synthetic
caccgctgtcccaaaaggtccatttggacgtaatgaccccccacgactttccgcgccaacatgcatgcacgaatgagcccttgtgcgcgcacgaagtacggcactctagttatgccggcccatatcagcagccagggcct

SEQ ID NO: 398721 - DNA, 140 bp, Artificial Sequence
  Synthetic
aggccctggctgctgatatgaggagtgggcaacaagaccttgtactgtcccacagattgtttccgcaaacatccggacgccacatactctcgatgcggctccggtccctggcttacacccgaccttttgggacagcggtg

SEQ ID NO: 398722 - DNA, 140 bp, Artificial Sequence
  Synthetic
caccgctgtcccaaaaggtcgggtgtaagccagggaccggagccgcatcgagagtatgtggcgtccggatgtttgcggaaacaatctgtgggacagtacaaggtcttgttgcccactcctcatatcagcagccagggcct

SEQ ID NO: 398723 - DNA, 140 bp, Artificial Sequence
  Synthetic
aggccctggctgctgatatggcgtatttctccatggtggggaactgggcgaaggtgctggtagtgctgctgctatttgccggcgttgacgcggagactcgtatcaccgcggatggcgtcggaccttttgggacagcggtg

SEQ ID NO: 398724 - DNA, 140 bp, Artificial Sequence
  Synthetic
caccgctgtcccaaaaggtccgacgccatccgcggtgatacgagtctccgcgtcaacgccggcaaatagcagcagcactaccagcaccttcgcccagttccccaccatggagaaatacgccatatcagcagccagggcct

SEQ ID NO: 398725 - DNA, 140 bp, Artificial Sequence
  Synthetic
atacgccatgctgggtctcccaacaccttgcattgccccaccgactgtttccgcaagcatccagaagccacgtactctcggtgtggttccggcccctggcttacacccaggtgcatggtccgtacttgggagtcggccat

SEQ ID NO: 398726 - DNA, 140 bp, Artificial Sequence
  Synthetic
atggccgactcccaagtacggaccatgcacctgggtgtaagccaggggccggaaccacaccgagagtacgtggcttctggatgcttgcggaaacagtcggtggggcaatgcaaggtgttgggagacccagcatggcgtat

SEQ ID NO: 398727 - DNA, 140 bp, Artificial Sequence
  Synthetic
aggccctggctgctgatatgcttgccgcgctgttttacacccacaagttcaactcatccgggtgcccagagcgcatggccagctgccgctccattgataagttcgcccaggggtggggtcgaccttttgggacagcggtg

SEQ ID NO: 398728 - DNA, 140 bp, Artificial Sequence
  Synthetic
caccgctgtcccaaaaggtcgaccccacccctgggcgaacttatcaatggagcggcagctggccatgcgctctgggcacccggatgagttgaacttgtgggtgtaaaacagcgcggcaagcatatcagcagccagggcct

SEQ ID NO: 398729 - DNA, 140 bp, Artificial Sequence
  Synthetic
aggccctggctgctgatatgggagtcctagcgggccttgcctactattccatggtggggaactgggctaaggttctgattgtgatgctactctttgccggcgttgacgggggaacctatggaccttttgggacagcggtg

SEQ ID NO: 398730 - DNA, 140 bp, Artificial Sequence
  Synthetic
caccgctgtcccaaaaggtccataggttcccccgtcaacgccggcaaagagtagcatcacaatcagaaccttagcccagttccccaccatggaatagtaggcaaggcccgctaggactcccatatcagcagccagggcct

SEQ ID NO: 398731 - DNA, 140 bp, Artificial Sequence
  Synthetic
atacgccatgctgggtctccaccaagagtcagcatccaggtccgggtcacccggttccccctcaaggggcggcatggacgaatatgactccacgtccgattcttcgccagtttcgggcgacgtacttgggagtcggccat

SEQ ID NO: 398732 - DNA, 140 bp, Artificial Sequence
  Synthetic
atggccgactcccaagtacgtcgcccgaaactggcgaagaatcggacgtggagtcatattcgtccatgccgccccttgagggggaaccgggtgacccggacctggatgctgactcttggtggagacccagcatggcgtat

SEQ ID NO: 398733 - DNA, 140 bp, Artificial Sequence
  Synthetic
atacgccatgctgggtctccttttctgcgttcagcctgaaaaggggggtcgtaagccagctcgtctcatcgtgttccccgacctgggtgtgcgcgtgtgcgagaagatggccttgtacgacgtacttgggagtcggccat

SEQ ID NO: 398734 - DNA, 140 bp, Artificial Sequence
  Synthetic
atggccgactcccaagtacgtcgtacaaggccatcttctcgcacacgcgcacacccaggtcggggaacacgatgagacgagctggcttacgaccccccttttcaggctgaacgcagaaaaggagacccagcatggcgtat

SEQ ID NO: 398735 - DNA, 140 bp, Artificial Sequence
  Synthetic
aggccctggctgctgatatggatggagaccaagctcattacgtggggggcggacaccgccgcatgcggtgacatcatcaacggcttgcccgtctctgcccgtaggggccgagagatactggaccttttgggacagcggtg

SEQ ID NO: 398736 - DNA, 140 bp, Artificial Sequence
  Synthetic
caccgctgtcccaaaaggtccagtatctctcggcccctacgggcagagacgggcaagccgttgatgatgtcaccgcatgcggcggtgtccgccccccacgtaatgagcttggtctccatccatatcagcagccagggcct

SEQ ID NO: 398737 - DNA, 140 bp, Artificial Sequence
  Synthetic
aggccctggctgctgatatggaggagtacgtggaggttacgcgggtgggggatttccactacgtgacgggcatgaccactgacaacataaagtgcccatgccaggttccggcccctgaatgaccttttgggacagcggtg

SEQ ID NO: 398738 - DNA, 140 bp, Artificial Sequence
  Synthetic
caccgctgtcccaaaaggtcattcaggggccggaacctggcatgggcactttatgttgtcagtggtcatgcccgtcacgtagtggaaatcccccacccgcgtaacctccacgtactcctccatatcagcagccagggcct

SEQ ID NO: 398739 - DNA, 140 bp, Artificial Sequence
  Synthetic
atacgccatgctgggtctcctgcagcctccaggacccccccctccccgggagagccatagtggtctgcggaaccggtgagtacaccggaattgccaggacgaccgggtcctttcttggatcgtacttgggagtcggccat

SEQ ID NO: 398740 - DNA, 140 bp, Artificial Sequence
  Synthetic
atggccgactcccaagtacgatccaagaaaggacccggtcgtcctggcaattccggtgtactcaccggttccgcagaccactatggctctcccggggaggggggggtcctggaggctgcaggagacccagcatggcgtat

SEQ ID NO: 398741 - DNA, 140 bp, Artificial Sequence
  Synthetic
aggccctggctgctgatatggtcctagcgggcatagcgtatttctccatggtggggaactgggcgaaggtcgcggtagtactgctgctattcgccggcgtcgacgcgggaacccatgtcagaccttttgggacagcggtg

SEQ ID NO: 398742 - DNA, 140 bp, Artificial Sequence
  Synthetic
caccgctgtcccaaaaggtctgacatgggttcccgcgtcgacgccggcgaatagcagcagtactaccgcgaccttcgcccagttccccaccatggagaaatacgctatgcccgctaggaccatatcagcagccagggcct

SEQ ID NO: 398743 - DNA, 140 bp, Artificial Sequence
  Synthetic
atacgccatgctgggtctcccatcaatcgcacggccttgaactgtaatgacagcctcaacaccggctggctagcggggcttttctaccaccgcaaattcaactcctcaggctgtcccgagcgtacttgggagtcggccat

SEQ ID NO: 398744 - DNA, 140 bp, Artificial Sequence
  Synthetic
atggccgactcccaagtacgctcgggacagcctgaggagttgaatttgcggtggtagaaaagccccgctagccagccggtgttgaggctgtcattacagttcaaggccgtgcgattgatgggagacccagcatggcgtat

SEQ ID NO: 398745 - DNA, 140 bp, Artificial Sequence
  Synthetic
atacgccatgctgggtctcctgttctacgcacacaagttcaacgcatccgggtgcccagaacgcttggccagctgccgctccattgacaagttcgctcaagggtggggccccattacctacgtacttgggagtcggccat

SEQ ID NO: 398746 - DNA, 140 bp, Artificial Sequence
  Synthetic
atggccgactcccaagtacgtaggtaatggggccccacccttgagcgaacttgtcaatggagcggcagctggccaagcgttctgggcacccggatgcgttgaacttgtgtgcgtagaacaggagacccagcatggcgtat

SEQ ID NO: 398747 - DNA, 140 bp, Artificial Sequence
  Synthetic
aggccctggctgctgatatgggagtcctggcgggccttgcttactattccatggtagggaactgggctaaggttttgattgtgatgctactctttgccggcgtcgatgggcagacccgcggaccttttgggacagcggtg

SEQ ID NO: 398748 - DNA, 140 bp, Artificial Sequence
  Synthetic
caccgctgtcccaaaaggtccgcgggtctgcccatcgacgccggcaaagagtagcatcacaatcaaaaccttagcccagttccctaccatggaatagtaagcaaggcccgccaggactcccatatcagcagccagggcct

SEQ ID NO: 398749 - DNA, 140 bp, Artificial Sequence
  Synthetic
atacgccatgctgggtctccgcacatcaacaggactgccctgaactgcaatgacaccctccaaaccgggtttatagccgcgctgttctacacacacaagttcaactcgtctgggtgccggcgtacttgggagtcggccat

SEQ ID NO: 398750 - DNA, 140 bp, Artificial Sequence
  Synthetic
atggccgactcccaagtacgccggcacccagacgagttgaacttgtgtgtgtagaacagcgcggctataaacccggtttggagggtgtcattgcagttcagggcagtcctgttgatgtgcggagacccagcatggcgtat

SEQ ID NO: 398751 - DNA, 140 bp, Artificial Sequence
  Synthetic
atacgccatgctgggtctccgagcgcatggccagatgcagccccatcggcgagtttgatcaggggtggggccctatcacctacaatgagtcccacggtccggaccagaggccttattgctcgtacttgggagtcggccat

SEQ ID NO: 398752 - DNA, 140 bp, Artificial Sequence
  Synthetic
atggccgactcccaagtacgagcaataaggcctctggtccggaccgtgggactcattgtaggtgatagggccccacccctgatcaaactcgccgatggggctgcatctggccatgcgctcggagacccagcatggcgtat

SEQ ID NO: 398753 - DNA, 140 bp, Artificial Sequence
  Synthetic
aggccctggctgctgatatggaatttttcacagaactggacggggtgcgcctgcacaggttcgcgcccccttgcaagcctttgctacgagacgaggtgtcgttcagagtaggactatacggaccttttgggacagcggtg

SEQ ID NO: 398754 - DNA, 140 bp, Artificial Sequence
  Synthetic
caccgctgtcccaaaaggtccgtatagtcctactctgaacgacacctcgtctcgtagcaaaggcttgcaagggggcgcgaacctgtgcaggcgcaccccgtccagttctgtgaaaaattccatatcagcagccagggcct

SEQ ID NO: 398755 - DNA, 140 bp, Artificial Sequence
  Synthetic
atacgccatgctgggtctcccaacaccaacggcagttggcacatcaacagcacggccttgaactgcaatgacagccttagcgccggctggttagcaggcctcttctattacaacaaattccgtacttgggagtcggccat

SEQ ID NO: 398756 - DNA, 140 bp, Artificial Sequence
  Synthetic
atggccgactcccaagtacggaatttgttgtaatagaagaggcctgctaaccagccggcgctaaggctgtcattgcagttcaaggccgtgctgttgatgtgccaactgccgttggtgttgggagacccagcatggcgtat

SEQ ID NO: 398757 - DNA, 140 bp, Artificial Sequence
  Synthetic
aggccctggctgctgatatgcatttgggcacggccggactacaaccccccgttgctggagacgtggaaaaagccggactacgaaccacctgtggtccatggctgcccacttccacctccagaccttttgggacagcggtg

SEQ ID NO: 398758 - DNA, 140 bp, Artificial Sequence
  Synthetic
caccgctgtcccaaaaggtctggaggtggaagtgggcagccatggaccacaggtggttcgtagtccggctttttccacgtctccagcaacggggggttgtagtccggccgtgcccaaatgcatatcagcagccagggcct

SEQ ID NO: 398759 - DNA, 140 bp, Artificial Sequence
  Synthetic
aggccctggctgctgatatgagccggactacgaaccacctgtggtccatggctgcccacttccacctccacggtcccctcctgtgcctccgccccggaagaagcggacggtggtcctcacgaccttttgggacagcggtg

SEQ ID NO: 398760 - DNA, 140 bp, Artificial Sequence
  Synthetic
caccgctgtcccaaaaggtcgtgaggaccaccgtccgcttcttccggggcggaggcacaggaggggaccgtggaggtggaagtgggcagccatggaccacaggtggttcgtagtccggctcatatcagcagccagggcct

SEQ ID NO: 398761 - DNA, 140 bp, Artificial Sequence
  Synthetic
aggccctggctgctgatatgggccagattaccagccgcccgttgttgcgggctgcgctctccccccccctaagaagaccccgacgcctcccccaaggagacgccggacagtgggtttgaggaccttttgggacagcggtg

SEQ ID NO: 398762 - DNA, 140 bp, Artificial Sequence
  Synthetic
caccgctgtcccaaaaggtcctcaaacccactgtccggcgtctccttgggggaggcgtcggggtcttcttagggggggggagagcgcagcccgcaacaacgggcggctggtaatctggcccatatcagcagccagggcct

SEQ ID NO: 398763 - DNA, 140 bp, Artificial Sequence
  Synthetic
atacgccatgctgggtctccatgactactgacaatctcaaatgcccgtgccaggtcccatcgcccgaatttttcacagaactggacggggtgcgcctacataggttcgcgcccccttgcacgtacttgggagtcggccat

SEQ ID NO: 398764 - DNA, 140 bp, Artificial Sequence
  Synthetic
atggccgactcccaagtacgtgcaagggggcgcgaacctatgtaggcgcaccccgtccagttctgtgaaaaattcgggcgatgggacctggcacgggcatttgagattgtcagtagtcatggagacccagcatggcgtat

SEQ ID NO: 398765 - DNA, 140 bp, Artificial Sequence
  Synthetic
atacgccatgctgggtctccgtctggtccaaatcagaagatacagcttattaacaccaatggtagctggcacataaataggaccgctctaaactgtatcgacagtctccaaactgggtttcgtacttgggagtcggccat

SEQ ID NO: 398766 - DNA, 140 bp, Artificial Sequence
  Synthetic
atggccgactcccaagtacgaaacccagtttggagactgtcgatacagtttagagcggtcctatttatgtgccagctaccattggtgttaataagctgtatcttctgatttggaccagacggagacccagcatggcgtat

SEQ ID NO: 398767 - DNA, 140 bp, Artificial Sequence
  Synthetic
aggccctggctgctgatatgggggatgcagctcgccgagcaattcaagcagaaggcgctcgggttgctgcaaacagccaccaagcaagcggaggctgctgctcccgtggtggagtccaaggaccttttgggacagcggtg

SEQ ID NO: 398768 - DNA, 140 bp, Artificial Sequence
  Synthetic
caccgctgtcccaaaaggtccttggactccaccacgggagcagcagcctccgcttgcttggtggctgtttgcagcaacccgagcgccttctgcttgaattgctcggcgagctgcatcccccatatcagcagccagggcct

SEQ ID NO: 398769 - DNA, 140 bp, Artificial Sequence
  Synthetic
aggccctggctgctgatatgatttcgcccagggctggggccctatcagctatgccaacggaagcggccccgaacaccgcccttactgctggcactaccctccaaagccttgtggtatcgtgaccttttgggacagcggtg

SEQ ID NO: 398770 - DNA, 140 bp, Artificial Sequence
  Synthetic
caccgctgtcccaaaaggtcacgataccacaaggctttggagggtagtgccagcagtaagggcggtgttcggggccgcttccgttggcatagctgatagggccccagccctgggcgaaatcatatcagcagccagggcct

SEQ ID NO: 398771 - DNA, 140 bp, Artificial Sequence
  Synthetic
aggccctggctgctgatatgaacatggtctatgccacaacatctcgcagcgcaagccagcggcagaagaaggtcacctttgacagactgcaagtcctggacgaccactaccgggacgtgcgaccttttgggacagcggtg

SEQ ID NO: 398772 - DNA, 140 bp, Artificial Sequence
  Synthetic
caccgctgtcccaaaaggtcgcacgtcccggtagtggtcgtccaggacttgcagtctgtcaaaggtgaccttcttctgccgctggcttgcgctgcgagatgttgtggcatagaccatgttcatatcagcagccagggcct

SEQ ID NO: 398773 - DNA, 140 bp, Artificial Sequence
  Synthetic
aggccctggctgctgatatggaccggccgggacaaaaaccaggtggagggtgaggtccagattgtgtcaactgctgcccagaccttcctggcaacctgcatcaacggggtgtgctggactgaccttttgggacagcggtg

SEQ ID NO: 398774 - DNA, 140 bp, Artificial Sequence
  Synthetic
caccgctgtcccaaaaggtcagtccagcacaccccgttgatgcaggttgccaggaaggtctgggcagcagttgacacaatctggacctcaccctccacctggtttttgtcccggccggtccatatcagcagccagggcct

SEQ ID NO: 398775 - DNA, 140 bp, Artificial Sequence
  Synthetic
aggccctggctgctgatatgctccgtgtggaaggacttgctggaagacactgagacaccaattgataccaccatcatggcaaaaaatgaggttttctgcgtccaaccagagaagggaggcgaccttttgggacagcggtg

SEQ ID NO: 398776 - DNA, 140 bp, Artificial Sequence
  Synthetic
caccgctgtcccaaaaggtcgcctcccttctctggttggacgcagaaaacctcattttttgccatgatggtggtatcaattggtgtctcagtgtcttccagcaagtccttccacacggagcatatcagcagccagggcct

SEQ ID NO: 398777 - DNA, 140 bp, Artificial Sequence
  Synthetic
aggccctggctgctgatatgtggcattcaagatcatgagcggtgaggtcccctccacagaggacctggtcaatctattgcccgccatcctttcgcccggagcccttgtagtcggtgtggtgaccttttgggacagcggtg

SEQ ID NO: 398778 - DNA, 140 bp, Artificial Sequence
  Synthetic
caccgctgtcccaaaaggtcaccacaccgactacaagggctccgggcgaaaggatggcgggcaatagattgaccaggtcctctgtggaggggacctcaccgctcatgatcttgaatgccacatatcagcagccagggcct

SEQ ID NO: 398779 - DNA, 140 bp, Artificial Sequence
  Synthetic
atacgccatgctgggtctcccacatcaacaggactgccctgaattgcaatgactccctccacaccgggttccttgccgcgctgttctatacgcgcagattcaacgcgtctggatgcccagcgtacttgggagtcggccat

SEQ ID NO: 398780 - DNA, 140 bp, Artificial Sequence
  Synthetic
atggccgactcccaagtacgctgggcatccagacgcgttgaatctgcgcgtatagaacagcgcggcaaggaacccggtgtggagggagtcattgcaattcagggcagtcctgttgatgtgggagacccagcatggcgtat

SEQ ID NO: 398781 - DNA, 140 bp, Artificial Sequence
  Synthetic
atacgccatgctgggtctccagcgtatggccagctgtcgctccatcgaccaattcgaccaagggtggggccccatcacttacgccgggacgctcagcccggaccagaggccctattgctgcgtacttgggagtcggccat

SEQ ID NO: 398782 - DNA, 140 bp, Artificial Sequence
  Synthetic
atggccgactcccaagtacgcagcaatagggcctctggtccgggctgagcgtcccggcgtaagtgatggggccccacccttggtcgaattggtcgatggagcgacagctggccatacgctggagacccagcatggcgtat

SEQ ID NO: 398783 - DNA, 140 bp, Artificial Sequence
  Synthetic
aggccctggctgctgatatgggagtcttggcgggccttgcctactattccatggtggggaactgggctaaggttctgattgtgatgctgctctttgcaggcgttgacgggcagacacgtggaccttttgggacagcggtg

SEQ ID NO: 398784 - DNA, 140 bp, Artificial Sequence
  Synthetic
caccgctgtcccaaaaggtccacgtgtctgcccgtcaacgcctgcaaagagcagcatcacaatcagaaccttagcccagttccccaccatggaatagtaggcaaggcccgccaagactcccatatcagcagccagggcct

SEQ ID NO: 398785 - DNA, 140 bp, Artificial Sequence
  Synthetic
atacgccatgctgggtctccgcacgtcaataggactgccctgaactgcaacgactccctccaaactggattcattgctgcgctgttctacgcaaacaggttcaactcatctggatgcccacgtacttgggagtcggccat

SEQ ID NO: 398786 - DNA, 140 bp, Artificial Sequence
  Synthetic
atggccgactcccaagtacgtgggcatccagatgagttgaacctgtttgcgtagaacagcgcagcaatgaatccagtttggagggagtcgttgcagttcagggcagtcctattgacgtgcggagacccagcatggcgtat

SEQ ID NO: 398787 - DNA, 140 bp, Artificial Sequence
  Synthetic
aggccctggctgctgatatggttgctctgtccaccaccggagagatccccttttacggcaaggctatcccccttgaggcaatcaagggggggagacatctcatcttctgccactcaaagagaccttttgggacagcggtg

SEQ ID NO: 398788 - DNA, 140 bp, Artificial Sequence
  Synthetic
caccgctgtcccaaaaggtctctttgagtggcagaagatgagatgtctcccccccttgattgcctcaagggggatagccttgccgtaaaaggggatctctccggtggtggacagagcaaccatatcagcagccagggcct

SEQ ID NO: 398789 - DNA, 140 bp, Artificial Sequence
  Synthetic
atacgccatgctgggtctccagccttgaccctaccttcaccattgagacaaccacgcttccccaggatgctgtctcccgcactcaacgtcggggcaggactggcagggggaagccaggcacgtacttgggagtcggccat

SEQ ID NO: 398790 - DNA, 140 bp, Artificial Sequence
  Synthetic
atggccgactcccaagtacgtgcctggcttccccctgccagtcctgccccgacgttgagtgcgggagacagcatcctggggaagcgtggttgtctcaatggtgaaggtagggtcaaggctggagacccagcatggcgtat

SEQ ID NO: 398791 - DNA, 140 bp, Artificial Sequence
  Synthetic
aggccctggctgctgatatgggcccttggcctcctgcagaccgcgtcccgccaggcagaggtcatcgcccctgctgtccagaccaactggcaaagactcgaggccttctgggcgaagcacgaccttttgggacagcggtg

SEQ ID NO: 398792 - DNA, 140 bp, Artificial Sequence
  Synthetic
caccgctgtcccaaaaggtcgtgcttcgcccagaaggcctcgagtctttgccagttggtctggacagcaggggcgatgacctctgcctggcgggacgcggtctgcaggaggccaagggcccatatcagcagccagggcct

SEQ ID NO: 398793 - DNA, 140 bp, Artificial Sequence
  Synthetic
aggccctggctgctgatatgtgcatgcatgttggtgcggaaagtcgccgggggccattatgtccaaatggccctcatgaagctggccgcactgacaggtacgtacgtttatgaccatctcgaccttttgggacagcggtg

SEQ ID NO: 398794 - DNA, 140 bp, Artificial Sequence
  Synthetic
caccgctgtcccaaaaggtcgagatggtcataaacgtacgtacctgtcagtgcggccagcttcatgagggccatttggacataatggcccccggcgactttccgcaccaacatgcatgcacatatcagcagccagggcct

SEQ ID NO: 398795 - DNA, 140 bp, Artificial Sequence
  Synthetic
aggccctggctgctgatatgccagcccactaaccactagccaaactctcctcttcaacatcttgggggggtgggtggctgcccagctcgcagcccccggtgccgctaccgcctttgtggggaccttttgggacagcggtg

SEQ ID NO: 398796 - DNA, 140 bp, Artificial Sequence
  Synthetic
caccgctgtcccaaaaggtccccacaaaggcggtagcggcaccgggggctgcgagctgggcagccacccacccccccaagatgttgaagaggagagtttggctagtggttagtgggctggcatatcagcagccagggcct

SEQ ID NO: 398797 - DNA, 140 bp, Artificial Sequence
  Synthetic
aggccctggctgctgatatggcggaaccggtgagtacaccggaattgccaggacgaccgggtcctttcttggattaacccgctcaatgcctggagatttgggcgtgcccccgcaagactggaccttttgggacagcggtg

SEQ ID NO: 398798 - DNA, 140 bp, Artificial Sequence
  Synthetic
caccgctgtcccaaaaggtccagtcttgcgggggcacgcccaaatctccaggcattgagcgggttaatccaagaaaggacccggtcgtcctggcaattccggtgtactcaccggttccgccatatcagcagccagggcct

SEQ ID NO: 398799 - DNA, 140 bp, Artificial Sequence
  Synthetic
aggccctggctgctgatatggacggctggagcgcggctcgtcgtgctcgccaccgctacgcctccgggatcggtcaccgtgccacatcccaacatcgaggaggtggctctgtccaacactgaccttttgggacagcggtg

SEQ ID NO: 398800 - DNA, 140 bp, Artificial Sequence
  Synthetic
caccgctgtcccaaaaggtcagtgttggacagagccacctcctcgatgttgggatgtggcacggtgaccgatcccggaggcgtagcggtggcgagcacgacgagccgcgctccagccgtccatatcagcagccagggcct

SEQ ID NO: 398801 - DNA, 140 bp, Artificial Sequence
  Synthetic
atacgccatgctgggtctcctcccaaatcgcgccacccgcgggggccaccggcttcgtcgtcagtggcctggtgggggctgccgtaggcagcataggcctgggtaaggtgctggtggacacgtacttgggagtcggccat

SEQ ID NO: 398802 - DNA, 140 bp, Artificial Sequence
  Synthetic
atggccgactcccaagtacgtgtccaccagcaccttacccaggcctatgctgcctacggcagcccccaccaggccactgacgacgaagccggtggcccccgcgggtggcgcgatttgggaggagacccagcatggcgtat

SEQ ID NO: 398803 - DNA, 140 bp, Artificial Sequence
  Synthetic
aggccctggctgctgatatgggctgttggcagcattggccttgggaaggtgcttgtggacatcttggcgggctatggagcaggggtggctggcgcactcgtggcctttaagatcatgagcgaccttttgggacagcggtg

SEQ ID NO: 398804 - DNA, 140 bp, Artificial Sequence
  Synthetic
caccgctgtcccaaaaggtcgctcatgatcttaaaggccacgagtgcgccagccacccctgctccatagcccgccaagatgtccacaagcaccttcccaaggccaatgctgccaacagcccatatcagcagccagggcct

SEQ ID NO: 398805 - DNA, 140 bp, Artificial Sequence
  Synthetic
aggccctggctgctgatatgatcaataggacggccttgaactgcaatgatagccttcacaccggctggatagcagggcttttctatcaccacaaattcaattcttcaggctgtcccgagagaccttttgggacagcggtg

SEQ ID NO: 398806 - DNA, 140 bp, Artificial Sequence
  Synthetic
caccgctgtcccaaaaggtctctcgggacagcctgaagaattgaatttgtggtgatagaaaagccctgctatccagccggtgtgaaggctatcattgcagttcaaggccgtcctattgatcatatcagcagccagggcct

SEQ ID NO: 398807 - DNA, 140 bp, Artificial Sequence
  Synthetic
aggccctggctgctgatatgtggctgcagtatttcctgaccagaacagaagcgctactacacgtgtgggttccccccctcaacgtccgaggggggcgcgacgctgtcatcctactcatgtgaccttttgggacagcggtg

SEQ ID NO: 398808 - DNA, 140 bp, Artificial Sequence
  Synthetic
caccgctgtcccaaaaggtcacatgagtaggatgacagcgtcgcgcccccctcggacgttgagggggggaacccacacgtgtagtagcgcttctgttctggtcaggaaatactgcagccacatatcagcagccagggcct

SEQ ID NO: 398809 - DNA, 140 bp, Artificial Sequence
  Synthetic
aggccctggctgctgatatgtccccccctcaacgtccgaggggggcgcgacgctgtcatcctactcatgtgtgttgtacacccggccttggtatttgacatcaccaagctgctgctggccgaccttttgggacagcggtg

SEQ ID NO: 398810 - DNA, 140 bp, Artificial Sequence
  Synthetic
caccgctgtcccaaaaggtcggccagcagcagcttggtgatgtcaaataccaaggccgggtgtacaacacacatgagtaggatgacagcgtcgcgcccccctcggacgttgagggggggacatatcagcagccagggcct

SEQ ID NO: 398811 - DNA, 140 bp, Artificial Sequence
  Synthetic
aggccctggctgctgatatgactcttcaggctgccccgagaggatggccagctgtagaccccttgccgatttcgaccaaggctggggccctatcagctacgccaacggaagcggccccgagaccttttgggacagcggtg

SEQ ID NO: 398812 - DNA, 140 bp, Artificial Sequence
  Synthetic
caccgctgtcccaaaaggtctcggggccgcttccgttggcgtagctgatagggccccagccttggtcgaaatcggcaaggggtctacagctggccatcctctcggggcagcctgaagagtcatatcagcagccagggcct

SEQ ID NO: 398813 - DNA, 140 bp, Artificial Sequence
  Synthetic
atacgccatgctgggtctcccaatgatacggacgttctcgtccttaataacaccaggccaccgttgggtaattggttcggctgcacttggatgaacgcatctggatatactaaagtgtgccgtacttgggagtcggccat

SEQ ID NO: 398814 - DNA, 140 bp, Artificial Sequence
  Synthetic
atggccgactcccaagtacggcacactttagtatatccagatgcgttcatccaagtgcagccgaaccaattacccaacggtggcctggtgttattaaggacgagaacgtccgtatcattgggagacccagcatggcgtat

SEQ ID NO: 398815 - DNA, 140 bp, Artificial Sequence
  Synthetic
aggccctggctgctgatatggtgctcgccaccgctacccctccgggctccgtcaccgtgccccaccctaacatcgaggaggttgctctgtccaccaccggagagatccccttttacggcagaccttttgggacagcggtg

SEQ ID NO: 398816 - DNA, 140 bp, Artificial Sequence
  Synthetic
caccgctgtcccaaaaggtctgccgtaaaaggggatctctccggtggtggacagagcaacctcctcgatgttagggtggggcacggtgacggagcccggaggggtagcggtggcgagcaccatatcagcagccagggcct

SEQ ID NO: 398817 - DNA, 140 bp, Artificial Sequence
  Synthetic
aggccctggctgctgatatgccctttggattcttcaaaccagtctgctcaaggtgccctatttcgtgcgcgtccaaggccttctccggatctgcgcgctagcgcgcaagatggctggagggaccttttgggacagcggtg

SEQ ID NO: 398818 - DNA, 140 bp, Artificial Sequence
  Synthetic
caccgctgtcccaaaaggtccctccagccatcttgcgcgctagcgcgcagatccggagaaggccttggacgcgcacgaaatagggcaccttgagcagactggtttgaagaatccaaagggcatatcagcagccagggcct

SEQ ID NO: 398819 - DNA, 140 bp, Artificial Sequence
  Synthetic
aggccctggctgctgatatggagtcctggcgggccttgcctactattccatggtagggaactgggctaaggttttgattgtgatgctactcttcgccggcgttgacgggaacacccaaacgaccttttgggacagcggtg

SEQ ID NO: 398820 - DNA, 140 bp, Artificial Sequence
  Synthetic
caccgctgtcccaaaaggtcgtttgggtgttcccgtcaacgccggcgaagagtagcatcacaatcaaaaccttagcccagttccctaccatggaatagtaggcaaggcccgccaggactccatatcagcagccagggcct

SEQ ID NO: 398821 - DNA, 140 bp, Artificial Sequence
  Synthetic
atacgccatgctgggtctcccacatcaacaggaccgccctgaactgcaatgactcccttcacaccgggtttcttgctgcgctgttctacgtgaacaaattcaactcgtccgggtgcccggcgtacttgggagtcggccat

SEQ ID NO: 398822 - DNA, 140 bp, Artificial Sequence
  Synthetic
atggccgactcccaagtacgccgggcacccggacgagttgaatttgttcacgtagaacagcgcagcaagaaacccggtgtgaagggagtcattgcagttcagggcggtcctgttgatgtgggagacccagcatggcgtat

SEQ ID NO: 398823 - DNA, 140 bp, Artificial Sequence
  Synthetic
atacgccatgctgggtctcccccatcacttacgcccagcctgacagctcggaccagagaccctactgctggcactacgcgccccgaccgtgtggtactgtgcccgcgtcggaggtgtgtgcgtacttgggagtcggccat

SEQ ID NO: 398824 - DNA, 140 bp, Artificial Sequence
  Synthetic
atggccgactcccaagtacgcacacacctccgacgcgggcacagtaccacacggtcggggcgcgtagtgccagcagtagggtctctggtccgagctgtcaggctgggcgtaagtgatgggggagacccagcatggcgtat

SEQ ID NO: 398825 - DNA, 140 bp, Artificial Sequence
  Synthetic
aggccctggctgctgatatgtggaagacagggatagatcagagcttagtccgctgctgctgtctacaacagagtggcaagtgctgccttgttcctttgctaccctacctgccttgtccacgaccttttgggacagcggtg

SEQ ID NO: 398826 - DNA, 140 bp, Artificial Sequence
  Synthetic
caccgctgtcccaaaaggtcgtggacaaggcaggtagggtagcaaaggaacaaggcagcacttgccactctgttgtagacagcagcagcggactaagctctgatctatccctgtcttccacatatcagcagccagggcct

SEQ ID NO: 398827 - DNA, 140 bp, Artificial Sequence
  Synthetic
aggccctggctgctgatatgttcttctgtgctgcctggtacatcaagggcaggtcggtccctggggcggcatacgctctctatggcgtatggccgctgctcctgctcctgctggcgttacgaccttttgggacagcggtg

SEQ ID NO: 398828 - DNA, 140 bp, Artificial Sequence
  Synthetic
caccgctgtcccaaaaggtcgtaacgccagcaggagcaggagcagcggccatacgccatagagagcgtatgccgccccagggaccgacctgcccttgatgtaccaggcagcacagaagaacatatcagcagccagggcct

SEQ ID NO: 398829 - DNA, 140 bp, Artificial Sequence
  Synthetic
aggccctggctgctgatatgacgttggcccgggcgagggggcagtgcagtggatgaaccggctgatagccttcgcctcccgggggaaccatgtttcccccacgcactacgtgccggagaggaccttttgggacagcggtg

SEQ ID NO: 398830 - DNA, 140 bp, Artificial Sequence
  Synthetic
caccgctgtcccaaaaggtcctctccggcacgtagtgcgtgggggaaacatggttcccccgggaggcgaaggctatcagccggttcatccactgcactgccccctcgcccgggccaacgtcatatcagcagccagggcct

SEQ ID NO: 398831 - DNA, 140 bp, Artificial Sequence
  Synthetic
aggccctggctgctgatatggcccctccaataccacctccacggaggaagaagacggttgtcctgacagaatccaccgtgtcctctgccttggcggagctcgctacaaagaccttcggcagaccttttgggacagcggtg

SEQ ID NO: 398832 - DNA, 140 bp, Artificial Sequence
  Synthetic
caccgctgtcccaaaaggtctgccgaaggtctttgtagcgagctccgccaaggcagaggacacggtggattctgtcaggacaaccgtcttcttcctccgtggaggtggtattggaggggccatatcagcagccagggcct

SEQ ID NO: 398833 - DNA, 140 bp, Artificial Sequence
  Synthetic
atacgccatgctgggtctcctcccattacttatgatgaaggccccgatttagaccagaggccctattgctggcactacgcaccccggtcgtgcggtattgtgcccgcgtcgcaggtgtgtcgtacttgggagtcggccat

SEQ ID NO: 398834 - DNA, 140 bp, Artificial Sequence
  Synthetic
atggccgactcccaagtacgacacacctgcgacgcgggcacaataccgcacgaccggggtgcgtagtgccagcaatagggcctctggtctaaatcggggccttcatcataagtaatgggaggagacccagcatggcgtat

SEQ ID NO: 398835 - DNA, 140 bp, Artificial Sequence
  Synthetic
aggccctggctgctgatatgatcatcactagcctcacaggccgggacaagaaccaggtcgagggggaggttcaagtggtctccaccgcaacacaatctttcctggcgacctgtgtcaacggaccttttgggacagcggtg

SEQ ID NO: 398836 - DNA, 140 bp, Artificial Sequence
  Synthetic
caccgctgtcccaaaaggtccgttgacacaggtcgccaggaaagattgtgttgcggtggagaccacttgaacctccccctcgacctggttcttgtcccggcctgtgaggctagtgatgatcatatcagcagccagggcct

SEQ ID NO: 398837 - DNA, 140 bp, Artificial Sequence
  Synthetic
aggccctggctgctgatatgcgcggttttcataggtctggtactcctgaccctgtcaccacactataaagtgttccttgctaggctcatatggtggttgcagtactttaccaccagagccgaccttttgggacagcggtg

SEQ ID NO: 398838 - DNA, 140 bp, Artificial Sequence
  Synthetic
caccgctgtcccaaaaggtcggctctggtggtaaagtactgcaaccaccatatgagcctagcaaggaacactttatagtgtggtgacagggtcaggagtaccagacctatgaaaaccgcgcatatcagcagccagggcct

SEQ ID NO: 398839 - DNA, 140 bp, Artificial Sequence
  Synthetic
atacgccatgctgggtctccgtcctagaccaggcagaaaccgcgggggtccgcctcacggtgctcgctacggcgacgccgccaggctctgtcactgtcccccatcctaatataacagagacgtacttgggagtcggccat

SEQ ID NO: 398840 - DNA, 140 bp, Artificial Sequence
  Synthetic
atggccgactcccaagtacgtctctgttatattaggatgggggacagtgacagagcctggcggcgtcgccgtagcgagcaccgtgaggcggacccccgcggtttctgcctggtctaggacggagacccagcatggcgtat

SEQ ID NO: 398841 - DNA, 140 bp, Artificial Sequence
  Synthetic
atacgccatgctgggtctccacatcaccaaactcttgctcgctgtgctcggtccgctcatggtgtttctggccggcataacaagggtgccatacttcgtgcgcgcccaaggcctcattcgcgtacttgggagtcggccat

SEQ ID NO: 398842 - DNA, 140 bp, Artificial Sequence
  Synthetic
atggccgactcccaagtacgcgaatgaggccttgggcgcgcacgaagtatggcacccttgttatgccggccagaaacaccatgagcggaccgagcacagcgagcaagagtttggtgatgtggagacccagcatggcgtat

SEQ ID NO: 398843 - DNA, 140 bp, Artificial Sequence
  Synthetic
aggccctggctgctgatatggccggcataacaagggtgccatacttcgtgcgcgcccaaggcctcattcgtgcgtgcgcgttagcgcggaaggtcgctgggggtcattatatccaaatgggaccttttgggacagcggtg

SEQ ID NO: 398844 - DNA, 140 bp, Artificial Sequence
  Synthetic
caccgctgtcccaaaaggtcccatttggatataatgacccccagcgaccttccgcgctaacgcgcacgcacgaatgaggccttgggcgcgcacgaagtatggcacccttgttatgccggccatatcagcagccagggcct

SEQ ID NO: 398845 - DNA, 140 bp, Artificial Sequence
  Synthetic
aggccctggctgctgatatgggggcctacttggctgcatcatcactagtctcacaggtcgggacaagaaccaggtcgagggggaggttcaagtggtttccaccgcaacacagtctttcctgaccttttgggacagcggtg

SEQ ID NO: 398846 - DNA, 140 bp, Artificial Sequence
  Synthetic
caccgctgtcccaaaaggtcaggaaagactgtgttgcggtggaaaccacttgaacctccccctcgacctggttcttgtcccgacctgtgagactagtgatgatgcagccaagtaggcccccatatcagcagccagggcct

SEQ ID NO: 398847 - DNA, 140 bp, Artificial Sequence
  Synthetic
aggccctggctgctgatatggggttccttgccgcgctgttctacacatcgcgcttcaacgcgtccggatgtccagagcgcatggccagctgccgctccatcaatgattttgaccagggctgaccttttgggacagcggtg

SEQ ID NO: 398848 - DNA, 140 bp, Artificial Sequence
  Synthetic
caccgctgtcccaaaaggtcagccctggtcaaaatcattgatggagcggcagctggccatgcgctctggacatccggacgcgttgaagcgcgatgtgtagaacagcgcggcaaggaaccccatatcagcagccagggcct

SEQ ID NO: 398849 - DNA, 140 bp, Artificial Sequence
  Synthetic
atacgccatgctgggtctccaacagggaacttacctggttgctccttttctattttcttgctggccctactgtcctgcatcaccattccggtctctgctgtccaagtgaagaacaccagtcgtacttgggagtcggccat

SEQ ID NO: 398850 - DNA, 140 bp, Artificial Sequence
  Synthetic
atggccgactcccaagtacgactggtgttcttcacttggacagcagagaccggaatggtgatgcaggacagtagggccagcaagaaaatagaaaaggagcaaccaggtaagttccctgttggagacccagcatggcgtat

SEQ ID NO: 398851 - DNA, 140 bp, Artificial Sequence
  Synthetic
aggccctggctgctgatatgcaccagggacggcaaactccccacaacgcagcttcgacgtcacatcgatctgctcgtcgggagcgccaccctctgctcggccctctatgtgggggacctggaccttttgggacagcggtg

SEQ ID NO: 398852 - DNA, 140 bp, Artificial Sequence
  Synthetic
caccgctgtcccaaaaggtccaggtcccccacatagagggccgagcagagggtggcgctcccgacgagcagatcgatgtgacgtcgaagctgcgttgtggggagtttgccgtccctggtgcatatcagcagccagggcct

SEQ ID NO: 398853 - DNA, 140 bp, Artificial Sequence
  Synthetic
atacgccatgctgggtctcccggcagttggtcaactcttcaggctgccccgagaggatggccagctgtaggccccttgctgatttcgcccagggctggggccccatcagctacaccaacgcgtacttgggagtcggccat

SEQ ID NO: 398854 - DNA, 140 bp, Artificial Sequence
  Synthetic
atggccgactcccaagtacgcgttggtgtagctgatggggccccagccctgggcgaaatcagcaaggggcctacagctggccatcctctcggggcagcctgaagagttgaccaactgccgggagacccagcatggcgtat

SEQ ID NO: 398855 - DNA, 140 bp, Artificial Sequence
  Synthetic
aggccctggctgctgatatgtagcatcactgatggcatttacagcctctatcaccagcccgctcaccacccaacacaccctcctgtttaacatcttggggggatgggtggccgcccaactgaccttttgggacagcggtg

SEQ ID NO: 398856 - DNA, 140 bp, Artificial Sequence
  Synthetic
caccgctgtcccaaaaggtcagttgggcggccacccatccccccaagatgttaaacaggagggtgtgttgggtggtgagcgggctggtgatagaggctgtaaatgccatcagtgatgctacatatcagcagccagggcct

SEQ ID NO: 398857 - DNA, 140 bp, Artificial Sequence
  Synthetic
atacgccatgctgggtctccgaaccggccccgaacaccgtccctattgctggcactaccctcccaagccctgcggcattgtgccagcactgaatgtatgtggcccagtatattgcttcaccgtacttgggagtcggccat

SEQ ID NO: 398858 - DNA, 140 bp, Artificial Sequence
  Synthetic
atggccgactcccaagtacggtgaagcaatatactgggccacatacattcagtgctggcacaatgccgcagggcttgggagggtagtgccagcaatagggacggtgttcggggccggttcggagacccagcatggcgtat

SEQ ID NO: 398859 - DNA, 140 bp, Artificial Sequence
  Synthetic
aggccctggctgctgatatggggcggaaacatcacccgtgtggagtcagaaaacaaggtagtaattttggactctttcgacccgcttcgagcggaggaggatcggagggaaatatccgttgaccttttgggacagcggtg

SEQ ID NO: 398860 - DNA, 140 bp, Artificial Sequence
  Synthetic
caccgctgtcccaaaaggtcaacggatatttccctccgatcctcctccgctcgaagcgggtcgaaagagtccaaaattactaccttgttttctgactccacacgggtgatgtttccgccccatatcagcagccagggcct

SEQ ID NO: 398861 - DNA, 140 bp, Artificial Sequence
  Synthetic
aggccctggctgctgatatgaggtgggtgcccggagcggcctacgccgtctacgggatgtggcctctcctcctgctcctgttggcgttgccccaacgggcatacgcgctggacacggagggaccttttgggacagcggtg

SEQ ID NO: 398862 - DNA, 140 bp, Artificial Sequence
  Synthetic
caccgctgtcccaaaaggtccctccgtgtccagcgcgtatgcccgttggggcaacgccaacaggagcaggaggagaggccacatcccgtagacggcgtaggccgctccgggcacccacctcatatcagcagccagggcct

SEQ ID NO: 398863 - DNA, 140 bp, Artificial Sequence
  Synthetic
atacgccatgctgggtctccgccgtgctccggttcctggctgagagatgtttgggactggatatgtacggtgctgactgacttcaagacctggctccaatccaaactcctgccgcggttacgtacttgggagtcggccat

SEQ ID NO: 398864 - DNA, 140 bp, Artificial Sequence
  Synthetic
atggccgactcccaagtacgtaaccgcggcaggagtttggattggagccaggtcttgaagtcagtcagcaccgtacatatccagtcccaaacatctctcagccaggaaccggagcacggcggagacccagcatggcgtat

SEQ ID NO: 398865 - DNA, 140 bp, Artificial Sequence
  Synthetic
atacgccatgctgggtctcccgacgcggacacccacgtcaccgggggaactgccggccgcgacgtggctggatttactagtctcttcagtagaggccccagccagaagatccagctgattcgtacttgggagtcggccat

SEQ ID NO: 398866 - DNA, 140 bp, Artificial Sequence
  Synthetic
atggccgactcccaagtacgaatcagctggatcttctggctggggcctctactgaagagactagtaaatccagccacgtcgcggccggcagttcccccggtgacgtgggtgtccgcgtcgggagacccagcatggcgtat

SEQ ID NO: 398867 - DNA, 140 bp, Artificial Sequence
  Synthetic
atacgccatgctgggtctccttggaccagaggccttactgttggcactacgcacctcgaccgtgcggtgtcgtacccgcggcgcaggtgtgtggtccagtgtactgcttcaccccaagcccgtacttgggagtcggccat

SEQ ID NO: 398868 - DNA, 140 bp, Artificial Sequence
  Synthetic
atggccgactcccaagtacgggcttggggtgaagcagtacactggaccacacacctgcgccgcgggtacgacaccgcacggtcgaggtgcgtagtgccaacagtaaggcctctggtccaaggagacccagcatggcgtat

SEQ ID NO: 398869 - DNA, 140 bp, Artificial Sequence
  Synthetic
atacgccatgctgggtctcctagtataatcaaagtgccgtacttcgtacgcgctcaggggctcattcgtgcatgcatgctggtgcggaaggtcgccggaggccattatgtccaaatggcccgtacttgggagtcggccat

SEQ ID NO: 398870 - DNA, 140 bp, Artificial Sequence
  Synthetic
atggccgactcccaagtacgggccatttggacataatggcctccggcgaccttccgcaccagcatgcatgcacgaatgagcccctgagcgcgtacgaagtacggcactttgattatactaggagacccagcatggcgtat

SEQ ID NO: 398871 - DNA, 140 bp, Artificial Sequence
  Synthetic
aggccctggctgctgatatgggaggcatctcattttctgccattccaagaagaaatgtgatgagctcgctgcaaagctgtcaagcctcggactcaatgctgtagcatattaccggggtctgaccttttgggacagcggtg

SEQ ID NO: 398872 - DNA, 140 bp, Artificial Sequence
  Synthetic
caccgctgtcccaaaaggtcagaccccggtaatatgctacagcattgagtccgaggcttgacagctttgcagcgagctcatcacatttcttcttggaatggcagaaaatgagatgcctcccatatcagcagccagggcct

SEQ ID NO: 398873 - DNA, 140 bp, Artificial Sequence
  Synthetic
aggccctggctgctgatatgtcctaaacctcaaagaaaaaccaaacgtaacaccaaccgccgcccacaggacgttaagttcccgggcggtggtcagatcgttggtggagtttacttgttggaccttttgggacagcggtg

SEQ ID NO: 398874 - DNA, 140 bp, Artificial Sequence
  Synthetic
caccgctgtcccaaaaggtccaacaagtaaactccaccaacgatctgaccaccgcccgggaacttaacgtcctgtgggcggcggttggtgttacgtttggtttttctttgaggtttaggacatatcagcagccagggcct

SEQ ID NO: 398875 - DNA, 140 bp, Artificial Sequence
  Synthetic
aggccctggctgctgatatgcttgcgtccttcctcgtgtttttctgctttgcatggtatctgaagggtaagtgggtgcccggagcggcctacgccttctatgggatgtggcccctcctccgaccttttgggacagcggtg

SEQ ID NO: 398876 - DNA, 140 bp, Artificial Sequence
  Synthetic
caccgctgtcccaaaaggtcggaggaggggccacatcccatagaaggcgtaggccgctccgggcacccacttacccttcagataccatgcaaagcagaaaaacacgaggaaggacgcaagcatatcagcagccagggcct

SEQ ID NO: 398877 - DNA, 140 bp, Artificial Sequence
  Synthetic
atacgccatgctgggtctccacgacagggggggtagccggccgcagcaccgccagcctgacgttcttctttacacgtgggccccaccagaacattcagcttataaacaccaacggcagctcgtacttgggagtcggccat

SEQ ID NO: 398878 - DNA, 140 bp, Artificial Sequence
  Synthetic
atggccgactcccaagtacgagctgccgttggtgtttataagctgaatgttctggtggggcccacgtgtaaagaagaacgtcaggctggcggtgctgcggccggctaccccccctgtcgtggagacccagcatggcgtat

SEQ ID NO: 398879 - DNA, 140 bp, Artificial Sequence
  Synthetic
atacgccatgctgggtctccgacaccatgctccacgacctggttaagagacatctgggactgggtttgcaccgtgctgtcagacttcaagacctggcttaaggccaagcttgtgccgtcccgtacttgggagtcggccat

SEQ ID NO: 398880 - DNA, 140 bp, Artificial Sequence
  Synthetic
atggccgactcccaagtacgggacggcacaagcttggccttaagccaggtcttgaagtctgacagcacggtgcaaacccagtcccagatgtctcttaaccaggtcgtggagcatggtgtcggagacccagcatggcgtat

SEQ ID NO: 398881 - DNA, 140 bp, Artificial Sequence
  Synthetic
aggccctggctgctgatatggcgcggttctcgtaggactggtactcttgaccttgtcgccgcactacaaagcattcctcgctaggctcatatggtggttacaatatcttatcaccagagcgaccttttgggacagcggtg

SEQ ID NO: 398882 - DNA, 140 bp, Artificial Sequence
  Synthetic
caccgctgtcccaaaaggtcgctctggtgataagatattgtaaccaccatatgagcctagcgaggaatgctttgtagtgcggcgacaaggtcaagagtaccagtcctacgagaaccgcgccatatcagcagccagggcct

SEQ ID NO: 398883 - DNA, 140 bp, Artificial Sequence
  Synthetic
aggccctggctgctgatatgtaaacaccaacggcagctggcacatcaacaggactgccctgaattgcaatgactccctccagactgggttccttgccgcgctgttctatgcacacaatctgaccttttgggacagcggtg

SEQ ID NO: 398884 - DNA, 140 bp, Artificial Sequence
  Synthetic
caccgctgtcccaaaaggtcagattgtgtgcatagaacagcgcggcaaggaacccagtctggagggagtcattgcaattcagggcagtcctgttgatgtgccagctgccgttggtgtttacatatcagcagccagggcct

SEQ ID NO: 398885 - DNA, 140 bp, Artificial Sequence
  Synthetic
atacgccatgctgggtctccgtaaacacttgaccaattgcaaattctgacttggtcctcgcctgttttttgaacattacccggcagtggcttgggccgcgctcccacctctgcacacacacgtacttgggagtcggccat

SEQ ID NO: 398886 - DNA, 140 bp, Artificial Sequence
  Synthetic
atggccgactcccaagtacgtgtgtgtgcagaggtgggagcgcggcccaagccactgccgggtaatgttcaaaaaacaggcgaggaccaagtcagaatttgcaattggtcaagtgtttacggagacccagcatggcgtat

SEQ ID NO: 398887 - DNA, 140 bp, Artificial Sequence
  Synthetic
aggccctggctgctgatatggaccagaggccttattgctggcactacgcacctaaaccgtgtggtattgtacccgcgtcgcaggtgtgtggtccagtgtattgcttcaccccgagccctggaccttttgggacagcggtg

SEQ ID NO: 398888 - DNA, 140 bp, Artificial Sequence
  Synthetic
caccgctgtcccaaaaggtccagggctcggggtgaagcaatacactggaccacacacctgcgacgcgggtacaataccacacggtttaggtgcgtagtgccagcaataaggcctctggtccatatcagcagccagggcct

SEQ ID NO: 398889 - DNA, 140 bp, Artificial Sequence
  Synthetic
aggccctggctgctgatatgagtccacggctgcccacttccacctccacagtctccccctgtgcctccaccccggaagaagcggacggtggtccttaccgactcaactgtgtccactgccgaccttttgggacagcggtg

SEQ ID NO: 398890 - DNA, 140 bp, Artificial Sequence
  Synthetic
caccgctgtcccaaaaggtcggcagtggacacagttgagtcggtaaggaccaccgtccgcttcttccggggtggaggcacagggggagactgtggaggtggaagtgggcagccgtggactcatatcagcagccagggcct

SEQ ID NO: 398891 - DNA, 140 bp, Artificial Sequence
  Synthetic
aggccctggctgctgatatgatgtatgtggggggcgtggagcacaggctcaacgccgcgtgcaattggactcgaggagagcgttgtgacttggaggacagggatagatcagagcttagccgaccttttgggacagcggtg

SEQ ID NO: 398892 - DNA, 140 bp, Artificial Sequence
  Synthetic
caccgctgtcccaaaaggtcggctaagctctgatctatccctgtcctccaagtcacaacgctctcctcgagtccaattgcacgcggcgttgagcctgtgctccacgccccccacatacatcatatcagcagccagggcct

SEQ ID NO: 398893 - DNA, 140 bp, Artificial Sequence
  Synthetic
aggccctggctgctgatatgaacgcactgagcaactcgttactgcgtcaccacaatctcgtgtattctaccacctcacgcagtgcttgcctaaggcagaagaaagtcacatttgacagacgaccttttgggacagcggtg

SEQ ID NO: 398894 - DNA, 140 bp, Artificial Sequence
  Synthetic
caccgctgtcccaaaaggtcgtctgtcaaatgtgactttcttctgccttaggcaagcactgcgtgaggtggtagaatacacgagattgtggtgacgcagtaacgagttgctcagtgcgttcatatcagcagccagggcct

SEQ ID NO: 398895 - DNA, 140 bp, Artificial Sequence
  Synthetic
aggccctggctgctgatatggcgggatacagtacttagcaggcttgtccactctgcctgggaaccccgcgatagcatcactgatggcattcacagcctctatcaccagcccgctcaccacgaccttttgggacagcggtg

SEQ ID NO: 398896 - DNA, 140 bp, Artificial Sequence
  Synthetic
caccgctgtcccaaaaggtcgtggtgagcgggctggtgatagaggctgtgaatgccatcagtgatgctatcgcggggttcccaggcagagtggacaagcctgctaagtactgtatcccgccatatcagcagccagggcct

SEQ ID NO: 398897 - DNA, 140 bp, Artificial Sequence
  Synthetic
aggccctggctgctgatatgccaaggggtggaggttgctggcgcccatcacggcgtacgcccaacagacaaggggcctcctgggatgcataattaccagcctgaccggccgggacaaaaagaccttttgggacagcggtg

SEQ ID NO: 398898 - DNA, 140 bp, Artificial Sequence
  Synthetic
caccgctgtcccaaaaggtctttttgtcccggccggtcaggctggtaattatgcatcccaggaggccccttgtctgttgggcgtacgccgtgatgggcgccagcaacctccaccccttggcatatcagcagccagggcct

SEQ ID NO: 398899 - DNA, 140 bp, Artificial Sequence
  Synthetic
aggccctggctgctgatatgggggtaaggaccatcaccacaggcgctcccatcacgtactccacctatggcaagttccttgccgacggtggttgctctgggggcgcctatgacatcataagaccttttgggacagcggtg

SEQ ID NO: 398900 - DNA, 140 bp, Artificial Sequence
  Synthetic
caccgctgtcccaaaaggtcttatgatgtcataggcgcccccagagcaaccaccgtcggcaaggaacttgccataggtggagtacgtgatgggagcgcctgtggtgatggtccttacccccatatcagcagccagggcct

SEQ ID NO: 398901 - DNA, 140 bp, Artificial Sequence
  Synthetic
aggccctggctgctgatatgctctcaacgttcgggggggccgcgatgccatcatcctcctcacgtgcgcgatccacccagagctaatcttcaccatcaccaaaatcttgctcgccatactgaccttttgggacagcggtg

SEQ ID NO: 398902 - DNA, 140 bp, Artificial Sequence
  Synthetic
caccgctgtcccaaaaggtcagtatggcgagcaagattttggtgatggtgaagattagctctgggtggatcgcgcacgtgaggaggatgatggcatcgcggcccccccgaacgttgagagcatatcagcagccagggcct

SEQ ID NO: 398903 - DNA, 140 bp, Artificial Sequence
  Synthetic
aggccctggctgctgatatgacggaagcggccccgaacaccgcccctactgctggcactaccccccaaagccttgtggcatcgtgccggcacagaccgtatgtggcccagtgtattgcttgaccttttgggacagcggtg

SEQ ID NO: 398904 - DNA, 140 bp, Artificial Sequence
  Synthetic
caccgctgtcccaaaaggtcaagcaatacactgggccacatacggtctgtgccggcacgatgccacaaggctttggggggtagtgccagcagtaggggcggtgttcggggccgcttccgtcatatcagcagccagggcct

SEQ ID NO: 398905 - DNA, 140 bp, Artificial Sequence
  Synthetic
aggccctggctgctgatatgctggtttgattcacctccatcagaacatcgtggacgtgcaatacctgtatggtgtagggtcagcagttgtctccattgtgatcaaatgggagtatgtcctgaccttttgggacagcggtg

SEQ ID NO: 398906 - DNA, 140 bp, Artificial Sequence
  Synthetic
caccgctgtcccaaaaggtcaggacatactcccatttgatcacaatggagacaactgctgaccctacaccatacaggtattgcacgtccacgatgttctgatggaggtgaatcaaaccagcatatcagcagccagggcct

SEQ ID NO: 398907 - DNA, 140 bp, Artificial Sequence
  Synthetic
aggccctggctgctgatatgaaggaggccgcaagccagctcgccttatcgtattcccagacttgggggttcgtgtgtgcgagaaaatggccctttacgacgtggtctccacccttcctcagaccttttgggacagcggtg

SEQ ID NO: 398908 - DNA, 140 bp, Artificial Sequence
  Synthetic
caccgctgtcccaaaaggtctgaggaagggtggagaccacgtcgtaaagggccattttctcgcacacacgaacccccaagtctgggaatacgataaggcgagctggcttgcggcctccttcatatcagcagccagggcct

SEQ ID NO: 398909 - DNA, 140 bp, Artificial Sequence
  Synthetic
aggccctggctgctgatatgtagcgtatttttccatggtggggaactgggcgaaggtcctggtggtgctgctgctattcgccggcgttgacgcggggaccgtcgtctccgggggagtcgcgaccttttgggacagcggtg

SEQ ID NO: 398910 - DNA, 140 bp, Artificial Sequence
  Synthetic
caccgctgtcccaaaaggtcgcgactcccccggagacgacggtccccgcgtcaacgccggcgaatagcagcagcaccaccaggaccttcgcccagttccccaccatggaaaaatacgctacatatcagcagccagggcct

SEQ ID NO: 398911 - DNA, 140 bp, Artificial Sequence
  Synthetic
atacgccatgctgggtctccgccttgaactgtaatgacagcctcaacaccggctggctggcaggcctcttctactaccacaaatttaactcttcaggctgtcctgagagaatggccagctcgtacttgggagtcggccat

SEQ ID NO: 398912 - DNA, 140 bp, Artificial Sequence
  Synthetic
atggccgactcccaagtacgagctggccattctctcaggacagcctgaagagttaaatttgtggtagtagaagaggcctgccagccagccggtgttgaggctgtcattacagttcaaggcggagacccagcatggcgtat

SEQ ID NO: 398913 - DNA, 140 bp, Artificial Sequence
  Synthetic
atacgccatgctgggtctccgatggagacggccccgaccaccgcccctactgctggcactaccctccaaaaccttgtggtattgtggacgcaagaaccgtctgtggtccggtatattgctcgtacttgggagtcggccat

SEQ ID NO: 398914 - DNA, 140 bp, Artificial Sequence
  Synthetic
atggccgactcccaagtacgagcaatataccggaccacagacggttcttgcgtccacaataccacaaggttttggagggtagtgccagcagtaggggcggtggtcggggccgtctccatcggagacccagcatggcgtat

SEQ ID NO: 398915 - DNA, 140 bp, Artificial Sequence
  Synthetic
aggccctggctgctgatatgctcatgtgtgctgtacacccgaccttggtattcgaaatcaccaagctgctgctggccgtcattgggcccctttggattcttcaagccagtttgcttaagggaccttttgggacagcggtg

SEQ ID NO: 398916 - DNA, 140 bp, Artificial Sequence
  Synthetic
caccgctgtcccaaaaggtcccttaagcaaactggcttgaagaatccaaaggggcccaatgacggccagcagcagcttggtgatttcgaataccaaggtcgggtgtacagcacacatgagcatatcagcagccagggcct

SEQ ID NO: 398917 - DNA, 140 bp, Artificial Sequence
  Synthetic
aggccctggctgctgatatggagtcctggcgggtcttgcctactattctatggtggggaactgggctaaggttttgattgtgatgctactttttgccggcgtcgacgggggtacctatgtgaccttttgggacagcggtg

SEQ ID NO: 398918 - DNA, 140 bp, Artificial Sequence
  Synthetic
caccgctgtcccaaaaggtcacataggtacccccgtcgacgccggcaaaaagtagcatcacaatcaaaaccttagcccagttccccaccatagaatagtaggcaagacccgccaggactccatatcagcagccagggcct

SEQ ID NO: 398919 - DNA, 140 bp, Artificial Sequence
  Synthetic
atacgccatgctgggtctcccacatcaacaggactgccttgaactgcaatgacaccctcaagactggattcattgccgcgctgttctacgtgcgcagtttcaactcgtccgggtgtccagcgtacttgggagtcggccat

SEQ ID NO: 398920 - DNA, 140 bp, Artificial Sequence
  Synthetic
atggccgactcccaagtacgctggacacccggacgagttgaaactgcgcacgtagaacagcgcggcaatgaatccagtcttgagggtgtcattgcagttcaaggcagtcctgttgatgtgggagacccagcatggcgtat

SEQ ID NO: 398921 - DNA, 140 bp, Artificial Sequence
  Synthetic
atacgccatgctgggtctcccccatcacctactccaagtctggcggctcggatcagaggccctattgctggcactacgctccttcaccgtgtggtatcgtacccgcggcgaatgtgtgtgcgtacttgggagtcggccat

SEQ ID NO: 398922 - DNA, 140 bp, Artificial Sequence
  Synthetic
atggccgactcccaagtacgcacacacattcgccgcgggtacgataccacacggtgaaggagcgtagtgccagcaatagggcctctgatccgagccgccagacttggagtaggtgatgggggagacccagcatggcgtat

SEQ ID NO: 398923 - DNA, 140 bp, Artificial Sequence
  Synthetic
atacgccatgctgggtctccctccttgcgccgcagaggaggagaagttgcccattagtccactgagcaactccctcattcgccaccataacctggtatactccacaacatcacggagtgccgtacttgggagtcggccat

SEQ ID NO: 398924 - DNA, 140 bp, Artificial Sequence
  Synthetic
atggccgactcccaagtacggcactccgtgatgttgtggagtataccaggttatggtggcgaatgagggagttgctcagtggactaatgggcaacttctcctcctctgcggcgcaaggagggagacccagcatggcgtat

SEQ ID NO: 398925 - DNA, 140 bp, Artificial Sequence
  Synthetic
atacgccatgctgggtctccgttcctcgccaaactcatatggtggttgcaatattttatcaccagaactgaggcgcatttgcaagtgtgggtccccccactcaacgttcgggggggccgccgtacttgggagtcggccat

SEQ ID NO: 398926 - DNA, 140 bp, Artificial Sequence
  Synthetic
atggccgactcccaagtacggcggcccccccgaacgttgagtggggggacccacacttgcaaatgcgcctcagttctggtgataaaatattgcaaccaccatatgagtttggcgaggaacggagacccagcatggcgtat

SEQ ID NO: 398927 - DNA, 140 bp, Artificial Sequence
  Synthetic
aggccctggctgctgatatgggagtcctggcgggccttgcctactattccatggcggggaactgggctaaggttttgatcgtgatgctactctttgccggcgttgacggaaacacccacggaccttttgggacagcggtg

SEQ ID NO: 398928 - DNA, 140 bp, Artificial Sequence
  Synthetic
caccgctgtcccaaaaggtccgtgggtgtttccgtcaacgccggcaaagagtagcatcacgatcaaaaccttagcccagttccccgccatggaatagtaggcaaggcccgccaggactcccatatcagcagccagggcct

SEQ ID NO: 398929 - DNA, 140 bp, Artificial Sequence
  Synthetic
aggccctggctgctgatatgcccacaacgcagcttcgacgtcacatcgatctgcttgtcgggagcgccaccctctgttcggccctctacgtgggggacctgtgcgggtctgtctttcttggaccttttgggacagcggtg

SEQ ID NO: 398930 - DNA, 140 bp, Artificial Sequence
  Synthetic
caccgctgtcccaaaaggtccaagaaagacagacccgcacaggtcccccacgtagagggccgaacagagggtggcgctcccgacaagcagatcgatgtgacgtcgaagctgcgttgtgggcatatcagcagccagggcct

SEQ ID NO: 398931 - DNA, 140 bp, Artificial Sequence
  Synthetic
atacgccatgctgggtctcctcaccgggggaaatgtcgcccgcactacagctggatttgctggtctcttctcaccaggcgcccagcagaaaatccagttggtcaacaccaacggcagttgcgtacttgggagtcggccat

SEQ ID NO: 398932 - DNA, 140 bp, Artificial Sequence
  Synthetic
atggccgactcccaagtacgcaactgccgttggtgttgaccaactggattttctgctgggcgcctggtgagaagagaccagcaaatccagctgtagtgcgggcgacatttcccccggtgaggagacccagcatggcgtat

SEQ ID NO: 398933 - DNA, 140 bp, Artificial Sequence
  Synthetic
aggccctggctgctgatatgggaagcaccccgaggccacttacacaaaatgtggttcgggtccttggttgacacctaggtgcttagttgactacccatacaggctctggcactacccctggaccttttgggacagcggtg

SEQ ID NO: 398934 - DNA, 140 bp, Artificial Sequence
  Synthetic
caccgctgtcccaaaaggtccaggggtagtgccagagcctgtatgggtagtcaactaagcacctaggtgtcaaccaaggacccgaaccacattttgtgtaagtggcctcggggtgcttcccatatcagcagccagggcct

SEQ ID NO: 398935 - DNA, 140 bp, Artificial Sequence
  Synthetic
aggccctggctgctgatatgacacctaggtgcttagttgactacccatacaggctctggcactacccctgcactgtcaactttaccatcttcaaggttaggatgtatgtggggggcgtgggaccttttgggacagcggtg

SEQ ID NO: 398936 - DNA, 140 bp, Artificial Sequence
  Synthetic
caccgctgtcccaaaaggtcccacgccccccacatacatcctaaccttgaagatggtaaagttgacagtgcaggggtagtgccagagcctgtatgggtagtcaactaagcacctaggtgtcatatcagcagccagggcct

SEQ ID NO: 398937 - DNA, 140 bp, Artificial Sequence
  Synthetic
aggccctggctgctgatatgttggaggacagggatagatcagagctcagcccgctgctgctgtctacgacagagtggcagatactgccctgttccttcaccaccctaccggccttgtccagaccttttgggacagcggtg

SEQ ID NO: 398938 - DNA, 140 bp, Artificial Sequence
  Synthetic
caccgctgtcccaaaaggtctggacaaggccggtagggtggtgaaggaacagggcagtatctgccactctgtcgtagacagcagcagcgggctgagctctgatctatccctgtcctccaacatatcagcagccagggcct

SEQ ID NO: 398939 - DNA, 140 bp, Artificial Sequence
  Synthetic
atacgccatgctgggtctcccgcggtttttgtaggcctggcacttttgaccttgtcaccatactataaggtgttactcgccaggctcatatggtggctacaatatttcattgcaagagcccgtacttgggagtcggccat

SEQ ID NO: 398940 - DNA, 140 bp, Artificial Sequence
  Synthetic
atggccgactcccaagtacgggctcttgcaatgaaatattgtagccaccatatgagcctggcgagtaacaccttatagtatggtgacaaggtcaaaagtgccaggcctacaaaaaccgcgggagacccagcatggcgtat

SEQ ID NO: 398941 - DNA, 140 bp, Artificial Sequence
  Synthetic
aggccctggctgctgatatgcaaactccccacaacgcagcttcgacgtcacatcgatctgcttgtcgggagcgccaccctctgctcggccctctatgtgggggacttgtgcgggtctgtcgaccttttgggacagcggtg

SEQ ID NO: 398942 - DNA, 140 bp, Artificial Sequence
  Synthetic
caccgctgtcccaaaaggtcgacagacccgcacaagtcccccacatagagggccgagcagagggtggcgctcccgacaagcagatcgatgtgacgtcgaagctgcgttgtggggagtttgcatatcagcagccagggcct

SEQ ID NO: 398943 - DNA, 140 bp, Artificial Sequence
  Synthetic
atacgccatgctgggtctccgcgccccccagcgccgcttcagccttcgtgggtgccggcattgccggcgcagctgttggcagcataggtcttgggaaggtgcttgtggacattctggcggcgtacttgggagtcggccat

SEQ ID NO: 398944 - DNA, 140 bp, Artificial Sequence
  Synthetic
atggccgactcccaagtacgccgccagaatgtccacaagcaccttcccaagacctatgctgccaacagctgcgccggcaatgccggcacccacgaaggctgaagcggcgctggggggcgcggagacccagcatggcgtat

SEQ ID NO: 398945 - DNA, 140 bp, Artificial Sequence
  Synthetic
aggccctggctgctgatatgtcggtcaccgtgccacaccccaatatcgaggaggtggccctgtccaacactggggagatccccttctatggcaaagccatccccattgaggccatcaagggaccttttgggacagcggtg

SEQ ID NO: 398946 - DNA, 140 bp, Artificial Sequence
  Synthetic
caccgctgtcccaaaaggtcccttgatggcctcaatggggatggctttgccatagaaggggatctccccagtgttggacagggccacctcctcgatattggggtgtggcacggtgaccgacatatcagcagccagggcct

SEQ ID NO: 398947 - DNA, 140 bp, Artificial Sequence
  Synthetic
aggccctggctgctgatatggggcgaaggtcctgctagtactgttgctgtttgccggcgtcgatgcggcgacctacaccagcgggggaagtgccgctaggaccacgtctgggatcaccaggaccttttgggacagcggtg

SEQ ID NO: 398948 - DNA, 140 bp, Artificial Sequence
  Synthetic
caccgctgtcccaaaaggtcctggtgatcccagacgtggtcctagcggcacttcccccgctggtgtaggtcgccgcatcgacgccggcaaacagcaacagtactagcaggaccttcgccccatatcagcagccagggcct

SEQ ID NO: 398949 - DNA, 140 bp, Artificial Sequence
  Synthetic
aggccctggctgctgatatggggcgggaacatcacccgcgtggagtcagagaataaggtagtgattctggactctttcgacccgcttcgagcggaggaggatgagagggaaatatccgttgaccttttgggacagcggtg

SEQ ID NO: 398950 - DNA, 140 bp, Artificial Sequence
  Synthetic
caccgctgtcccaaaaggtcaacggatatttccctctcatcctcctccgctcgaagcgggtcgaaagagtccagaatcactaccttattctctgactccacgcgggtgatgttcccgccccatatcagcagccagggcct

SEQ ID NO: 398951 - DNA, 140 bp, Artificial Sequence
  Synthetic
aggccctggctgctgatatgacgtcatcctcttgtttctcctgcttgcagacgcgcgcatctgcgcctgtttgtggatgatgctactcatatcccaagcagaggcagctttggaaaacctgaccttttgggacagcggtg

SEQ ID NO: 398952 - DNA, 140 bp, Artificial Sequence
  Synthetic
caccgctgtcccaaaaggtcaggttttccaaagctgcctctgcttgggatatgagtagcatcatccacaaacaggcgcagatgcgcgcgtctgcaagcaggagaaacaagaggatgacgtcatatcagcagccagggcct

SEQ ID NO: 398953 - DNA, 140 bp, Artificial Sequence
  Synthetic
aggccctggctgctgatatgtgttgactgacttcaagacctggctccagtccaagctcctgccgcggttgccgggagtccccttcttctcatgccaacgtgggtacaagggagtctggcggaccttttgggacagcggtg

SEQ ID NO: 398954 - DNA, 140 bp, Artificial Sequence
  Synthetic
caccgctgtcccaaaaggtccgccagactcccttgtacccacgttggcatgagaagaaggggactcccggcaaccgcggcaggagcttggactggagccaggtcttgaagtcagtcaacacatatcagcagccagggcct

SEQ ID NO: 398955 - DNA, 140 bp, Artificial Sequence
  Synthetic
aggccctggctgctgatatgatgctgctggtagctcaagctgaggccgccttagagaacctggtggtcctcaatgcggcgtccgtggccggagcgcatggcattctctccttccttgtgtgaccttttgggacagcggtg

SEQ ID NO: 398956 - DNA, 140 bp, Artificial Sequence
  Synthetic
caccgctgtcccaaaaggtcacacaaggaaggagagaatgccatgcgctccggccacggacgccgcattgaggaccaccaggttctctaaggcggcctcagcttgagctaccagcagcatcatatcagcagccagggcct

SEQ ID NO: 398957 - DNA, 140 bp, Artificial Sequence
  Synthetic
aggccctggctgctgatatgtatcagctggtgcttgtggtggcttcagtattttctgaccagagtagaagcgcaactgcacgtgtgggttccccccctcaatgtccgaggggggcgtgacgaccttttgggacagcggtg

SEQ ID NO: 398958 - DNA, 140 bp, Artificial Sequence
  Synthetic
caccgctgtcccaaaaggtcgtcacgcccccctcggacattgagggggggaacccacacgtgcagttgcgcttctactctggtcagaaaatactgaagccaccacaagcaccagctgatacatatcagcagccagggcct

SEQ ID NO: 398959 - DNA, 140 bp, Artificial Sequence
  Synthetic
aggccctggctgctgatatgcgaacgactgctccaactcaagcatagtgtatgaggcagcggacatgatcatgcacacccctgggtgcgtgccctgcgttcgggaggccaacatctcccggaccttttgggacagcggtg

SEQ ID NO: 398960 - DNA, 140 bp, Artificial Sequence
  Synthetic
caccgctgtcccaaaaggtccgggagatgttggcctcccgaacgcagggcacgcacccaggggtgtgcatgatcatgtccgctgcctcatacactatgcttgagttggagcagtcgttcgcatatcagcagccagggcct

SEQ ID NO: 398961 - DNA, 140 bp, Artificial Sequence
  Synthetic
atacgccatgctgggtctccagaaggggggtcttaagccaacttgtctcttcttgtcccccgacctgggtgtgcgcgtgtgcgagaagatggccctggacgacgtggttccaaagctccccgtacttgggagtcggccat

SEQ ID NO: 398962 - DNA, 140 bp, Artificial Sequence
  Synthetic
atggccgactcccaagtacggggagctttggaaccacgtcgtccagggccatcttctcgcacacgcgcacacccaggtcgggggacaagaagagacaagttggcttaagaccccccttctggagacccagcatggcgtat

SEQ ID NO: 398963 - DNA, 140 bp, Artificial Sequence
  Synthetic
atacgccatgctgggtctcccacattaacaggactgctctgaactgcaatgactccctcaacactgggttcattgccgcgctgatttacaaccacaggttcaacgcgaccggatgcccagcgtacttgggagtcggccat

SEQ ID NO: 398964 - DNA, 140 bp, Artificial Sequence
  Synthetic
atggccgactcccaagtacgctgggcatccggtcgcgttgaacctgtggttgtaaatcagcgcggcaatgaacccagtgttgagggagtcattgcagttcagagcagtcctgttaatgtgggagacccagcatggcgtat

SEQ ID NO: 398965 - DNA, 140 bp, Artificial Sequence
  Synthetic
aggccctggctgctgatatggcactacgcgcctcaaccatgcggtattgtacccgcgtcacaggtgtgtggtccagtgtattgtttcaccccaagcccagttgtggtggggacgaccgatgaccttttgggacagcggtg

SEQ ID NO: 398966 - DNA, 140 bp, Artificial Sequence
  Synthetic
caccgctgtcccaaaaggtcatcggtcgtccccaccacaactgggcttggggtgaaacaatacactggaccacacacctgtgacgcgggtacaataccgcatggttgaggcgcgtagtgccatatcagcagccagggcct

SEQ ID NO: 398967 - DNA, 140 bp, Artificial Sequence
  Synthetic
atacgccatgctgggtctccaaagcaccccgaggccacttacgccagatgcggctcgggaccttggttgacacccaggtgcattgttaactatccatacaggctttggcactacccctgccgtacttgggagtcggccat

SEQ ID NO: 398968 - DNA, 140 bp, Artificial Sequence
  Synthetic
atggccgactcccaagtacggcaggggtagtgccaaagcctgtatggatagttaacaatgcacctgggtgtcaaccaaggtcccgagccgcatctggcgtaagtggcctcggggtgctttggagacccagcatggcgtat

SEQ ID NO: 398969 - DNA, 140 bp, Artificial Sequence
  Synthetic
aggccctggctgctgatatgggacctgtctgggtggtttgtcgtgggcggacgcgggggggacatatttcacagcgtgtcccgggcccgaccccgcactttactcctgtgcctactcctagaccttttgggacagcggtg

SEQ ID NO: 398970 - DNA, 140 bp, Artificial Sequence
  Synthetic
caccgctgtcccaaaaggtctaggagtaggcacaggagtaaagtgcggggtcgggcccgggacacgctgtgaaatatgtcccccccgcgtccgcccacgacaaaccacccagacaggtcccatatcagcagccagggcct

SEQ ID NO: 398971 - DNA, 140 bp, Artificial Sequence
  Synthetic
aggccctggctgctgatatgaggcgcacttgcaagtgtgggtcccccctctcaacgtccgggggggccgcgatgccatcatcctcctcacgtgcgcgatccacccagagctaatctttgagaccttttgggacagcggtg

SEQ ID NO: 398972 - DNA, 140 bp, Artificial Sequence
  Synthetic
caccgctgtcccaaaaggtctcaaagattagctctgggtggatcgcgcacgtgaggaggatgatggcatcgcggcccccccggacgttgagaggggggacccacacttgcaagtgcgcctcatatcagcagccagggcct

SEQ ID NO: 398973 - DNA, 140 bp, Artificial Sequence
  Synthetic
aggccctggctgctgatatgcatcaccaaactcttgctcgccatactcggtccgctcatggtgctccaggctggcataactagagtgccgtactttgtgcgcgctcaagggctcattcgtgaccttttgggacagcggtg

SEQ ID NO: 398974 - DNA, 140 bp, Artificial Sequence
  Synthetic
caccgctgtcccaaaaggtcacgaatgagcccttgagcgcgcacaaagtacggcactctagttatgccagcctggagcaccatgagcggaccgagtatggcgagcaagagtttggtgatgcatatcagcagccagggcct

SEQ ID NO: 398975 - DNA, 140 bp, Artificial Sequence
  Synthetic
aggccctggctgctgatatgctccactgcgggactgggcccacgagggcctacgagaccttgcggtggcagttgagcccgtcatcttttctgacatggagaccaaggtcatcacctgggggaccttttgggacagcggtg

SEQ ID NO: 398976 - DNA, 140 bp, Artificial Sequence
  Synthetic
caccgctgtcccaaaaggtcccccaggtgatgaccttggtctccatgtcagaaaagatgacgggctcaactgccaccgcaaggtctcgtaggccctcgtgggcccagtcccgcagtggagcatatcagcagccagggcct

SEQ ID NO: 398977 - DNA, 140 bp, Artificial Sequence
  Synthetic
aggccctggctgctgatatgggtggcgggagcccactggggagtcctggcgggccttgcctactattccatggtggggaactgggctaaggtcttgattgtgatgctactctttgccggcgaccttttgggacagcggtg

SEQ ID NO: 398978 - DNA, 140 bp, Artificial Sequence
  Synthetic
caccgctgtcccaaaaggtcgccggcaaagagtagcatcacaatcaagaccttagcccagttccccaccatggaatagtaggcaaggcccgccaggactccccagtgggctcccgccacccatatcagcagccagggcct

SEQ ID NO: 398979 - DNA, 140 bp, Artificial Sequence
  Synthetic
atacgccatgctgggtctcctaaacaccaatggcagctggcacatcaacaggactgccctgaattgcaatgactccctcaacaccgggttccttgccgcgctgttctacgcacacaggttcgtacttgggagtcggccat

SEQ ID NO: 398980 - DNA, 140 bp, Artificial Sequence
  Synthetic
atggccgactcccaagtacgaacctgtgtgcgtagaacagcgcggcaaggaacccggtgttgagggagtcattgcaattcagggcagtcctgttgatgtgccagctgccattggtgtttaggagacccagcatggcgtat

SEQ ID NO: 398981 - DNA, 140 bp, Artificial Sequence
  Synthetic
atacgccatgctgggtctccccgcaaagctgtcaggtctcggtcttaacgctgtagcgtactaccggggtctagacgtgtccgtcataccatctagcggggacgtcgttgtcgtggcaaccgtacttgggagtcggccat

SEQ ID NO: 398982 - DNA, 140 bp, Artificial Sequence
  Synthetic
atggccgactcccaagtacggttgccacgacaacgacgtccccgctagatggtatgacggacacgtctagaccccggtagtacgctacagcgttaagaccgagacctgacagctttgcggggagacccagcatggcgtat

SEQ ID NO: 398983 - DNA, 140 bp, Artificial Sequence
  Synthetic
aggccctggctgctgatatggacatcaccaaactgctgctggccgtcttcggacccctctggattcttcaagccagtttgcttaaagtgccctactttgtgcgcgtccaaggccttctccgaccttttgggacagcggtg

SEQ ID NO: 398984 - DNA, 140 bp, Artificial Sequence
  Synthetic
caccgctgtcccaaaaggtcggagaaggccttggacgcgcacaaagtagggcactttaagcaaactggcttgaagaatccagaggggtccgaagacggccagcagcagtttggtgatgtccatatcagcagccagggcct

SEQ ID NO: 398985 - DNA, 140 bp, Artificial Sequence
  Synthetic
atacgccatgctgggtctcctggcaacgtgcatcaatggggtatgctggactgtctaccacggggccggaacgaggaccatcgcatcacccaagggtcctgttatccagatgtataccaacgtacttgggagtcggccat

SEQ ID NO: 398986 - DNA, 140 bp, Artificial Sequence
  Synthetic
atggccgactcccaagtacgttggtatacatctggataacaggacccttgggtgatgcgatggtcctcgttccggccccgtggtagacagtccagcataccccattgatgcacgttgccaggagacccagcatggcgtat

SEQ ID NO: 398987 - DNA, 140 bp, Artificial Sequence
  Synthetic
aggccctggctgctgatatgttcgccggcgtcgatgcgtcgacctacaccaccggggggagcgtcgccaagtccacgcttgcactcaccggtcttttttctccgggcgccaagcagaatagaccttttgggacagcggtg

SEQ ID NO: 398988 - DNA, 140 bp, Artificial Sequence
  Synthetic
caccgctgtcccaaaaggtctattctgcttggcgcccggagaaaaaagaccggtgagtgcaagcgtggacttggcgacgctccccccggtggtgtaggtcgacgcatcgacgccggcgaacatatcagcagccagggcct

SEQ ID NO: 398989 - DNA, 140 bp, Artificial Sequence
  Synthetic
aggccctggctgctgatatgagcccgccccttctggctgctccccagactccgacgctgagtcctattcttccatgccccccctggagggggagcctggggatccggatctcagcgacgggaccttttgggacagcggtg

SEQ ID NO: 398990 - DNA, 140 bp, Artificial Sequence
  Synthetic
caccgctgtcccaaaaggtcccgtcgctgagatccggatccccaggctccccctccagggggggcatggaagaataggactcagcgtcggagtctggggagcagccagaaggggcgggctcatatcagcagccagggcct

SEQ ID NO: 398991 - DNA, 140 bp, Artificial Sequence
  Synthetic
aggccctggctgctgatatgcaggaacgccagcatccccactacgacaatacgacgtcacgtcgatttgctcgttggggcggctgctttctgctccgctatgtacgtgggggatctctgcgaccttttgggacagcggtg

SEQ ID NO: 398992 - DNA, 140 bp, Artificial Sequence
  Synthetic
caccgctgtcccaaaaggtcgcagagatcccccacgtacatagcggagcagaaagcagccgccccaacgagcaaatcgacgtgacgtcgtattgtcgtagtggggatgctggcgttcctgcatatcagcagccagggcct

SEQ ID NO: 398993 - DNA, 140 bp, Artificial Sequence
  Synthetic
aggccctggctgctgatatgtggggaactgggccaaggtgttgattgtgatgctactctttgctggcgttgacgggtcgacctatgtatcagggggatcggcggctcgctccaccctcaggaccttttgggacagcggtg

SEQ ID NO: 398994 - DNA, 140 bp, Artificial Sequence
  Synthetic
caccgctgtcccaaaaggtcctgagggtggagcgagccgccgatccccctgatacataggtcgacccgtcaacgccagcaaagagtagcatcacaatcaacaccttggcccagttccccacatatcagcagccagggcct

SEQ ID NO: 398995 - DNA, 140 bp, Artificial Sequence
  Synthetic
atacgccatgctgggtctcctccctccagactgggttcatcgctgcgttgttctacgcacgcagtttcaactcgtccggatgcccagaacgcatggccagctgtctccccatcagtgagtcgtacttgggagtcggccat

SEQ ID NO: 398996 - DNA, 140 bp, Artificial Sequence
  Synthetic
atggccgactcccaagtacgactcactgatggggagacagctggccatgcgttctgggcatccggacgagttgaaactgcgtgcgtagaacaacgcagcgatgaacccagtctggagggaggagacccagcatggcgtat

SEQ ID NO: 398997 - DNA, 140 bp, Artificial Sequence
  Synthetic
atacgccatgctgggtctcctaaacaccaacggcagctggcacatcaacagaaccgctctgaattgcaacgactccctccacactgggttcattgccgcgttgttctacgcacataagttcgtacttgggagtcggccat

SEQ ID NO: 398998 - DNA, 140 bp, Artificial Sequence
  Synthetic
atggccgactcccaagtacgaacttatgtgcgtagaacaacgcggcaatgaacccagtgtggagggagtcgttgcaattcagagcggttctgttgatgtgccagctgccgttggtgtttaggagacccagcatggcgtat

SEQ ID NO: 398999 - DNA, 140 bp, Artificial Sequence
  Synthetic
aggccctggctgctgatatggaccagaggccttattgctggcactacgcacctcgaccgtgcggtatcgtacccgcgtcgcaggtgtgcggtccagtgtattgcttcaccccaagccctggaccttttgggacagcggtg

SEQ ID NO: 399000 - DNA, 140 bp, Artificial Sequence
  Synthetic
caccgctgtcccaaaaggtccagggcttggggtgaagcaatacactggaccgcacacctgcgacgcgggtacgataccgcacggtcgaggtgcgtagtgccagcaataaggcctctggtccatatcagcagccagggcct

SEQ ID NO: 399001 - DNA, 140 bp, Artificial Sequence
  Synthetic
atacgccatgctgggtctcccgcaacgcctccgggatccgtcactgtgccacatcccaacatcgaggaggtggccttgtccaacactggagagatccccttctacggtaaggccatcccccgtacttgggagtcggccat

SEQ ID NO: 399002 - DNA, 140 bp, Artificial Sequence
  Synthetic
atggccgactcccaagtacgggggatggccttaccgtagaaggggatctctccagtgttggacaaggccacctcctcgatgttgggatgtggcacagtgacggatcccggaggcgttgcgggagacccagcatggcgtat

SEQ ID NO: 399003 - DNA, 140 bp, Artificial Sequence
  Synthetic
aggccctggctgctgatatggactttggcactacccctgcactgtcaactttaccatctttaaggtcaggatgtatgtggggggcgtggagcacaggctcaacgccgcgtgcaactggacgaccttttgggacagcggtg

SEQ ID NO: 399004 - DNA, 140 bp, Artificial Sequence
  Synthetic
caccgctgtcccaaaaggtcgtccagttgcacgcggcgttgagcctgtgctccacgccccccacatacatcctgaccttaaagatggtaaagttgacagtgcaggggtagtgccaaagtccatatcagcagccagggcct

SEQ ID NO: 399005 - DNA, 140 bp, Artificial Sequence
  Synthetic
aggccctggctgctgatatgtagcgtattaccggggtctggacgtgtccgttataccatctagcggggacgtcgtcgtcgtggcaaccgacgccctaatgacaggctttaccggcgacttgaccttttgggacagcggtg

SEQ ID NO: 399006 - DNA, 140 bp, Artificial Sequence
  Synthetic
caccgctgtcccaaaaggtcaagtcgccggtaaagcctgtcattagggcgtcggttgccacgacgacgacgtccccgctagatggtataacggacacgtccagaccccggtaatacgctacatatcagcagccagggcct

SEQ ID NO: 399007 - DNA, 140 bp, Artificial Sequence
  Synthetic
aggccctggctgctgatatggcccctccaataccacctccacggagaaagaggacggttgtcctgacagaatccaccgtgtcttctgccttggcggagctcgccacaaagaccttcggcagaccttttgggacagcggtg

SEQ ID NO: 399008 - DNA, 140 bp, Artificial Sequence
  Synthetic
caccgctgtcccaaaaggtctgccgaaggtctttgtggcgagctccgccaaggcagaagacacggtggattctgtcaggacaaccgtcctctttctccgtggaggtggtattggaggggccatatcagcagccagggcct

SEQ ID NO: 399009 - DNA, 140 bp, Artificial Sequence
  Synthetic
atacgccatgctgggtctccggctccacctccgtcatgggatcaaatgtggaagtgtctcctgcggctcaaacctacactgcacgggccaacgcccctgctgtataggctgggagccgtccgtacttgggagtcggccat

SEQ ID NO: 399010 - DNA, 140 bp, Artificial Sequence
  Synthetic
atggccgactcccaagtacggacggctcccagcctatacagcaggggcgttggcccgtgcagtgtaggtttgagccgcaggagacacttccacatttgatcccatgacggaggtggagccggagacccagcatggcgtat

SEQ ID NO: 399011 - DNA, 140 bp, Artificial Sequence
  Synthetic
aggccctggctgctgatatgtccgctcatggtgctccaggctggcctaactagagtgccgtacttcgtgcgcgctcaagggctcatccgtgcatgcatgttggtgcggaaagtcgctggggaccttttgggacagcggtg

SEQ ID NO: 399012 - DNA, 140 bp, Artificial Sequence
  Synthetic
caccgctgtcccaaaaggtccccagcgactttccgcaccaacatgcatgcacggatgagcccttgagcgcgcacgaagtacggcactctagttaggccagcctggagcaccatgagcggacatatcagcagccagggcct

SEQ ID NO: 399013 - DNA, 140 bp, Artificial Sequence
  Synthetic
aggccctggctgctgatatggcgctcaagggctcatccgtgcatgcatgttggtgcggaaagtcgctgggggtcattatgtccaaatggctctcatgaagctggccgcactgacgggtacgaccttttgggacagcggtg

SEQ ID NO: 399014 - DNA, 140 bp, Artificial Sequence
  Synthetic
caccgctgtcccaaaaggtcgtacccgtcagtgcggccagcttcatgagagccatttggacataatgacccccagcgactttccgcaccaacatgcatgcacggatgagcccttgagcgccatatcagcagccagggcct

SEQ ID NO: 399015 - DNA, 140 bp, Artificial Sequence
  Synthetic
aggccctggctgctgatatgtgtggaatttcatcagcgggatacagtacttagcaggcttgtccaccctgcctgggaaccccgcaatagcttcactgatggcattcacagcctccatcacgaccttttgggacagcggtg

SEQ ID NO: 399016 - DNA, 140 bp, Artificial Sequence
  Synthetic
caccgctgtcccaaaaggtcgtgatggaggctgtgaatgccatcagtgaagctattgcggggttcccaggcagggtggacaagcctgctaagtactgtatcccgctgatgaaattccacacatatcagcagccagggcct

SEQ ID NO: 399017 - DNA, 140 bp, Artificial Sequence
  Synthetic
aggccctggctgctgatatgcacaggtcgggacaagaaccaggtcgagggggaggttcaggtggtttccaccgcaacgcaatctttcttggcgacctgcgtcaacggcgtgtgctggactgaccttttgggacagcggtg

SEQ ID NO: 399018 - DNA, 140 bp, Artificial Sequence
  Synthetic
caccgctgtcccaaaaggtcagtccagcacacgccgttgacgcaggtcgccaagaaagattgcgttgcggtggaaaccacctgaacctccccctcgacctggttcttgtcccgacctgtgcatatcagcagccagggcct

SEQ ID NO: 399019 - DNA, 140 bp, Artificial Sequence
  Synthetic
atacgccatgctgggtctcctgcacatggatgaatagtactgggtttactaagacctgcggcgcaccaccttgccgcataaggccagacttcaattcctccgaggatctgctgtgccccacgtacttgggagtcggccat

SEQ ID NO: 399020 - DNA, 140 bp, Artificial Sequence
  Synthetic
atggccgactcccaagtacgtggggcacagcagatcctcggaggaattgaagtctggccttatgcggcaaggtggtgcgccgcaggtcttagtaaacccagtactattcatccatgtgcaggagacccagcatggcgtat

SEQ ID NO: 399021 - DNA, 140 bp, Artificial Sequence
  Synthetic
aggccctggctgctgatatgactggacgcggggcgagcgttgtgatctggacgacagggacaggtccgagctcagcccgctgctgctgtccaccacacagtggcaggtccttccgtgttcgaccttttgggacagcggtg

SEQ ID NO: 399022 - DNA, 140 bp, Artificial Sequence
  Synthetic
caccgctgtcccaaaaggtcgaacacggaaggacctgccactgtgtggtggacagcagcagcgggctgagctcggacctgtccctgtcgtccagatcacaacgctcgccccgcgtccagtcatatcagcagccagggcct

SEQ ID NO: 399023 - DNA, 140 bp, Artificial Sequence
  Synthetic
atacgccatgctgggtctcccagggaagttctctaccaggagttcgatgaaatggaagagtgcgcctcacacctcccttacatcgaacagggaatgcagctcgccgagcaattcaagcagcgtacttgggagtcggccat

SEQ ID NO: 399024 - DNA, 140 bp, Artificial Sequence
  Synthetic
atggccgactcccaagtacgctgcttgaattgctcggcgagctgcattccctgttcgatgtaagggaggtgtgaggcgcactcttccatttcatcgaactcctggtagagaacttccctgggagacccagcatggcgtat

SEQ ID NO: 399025 - DNA, 140 bp, Artificial Sequence
  Synthetic
aggccctggctgctgatatggatgggtggccgcccaactcgctccccccagcgctgcttcagctttcgtgggcgccggcatcgccggcgcggctgttggcagcataggccttgggaaggtgaccttttgggacagcggtg

SEQ ID NO: 399026 - DNA, 140 bp, Artificial Sequence
  Synthetic
caccgctgtcccaaaaggtcaccttcccaaggcctatgctgccaacagccgcgccggcgatgccggcgcccacgaaagctgaagcagcgctggggggagcgagttgggcggccacccatccatatcagcagccagggcct

SEQ ID NO: 399027 - DNA, 140 bp, Artificial Sequence
  Synthetic
atacgccatgctgggtctccggaggatgtcgtgtgctgctcaatgtcttattcctggacaggcgcacttgtcaccccgtgtgccgcggaagaacaaaaattgcctatcaacgcactgagccgtacttgggagtcggccat

SEQ ID NO: 399028 - DNA, 140 bp, Artificial Sequence
  Synthetic
atggccgactcccaagtacggctcagtgcgttgataggcaatttttgttcttccgcggcacacggggtgacaagtgcgcctgtccaggaataagacattgagcagcacacgacatcctccggagacccagcatggcgtat

SEQ ID NO: 399029 - DNA, 140 bp, Artificial Sequence
  Synthetic
atacgccatgctgggtctccatgagagggaagtatccgttgcggcggagatcctgcggaaatccaggaagttccccccggcgctgcccgtatgggcacgcccggattacaaccctccactcgtacttgggagtcggccat

SEQ ID NO: 399030 - DNA, 140 bp, Artificial Sequence
  Synthetic
atggccgactcccaagtacgagtggagggttgtaatccgggcgtgcccatacgggcagcgccggggggaacttcctggatttccgcaggatctccgccgcaacggatacttccctctcatggagacccagcatggcgtat

SEQ ID NO: 399031 - DNA, 140 bp, Artificial Sequence
  Synthetic
aggccctggctgctgatatggcccattgccacctactaaggcccctccaataccacctccacggaggaagaggacggttgtcctgacagaatccaccgtgtcttctgccttggcggagctgaccttttgggacagcggtg

SEQ ID NO: 399032 - DNA, 140 bp, Artificial Sequence
  Synthetic
caccgctgtcccaaaaggtcagctccgccaaggcagaagacacggtggattctgtcaggacaaccgtcctcttcctccgtggaggtggtattggaggggccttagtaggtggcaatgggccatatcagcagccagggcct

SEQ ID NO: 399033 - DNA, 140 bp, Artificial Sequence
  Synthetic
aggccctggctgctgatatgaggacggttgtcctgacagaatccaccgtgtcttctgccttggcggagcttgctacaaagacctttggcagctccggatcgtcggccgtcgacagcggcagaccttttgggacagcggtg

SEQ ID NO: 399034 - DNA, 140 bp, Artificial Sequence
  Synthetic
caccgctgtcccaaaaggtctgccgctgtcgacggccgacgatccggagctgccaaaggtctttgtagcaagctccgccaaggcagaagacacggtggattctgtcaggacaaccgtcctcatatcagcagccagggcct

SEQ ID NO: 399035 - DNA, 140 bp, Artificial Sequence
  Synthetic
aggccctggctgctgatatgtgccaccaaaagttttggcagctcctcaacttccggcattacgggcgacaatacgacaacatcctctgagcccgccccttctggctgcccccccgactccgaccttttgggacagcggtg

SEQ ID NO: 399036 - DNA, 140 bp, Artificial Sequence
  Synthetic
caccgctgtcccaaaaggtcggagtcgggggggcagccagaaggggcgggctcagaggatgttgtcgtattgtcgcccgtaatgccggaagttgaggagctgccaaaacttttggtggcacatatcagcagccagggcct

SEQ ID NO: 399037 - DNA, 140 bp, Artificial Sequence
  Synthetic
atacgccatgctgggtctccgcaagggccgtctcagaaaatccagcttgtaaacaccaacggcagctggcacatcaacaggactgccttgaactgtaacgactctctcaacactgggttccgtacttgggagtcggccat

SEQ ID NO: 399038 - DNA, 140 bp, Artificial Sequence
  Synthetic
atggccgactcccaagtacggaacccagtgttgagagagtcgttacagttcaaggcagtcctgttgatgtgccagctgccgttggtgtttacaagctggattttctgagacggcccttgcggagacccagcatggcgtat

SEQ ID NO: 399039 - DNA, 140 bp, Artificial Sequence
  Synthetic
aggccctggctgctgatatgacatcaacaggactgccttgaactgtaacgactctctcaacactgggttcatcgccgcactgttctacgtgcgcaatttcaactcatccgggtgcgcagagaccttttgggacagcggtg

SEQ ID NO: 399040 - DNA, 140 bp, Artificial Sequence
  Synthetic
caccgctgtcccaaaaggtctctgcgcacccggatgagttgaaattgcgcacgtagaacagtgcggcgatgaacccagtgttgagagagtcgttacagttcaaggcagtcctgttgatgtcatatcagcagccagggcct

SEQ ID NO: 399041 - DNA, 140 bp, Artificial Sequence
  Synthetic
aggccctggctgctgatatgtcgagcccgtcgtcttttctgacatggagaccaagatcatcacctggggggcagacaccgcggcgtgcggggacattatctcgggcctgcctgtctccgcgaccttttgggacagcggtg

SEQ ID NO: 399042 - DNA, 140 bp, Artificial Sequence
  Synthetic
caccgctgtcccaaaaggtcgcggagacaggcaggcccgagataatgtccccgcacgccgcggtgtctgccccccaggtgatgatcttggtctccatgtcagaaaagacgacgggctcgacatatcagcagccagggcct

SEQ ID NO: 399043 - DNA, 140 bp, Artificial Sequence
  Synthetic
aggccctggctgctgatatgcctgaaccggacgtggccgtgttaacgtccatgctcactgatccctcccatataacagcagaggcggctgggaggaggttagcaaggggatcgcccccttgaccttttgggacagcggtg

SEQ ID NO: 399044 - DNA, 140 bp, Artificial Sequence
  Synthetic
caccgctgtcccaaaaggtcaagggggcgatccccttgctaacctcctcccagccgcctctgctgttatatgggagggatcagtgagcatggacgttaacacggccacgtccggttcaggcatatcagcagccagggcct

SEQ ID NO: 399045 - DNA, 140 bp, Artificial Sequence
  Synthetic
aggccctggctgctgatatggtggcgggggcccactggggagtcctggcgggccttgcctactactccatggtggggaactgggctaaggttttgattgtgatgctactcttcgccggcggaccttttgggacagcggtg

SEQ ID NO: 399046 - DNA, 140 bp, Artificial Sequence
  Synthetic
caccgctgtcccaaaaggtccgccggcgaagagtagcatcacaatcaaaaccttagcccagttccccaccatggagtagtaggcaaggcccgccaggactccccagtgggcccccgccaccatatcagcagccagggcct

SEQ ID NO: 399047 - DNA, 140 bp, Artificial Sequence
  Synthetic
aggccctggctgctgatatgggtcaccgtgccacatcccaacatcgaggaggtggccctgtccaacgctggagaaatcccattttatggcaaagccatccccattgaggccatcaagggggaccttttgggacagcggtg

SEQ ID NO: 399048 - DNA, 140 bp, Artificial Sequence
  Synthetic
caccgctgtcccaaaaggtcccccttgatggcctcaatggggatggctttgccataaaatgggatttctccagcgttggacagggccacctcctcgatgttgggatgtggcacggtgacccatatcagcagccagggcct

SEQ ID NO: 399049 - DNA, 140 bp, Artificial Sequence
  Synthetic
aggccctggctgctgatatgaaacaccaatggcagttggcacatcaacaggactgccctgaactgcaatgactccctccacactgggttccttgccgcgctgttctacacacacaggttcgaccttttgggacagcggtg

SEQ ID NO: 399050 - DNA, 140 bp, Artificial Sequence
  Synthetic
caccgctgtcccaaaaggtcgaacctgtgtgtgtagaacagcgcggcaaggaacccagtgtggagggagtcattgcagttcagggcagtcctgttgatgtgccaactgccattggtgtttcatatcagcagccagggcct

SEQ ID NO: 399051 - DNA, 140 bp, Artificial Sequence
  Synthetic
aggccctggctgctgatatgcccgcgtcgcaggtgtgtggtccagtgtattgtttcaccccaagcccggttgtggtggggacgaccgatcgtttcggtgtccctacgtatagctgggggggaccttttgggacagcggtg

SEQ ID NO: 399052 - DNA, 140 bp, Artificial Sequence
  Synthetic
caccgctgtcccaaaaggtcccccccagctatacgtagggacaccgaaacgatcggtcgtccccaccacaaccgggcttggggtgaaacaatacactggaccacacacctgcgacgcgggcatatcagcagccagggcct

SEQ ID NO: 399053 - DNA, 140 bp, Artificial Sequence
  Synthetic
atacgccatgctgggtctccgggccctggctcacgccaaggtgcctgatcgactacccctacaggctctggcattacccctgcacagttaactataccatcttcaaaataaggatgtatgcgtacttgggagtcggccat

SEQ ID NO: 399054 - DNA, 140 bp, Artificial Sequence
  Synthetic
atggccgactcccaagtacgcatacatccttattttgaagatggtatagttaactgtgcaggggtaatgccagagcctgtaggggtagtcgatcaggcaccttggcgtgagccagggcccggagacccagcatggcgtat

SEQ ID NO: 399055 - DNA, 140 bp, Artificial Sequence
  Synthetic
atacgccatgctgggtctccccgccttgtcgactggtcttctccacctccaccaaaacatcgtggacgtacaattcatgtatggcctatcacctgccctcacaaaatacatcgtccgatgcgtacttgggagtcggccat

SEQ ID NO: 399056 - DNA, 140 bp, Artificial Sequence
  Synthetic
atggccgactcccaagtacgcatcggacgatgtattttgtgagggcaggtgataggccatacatgaattgtacgtccacgatgttttggtggaggtggagaagaccagtcgacaaggcggggagacccagcatggcgtat

SEQ ID NO: 399057 - DNA, 140 bp, Artificial Sequence
  Synthetic
aggccctggctgctgatatgcgggtcaccgcatggcatgggatatgatgatgaactggtcccctacgacggcgttggtagtagctcagctgctccggatcccacaagccatcttggacatgaccttttgggacagcggtg

SEQ ID NO: 399058 - DNA, 140 bp, Artificial Sequence
  Synthetic
caccgctgtcccaaaaggtcatgtccaagatggcttgtgggatccggagcagctgagctactaccaacgccgtcgtaggggaccagttcatcatcatatcccatgccatgcggtgacccgcatatcagcagccagggcct

SEQ ID NO: 399059 - DNA, 140 bp, Artificial Sequence
  Synthetic
aggccctggctgctgatatgccagctgattaacaccaacggcagttggcacatcaatcgcacggccttgaactgcaatgacagccttagcaccggctggatagcagggcttttctattacgaccttttgggacagcggtg

SEQ ID NO: 399060 - DNA, 140 bp, Artificial Sequence
  Synthetic
caccgctgtcccaaaaggtcgtaatagaaaagccctgctatccagccggtgctaaggctgtcattgcagttcaaggccgtgcgattgatgtgccaactgccgttggtgttaatcagctggcatatcagcagccagggcct

SEQ ID NO: 399061 - DNA, 140 bp, Artificial Sequence
  Synthetic
aggccctggctgctgatatgctgggcagtaaagaccaagcttaaactcactccaatcccggccgcgtcccagctggacttatccagctggttcgttgctggttacagcgggggagacatagaccttttgggacagcggtg

SEQ ID NO: 399062 - DNA, 140 bp, Artificial Sequence
  Synthetic
caccgctgtcccaaaaggtctatgtctcccccgctgtaaccagcaacgaaccagctggataagtccagctgggacgcggccgggattggagtgagtttaagcttggtctttactgcccagcatatcagcagccagggcct

SEQ ID NO: 399063 - DNA, 140 bp, Artificial Sequence
  Synthetic
aggccctggctgctgatatggggactggatatgcacggtgttgattgacttcaagacctggctccagtccaagctcctgccgcggctaccgggagtccccttcttctcatgccaacgtgggaccttttgggacagcggtg

SEQ ID NO: 399064 - DNA, 140 bp, Artificial Sequence
  Synthetic
caccgctgtcccaaaaggtcccacgttggcatgagaagaaggggactcccggtagccgcggcaggagcttggactggagccaggtcttgaagtcaatcaacaccgtgcatatccagtccccatatcagcagccagggcct

SEQ ID NO: 399065 - DNA, 140 bp, Artificial Sequence
  Synthetic
aggccctggctgctgatatgggagccaatcactccaggccaataggccattctgttgctaaacactccaggccaatggtcatactggggtttcctgagctagaaggttggagaagaagtggaccttttgggacagcggtg

SEQ ID NO: 399066 - DNA, 140 bp, Artificial Sequence
  Synthetic
caccgctgtcccaaaaggtccacttcttctccaaccttctagctcaggaaaccccagtatgaccattggcctggagtgtttagcaacagaatggcctattggcctggagtgattggctcccatatcagcagccagggcct

SEQ ID NO: 399067 - DNA, 140 bp, Artificial Sequence
  Synthetic
aggccctggctgctgatatgccactgcgacaatacgacgtcatgtcgatttgctcgttggggcggctgctttctgttccgctatgtacgtgggggatctctgcggatctgttttccttgtgaccttttgggacagcggtg

SEQ ID NO: 399068 - DNA, 140 bp, Artificial Sequence
  Synthetic
caccgctgtcccaaaaggtcacaaggaaaacagatccgcagagatcccccacgtacatagcggaacagaaagcagccgccccaacgagcaaatcgacatgacgtcgtattgtcgcagtggcatatcagcagccagggcct

SEQ ID NO: 399069 - DNA, 140 bp, Artificial Sequence
  Synthetic
atacgccatgctgggtctccttcccccagcgatgcccatatgggcacgcccggattacaaccctccactgctagagtcctggaaagacccggactacgtccctccagtggtacacgggtgcgtacttgggagtcggccat

SEQ ID NO: 399070 - DNA, 140 bp, Artificial Sequence
  Synthetic
atggccgactcccaagtacgcacccgtgtaccactggagggacgtagtccgggtctttccaggactctagcagtggagggttgtaatccgggcgtgcccatatgggcatcgctgggggaaggagacccagcatggcgtat

SEQ ID NO: 399071 - DNA, 140 bp, Artificial Sequence
  Synthetic
atacgccatgctgggtctcccacatcaacagaactgccctgaactgcaacgactccctccagaccgggttcattgctgcgttgttctacgtacgcaatatcaactcgaccggatgcctagcgtacttgggagtcggccat

SEQ ID NO: 399072 - DNA, 140 bp, Artificial Sequence
  Synthetic
atggccgactcccaagtacgctaggcatccggtcgagttgatattgcgtacgtagaacaacgcagcaatgaacccggtctggagggagtcgttgcagttcagggcagttctgttgatgtgggagacccagcatggcgtat

SEQ ID NO: 399073 - DNA, 140 bp, Artificial Sequence
  Synthetic
aggccctggctgctgatatgggcgaccgcccctcctgaccaggcctctgacgacggcgacaaagaatccgacgttgagtcgtactcctccatgcccccccttgagggagagccgggggacgaccttttgggacagcggtg

SEQ ID NO: 399074 - DNA, 140 bp, Artificial Sequence
  Synthetic
caccgctgtcccaaaaggtcgtcccccggctctccctcaagggggggcatggaggagtacgactcaacgtcggattctttgtcgccgtcgtcagaggcctggtcaggaggggcggtcgcccatatcagcagccagggcct

SEQ ID NO: 399075 - DNA, 140 bp, Artificial Sequence
  Synthetic
aggccctggctgctgatatgggacgtcgtctgctgctcaatgtcctacacatggacaggcgccctgatcacgccatgcgctgcggaggaaagcaagctgcccatcaacgcgctgagcaacgaccttttgggacagcggtg

SEQ ID NO: 399076 - DNA, 140 bp, Artificial Sequence
  Synthetic
caccgctgtcccaaaaggtcgttgctcagcgcgttgatgggcagcttgctttcctccgcagcgcatggcgtgatcagggcgcctgtccatgtgtaggacattgagcagcagacgacgtcccatatcagcagccagggcct

SEQ ID NO: 399077 - DNA, 140 bp, Artificial Sequence
  Synthetic
aggccctggctgctgatatgtctcaccccagcttacaaacaactgctcgtaagtgtgatttggtggctacaatatttcatcgcacgggcggaagcagttatccatgtgtgggtaccatccgaccttttgggacagcggtg

SEQ ID NO: 399078 - DNA, 140 bp, Artificial Sequence
  Synthetic
caccgctgtcccaaaaggtcggatggtacccacacatggataactgcttccgcccgtgcgatgaaatattgtagccaccaaatcacacttacgagcagttgtttgtaagctggggtgagacatatcagcagccagggcct

SEQ ID NO: 399079 - DNA, 140 bp, Artificial Sequence
  Synthetic
aggccctggctgctgatatgaggcgcacttgcaagtgtgggtcccccccctcaacgttcgggggggccgcgatgccatcatcctcctcacatgcgtggtccacccagagctaatctttgagaccttttgggacagcggtg

SEQ ID NO: 399080 - DNA, 140 bp, Artificial Sequence
  Synthetic
caccgctgtcccaaaaggtctcaaagattagctctgggtggaccacgcatgtgaggaggatgatggcatcgcggcccccccgaacgttgaggggggggacccacacttgcaagtgcgcctcatatcagcagccagggcct

SEQ ID NO: 399081 - DNA, 140 bp, Artificial Sequence
  Synthetic
atacgccatgctgggtctccctggcataactaaggtgccgtactttgtacgtgctcatgggctcatccgtgcatgcatgatggtgcggaaggttgccggaggtcattatatccagatggccgtacttgggagtcggccat

SEQ ID NO: 399082 - DNA, 140 bp, Artificial Sequence
  Synthetic
atggccgactcccaagtacggccatctggatataatgacctccggcaaccttccgcaccatcatgcatgcacggatgagcccatgagcacgtacaaagtacggcaccttagttatgccagggagacccagcatggcgtat

SEQ ID NO: 399083 - DNA, 140 bp, Artificial Sequence
  Synthetic
atacgccatgctgggtctccacaattgcttttacagatgcacatatcgaggtggacatcacttacgctgagtacttcgaaatgtccgttcggttggcagaagctatgaaacgatatgggccgtacttgggagtcggccat

SEQ ID NO: 399084 - DNA, 140 bp, Artificial Sequence
  Synthetic
atggccgactcccaagtacggcccatatcgtttcatagcttctgccaaccgaacggacatttcgaagtactcagcgtaagtgatgtccacctcgatatgtgcatctgtaaaagcaattgtggagacccagcatggcgtat

SEQ ID NO: 399085 - DNA, 140 bp, Artificial Sequence
  Synthetic
atacgccatgctgggtctccgaacgacatttataatgaacgtgaattgctcaacagtatgggcatttcgcagcctaccgtggtgttcgtttccaaaaaggggttgcaaaaaattttgaaccgtacttgggagtcggccat

SEQ ID NO: 399086 - DNA, 140 bp, Artificial Sequence
  Synthetic
atggccgactcccaagtacggttcaaaattttttgcaacccctttttggaaacgaacaccacggtaggctgcgaaatgcccatactgttgagcaattcacgttcattataaatgtcgttcggagacccagcatggcgtat

SEQ ID NO: 399087 - DNA, 140 bp, Artificial Sequence
  Synthetic
aggccctggctgctgatatggggcctgcttggctgcatcatcactagcctcacaggccgggacaagaaccaggtcgagggggaggttcaagtggtttccaccgcgacgcaatctttcctggaccttttgggacagcggtg

SEQ ID NO: 399088 - DNA, 140 bp, Artificial Sequence
  Synthetic
caccgctgtcccaaaaggtccaggaaagattgcgtcgcggtggaaaccacttgaacctccccctcgacctggttcttgtcccggcctgtgaggctagtgatgatgcagccaagcaggccccatatcagcagccagggcct

SEQ ID NO: 399089 - DNA, 140 bp, Artificial Sequence
  Synthetic
atacgccatgctgggtctccaacggattaccagggatttcagtcgatgtacacgttcgtcacatctcatctacctcccggttttaatgaatacgattttgtgccagagtccttcgataggcgtacttgggagtcggccat

SEQ ID NO: 399090 - DNA, 140 bp, Artificial Sequence
  Synthetic
atggccgactcccaagtacgcctatcgaaggactctggcacaaaatcgtattcattaaaaccgggaggtagatgagatgtgacgaacgtgtacatcgactgaaatccctggtaatccgttggagacccagcatggcgtat

SEQ ID NO: 399091 - DNA, 140 bp, Artificial Sequence
  Synthetic
atacgccatgctgggtctccccagagatcctatttttggcaatcaaatcattccggatactgcgattttaagtgttgttccattccatcacggttttggaatgtttactacactcggatacgtacttgggagtcggccat

SEQ ID NO: 399092 - DNA, 140 bp, Artificial Sequence
  Synthetic
atggccgactcccaagtacgtatccgagtgtagtaaacattccaaaaccgtgatggaatggaacaacacttaaaatcgcagtatccggaatgatttgattgccaaaaataggatctctggggagacccagcatggcgtat

SEQ ID NO: 399093 - DNA, 140 bp, Artificial Sequence
  Synthetic
atacgccatgctgggtctcctgtttctgaggagccttcaggattacaagattcaaagtgcgctgctggtgccaaccctattctccttcttcgccaaaagcactctgattgacaaatacgacgtacttgggagtcggccat

SEQ ID NO: 399094 - DNA, 140 bp, Artificial Sequence
  Synthetic
atggccgactcccaagtacgtcgtatttgtcaatcagagtgcttttggcgaagaaggagaatagggttggcaccagcagcgcactttgaatcttgtaatcctgaaggctcctcagaaacaggagacccagcatggcgtat

SEQ ID NO: 399095 - DNA, 140 bp, Artificial Sequence
  Synthetic
atacgccatgctgggtctccggatatgggctcactgagactacatcagctattctgattacacccgagggggatgataaaccgggcgcggtcggtaaagttgttccattttttgaagcgacgtacttgggagtcggccat

SEQ ID NO: 399096 - DNA, 140 bp, Artificial Sequence
  Synthetic
atggccgactcccaagtacgtcgcttcaaaaaatggaacaactttaccgaccgcgcccggtttatcatccccctcgggtgtaatcagaatagctgatgtagtctcagtgagcccatatccggagacccagcatggcgtat

SEQ ID NO: 399097 - DNA, 140 bp, Artificial Sequence
  Synthetic
aggccctggctgctgatatgccactatggctctcccggaaggggggggcctggaggctgcacgacactcgtactaacgccatggctagacgctttccgcgtgaagacagaagttcctcacgaccttttgggacagcggtg

SEQ ID NO: 399098 - DNA, 140 bp, Artificial Sequence
  Synthetic
caccgctgtcccaaaaggtcgtgaggaacttctgtcttcacgcggaaagcgtctagccatggcgttagtacgagtgtcgtgcagcctccaggccccccccttccgggagagccatagtggcatatcagcagccagggcct

SEQ ID NO: 399099 - DNA, 140 bp, Artificial Sequence
  Synthetic
atacgccatgctgggtctccggaagcgaccaacgccttgattgacaaggatggatggctacattctggagacatagcttactgggacgaagacgaacacttcttcatcgttgaccgcctgcgtacttgggagtcggccat

SEQ ID NO: 399100 - DNA, 140 bp, Artificial Sequence
  Synthetic
atggccgactcccaagtacgcaggcggtcaacgatgaagaagtgttcgtcttcgtcccagtaagctatgtctccagaatgtagccatccatccttgtcaatcaaggcgttggtcgcttccggagacccagcatggcgtat

SEQ ID NO: 399101 - DNA, 140 bp, Artificial Sequence
  Synthetic
atacgccatgctgggtctccttcccgacgatgacgccggtgaacttcccgccgccgttgttgttttggagcacggaaagacgatgacggaaaaagagatcgtggattacgtcgccagtcacgtacttgggagtcggccat

SEQ ID NO: 399102 - DNA, 140 bp, Artificial Sequence
  Synthetic
atggccgactcccaagtacgtgactggcgacgtaatccacgatctctttttccgtcatcgtctttccgtgctccaaaacaacaacggcggcgggaagttcaccggcgtcatcgtcgggaaggagacccagcatggcgtat

SEQ ID NO: 399103 - DNA, 140 bp, Artificial Sequence
  Synthetic
atacgccatgctgggtctccagtaacaaccgcgaaaaagttgcgcggaggagttgtgtttgtggacgaagtaccgaaaggtcttaccggaaaactcgacgcaagaaaaatcagagagatccgtacttgggagtcggccat

SEQ ID NO: 399104 - DNA, 140 bp, Artificial Sequence
  Synthetic
atggccgactcccaagtacggatctctctgatttttcttgcgtcgagttttccggtaagacctttcggtacttcgtccacaaacacaactcctccgcgcaactttttcgcggttgttactggagacccagcatggcgtat

SEQ ID NO: 399105 - DNA, 140 bp, Artificial Sequence
  Synthetic
atacgccatgctgggtctccgtgttccggctgtcagcgcaggggcgcccggttctttttgtcaagaccgacctgtccggtgccctgaatgaactgcaggacgaggcagcgcggctatcgtcgtacttgggagtcggccat

SEQ ID NO: 399106 - DNA, 140 bp, Artificial Sequence
  Synthetic
atggccgactcccaagtacgacgatagccgcgctgcctcgtcctgcagttcattcagggcaccggacaggtcggtcttgacaaaaagaaccgggcgcccctgcgctgacagccggaacacggagacccagcatggcgtat

SEQ ID NO: 399107 - DNA, 140 bp, Artificial Sequence
  Synthetic
aggccctggctgctgatatgaaagctgtcggccctcggacttaatgctgtagcatattaccggggtctcgatgtgtccgtcataccgaccagcggagacgtcgttgtcgtggcaacagacgaccttttgggacagcggtg

SEQ ID NO: 399108 - DNA, 140 bp, Artificial Sequence
  Synthetic
caccgctgtcccaaaaggtcgtctgttgccacgacaacgacgtctccgctggtcggtatgacggacacatcgagaccccggtaatatgctacagcattaagtccgagggccgacagctttcatatcagcagccagggcct

SEQ ID NO: 399109 - DNA, 140 bp, Artificial Sequence
  Synthetic
atacgccatgctgggtctcccctgtcatctcaccttgctcctgccgagaaagtatccatcatggctgatgcaatgcggcggctgcatacgcttgatccggctacctgcccattcgaccaccgtacttgggagtcggccat

SEQ ID NO: 399110 - DNA, 140 bp, Artificial Sequence
  Synthetic
atggccgactcccaagtacggtggtcgaatgggcaggtagccggatcaagcgtatgcagccgccgcattgcatcagccatgatggatactttctcggcaggagcaaggtgagatgacaggggagacccagcatggcgtat

SEQ ID NO: 399111 - DNA, 140 bp, Artificial Sequence
  Synthetic
atacgccatgctgggtctccgaccagaggccctattgctggcactacgcacctcaaccgtgtggtatcgtacccgcgttgcaggtgtgtggtccagtgtattgcttcaccccaagccccgcgtacttgggagtcggccat

SEQ ID NO: 399112 - DNA, 140 bp, Artificial Sequence
  Synthetic
atggccgactcccaagtacgcggggcttggggtgaagcaatacactggaccacacacctgcaacgcgggtacgataccacacggttgaggtgcgtagtgccagcaatagggcctctggtcggagacccagcatggcgtat

SEQ ID NO: 399113 - DNA, 140 bp, Artificial Sequence
  Synthetic
atacgccatgctgggtctccgatttcggtggcggcggaatgccacaggccgccgaggttcaagtatcctcctgctcttcccgtgtgggctcgacctgattataacccgcctttacttgagcgtacttgggagtcggccat

SEQ ID NO: 399114 - DNA, 140 bp, Artificial Sequence
  Synthetic
atggccgactcccaagtacgctcaagtaaaggcgggttataatcaggtcgagcccacacgggaagagcaggaggatacttgaacctcggcggcctgtggcattccgccgccaccgaaatcggagacccagcatggcgtat

SEQ ID NO: 399115 - DNA, 140 bp, Artificial Sequence
  Synthetic
atacgccatgctgggtctcccccccctaacgttactggccgaagccgcttggaataaggccggtgtgcgtttgtctatatgttattttccaccatattgccgtcttttggcaatgtgaggcgtacttgggagtcggccat

SEQ ID NO: 399116 - DNA, 140 bp, Artificial Sequence
  Synthetic
atggccgactcccaagtacgcctcacattgccaaaagacggcaatatggtggaaaataacatatagacaaacgcacaccggccttattccaagcggcttcggccagtaacgttaggggggggagacccagcatggcgtat

SEQ ID NO: 399117 - DNA, 140 bp, Artificial Sequence
  Synthetic
atacgccatgctgggtctccttcctctggaagcttcttgaagacaaacaacgtctgtagcgaccctttgcaggcagcggaaccccccacctggcgacaggtgcctctgcggccaaaagcccgtacttgggagtcggccat

SEQ ID NO: 399118 - DNA, 140 bp, Artificial Sequence
  Synthetic
atggccgactcccaagtacgggcttttggccgcagaggcacctgtcgccaggtggggggttccgctgcctgcaaagggtcgctacagacgttgtttgtcttcaagaagcttccagaggaaggagacccagcatggcgtat

SEQ ID NO: 399119 - DNA, 140 bp, Artificial Sequence
  Synthetic
atacgccatgctgggtctccaacaaggggctgaaggatgcccagaaggtaccccattgtatgggatctgatctggggcctcggtgcacatgctttacatgtgtttagtcgaggttaaaaacgtacttgggagtcggccat

SEQ ID NO: 399120 - DNA, 140 bp, Artificial Sequence
  Synthetic
atggccgactcccaagtacgtttttaacctcgactaaacacatgtaaagcatgtgcaccgaggccccagatcagatcccatacaatggggtaccttctgggcatccttcagccccttgttggagacccagcatggcgtat

SEQ ID NO: 399121 - DNA, 140 bp, Artificial Sequence
  Synthetic
aggccctggctgctgatatgcttagagaacctggtggtcctcaatgcagcgtccctggccggagcgcatggcattctctccttccttgtgttcttctgtgctgcctggtacatcaagggcgaccttttgggacagcggtg

SEQ ID NO: 399122 - DNA, 140 bp, Artificial Sequence
  Synthetic
caccgctgtcccaaaaggtcgcccttgatgtaccaggcagcacagaagaacacaaggaaggagagaatgccatgcgctccggccagggacgctgcattgaggaccaccaggttctctaagcatatcagcagccagggcct

SEQ ID NO: 399123 - DNA, 140 bp, Artificial Sequence
  Synthetic
atacgccatgctgggtctcctccgctcatggtgctccaagccggcctaatcagagtgccgtacttcgtgcgcgcgcaagggctcgtgcgtgcatgcatgttggtgcggaaagtttctgggcgtacttgggagtcggccat

SEQ ID NO: 399124 - DNA, 140 bp, Artificial Sequence
  Synthetic
atggccgactcccaagtacgcccagaaactttccgcaccaacatgcatgcacgcacgagcccttgcgcgcgcacgaagtacggcactctgattaggccggcttggagcaccatgagcggaggagacccagcatggcgtat

SEQ ID NO: 399125 - DNA, 140 bp, Artificial Sequence
  Synthetic
atacgccatgctgggtctcccaagcaggcccaggaagcagcaccagtggtccagtcaaactttgccaaacttgaacaattttgggcgaagcatatgtggaacttcatcagtggcatccaacgtacttgggagtcggccat

SEQ ID NO: 399126 - DNA, 140 bp, Artificial Sequence
  Synthetic
atggccgactcccaagtacgttggatgccactgatgaagttccacatatgcttcgcccaaaattgttcaagtttggcaaagtttgactggaccactggtgctgcttcctgggcctgcttgggagacccagcatggcgtat

SEQ ID NO: 399127 - DNA, 140 bp, Artificial Sequence
  Synthetic
atacgccatgctgggtctcccgccagcgtcgacgcggtaacccacaccaccggagggactgctgcccagaacgcgcttggactcgccactcttttcagtcgaggccccaagcagaacgtccgtacttgggagtcggccat

SEQ ID NO: 399128 - DNA, 140 bp, Artificial Sequence
  Synthetic
atggccgactcccaagtacggacgttctgcttggggcctcgactgaaaagagtggcgagtccaagcgcgttctgggcagcagtccctccggtggtgtgggttaccgcgtcgacgctggcgggagacccagcatggcgtat

SEQ ID NO: 399129 - DNA, 140 bp, Artificial Sequence
  Synthetic
aggccctggctgctgatatgacaaattcaactcttcaggctgccccgagaggatggccagctgcaaaccccttgcctatttcgcccagggctggggccctatcagctatgccaacggaaggaccttttgggacagcggtg

SEQ ID NO: 399130 - DNA, 140 bp, Artificial Sequence
  Synthetic
caccgctgtcccaaaaggtccttccgttggcatagctgatagggccccagccctgggcgaaataggcaaggggtttgcagctggccatcctctcggggcagcctgaagagttgaatttgtcatatcagcagccagggcct

SEQ ID NO: 399131 - DNA, 140 bp, Artificial Sequence
  Synthetic
aggccctggctgctgatatgcgagccgctgtgtgcacccggggggttgcgaaggcggtggactttgtacccgttgagtctatggagaccactatgcggtctccggtcttcacggacaactgaccttttgggacagcggtg

SEQ ID NO: 399132 - DNA, 140 bp, Artificial Sequence
  Synthetic
caccgctgtcccaaaaggtcagttgtccgtgaagaccggagaccgcatagtggtctccatagactcaacgggtacaaagtccaccgccttcgcaaccccccgggtgcacacagcggctcgcatatcagcagccagggcct

SEQ ID NO: 399133 - DNA, 140 bp, Artificial Sequence
  Synthetic
aggccctggctgctgatatgcaccgctacgcctccgggatcggtcaccgtgccacatcccaacatcgaggaggtggccttgtccaacactggagagatccccttttatggtaaagccatcgaccttttgggacagcggtg

SEQ ID NO: 399134 - DNA, 140 bp, Artificial Sequence
  Synthetic
caccgctgtcccaaaaggtcgatggctttaccataaaaggggatctctccagtgttggacaaggccacctcctcgatgttgggatgtggcacggtgaccgatcccggaggcgtagcggtgcatatcagcagccagggcct

SEQ ID NO: 399135 - DNA, 140 bp, Artificial Sequence
  Synthetic
aggccctggctgctgatatggtccaaaacgaggtcaccctcacacaccccataaccaaatacatcatgacatgcatggcggctgacctagaggtcgtcacgagcacctgggtgctagtgggaccttttgggacagcggtg

SEQ ID NO: 399136 - DNA, 140 bp, Artificial Sequence
  Synthetic
caccgctgtcccaaaaggtcccactagcacccaggtgctcgtgacgacctctaggtcagccgccatgcatgtcatgatgtatttggttatggggtgtgtgagggtgacctcgttttggaccatatcagcagccagggcct

SEQ ID NO: 399137 - DNA, 140 bp, Artificial Sequence
  Synthetic
atacgccatgctgggtctcctcggtcgtgtgaacatcaatcaaaagaccatagtcgcccctgataaggaagtcctgtacgaggcgtttgatgagatggaggaatgcgcttccagggctctcgtacttgggagtcggccat

SEQ ID NO: 399138 - DNA, 140 bp, Artificial Sequence
  Synthetic
atggccgactcccaagtacgagagccctggaagcgcattcctccatctcatcaaacgcctcgtacaggacttccttatcaggggcgactatggtcttttgattgatgttcacacgaccgaggagacccagcatggcgtat

SEQ ID NO: 399139 - DNA, 140 bp, Artificial Sequence
  Synthetic
aggccctggctgctgatatgctgcacgtgtgggttccccccctcaacgtccgaggggggcgcgacgctgtcatcttactcatgtgtgttgtacacccgactttggtatttgacatcaccagaccttttgggacagcggtg

SEQ ID NO: 399140 - DNA, 140 bp, Artificial Sequence
  Synthetic
caccgctgtcccaaaaggtctggtgatgtcaaataccaaagtcgggtgtacaacacacatgagtaagatgacagcgtcgcgcccccctcggacgttgagggggggaacccacacgtgcagcatatcagcagccagggcct

SEQ ID NO: 399141 - DNA, 140 bp, Artificial Sequence
  Synthetic
aggccctggctgctgatatggcatgctcccaccggcagcggtaagagcaccaaggtcccggccgcatacgcggctcagggctataaggtgctggtgctcaacccctccgttgctgcaacagaccttttgggacagcggtg

SEQ ID NO: 399142 - DNA, 140 bp, Artificial Sequence
  Synthetic
caccgctgtcccaaaaggtctgttgcagcaacggaggggttgagcaccagcaccttatagccctgagccgcgtatgcggccgggaccttggtgctcttaccgctgccggtgggagcatgccatatcagcagccagggcct

SEQ ID NO: 399143 - DNA, 140 bp, Artificial Sequence
  Synthetic
aggccctggctgctgatatggtgcgcagcaatactgcgtcggcacgtgggcccaggggagggagctgtgcagtggatgaaccggctgatagcgttcgcctcgcggggtaaccacgtctccgaccttttgggacagcggtg

SEQ ID NO: 399144 - DNA, 140 bp, Artificial Sequence
  Synthetic
caccgctgtcccaaaaggtcggagacgtggttaccccgcgaggcgaacgctatcagccggttcatccactgcacagctccctcccctgggcccacgtgccgacgcagtattgctgcgcaccatatcagcagccagggcct

SEQ ID NO: 399145 - DNA, 140 bp, Artificial Sequence
  Synthetic
aggccctggctgctgatatgggtacaagggagtctggcgaggagatggtgtcatgcataccacctgcccctgtggcgcacaaatctccggacatgtcaaaaacggttccatgaggatcgtgaccttttgggacagcggtg

SEQ ID NO: 399146 - DNA, 140 bp, Artificial Sequence
  Synthetic
caccgctgtcccaaaaggtcacgatcctcatggaaccgtttttgacatgtccggagatttgtgcgccacaggggcaggtggtatgcatgacaccatctcctcgccagactcccttgtacccatatcagcagccagggcct

SEQ ID NO: 399147 - DNA, 140 bp, Artificial Sequence
  Synthetic
aggccctggctgctgatatggtcaatgctgtggcttactaccgcggcctcgacgtgtccgtcatcccgaccagtggcgatgttgtcgtcgtggcaactgatgccctcatgaccggctttagaccttttgggacagcggtg

SEQ ID NO: 399148 - DNA, 140 bp, Artificial Sequence
  Synthetic
caccgctgtcccaaaaggtctaaagccggtcatgagggcatcagttgccacgacgacaacatcgccactggtcgggatgacggacacgtcgaggccgcggtagtaagccacagcattgaccatatcagcagccagggcct

SEQ ID NO: 399149 - DNA, 140 bp, Artificial Sequence
  Synthetic
aggccctggctgctgatatggggtcctggcgggccttgcctactattccatggcggggaactgggctaaggttttgattgtgctgctactctttgccggcgttgacggagcaacctatgtgaccttttgggacagcggtg

SEQ ID NO: 399150 - DNA, 140 bp, Artificial Sequence
  Synthetic
caccgctgtcccaaaaggtcacataggttgctccgtcaacgccggcaaagagtagcagcacaatcaaaaccttagcccagttccccgccatggaatagtaggcaaggcccgccaggaccccatatcagcagccagggcct

SEQ ID NO: 399151 - DNA, 140 bp, Artificial Sequence
  Synthetic
atacgccatgctgggtctcccatattaacaggactgccctgaattgcaatgactctctccagactgggtttttggccgcgctgttctacgtccgccagttcaactcgtccggatgcccagcgtacttgggagtcggccat

SEQ ID NO: 399152 - DNA, 140 bp, Artificial Sequence
  Synthetic
atggccgactcccaagtacgctgggcatccggacgagttgaactggcggacgtagaacagcgcggccaaaaacccagtctggagagagtcattgcaattcagggcagtcctgttaatatgggagacccagcatggcgtat

SEQ ID NO: 399153 - DNA, 140 bp, Artificial Sequence
  Synthetic
aggccctggctgctgatatggatgctgctgataactcaggctgaggccgccttagagaacctggtggtcctcaacgcagcatccgtggccggaacgcatggctttgtctccctccttgtggaccttttgggacagcggtg

SEQ ID NO: 399154 - DNA, 140 bp, Artificial Sequence
  Synthetic
caccgctgtcccaaaaggtccacaaggagggagacaaagccatgcgttccggccacggatgctgcgttgaggaccaccaggttctctaaggcggcctcagcctgagttatcagcagcatccatatcagcagccagggcct

SEQ ID NO: 399155 - DNA, 140 bp, Artificial Sequence
  Synthetic
aggccctggctgctgatatgatatgctctttatggcgtatggccgctgctcctgctcttgctggcactaccaccgcgagcatacgccatggaccgggagatggccgcatcgtgtggaggcgaccttttgggacagcggtg

SEQ ID NO: 399156 - DNA, 140 bp, Artificial Sequence
  Synthetic
caccgctgtcccaaaaggtcgcctccacacgatgcggccatctcccggtccatggcgtatgctcgcggtggtagtgccagcaagagcaggagcagcggccatacgccataaagagcatatcatatcagcagccagggcct

SEQ ID NO: 399157 - DNA, 140 bp, Artificial Sequence
  Synthetic
aggccctggctgctgatatggcttgcatgttagtgcggaaagtcgctggcggtcattatgtccaaatggctttcatgaaactggccgcgctgacaggtacgtacgtttatgaccacctcagaccttttgggacagcggtg

SEQ ID NO: 399158 - DNA, 140 bp, Artificial Sequence
  Synthetic
caccgctgtcccaaaaggtctgaggtggtcataaacgtacgtacctgtcagcgcggccagtttcatgaaagccatttggacataatgaccgccagcgactttccgcactaacatgcaagccatatcagcagccagggcct

SEQ ID NO: 399159 - DNA, 140 bp, Artificial Sequence
  Synthetic
atacgccatgctgggtctcccaccaaggtgccggctgcgtacgcagcccaggggtacaaggtgctcgtcttgaacccgtctgttgctgccaccttaggttttggggcgtacatgtctaagcgtacttgggagtcggccat

SEQ ID NO: 399160 - DNA, 140 bp, Artificial Sequence
  Synthetic
atggccgactcccaagtacgcttagacatgtacgccccaaaacctaaggtggcagcaacagacgggttcaagacgagcaccttgtacccctgggctgcgtacgcagccggcaccttggtgggagacccagcatggcgtat

SEQ ID NO: 399161 - DNA, 140 bp, Artificial Sequence
  Synthetic
aggccctggctgctgatatggagaatgagacagacgtgctgcttctcaacaacacgcggccgccacaaggcaactggtttggctgtacatggatgaatggcactgggttcaccaagacgtgaccttttgggacagcggtg

SEQ ID NO: 399162 - DNA, 140 bp, Artificial Sequence
  Synthetic
caccgctgtcccaaaaggtcacgtcttggtgaacccagtgccattcatccatgtacagccaaaccagttgccttgtggcggccgcgtgttgttgagaagcagcacgtctgtctcattctccatatcagcagccagggcct

SEQ ID NO: 399163 - DNA, 140 bp, Artificial Sequence
  Synthetic
atacgccatgctgggtctccaccacgagcatacgccctagaccgggaggtggctgcatcgtgcggaggcgcggttttcgtgggtctggtgctcttgaccttatcaccacactacaaggtgcgtacttgggagtcggccat

SEQ ID NO: 399164 - DNA, 140 bp, Artificial Sequence
  Synthetic
atggccgactcccaagtacgcaccttgtagtgtggtgataaggtcaagagcaccagacccacgaaaaccgcgcctccgcacgatgcagccacctcccggtctagggcgtatgctcgtggtggagacccagcatggcgtat

SEQ ID NO: 399165 - DNA, 140 bp, Artificial Sequence
  Synthetic
aggccctggctgctgatatgtggctgcatcgtgtggaggcgcggtttttgtaggactggcactcttgaccttgtcaccatactataaagtgttcctcgctaggctcatatggtggttacagaccttttgggacagcggtg

SEQ ID NO: 399166 - DNA, 140 bp, Artificial Sequence
  Synthetic
caccgctgtcccaaaaggtctgtaaccaccatatgagcctagcgaggaacactttatagtatggtgacaaggtcaagagtgccagtcctacaaaaaccgcgcctccacacgatgcagccacatatcagcagccagggcct

SEQ ID NO: 399167 - DNA, 140 bp, Artificial Sequence
  Synthetic
aggccctggctgctgatatgggtctgcttggctgcatcatcactagcctcacaggtcgggacaaaaaccaggtcgagggggaggttcaggtggtctctaccgcaacgcaatctttcctaggaccttttgggacagcggtg

SEQ ID NO: 399168 - DNA, 140 bp, Artificial Sequence
  Synthetic
caccgctgtcccaaaaggtcctaggaaagattgcgttgcggtagagaccacctgaacctccccctcgacctggtttttgtcccgacctgtgaggctagtgatgatgcagccaagcagacccatatcagcagccagggcct

SEQ ID NO: 399169 - DNA, 140 bp, Artificial Sequence
  Synthetic
aggccctggctgctgatatgctcacttccatgttcaccgacccctcccacattacagcagaagcggccaagcgtaggctggccagggggtctcccccctccttggccagctcctcagctagaccttttgggacagcggtg

SEQ ID NO: 399170 - DNA, 140 bp, Artificial Sequence
  Synthetic
caccgctgtcccaaaaggtctagctgaggagctggccaaggaggggggagaccccctggccagcctacgcttggccgcttctgctgtaatgtgggaggggtcggtgaacatggaagtgagcatatcagcagccagggcct

SEQ ID NO: 399171 - DNA, 140 bp, Artificial Sequence
  Synthetic
aggccctggctgctgatatgtacgagaccttgcagtggcagtagagcccgttgtcttctctgacatggagaccaagatcatcacctggggggcagacaccgcagcgtgtggggacatcatgaccttttgggacagcggtg

SEQ ID NO: 399172 - DNA, 140 bp, Artificial Sequence
  Synthetic
caccgctgtcccaaaaggtcatgatgtccccacacgctgcggtgtctgccccccaggtgatgatcttggtctccatgtcagagaagacaacgggctctactgccactgcaaggtctcgtacatatcagcagccagggcct

SEQ ID NO: 399173 - DNA, 140 bp, Artificial Sequence
  Synthetic
aggccctggctgctgatatgatgggcacggccagattacaaccctccactgctagagtcctggaaggacccggactacgtccctccggtggtgcacgggtgcccattaccacctactaaggaccttttgggacagcggtg

SEQ ID NO: 399174 - DNA, 140 bp, Artificial Sequence
  Synthetic
caccgctgtcccaaaaggtccttagtaggtggtaatgggcacccgtgcaccaccggagggacgtagtccgggtccttccaggactctagcagtggagggttgtaatctggccgtgcccatcatatcagcagccagggcct

SEQ ID NO: 399175 - DNA, 140 bp, Artificial Sequence
  Synthetic
aggccctggctgctgatatggcctactcccaacagacgcggggcctacttggttgcatcatcactagcctcacaggccgggacaagaaccaggtcgagggggaggttcaagtggtttccagaccttttgggacagcggtg

SEQ ID NO: 399176 - DNA, 140 bp, Artificial Sequence
  Synthetic
caccgctgtcccaaaaggtctggaaaccacttgaacctccccctcgacctggttcttgtcccggcctgtgaggctagtgatgatgcaaccaagtaggccccgcgtctgttgggagtaggccatatcagcagccagggcct

SEQ ID NO: 399177 - DNA, 140 bp, Artificial Sequence
  Synthetic
atacgccatgctgggtctcccacccaaatgtacaccaatgtggaccaggacctcgtcggctggcaggcgccccctggggcgcgttccttgacaccatgcacctgcggcagctcggaccttcgtacttgggagtcggccat

SEQ ID NO: 399178 - DNA, 140 bp, Artificial Sequence
  Synthetic
atggccgactcccaagtacgaaggtccgagctgccgcaggtgcatggtgtcaaggaacgcgccccagggggcgcctgccagccgacgaggtcctggtccacattggtgtacatttgggtgggagacccagcatggcgtat

SEQ ID NO: 399179 - DNA, 140 bp, Artificial Sequence
  Synthetic
atacgccatgctgggtctccggggcccaagcagaatatccagctgatcaactccaacggcagctggcacatcaaccgcacggccttgaactgtaatgagagcctcgagaccggctggttacgtacttgggagtcggccat

SEQ ID NO: 399180 - DNA, 140 bp, Artificial Sequence
  Synthetic
atggccgactcccaagtacgtaaccagccggtctcgaggctctcattacagttcaaggccgtgcggttgatgtgccagctgccgttggagttgatcagctggatattctgcttgggccccggagacccagcatggcgtat

SEQ ID NO: 399181 - DNA, 140 bp, Artificial Sequence
  Synthetic
aggccctggctgctgatatggctatggagcaggggtggcaggcgcgctcgtggcctttaaggtcatgagcggcgagatgccctctaccgaggacctggtcaacttgctccctgccatcctgaccttttgggacagcggtg

SEQ ID NO: 399182 - DNA, 140 bp, Artificial Sequence
  Synthetic
caccgctgtcccaaaaggtcaggatggcagggagcaagttgaccaggtcctcggtagagggcatctcgccgctcatgaccttaaaggccacgagcgcgcctgccacccctgctccatagccatatcagcagccagggcct

SEQ ID NO: 399183 - DNA, 140 bp, Artificial Sequence
  Synthetic
aggccctggctgctgatatgaaggcctcctccggatctgcgcgctagcgcggaagatggccggaggccattacgtgcaaatggccatcatcaagttaggggcgcttactggcacctatgtgaccttttgggacagcggtg

SEQ ID NO: 399184 - DNA, 140 bp, Artificial Sequence
  Synthetic
caccgctgtcccaaaaggtcacataggtgccagtaagcgcccctaacttgatgatggccatttgcacgtaatggcctccggccatcttccgcgctagcgcgcagatccggaggaggccttcatatcagcagccagggcct

SEQ ID NO: 399185 - DNA, 140 bp, Artificial Sequence
  Synthetic
aggccctggctgctgatatggagtcctggcgggccttgcctactattccatggtggggaactgggctaaggttttgattgtgatgctactctttgccggggtcgacgggaacaccgttgtgaccttttgggacagcggtg

SEQ ID NO: 399186 - DNA, 140 bp, Artificial Sequence
  Synthetic
caccgctgtcccaaaaggtcacaacggtgttcccgtcgaccccggcaaagagtagcatcacaatcaaaaccttagcccagttccccaccatggaatagtaggcaaggcccgccaggactccatatcagcagccagggcct

SEQ ID NO: 399187 - DNA, 140 bp, Artificial Sequence
  Synthetic
atacgccatgctgggtctcccatatcaacagaactgccctgaactgcaatgattccctcaacaccgggttcatctctgcgctgttctacgcacacaggttcaactcgtccggatgccctgcgtacttgggagtcggccat

SEQ ID NO: 399188 - DNA, 140 bp, Artificial Sequence
  Synthetic
atggccgactcccaagtacgcagggcatccggacgagttgaacctgtgtgcgtagaacagcgcagagatgaacccggtgttgagggaatcattgcagttcagggcagttctgttgatatgggagacccagcatggcgtat

SEQ ID NO: 399189 - DNA, 140 bp, Artificial Sequence
  Synthetic
aggccctggctgctgatatgcatctctgcgctgttctacgcacacaggttcaactcgtccggatgccctgagcgcatggccagctgccgccccgtcgacgacttcgcccaggggtggggtgaccttttgggacagcggtg

SEQ ID NO: 399190 - DNA, 140 bp, Artificial Sequence
  Synthetic
caccgctgtcccaaaaggtcaccccacccctgggcgaagtcgtcgacggggcggcagctggccatgcgctcagggcatccggacgagttgaacctgtgtgcgtagaacagcgcagagatgcatatcagcagccagggcct

SEQ ID NO: 399191 - DNA, 140 bp, Artificial Sequence
  Synthetic
aggccctggctgctgatatgggtacaagggagtctggcggggggacggcatcatgcacaccacctgcccatgtggagcacagatcaccggacatgtcaaaaacggttccatgaggatcgtgaccttttgggacagcggtg

SEQ ID NO: 399192 - DNA, 140 bp, Artificial Sequence
  Synthetic
caccgctgtcccaaaaggtcacgatcctcatggaaccgtttttgacatgtccggtgatctgtgctccacatgggcaggtggtgtgcatgatgccgtccccccgccagactcccttgtacccatatcagcagccagggcct

SEQ ID NO: 399193 - DNA, 140 bp, Artificial Sequence
  Synthetic
aggccctggctgctgatatgcggactacgtccctccggtggtacatgggtgcccattgccgcctaccaaggcccctccaataccacctccacggagaaagaggacggttgtcctgacagagaccttttgggacagcggtg

SEQ ID NO: 399194 - DNA, 140 bp, Artificial Sequence
  Synthetic
caccgctgtcccaaaaggtctctgtcaggacaaccgtcctctttctccgtggaggtggtattggaggggccttggtaggcggcaatgggcacccatgtaccaccggagggacgtagtccgcatatcagcagccagggcct

SEQ ID NO: 399195 - DNA, 140 bp, Artificial Sequence
  Synthetic
aggccctggctgctgatatgagatccccttttacggcaaggctatcccccttgaggtaatcaagggggggagacatctcatcttctgccactcaaagaagaagtgcgacgagctcgccgcgaccttttgggacagcggtg

SEQ ID NO: 399196 - DNA, 140 bp, Artificial Sequence
  Synthetic
caccgctgtcccaaaaggtcgcggcgagctcgtcgcacttcttctttgagtggcagaagatgagatgtctcccccccttgattacctcaagggggatagccttgccgtaaaaggggatctcatatcagcagccagggcct

SEQ ID NO: 399197 - DNA, 140 bp, Artificial Sequence
  Synthetic
aggccctggctgctgatatggcggttttcgtaggtctggcactcttgaccttgtcaccatactataaagtgttcctcgccaagctcatatggtggttacaatactttatcaccagagccggaccttttgggacagcggtg

SEQ ID NO: 399198 - DNA, 140 bp, Artificial Sequence
  Synthetic
caccgctgtcccaaaaggtccggctctggtgataaagtattgtaaccaccatatgagcttggcgaggaacactttatagtatggtgacaaggtcaagagtgccagacctacgaaaaccgccatatcagcagccagggcct

SEQ ID NO: 399199 - DNA, 140 bp, Artificial Sequence
  Synthetic
aggccctggctgctgatatgtggacttgtccggctggttcgttgctggttacagcgggggagacatatatcacagcctgtctcgtgcccgaccccgctggttcatgttgtgcctactcctgaccttttgggacagcggtg

SEQ ID NO: 399200 - DNA, 140 bp, Artificial Sequence
  Synthetic
caccgctgtcccaaaaggtcaggagtaggcacaacatgaaccagcggggtcgggcacgagacaggctgtgatatatgtctcccccgctgtaaccagcaacgaaccagccggacaagtccacatatcagcagccagggcct

SEQ ID NO: 399201 - DNA, 140 bp, Artificial Sequence
  Synthetic
aggccctggctgctgatatgccgcaaagctgtcaggcctcggactcaatgctgtagcgtattaccggggtcttgatgtgtccgtcataccgaccagcggagacgtcgttgtcgtggcaacgaccttttgggacagcggtg

SEQ ID NO: 399202 - DNA, 140 bp, Artificial Sequence
  Synthetic
caccgctgtcccaaaaggtcgttgccacgacaacgacgtctccgctggtcggtatgacggacacatcaagaccccggtaatacgctacagcattgagtccgaggcctgacagctttgcggcatatcagcagccagggcct

SEQ ID NO: 399203 - DNA, 140 bp, Artificial Sequence
  Synthetic
aggccctggctgctgatatgacatcaacaggactgctctgaactgcaatgactccctccaaaccgggttccttgccgcgctgttttacagacgcaacttcaactcgtccggatgcccagagaccttttgggacagcggtg

SEQ ID NO: 399204 - DNA, 140 bp, Artificial Sequence
  Synthetic
caccgctgtcccaaaaggtctctgggcatccggacgagttgaagttgcgtctgtaaaacagcgcggcaaggaacccggtttggagggagtcattgcagttcagagcagtcctgttgatgtcatatcagcagccagggcct

SEQ ID NO: 399205 - DNA, 140 bp, Artificial Sequence
  Synthetic
atacgccatgctgggtctccccatcacttacacataggaagaaacatctgatcagaggccctattgctggcactacgcccctctaccgtgcggtatcgtacccgcgtcacaggtgtgtggcgtacttgggagtcggccat

SEQ ID NO: 399206 - DNA, 140 bp, Artificial Sequence
  Synthetic
atggccgactcccaagtacgccacacacctgtgacgcgggtacgataccgcacggtagaggggcgtagtgccagcaatagggcctctgatcagatgtttcttcctatgtgtaagtgatggggagacccagcatggcgtat

SEQ ID NO: 399207 - DNA, 140 bp, Artificial Sequence
  Synthetic
atacgccatgctgggtctccgctggcatatcaataggactgccttgaattgcaatgacaccctccagaccgggttccttgcctcgctgttctacgtacacaagtttaacgcgtctggatgcgtacttgggagtcggccat

SEQ ID NO: 399208 - DNA, 140 bp, Artificial Sequence
  Synthetic
atggccgactcccaagtacgcatccagacgcgttaaacttgtgtacgtagaacagcgaggcaaggaacccggtctggagggtgtcattgcaattcaaggcagtcctattgatatgccagcggagacccagcatggcgtat

SEQ ID NO: 399209 - DNA, 140 bp, Artificial Sequence
  Synthetic
aggccctggctgctgatatgtgccaggacgaccgggtcctttcttggattaacccgctcaatgcctggagatttgggcgtgcccccgcaagactgctagccgagtagtgttgggtcgcgagaccttttgggacagcggtg

SEQ ID NO: 399210 - DNA, 140 bp, Artificial Sequence
  Synthetic
caccgctgtcccaaaaggtctcgcgacccaacactactcggctagcagtcttgcgggggcacgcccaaatctccaggcattgagcgggttaatccaagaaaggacccggtcgtcctggcacatatcagcagccagggcct

SEQ ID NO: 399211 - DNA, 140 bp, Artificial Sequence
  Synthetic
atacgccatgctgggtctccggcctactcggctgcattatcaccagtctcacaggccgggacaggaaccaggtcgagggggaggttcaagtagtttccactgcgacacaatctttcctggcgtacttgggagtcggccat

SEQ ID NO: 399212 - DNA, 140 bp, Artificial Sequence
  Synthetic
atggccgactcccaagtacgccaggaaagattgtgtcgcagtggaaactacttgaacctccccctcgacctggttcctgtcccggcctgtgagactggtgataatgcagccgagtaggccggagacccagcatggcgtat

SEQ ID NO: 399213 - DNA, 140 bp, Artificial Sequence
  Synthetic
atacgccatgctgggtctccggaacacactgacgtgctatcttaaggccagcgcagccatcagggctgcaggcctaaaagactgcaccatgctggtctgtggtgacgacttagtcgttatcgtacttgggagtcggccat

SEQ ID NO: 399214 - DNA, 140 bp, Artificial Sequence
  Synthetic
atggccgactcccaagtacgataacgactaagtcgtcaccacagaccagcatggtgcagtcttttaggcctgcagccctgatggctgcgctggccttaagatagcacgtcagtgtgttccggagacccagcatggcgtat

SEQ ID NO: 399215 - DNA, 140 bp, Artificial Sequence
  Synthetic
aggccctggctgctgatatgagacattccaagtggcccatctacacgctcccactggcagcggcaagagcactaaggtgccggctgcgtatgcagcccaagggtacaaggtgctcgtcctgaccttttgggacagcggtg

SEQ ID NO: 399216 - DNA, 140 bp, Artificial Sequence
  Synthetic
caccgctgtcccaaaaggtcaggacgagcaccttgtacccttgggctgcatacgcagccggcaccttagtgctcttgccgctgccagtgggagcgtgtagatgggccacttggaatgtctcatatcagcagccagggcct

SEQ ID NO: 399217 - DNA, 140 bp, Artificial Sequence
  Synthetic
aggccctggctgctgatatgtccgtgcatgcatgttggtgcggaaagccgccgggggtcattatgtccaaatggctctcatgaagctggccgcactgacgggcacgtacgtttatgaccagaccttttgggacagcggtg

SEQ ID NO: 399218 - DNA, 140 bp, Artificial Sequence
  Synthetic
caccgctgtcccaaaaggtctggtcataaacgtacgtgcccgtcagtgcggccagcttcatgagagccatttggacataatgacccccggcggctttccgcaccaacatgcatgcacggacatatcagcagccagggcct

SEQ ID NO: 399219 - DNA, 140 bp, Artificial Sequence
  Synthetic
aggccctggctgctgatatggcctgactgtgcccgcgtcagcctaccaagtacgcaactcctcgggcctttaccatgtcaccaatgattgccccaattcgagtattgtgtacgagacggcgaccttttgggacagcggtg

SEQ ID NO: 399220 - DNA, 140 bp, Artificial Sequence
  Synthetic
caccgctgtcccaaaaggtcgccgtctcgtacacaatactcgaattggggcaatcattggtgacatggtaaaggcccgaggagttgcgtacttggtaggctgacgcgggcacagtcaggccatatcagcagccagggcct

SEQ ID NO: 399221 - DNA, 140 bp, Artificial Sequence
  Synthetic
atacgccatgctgggtctccgattggcgcctgaacagggacttgaaggagagtgagagactcctgagtacggctgagtgaaggcagtaagggcggcaggaaccaaccacgacggagtgctcgtacttgggagtcggccat

SEQ ID NO: 399222 - DNA, 140 bp, Artificial Sequence
  Synthetic
atggccgactcccaagtacgagcactccgtcgtggttggttcctgccgcccttactgccttcactcagccgtactcaggagtctctcactctccttcaagtccctgttcaggcgccaatcggagacccagcatggcgtat

SEQ ID NO: 399223 - DNA, 140 bp, Artificial Sequence
  Synthetic
aggccctggctgctgatatgggctgagtgaaggcagtaagggcggcaggaaccaaccacgacggagtgctcctataaaggcgcgggtcggtaccagacggcgtgaggagcgggagaggaagaccttttgggacagcggtg

SEQ ID NO: 399224 - DNA, 140 bp, Artificial Sequence
  Synthetic
caccgctgtcccaaaaggtcttcctctcccgctcctcacgccgtctggtaccgacccgcgcctttataggagcactccgtcgtggttggttcctgccgcccttactgccttcactcagcccatatcagcagccagggcct

SEQ ID NO: 399225 - DNA, 140 bp, Artificial Sequence
  Synthetic
atacgccatgctgggtctcccctataaaggcgcgggtcggtaccagacggcgtgaggagcgggagaggaagaggcctccggttgcaggtaagtgcaacacaaaaaagaaatagctgtcttcgtacttgggagtcggccat

SEQ ID NO: 399226 - DNA, 140 bp, Artificial Sequence
  Synthetic
atggccgactcccaagtacgaagacagctatttcttttttgtgttgcacttacctgcaaccggaggcctcttcctctcccgctcctcacgccgtctggtaccgacccgcgcctttataggggagacccagcatggcgtat

SEQ ID NO: 399227 - DNA, 140 bp, Artificial Sequence
  Synthetic
atacgccatgctgggtctcctctatttggggcaacctcacatggcagcaatgggatcaggagatagacaatgtaagtgccaccatatttgaggaaatactaaaagcacaagtacagcaggcgtacttgggagtcggccat

SEQ ID NO: 399228 - DNA, 140 bp, Artificial Sequence
  Synthetic
atggccgactcccaagtacgcctgctgtacttgtgcttttagtatttcctcaaatatggtggcacttacattgtctatctcctgatcccattgctgccatgtgaggttgccccaaatagaggagacccagcatggcgtat

SEQ ID NO: 399229 - DNA, 140 bp, Artificial Sequence
  Synthetic
atacgccatgctgggtctccccgtcttgtcagggaagaaagcagatgaattagaaaaaattaggctacgacccaacggaaagaaaaagtacatgttgaagcatgtagtatgggcagcaaacgtacttgggagtcggccat

SEQ ID NO: 399230 - DNA, 140 bp, Artificial Sequence
  Synthetic
atggccgactcccaagtacgtttgctgcccatactacatgcttcaacatgtactttttctttccgttgggtcgtagcctaattttttctaattcatctgctttcttccctgacaagacggggagacccagcatggcgtat

SEQ ID NO: 399231 - DNA, 140 bp, Artificial Sequence
  Synthetic
aggccctggctgctgatatgcccaacggaaagaaaaagtacatgttgaagcatgtagtatgggcagcaaatgaattagatagatttggattagcagaaagcctgttggagaacaaagaaggaccttttgggacagcggtg

SEQ ID NO: 399232 - DNA, 140 bp, Artificial Sequence
  Synthetic
caccgctgtcccaaaaggtccttctttgttctccaacaggctttctgctaatccaaatctatctaattcatttgctgcccatactacatgcttcaacatgtactttttctttccgttgggcatatcagcagccagggcct

SEQ ID NO: 399233 - DNA, 140 bp, Artificial Sequence
  Synthetic
atacgccatgctgggtctcctagtgagaaacattaggcagggatatcaacccctctcgttccagatccccatccatcaccaatcggaagcagaaacgccaggaagaacaggagaaggaggcgtacttgggagtcggccat

SEQ ID NO: 399234 - DNA, 140 bp, Artificial Sequence
  Synthetic
atggccgactcccaagtacgcctccttctcctgttcttcctggcgtttctgcttccgattggtgatggatggggatctggaacgagaggggttgatatccctgcctaatgtttctcactaggagacccagcatggcgtat

SEQ ID NO: 399235 - DNA, 140 bp, Artificial Sequence
  Synthetic
atacgccatgctgggtctccgaaaatttaaaaagcctttataatactgtctgcgtcatctggtgcattcacgcagaagagaaagtgaaacacactgaggaagcaaaacagatagtgcagacgtacttgggagtcggccat

SEQ ID NO: 399236 - DNA, 140 bp, Artificial Sequence
  Synthetic
atggccgactcccaagtacgtctgcactatctgttttgcttcctcagtgtgtttcactttctcttctgcgtgaatgcaccagatgacgcagacagtattataaaggctttttaaattttcggagacccagcatggcgtat

SEQ ID NO: 399237 - DNA, 140 bp, Artificial Sequence
  Synthetic
aggccctggctgctgatatgcgcagaagagaaagtgaaacacactgaggaagcaaaacagatagtgcagagacacctagtggtggaaacaggaacaacagaaactatgccaaaaacaagtgaccttttgggacagcggtg

SEQ ID NO: 399238 - DNA, 140 bp, Artificial Sequence
  Synthetic
caccgctgtcccaaaaggtcacttgtttttggcatagtttctgttgttcctgtttccaccactaggtgtctctgcactatctgttttgcttcctcagtgtgtttcactttctcttctgcgcatatcagcagccagggcct

SEQ ID NO: 399239 - DNA, 140 bp, Artificial Sequence
  Synthetic
atacgccatgctgggtctccaataggtggtaactatgtccacctgccattaagcccgagaacattaaatgcctgggtaaaattgatagaggaaaagaaatttggagcagaagtagtgccacgtacttgggagtcggccat

SEQ ID NO: 399240 - DNA, 140 bp, Artificial Sequence
  Synthetic
atggccgactcccaagtacgtggcactacttctgctccaaatttcttttcctctatcaattttacccaggcatttaatgttctcgggcttaatggcaggtggacatagttaccacctattggagacccagcatggcgtat

SEQ ID NO: 399241 - DNA, 140 bp, Artificial Sequence
  Synthetic
aggccctggctgctgatatgcctgggtaaaattgatagaggaaaagaaatttggagcagaagtagtgccaggatttcaggcactgtcagaaggttgcaccccctatgacattaatcagatgaccttttgggacagcggtg

SEQ ID NO: 399242 - DNA, 140 bp, Artificial Sequence
  Synthetic
caccgctgtcccaaaaggtcatctgattaatgtcatagggggtgcaaccttctgacagtgcctgaaatcctggcactacttctgctccaaatttcttttcctctatcaattttacccaggcatatcagcagccagggcct

SEQ ID NO: 399243 - DNA, 140 bp, Artificial Sequence
  Synthetic
atacgccatgctgggtctccttataaacgaggaggctgcagattgggacttgcagcacccacaaccagctccacaacaaggacaacttagggagccgtcaggatcagatattgcaggaaccgtacttgggagtcggccat

SEQ ID NO: 399244 - DNA, 140 bp, Artificial Sequence
  Synthetic
atggccgactcccaagtacggttcctgcaatatctgatcctgacggctccctaagttgtccttgttgtggagctggttgtgggtgctgcaagtcccaatctgcagcctcctcgtttataaggagacccagcatggcgtat

SEQ ID NO: 399245 - DNA, 140 bp, Artificial Sequence
  Synthetic
aggccctggctgctgatatgccacaacaaggacaacttagggagccgtcaggatcagatattgcaggaacaactagttcagtagatgaacaaatccagtggatgtacagacaacagaaccgaccttttgggacagcggtg

SEQ ID NO: 399246 - DNA, 140 bp, Artificial Sequence
  Synthetic
caccgctgtcccaaaaggtcggttctgttgtctgtacatccactggatttgttcatctactgaactagttgttcctgcaatatctgatcctgacggctccctaagttgtccttgttgtggcatatcagcagccagggcct

SEQ ID NO: 399247 - DNA, 140 bp, Artificial Sequence
  Synthetic
atacgccatgctgggtctccaaatgtgtcagaatgtataacccaacaaacattctagatgtaaaacaagggccaaaagagccatttcagagctatgtagacaggttctacaaaagtttaacgtacttgggagtcggccat

SEQ ID NO: 399248 - DNA, 140 bp, Artificial Sequence
  Synthetic
atggccgactcccaagtacgttaaacttttgtagaacctgtctacatagctctgaaatggctcttttggcccttgttttacatctagaatgtttgttgggttatacattctgacacatttggagacccagcatggcgtat

SEQ ID NO: 399249 - DNA, 140 bp, Artificial Sequence
  Synthetic
aggccctggctgctgatatggccaaaagagccatttcagagctatgtagacaggttctacaaaagtttaagagcagaacagacagatgcagcagtaaagaattggatgactcaaacactggaccttttgggacagcggtg

SEQ ID NO: 399250 - DNA, 140 bp, Artificial Sequence
  Synthetic
caccgctgtcccaaaaggtccagtgtttgagtcatccaattctttactgctgcatctgtctgttctgctcttaaacttttgtagaacctgtctacatagctctgaaatggctcttttggccatatcagcagccagggcct

SEQ ID NO: 399251 - DNA, 140 bp, Artificial Sequence
  Synthetic
atacgccatgctgggtctcctgtgaatcccaccctagaagaaatgctgacggcttgtcaaggagtaggggggccgggacagaaggctagattaatggcagaagccctgaaagaggccctccgtacttgggagtcggccat

SEQ ID NO: 399252 - DNA, 140 bp, Artificial Sequence
  Synthetic
atggccgactcccaagtacggagggcctctttcagggcttctgccattaatctagccttctgtcccggcccccctactccttgacaagccgtcagcatttcttctagggtgggattcacaggagacccagcatggcgtat

SEQ ID NO: 399253 - DNA, 140 bp, Artificial Sequence
  Synthetic
aggccctggctgctgatatgggccgggacagaaggctagattaatggcagaagccctgaaagaggccctcgcaccagtgccaatcccttttgcagcagcccaacagaggggaccaagaaagaccttttgggacagcggtg

SEQ ID NO: 399254 - DNA, 140 bp, Artificial Sequence
  Synthetic
caccgctgtcccaaaaggtctttcttggtcccctctgttgggctgctgcaaaagggattggcactggtgcgagggcctctttcagggcttctgccattaatctagccttctgtcccggcccatatcagcagccagggcct

SEQ ID NO: 399255 - DNA, 140 bp, Artificial Sequence
  Synthetic
atacgccatgctgggtctccgcagagccccaagaagacagggatgctggaaatgtggaaaaatggaccatgttatggccaaatgcccagacagacaggcgggttttttaggccttggtcccgtacttgggagtcggccat

SEQ ID NO: 399256 - DNA, 140 bp, Artificial Sequence
  Synthetic
atggccgactcccaagtacgggaccaaggcctaaaaaacccgcctgtctgtctgggcatttggccataacatggtccatttttccacatttccagcatccctgtcttcttggggctctgcggagacccagcatggcgtat

SEQ ID NO: 399257 - DNA, 140 bp, Artificial Sequence
  Synthetic
aggccctggctgctgatatgaggcttaggcatttcctatggcaggaagaagcggagacaacgacgaagcgctcctccaagcagtaaggatcatcaaaatcctatatcaaagcagtaagtagaccttttgggacagcggtg

SEQ ID NO: 399258 - DNA, 140 bp, Artificial Sequence
  Synthetic
caccgctgtcccaaaaggtctacttactgctttgatataggattttgatgatccttactgcttggaggagcgcttcgtcgttgtctccgcttcttcctgccataggaaatgcctaagcctcatatcagcagccagggcct

SEQ ID NO: 399259 - DNA, 140 bp, Artificial Sequence
  Synthetic
aggccctggctgctgatatgttggaggaaatgaacaagtagataaattagtcagtagtggaatcaggaaagtactatttttagatggcatagataaagcccaagaagaacatgaaagatagaccttttgggacagcggtg

SEQ ID NO: 399260 - DNA, 140 bp, Artificial Sequence
  Synthetic
caccgctgtcccaaaaggtctatctttcatgttcttcttgggctttatctatgccatctaaaaatagtactttcctgattccactactgactaatttatctacttgttcatttcctccaacatatcagcagccagggcct

SEQ ID NO: 399261 - DNA, 140 bp, Artificial Sequence
  Synthetic
atacgccatgctgggtctcctacatgcagttgggcaagcagcagagagaaaagcagagagaaagcagagagaagccttacaaggaggtgacagaggatttgctgcacctcaattctctctcgtacttgggagtcggccat

SEQ ID NO: 399262 - DNA, 140 bp, Artificial Sequence
  Synthetic
atggccgactcccaagtacgagagagaattgaggtgcagcaaatcctctgtcacctccttgtaaggcttctctctgctttctctctgcttttctctctgctgcttgcccaactgcatgtaggagacccagcatggcgtat

SEQ ID NO: 399263 - DNA, 140 bp, Artificial Sequence
  Synthetic
aggccctggctgctgatatggaagccttacaaggaggtgacagaggatttgctgcacctcaattctctctttggaggagaccagtagtcactgctcatattgaaggacagcctgtagaaggaccttttgggacagcggtg

SEQ ID NO: 399264 - DNA, 140 bp, Artificial Sequence
  Synthetic
caccgctgtcccaaaaggtccttctacaggctgtccttcaatatgagcagtgactactggtctcctccaaagagagaattgaggtgcagcaaatcctctgtcacctccttgtaaggcttccatatcagcagccagggcct

SEQ ID NO: 399265 - DNA, 140 bp, Artificial Sequence
  Synthetic
atacgccatgctgggtctccggtccacattataccccaaaaatagtaggaggaataggaggttttattaatactaaagaatacaaaaatgtagaaatagaagttttaggcaaaaggattacgtacttgggagtcggccat

SEQ ID NO: 399266 - DNA, 140 bp, Artificial Sequence
  Synthetic
atggccgactcccaagtacgtaatccttttgcctaaaacttctatttctacatttttgtattctttagtattaataaaacctcctattcctcctactatttttggggtataatgtggaccggagacccagcatggcgtat

SEQ ID NO: 399267 - DNA, 140 bp, Artificial Sequence
  Synthetic
aggccctggctgctgatatgtactaaagaatacaaaaatgtagaaatagaagttttaggcaaaaggattaaagggacaatcatgacaggggacaccccgattaacatttttggtagaaatgaccttttgggacagcggtg

SEQ ID NO: 399268 - DNA, 140 bp, Artificial Sequence
  Synthetic
caccgctgtcccaaaaggtcatttctaccaaaaatgttaatcggggtgtcccctgtcatgattgtccctttaatccttttgcctaaaacttctatttctacatttttgtattctttagtacatatcagcagccagggcct

SEQ ID NO: 399269 - DNA, 140 bp, Artificial Sequence
  Synthetic
aggccctggctgctgatatgaatattccaatgtagcatgacaaaaatcttagatccctttagagcaaaaaatccagacctagttatctaccaatacatggatgatttgtatgtagggtctgaccttttgggacagcggtg

SEQ ID NO: 399270 - DNA, 140 bp, Artificial Sequence
  Synthetic
caccgctgtcccaaaaggtcagaccctacatacaaatcatccatgtattggtagataactaggtctggattttttgctctaaagggatctaagatttttgtcatgctacattggaatattcatatcagcagccagggcct

SEQ ID NO: 399271 - DNA, 140 bp, Artificial Sequence
  Synthetic
atacgccatgctgggtctccgcctgtaaaagtcgccttaaagccaggaaaggatggaccaaaattgaagcagtggccattatcaaaagaaaagatagttgcattaagagaaatctgtgaacgtacttgggagtcggccat

SEQ ID NO: 399272 - DNA, 140 bp, Artificial Sequence
  Synthetic
atggccgactcccaagtacgttcacagatttctcttaatgcaactatcttttcttttgataatggccactgcttcaattttggtccatcctttcctggctttaaggcgacttttacaggcggagacccagcatggcgtat

SEQ ID NO: 399273 - DNA, 140 bp, Artificial Sequence
  Synthetic
aggccctggctgctgatatgagtggccattatcaaaagaaaagatagttgcattaagagaaatctgtgaaaagatggaaaaggatggtcagttggaggaagctcccccgaccaatccatagaccttttgggacagcggtg

SEQ ID NO: 399274 - DNA, 140 bp, Artificial Sequence
  Synthetic
caccgctgtcccaaaaggtctatggattggtcgggggagcttcctccaactgaccatccttttccatcttttcacagatttctcttaatgcaactatcttttcttttgataatggccactcatatcagcagccagggcct

SEQ ID NO: 399275 - DNA, 140 bp, Artificial Sequence
  Synthetic
atacgccatgctgggtctccatgctagtaatcaaaatattactgacatgaaaagctgttctttcaatgcaaccacagaaataagagataagaaacataaagtgcaggcacttttctataacgtacttgggagtcggccat

SEQ ID NO: 399276 - DNA, 140 bp, Artificial Sequence
  Synthetic
atggccgactcccaagtacgttatagaaaagtgcctgcactttatgtttcttatctcttatttctgtggttgcattgaaagaacagcttttcatgtcagtaatattttgattactagcatggagacccagcatggcgtat

SEQ ID NO: 399277 - DNA, 140 bp, Artificial Sequence
  Synthetic
atacgccatgctgggtctcctgctgatagattttagggaactaaatagggtcactcaggactttacggaagtccaattaggaataccacaccctgcaggactagcaaaaaggaaaagaatcgtacttgggagtcggccat

SEQ ID NO: 399278 - DNA, 140 bp, Artificial Sequence
  Synthetic
atggccgactcccaagtacgattcttttcctttttgctagtcctgcagggtgtggtattcctaattggacttccgtaaagtcctgagtgaccctatttagttccctaaaatctatcagcaggagacccagcatggcgtat

SEQ ID NO: 399279 - DNA, 140 bp, Artificial Sequence
  Synthetic
aggccctggctgctgatatgaagtaaagcaattatgtaaactccttaggggagccaaggcactaacagacatagtgccactgactgcagaagcagagttagaattggcagagaatagggagaccttttgggacagcggtg

SEQ ID NO: 399280 - DNA, 140 bp, Artificial Sequence
  Synthetic
caccgctgtcccaaaaggtctccctattctctgccaattctaactctgcttctgcagtcagtggcactatgtctgttagtgccttggctcccctaaggagtttacataattgctttacttcatatcagcagccagggcct

SEQ ID NO: 399281 - DNA, 140 bp, Artificial Sequence
  Synthetic
atacgccatgctgggtctccccaggaaaacgatacatttataaggttctgcctcagggatggaaggggtcaccagccatcttccaatacactatgagacatgtgctagaacccttcaggacgtacttgggagtcggccat

SEQ ID NO: 399282 - DNA, 140 bp, Artificial Sequence
  Synthetic
atggccgactcccaagtacgtcctgaagggttctagcacatgtctcatagtgtattggaagatggctggtgaccccttccatccctgaggcagaaccttataaatgtatcgttttcctggggagacccagcatggcgtat

SEQ ID NO: 399283 - DNA, 140 bp, Artificial Sequence
  Synthetic
aggccctggctgctgatatgaccagccatcttccaatacactatgagacatgtgctagaacccttcaggaaggcaaatccagatgtgaccttagtccagtatatggatgacatcttaatagaccttttgggacagcggtg

SEQ ID NO: 399284 - DNA, 140 bp, Artificial Sequence
  Synthetic
caccgctgtcccaaaaggtctattaagatgtcatccatatactggactaaggtcacatctggatttgccttcctgaagggttctagcacatgtctcatagtgtattggaagatggctggtcatatcagcagccagggcct

SEQ ID NO: 399285 - DNA, 140 bp, Artificial Sequence
  Synthetic
atacgccatgctgggtctccgctgctgcaagccgtccggataataaagatcttgtaccagagcagtaagtagcgctaatgcatcatagggacctgctattattaataattattagtgcttcgtacttgggagtcggccat

SEQ ID NO: 399286 - DNA, 140 bp, Artificial Sequence
  Synthetic
atggccgactcccaagtacgaagcactaataattattaataatagcaggtccctatgatgcattagcgctacttactgctctggtacaagatctttattatccggacggcttgcagcagcggagacccagcatggcgtat

SEQ ID NO: 399287 - DNA, 140 bp, Artificial Sequence
  Synthetic
atacgccatgctgggtctccggaactcttgaatagcatagggttttctaccccagaagagaaattccaaaaagatcccccatttcaatggatggggtacgaattgtggccaacaaaatggcgtacttgggagtcggccat

SEQ ID NO: 399288 - DNA, 140 bp, Artificial Sequence
  Synthetic
atggccgactcccaagtacgccattttgttggccacaattcgtaccccatccattgaaatgggggatctttttggaatttctcttctggggtagaaaaccctatgctattcaagagttccggagacccagcatggcgtat

SEQ ID NO: 399289 - DNA, 140 bp, Artificial Sequence
  Synthetic
aggccctggctgctgatatgaagatcccccatttcaatggatggggtacgaattgtggccaacaaaatggaagttgcaaaagatagagttgccacaaagagagacctggacagtgaatgagaccttttgggacagcggtg

SEQ ID NO: 399290 - DNA, 140 bp, Artificial Sequence
  Synthetic
caccgctgtcccaaaaggtctcattcactgtccaggtctctctttgtggcaactctatcttttgcaacttccattttgttggccacaattcgtaccccatccattgaaatgggggatcttcatatcagcagccagggcct

SEQ ID NO: 399291 - DNA, 140 bp, Artificial Sequence
  Synthetic
atacgccatgctgggtctccgtataaaaaccaaacatctctgtaggttaattagaggaaaaatgactctaacagaggaagttcagtggactgagatggcagaagcagaatatgaggaaaacgtacttgggagtcggccat

SEQ ID NO: 399292 - DNA, 140 bp, Artificial Sequence
  Synthetic
atggccgactcccaagtacgttttcctcatattctgcttctgccatctcagtccactgaacttcctctgttagagtcatttttcctctaattaacctacagagatgtttggtttttatacggagacccagcatggcgtat

SEQ ID NO: 399293 - DNA, 140 bp, Artificial Sequence
  Synthetic
aggccctggctgctgatatgacagaggaagttcagtggactgagatggcagaagcagaatatgaggaaaataaaataattctcagtcaggaacaagaaggatgttattaccaagaaggcagaccttttgggacagcggtg

SEQ ID NO: 399294 - DNA, 140 bp, Artificial Sequence
  Synthetic
caccgctgtcccaaaaggtctgccttcttggtaataacatccttcttgttcctgactgagaattattttattttcctcatattctgcttctgccatctcagtccactgaacttcctctgtcatatcagcagccagggcct

SEQ ID NO: 399295 - DNA, 140 bp, Artificial Sequence
  Synthetic
atacgccatgctgggtctccaaaattcaccaagaagacaaaatactgaaagtaggaaaatttgcaaagataaagaatacacataccaatggagtgagactattagcacatgtaatacagacgtacttgggagtcggccat

SEQ ID NO: 399296 - DNA, 140 bp, Artificial Sequence
  Synthetic
atggccgactcccaagtacgtctgtattacatgtgctaatagtctcactccattggtatgtgtattctttatctttgcaaattttcctactttcagtattttgtcttcttggtgaattttggagacccagcatggcgtat

SEQ ID NO: 399297 - DNA, 140 bp, Artificial Sequence
  Synthetic
aggccctggctgctgatatgaaagaatacacataccaatggagtgagactattagcacatgtaatacagaaaataggaaaggaagcaatagtgatctggggacaggtcccaaaattccacgaccttttgggacagcggtg

SEQ ID NO: 399298 - DNA, 140 bp, Artificial Sequence
  Synthetic
caccgctgtcccaaaaggtcgtggaattttgggacctgtccccagatcactattgcttcctttcctattttctgtattacatgtgctaatagtctcactccattggtatgtgtattctttcatatcagcagccagggcct

SEQ ID NO: 399299 - DNA, 140 bp, Artificial Sequence
  Synthetic
atacgccatgctgggtctccggtaacctggataccggaatgggattttatctcaacaccaccgctagtaagattagtcttcaatctagtgaaggaccctatagagggagaagaaacctatcgtacttgggagtcggccat

SEQ ID NO: 399300 - DNA, 140 bp, Artificial Sequence
  Synthetic
atggccgactcccaagtacgataggtttcttctccctctatagggtccttcactagattgaagactaatcttactagcggtggtgttgagataaaatcccattccggtatccaggttaccggagacccagcatggcgtat

SEQ ID NO: 399301 - DNA, 140 bp, Artificial Sequence
  Synthetic
aggccctggctgctgatatggattagtcttcaatctagtgaaggaccctatagagggagaagaaacctattatacagatggatcatgtaataaacagtcaaaagaagggaaagcaggatagaccttttgggacagcggtg

SEQ ID NO: 399302 - DNA, 140 bp, Artificial Sequence
  Synthetic
caccgctgtcccaaaaggtctatcctgctttcccttcttttgactgtttattacatgatccatctgtataataggtttcttctccctctatagggtccttcactagattgaagactaatccatatcagcagccagggcct

SEQ ID NO: 399303 - DNA, 140 bp, Artificial Sequence
  Synthetic
atacgccatgctgggtctccatcaacaagcagaattggaagcatttctcatggcattgacagactcagggccaaaggcaaatattatagtagattcacaatatgttatgggaataataaccgtacttgggagtcggccat

SEQ ID NO: 399304 - DNA, 140 bp, Artificial Sequence
  Synthetic
atggccgactcccaagtacggttattattcccataacatattgtgaatctactataatatttgcctttggccctgagtctgtcaatgccatgagaaatgcttccaattctgcttgttgatggagacccagcatggcgtat

SEQ ID NO: 399305 - DNA, 140 bp, Artificial Sequence
  Synthetic
aggccctggctgctgatatgccaaaggcaaatattatagtagattcacaatatgttatgggaataataacaggatgccctacagaatcagagagcaggctagttaatcaaataatagaaggaccttttgggacagcggtg

SEQ ID NO: 399306 - DNA, 140 bp, Artificial Sequence
  Synthetic
caccgctgtcccaaaaggtccttctattatttgattaactagcctgctctctgattctgtagggcatcctgttattattcccataacatattgtgaatctactataatatttgcctttggcatatcagcagccagggcct

SEQ ID NO: 399307 - DNA, 140 bp, Artificial Sequence
  Synthetic
atacgccatgctgggtctccggtataggaggaaaccaagaaatagaccacctagttagtcaagggattagacaagttctcttcttggaaaagatagagccagcacaagaagaacatgatacgtacttgggagtcggccat

SEQ ID NO: 399308 - DNA, 140 bp, Artificial Sequence
  Synthetic
atggccgactcccaagtacgtatcatgttcttcttgtgctggctctatcttttccaagaagagaacttgtctaatcccttgactaactaggtggtctatttcttggtttcctcctataccggagacccagcatggcgtat

SEQ ID NO: 399309 - DNA, 140 bp, Artificial Sequence
  Synthetic
aggccctggctgctgatatgacaagttctcttcttggaaaagatagagccagcacaagaagaacatgataaataccatagtaatgtaaaagaattggtattcaaatttggattacccagagaccttttgggacagcggtg

SEQ ID NO: 399310 - DNA, 140 bp, Artificial Sequence
  Synthetic
caccgctgtcccaaaaggtctctgggtaatccaaatttgaataccaattcttttacattactatggtatttatcatgttcttcttgtgctggctctatcttttccaagaagagaacttgtcatatcagcagccagggcct

SEQ ID NO: 399311 - DNA, 140 bp, Artificial Sequence
  Synthetic
atacgccatgctgggtctccagaggctatacatgggcaggcaaattcagatctagggacttggcaaatggattgtacccatctagagggaaaaataatcatagttgcagtacatgtagctcgtacttgggagtcggccat

SEQ ID NO: 399312 - DNA, 140 bp, Artificial Sequence
  Synthetic
atggccgactcccaagtacgagctacatgtactgcaactatgattatttttccctctagatgggtacaatccatttgccaagtccctagatctgaatttgcctgcccatgtatagcctctggagacccagcatggcgtat

SEQ ID NO: 399313 - DNA, 140 bp, Artificial Sequence
  Synthetic
aggccctggctgctgatatgattgtacccatctagagggaaaaataatcatagttgcagtacatgtagctagtggattcatagaagcagaggtaattccacaagagacaggaagacagacgaccttttgggacagcggtg

SEQ ID NO: 399314 - DNA, 140 bp, Artificial Sequence
  Synthetic
caccgctgtcccaaaaggtcgtctgtcttcctgtctcttgtggaattacctctgcttctatgaatccactagctacatgtactgcaactatgattatttttccctctagatgggtacaatcatatcagcagccagggcct

SEQ ID NO: 399315 - DNA, 140 bp, Artificial Sequence
  Synthetic
atacgccatgctgggtctccacacagataatggtgctaactttgcttcgcaagaagtaaagatggttgcatggtgggcagggatagagcacacctttggggtaccatacaatccacagagcgtacttgggagtcggccat

SEQ ID NO: 399316 - DNA, 140 bp, Artificial Sequence
  Synthetic
atggccgactcccaagtacgctctgtggattgtatggtaccccaaaggtgtgctctatccctgcccaccatgcaaccatctttacttcttgcgaagcaaagttagcaccattatctgtgtggagacccagcatggcgtat

SEQ ID NO: 399317 - DNA, 140 bp, Artificial Sequence
  Synthetic
atacgccatgctgggtctcctaataatagtaataactatagtgactataggctaataaattgtaatgtctcagccattaaacaggcttgtccaaaggtgtcttttgatccaattcccatacgtacttgggagtcggccat

SEQ ID NO: 399318 - DNA, 140 bp, Artificial Sequence
  Synthetic
atggccgactcccaagtacgtatgggaattggatcaaaagacacctttggacaagcctgtttaatggctgagacattacaatttattagcctatagtcactatagttattactattattaggagacccagcatggcgtat

SEQ ID NO: 399319 - DNA, 140 bp, Artificial Sequence
  Synthetic
atacgccatgctgggtctcccattgcatgaattttaaaagaaggggaggaataggggatatgactccagcagaaagattaattaacatgatcactacagaacaagagatacaatttcaaccgtacttgggagtcggccat

SEQ ID NO: 399320 - DNA, 140 bp, Artificial Sequence
  Synthetic
atggccgactcccaagtacggttgaaattgtatctcttgttctgtagtgatcatgttaattaatctttctgctggagtcatatcccctattcctccccttcttttaaaattcatgcaatgggagacccagcatggcgtat

SEQ ID NO: 399321 - DNA, 140 bp, Artificial Sequence
  Synthetic
aggccctggctgctgatatgagaaagattaattaacatgatcactacagaacaagagatacaatttcaacaatcaaaaaactcaaaatttaaaaattttcgggtctattacagagaaggcgaccttttgggacagcggtg

SEQ ID NO: 399322 - DNA, 140 bp, Artificial Sequence
  Synthetic
caccgctgtcccaaaaggtcgccttctctgtaatagacccgaaaatttttaaattttgagttttttgattgttgaaattgtatctcttgttctgtagtgatcatgttaattaatctttctcatatcagcagccagggcct

SEQ ID NO: 399323 - DNA, 140 bp, Artificial Sequence
  Synthetic
atacgccatgctgggtctccagcagtcatcttaaaggtagggacagacattaaggtagtacccagaagaaaggctaaaattatcaaagattatggaggaggaaaagaggtggatagcagtcgtacttgggagtcggccat

SEQ ID NO: 399324 - DNA, 140 bp, Artificial Sequence
  Synthetic
atggccgactcccaagtacgactgctatccacctcttttcctcctccataatctttgataattttagcctttcttctgggtactaccttaatgtctgtccctacctttaagatgactgctggagacccagcatggcgtat

SEQ ID NO: 399325 - DNA, 140 bp, Artificial Sequence
  Synthetic
aggccctggctgctgatatgaggctaaaattatcaaagattatggaggaggaaaagaggtggatagcagttcccacatggaggataccggagaggctagagaggtggcatagcctcataagaccttttgggacagcggtg

SEQ ID NO: 399326 - DNA, 140 bp, Artificial Sequence
  Synthetic
caccgctgtcccaaaaggtcttatgaggctatgccacctctctagcctctccggtatcctccatgtgggaactgctatccacctcttttcctcctccataatctttgataattttagcctcatatcagcagccagggcct

SEQ ID NO: 399327 - DNA, 140 bp, Artificial Sequence
  Synthetic
atacgccatgctgggtctcccattttaaggtcggatgggcatggtggacctgcagcagagtaatcttcccactacaggaaggaagccatttagaagtacaagggtattggcatttgacaccgtacttgggagtcggccat

SEQ ID NO: 399328 - DNA, 140 bp, Artificial Sequence
  Synthetic
atggccgactcccaagtacggtgtcaaatgccaatacccttgtacttctaaatggcttccttcctgtagtgggaagattactctgctgcaggtccaccatgcccatccgaccttaaaatgggagacccagcatggcgtat

SEQ ID NO: 399329 - DNA, 140 bp, Artificial Sequence
  Synthetic
aggccctggctgctgatatgactacaggaaggaagccatttagaagtacaagggtattggcatttgacaccagaaaaagggtggctcagtacttatgcagtgaggataacctggtactcagaccttttgggacagcggtg

SEQ ID NO: 399330 - DNA, 140 bp, Artificial Sequence
  Synthetic
caccgctgtcccaaaaggtctgagtaccaggttatcctcactgcataagtactgagccaccctttttctggtgtcaaatgccaatacccttgtacttctaaatggcttccttcctgtagtcatatcagcagccagggcct

SEQ ID NO: 399331 - DNA, 140 bp, Artificial Sequence
  Synthetic
aggccctggctgctgatatgtttcattgttactggtgctttacaacgaagggcttaggcatctcctatggcaggaagaagcggagacagcgacacagaactcctcaaagcagtcagatacgaccttttgggacagcggtg

SEQ ID NO: 399332 - DNA, 140 bp, Artificial Sequence
  Synthetic
caccgctgtcccaaaaggtcgtatctgactgctttgaggagttctgtgtcgctgtctccgcttcttcctgccataggagatgcctaagcccttcgttgtaaagcaccagtaacaatgaaacatatcagcagccagggcct

SEQ ID NO: 399333 - DNA, 140 bp, Artificial Sequence
  Synthetic
aggccctggctgctgatatgggggagaacaactgctgtcttgctgcaggttcccgagagctcataagtaccaggtaccaagcctacagtacttagcactgaaagtagtaagcgatgtcaggaccttttgggacagcggtg

SEQ ID NO: 399334 - DNA, 140 bp, Artificial Sequence
  Synthetic
caccgctgtcccaaaaggtcctgacatcgcttactactttcagtgctaagtactgtaggcttggtacctggtacttatgagctctcgggaacctgcagcaagacagcagttgttctcccccatatcagcagccagggcct

SEQ ID NO: 399335 - DNA, 140 bp, Artificial Sequence
  Synthetic
atacgccatgctgggtctccgaggccttcgaatggctaaacagaacagtagaggagataaacagagaggcggtaaaccacctaccaagggagctaattttccaggtttggcaaaggtcttcgtacttgggagtcggccat

SEQ ID NO: 399336 - DNA, 140 bp, Artificial Sequence
  Synthetic
atggccgactcccaagtacgaagacctttgccaaacctggaaaattagctcccttggtaggtggtttaccgcctctctgtttatctcctctactgttctgtttagccattcgaaggcctcggagacccagcatggcgtat

SEQ ID NO: 399337 - DNA, 140 bp, Artificial Sequence
  Synthetic
aggccctggctgctgatatgggtaaaccacctaccaagggagctaattttccaggtttggcaaaggtcttgggaatactggcatgatgaacaagggatgtcaccaagctatgtaaaatacgaccttttgggacagcggtg

SEQ ID NO: 399338 - DNA, 140 bp, Artificial Sequence
  Synthetic
caccgctgtcccaaaaggtcgtattttacatagcttggtgacatcccttgttcatcatgccagtattcccaagacctttgccaaacctggaaaattagctcccttggtaggtggtttacccatatcagcagccagggcct

SEQ ID NO: 399339 - DNA, 140 bp, Artificial Sequence
  Synthetic
atacgccatgctgggtctccctgtagatgtctaggggaaggacatggggcagggggatggagaccaggacctcctcctcctccccctccaggactagcataaatggaagaaagacctccacgtacttgggagtcggccat

SEQ ID NO: 399340 - DNA, 140 bp, Artificial Sequence
  Synthetic
atggccgactcccaagtacgtggaggtctttcttccatttatgctagtcctggagggggaggaggaggaggtcctggtctccatccccctgccccatgtccttcccctagacatctacagggagacccagcatggcgtat

SEQ ID NO: 399341 - DNA, 140 bp, Artificial Sequence
  Synthetic
aggccctggctgctgatatgctcctcctcctccccctccaggactagcataaatggaagaaagacctccagaaaatgaaggaccacaaagggaaccatgggatgaatgggtagtggaggtgaccttttgggacagcggtg

SEQ ID NO: 399342 - DNA, 140 bp, Artificial Sequence
  Synthetic
caccgctgtcccaaaaggtcacctccactacccattcatcccatggttccctttgtggtccttcattttctggaggtctttcttccatttatgctagtcctggagggggaggaggaggagcatatcagcagccagggcct

SEQ ID NO: 399343 - DNA, 140 bp, Artificial Sequence
  Synthetic
aggccctggctgctgatatgacactagttggagtaataaatcttataatgaaatttgggacaacatgacctggatagaatgggagagggaaattaacaattacacacaacaaatatacacgaccttttgggacagcggtg

SEQ ID NO: 399344 - DNA, 140 bp, Artificial Sequence
  Synthetic
caccgctgtcccaaaaggtcgtgtatatttgttgtgtgtaattgttaatttccctctcccattctatccaggtcatgttgtcccaaatttcattataagatttattactccaactagtgtcatatcagcagccagggcct

SEQ ID NO: 399345 - DNA, 140 bp, Artificial Sequence
  Synthetic
atacgccatgctgggtctcctaactgcacttggtaatcatatctataatcgtcacggagacactctagagggagcaggagaactcattagaatcctccaacgagcgctcttcatgcatttcgtacttgggagtcggccat

SEQ ID NO: 399346 - DNA, 140 bp, Artificial Sequence
  Synthetic
atggccgactcccaagtacgaaatgcatgaagagcgctcgttggaggattctaatgagttctcctgctccctctagagtgtctccgtgacgattatagatatgattaccaagtgcagttaggagacccagcatggcgtat

SEQ ID NO: 399347 - DNA, 140 bp, Artificial Sequence
  Synthetic
aggccctggctgctgatatgggagcaggagaactcattagaatcctccaacgagcgctcttcatgcatttcagaggcggatgcatccactccagaatcggccaacctgggggaggaaatcgaccttttgggacagcggtg

SEQ ID NO: 399348 - DNA, 140 bp, Artificial Sequence
  Synthetic
caccgctgtcccaaaaggtcgatttcctcccccaggttggccgattctggagtggatgcatccgcctctgaaatgcatgaagagcgctcgttggaggattctaatgagttctcctgctcccatatcagcagccagggcct

SEQ ID NO: 399349 - DNA, 140 bp, Artificial Sequence
  Synthetic
aggccctggctgctgatatgaaaactgcttgtaccaattgctattgtaaaaagtgttgctttcattgccaagtttgtttcataacaaaagccttaggcatctcctatggcaggaagaagcgaccttttgggacagcggtg

SEQ ID NO: 399350 - DNA, 140 bp, Artificial Sequence
  Synthetic
caccgctgtcccaaaaggtcgcttcttcctgccataggagatgcctaaggcttttgttatgaaacaaacttggcaatgaaagcaacactttttacaatagcaattggtacaagcagttttcatatcagcagccagggcct

SEQ ID NO: 399351 - DNA, 140 bp, Artificial Sequence
  Synthetic
aggccctggctgctgatatgagtagcattagtagtagcaataataatagcaatagttgtgtggtccatagtaatcatagaatataggaaaatattaagacaaagaaaaatagacaggttagaccttttgggacagcggtg

SEQ ID NO: 399352 - DNA, 140 bp, Artificial Sequence
  Synthetic
caccgctgtcccaaaaggtctaacctgtctatttttctttgtcttaatattttcctatattctatgattactatggaccacacaactattgctattattattgctactactaatgctactcatatcagcagccagggcct

SEQ ID NO: 399353 - DNA, 140 bp, Artificial Sequence
  Synthetic
atacgccatgctgggtctcctaaatgatatacaaaagctagtaggaaaattaaattgggcaagtcaaatttatccaggaatcagagtaagagaattatgtaaactaattagaggcaccaacgtacttgggagtcggccat

SEQ ID NO: 399354 - DNA, 140 bp, Artificial Sequence
  Synthetic
atggccgactcccaagtacgttggtgcctctaattagtttacataattctcttactctgattcctggataaatttgacttgcccaatttaattttcctactagcttttgtatatcatttaggagacccagcatggcgtat

SEQ ID NO: 399355 - DNA, 140 bp, Artificial Sequence
  Synthetic
atacgccatgctgggtctccaataccaatagtaatagttggggagagatggagaaaggagaaataaaaaactgctctttcaatatcaccacaaacataagagacaaggtgacaaaagaatcgtacttgggagtcggccat

SEQ ID NO: 399356 - DNA, 140 bp, Artificial Sequence
  Synthetic
atggccgactcccaagtacgattcttttgtcaccttgtctcttatgtttgtggtgatattgaaagagcagttttttatttctcctttctccatctctccccaactattactattggtattggagacccagcatggcgtat

SEQ ID NO: 399357 - DNA, 140 bp, Artificial Sequence
  Synthetic
aggccctggctgctgatatgggggcatcaagcagctatgcaaatgctaaaggatactatcaatgaggaagctgcagagtgggacaggctacacccacagcaggcagggcctatcccaccagaccttttgggacagcggtg

SEQ ID NO: 399358 - DNA, 140 bp, Artificial Sequence
  Synthetic
caccgctgtcccaaaaggtctggtgggataggccctgcctgctgtgggtgtagcctgtcccactctgcagcttcctcattgatagtatcctttagcatttgcatagctgcttgatgcccccatatcagcagccagggcct

SEQ ID NO: 399359 - DNA, 140 bp, Artificial Sequence
  Synthetic
atacgccatgctgggtctccaatataagctttaattcaagctcaggaggggacctagaagttacaacacatagttttaattgtagaggagaatttttctactgcaatacaacacaactgtcgtacttgggagtcggccat

SEQ ID NO: 399360 - DNA, 140 bp, Artificial Sequence
  Synthetic
atggccgactcccaagtacgacagttgtgttgtattgcagtagaaaaattctcctctacaattaaaactatgtgttgtaacttctaggtcccctcctgagcttgaattaaagcttatattggagacccagcatggcgtat

SEQ ID NO: 399361 - DNA, 140 bp, Artificial Sequence
  Synthetic
atacgccatgctgggtctccgacatagtaattagatctgaaaatttcacagacaatgctaaaaccataatagtacagctaaatgaatctgtagtaattaattgtacaagacccaacaacacgtacttgggagtcggccat

SEQ ID NO: 399362 - DNA, 140 bp, Artificial Sequence
  Synthetic
atggccgactcccaagtacgtgttgttgggtcttgtacaattaattactacagattcatttagctgtactattatggttttagcattgtctgtgaaattttcagatctaattactatgtcggagacccagcatggcgtat

SEQ ID NO: 399363 - DNA, 140 bp, Artificial Sequence
  Synthetic
atacgccatgctgggtctccgttacaggtatcaaggcagagaaaaatattacagataatagtataaaggaagaaataaaaaactgctctttcaatgtcacaagcatagggaataaggtgccgtacttgggagtcggccat

SEQ ID NO: 399364 - DNA, 140 bp, Artificial Sequence
  Synthetic
atggccgactcccaagtacggcaccttattccctatgcttgtgacattgaaagagcagttttttatttcttcctttatactattatctgtaatatttttctctgccttgatacctgtaacggagacccagcatggcgtat

SEQ ID NO: 399365 - DNA, 140 bp, Artificial Sequence
  Synthetic
aggccctggctgctgatatgttaggaataaaacaatagcctttaatcaatcctcaggaggggacccagaaattgtaatgcacagttttaattgtggaggggaatttttctactgtaatacgaccttttgggacagcggtg

SEQ ID NO: 399366 - DNA, 140 bp, Artificial Sequence
  Synthetic
caccgctgtcccaaaaggtcgtattacagtagaaaaattcccctccacaattaaaactgtgcattacaatttctgggtcccctcctgaggattgattaaaggctattgttttattcctaacatatcagcagccagggcct

SEQ ID NO: 399367 - DNA, 140 bp, Artificial Sequence
  Synthetic
aggccctggctgctgatatgcaaggggaggccagggaattttcttcagagcaggccagagccaacagccccacctgcagagagcttcgggttcggagaggagatagccccctccccgaaggaccttttgggacagcggtg

SEQ ID NO: 399368 - DNA, 140 bp, Artificial Sequence
  Synthetic
caccgctgtcccaaaaggtccttcggggagggggctatctcctctccgaacccgaagctctctgcaggtggggctgttggctctggcctgctctgaagaaaattccctggcctccccttgcatatcagcagccagggcct

SEQ ID NO: 399369 - DNA, 140 bp, Artificial Sequence
  Synthetic
aggccctggctgctgatatgaagacccaacaacaatacaagaaaaagtataaatatgggaccagggagagcattttatgcaacaggagatataataggagatataagacaagcacattgtgaccttttgggacagcggtg

SEQ ID NO: 399370 - DNA, 140 bp, Artificial Sequence
  Synthetic
caccgctgtcccaaaaggtcacaatgtgcttgtcttatatctcctattatatctcctgttgcataaaatgctctccctggtcccatatttatactttttcttgtattgttgttgggtcttcatatcagcagccagggcct

SEQ ID NO: 399371 - DNA, 140 bp, Artificial Sequence
  Synthetic
aggccctggctgctgatatgggatagagaaattagtaattacacagacataatatacaggttgcttgaagactcgcaaagccagcaggagaaaaatgaaaaggatttattagcattggacgaccttttgggacagcggtg

SEQ ID NO: 399372 - DNA, 140 bp, Artificial Sequence
  Synthetic
caccgctgtcccaaaaggtcgtccaatgctaataaatccttttcatttttctcctgctggctttgcgagtcttcaagcaacctgtatattatgtctgtgtaattactaatttctctatcccatatcagcagccagggcct

SEQ ID NO: 399373 - DNA, 140 bp, Artificial Sequence
  Synthetic
atacgccatgctgggtctccaagttgtcaaaaagtaagatagtaggatggtccactataagggaaagaataagacgagccccagctccggcagcagacggggtgggagcagcatctcaagcgtacttgggagtcggccat

SEQ ID NO: 399374 - DNA, 140 bp, Artificial Sequence
  Synthetic
atggccgactcccaagtacgcttgagatgctgctcccaccccgtctgctgccggagctggggctcgtcttattctttcccttatagtggaccatcctactatcttactttttgacaacttggagacccagcatggcgtat

SEQ ID NO: 399375 - DNA, 140 bp, Artificial Sequence
  Synthetic
aggccctggctgctgatatgtcctgatagtatggcaagtggacagacagaaagtgaaagcgtggaacagcctggtgaaataccataagtataggactaggaaggccagggattggtcttagaccttttgggacagcggtg

SEQ ID NO: 399376 - DNA, 140 bp, Artificial Sequence
  Synthetic
caccgctgtcccaaaaggtctaagaccaatccctggccttcctagtcctatacttatggtatttcaccaggctgttccacgctttcactttctgtctgtccacttgccatactatcaggacatatcagcagccagggcct

SEQ ID NO: 399377 - DNA, 140 bp, Artificial Sequence
  Synthetic
atacgccatgctgggtctcctggaaagggcacctgaggatcacggaccagctagagagccattcaatgaatgggtactagagaccctagaagagctaaaagcagaggcagtaagacacttcgtacttgggagtcggccat

SEQ ID NO: 399378 - DNA, 140 bp, Artificial Sequence
  Synthetic
atggccgactcccaagtacgaagtgtcttactgcctctgcttttagctcttctagggtctctagtacccattcattgaatggctctctagctggtccgtgatcctcaggtgccctttccaggagacccagcatggcgtat

SEQ ID NO: 399379 - DNA, 140 bp, Artificial Sequence
  Synthetic
aggccctggctgctgatatgaggaacagataggattatagaatttatacaaagaatttgtagagctatccgcaacatacctagaagaataagacagggctttgaagcagctttgctataagaccttttgggacagcggtg

SEQ ID NO: 399380 - DNA, 140 bp, Artificial Sequence
  Synthetic
caccgctgtcccaaaaggtcttatagcaaagctgcttcaaagccctgtcttattcttctaggtatgttgcggatagctctacaaattctttgtataaattctataatcctatctgttcctcatatcagcagccagggcct

SEQ ID NO: 399381 - DNA, 140 bp, Artificial Sequence
  Synthetic
aggccctggctgctgatatgactcatctgcaccactactgtgccttggaatactagttggagtaacaggtctttggataacatttggcagaacatgacttggatggagtgggagagagaagaccttttgggacagcggtg

SEQ ID NO: 399382 - DNA, 140 bp, Artificial Sequence
  Synthetic
caccgctgtcccaaaaggtcttctctctcccactccatccaagtcatgttctgccaaatgttatccaaagacctgttactccaactagtattccaaggcacagtagtggtgcagatgagtcatatcagcagccagggcct

SEQ ID NO: 399383 - DNA, 140 bp, Artificial Sequence
  Synthetic
aggccctggctgctgatatgataatgctgattgtgcctggctagaagcacaagaggaggaggaagtgggttttccagtcagacctcaggtacctttaagaccaatgactttcaagggagcgaccttttgggacagcggtg

SEQ ID NO: 399384 - DNA, 140 bp, Artificial Sequence
  Synthetic
caccgctgtcccaaaaggtcgctcccttgaaagtcattggtcttaaaggtacctgaggtctgactggaaaacccacttcctcctcctcttgtgcttctagccaggcacaatcagcattatcatatcagcagccagggcct

SEQ ID NO: 399385 - DNA, 140 bp, Artificial Sequence
  Synthetic
  misc_feature (34)..(34): n is a, c, g, or t
  misc_feature (96)..(96): n is a, c, g, or t
  misc_feature (101)..(101): n is a, c, g, or t
atacgccatgctgggtctccactacgcgtcatcnggatcataaacatcttgtaccaaagcagtaagtaacgctaatgcatcatagggacctgctanctttnataattattagtgctttgccgtacttgggagtcggccat

SEQ ID NO: 399386 - DNA, 140 bp, Artificial Sequence
  Synthetic
  misc_feature (40)..(40): n is a, c, g, or t
  misc_feature (45)..(45): n is a, c, g, or t
  misc_feature (107)..(107): n is a, c, g, or t
atggccgactcccaagtacggcaaagcactaataattatnaaagntagcaggtccctatgatgcattagcgttacttactgctttggtacaagatgtttatgatccngatgacgcgtagtggagacccagcatggcgtat

SEQ ID NO: 399387 - DNA, 140 bp, Artificial Sequence
  Synthetic
  misc_feature (46)..(46): n is a, c, g, or t
  misc_feature (51)..(51): n is a, c, g, or t
  misc_feature (74)..(74): n is a, c, g, or t
  misc_feature (114)..(114): n is a, c, g, or t
  misc_feature (117)..(117): n is a, c, g, or t
aggccctggctgctgatatggctaatgcatcatagggacctgctanctttnataattattagtgctttgctgantataaatgtaattctatggatgtttattcttagacaatanttnaaagaccttttgggacagcggtg

SEQ ID NO: 399388 - DNA, 140 bp, Artificial Sequence
  Synthetic
  misc_feature (24)..(24): n is a, c, g, or t
  misc_feature (27)..(27): n is a, c, g, or t
  misc_feature (67)..(67): n is a, c, g, or t
  misc_feature (90)..(90): n is a, c, g, or t
  misc_feature (95)..(95): n is a, c, g, or t
caccgctgtcccaaaaggtctttnaantattgtctaagaataaacatccatagaattacatttatantcagcaaagcactaataattatnaaagntagcaggtccctatgatgcattagccatatcagcagccagggcct

SEQ ID NO: 399389 - DNA, 140 bp, Artificial Sequence
  Synthetic
aggccctggctgctgatatgttatgggagactcttaggagaggtggaagatggatactcgcaatccccaggaggattagacaagggcttgagctcactctcttgtgagggacagaaatacgaccttttgggacagcggtg

SEQ ID NO: 399390 - DNA, 140 bp, Artificial Sequence
  Synthetic
caccgctgtcccaaaaggtcgtatttctgtccctcacaagagagtgagctcaagcccttgtctaatcctcctggggattgcgagtatccatcttccacctctcctaagagtctcccataacatatcagcagccagggcct

SEQ ID NO: 399391 - DNA, 140 bp, Artificial Sequence
  Synthetic
atacgccatgctgggtctcctggattcttagcactcgtgtgggacgacctgaggagcctgtgcctcttcagctaccgccacttgagaaacttactcttgattctcgcgaggactctggagcgtacttgggagtcggccat

SEQ ID NO: 399392 - DNA, 140 bp, Artificial Sequence
  Synthetic
atggccgactcccaagtacgctccagagtcctcgcgagaatcaagagtaagtttctcaagtggcggtagctgaagaggcacaggctcctcaggtcgtcccacacgagtgctaagaatccaggagacccagcatggcgtat

SEQ ID NO: 399393 - DNA, 140 bp, Artificial Sequence
  Synthetic
aggccctggctgctgatatgaacaggaagttagagatcttgtacatagtcatgggtttgataatcccatgtttgagctctaataagatgtatgcaacagtctatgctggggtacctgtgtgaccttttgggacagcggtg

SEQ ID NO: 399394 - DNA, 140 bp, Artificial Sequence
  Synthetic
caccgctgtcccaaaaggtcacacaggtaccccagcatagactgttgcatacatcttattagagctcaaacatgggattatcaaacccatgactatgtacaagatctctaacttcctgttcatatcagcagccagggcct

SEQ ID NO: 399395 - DNA, 140 bp, Artificial Sequence
  Synthetic
aggccctggctgctgatatggttatggccaaatgcccagacagacaggcgggttttttaggccttggtccatggggaaagaagccccgcaatttccccatggctcaagtgcatcaggggcgaccttttgggacagcggtg

SEQ ID NO: 399396 - DNA, 140 bp, Artificial Sequence
  Synthetic
caccgctgtcccaaaaggtcgcccctgatgcacttgagccatggggaaattgcggggcttctttccccatggaccaaggcctaaaaaacccgcctgtctgtctgggcatttggccataaccatatcagcagccagggcct

SEQ ID NO: 399397 - DNA, 140 bp, Artificial Sequence
  Synthetic
atacgccatgctgggtctcccttagaaagggctttactataagatgggtggcaagtggtcaaaacatagtggatggaatgctataagggaaaaaatgagacgaacgccagcagctgagcccgtacttgggagtcggccat

SEQ ID NO: 399398 - DNA, 140 bp, Artificial Sequence
  Synthetic
atggccgactcccaagtacgggctcagctgctggcgttcgtctcattttttcccttatagcattccatccactatgttttgaccacttgccacccatcttatagtaaagccctttctaagggagacccagcatggcgtat

SEQ ID NO: 399399 - DNA, 140 bp, Artificial Sequence
  Synthetic
atacgccatgctgggtctccagagccctaggaacatagagaaccctgtgaaaaagtgtgagtttaatacaaccacagttcttaaagacaagaaagagaaaaaacaggctctattctatttcgtacttgggagtcggccat

SEQ ID NO: 399400 - DNA, 140 bp, Artificial Sequence
  Synthetic
atggccgactcccaagtacgaaatagaatagagcctgttttttctctttcttgtctttaagaactgtggttgtattaaactcacactttttcacagggttctctatgttcctagggctctggagacccagcatggcgtat

SEQ ID NO: 399401 - DNA, 140 bp, Artificial Sequence
  Synthetic
atacgccatgctgggtctccctttaagtgtaacagcacagaatttaatggaataggcatatgtaagaacattacagtggttacttgtacacatggcatcaagcccacagtgagcactcaccgtacttgggagtcggccat

SEQ ID NO: 399402 - DNA, 140 bp, Artificial Sequence
  Synthetic
atggccgactcccaagtacggtgagtgctcactgtgggcttgatgccatgtgtacaagtaaccactgtaatgttcttacatatgcctattccattaaattctgtgctgttacacttaaagggagacccagcatggcgtat

SEQ ID NO: 399403 - DNA, 140 bp, Artificial Sequence
  Synthetic
atacgccatgctgggtctccaaacatttcagattctgcggaaaatatcttagtgaccctaaattatcctgtaaacataacttgtcagagaccaaatgttacggtacaagagataaaaatacgtacttgggagtcggccat

SEQ ID NO: 399404 - DNA, 140 bp, Artificial Sequence
  Synthetic
atggccgactcccaagtacgtatttttatctcttgtaccgtaacatttggtctctgacaagttatgtttacaggataatttagggtcactaagatattttccgcagaatctgaaatgtttggagacccagcatggcgtat

SEQ ID NO: 399405 - DNA, 140 bp, Artificial Sequence
  Synthetic
aggccctggctgctgatatgtaaacataacttgtcagagaccaaatgttacggtacaagagataaaaataggtccaatggcctggtacagcatggccatagagaaaaactcaacctcaaggaccttttgggacagcggtg

SEQ ID NO: 399406 - DNA, 140 bp, Artificial Sequence
  Synthetic
caccgctgtcccaaaaggtccttgaggttgagtttttctctatggccatgctgtaccaggccattggacctatttttatctcttgtaccgtaacatttggtctctgacaagttatgtttacatatcagcagccagggcct

SEQ ID NO: 399407 - DNA, 140 bp, Artificial Sequence
  Synthetic
aggccctggctgctgatatgagtttgtttcacaacaaaagccttaggcatctcctatggcaggaagaagcggagacagcgacgaagagctcatcagaacagtcagactcatcaagcttctgaccttttgggacagcggtg

SEQ ID NO: 399408 - DNA, 140 bp, Artificial Sequence
  Synthetic
caccgctgtcccaaaaggtcagaagcttgatgagtctgactgttctgatgagctcttcgtcgctgtctccgcttcttcctgccataggagatgcctaaggcttttgttgtgaaacaaactcatatcagcagccagggcct

SEQ ID NO: 399409 - DNA, 140 bp, Artificial Sequence
  Synthetic
atacgccatgctgggtctccaaacagctgaaaggtatttagaacttatgaacaataatgagacaaatataacaatgacattcaatcgcagccttgatggagacgcagagacaacccatttcgtacttgggagtcggccat

SEQ ID NO: 399410 - DNA, 140 bp, Artificial Sequence
  Synthetic
atggccgactcccaagtacgaaatgggttgtctctgcgtctccatcaaggctgcgattgaatgtcattgttatatttgtctcattattgttcataagttctaaatacctttcagctgtttggagacccagcatggcgtat

SEQ ID NO: 399411 - DNA, 140 bp, Artificial Sequence
  Synthetic
aggccctggctgctgatatgacaatgacattcaatcgcagccttgatggagacgcagagacaacccatttgcactttaactgtcatggagagttcttttattgtaacacaagtggaatgtgaccttttgggacagcggtg

SEQ ID NO: 399412 - DNA, 140 bp, Artificial Sequence
  Synthetic
caccgctgtcccaaaaggtcacattccacttgtgttacaataaaagaactctccatgacagttaaagtgcaaatgggttgtctctgcgtctccatcaaggctgcgattgaatgtcattgtcatatcagcagccagggcct

SEQ ID NO: 399413 - DNA, 140 bp, Artificial Sequence
  Synthetic
atacgccatgctgggtctccaacaataataccttgataccttgcaagttgagacaagtggtcagatcatggatgaggggagggtcgggactctatgcacctcccatctcaggttacctaacgtacttgggagtcggccat

SEQ ID NO: 399414 - DNA, 140 bp, Artificial Sequence
  Synthetic
atggccgactcccaagtacgttaggtaacctgagatgggaggtgcatagagtcccgaccctcccctcatccatgatctgaccacttgtctcaacttgcaaggtatcaaggtattattgttggagacccagcatggcgtat

SEQ ID NO: 399415 - DNA, 140 bp, Artificial Sequence
  Synthetic
  misc_feature (52)..(52): n is a, c, g, or t
aggccctggctgctgatatggtgtagcacctacaaaaattgcaaggccagtnataagcactggcactcatagagagaaaagagcagtaggattgggaatgctattcttgggggttctaaggaccttttgggacagcggtg

SEQ ID NO: 399416 - DNA, 140 bp, Artificial Sequence
  Synthetic
  misc_feature (89)..(89): n is a, c, g, or t
caccgctgtcccaaaaggtccttagaacccccaagaatagcattcccaatcctactgctcttttctctctatgagtgccagtgcttatnactggccttgcaatttttgtaggtgctacaccatatcagcagccagggcct

SEQ ID NO: 399417 - DNA, 140 bp, Artificial Sequence
  Synthetic
atacgccatgctgggtctccagagagaaaagagcagtaggattgggaatgctattcttgggggttctaagtgcagcaggtagcactatgggcgcagcggcaacggcgctgacggtacagacgtacttgggagtcggccat

SEQ ID NO: 399418 - DNA, 140 bp, Artificial Sequence
  Synthetic
atggccgactcccaagtacgtctgtaccgtcagcgccgttgccgctgcgcccatagtgctacctgctgcacttagaacccccaagaatagcattcccaatcctactgctcttttctctctggagacccagcatggcgtat

SEQ ID NO: 399419 - DNA, 140 bp, Artificial Sequence
  Synthetic
aggccctggctgctgatatgggacaatatatctatgaaacttatggggatacctgggcaggagttgaagctataataagaatcctgcaacaactactgtttattcatttcagaattgggtgaccttttgggacagcggtg

SEQ ID NO: 399420 - DNA, 140 bp, Artificial Sequence
  Synthetic
caccgctgtcccaaaaggtcacccaattctgaaatgaataaacagtagttgttgcaggattcttattatagcttcaactcctgcccaggtatccccataagtttcatagatatattgtcccatatcagcagccagggcct

SEQ ID NO: 399421 - DNA, 140 bp, Artificial Sequence
  Synthetic
atacgccatgctgggtctccaactcctaaacctatggggctgtaagggaagactaatctgttacacatcagtagcatggaacaacacatggaccaagtataatgaaacgaacatagacaacgtacttgggagtcggccat

SEQ ID NO: 399422 - DNA, 140 bp, Artificial Sequence
  Synthetic
atggccgactcccaagtacgttgtctatgttcgtttcattatacttggtccatgtgttgttccatgctactgatgtgtaacagattagtcttcccttacagccccataggtttaggagttggagacccagcatggcgtat

SEQ ID NO: 399423 - DNA, 140 bp, Artificial Sequence
  Synthetic
atacgccatgctgggtctcctaagtgacatcatatatgaggaaatacaaaaagcacaagtacagcaggaacaaaatgagaggaagttgctggagttagatgaatgggcttctatttggaacgtacttgggagtcggccat

SEQ ID NO: 399424 - DNA, 140 bp, Artificial Sequence
  Synthetic
atggccgactcccaagtacgttccaaatagaagcccattcatctaactccagcaacttcctctcattttgttcctgctgtacttgtgctttttgtatttcctcatatatgatgtcacttaggagacccagcatggcgtat

SEQ ID NO: 399425 - DNA, 140 bp, Artificial Sequence
  Synthetic
atacgccatgctgggtctccgaggcggtccaggccgtctggagatctgcgacagagactcttgcgggcgcgtggggagacgtatgggagactcttaggagaggtggaagatggatactcgcgtacttgggagtcggccat

SEQ ID NO: 399426 - DNA, 140 bp, Artificial Sequence
  Synthetic
atggccgactcccaagtacgcgagtatccatcttccacctctcctaagagtctcccatacgtctccccacgcgcccgcaagagtctctgtcgcagatctccagacggcctggaccgcctcggagacccagcatggcgtat

SEQ ID NO: 399427 - DNA, 140 bp, Artificial Sequence
  Synthetic
aggccctggctgctgatatgtacagtacaatgtacacatggaattaagccagtggtatcaactcaattactgctgaatggcagcttagcagaaaaggaaataatgattagatctgaaaacgaccttttgggacagcggtg

SEQ ID NO: 399428 - DNA, 140 bp, Artificial Sequence
  Synthetic
caccgctgtcccaaaaggtcgttttcagatctaatcattatttccttttctgctaagctgccattcagcagtaattgagttgataccactggcttaattccatgtgtacattgtactgtacatatcagcagccagggcct

SEQ ID NO: 399429 - DNA, 140 bp, Artificial Sequence
  Synthetic
atacgccatgctgggtctcctaccatgggcaatattaccatgggtacagagatgaaaaattgctctttcaatacaaccacagaaataagggataagagacagaaagcatatgcactttttcgtacttgggagtcggccat

SEQ ID NO: 399430 - DNA, 140 bp, Artificial Sequence
  Synthetic
atggccgactcccaagtacgaaaaagtgcatatgctttctgtctcttatcccttatttctgtggttgtattgaaagagcaatttttcatctctgtacccatggtaatattgcccatggtaggagacccagcatggcgtat

SEQ ID NO: 399431 - DNA, 140 bp, Artificial Sequence
  Synthetic
aggccctggctgctgatatgaattaattgtaccagacccaacaacaatacaagaaagagtataagatttggaccaggacaagcgttctatgcaacaggtgacataataggagatataagagaccttttgggacagcggtg

SEQ ID NO: 399432 - DNA, 140 bp, Artificial Sequence
  Synthetic
caccgctgtcccaaaaggtctcttatatctcctattatgtcacctgttgcatagaacgcttgtcctggtccaaatcttatactctttcttgtattgttgttgggtctggtacaattaattcatatcagcagccagggcct

SEQ ID NO: 399433 - DNA, 140 bp, Artificial Sequence
  Synthetic
aggccctggctgctgatatggaccaggacaagcgttctatgcaacaggtgacataataggagatataagagaagcatattgtgtggttaatagaacagaatggaatgagatgatacagaagaccttttgggacagcggtg

SEQ ID NO: 399434 - DNA, 140 bp, Artificial Sequence
  Synthetic
caccgctgtcccaaaaggtcttctgtatcatctcattccattctgttctattaaccacacaatatgcttctcttatatctcctattatgtcacctgttgcatagaacgcttgtcctggtccatatcagcagccagggcct

SEQ ID NO: 399435 - DNA, 140 bp, Artificial Sequence
  Synthetic
aggccctggctgctgatatgataaacatgtggcaggaagtaggaaaagcaatgtatgcccctcccatcgaaggacaaattagatgttcatcaaatattacagggctgctattaacaagaggaccttttgggacagcggtg

SEQ ID NO: 399436 - DNA, 140 bp, Artificial Sequence
  Synthetic
caccgctgtcccaaaaggtcctcttgttaatagcagccctgtaatatttgatgaacatctaatttgtccttcgatgggaggggcatacattgcttttcctacttcctgccacatgtttatcatatcagcagccagggcct

SEQ ID NO: 399437 - DNA, 140 bp, Artificial Sequence
  Synthetic
aggccctggctgctgatatgcatttggcccacccacaggaggggacctagaaattacaacacatagttttaattgtagaggagaatttttctattgtaatacatcaggactgtttaataggaccttttgggacagcggtg

SEQ ID NO: 399438 - DNA, 140 bp, Artificial Sequence
  Synthetic
caccgctgtcccaaaaggtcctattaaacagtcctgatgtattacaatagaaaaattctcctctacaattaaaactatgtgttgtaatttctaggtcccctcctgtgggtgggccaaatgcatatcagcagccagggcct

SEQ ID NO: 399439 - DNA, 140 bp, Artificial Sequence
  Synthetic
aggccctggctgctgatatgagacagggcttagaaaggagtttattgtaacatgggaaacgcattgaggaaacacagagatcagagatggccagcagtaagagaaagaatgagaaatgcagaccttttgggacagcggtg

SEQ ID NO: 399440 - DNA, 140 bp, Artificial Sequence
  Synthetic
caccgctgtcccaaaaggtctgcatttctcattctttctcttactgctggccatctctgatctctgtgtttcctcaatgcgtttcccatgttacaataaactcctttctaagccctgtctcatatcagcagccagggcct

SEQ ID NO: 399441 - DNA, 140 bp, Artificial Sequence
  Synthetic
  misc_feature (26)..(26): n is a, c, g, or t
atacgccatgctgggtctccgaagangtaggtttcccagtaagacctcaagtgcctctaaggccaatgacctttaaaggagcatttgacctcagcttctttttaaaagaaaagggaggaccgtacttgggagtcggccat

SEQ ID NO: 399442 - DNA, 140 bp, Artificial Sequence
  Synthetic
  misc_feature (115)..(115): n is a, c, g, or t
atggccgactcccaagtacggtcctcccttttcttttaaaaagaagctgaggtcaaatgctcctttaaaggtcattggccttagaggcacttgaggtcttactgggaaacctacntcttcggagacccagcatggcgtat

SEQ ID NO: 399443 - DNA, 140 bp, Artificial Sequence
  Synthetic
aggccctggctgctgatatgttgggatgttgatgatctgtagtgctgcaggaaatttgtgggtcacagtctattatggggtacctgtgtggaaagaagcaaccaccactctattttgtgcgaccttttgggacagcggtg

SEQ ID NO: 399444 - DNA, 140 bp, Artificial Sequence
  Synthetic
caccgctgtcccaaaaggtcgcacaaaatagagtggtggttgcttctttccacacaggtaccccataatagactgtgacccacaaatttcctgcagcactacagatcatcaacatcccaacatatcagcagccagggcct

SEQ ID NO: 399445 - DNA, 140 bp, Artificial Sequence
  Synthetic
aggccctggctgctgatatgcctgcagtcactctggaacacaatagcagtgctctggtgtgttcacaacagatataaagttgaagatacgcagcaggcaatacaaaagttaaaggaagtagaccttttgggacagcggtg

SEQ ID NO: 399446 - DNA, 140 bp, Artificial Sequence
  Synthetic
caccgctgtcccaaaaggtctacttcctttaacttttgtattgcctgctgcgtatcttcaactttatatctgttgtgaacacaccagagcactgctattgtgttccagagtgactgcaggcatatcagcagccagggcct

SEQ ID NO: 399447 - DNA, 140 bp, Artificial Sequence
  Synthetic
atacgccatgctgggtctccgcaaataagggaaccaacaggaagtgacattgctgggacaactagctcccagcaagagcaagttcactggattactagggccaaccaccctatcccagtacgtacttgggagtcggccat

SEQ ID NO: 399448 - DNA, 140 bp, Artificial Sequence
  Synthetic
atggccgactcccaagtacgtactgggatagggtggttggccctagtaatccagtgaacttgctcttgctgggagctagttgtcccagcaatgtcacttcctgttggttcccttatttgcggagacccagcatggcgtat

SEQ ID NO: 399449 - DNA, 140 bp, Artificial Sequence
  Synthetic
aggccctggctgctgatatgaatgtacagtccagtgagcatcttagatattaaacagggaccaaaagaaccatttagagattatgtagatcggttctacaaaacattaagagctgagcaagaccttttgggacagcggtg

SEQ ID NO: 399450 - DNA, 140 bp, Artificial Sequence
  Synthetic
caccgctgtcccaaaaggtcttgctcagctcttaatgttttgtagaaccgatctacataatctctaaatggttcttttggtccctgtttaatatctaagatgctcactggactgtacattcatatcagcagccagggcct

SEQ ID NO: 399451 - DNA, 140 bp, Artificial Sequence
  Synthetic
aggccctggctgctgatatgtgccaacccagattgcaaacagattttgaaagcattagggccaggagctaccttagaagaaatgatggtagcctgtcagggagtaggaggaccaactcatgaccttttgggacagcggtg

SEQ ID NO: 399452 - DNA, 140 bp, Artificial Sequence
  Synthetic
caccgctgtcccaaaaggtcatgagttggtcctcctactccctgacaggctaccatcatttcttctaaggtagctcctggccctaatgctttcaaaatctgtttgcaatctgggttggcacatatcagcagccagggcct

SEQ ID NO: 399453 - DNA, 140 bp, Artificial Sequence
  Synthetic
atacgccatgctgggtctccccttgtaccagatgttattgtaaacgatgttgctttcattgtcaatggtgctttacaacgaagggcttaggcatctcctatggcaggaagaagcggagaccgtacttgggagtcggccat

SEQ ID NO: 399454 - DNA, 140 bp, Artificial Sequence
  Synthetic
atggccgactcccaagtacggtctccgcttcttcctgccataggagatgcctaagcccttcgttgtaaagcaccattgacaatgaaagcaacatcgtttacaataacatctggtacaaggggagacccagcatggcgtat

SEQ ID NO: 399455 - DNA, 140 bp, Artificial Sequence
  Synthetic
aggccctggctgctgatatgactatagcatatatagaatataggaaactggtaaggcaaagaaaaataaataggttatataaaagaataagagaaagagcagaagacagtggcaatgagagaccttttgggacagcggtg

SEQ ID NO: 399456 - DNA, 140 bp, Artificial Sequence
  Synthetic
caccgctgtcccaaaaggtctctcattgccactgtcttctgctctttctcttattcttttatataacctatttatttttctttgccttaccagtttcctatattctatatatgctatagtcatatcagcagccagggcct

SEQ ID NO: 399457 - DNA, 140 bp, Artificial Sequence
  Synthetic
aggccctggctgctgatatgggaataacatgacctggatggagtgggaaagagaaattaacaattacacaagcttaatatacaccttaattgaagaatcgcagaaccaacaagaaaagaagaccttttgggacagcggtg

SEQ ID NO: 399458 - DNA, 140 bp, Artificial Sequence
  Synthetic
caccgctgtcccaaaaggtcttcttttcttgttggttctgcgattcttcaattaaggtgtatattaagcttgtgtaattgttaatttctctttcccactccatccaggtcatgttattcccatatcagcagccagggcct

SEQ ID NO: 399459 - DNA, 140 bp, Artificial Sequence
  Synthetic
aggccctggctgctgatatgagcttaatatacaccttaattgaagaatcgcagaaccaacaagaaaagaatgaacaagaattattggaattagataagtgggcaagtttgtggaattggtgaccttttgggacagcggtg

SEQ ID NO: 399460 - DNA, 140 bp, Artificial Sequence
  Synthetic
caccgctgtcccaaaaggtcaccaattccacaaacttgcccacttatctaattccaataattcttgttcattcttttcttgttggttctgcgattcttcaattaaggtgtatattaagctcatatcagcagccagggcct

SEQ ID NO: 399461 - DNA, 140 bp, Artificial Sequence
  Synthetic
atacgccatgctgggtctcctaaaaagaatccgtatccagagaggaccagggagagcatttgttacaatgggaaaaataggaaatatgagacaagcacattgtaacattagtagagcaaacgtacttgggagtcggccat

SEQ ID NO: 399462 - DNA, 140 bp, Artificial Sequence
  Synthetic
atggccgactcccaagtacgtttgctctactaatgttacaatgtgcttgtctcatatttcctatttttcccattgtaacaaatgctctccctggtcctctctggatacggattctttttaggagacccagcatggcgtat

SEQ ID NO: 399463 - DNA, 140 bp, Artificial Sequence
  Synthetic
atacgccatgctgggtctccacagcaatatgtcaggaaatggaacaagaaggaaaaatttcaagaataggacctgaaaatccttataatacacctatctttgcaataaaaaagaaagatacgtacttgggagtcggccat

SEQ ID NO: 399464 - DNA, 140 bp, Artificial Sequence
  Synthetic
atggccgactcccaagtacgtatctttcttttttattgcaaagataggtgtattataaggattttcaggtcctattcttgaaatttttccttcttgttccatttcctgacatattgctgtggagacccagcatggcgtat

SEQ ID NO: 399465 - DNA, 140 bp, Artificial Sequence
  Synthetic
atacgccatgctgggtctcccaagatttctgggaggtacagttaggtatcccacatccagggggtttaaagcaaaagcaatctgttacagtcctagatgtaggagatgcttatttctcatcgtacttgggagtcggccat

SEQ ID NO: 399466 - DNA, 140 bp, Artificial Sequence
  Synthetic
atggccgactcccaagtacgatgagaaataagcatctcctacatctaggactgtaacagattgcttttgctttaaaccccctggatgtgggatacctaactgtacctcccagaaatcttgggagacccagcatggcgtat

SEQ ID NO: 399467 - DNA, 140 bp, Artificial Sequence
  Synthetic
aggccctggctgctgatatgataatgcaaaaaccataatagtacaccttaatgaatctgtacagattaattgtacaagacccaacaacaatacaagaaaaagtatacatttaggaccagggaccttttgggacagcggtg

SEQ ID NO: 399468 - DNA, 140 bp, Artificial Sequence
  Synthetic
caccgctgtcccaaaaggtccctggtcctaaatgtatactttttcttgtattgttgttgggtcttgtacaattaatctgtacagattcattaaggtgtactattatggtttttgcattatcatatcagcagccagggcct

SEQ ID NO: 399469 - DNA, 140 bp, Artificial Sequence
  Synthetic
aggccctggctgctgatatgggaggaggagatatgagggacaattggagaagtgaattatataaatataaagtagtaaaaattgaaccattaggagtagcacccaccaaggcaaagagaagaccttttgggacagcggtg

SEQ ID NO: 399470 - DNA, 140 bp, Artificial Sequence
  Synthetic
caccgctgtcccaaaaggtcttctctttgccttggtgggtgctactcctaatggttcaatttttactactttatatttatataattcacttctccaattgtccctcatatctcctcctcccatatcagcagccagggcct

SEQ ID NO: 399471 - DNA, 140 bp, Artificial Sequence
  Synthetic
aggccctggctgctgatatggacggtacaggccagacaattattgtctggtatagtgcagcagcagaacaatttgctgagggctattgaggcgcaacagcatctgttgcaactcacagtcgaccttttgggacagcggtg

SEQ ID NO: 399472 - DNA, 140 bp, Artificial Sequence
  Synthetic
caccgctgtcccaaaaggtcgactgtgagttgcaacagatgctgttgcgcctcaatagccctcagcaaattgttctgctgctgcactataccagacaataattgtctggcctgtaccgtccatatcagcagccagggcct

SEQ ID NO: 399473 - DNA, 140 bp, Artificial Sequence
  Synthetic
  misc_feature (51)..(51): n is a, c, g, or t
  misc_feature (84)..(84): n is a, c, g, or t
  misc_feature (90)..(90): n is a, c, g, or t
  misc_feature (118)..(118): n is a, c, g, or t
atacgccatgctgggtctccggaattagaggagaacagagagaagctaaangaaacagtgcatggtgtatactatcaacctganaaaganttatgggttcagattcagaagcatgaancacgtacttgggagtcggccat

SEQ ID NO: 399474 - DNA, 140 bp, Artificial Sequence
  Synthetic
  misc_feature (23)..(23): n is a, c, g, or t
  misc_feature (51)..(51): n is a, c, g, or t
  misc_feature (57)..(57): n is a, c, g, or t
  misc_feature (90)..(90): n is a, c, g, or t
atggccgactcccaagtacgtgnttcatgcttctgaatctgaacccataantctttntcaggttgatagtatacaccatgcactgtttcntttagcttctctctgttctcctctaattccggagacccagcatggcgtat

SEQ ID NO: 399475 - DNA, 140 bp, Artificial Sequence
  Synthetic
atacgccatgctgggtctccaaagcagacatccaaaagtaagctcagaagtgcacatcccactaggagacgctaaactaatagtaagaacatattggggtctgcatacaggagaaaaagacgtacttgggagtcggccat

SEQ ID NO: 399476 - DNA, 140 bp, Artificial Sequence
  Synthetic
atggccgactcccaagtacgtctttttctcctgtatgcagaccccaatatgttcttactattagtttagcgtctcctagtgggatgtgcacttctgagcttacttttggatgtctgctttggagacccagcatggcgtat

SEQ ID NO: 399477 - DNA, 140 bp, Artificial Sequence
  Synthetic
aggccctggctgctgatatgtgtaaaattaaccccaatctgtgttatgttaaactgcactgattatactggtgccaatggtacttgtgccaatggtaccagtggtgctggtaccaattgtgaccttttgggacagcggtg

SEQ ID NO: 399478 - DNA, 140 bp, Artificial Sequence
  Synthetic
caccgctgtcccaaaaggtcacaattggtaccagcaccactggtaccattggcacaagtaccattggcaccagtataatcagtgcagtttaacataacacagattggggttaattttacacatatcagcagccagggcct

SEQ ID NO: 399479 - DNA, 140 bp, Artificial Sequence
  Synthetic
atacgccatgctgggtctccgaagggagaaataaaaaaatgttctttcaatatcaccacacaactaggcaataaagtgaagaaagaatatgcactctttaatatgcttgatatagtacgacgtacttgggagtcggccat

SEQ ID NO: 399480 - DNA, 140 bp, Artificial Sequence
  Synthetic
atggccgactcccaagtacgtcgtactatatcaagcatattaaagagtgcatattctttcttcactttattgcctagttgtgtggtgatattgaaagaacatttttttatttctcccttcggagacccagcatggcgtat

SEQ ID NO: 399481 - DNA, 140 bp, Artificial Sequence
  Synthetic
aggccctggctgctgatatgactcaagacttttgggaagttcaattaggaataccacacccagcagggttaaaaaagaaaaaatcagtgacagtactagatgtgggggatgcatatttttgaccttttgggacagcggtg

SEQ ID NO: 399482 - DNA, 140 bp, Artificial Sequence
  Synthetic
caccgctgtcccaaaaggtcaaaaatatgcatcccccacatctagtactgtcactgattttttcttttttaaccctgctgggtgtggtattcctaattgaacttcccaaaagtcttgagtcatatcagcagccagggcct

SEQ ID NO: 399483 - DNA, 140 bp, Artificial Sequence
  Synthetic
atacgccatgctgggtctccaaaaaagaaaaaatcagtgacagtactagatgtgggggatgcatatttttcagttcctttagatgaaggcttcaggaaatatactgcattcaccatacctcgtacttgggagtcggccat

SEQ ID NO: 399484 - DNA, 140 bp, Artificial Sequence
  Synthetic
atggccgactcccaagtacgaggtatggtgaatgcagtatatttcctgaagccttcatctaaaggaactgaaaaatatgcatcccccacatctagtactgtcactgattttttcttttttggagacccagcatggcgtat

SEQ ID NO: 399485 - DNA, 140 bp, Artificial Sequence
  Synthetic
aggccctggctgctgatatgagatagagttatagaagctttgcaaagagctggtagagctgttctcaacatacctagaagaataagacaaggcttggaaagggctttgctataaaatggggaccttttgggacagcggtg

SEQ ID NO: 399486 - DNA, 140 bp, Artificial Sequence
  Synthetic
caccgctgtcccaaaaggtccccattttatagcaaagccctttccaagccttgtcttattcttctaggtatgttgagaacagctctaccagctctttgcaaagcttctataactctatctcatatcagcagccagggcct

SEQ ID NO: 399487 - DNA, 140 bp, Artificial Sequence
  Synthetic
atacgccatgctgggtctccagagaaaaaattagaagaacaatataataagacaatacactttaagcattcctcaggaggggacccagaaattgtaatgcacatgtttaattgtggaggacgtacttgggagtcggccat

SEQ ID NO: 399488 - DNA, 140 bp, Artificial Sequence
  Synthetic
atggccgactcccaagtacgtcctccacaattaaacatgtgcattacaatttctgggtcccctcctgaggaatgcttaaagtgtattgtcttattatattgttcttctaattttttctctggagacccagcatggcgtat

SEQ ID NO: 399489 - DNA, 140 bp, Artificial Sequence
  Synthetic
aggccctggctgctgatatgggaacagcctggtgaaataccataagtacaggtctgggaaggccaggaactggtattacaggcatcattttgaatctagaaatccaagattcagttcagggaccttttgggacagcggtg

SEQ ID NO: 399490 - DNA, 140 bp, Artificial Sequence
  Synthetic
caccgctgtcccaaaaggtccctgaactgaatcttggatttctagattcaaaatgatgcctgtaataccagttcctggccttcccagacctgtacttatggtatttcaccaggctgttcccatatcagcagccagggcct

SEQ ID NO: 399491 - DNA, 140 bp, Artificial Sequence
  Synthetic
aggccctggctgctgatatgatcccttcagacaggatcagaagagcttaaatcattatataatacagtagtagtcctctattatgtacatcaaagggtagaggtaaaggacaccaaggaagaccttttgggacagcggtg

SEQ ID NO: 399492 - DNA, 140 bp, Artificial Sequence
  Synthetic
caccgctgtcccaaaaggtcttccttggtgtcctttacctctaccctttgatgtacataatagaggactactactgtattatataatgatttaagctcttctgatcctgtctgaagggatcatatcagcagccagggcct

SEQ ID NO: 399493 - DNA, 140 bp, Artificial Sequence
  Synthetic
aggccctggctgctgatatgggacatagtcaggtagggacactgcaactattagctctaagagcagtagtaaaagcaaaaagaaataagcctcccctacccagtgtccagaaattaacaggaccttttgggacagcggtg

SEQ ID NO: 399494 - DNA, 140 bp, Artificial Sequence
  Synthetic
caccgctgtcccaaaaggtcctgttaatttctggacactgggtaggggaggcttatttctttttgcttttactactgctcttagagctaatagttgcagtgtccctacctgactatgtcccatatcagcagccagggcct

SEQ ID NO: 399495 - DNA, 140 bp, Artificial Sequence
  Synthetic
  misc_feature (87)..(87): n is a, c, g, or t
  misc_feature (97)..(97): n is a, c, g, or t
  misc_feature (103)..(103): n is a, c, g, or t
atacgccatgctgggtctcctcaatgaatgggcactagaaactctagaagaactaaaaacagaagcagtaagacattttcctaggcnttggctacanagcttnggacaatacatttatgacgtacttgggagtcggccat

SEQ ID NO: 399496 - DNA, 140 bp, Artificial Sequence
  Synthetic
  misc_feature (38)..(38): n is a, c, g, or t
  misc_feature (44)..(44): n is a, c, g, or t
  misc_feature (54)..(54): n is a, c, g, or t
atggccgactcccaagtacgtcataaatgtattgtccnaagctntgtagccaangcctaggaaaatgtcttactgcttctgtttttagttcttctagagtttctagtgcccattcattgaggagacccagcatggcgtat

SEQ ID NO: 399497 - DNA, 140 bp, Artificial Sequence
  Synthetic
atacgccatgctgggtctcccagtgggagaaagaaattgacaattacacagaattaatatacactttacttgaagaatcgcagaaccaacaggaacagaatgaacaagaattattggcaccgtacttgggagtcggccat

SEQ ID NO: 399498 - DNA, 140 bp, Artificial Sequence
  Synthetic
atggccgactcccaagtacggtgccaataattcttgttcattctgttcctgttggttctgcgattcttcaagtaaagtgtatattaattctgtgtaattgtcaatttctttctcccactgggagacccagcatggcgtat

SEQ ID NO: 399499 - DNA, 140 bp, Artificial Sequence
  Synthetic
aggccctggctgctgatatgggccttttagaaacatcagaaggctgtaaacaaataatgaaacagctacaaccagctcttcagacaggaacagaggaacttaaatcattatacaatacaggaccttttgggacagcggtg

SEQ ID NO: 399500 - DNA, 140 bp, Artificial Sequence
  Synthetic
caccgctgtcccaaaaggtcctgtattgtataatgatttaagttcctctgttcctgtctgaagagctggttgtagctgtttcattatttgtttacagccttctgatgtttctaaaaggcccatatcagcagccagggcct

SEQ ID NO: 399501 - DNA, 140 bp, Artificial Sequence
  Synthetic
  misc_feature (66)..(66): n is a, c, g, or t
aggccctggctgctgatatgtagatcctaagatgcccccatggcatcaccctggaagtcagccccngaccccttgcaacacttgctattgcaaaagatgctgctatcattgctatgtttggaccttttgggacagcggtg

SEQ ID NO: 399502 - DNA, 140 bp, Artificial Sequence
  Synthetic
  misc_feature (75)..(75): n is a, c, g, or t
caccgctgtcccaaaaggtccaaacatagcaatgatagcagcatcttttgcaatagcaagtgttgcaaggggtcnggggctgacttccagggtgatgccatgggggcatcttaggatctacatatcagcagccagggcct

SEQ ID NO: 399503 - DNA, 140 bp, Artificial Sequence
  Synthetic
aggccctggctgctgatatgcctttgcctagtgttaggaaattaacagaagatagatggaacaagccccagaggaccaggggccacagagagaaccccacaatgaatggacattagaactgaccttttgggacagcggtg

SEQ ID NO: 399504 - DNA, 140 bp, Artificial Sequence
  Synthetic
caccgctgtcccaaaaggtcagttctaatgtccattcattgtggggttctctctgtggcccctggtcctctggggcttgttccatctatcttctgttaatttcctaacactaggcaaaggcatatcagcagccagggcct

SEQ ID NO: 399505 - DNA, 140 bp, Artificial Sequence
  Synthetic
aggccctggctgctgatatgcagtaagtaacgctaatgcagcatagggacctgctaataattattagtgctttgctaattataaatgtaattctatggatgtatgttcttagacaatgctgaccttttgggacagcggtg

SEQ ID NO: 399506 - DNA, 140 bp, Artificial Sequence
  Synthetic
caccgctgtcccaaaaggtcagcattgtctaagaacatacatccatagaattacatttataattagcaaagcactaataattattagcaggtccctatgctgcattagcgttacttactgcatatcagcagccagggcct

SEQ ID NO: 399507 - DNA, 140 bp, Artificial Sequence
  Synthetic
aggccctggctgctgatatgtggtgcagagagaaaaaagagcagtgggaataggagctttgttccttgggttcttgggagcagcaggaagcactatgggcgcagcgtcaatgacgctgacgaccttttgggacagcggtg

SEQ ID NO: 399508 - DNA, 140 bp, Artificial Sequence
  Synthetic
caccgctgtcccaaaaggtcgtcagcgtcattgacgctgcgcccatagtgcttcctgctgctcccaagaacccaaggaacaaagctcctattcccactgctcttttttctctctgcaccacatatcagcagccagggcct

SEQ ID NO: 399509 - DNA, 140 bp, Artificial Sequence
  Synthetic
atacgccatgctgggtctccaataagacagggccttgaaagaattttgctataaaatgggtggcaaatggtcaaaacgtagtaagagtgactggtctgctgtaagggagagaatgaggcacgtacttgggagtcggccat

SEQ ID NO: 399510 - DNA, 140 bp, Artificial Sequence
  Synthetic
atggccgactcccaagtacgtgcctcattctctcccttacagcagaccagtcactcttactacgttttgaccatttgccacccattttatagcaaaattctttcaaggccctgtcttattggagacccagcatggcgtat

SEQ ID NO: 399511 - DNA, 140 bp, Artificial Sequence
  Synthetic
aggccctggctgctgatatggtacaaatgaattgtacagacatagaaaacaaaaacagtagctcagaaaaccctatgaaaaagtgtgagtttaatataaccacagttctcaaggacaaaagaccttttgggacagcggtg

SEQ ID NO: 399512 - DNA, 140 bp, Artificial Sequence
  Synthetic
caccgctgtcccaaaaggtcttttgtccttgagaactgtggttatattaaactcacactttttcatagggttttctgagctactgtttttgttttctatgtctgtacaattcatttgtaccatatcagcagccagggcct

SEQ ID NO: 399513 - DNA, 140 bp, Artificial Sequence
  Synthetic
atacgccatgctgggtctccagaagtacacatcccattaggggaggctagattagtaataaaaacatattggggtttgcaaacaggagaaagagattggcatttgggtcatggagtctcccgtacttgggagtcggccat

SEQ ID NO: 399514 - DNA, 140 bp, Artificial Sequence
  Synthetic
atggccgactcccaagtacgggagactccatgacccaaatgccaatctctttctcctgtttgcaaaccccaatatgtttttattactaatctagcctcccctaatgggatgtgtacttctggagacccagcatggcgtat

SEQ ID NO: 399515 - DNA, 140 bp, Artificial Sequence
  Synthetic
aggccctggctgctgatatgactactgtgctccagcaggatatgccatttttaagtgtaacaatgcagaatttaatggaacaggcaaatgcaacaacatttcagtggtgacttgtacacagaccttttgggacagcggtg

SEQ ID NO: 399516 - DNA, 140 bp, Artificial Sequence
  Synthetic
caccgctgtcccaaaaggtctgtgtacaagtcaccactgaaatgttgttgcatttgcctgttccattaaattctgcattgttacacttaaaaatggcatatcctgctggagcacagtagtcatatcagcagccagggcct

SEQ ID NO: 399517 - DNA, 140 bp, Artificial Sequence
  Synthetic
atacgccatgctgggtctcccaaaagaaaaaataagaattatgggacaaaatatttcggccactgcacaaaatatcatagtgaccctaagttctgctgtaaacataacctgtgtgagacccgtacttgggagtcggccat

SEQ ID NO: 399518 - DNA, 140 bp, Artificial Sequence
  Synthetic
atggccgactcccaagtacgggtctcacacaggttatgtttacagcagaacttagggtcactatgatattttgtgcagtggccgaaatattttgtcccataattcttattttttcttttgggagacccagcatggcgtat

SEQ ID NO: 399519 - DNA, 140 bp, Artificial Sequence
  Synthetic
aggccctggctgctgatatgaatatcatagtgaccctaagttctgctgtaaacataacctgtgtgagaccagggaataagacagtacaagagatgagaataggtccgatggcctggtacagaccttttgggacagcggtg

SEQ ID NO: 399520 - DNA, 140 bp, Artificial Sequence
  Synthetic
caccgctgtcccaaaaggtctgtaccaggccatcggacctattctcatctcttgtactgtcttattccctggtctcacacaggttatgtttacagcagaacttagggtcactatgatattcatatcagcagccagggcct

SEQ ID NO: 399521 - DNA, 140 bp, Artificial Sequence
  Synthetic
aggccctggctgctgatatgtgcaacaactactgtttattcatttcagaattgggtgccaacatagcagaataggcattttgcgacagagaagagcaagaaatggagccagtagatcctagaccttttgggacagcggtg

SEQ ID NO: 399522 - DNA, 140 bp, Artificial Sequence
  Synthetic
caccgctgtcccaaaaggtctaggatctactggctccatttcttgctcttctctgtcgcaaaatgcctattctgctatgttggcacccaattctgaaatgaataaacagtagttgttgcacatatcagcagccagggcct

SEQ ID NO: 399523 - DNA, 140 bp, Artificial Sequence
  Synthetic
aggccctggctgctgatatgggaacttataaataagacagaagagaatacaacaataatgttcaaccggagccatgatggcgatgtagaggtaacccatttgcattttaactgtcatggagaccttttgggacagcggtg

SEQ ID NO: 399524 - DNA, 140 bp, Artificial Sequence
  Synthetic
caccgctgtcccaaaaggtctccatgacagttaaaatgcaaatgggttacctctacatcgccatcatggctccggttgaacattattgttgtattctcttctgtcttatttataagttcccatatcagcagccagggcct

SEQ ID NO: 399525 - DNA, 140 bp, Artificial Sequence
  Synthetic
atacgccatgctgggtctcctaatgggaccaactgtaaaaaccaaagtacccatagcaataatggcacgataccttgcaagttgaaacaggtggtaagatcatggatgaggggagggtcgcgtacttgggagtcggccat

SEQ ID NO: 399526 - DNA, 140 bp, Artificial Sequence
  Synthetic
atggccgactcccaagtacgcgaccctcccctcatccatgatcttaccacctgtttcaacttgcaaggtatcgtgccattattgctatgggtactttggtttttacagttggtcccattaggagacccagcatggcgtat

SEQ ID NO: 399527 - DNA, 140 bp, Artificial Sequence
  Synthetic
aggccctggctgctgatatgtaccttgcaagttgaaacaggtggtaagatcatggatgaggggagggtcgggactctatgcacctcccatcccaggtaacctaacatgcatgtcacacatgaccttttgggacagcggtg

SEQ ID NO: 399528 - DNA, 140 bp, Artificial Sequence
  Synthetic
caccgctgtcccaaaaggtcatgtgtgacatgcatgttaggttacctgggatgggaggtgcatagagtcccgaccctcccctcatccatgatcttaccacctgtttcaacttgcaaggtacatatcagcagccagggcct

SEQ ID NO: 399529 - DNA, 140 bp, Artificial Sequence
  Synthetic
aggccctggctgctgatatgatcatagcatatatagaatataggaaattgttaagacaaagaaaaatagactggttaattaaaagaattagggaaagagcagaagacagtggcaatgagagaccttttgggacagcggtg

SEQ ID NO: 399530 - DNA, 140 bp, Artificial Sequence
  Synthetic
caccgctgtcccaaaaggtctctcattgccactgtcttctgctctttccctaattcttttaattaaccagtctatttttctttgtcttaacaatttcctatattctatatatgctatgatcatatcagcagccagggcct

SEQ ID NO: 399531 - DNA, 140 bp, Artificial Sequence
  Synthetic
  misc_feature (86)..(86): n is a, c, g, or t
aggccctggctgctgatatggctcgcctgctagccttagaaaccttcatacagaatcagcaactcctaaacctatggggctgtaanggaagactaatctgctacacatcagtaaaatggagaccttttgggacagcggtg

SEQ ID NO: 399532 - DNA, 140 bp, Artificial Sequence
  Synthetic
  misc_feature (55)..(55): n is a, c, g, or t
caccgctgtcccaaaaggtctccattttactgatgtgtagcagattagtcttccnttacagccccataggtttaggagttgctgattctgtatgaaggtttctaaggctagcaggcgagccatatcagcagccagggcct

SEQ ID NO: 399533 - DNA, 140 bp, Artificial Sequence
  Synthetic
  misc_feature (63)..(63): n is a, c, g, or t
atacgccatgctgggtctccacatggcaggaatgggatcagcagatagacaacgtaagtgccnccatatatgaggaaatacaaagggcacaagtacagcaggaacaaaatgagaaaaagtcgtacttgggagtcggccat

SEQ ID NO: 399534 - DNA, 140 bp, Artificial Sequence
  Synthetic
  misc_feature (78)..(78): n is a, c, g, or t
atggccgactcccaagtacgactttttctcattttgttcctgctgtacttgtgccctttgtatttcctcatatatggnggcacttacgttgtctatctgctgatcccattcctgccatgtggagacccagcatggcgtat

SEQ ID NO: 399535 - DNA, 140 bp, Artificial Sequence
  Synthetic
aggccctggctgctgatatgcaatggacatatcaaatttatcaagagccatttaaaaatctaaaaacaggaaagtatgcaaaaatgaggtctgcccacactaatgatgtaaaacaattaagaccttttgggacagcggtg

SEQ ID NO: 399536 - DNA, 140 bp, Artificial Sequence
  Synthetic
caccgctgtcccaaaaggtcttaattgttttacatcattagtgtgggcagacctcatttttgcatactttcctgtttttagatttttaaatggctcttgataaatttgatatgtccattgcatatcagcagccagggcct

SEQ ID NO: 399537 - DNA, 140 bp, Artificial Sequence
  Synthetic
  misc_feature (26)..(26): n is a, c, g, or t
aggccctggctgctgatatggggatncagacggtgatcagccatctgagaagtggactgtggatcctaggacagaagataattgatgcttgcagaatttgtgcagctgtaatacatttctgaccttttgggacagcggtg

SEQ ID NO: 399538 - DNA, 140 bp, Artificial Sequence
  Synthetic
  misc_feature (115)..(115): n is a, c, g, or t
caccgctgtcccaaaaggtcagaaatgtattacagctgcacaaattctgcaagcatcaattatcttctgtcctaggatccacagtccacttctcagatggctgatcaccgtctgnatccccatatcagcagccagggcct

SEQ ID NO: 399539 - DNA, 140 bp, Artificial Sequence
  Synthetic
  misc_feature (60)..(60): n is a, c, g, or t
atacgccatgctgggtctccgtagcagttgctaattggactgacggcataatcttagggntacaaaggctaggaagaggaattcttaatatcccccgaagaataagacagggcttggaaacgtacttgggagtcggccat

SEQ ID NO: 399540 - DNA, 140 bp, Artificial Sequence
  Synthetic
  misc_feature (81)..(81): n is a, c, g, or t
atggccgactcccaagtacgtttccaagccctgtcttattcttcgggggatattaagaattcctcttcctagcctttgtanccctaagattatgccgtcagtccaattagcaactgctacggagacccagcatggcgtat

SEQ ID NO: 399541 - DNA, 140 bp, Artificial Sequence
  Synthetic
atacgccatgctgggtctccaaaataatagaatttaaaccaccaccctcaggaggggatctagaaattacaacacatagctttaattgtcaaggagaatttttctattgcaacacatcagcgtacttgggagtcggccat

SEQ ID NO: 399542 - DNA, 140 bp, Artificial Sequence
  Synthetic
atggccgactcccaagtacgctgatgtgttgcaatagaaaaattctccttgacaattaaagctatgtgttgtaatttctagatcccctcctgagggtggtggtttaaattctattattttggagacccagcatggcgtat

SEQ ID NO: 399543 - DNA, 140 bp, Artificial Sequence
  Synthetic
atacgccatgctgggtctccgcggaagtgtgagtacgcaattttgactggcggtggccagaaagcaggagagaggatgggtgcgagagcgtcagtgttaacagggggaaaattagatcaacgtacttgggagtcggccat

SEQ ID NO: 399544 - DNA, 140 bp, Artificial Sequence
  Synthetic
atggccgactcccaagtacgttgatctaattttccccctgttaacactgacgctctcgcacccatcctctctcctgctttctggccaccgccagtcaaaattgcgtactcacacttccgcggagacccagcatggcgtat

SEQ ID NO: 399545 - DNA, 140 bp, Artificial Sequence
  Synthetic
atacgccatgctgggtctccacatttagtatgggcaagcagggagctggaaagattcgcttgtaacccaggtctcatggacacagcgagcggctgtgcccagttactaaaccaattagaacgtacttgggagtcggccat

SEQ ID NO: 399546 - DNA, 140 bp, Artificial Sequence
  Synthetic
atggccgactcccaagtacgttctaattggtttagtaactgggcacagccgctcgctgtgtccatgagacctgggttacaagcgaatctttccagctccctgcttgcccatactaaatgtggagacccagcatggcgtat

SEQ ID NO: 399547 - DNA, 140 bp, Artificial Sequence
  Synthetic
atacgccatgctgggtctccccagctctcgcaacagggtcagaaggactgcgctccttatataacgccctagcagttctttattgtgtccatagtaacatacaggtacacaatacacaagcgtacttgggagtcggccat

SEQ ID NO: 399548 - DNA, 140 bp, Artificial Sequence
  Synthetic
atggccgactcccaagtacgcttgtgtattgtgtacctgtatgttactatggacacaataaagaactgctagggcgttatataaggagcgcagtccttctgaccctgttgcgagagctggggagacccagcatggcgtat

SEQ ID NO: 399549 - DNA, 140 bp, Artificial Sequence
  Synthetic
atacgccatgctgggtctcctccgagccaaaaaacccagaagcaggggcagcggcagcagctgataacaatatcagtaggaattatcctctagtccagaatgctcaaggacaaatgataccgtacttgggagtcggccat

SEQ ID NO: 399550 - DNA, 140 bp, Artificial Sequence
  Synthetic
atggccgactcccaagtacggtatcatttgtccttgagcattctggactagaggataattcctactgatattgttatcagctgctgccgctgcccctgcttctgggttttttggctcggaggagacccagcatggcgtat

SEQ ID NO: 399551 - DNA, 140 bp, Artificial Sequence
  Synthetic
aggccctggctgctgatatgtatcagtaggaattatcctctagtccagaatgctcaaggacaaatgatacatcagccgctgacacccagaactttaaatgcttgggtaaaagtgatagaggaccttttgggacagcggtg

SEQ ID NO: 399552 - DNA, 140 bp, Artificial Sequence
  Synthetic
caccgctgtcccaaaaggtcctctatcacttttacccaagcatttaaagttctgggtgtcagcggctgatgtatcatttgtccttgagcattctggactagaggataattcctactgatacatatcagcagccagggcct

SEQ ID NO: 399553 - DNA, 140 bp, Artificial Sequence
  Synthetic
atacgccatgctgggtctccaggggcaacacccgcagatctaaatactatgttaaatacagtaggaggacatcaggcagctatgcagatgctaaaggaagtcatcaatgaggaagcagcacgtacttgggagtcggccat

SEQ ID NO: 399554 - DNA, 140 bp, Artificial Sequence
  Synthetic
atggccgactcccaagtacgtgctgcttcctcattgatgacttcctttagcatctgcatagctgcctgatgtcctcctactgtatttaacatagtatttagatctgcgggtgttgcccctggagacccagcatggcgtat

SEQ ID NO: 399555 - DNA, 140 bp, Artificial Sequence
  Synthetic
aggccctggctgctgatatgaaactcatctgcaccactgctgtgccttggaacaagagttggagtaatatgtctcatgattatatttggggtaacatgacctggatgcagtgggatagaggaccttttgggacagcggtg

SEQ ID NO: 399556 - DNA, 140 bp, Artificial Sequence
  Synthetic
caccgctgtcccaaaaggtcctctatcccactgcatccaggtcatgttaccccaaatataatcatgagacatattactccaactcttgttccaaggcacagcagtggtgcagatgagtttcatatcagcagccagggcct

SEQ ID NO: 399557 - DNA, 140 bp, Artificial Sequence
  Synthetic
aggccctggctgctgatatggcaggtgatgattgtgtggcaagtagacaggatgaggattaacacatggaaaagtttagtaaaataccatatgcatgtttcaaagaaagctaaaagatgggaccttttgggacagcggtg

SEQ ID NO: 399558 - DNA, 140 bp, Artificial Sequence
  Synthetic
caccgctgtcccaaaaggtcccatcttttagctttctttgaaacatgcatatggtattttactaaacttttccatgtgttaatcctcatcctgtctacttgccacacaatcatcacctgccatatcagcagccagggcct

SEQ ID NO: 399559 - DNA, 140 bp, Artificial Sequence
  Synthetic
atacgccatgctgggtctcccagccataattgtgtgggccatagttttcatactatataaggaaattagaaaacagaaaaaaatagataggatacttgaaagaataagagaaagagcagacgtacttgggagtcggccat

SEQ ID NO: 399560 - DNA, 140 bp, Artificial Sequence
  Synthetic
atggccgactcccaagtacgtctgctctttctcttattctttcaagtatcctatctatttttttctgttttctaatttccttatatagtatgaaaactatggcccacacaattatggctgggagacccagcatggcgtat

SEQ ID NO: 399561 - DNA, 140 bp, Artificial Sequence
  Synthetic
atacgccatgctgggtctcctagtcctgtcagcattctagagatcaaacaaggaccaaaagaaccctttagagattatgtagacaggttctacaaaactttaagagcagagcaggcatcacgtacttgggagtcggccat

SEQ ID NO: 399562 - DNA, 140 bp, Artificial Sequence
  Synthetic
atggccgactcccaagtacgtgatgcctgctctgctcttaaagttttgtagaacctgtctacataatctctaaagggttcttttggtccttgtttgatctctagaatgctgacaggactaggagacccagcatggcgtat

SEQ ID NO: 399563 - DNA, 140 bp, Artificial Sequence
  Synthetic
atacgccatgctgggtctcccaggatgtaaagaattggatgacagaaacactcttagtacaaaatgcaaatccagattgtaaacagatactaaaagcattagggccagcagctaccttagcgtacttgggagtcggccat

SEQ ID NO: 399564 - DNA, 140 bp, Artificial Sequence
  Synthetic
atggccgactcccaagtacgctaaggtagctgctggccctaatgcttttagtatctgtttacaatctggatttgcattttgtactaagagtgtttctgtcatccaattctttacatcctgggagacccagcatggcgtat

SEQ ID NO: 399565 - DNA, 140 bp, Artificial Sequence
  Synthetic
aggccctggctgctgatatgctccaggcaagagtcctggctgtggaaagatacctaagggatcaacagctcctaggaatttggggctgctctggaaaactcatctgcaccactaatgtgcgaccttttgggacagcggtg

SEQ ID NO: 399566 - DNA, 140 bp, Artificial Sequence
  Synthetic
caccgctgtcccaaaaggtcgcacattagtggtgcagatgagttttccagagcagccccaaattcctaggagctgttgatcccttaggtatctttccacagccaggactcttgcctggagcatatcagcagccagggcct

SEQ ID NO: 399567 - DNA, 140 bp, Artificial Sequence
  Synthetic
aggccctggctgctgatatgattcatatgcattattttgattgttttgcagactctgccataagaaaagccatattaggacatatagttattcctaggtgtgactatcaagcaggacatagaccttttgggacagcggtg

SEQ ID NO: 399568 - DNA, 140 bp, Artificial Sequence
  Synthetic
caccgctgtcccaaaaggtctatgtcctgcttgatagtcacacctaggaataactatatgtcctaatatggcttttcttatggcagagtctgcaaaacaatcaaaataatgcatatgaatcatatcagcagccagggcct

SEQ ID NO: 399569 - DNA, 140 bp, Artificial Sequence
  Synthetic
atacgccatgctgggtctccattgtggcaaagagggccatttggcaagaaactgtaaggcccctagaagagggggctgttggaaatgtgggcaagaaggacatcaaatgaaagattgtaacgtacttgggagtcggccat

SEQ ID NO: 399570 - DNA, 140 bp, Artificial Sequence
  Synthetic
atggccgactcccaagtacgttacaatctttcatttgatgtccttcttgcccacatttccaacagccccctcttctaggggccttacagtttcttgccaaatggccctctttgccacaatggagacccagcatggcgtat

SEQ ID NO: 399571 - DNA, 140 bp, Artificial Sequence
  Synthetic
atacgccatgctgggtctccaagggagaccaggcaacttcccccagacaacaacaacaaggaaagagcccacagccccgccactagagaattatgggtctcaggaggagaggagcacacacgtacttgggagtcggccat

SEQ ID NO: 399572 - DNA, 140 bp, Artificial Sequence
  Synthetic
atggccgactcccaagtacgtgtgtgctcctctcctcctgagacccataattctctagtggcggggctgtgggctctttccttgttgttgttgtctgggggaagttgcctggtctcccttggagacccagcatggcgtat

SEQ ID NO: 399573 - DNA, 140 bp, Artificial Sequence
  Synthetic
atacgccatgctgggtctccgagggaatgagacgaactgagccagcagcagagggagtaggagcagcgtctcgagacttagagaggcatggtgcgcttacaagcagtaatacacccagcacgtacttgggagtcggccat

SEQ ID NO: 399574 - DNA, 140 bp, Artificial Sequence
  Synthetic
atggccgactcccaagtacgtgctgggtgtattactgcttgtaagcgcaccatgcctctctaagtctcgagacgctgctcctactccctctgctgctggctcagttcgtctcattccctcggagacccagcatggcgtat

SEQ ID NO: 399575 - DNA, 140 bp, Artificial Sequence
  Synthetic
atacgccatgctgggtctcccttccctcagatcactctttggcaacgacctgtcatcacagtaaaaataggaaaagaagtaagagaagctcttctagatacaggagctgatgatacagtgcgtacttgggagtcggccat

SEQ ID NO: 399576 - DNA, 140 bp, Artificial Sequence
  Synthetic
atggccgactcccaagtacgcactgtatcatcagctcctgtatctagaagagcttctcttacttcttttcctatttttactgtgatgacaggtcgttgccaaagagtgatctgagggaagggagacccagcatggcgtat

SEQ ID NO: 399577 - DNA, 140 bp, Artificial Sequence
  Synthetic
aggccctggctgctgatatgggcatttcctatggcaggaagaagcggagacagcgacgaagcactcctccaagcagtaaggatcatcaagatcttatatcaaagcagtaagtatatgtaagaccttttgggacagcggtg

SEQ ID NO: 399578 - DNA, 140 bp, Artificial Sequence
  Synthetic
caccgctgtcccaaaaggtcttacatatacttactgctttgatataagatcttgatgatccttactgcttggaggagtgcttcgtcgctgtctccgcttcttcctgccataggaaatgcccatatcagcagccagggcct

SEQ ID NO: 399579 - DNA, 140 bp, Artificial Sequence
  Synthetic
atacgccatgctgggtctcctacaaggaaggaaagcagttggtacagtgttagtaggaccaacacctgttaatattataggaagaaactttttaacacagattggctgtactttaaatttcgtacttgggagtcggccat

SEQ ID NO: 399580 - DNA, 140 bp, Artificial Sequence
  Synthetic
atggccgactcccaagtacgaaatttaaagtacagccaatctgtgttaaaaagtttcttcctataatattaacaggtgttggtcctactaacactgtaccaactgctttccttccttgtaggagacccagcatggcgtat

SEQ ID NO: 399581 - DNA, 140 bp, Artificial Sequence
  Synthetic
aggccctggctgctgatatgaatattataggaagaaactttttaacacagattggctgtactttaaattttccaataagtcctattgaaactgtaccagtaaaattaaaaccagggatgggaccttttgggacagcggtg

SEQ ID NO: 399582 - DNA, 140 bp, Artificial Sequence
  Synthetic
caccgctgtcccaaaaggtcccatccctggttttaattttactggtacagtttcaataggacttattggaaaatttaaagtacagccaatctgtgttaaaaagtttcttcctataatattcatatcagcagccagggcct

SEQ ID NO: 399583 - DNA, 140 bp, Artificial Sequence
  Synthetic
atacgccatgctgggtctccttaagacaaatttgtgcagaaatggaacaggaaggaaaaatttctagaatagggcctgaaaatccatacaacactccaatctttgctataaaaaagaaagcgtacttgggagtcggccat

SEQ ID NO: 399584 - DNA, 140 bp, Artificial Sequence
  Synthetic
atggccgactcccaagtacgctttcttttttatagcaaagattggagtgttgtatggattttcaggccctattctagaaatttttccttcctgttccatttctgcacaaatttgtcttaaggagacccagcatggcgtat

SEQ ID NO: 399585 - DNA, 140 bp, Artificial Sequence
  Synthetic
aggccctggctgctgatatgcctgtgtggaaagaagcaaccactactctattctgtgcatcagatgctaaatcatatgaaagagaggtacataatgtctgggctacacatgcctgtgtacgaccttttgggacagcggtg

SEQ ID NO: 399586 - DNA, 140 bp, Artificial Sequence
  Synthetic
caccgctgtcccaaaaggtcgtacacaggcatgtgtagcccagacattatgtacctctctttcatatgatttagcatctgatgcacagaatagagtagtggttgcttctttccacacaggcatatcagcagccagggcct

SEQ ID NO: 399587 - DNA, 140 bp, Artificial Sequence
  Synthetic
aggccctggctgctgatatgacagggatggaaggggtcaccagcaatttttcaaagttcaatgacaaaaattttagaaccatttagaaagaaacatccagagataatcatttatcagtacgaccttttgggacagcggtg

SEQ ID NO: 399588 - DNA, 140 bp, Artificial Sequence
  Synthetic
caccgctgtcccaaaaggtcgtactgataaatgattatctctggatgtttctttctaaatggttctaaaatttttgtcattgaactttgaaaaattgctggtgaccccttccatccctgtcatatcagcagccagggcct

SEQ ID NO: 399589 - DNA, 140 bp, Artificial Sequence
  Synthetic
atacgccatgctgggtctccttttagaaccatttagaaagaaacatccagagataatcatttatcagtacatggatgacctctatgtgggatctgactcagaactagcacaacatagagacgtacttgggagtcggccat

SEQ ID NO: 399590 - DNA, 140 bp, Artificial Sequence
  Synthetic
atggccgactcccaagtacgtctctatgttgtgctagttctgagtcagatcccacatagaggtcatccatgtactgataaatgattatctctggatgtttctttctaaatggttctaaaaggagacccagcatggcgtat

SEQ ID NO: 399591 - DNA, 140 bp, Artificial Sequence
  Synthetic
atacgccatgctgggtctccctgacaaaaaacatcaaaaggagccaccgttcctctggatgggatatgagctccatccagataaatggacggtccagacaataaagttaccagaacaggacgtacttgggagtcggccat

SEQ ID NO: 399592 - DNA, 140 bp, Artificial Sequence
  Synthetic
atggccgactcccaagtacgtcctgttctggtaactttattgtctggaccgtccatttatctggatggagctcatatcccatccagaggaacggtggctccttttgatgttttttgtcagggagacccagcatggcgtat

SEQ ID NO: 399593 - DNA, 140 bp, Artificial Sequence
  Synthetic
aggccctggctgctgatatgctcaaaatatctcagataatacaaaaaccataatagtacaccttaatgaatctgtacagattaattgtacaagacccaacaacaatacaagaaaaagtatgaccttttgggacagcggtg

SEQ ID NO: 399594 - DNA, 140 bp, Artificial Sequence
  Synthetic
caccgctgtcccaaaaggtcatactttttcttgtattgttgttgggtcttgtacaattaatctgtacagattcattaaggtgtactattatggtttttgtattatctgagatattttgagcatatcagcagccagggcct

SEQ ID NO: 399595 - DNA, 140 bp, Artificial Sequence
  Synthetic
aggccctggctgctgatatgcaagatcagtggacatatcagatttatcaggagccatataaaaatttaaaaacaggaaaatatgcaaaaaggagatctgcccatactaatgatataaaacgaccttttgggacagcggtg

SEQ ID NO: 399596 - DNA, 140 bp, Artificial Sequence
  Synthetic
caccgctgtcccaaaaggtcgttttatatcattagtatgggcagatctcctttttgcatattttcctgtttttaaatttttatatggctcctgataaatctgatatgtccactgatcttgcatatcagcagccagggcct

SEQ ID NO: 399597 - DNA, 140 bp, Artificial Sequence
  Synthetic
atacgccatgctgggtctccggaaagattcctaagtttaaattaccagtacaaaaggaagtgtgggaggcatggtggactgacaattggcaagcaacctggattcctgagtgggaattcgcgtacttgggagtcggccat

SEQ ID NO: 399598 - DNA, 140 bp, Artificial Sequence
  Synthetic
atggccgactcccaagtacgcgaattcccactcaggaatccaggttgcttgccaattgtcagtccaccatgcctcccacacttccttttgtactggtaatttaaacttaggaatctttccggagacccagcatggcgtat

SEQ ID NO: 399599 - DNA, 140 bp, Artificial Sequence
  Synthetic
aggccctggctgctgatatgatggtggactgacaattggcaagcaacctggattcctgagtgggaattcgtcaacactcctccccttgtaaaattatggtatcagttagaaacagagccagaccttttgggacagcggtg

SEQ ID NO: 399600 - DNA, 140 bp, Artificial Sequence
  Synthetic
caccgctgtcccaaaaggtctggctctgtttctaactgataccataattttacaaggggaggagtgttgacgaattcccactcaggaatccaggttgcttgccaattgtcagtccaccatcatatcagcagccagggcct

SEQ ID NO: 399601 - DNA, 140 bp, Artificial Sequence
  Synthetic
aggccctggctgctgatatgatcaaggaattagagtaaaagaattgtgtaagttaattagaggcaccaagtcattgacagaagtagtacctttaagtaaagaggcagagctagaattagagaccttttgggacagcggtg

SEQ ID NO: 399602 - DNA, 140 bp, Artificial Sequence
  Synthetic
caccgctgtcccaaaaggtctctaattctagctctgcctctttacttaaaggtactacttctgtcaatgacttggtgcctctaattaacttacacaattcttttactctaattccttgatcatatcagcagccagggcct

SEQ ID NO: 399603 - DNA, 140 bp, Artificial Sequence
  Synthetic
atacgccatgctgggtctccaaaattgggaaaagcaggttttgtgacagatagaggaaaacagaaagtggtctctattgaagacaccaccaatcaaaagactgagttacaagctatccttcgtacttgggagtcggccat

SEQ ID NO: 399604 - DNA, 140 bp, Artificial Sequence
  Synthetic
atggccgactcccaagtacgaaggatagcttgtaactcagtcttttgattggtggtgtcttcaatagagaccactttctgttttcctctatctgtcacaaaacctgcttttcccaattttggagacccagcatggcgtat

SEQ ID NO: 399605 - DNA, 140 bp, Artificial Sequence
  Synthetic
aggccctggctgctgatatggagaggagaaataaaaaactgctctttcaatatcaccactagcataagagataaggtgcagaaagaatatgcacttttttataaacttgatgtagtaccagaccttttgggacagcggtg

SEQ ID NO: 399606 - DNA, 140 bp, Artificial Sequence
  Synthetic
caccgctgtcccaaaaggtctggtactacatcaagtttataaaaaagtgcatattctttctgcaccttatctcttatgctagtggtgatattgaaagagcagttttttatttctcctctccatatcagcagccagggcct

SEQ ID NO: 399607 - DNA, 140 bp, Artificial Sequence
  Synthetic
atacgccatgctgggtctccctggccttacaagattcaggacaggaagtaaacatagtcactgattctcagtatgctctgggaataattcactcacacccagataaaagtgaatcagaatcgtacttgggagtcggccat

SEQ ID NO: 399608 - DNA, 140 bp, Artificial Sequence
  Synthetic
atggccgactcccaagtacgattctgattcacttttatctgggtgtgagtgaattattcccagagcatactgagaatcagtgactatgtttacttcctgtcctgaatcttgtaaggccagggagacccagcatggcgtat

SEQ ID NO: 399609 - DNA, 140 bp, Artificial Sequence
  Synthetic
atacgccatgctgggtctcctggtgagccaaataatagaagagctcataaaaaaggaaagagtttatctctcttgggtacctgcacataaaggtattggaggaaatgagcaggtagacaacgtacttgggagtcggccat

SEQ ID NO: 399610 - DNA, 140 bp, Artificial Sequence
  Synthetic
atggccgactcccaagtacgttgtctacctgctcatttcctccaatacctttatgtgcaggtacccaagagagataaactctttccttttttatgagctcttctattatttggctcaccaggagacccagcatggcgtat

SEQ ID NO: 399611 - DNA, 140 bp, Artificial Sequence
  Synthetic
aggccctggctgctgatatgtcttgggtacctgcacataaaggtattggaggaaatgagcaggtagacaaattagttagctcaggaattagaaaagtattattcctagatggtatagaaagaccttttgggacagcggtg

SEQ ID NO: 399612 - DNA, 140 bp, Artificial Sequence
  Synthetic
caccgctgtcccaaaaggtctttctataccatctaggaataatacttttctaattcctgagctaactaatttgtctacctgctcatttcctccaatacctttatgtgcaggtacccaagacatatcagcagccagggcct

SEQ ID NO: 399613 - DNA, 140 bp, Artificial Sequence
  Synthetic
atacgccatgctgggtctccagtgattttaacttaccctctgtagtggcaaaagaaatagtagccagctgtgacaaatgccagctaaaaggggaagccatacatggacaggtcaattgtacgtacttgggagtcggccat

SEQ ID NO: 399614 - DNA, 140 bp, Artificial Sequence
  Synthetic
atggccgactcccaagtacgtacaattgacctgtccatgtatggcttccccttttagctggcatttgtcacagctggctactatttcttttgccactacagagggtaagttaaaatcactggagacccagcatggcgtat

SEQ ID NO: 399615 - DNA, 140 bp, Artificial Sequence
  Synthetic
aggccctggctgctgatatgctcaaatcactctttggcaacgaccccttgtcacagtaaaaataggaggacagctgaaagaagctctattagatacaggagcagatgatacagtattagagaccttttgggacagcggtg

SEQ ID NO: 399616 - DNA, 140 bp, Artificial Sequence
  Synthetic
caccgctgtcccaaaaggtctctaatactgtatcatctgctcctgtatctaatagagcttctttcagctgtcctcctatttttactgtgacaaggggtcgttgccaaagagtgatttgagcatatcagcagccagggcct

SEQ ID NO: 399617 - DNA, 140 bp, Artificial Sequence
  Synthetic
atacgccatgctgggtctccagaccaccaatcaaaaggctgaattaatggcagtattattagccttacaggattccaaggaaacagtaaatatagtaacagattcacaatatgtattgggcgtacttgggagtcggccat

SEQ ID NO: 399618 - DNA, 140 bp, Artificial Sequence
  Synthetic
atggccgactcccaagtacgcccaatacatattgtgaatctgttactatatttactgtttccttggaatcctgtaaggctaataatactgccattaattcagccttttgattggtggtctggagacccagcatggcgtat

SEQ ID NO: 399619 - DNA, 140 bp, Artificial Sequence
  Synthetic
atacgccatgctgggtctccatgaaatatacaggttaattgaaaaatcgcagaaccagcaggaaaagaatgaacaagaattattggcattggacaaatgggcaagtctgtggaattggttcgtacttgggagtcggccat

SEQ ID NO: 399620 - DNA, 140 bp, Artificial Sequence
  Synthetic
atggccgactcccaagtacgaaccaattccacagacttgcccatttgtccaatgccaataattcttgttcattcttttcctgctggttctgcgatttttcaattaacctgtatatttcatggagacccagcatggcgtat

SEQ ID NO: 399621 - DNA, 140 bp, Artificial Sequence
  Synthetic
atacgccatgctgggtctcctgcagaaacaggacaggaaacagcatattttattttaaaattagctggaagatggccagtaaaagttatacacactgataatggacccaatttcactagtcgtacttgggagtcggccat

SEQ ID NO: 399622 - DNA, 140 bp, Artificial Sequence
  Synthetic
atggccgactcccaagtacgactagtgaaattgggtccattatcagtgtgtataacttttactggccatcttccagctaattttaaaataaaatatgctgtttcctgtcctgtttctgcaggagacccagcatggcgtat

SEQ ID NO: 399623 - DNA, 140 bp, Artificial Sequence
  Synthetic
atacgccatgctgggtctccttgaataataatagtaccactaccactaatagtagcgagggaaaggaaatgaagaactgttctttcaacatccccacaagcatgcaggataagacgaagacgtacttgggagtcggccat

SEQ ID NO: 399624 - DNA, 140 bp, Artificial Sequence
  Synthetic
atggccgactcccaagtacgtcttcgtcttatcctgcatgcttgtggggatgttgaaagaacagttcttcatttcctttccctcgctactattagtggtagtggtactattattattcaaggagacccagcatggcgtat

SEQ ID NO: 399625 - DNA, 140 bp, Artificial Sequence
  Synthetic
atacgccatgctgggtctccgccactgtaaaagcagcctgttggtgggcaaatatcacacaggaattcgggataccctacaatcctcaaagtcagggagtagtagaatccatgaataaagcgtacttgggagtcggccat

SEQ ID NO: 399626 - DNA, 140 bp, Artificial Sequence
  Synthetic
atggccgactcccaagtacgctttattcatggattctactactccctgactttgaggattgtagggtatcccgaattcctgtgtgatatttgcccaccaacaggctgcttttacagtggcggagacccagcatggcgtat

SEQ ID NO: 399627 - DNA, 140 bp, Artificial Sequence
  Synthetic
aggccctggctgctgatatggcagcatagttggatggcctgctgtaagagaaagaataagaagagctgagccagcagcagagggagtaggagcagcgtctcaagacttagataaacatgggaccttttgggacagcggtg

SEQ ID NO: 399628 - DNA, 140 bp, Artificial Sequence
  Synthetic
caccgctgtcccaaaaggtcccatgtttatctaagtcttgagacgctgctcctactccctctgctgctggctcagctcttcttattctttctcttacagcaggccatccaactatgctgccatatcagcagccagggcct

SEQ ID NO: 399629 - DNA, 140 bp, Artificial Sequence
  Synthetic
atacgccatgctgggtctcccatgtggcaagtggattcatagaagcagaagtaataccagcagaaacaggacaagaaactgcctacttcctgttaaaattagctgcaagatggcctgttacgtacttgggagtcggccat

SEQ ID NO: 399630 - DNA, 140 bp, Artificial Sequence
  Synthetic
atggccgactcccaagtacgtaacaggccatcttgcagctaattttaacaggaagtaggcagtttcttgtcctgtttctgctggtattacttctgcttctatgaatccacttgccacatgggagacccagcatggcgtat

SEQ ID NO: 399631 - DNA, 140 bp, Artificial Sequence
  Synthetic
atacgccatgctgggtctccacttctgtggaaaggagaaggggcagtggtaatccaagataacggagatataaaagtagtcccacgtaggaaagcaaaaataattagggattatggaaaacgtacttgggagtcggccat

SEQ ID NO: 399632 - DNA, 140 bp, Artificial Sequence
  Synthetic
atggccgactcccaagtacgttttccataatccctaattatttttgctttcctacgtgggactacttttatatctccgttatcttggattaccactgccccttctcctttccacagaagtggagacccagcatggcgtat

SEQ ID NO: 399633 - DNA, 140 bp, Artificial Sequence
  Synthetic
atacgccatgctgggtctcccatggcatagcttagtaaagcatcatatgtatgtgtcaagaaaggcagaagggtggtattatagacatcattatgaaacaaatcatccaaaaataagttccgtacttgggagtcggccat

SEQ ID NO: 399634 - DNA, 140 bp, Artificial Sequence
  Synthetic
atggccgactcccaagtacggaacttatttttggatgatttgtttcataatgatgtctataataccacccttctgcctttcttgacacatacatatgatgctttactaagctatgccatgggagacccagcatggcgtat

SEQ ID NO: 399635 - DNA, 140 bp, Artificial Sequence
  Synthetic
atacgccatgctgggtctccagaacagtttaataaaacaataatctttaagtccccctcaggaggggacccagaaattgtacagcacacttttaattgtggaggggaatttttctactgtcgtacttgggagtcggccat

SEQ ID NO: 399636 - DNA, 140 bp, Artificial Sequence
  Synthetic
atggccgactcccaagtacgacagtagaaaaattcccctccacaattaaaagtgtgctgtacaatttctgggtcccctcctgagggggacttaaagattattgttttattaaactgttctggagacccagcatggcgtat

SEQ ID NO: 399637 - DNA, 140 bp, Artificial Sequence
  Synthetic
aggccctggctgctgatatgatagaatggaaactaggaaaatacaagacacaagttgatcctgaaatggcagacaagctaatacatctttattattttaattgttttacagcctctgccagaccttttgggacagcggtg

SEQ ID NO: 399638 - DNA, 140 bp, Artificial Sequence
  Synthetic
caccgctgtcccaaaaggtctggcagaggctgtaaaacaattaaaataataaagatgtattagcttgtctgccatttcaggatcaacttgtgtcttgtattttcctagtttccattctatcatatcagcagccagggcct

SEQ ID NO: 399639 - DNA, 140 bp, Artificial Sequence
  Synthetic
aggccctggctgctgatatgaggtgagggagcagtagtcatacaagataaaggagacattaaggtagtaccaagaagaaaggcaaaaataatcagacattatggaaaacagatggcaggtgaccttttgggacagcggtg

SEQ ID NO: 399640 - DNA, 140 bp, Artificial Sequence
  Synthetic
caccgctgtcccaaaaggtcacctgccatctgttttccataatgtctgattatttttgcctttcttcttggtactaccttaatgtctcctttatcttgtatgactactgctccctcacctcatatcagcagccagggcct

SEQ ID NO: 399641 - DNA, 140 bp, Artificial Sequence
  Synthetic
aggccctggctgctgatatgtggtgggcagggatagagcacacctttggggtaccatacaatccacagagtcagggagtagtggaagcaatgaatcaccacctgaaaaatcaaatagatagaccttttgggacagcggtg

SEQ ID NO: 399642 - DNA, 140 bp, Artificial Sequence
  Synthetic
caccgctgtcccaaaaggtctatctatttgatttttcaggtggtgattcattgcttccactactccctgactctgtggattgtatggtaccccaaaggtgtgctctatccctgcccaccacatatcagcagccagggcct

SEQ ID NO: 399643 - DNA, 140 bp, Artificial Sequence
  Synthetic
atacgccatgctgggtctccggtgggagtaaagaagagaaagccacccttacctagtgtgactaagttaacagaagatagatggaacaagcaccagaagacgcagggccacagagggaaccgtacttgggagtcggccat

SEQ ID NO: 399644 - DNA, 140 bp, Artificial Sequence
  Synthetic
atggccgactcccaagtacggttccctctgtggccctgcgtcttctggtgcttgttccatctatcttctgttaacttagtcacactaggtaagggtggctttctcttctttactcccaccggagacccagcatggcgtat

SEQ ID NO: 399645 - DNA, 140 bp, Artificial Sequence
  Synthetic
atacgccatgctgggtctcccctataatgaatggacactagaattattagaagaattaaaaaatgaagctgtgcgccattttccaaggacttggctacatgggttagggcaacacatctacgtacttgggagtcggccat

SEQ ID NO: 399646 - DNA, 140 bp, Artificial Sequence
  Synthetic
atggccgactcccaagtacgtagatgtgttgccctaacccatgtagccaagtccttggaaaatggcgcacagcttcattttttaattcttctaataattctagtgtccattcattataggggagacccagcatggcgtat

SEQ ID NO: 399647 - DNA, 140 bp, Artificial Sequence
  Synthetic
atacgccatgctgggtctcctacaacaattactgtttatccattataggattggctgccagcatagcagaatagggattactcctcgggggagaaggaatggagccagtagatcctagatcgtacttgggagtcggccat

SEQ ID NO: 399648 - DNA, 140 bp, Artificial Sequence
  Synthetic
atggccgactcccaagtacgatctaggatctactggctccattccttctcccccgaggagtaatccctattctgctatgctggcagccaatcctataatggataaacagtaattgttgtaggagacccagcatggcgtat

SEQ ID NO: 399649 - DNA, 140 bp, Artificial Sequence
  Synthetic
aggccctggctgctgatatgatagggattactcctcgggggagaaggaatggagccagtagatcctagattagagccctggaatcatccaggaagccaacccaagacagcttgcaatggagaccttttgggacagcggtg

SEQ ID NO: 399650 - DNA, 140 bp, Artificial Sequence
  Synthetic
caccgctgtcccaaaaggtctccattgcaagctgtcttgggttggcttcctggatgattccagggctctaatctaggatctactggctccattccttctcccccgaggagtaatccctatcatatcagcagccagggcct

SEQ ID NO: 399651 - DNA, 140 bp, Artificial Sequence
  Synthetic
atacgccatgctgggtctccctcctgggaatttggggctgctctggaaaactcatttgccccactgctgtgccttggaatgctagttggagtaacaaatcctattcagagatttggaatacgtacttgggagtcggccat

SEQ ID NO: 399652 - DNA, 140 bp, Artificial Sequence
  Synthetic
atggccgactcccaagtacgtattccaaatctctgaataggatttgttactccaactagcattccaaggcacagcagtggggcaaatgagttttccagagcagccccaaattcccaggagggagacccagcatggcgtat

SEQ ID NO: 399653 - DNA, 140 bp, Artificial Sequence
  Synthetic
atacgccatgctgggtctccaggcttaggcatatcatatggcaggaagaagcggagtcaacgacgaagaactcctaagagcagtaagaatcatcaagatcctataccagagcagtaagtacgtacttgggagtcggccat

SEQ ID NO: 399654 - DNA, 140 bp, Artificial Sequence
  Synthetic
atggccgactcccaagtacgtacttactgctctggtataggatcttgatgattcttactgctcttaggagttcttcgtcgttgactccgcttcttcctgccatatgatatgcctaagcctggagacccagcatggcgtat

SEQ ID NO: 399655 - DNA, 140 bp, Artificial Sequence
  Synthetic
atacgccatgctgggtctccgagtcagcctaaaactgcttgtaacaagtgctattgtaaagtgtgttgctggcattgtcaagtctgctttctgaacaaaggcttaggcatctcctatggccgtacttgggagtcggccat

SEQ ID NO: 399656 - DNA, 140 bp, Artificial Sequence
  Synthetic
atggccgactcccaagtacggccataggagatgcctaagcctttgttcagaaagcagacttgacaatgccagcaacacactttacaatagcacttgttacaagcagttttaggctgactcggagacccagcatggcgtat

SEQ ID NO: 399657 - DNA, 140 bp, Artificial Sequence
  Synthetic
aggccctggctgctgatatgcatacctacaagaataagacagggcttggaaagggctttgctataagatgggtggcaagtggtcaaaacgtagtggggttggatggcctactgtaagggagaccttttgggacagcggtg

SEQ ID NO: 399658 - DNA, 140 bp, Artificial Sequence
  Synthetic
caccgctgtcccaaaaggtctcccttacagtaggccatccaaccccactacgttttgaccacttgccacccatcttatagcaaagccctttccaagccctgtcttattcttgtaggtatgcatatcagcagccagggcct

SEQ ID NO: 399659 - DNA, 140 bp, Artificial Sequence
  Synthetic
atacgccatgctgggtctcctaaaattgcaggaaaaaatagaacaaataagacaaagaataagagatagaacagaagatagtggcagtgagaatgatggggatgcagattggttggccatcgtacttgggagtcggccat

SEQ ID NO: 399660 - DNA, 140 bp, Artificial Sequence
  Synthetic
atggccgactcccaagtacgatggccaaccaatctgcatccccatcattctcactgccactatcttctgttctatctcttattctttgtcttatttgttctattttttcctgcaattttaggagacccagcatggcgtat

SEQ ID NO: 399661 - DNA, 140 bp, Artificial Sequence
  Synthetic
atacgccatgctgggtctcctatttgcccattttagaattggatgccaacatagtagaataggaattaacccatctaacacaagaggaagaggaagaagaaatggatccagtagatcctgcgtacttgggagtcggccat

SEQ ID NO: 399662 - DNA, 140 bp, Artificial Sequence
  Synthetic
atggccgactcccaagtacgcaggatctactggatccatttcttcttcctcttcctcttgtgttagatgggttaattcctattctactatgttggcatccaattctaaaatgggcaaataggagacccagcatggcgtat

SEQ ID NO: 399663 - DNA, 140 bp, Artificial Sequence
  Synthetic
aggccctggctgctgatatgccatctaacacaagaggaagaggaagaagaaatggatccagtagatcctgagatgcccccttggcatcaccctggaagtcagccccagaccccttgtaatgaccttttgggacagcggtg

SEQ ID NO: 399664 - DNA, 140 bp, Artificial Sequence
  Synthetic
caccgctgtcccaaaaggtcattacaaggggtctggggctgacttccagggtgatgccaagggggcatctcaggatctactggatccatttcttcttcctcttcctcttgtgttagatggcatatcagcagccagggcct

SEQ ID NO: 399665 - DNA, 140 bp, Artificial Sequence
  Synthetic
aggccctggctgctgatatggacagtggaaatgagagtgaaggggatacagaggaattggcaacacttgtggacatgggggactttgatcattgggttggggataatttgtagtgcctcagaccttttgggacagcggtg

SEQ ID NO: 399666 - DNA, 140 bp, Artificial Sequence
  Synthetic
caccgctgtcccaaaaggtctgaggcactacaaattatccccaacccaatgatcaaagtcccccatgtccacaagtgttgccaattcctctgtatccccttcactctcatttccactgtccatatcagcagccagggcct

SEQ ID NO: 399667 - DNA, 140 bp, Artificial Sequence
  Synthetic
atacgccatgctgggtctccagtgcaagaggacattattagtttatgggaacagagcttaaagccctgtgttaaattaaccccattatgtgtaactatgaattgtagcaatagcaatggacgtacttgggagtcggccat

SEQ ID NO: 399668 - DNA, 140 bp, Artificial Sequence
  Synthetic
atggccgactcccaagtacgtccattgctattgctacaattcatagttacacataatggggttaatttaacacagggctttaagctctgttcccataaactaataatgtcctcttgcactggagacccagcatggcgtat

SEQ ID NO: 399669 - DNA, 140 bp, Artificial Sequence
  Synthetic
atacgccatgctgggtctccagaataagacaaattgaggatgacagtgactatgaaagtgatggaaaagaggaacaggaagttagggatcttgtgcatggttatggctttgataaccccacgtacttgggagtcggccat

SEQ ID NO: 399670 - DNA, 140 bp, Artificial Sequence
  Synthetic
atggccgactcccaagtacgtggggttatcaaagccataaccatgcacaagatccctaacttcctgttcctcttttccatcactttcatagtcactgtcatcctcaatttgtcttattctggagacccagcatggcgtat

SEQ ID NO: 399671 - DNA, 140 bp, Artificial Sequence
  Synthetic
atacgccatgctgggtctccactgatttcaactgtaccggaaagtgcaataaaggcactgaaggaaacaacagcgctgtgacagacattagagaaataaaaaactgctctttcaacatgacgtacttgggagtcggccat

SEQ ID NO: 399672 - DNA, 140 bp, Artificial Sequence
  Synthetic
atggccgactcccaagtacgtcatgttgaaagagcagttttttatttctctaatgtctgtcacagcgctgttgtttccttcagtgcctttattgcactttccggtacagttgaaatcagtggagacccagcatggcgtat

SEQ ID NO: 399673 - DNA, 140 bp, Artificial Sequence
  Synthetic
aggccctggctgctgatatggggaacccttaacttccctcagatcactctttggcagcgaccccttgtctcaataaaagtagggggccagataaaggaggctctcttagacacaggagcagaccttttgggacagcggtg

SEQ ID NO: 399674 - DNA, 140 bp, Artificial Sequence
  Synthetic
caccgctgtcccaaaaggtctgctcctgtgtctaagagagcctcctttatctggccccctacttttattgagacaaggggtcgctgccaaagagtgatctgagggaagttaagggttccccatatcagcagccagggcct

SEQ ID NO: 399675 - DNA, 140 bp, Artificial Sequence
  Synthetic
atacgccatgctgggtctcctttaatggaacaggggaatgtaaaaatgtgagtactgtacaatgcacacatggaataaagccagtgatatccactcagttaatcctaaatgggagcttagcgtacttgggagtcggccat

SEQ ID NO: 399676 - DNA, 140 bp, Artificial Sequence
  Synthetic
atggccgactcccaagtacgctaagctcccatttaggattaactgagtggatatcactggctttattccatgtgtgcattgtacagtactcacatttttacattcccctgttccattaaaggagacccagcatggcgtat

SEQ ID NO: 399677 - DNA, 140 bp, Artificial Sequence
  Synthetic
aggccctggctgctgatatgtggaataaagccagtgatatccactcagttaatcctaaatgggagcttagataaagatattgttattagaaataatagtggtggaaatctgttggtgcaagaccttttgggacagcggtg

SEQ ID NO: 399678 - DNA, 140 bp, Artificial Sequence
  Synthetic
caccgctgtcccaaaaggtcttgcaccaacagatttccaccactattatttctaataacaatatctttatctaagctcccatttaggattaactgagtggatatcactggctttattccacatatcagcagccagggcct

SEQ ID NO: 399679 - DNA, 140 bp, Artificial Sequence
  Synthetic
atacgccatgctgggtctccaggacaggtacaaataggacctgctatgacattttataacatagaaaaaatagtaggagacattagacaagcacactgtaatgtctctaacgaatggagacgtacttgggagtcggccat

SEQ ID NO: 399680 - DNA, 140 bp, Artificial Sequence
  Synthetic
atggccgactcccaagtacgtctccattcgttagagacattacagtgtgcttgtctaatgtctcctactattttttctatgttataaaatgtcatagcaggtcctatttgtacctgtcctggagacccagcatggcgtat

SEQ ID NO: 399681 - DNA, 140 bp, Artificial Sequence
  Synthetic
atacgccatgctgggtctcccataacattcaaggctcaggaaaagaatggaggagacccagaagtaacacacttaatgttcaattgtggaggagagtttatctattgtaatacttccagacgtacttgggagtcggccat

SEQ ID NO: 399682 - DNA, 140 bp, Artificial Sequence
  Synthetic
atggccgactcccaagtacgtctggaagtattacaatagataaactctcctccacaattgaacattaagtgtgttacttctgggtctcctccattcttttcctgagccttgaatgttatgggagacccagcatggcgtat

SEQ ID NO: 399683 - DNA, 140 bp, Artificial Sequence
  Synthetic
atacgccatgctgggtctccgccctgtagaataagacaaattgtaaatttgtggacaagagtaggaaaaggaatttatgcaccgccaattcggggaaatcttacctgtaactccactattcgtacttgggagtcggccat

SEQ ID NO: 399684 - DNA, 140 bp, Artificial Sequence
  Synthetic
atggccgactcccaagtacgaatagtggagttacaggtaagatttccccgaattggcggtgcataaattccttttcctactcttgtccacaaatttacaatttgtcttattctacagggcggagacccagcatggcgtat

SEQ ID NO: 399685 - DNA, 140 bp, Artificial Sequence
  Synthetic
atacgccatgctgggtctcctaaatgggacaatctctgaaggaaagataagaattatgggaaaaaatatttcagacactgggaaaaatatcatagtgaccataaattctactataaacatcgtacttgggagtcggccat

SEQ ID NO: 399686 - DNA, 140 bp, Artificial Sequence
  Synthetic
atggccgactcccaagtacgatgtttatagtagaatttatggtcactatgatatttttcccagtgtctgaaatattttttcccataattcttatctttccttcagagattgtcccatttaggagacccagcatggcgtat

SEQ ID NO: 399687 - DNA, 140 bp, Artificial Sequence
  Synthetic
aggccctggctgctgatatgccaacaacaatacaagaaagagtataggatttggaccaggacaagcgttctatgcaacaggtgacataacaggagatataagacaagcattttgtgtggtgaccttttgggacagcggtg

SEQ ID NO: 399688 - DNA, 140 bp, Artificial Sequence
  Synthetic
caccgctgtcccaaaaggtcaccacacaaaatgcttgtcttatatctcctgttatgtcacctgttgcatagaacgcttgtcctggtccaaatcctatactctttcttgtattgttgttggcatatcagcagccagggcct

SEQ ID NO: 399689 - DNA, 140 bp, Artificial Sequence
  Synthetic
aggccctggctgctgatatgaaacagtcagtatagaacccataggagtagcaccaggtaaagctaaaagacgcacagtgagtagagaaaaaagagcagcctttggactaggtgcgctgttgaccttttgggacagcggtg

SEQ ID NO: 399690 - DNA, 140 bp, Artificial Sequence
  Synthetic
caccgctgtcccaaaaggtcaacagcgcacctagtccaaaggctgctcttttttctctactcactgtgcgtcttttagctttacctggtgctactcctatgggttctatactgactgtttcatatcagcagccagggcct

SEQ ID NO: 399691 - DNA, 140 bp, Artificial Sequence
  Synthetic
atacgccatgctgggtctcctctggggtttcttggagcagcagggagcactatgggcgcagcgtcaataacgctgacggtacaggcccggacattgttatctgggatagtgcaacagcagcgtacttgggagtcggccat

SEQ ID NO: 399692 - DNA, 140 bp, Artificial Sequence
  Synthetic
atggccgactcccaagtacgctgctgttgcactatcccagataacaatgtccgggcctgtaccgtcagcgttattgacgctgcgcccatagtgctccctgctgctccaagaaaccccagaggagacccagcatggcgtat

SEQ ID NO: 399693 - DNA, 140 bp, Artificial Sequence
  Synthetic
aggccctggctgctgatatgagattatagattaggagtaggagcattgatagtagcactaatcatagcaataattgtgtggaccatagcatatatagaatataggaaactgttaagacaagaccttttgggacagcggtg

SEQ ID NO: 399694 - DNA, 140 bp, Artificial Sequence
  Synthetic
caccgctgtcccaaaaggtcttgtcttaacagtttcctatattctatatatgctatggtccacacaattattgctatgattagtgctactatcaatgctcctactcctaatctataatctcatatcagcagccagggcct

SEQ ID NO: 399695 - DNA, 140 bp, Artificial Sequence
  Synthetic
atacgccatgctgggtctccaatctggggcattaaacagctccgtgcaaaagtccttgctatagaaagataccttagggatcagcaaatcctaagtctatggggctgctcaggaaaaactcgtacttgggagtcggccat

SEQ ID NO: 399696 - DNA, 140 bp, Artificial Sequence
  Synthetic
atggccgactcccaagtacgagtttttcctgagcagccccatagacttaggatttgctgatccctaaggtatctttctatagcaaggacttttgcacggagctgtttaatgccccagattggagacccagcatggcgtat

SEQ ID NO: 399697 - DNA, 140 bp, Artificial Sequence
  Synthetic
atacgccatgctgggtctccgcattaatggcacaatatcttgcaggataaaacaggtggtaaggtcatggatacagggagggtcgggactttatgcacctcccaggccaggttacctaaccgtacttgggagtcggccat

SEQ ID NO: 399698 - DNA, 140 bp, Artificial Sequence
  Synthetic
atggccgactcccaagtacggttaggtaacctggcctgggaggtgcataaagtcccgaccctccctgtatccatgaccttaccacctgttttatcctgcaagatattgtgccattaatgcggagacccagcatggcgtat

SEQ ID NO: 399699 - DNA, 140 bp, Artificial Sequence
  Synthetic
  misc_feature (30)..(30): n is a, c, g, or t
  misc_feature (108)..(108): n is a, c, g, or t
atacgccatgctgggtctccttatgatacnatctggggtaatttaacctggcagcaatgggataggaaagtaagaaactattcaggtgtcatttttgagcttataganaaggcacaagaacgtacttgggagtcggccat

SEQ ID NO: 399700 - DNA, 140 bp, Artificial Sequence
  Synthetic
  misc_feature (33)..(33): n is a, c, g, or t
  misc_feature (111)..(111): n is a, c, g, or t
atggccgactcccaagtacgttcttgtgccttntctataagctcaaaaatgacacctgaatagtttcttactttcctatcccattgctgccaggttaaattaccccagatngtatcataaggagacccagcatggcgtat

SEQ ID NO: 399701 - DNA, 140 bp, Artificial Sequence
  Synthetic
aggccctggctgctgatatgtctgtggaactggtttagtatcacaaactggctgtggtacatcaagatagctataatggtagtagcaggcattataggcataagaatcataagtgtaatagaccttttgggacagcggtg

SEQ ID NO: 399702 - DNA, 140 bp, Artificial Sequence
  Synthetic
caccgctgtcccaaaaggtctattacacttatgattcttatgcctataatgcctgctactaccattatagctatcttgatgtaccacagccagtttgtgatactaaaccagttccacagacatatcagcagccagggcct

SEQ ID NO: 399703 - DNA, 140 bp, Artificial Sequence
  Synthetic
aggccctggctgctgatatgtggtggatcagatgcatgaggatataatcagtttatgggatcaaagcctaaagccatgtgtaaagttgaccccactctgtgtcactttaaattgtacaaagaccttttgggacagcggtg

SEQ ID NO: 399704 - DNA, 140 bp, Artificial Sequence
  Synthetic
caccgctgtcccaaaaggtctttgtacaatttaaagtgacacagagtggggtcaactttacacatggctttaggctttgatcccataaactgattatatcctcatgcatctgatccaccacatatcagcagccagggcct

SEQ ID NO: 399705 - DNA, 140 bp, Artificial Sequence
  Synthetic
atacgccatgctgggtctcctgctactaggccagttactaggacaaatacaactgctaccggtacgaataatactgtgacaaattgtagtggtagtgctagtactaacaatacttgtatgcgtacttgggagtcggccat

SEQ ID NO: 399706 - DNA, 140 bp, Artificial Sequence
  Synthetic
atggccgactcccaagtacgcatacaagtattgttagtactagcactaccactacaatttgtcacagtattattcgtaccggtagcagttgtatttgtcctagtaactggcctagtagcaggagacccagcatggcgtat

SEQ ID NO: 399707 - DNA, 140 bp, Artificial Sequence
  Synthetic
aggccctggctgctgatatgccaagaataagttcagaagtacacatcccactaggggatgctaaattggtaataacaacatattggggtctgcatacaggagaaagagactggcatttgggaccttttgggacagcggtg

SEQ ID NO: 399708 - DNA, 140 bp, Artificial Sequence
  Synthetic
caccgctgtcccaaaaggtcccaaatgccagtctctttctcctgtatgcagaccccaatatgttgttattaccaatttagcatcccctagtgggatgtgtacttctgaacttattcttggcatatcagcagccagggcct

SEQ ID NO: 399709 - DNA, 140 bp, Artificial Sequence
  Synthetic
atacgccatgctgggtctccaagggataagaaaaagaaagagtatgcacttttttatagacttgatatagtaccacttaatgagactagggacaactctagttatagattaataaattgtcgtacttgggagtcggccat

SEQ ID NO: 399710 - DNA, 140 bp, Artificial Sequence
  Synthetic
atggccgactcccaagtacgacaatttattaatctataactagagttgtccctagtctcattaagtggtactatatcaagtctataaaaaagtgcatactctttctttttcttatcccttggagacccagcatggcgtat

SEQ ID NO: 399711 - DNA, 140 bp, Artificial Sequence
  Synthetic
aggccctggctgctgatatgtagtgctatcagcttgcttaacacaatagctattgtagtagcagagggaacagacaggcttatagaattagcacaaagaataggaaggggaatattacacgaccttttgggacagcggtg

SEQ ID NO: 399712 - DNA, 140 bp, Artificial Sequence
  Synthetic
caccgctgtcccaaaaggtcgtgtaatattccccttcctattctttgtgctaattctataagcctgtctgttccctctgctactacaatagctattgtgttaagcaagctgatagcactacatatcagcagccagggcct

SEQ ID NO: 399713 - DNA, 140 bp, Artificial Sequence
  Synthetic
atacgccatgctgggtctcccagacaggcttatagaattagcacaaagaataggaaggggaatattacacatacctagaagaatcagacagggcctagaaagagcacttctataagatggcgtacttgggagtcggccat

SEQ ID NO: 399714 - DNA, 140 bp, Artificial Sequence
  Synthetic
atggccgactcccaagtacgccatcttatagaagtgctctttctaggccctgtctgattcttctaggtatgtgtaatattccccttcctattctttgtgctaattctataagcctgtctgggagacccagcatggcgtat

SEQ ID NO: 399715 - DNA, 140 bp, Artificial Sequence
  Synthetic
atacgccatgctgggtctccgaaaaatttggtcaaagagcagcatagtaggatggccagaaatcagagaaagaatgagaagacaacgacctcacgagccagcagtagagccagcagtaggcgtacttgggagtcggccat

SEQ ID NO: 399716 - DNA, 140 bp, Artificial Sequence
  Synthetic
atggccgactcccaagtacgcctactgctggctctactgctggctcgtgaggtcgttgtcttctcattctttctctgatttctggccatcctactatgctgctctttgaccaaatttttcggagacccagcatggcgtat

SEQ ID NO: 399717 - DNA, 140 bp, Artificial Sequence
  Synthetic
aggccctggctgctgatatgagaatgagaagacaacgacctcacgagccagcagtagagccagcagtaggagtaggagcagcttctcaagatctagccaatcgaggggccctcaccacaagaccttttgggacagcggtg

SEQ ID NO: 399718 - DNA, 140 bp, Artificial Sequence
  Synthetic
caccgctgtcccaaaaggtcttgtggtgagggcccctcgattggctagatcttgagaagctgctcctactcctactgctggctctactgctggctcgtgaggtcgttgtcttctcattctcatatcagcagccagggcct

SEQ ID NO: 399719 - DNA, 140 bp, Artificial Sequence
  Synthetic
atacgccatgctgggtctccgacattctatacaacaggacaaataataggagacataagacaagcacattgcaacattacaggaaaagaatggaataaaactttacgccaggtaggtgcacgtacttgggagtcggccat

SEQ ID NO: 399720 - DNA, 140 bp, Artificial Sequence
  Synthetic
atggccgactcccaagtacgtgcacctacctggcgtaaagttttattccattcttttcctgtaatgttgcaatgtgcttgtcttatgtctcctattatttgtcctgttgtatagaatgtcggagacccagcatggcgtat

SEQ ID NO: 399721 - DNA, 140 bp, Artificial Sequence
  Synthetic
atacgccatgctgggtctccaggaggggacctagagattacaacacatagctttacttgtagcggagaattcttctattgcaatacatcaaaactgtttaatattagtatgtcaaacctgcgtacttgggagtcggccat

SEQ ID NO: 399722 - DNA, 140 bp, Artificial Sequence
  Synthetic
atggccgactcccaagtacgcaggtttgacatactaatattaaacagttttgatgtattgcaatagaagaattctccgctacaagtaaagctatgtgttgtaatctctaggtcccctcctggagacccagcatggcgtat

SEQ ID NO: 399723 - DNA, 140 bp, Artificial Sequence
  Synthetic
atacgccatgctgggtctccacaagcctactagatacccttgcagtggcagttgccaattggactgacggtataattttagggctacaaaggataggaagaggaattcttaacatcccaacgtacttgggagtcggccat

SEQ ID NO: 399724 - DNA, 140 bp, Artificial Sequence
  Synthetic
atggccgactcccaagtacgttgggatgttaagaattcctcttcctatcctttgtagccctaaaattataccgtcagtccaattggcaactgccactgcaagggtatctagtaggcttgtggagacccagcatggcgtat

SEQ ID NO: 399725 - DNA, 140 bp, Artificial Sequence
  Synthetic
aggccctggctgctgatatgtataattttagggctacaaaggataggaagaggaattcttaacatcccaagaagaattagacagggcttagaaagagctttattgtaacatgggaaacgtgaccttttgggacagcggtg

SEQ ID NO: 399726 - DNA, 140 bp, Artificial Sequence
  Synthetic
caccgctgtcccaaaaggtcacgtttcccatgttacaataaagctctttctaagccctgtctaattcttcttgggatgttaagaattcctcttcctatcctttgtagccctaaaattatacatatcagcagccagggcct

SEQ ID NO: 399727 - DNA, 140 bp, Artificial Sequence
  Synthetic
aggccctggctgctgatatgaccagctctcaatacagggtcagaaggactgcgctccttatataacaccttagcagttctttattgtgtccatagtacaataccggtacttaatacacaagaccttttgggacagcggtg

SEQ ID NO: 399728 - DNA, 140 bp, Artificial Sequence
  Synthetic
caccgctgtcccaaaaggtcttgtgtattaagtaccggtattgtactatggacacaataaagaactgctaaggtgttatataaggagcgcagtccttctgaccctgtattgagagctggtcatatcagcagccagggcct

SEQ ID NO: 399729 - DNA, 140 bp, Artificial Sequence
  Synthetic
aggccctggctgctgatatgttgtaacacctcagtcattacacaggcctgtccaaaggtatcctttgagccaattcccatacattattgtgccccggctggttttgcgattctaaagtgtgaccttttgggacagcggtg

SEQ ID NO: 399730 - DNA, 140 bp, Artificial Sequence
  Synthetic
caccgctgtcccaaaaggtcacactttagaatcgcaaaaccagccggggcacaataatgtatgggaattggctcaaaggatacctttggacaggcctgtgtaatgactgaggtgttacaacatatcagcagccagggcct

SEQ ID NO: 399731 - DNA, 140 bp, Artificial Sequence
  Synthetic
aggccctggctgctgatatgcaattcccatacattattgtgccccggctggttttgcgattctaaagtgtaacgataagaagttcaatggaacaggaccatgtacaaatgtcagcacagtgaccttttgggacagcggtg

SEQ ID NO: 399732 - DNA, 140 bp, Artificial Sequence
  Synthetic
caccgctgtcccaaaaggtcactgtgctgacatttgtacatggtcctgttccattgaacttcttatcgttacactttagaatcgcaaaaccagccggggcacaataatgtatgggaattgcatatcagcagccagggcct

SEQ ID NO: 399733 - DNA, 140 bp, Artificial Sequence
  Synthetic
aggccctggctgctgatatgaacaatgctaaaaccataatagtacagctgaacgaatctgtagtaattaattgtacaagacccaacaacaatacaagaaaaagtatacatataggaccaggaccttttgggacagcggtg

SEQ ID NO: 399734 - DNA, 140 bp, Artificial Sequence
  Synthetic
caccgctgtcccaaaaggtcctggtcctatatgtatactttttcttgtattgttgttgggtcttgtacaattaattactacagattcgttcagctgtactattatggttttagcattgttcatatcagcagccagggcct

SEQ ID NO: 399735 - DNA, 140 bp, Artificial Sequence
  Synthetic
atacgccatgctgggtctccagcctagaggcagtgatatagcagggacaactagtactctgccagaacagataacatggatgacttctaaccctcctattccagtaggagatatttatagcgtacttgggagtcggccat

SEQ ID NO: 399736 - DNA, 140 bp, Artificial Sequence
  Synthetic
atggccgactcccaagtacgctataaatatctcctactggaataggagggttagaagtcatccatgttatctgttctggcagagtactagttgtccctgctatatcactgcctctaggctggagacccagcatggcgtat

SEQ ID NO: 399737 - DNA, 140 bp, Artificial Sequence
  Synthetic
atacgccatgctgggtctcctagcacttatttcccttgctttacagcgggagaagtgagaagggccatcaggggagaacaactgctgtcttgctgcaggttcccgagagctcataagtaccgtacttgggagtcggccat

SEQ ID NO: 399738 - DNA, 140 bp, Artificial Sequence
  Synthetic
atggccgactcccaagtacggtacttatgagctctcgggaacctgcagcaagacagcagttgttctcccctgatggcccttctcacttctcccgctgtaaagcaagggaaataagtgctaggagacccagcatggcgtat

SEQ ID NO: 399739 - DNA, 140 bp, Artificial Sequence
  Synthetic
aggccctggctgctgatatgcatcctcaggaggggacccagaaattgtaacacacagttttatttgtggaggggaatttttctactgtaatacatcacaactgtttaatagtacttggaagaccttttgggacagcggtg

SEQ ID NO: 399740 - DNA, 140 bp, Artificial Sequence
  Synthetic
caccgctgtcccaaaaggtcttccaagtactattaaacagttgtgatgtattacagtagaaaaattcccctccacaaataaaactgtgtgttacaatttctgggtcccctcctgaggatgcatatcagcagccagggcct

SEQ ID NO: 399741 - DNA, 140 bp, Artificial Sequence
  Synthetic
aggccctggctgctgatatgggcttaggcatctcctatggcaggaagaagcggagacagcgacgcagaactcctcaaagcagtcagagccatcaagatcttgtaccaaagcagtaagtatgaccttttgggacagcggtg

SEQ ID NO: 399742 - DNA, 140 bp, Artificial Sequence
  Synthetic
caccgctgtcccaaaaggtcatacttactgctttggtacaagatcttgatggctctgactgctttgaggagttctgcgtcgctgtctccgcttcttcctgccataggagatgcctaagcccatatcagcagccagggcct

SEQ ID NO: 399743 - DNA, 140 bp, Artificial Sequence
  Synthetic
atacgccatgctgggtctccatgacggcctgccagggagtggggggaccagggcataaggcaagagtgctagcagaagctacggcacaggcacaggcagcaaccagtgtctttgtacaaacgtacttgggagtcggccat

SEQ ID NO: 399744 - DNA, 140 bp, Artificial Sequence
  Synthetic
atggccgactcccaagtacgtttgtacaaagacactggttgctgcctgtgcctgtgccgtagcttctgctagcactcttgccttatgccctggtccccccactccctggcaggccgtcatggagacccagcatggcgtat

SEQ ID NO: 399745 - DNA, 140 bp, Artificial Sequence
  Synthetic
aggccctggctgctgatatgcctagaagaataagacagggctttgaagcagctttgctataaaatggggaacaagtggtcaaaaagctggcctgctgtaagagaaagattaagaagaactgaccttttgggacagcggtg

SEQ ID NO: 399746 - DNA, 140 bp, Artificial Sequence
  Synthetic
caccgctgtcccaaaaggtcagttcttcttaatctttctcttacagcaggccagctttttgaccacttgttccccattttatagcaaagctgcttcaaagccctgtcttattcttctaggcatatcagcagccagggcct

SEQ ID NO: 399747 - DNA, 140 bp, Artificial Sequence
  Synthetic
atacgccatgctgggtctccccagggaactttccccagacaacaacaaggaaagagcccacagccccgccactagagagttatgggtctcaggaggagaggagcacacagagaaaggagacgtacttgggagtcggccat

SEQ ID NO: 399748 - DNA, 140 bp, Artificial Sequence
  Synthetic
atggccgactcccaagtacgtctcctttctctgtgtgctcctctcctcctgagacccataactctctagtggcggggctgtgggctctttccttgttgttgtctggggaaagttccctggggagacccagcatggcgtat

SEQ ID NO: 399749 - DNA, 140 bp, Artificial Sequence
  Synthetic
atacgccatgctgggtctcccgatcaaaacagcaccctgcgggaagagccaggggcaatacaaaactgttcttttaatatgaccacagaagtaagagataagaagaagaaagtatatgcacgtacttgggagtcggccat

SEQ ID NO: 399750 - DNA, 140 bp, Artificial Sequence
  Synthetic
atggccgactcccaagtacgtgcatatactttcttcttcttatctcttacttctgtggtcatattaaaagaacagttttgtattgcccctggctcttcccgcagggtgctgttttgatcgggagacccagcatggcgtat

SEQ ID NO: 399751 - DNA, 140 bp, Artificial Sequence
  Synthetic
atacgccatgctgggtctccagttaataatggtactacctgtgataataacacatgtgaagagataagaaattgcactttcaatacaaccacagtaataagggataaaaaacagcaagtgcgtacttgggagtcggccat

SEQ ID NO: 399752 - DNA, 140 bp, Artificial Sequence
  Synthetic
atggccgactcccaagtacgcacttgctgttttttatcccttattactgtggttgtattgaaagtgcaatttcttatctcttcacatgtgttattatcacaggtagtaccattattaactggagacccagcatggcgtat

SEQ ID NO: 399753 - DNA, 140 bp, Artificial Sequence
  Synthetic
aggccctggctgctgatatgaggattgtggaacttctgggacgcagggggtgggaagccctcaaatattggtggaatctcctgcagtattggagtcaggaactaaagaatagtgctgttagaccttttgggacagcggtg

SEQ ID NO: 399754 - DNA, 140 bp, Artificial Sequence
  Synthetic
caccgctgtcccaaaaggtctaacagcactattctttagttcctgactccaatactgcaggagattccaccaatatttgagggcttcccaccccctgcgtcccagaagttccacaatcctcatatcagcagccagggcct

SEQ ID NO: 399755 - DNA, 140 bp, Artificial Sequence
  Synthetic
atacgccatgctgggtctcctagtgagtatatattaataaattgcaatacctcaaccataacacaggcctgtccaaaggtctcttttgacccgattcctatacattattgtgctccagctcgtacttgggagtcggccat

SEQ ID NO: 399756 - DNA, 140 bp, Artificial Sequence
  Synthetic
atggccgactcccaagtacgagctggagcacaataatgtataggaatcgggtcaaaagagacctttggacaggcctgtgttatggttgaggtattgcaatttattaatatatactcactaggagacccagcatggcgtat

SEQ ID NO: 399757 - DNA, 140 bp, Artificial Sequence
  Synthetic
aggccctggctgctgatatgacaaatcagaagactgagttacaagcaattaatctagccttgcaggattcaggattagaagtaaacatagtaacagactcacaatatgcattaggaatcagaccttttgggacagcggtg

SEQ ID NO: 399758 - DNA, 140 bp, Artificial Sequence
  Synthetic
caccgctgtcccaaaaggtctgattcctaatgcatattgtgagtctgttactatgtttacttctaatcctgaatcctgcaaggctagattaattgcttgtaactcagtcttctgatttgtcatatcagcagccagggcct

SEQ ID NO: 399759 - DNA, 140 bp, Artificial Sequence
  Synthetic
atacgccatgctgggtctccaagtcagtggacatatcagatttatcaggagtcacataaaaatttaaagacaggaaagtatgcaaaaatgagatctgcccatactaatgatataaagcagcgtacttgggagtcggccat

SEQ ID NO: 399760 - DNA, 140 bp, Artificial Sequence
  Synthetic
atggccgactcccaagtacgctgctttatatcattagtatgggcagatctcatttttgcatactttcctgtctttaaatttttatgtgactcctgataaatctgatatgtccactgacttggagacccagcatggcgtat

SEQ ID NO: 399761 - DNA, 140 bp, Artificial Sequence
  Synthetic
aggccctggctgctgatatgggagacaacccccgctccgaagcaggagccgaaagacagggaacccttaacttccctcaaatcactctttggcagcgaccccttgtctcaataaaagtaggaccttttgggacagcggtg

SEQ ID NO: 399762 - DNA, 140 bp, Artificial Sequence
  Synthetic
caccgctgtcccaaaaggtcctacttttattgagacaaggggtcgctgccaaagagtgatttgagggaagttaagggttccctgtctttcggctcctgcttcggagcgggggttgtctcccatatcagcagccagggcct

SEQ ID NO: 399763 - DNA, 140 bp, Artificial Sequence
  Synthetic
aggccctggctgctgatatgccagcaggaaaagaatgaacaagaattattggcattggacaaatgggcaagtctgtggaattggtttgacatatcaaactggctgtggtatataaaaatagaccttttgggacagcggtg

SEQ ID NO: 399764 - DNA, 140 bp, Artificial Sequence
  Synthetic
caccgctgtcccaaaaggtctatttttatataccacagccagtttgatatgtcaaaccaattccacagacttgcccatttgtccaatgccaataattcttgttcattcttttcctgctggcatatcagcagccagggcct

SEQ ID NO: 399765 - DNA, 140 bp, Artificial Sequence
  Synthetic
aggccctggctgctgatatggtattggagtcgggaactaaggaatagtgctattagcttgtttaataccacagcaatagtagtagctgaggggacagatagagttctagaagctttgcaagaccttttgggacagcggtg

SEQ ID NO: 399766 - DNA, 140 bp, Artificial Sequence
  Synthetic
caccgctgtcccaaaaggtcttgcaaagcttctagaactctatctgtcccctcagctactactattgctgtggtattaaacaagctaatagcactattccttagttcccgactccaataccatatcagcagccagggcct

SEQ ID NO: 399767 - DNA, 140 bp, Artificial Sequence
  Synthetic
aggccctggctgctgatatgctcgacgcaggactcggcttgctgaaagtgcacacggcaagaggcgagagcggcggctggtgagtacgccaaattttgactagcagaggctagaaggagagaccttttgggacagcggtg

SEQ ID NO: 399768 - DNA, 140 bp, Artificial Sequence
  Synthetic
caccgctgtcccaaaaggtctctccttctagcctctgctagtcaaaatttggcgtactcaccagccgccgctctcgcctcttgccgtgtgcactttcagcaagccgagtcctgcgtcgagcatatcagcagccagggcct

SEQ ID NO: 399769 - DNA, 140 bp, Artificial Sequence
  Synthetic
atacgccatgctgggtctccaagaaataagcctcccctacccagtgtccagaagttaacagaagatagatggagcaggcacctgaggatcagggaccagctagagagccattcaatgaatcgtacttgggagtcggccat

SEQ ID NO: 399770 - DNA, 140 bp, Artificial Sequence
  Synthetic
atggccgactcccaagtacgattcattgaatggctctctagctggtccctgatcctcaggtgcctgctccatctatcttctgttaacttctggacactgggtaggggaggcttatttcttggagacccagcatggcgtat

SEQ ID NO: 399771 - DNA, 140 bp, Artificial Sequence
  Synthetic
atacgccatgctgggtctcctggaatagtttagtaaaacatcatatgcatgtgtcaaaaaaggcaaaaggatggtattatagacatcattatgaaacaaggcatccaaaaataagttcagcgtacttgggagtcggccat

SEQ ID NO: 399772 - DNA, 140 bp, Artificial Sequence
  Synthetic
atggccgactcccaagtacgctgaacttatttttggatgccttgtttcataatgatgtctataataccatccttttgccttttttgacacatgcatatgatgttttactaaactattccaggagacccagcatggcgtat

SEQ ID NO: 399773 - DNA, 140 bp, Artificial Sequence
  Synthetic
aggccctggctgctgatatggctttagagaagctagaggaagaacaaaacaaaagtcagcaaaagacacagcaagcggcagctgacaaaggggtcagtcaaaattaccccatagtacaaagaccttttgggacagcggtg

SEQ ID NO: 399774 - DNA, 140 bp, Artificial Sequence
  Synthetic
caccgctgtcccaaaaggtctttgtactatggggtaattttgactgacccctttgtcagctgccgcttgctgtgtcttttgctgacttttgttttgttcttcctctagcttctctaaagccatatcagcagccagggcct

SEQ ID NO: 399775 - DNA, 140 bp, Artificial Sequence
  Synthetic
atacgccatgctgggtctccggactaacaacaggagaacagccttggcatctaggacatggagtatccatagaatggagactaagaaaatacaagacacaggttgatcctgaaatggcagcgtacttgggagtcggccat

SEQ ID NO: 399776 - DNA, 140 bp, Artificial Sequence
  Synthetic
atggccgactcccaagtacgctgccatttcaggatcaacctgtgtcttgtattttcttagtctccattctatggatactccatgtcctagatgccaaggctgttctcctgttgttagtccggagacccagcatggcgtat

SEQ ID NO: 399777 - DNA, 140 bp, Artificial Sequence
  Synthetic
atacgccatgctgggtctccatgggaagaggcaaccccagtattattctgtgcttcagatgctaacctaacaagcactgagcagcataatatttgggcatcacaagcctgtgttcccacacgtacttgggagtcggccat

SEQ ID NO: 399778 - DNA, 140 bp, Artificial Sequence
  Synthetic
atggccgactcccaagtacgtgtgggaacacaggcttgtgatgcccaaatattatgctgctcagtgcttgttaggttagcatctgaagcacagaataatactggggttgcctcttcccatggagacccagcatggcgtat

SEQ ID NO: 399779 - DNA, 140 bp, Artificial Sequence
  Synthetic
atacgccatgctgggtctcctgggtcacagtctattatggggtacctgtgtggaaagacgcagatacccctctattttgtgcatctgatgctaaatcatatagtactgaaagccataatgcgtacttgggagtcggccat

SEQ ID NO: 399780 - DNA, 140 bp, Artificial Sequence
  Synthetic
atggccgactcccaagtacgcattatggctttcagtactatatgatttagcatcagatgcacaaaatagaggggtatctgcgtctttccacacaggtaccccataatagactgtgacccaggagacccagcatggcgtat

SEQ ID NO: 399781 - DNA, 140 bp, Artificial Sequence
  Synthetic
atacgccatgctgggtctcccataaataatgataccagcagtccagagaaccttgtgaaacagtgtgaatttaatgtaaccacagttgtcaaagacaaaaaggagaaaaaacaggctctacgtacttgggagtcggccat

SEQ ID NO: 399782 - DNA, 140 bp, Artificial Sequence
  Synthetic
atggccgactcccaagtacgtagagcctgttttttctcctttttgtctttgacaactgtggttacattaaattcacactgtttcacaaggttctctggactgctggtatcattatttatgggagacccagcatggcgtat

SEQ ID NO: 399783 - DNA, 140 bp, Artificial Sequence
  Synthetic
atacgccatgctgggtctcctaatagcagtaataatctgggtgttactatataaagaatataaggaaataaaactgcaagaaaaaatagaaaagataagacagagaataagagatagagccgtacttgggagtcggccat

SEQ ID NO: 399784 - DNA, 140 bp, Artificial Sequence
  Synthetic
atggccgactcccaagtacggctctatctcttattctctgtcttatcttttctattttttcttgcagttttatttccttatattctttatatagtaacacccagattattactgctattaggagacccagcatggcgtat

SEQ ID NO: 399785 - DNA, 140 bp, Artificial Sequence
  Synthetic
atacgccatgctgggtctcccatgtatacattaattaattgtaactccacaaccattaagcaagcctgtccaaaggtatcgtttgagccaattccaatacactattgtgctccagcgggacgtacttgggagtcggccat

SEQ ID NO: 399786 - DNA, 140 bp, Artificial Sequence
  Synthetic
atggccgactcccaagtacgtcccgctggagcacaatagtgtattggaattggctcaaacgatacctttggacaggcttgcttaatggttgtggagttacaattaattaatgtatacatgggagacccagcatggcgtat

SEQ ID NO: 399787 - DNA, 140 bp, Artificial Sequence
  Synthetic
aggccctggctgctgatatgcaaaggtatcgtttgagccaattccaatacactattgtgctccagcgggatatgccatctttaagtgtaacagcacagagtttaatggaacaggcccatggaccttttgggacagcggtg

SEQ ID NO: 399788 - DNA, 140 bp, Artificial Sequence
  Synthetic
caccgctgtcccaaaaggtccatgggcctgttccattaaactctgtgctgttacacttaaagatggcatatcccgctggagcacaatagtgtattggaattggctcaaacgatacctttgcatatcagcagccagggcct

SEQ ID NO: 399789 - DNA, 140 bp, Artificial Sequence
  Synthetic
aggccctggctgctgatatgccctcaaatcactctttggcaacgacccctagtcacaataaaaatagggggacagctaaaggaagctctattagatacaggagcagatgatacagtattagaccttttgggacagcggtg

SEQ ID NO: 399790 - DNA, 140 bp, Artificial Sequence
  Synthetic
caccgctgtcccaaaaggtctaatactgtatcatctgctcctgtatctaatagagcttcctttagctgtccccctatttttattgtgactaggggtcgttgccaaagagtgatttgagggcatatcagcagccagggcct

SEQ ID NO: 399791 - DNA, 140 bp, Artificial Sequence
  Synthetic
atacgccatgctgggtctcctaccagtatggagagaaacagatacagttcttttctgtgcttcagatgctaaagcccatagtacagaggctcacaacatctgggccacacaagcatgtgtcgtacttgggagtcggccat

SEQ ID NO: 399792 - DNA, 140 bp, Artificial Sequence
  Synthetic
atggccgactcccaagtacgacacatgcttgtgtggcccagatgttgtgagcctctgtactatgggctttagcatctgaagcacagaaaagaactgtatctgtttctctccatactggtaggagacccagcatggcgtat

SEQ ID NO: 399793 - DNA, 140 bp, Artificial Sequence
  Synthetic
aggccctggctgctgatatgatgggaaaaaatatttcagacaatatgaaaaatatcatagtgaccctaaattctactataaacatgacctgtgtgagacaaggaaatcagtcagtacaaggaccttttgggacagcggtg

SEQ ID NO: 399794 - DNA, 140 bp, Artificial Sequence
  Synthetic
caccgctgtcccaaaaggtccttgtactgactgatttccttgtctcacacaggtcatgtttatagtagaatttagggtcactatgatatttttcatattgtctgaaatattttttcccatcatatcagcagccagggcct

SEQ ID NO: 399795 - DNA, 140 bp, Artificial Sequence
  Synthetic
atacgccatgctgggtctccggaaaaccaaataactcaaggatagcctattgcaagtataacatctctgattgggaaaaagccttaaaacagacagctgaaaggtatttagaccttaggacgtacttgggagtcggccat

SEQ ID NO: 399796 - DNA, 140 bp, Artificial Sequence
  Synthetic
atggccgactcccaagtacgtcctaaggtctaaatacctttcagctgtctgttttaaggctttttcccaatcagagatgttatacttgcaataggctatccttgagttatttggttttccggagacccagcatggcgtat

SEQ ID NO: 399797 - DNA, 140 bp, Artificial Sequence
  Synthetic
atacgccatgctgggtctccggaatgggacattagacataggatacaaacaaatgaaaaattgctcattcaatgtaaccactgagagagaagatagaaagaagaaagcttactctctgttcgtacttgggagtcggccat

SEQ ID NO: 399798 - DNA, 140 bp, Artificial Sequence
  Synthetic
atggccgactcccaagtacgaacagagagtaagctttcttctttctatcttctctctcagtggttacattgaatgagcaatttttcatttgtttgtatcctatgtctaatgtcccattccggagacccagcatggcgtat

SEQ ID NO: 399799 - DNA, 140 bp, Artificial Sequence
  Synthetic
atacgccatgctgggtctcctcagaggtaacccatttgcatttcaactgtcatggagagttcttctattgtaacacatctaagatgtttaattataccttttcatgtataggaaccaactcgtacttgggagtcggccat

SEQ ID NO: 399800 - DNA, 140 bp, Artificial Sequence
  Synthetic
atggccgactcccaagtacgagttggttcctatacatgaaaaggtataattaaacatcttagatgtgttacaatagaagaactctccatgacagttgaaatgcaaatgggttacctctgaggagacccagcatggcgtat

SEQ ID NO: 399801 - DNA, 140 bp, Artificial Sequence
  Synthetic
aggccctggctgctgatatgcagggagagcattttatacaacaggagatataataggagatataagacaagctcattgtaaccttagtagagcagactggaataaaactttagaaaagatgaccttttgggacagcggtg

SEQ ID NO: 399802 - DNA, 140 bp, Artificial Sequence
  Synthetic
caccgctgtcccaaaaggtcatcttttctaaagttttattccagtctgctctactaaggttacaatgagcttgtcttatatctcctattatatctcctgttgtataaaatgctctccctgcatatcagcagccagggcct

SEQ ID NO: 399803 - DNA, 140 bp, Artificial Sequence
  Synthetic
atacgccatgctgggtctccaggataaaacaggtggtaaggtcatggatacagggagggtcaggactctatgcacctcccaggaaaggtaacctaacatgcagctcactcataactggaacgtacttgggagtcggccat

SEQ ID NO: 399804 - DNA, 140 bp, Artificial Sequence
  Synthetic
atggccgactcccaagtacgttccagttatgagtgagctgcatgttaggttacctttcctgggaggtgcatagagtcctgaccctccctgtatccatgaccttaccacctgttttatcctggagacccagcatggcgtat

SEQ ID NO: 399805 - DNA, 140 bp, Artificial Sequence
  Synthetic
aggccctggctgctgatatgtgccattatgagatgtaatgaaggaaactttagtggaaaaggggaatgtaaaaatgtgagtactgtacaatgcacacatggaataaagccagtgatatccgaccttttgggacagcggtg

SEQ ID NO: 399806 - DNA, 140 bp, Artificial Sequence
  Synthetic
caccgctgtcccaaaaggtcggatatcactggctttattccatgtgtgcattgtacagtactcacatttttacattccccttttccactaaagtttccttcattacatctcataatggcacatatcagcagccagggcct

SEQ ID NO: 399807 - DNA, 140 bp, Artificial Sequence
  Synthetic
atacgccatgctgggtctccacatttagaccaacagggggagatatgaaagatatatggagaactgaattgttcaaatacaaagtagtaaaggtaaaaccttttagtgtggcacctacaacgtacttgggagtcggccat

SEQ ID NO: 399808 - DNA, 140 bp, Artificial Sequence
  Synthetic
atggccgactcccaagtacgttgtaggtgccacactaaaaggttttacctttactactttgtatttgaacaattcagttctccatatatctttcatatctccccctgttggtctaaatgtggagacccagcatggcgtat

SEQ ID NO: 399809 - DNA, 140 bp, Artificial Sequence
  Synthetic
atacgccatgctgggtctcccagtattaataaattgtacaaggccagggaataatacaggaggacaggtgcagataggacctgctatgacattttataacatagagaaaataataggggacgtacttgggagtcggccat

SEQ ID NO: 399810 - DNA, 140 bp, Artificial Sequence
  Synthetic
atggccgactcccaagtacgtcccctattattttctctatgttataaaatgtcatagcaggtcctatctgcacctgtcctcctgtattattccctggccttgtacaatttattaatactgggagacccagcatggcgtat

SEQ ID NO: 399811 - DNA, 140 bp, Artificial Sequence
  Synthetic
atacgccatgctgggtctccggaatagaacaaaagaaaaaataaaggacattctgggaaacaaaacaacctttgaggctcgggggaacgatggaagtgacccagaagtaacacacttaatcgtacttgggagtcggccat

SEQ ID NO: 399812 - DNA, 140 bp, Artificial Sequence
  Synthetic
atggccgactcccaagtacgattaagtgtgttacttctgggtcacttccatcgttcccccgagcctcaaaggttgttttgtttcccagaatgtcctttattttttcttttgttctattccggagacccagcatggcgtat

SEQ ID NO: 399813 - DNA, 140 bp, Artificial Sequence
  Synthetic
aggccctggctgctgatatgtttgaggctcgggggaacgatggaagtgacccagaagtaacacacttaatgttcaattgtggaggagagtttttcctttgtaacacttccagattatttagaccttttgggacagcggtg

SEQ ID NO: 399814 - DNA, 140 bp, Artificial Sequence
  Synthetic
caccgctgtcccaaaaggtctaaataatctggaagtgttacaaaggaaaaactctcctccacaattgaacattaagtgtgttacttctgggtcacttccatcgttcccccgagcctcaaacatatcagcagccagggcct

SEQ ID NO: 399815 - DNA, 140 bp, Artificial Sequence
  Synthetic
aggccctggctgctgatatgtctgaacaaaggcttaggcatctcctatggcaggaagaagcggaaacagcgacgaagaactccttacagcaataaggatcatcaaaatcctataccaaaggaccttttgggacagcggtg

SEQ ID NO: 399816 - DNA, 140 bp, Artificial Sequence
  Synthetic
caccgctgtcccaaaaggtcctttggtataggattttgatgatccttattgctgtaaggagttcttcgtcgctgtttccgcttcttcctgccataggagatgcctaagcctttgttcagacatatcagcagccagggcct

SEQ ID NO: 399817 - DNA, 140 bp, Artificial Sequence
  Synthetic
atacgccatgctgggtctccggaaacatggttaatctctggagacaagagttgtataaatacaaagtagtgagtatagaacccataggagtagcaccaggtaaagctaaaagacgcacagcgtacttgggagtcggccat

SEQ ID NO: 399818 - DNA, 140 bp, Artificial Sequence
  Synthetic
atggccgactcccaagtacgctgtgcgtcttttagctttacctggtgctactcctatgggttctatactcactactttgtatttatacaactcttgtctccagagattaaccatgtttccggagacccagcatggcgtat

SEQ ID NO: 399819 - DNA, 140 bp, Artificial Sequence
  Synthetic
aggccctggctgctgatatggtggacagagtattggcaagccacctggattcctgaatgggagtttgtcaatacccctcctctagtaaaactatggtatcaattagaaacagagcccatagaccttttgggacagcggtg

SEQ ID NO: 399820 - DNA, 140 bp, Artificial Sequence
  Synthetic
caccgctgtcccaaaaggtctatgggctctgtttctaattgataccatagttttactagaggaggggtattgacaaactcccattcaggaatccaggtggcttgccaatactctgtccaccatatcagcagccagggcct

SEQ ID NO: 399821 - DNA, 140 bp, Artificial Sequence
  Synthetic
atacgccatgctgggtctcctgcccacgttgataccctggccgcaaggattcttgccactgttgtacacggacctcaggacaataatcttgtggagctaccacctcttgagcaacttagccgtacttgggagtcggccat

SEQ ID NO: 399822 - DNA, 140 bp, Artificial Sequence
  Synthetic
atggccgactcccaagtacggctaagttgctcaagaggtggtagctccacaagattattgtcctgaggtccgtgtacaacagtggcaagaatccttgcggccagggtatcaacgtgggcaggagacccagcatggcgtat

SEQ ID NO: 399823 - DNA, 140 bp, Artificial Sequence
  Synthetic
aggccctggctgctgatatgtactgtactttctatagtgaatagagttaggaagggatactcaccattatcgtttcagacccgcctcccaaccccgaggggacccgacaggcccgaaggagaccttttgggacagcggtg

SEQ ID NO: 399824 - DNA, 140 bp, Artificial Sequence
  Synthetic
caccgctgtcccaaaaggtctccttcgggcctgtcgggtcccctcggggttgggaggcgggtctgaaacgataatggtgagtatcccttcctaactctattcactatagaaagtacagtacatatcagcagccagggcct

SEQ ID NO: 399825 - DNA, 140 bp, Artificial Sequence
  Synthetic
  misc_feature (37)..(37): n is a, c, g, or t
  misc_feature (104)..(104): n is a, c, g, or t
  misc_feature (106)..(106): n is a, c, g, or t
  misc_feature (114)..(114): n is a, c, g, or t
  misc_feature (120)..(120): n is a, c, g, or t
aggccctggctgctgatatgggatcagcaaatcctangtctatggggctgctcaggaaaaactatatgctataccactgtgccttggaatgagacttggagcantnatacctcntatgangaccttttgggacagcggtg

SEQ ID NO: 399826 - DNA, 140 bp, Artificial Sequence
  Synthetic
  misc_feature (21)..(21): n is a, c, g, or t
  misc_feature (27)..(27): n is a, c, g, or t
  misc_feature (35)..(35): n is a, c, g, or t
  misc_feature (37)..(37): n is a, c, g, or t
  misc_feature (104)..(104): n is a, c, g, or t
caccgctgtcccaaaaggtcntcatangaggtatnantgctccaagtctcattccaaggcacagtggtatagcatatagtttttcctgagcagccccatagacntaggatttgctgatcccatatcagcagccagggcct

SEQ ID NO: 399827 - DNA, 140 bp, Artificial Sequence
  Synthetic
  misc_feature (63)..(63): n is a, c, g, or t
aggccctggctgctgatatgacacaaatgagaaatcactcttggaattggatcaatgggcaantctgtggaactggtttgatattacaagctggctgtggtacataaaaatagctataatgaccttttgggacagcggtg

SEQ ID NO: 399828 - DNA, 140 bp, Artificial Sequence
  Synthetic
  misc_feature (78)..(78): n is a, c, g, or t
caccgctgtcccaaaaggtcattatagctatttttatgtaccacagccagcttgtaatatcaaaccagttccacaganttgcccattgatccaattccaagagtgatttctcatttgtgtcatatcagcagccagggcct

SEQ ID NO: 399829 - DNA, 140 bp, Artificial Sequence
  Synthetic
aggccctggctgctgatatgcatacctagaaggataagacaaggccttgaaaggttactgctataaaatggggagcaaatggtcaaaaagtgtacctggatggtctgtgataagagaaaggaccttttgggacagcggtg

SEQ ID NO: 399830 - DNA, 140 bp, Artificial Sequence
  Synthetic
caccgctgtcccaaaaggtcctttctcttatcacagaccatccaggtacactttttgaccatttgctccccattttatagcagtaacctttcaaggccttgtcttatccttctaggtatgcatatcagcagccagggcct

SEQ ID NO: 399831 - DNA, 140 bp, Artificial Sequence
  Synthetic
aggccctggctgctgatatggaaccatgtgcacctggagtaggacaaatctccagggaattagcagctagaggagggataccaagttcctatactcctcaaaacaatgcagcccttgcatgaccttttgggacagcggtg

SEQ ID NO: 399832 - DNA, 140 bp, Artificial Sequence
  Synthetic
caccgctgtcccaaaaggtcatgcaagggctgcattgttttgaggagtataggaacttggtatccctcctctagctgctaattccctggagatttgtcctactccaggtgcacatggttccatatcagcagccagggcct

SEQ ID NO: 399833 - DNA, 140 bp, Artificial Sequence
  Synthetic
aggccctggctgctgatatgaggagggataccaagttcctatactcctcaaaacaatgcagcccttgcattcctagaaagtcaccaagatgaagaagtaggcttcccagtaagacctcaagaccttttgggacagcggtg

SEQ ID NO: 399834 - DNA, 140 bp, Artificial Sequence
  Synthetic
caccgctgtcccaaaaggtcttgaggtcttactgggaagcctacttcttcatcttggtgactttctaggaatgcaagggctgcattgttttgaggagtataggaacttggtatccctcctcatatcagcagccagggcct

SEQ ID NO: 399835 - DNA, 140 bp, Artificial Sequence
  Synthetic
aggccctggctgctgatatggacccaacaataatacaaggaaaagtataaggataggaccaggacaaacattctatgcaacaaacataataggagacataagacaagcatattgtaacatgaccttttgggacagcggtg

SEQ ID NO: 399836 - DNA, 140 bp, Artificial Sequence
  Synthetic
caccgctgtcccaaaaggtcatgttacaatatgcttgtcttatgtctcctattatgtttgttgcatagaatgtttgtcctggtcctatccttatacttttccttgtattattgttgggtccatatcagcagccagggcct

SEQ ID NO: 399837 - DNA, 140 bp, Artificial Sequence
  Synthetic
atacgccatgctgggtctccaagaacacttccctagtaaaaatataagctttgaatcggcctcaaaagggggggacctagaaattataacacatagctttaattgtggaggagaatttttcgtacttgggagtcggccat

SEQ ID NO: 399838 - DNA, 140 bp, Artificial Sequence
  Synthetic
atggccgactcccaagtacgaaaaattctcctccacaattaaagctatgtgttataatttctaggtcccccccttttgaggccgattcaaagcttatatttttactagggaagtgttcttggagacccagcatggcgtat

SEQ ID NO: 399839 - DNA, 140 bp, Artificial Sequence
  Synthetic
  misc_feature (65)..(65): n is a, c, g, or t
aggccctggctgctgatatgctgcagtcactctggaacacaatagtagtgctctggtgtgttcanaacagatatagaattgaagatacacagcaggcaataaaaaaattgagggaagtaagaccttttgggacagcggtg

SEQ ID NO: 399840 - DNA, 140 bp, Artificial Sequence
  Synthetic
  misc_feature (76)..(76): n is a, c, g, or t
caccgctgtcccaaaaggtcttacttccctcaatttttttattgcctgctgtgtatcttcaattctatatctgttntgaacacaccagagcactactattgtgttccagagtgactgcagcatatcagcagccagggcct

SEQ ID NO: 399841 - DNA, 140 bp, Artificial Sequence
  Synthetic
  misc_feature (30)..(30): n is a, c, g, or t
  misc_feature (34)..(34): n is a, c, g, or t
  misc_feature (57)..(57): n is a, c, g, or t
  misc_feature (101)..(101): n is a, c, g, or t
atacgccatgctgggtctcctatttttgancttntagagcaggcacaagaacaacanaacacaaatgagaaatcactcttggaattggatcaatgggcaantctgtggaactggtttgatcgtacttgggagtcggccat

SEQ ID NO: 399842 - DNA, 140 bp, Artificial Sequence
  Synthetic
  misc_feature (40)..(40): n is a, c, g, or t
  misc_feature (84)..(84): n is a, c, g, or t
  misc_feature (107)..(107): n is a, c, g, or t
  misc_feature (111)..(111): n is a, c, g, or t
atggccgactcccaagtacgatcaaaccagttccacaganttgcccattgatccaattccaagagtgatttctcatttgtgttntgttgttcttgtgcctgctctanaagntcaaaaataggagacccagcatggcgtat

SEQ ID NO: 399843 - DNA, 140 bp, Artificial Sequence
  Synthetic
atacgccatgctgggtctccgtggcgcccgaacagggacttgaaaacgaaagtagaaccggaggctgaaatctctcgacgcaggactcggctcgttgggtgcacacagcgagaggcgaggcgtacttgggagtcggccat

SEQ ID NO: 399844 - DNA, 140 bp, Artificial Sequence
  Synthetic
atggccgactcccaagtacgcctcgcctctcgctgtgtgcacccaacgagccgagtcctgcgtcgagagatttcagcctccggttctactttcgttttcaagtccctgttcgggcgccacggagacccagcatggcgtat

SEQ ID NO: 399845 - DNA, 140 bp, Artificial Sequence
  Synthetic
atacgccatgctgggtctcccagacgggtcaaaattaccctataataccaaatgcacaaggacaaatggtgcatcagcccatctcccccaggactttgaatgcatgggtaaaggcagtagcgtacttgggagtcggccat

SEQ ID NO: 399846 - DNA, 140 bp, Artificial Sequence
  Synthetic
atggccgactcccaagtacgctactgcctttacccatgcattcaaagtcctgggggagatgggctgatgcaccatttgtccttgtgcatttggtattatagggtaattttgacccgtctgggagacccagcatggcgtat

SEQ ID NO: 399847 - DNA, 140 bp, Artificial Sequence
  Synthetic
aggccctggctgctgatatgcagatgagggaaccaacaggaagtgacattgctgggacaactagcacccagcaagagcaagttcactggactaccagggccaacaaccctatcccagtaggaccttttgggacagcggtg

SEQ ID NO: 399848 - DNA, 140 bp, Artificial Sequence
  Synthetic
caccgctgtcccaaaaggtcctactgggatagggttgttggccctggtagtccagtgaacttgctcttgctgggtgctagttgtcccagcaatgtcacttcctgttggttccctcatctgcatatcagcagccagggcct

SEQ ID NO: 399849 - DNA, 140 bp, Artificial Sequence
  Synthetic
  misc_feature (52)..(52): n is a, c, g, or t
  misc_feature (87)..(87): n is a, c, g, or t
aggccctggctgctgatatggggcttaggcatctcctatggcaggaagaagnggagacagcgacataagactcctcgaagcagtcanaaacatcaagatcctataccaaagcagtaagtagaccttttgggacagcggtg

SEQ ID NO: 399850 - DNA, 140 bp, Artificial Sequence
  Synthetic
  misc_feature (54)..(54): n is a, c, g, or t
  misc_feature (89)..(89): n is a, c, g, or t
caccgctgtcccaaaaggtctacttactgctttggtataggatcttgatgtttntgactgcttcgaggagtcttatgtcgctgtctccncttcttcctgccataggagatgcctaagccccatatcagcagccagggcct

SEQ ID NO: 399851 - DNA, 140 bp, Artificial Sequence
  Synthetic
aggccctggctgctgatatgattaatacaaagaatttgtagagctatccgcaacacacctagaagaataagacagggctttgaagcagctttgctataaaatggggggcaagtggtcaaagaccttttgggacagcggtg

SEQ ID NO: 399852 - DNA, 140 bp, Artificial Sequence
  Synthetic
caccgctgtcccaaaaggtctttgaccacttgccccccattttatagcaaagctgcttcaaagccctgtcttattcttctaggtgtgttgcggatagctctacaaattctttgtattaatcatatcagcagccagggcct

SEQ ID NO: 399853 - DNA, 140 bp, Artificial Sequence
  Synthetic
aggccctggctgctgatatgtggattcttagcacttatctgggtcgatctgcggagcctgtgcctcttcagctaccaccgcttgagagacttactcttgattgtaacgaggattgtggaagaccttttgggacagcggtg

SEQ ID NO: 399854 - DNA, 140 bp, Artificial Sequence
  Synthetic
caccgctgtcccaaaaggtcttccacaatcctcgttacaatcaagagtaagtctctcaagcggtggtagctgaagaggcacaggctccgcagatcgacccagataagtgctaagaatccacatatcagcagccagggcct

SEQ ID NO: 399855 - DNA, 140 bp, Artificial Sequence
  Synthetic
atacgccatgctgggtctccgtgccttggaggaagacaacagtaccttgaaggaagagtcaggggcaataaaaaactgttctttcaatatgacctcagcagtaatggatagacagatgaacgtacttgggagtcggccat

SEQ ID NO: 399856 - DNA, 140 bp, Artificial Sequence
  Synthetic
atggccgactcccaagtacgttcatctgtctatccattactgctgaggtcatattgaaagaacagttttttattgcccctgactcttccttcaaggtactgttgtcttcctccaaggcacggagacccagcatggcgtat

SEQ ID NO: 399857 - DNA, 140 bp, Artificial Sequence
  Synthetic
atacgccatgctgggtctccgaggggatctagaagttacaacacatagctttaattgtagaggagaatttttctattgcaatacaacaaaactgttttcttctgagtggttaaacaacaccgtacttgggagtcggccat

SEQ ID NO: 399858 - DNA, 140 bp, Artificial Sequence
  Synthetic
atggccgactcccaagtacggtgttgtttaaccactcagaagaaaacagttttgttgtattgcaatagaaaaattctcctctacaattaaagctatgtgttgtaacttctagatcccctcggagacccagcatggcgtat

SEQ ID NO: 399859 - DNA, 140 bp, Artificial Sequence
  Synthetic
atacgccatgctgggtctcctaaacatgtggcagaaggtaggaagagcaatgtataaccctcctattgaaggaaacataacatgtaaatcaaatatcacagggctattattgacaagggacgtacttgggagtcggccat

SEQ ID NO: 399860 - DNA, 140 bp, Artificial Sequence
  Synthetic
atggccgactcccaagtacgtcccttgtcaataatagccctgtgatatttgatttacatgttatgtttccttcaataggagggttatacattgctcttcctaccttctgccacatgtttaggagacccagcatggcgtat

SEQ ID NO: 399861 - DNA, 140 bp, Artificial Sequence
  Synthetic
aggccctggctgctgatatggcacaagaggaggaagaggtgggttttccagtcagacctcaggtacctttaagaccaatgacttacaagggagctttagatcttagccactttttaagaggaccttttgggacagcggtg

SEQ ID NO: 399862 - DNA, 140 bp, Artificial Sequence
  Synthetic
caccgctgtcccaaaaggtcctcttaaaaagtggctaagatctaaagctcccttgtaagtcattggtcttaaaggtacctgaggtctgactggaaaacccacctcttcctcctcttgtgccatatcagcagccagggcct

SEQ ID NO: 399863 - DNA, 140 bp, Artificial Sequence
  Synthetic
atacgccatgctgggtctcccccaagacttttgggaagtgcagctaggaattccacatccagcaggattaaagcagaaaaagtcagtaacagtcctagatgtaggagatgcttatttttccgtacttgggagtcggccat

SEQ ID NO: 399864 - DNA, 140 bp, Artificial Sequence
  Synthetic
atggccgactcccaagtacggaaaaataagcatctcctacatctaggactgttactgactttttctgctttaatcctgctggatgtggaattcctagctgcacttcccaaaagtcttgggggagacccagcatggcgtat

SEQ ID NO: 399865 - DNA, 140 bp, Artificial Sequence
  Synthetic
atacgccatgctgggtctccatgtcccttagatgaagattttagaaaatatacagcttttaccatacctagtgtaaataatgagacacctggtattagataccagtataatgtgttaccacgtacttgggagtcggccat

SEQ ID NO: 399866 - DNA, 140 bp, Artificial Sequence
  Synthetic
atggccgactcccaagtacgtggtaacacattatactggtatctaataccaggtgtctcattatttacactaggtatggtaaaagctgtatattttctaaaatcttcatctaagggacatggagacccagcatggcgtat

SEQ ID NO: 399867 - DNA, 140 bp, Artificial Sequence
  Synthetic
  misc_feature (116)..(116): n is a, c, g, or t
atacgccatgctgggtctccattctcccatgtagaataatacgaattgtagacatgtggcaggaagtagcacgagcaatgtatgccgctcccattgcaggaaacagtacctgtatnacaacgtacttgggagtcggccat

SEQ ID NO: 399868 - DNA, 140 bp, Artificial Sequence
  Synthetic
  misc_feature (25)..(25): n is a, c, g, or t
atggccgactcccaagtacgttgtnatacaggtactgtttcctgcaatgggagcggcatacattgctcgtgctacttcctgccacatgtctacaattcgtattattctacatgggagaatggagacccagcatggcgtat

SEQ ID NO: 399869 - DNA, 140 bp, Artificial Sequence
  Synthetic
aggccctggctgctgatatgaaagaaacatgggaaacatggtggacagagtattggcaagccacctggattcctgagtgggagtttgtcaatacccctcccctagtaaaattatggtatcgaccttttgggacagcggtg

SEQ ID NO: 399870 - DNA, 140 bp, Artificial Sequence
  Synthetic
caccgctgtcccaaaaggtcgataccataattttactaggggaggggtattgacaaactcccactcaggaatccaggtggcttgccaatactctgtccaccatgtttcccatgtttctttcatatcagcagccagggcct

SEQ ID NO: 399871 - DNA, 140 bp, Artificial Sequence
  Synthetic
atacgccatgctgggtctccacatggactgtcaatgatatacaaaaattagtaggaaagttaaattgggcaagtcagatctatccaggaatcaaagtaagacagctttgtaaattaatcacgtacttgggagtcggccat

SEQ ID NO: 399872 - DNA, 140 bp, Artificial Sequence
  Synthetic
atggccgactcccaagtacgtgattaatttacaaagctgtcttactttgattcctggatagatctgacttgcccaatttaactttcctactaatttttgtatatcattgacagtccatgtggagacccagcatggcgtat

SEQ ID NO: 399873 - DNA, 140 bp, Artificial Sequence
  Synthetic
atacgccatgctgggtctccgccaacaactgaaccagcagctgagccagcagcagttggggtgggagcagtatctcaagacttggcaaaatatggagcagttacaagtagaaatacagcacgtacttgggagtcggccat

SEQ ID NO: 399874 - DNA, 140 bp, Artificial Sequence
  Synthetic
atggccgactcccaagtacgtgctgtatttctacttgtaactgctccatattttgccaagtcttgagatactgctcccaccccaactgctgctggctcagctgctggttcagttgttggcggagacccagcatggcgtat

SEQ ID NO: 399875 - DNA, 140 bp, Artificial Sequence
  Synthetic
atacgccatgctgggtctccttagaactagcagaaaatagggagatattaaaagaacccctacatggagtctattatgacccagaaaaagaattaatagcagaaattcaaaaacaaggaccgtacttgggagtcggccat

SEQ ID NO: 399876 - DNA, 140 bp, Artificial Sequence
  Synthetic
atggccgactcccaagtacggtccttgtttttgaatttctgctattaattctttttctgggtcataatagactccatgtaggggttcttttaatatctccctattttctgctagttctaaggagacccagcatggcgtat

SEQ ID NO: 399877 - DNA, 140 bp, Artificial Sequence
  Synthetic
aggccctggctgctgatatgtttggggctgctctggaaaactcatctgcaccactaatgtgccctggaactctagttggagtaataaatctcaggaggagatttgggataacatgacctggaccttttgggacagcggtg

SEQ ID NO: 399878 - DNA, 140 bp, Artificial Sequence
  Synthetic
caccgctgtcccaaaaggtccaggtcatgttatcccaaatctcctcctgagatttattactccaactagagttccagggcacattagtggtgcagatgagttttccagagcagccccaaacatatcagcagccagggcct

SEQ ID NO: 399879 - DNA, 140 bp, Artificial Sequence
  Synthetic
atacgccatgctgggtctcccatataaaaggggaagcaattcatggtcaggtagactgcagtccagaagtatggcaaatagattgcacacatacagaaggcaaagtcataatagttgctgcgtacttgggagtcggccat

SEQ ID NO: 399880 - DNA, 140 bp, Artificial Sequence
  Synthetic
atggccgactcccaagtacgcagcaactattatgactttgccttctgtatgtgtgcaatctatttgccatacttctggactgcagtctacctgaccatgaattgcttccccttttatatgggagacccagcatggcgtat

SEQ ID NO: 399881 - DNA, 140 bp, Artificial Sequence
  Synthetic
aggccctggctgctgatatggaagaataagacagggctttgaaagggctttgctataaaatgggtggcaagtggtcaaaaagtagtatagttggatggcctgctataagggaaagaatgagaccttttgggacagcggtg

SEQ ID NO: 399882 - DNA, 140 bp, Artificial Sequence
  Synthetic
caccgctgtcccaaaaggtctcattctttcccttatagcaggccatccaactatactactttttgaccacttgccacccattttatagcaaagccctttcaaagccctgtcttattcttccatatcagcagccagggcct

SEQ ID NO: 399883 - DNA, 140 bp, Artificial Sequence
  Synthetic
atacgccatgctgggtctcccttggtgaaataccataaacacagatctagaaagaccaaggaatggcattacaaacaccattttgaattcagaaatccaagagccagttcaggtgtatatcgtacttgggagtcggccat

SEQ ID NO: 399884 - DNA, 140 bp, Artificial Sequence
  Synthetic
atggccgactcccaagtacgatatacacctgaactggctcttggatttctgaattcaaaatggtgtttgtaatgccattccttggtctttctagatctgtgtttatggtatttcaccaagggagacccagcatggcgtat

SEQ ID NO: 399885 - DNA, 140 bp, Artificial Sequence
  Synthetic
aggccctggctgctgatatggtattaagcgggggaaaattagatgcttgggaaaaaattcggttaaggccggggggaaagaaaaaatatagactaaaacatctagtatgggcaagcaggggaccttttgggacagcggtg

SEQ ID NO: 399886 - DNA, 140 bp, Artificial Sequence
  Synthetic
caccgctgtcccaaaaggtcccctgcttgcccatactagatgttttagtctatattttttctttccccccggccttaaccgaattttttcccaagcatctaattttcccccgcttaataccatatcagcagccagggcct

SEQ ID NO: 399887 - DNA, 140 bp, Artificial Sequence
  Synthetic
aggccctggctgctgatatgtgagatgcccccttggcatcaccctggaagtcaaccccagaccccttgtaataagtgctattgcaaaaaatgctgctatcattgctatgtttgtttcacagaccttttgggacagcggtg

SEQ ID NO: 399888 - DNA, 140 bp, Artificial Sequence
  Synthetic
caccgctgtcccaaaaggtctgtgaaacaaacatagcaatgatagcagcattttttgcaatagcacttattacaaggggtctggggttgacttccagggtgatgccaagggggcatctcacatatcagcagccagggcct

SEQ ID NO: 399889 - DNA, 140 bp, Artificial Sequence
  Synthetic
aggccctggctgctgatatggacaagctaatacatctttattattttgattgttttacagattctgccataaggcaagcggtcttagggagacaagtatttcctaggtgtgaatatcctggaccttttgggacagcggtg

SEQ ID NO: 399890 - DNA, 140 bp, Artificial Sequence
  Synthetic
caccgctgtcccaaaaggtccaggatattcacacctaggaaatacttgtctccctaagaccgcttgccttatggcagaatctgtaaaacaatcaaaataataaagatgtattagcttgtccatatcagcagccagggcct

SEQ ID NO: 399891 - DNA, 140 bp, Artificial Sequence
  Synthetic
aggccctggctgctgatatgctgcttataaatgtaattctatggctgtttgttcttaagcaatgtttagaacaaaagaaacaaactaaaagagaaagagaaataattagaaggttaagaagaccttttgggacagcggtg

SEQ ID NO: 399892 - DNA, 140 bp, Artificial Sequence
  Synthetic
caccgctgtcccaaaaggtcttcttaaccttctaattatttctctttctcttttagtttgtttcttttgttctaaacattgcttaagaacaaacagccatagaattacatttataagcagcatatcagcagccagggcct

SEQ ID NO: 399893 - DNA, 140 bp, Artificial Sequence
  Synthetic
atacgccatgctgggtctccaggtgaagaaataaaaaactgctctttcaatataaccacagagataaaggataaaaagaaacaagaatatgcgcttttctatagacttgatatagtgccacgtacttgggagtcggccat

SEQ ID NO: 399894 - DNA, 140 bp, Artificial Sequence
  Synthetic
atggccgactcccaagtacgtggcactatatcaagtctatagaaaagcgcatattcttgtttctttttatcctttatctctgtggttatattgaaagagcagttttttatttcttcacctggagacccagcatggcgtat

SEQ ID NO: 399895 - DNA, 140 bp, Artificial Sequence
  Synthetic
aggccctggctgctgatatgatatgggaaaattacatggtagaacaaatgcaggaagacattattagtttatgggaacagagtttaaaaccttgtgttcaaatgactttcctgtgtgtacgaccttttgggacagcggtg

SEQ ID NO: 399896 - DNA, 140 bp, Artificial Sequence
  Synthetic
caccgctgtcccaaaaggtcgtacacacaggaaagtcatttgaacacaaggttttaaactctgttcccataaactaataatgtcttcctgcatttgttctaccatgtaattttcccatatcatatcagcagccagggcct

SEQ ID NO: 399897 - DNA, 140 bp, Artificial Sequence
  Synthetic
atacgccatgctgggtctccactacttgtaccaatagtagtaccaatagtagcaatagtgctggtagtaataatacttgtatagatgaacagatgaggggggaaataaaaaactgctcttcgtacttgggagtcggccat

SEQ ID NO: 399898 - DNA, 140 bp, Artificial Sequence
  Synthetic
atggccgactcccaagtacgaagagcagttttttatttcccccctcatctgttcatctatacaagtattattactaccagcactattgctactattggtactactattggtacaagtagtggagacccagcatggcgtat

SEQ ID NO: 399899 - DNA, 140 bp, Artificial Sequence
  Synthetic
atacgccatgctgggtctccaaactgtatatatgctgtcattgggattctcagcgctcggggtggcaattataatagcagtcataatctgggtattactatataaagaatataaggaaatcgtacttgggagtcggccat

SEQ ID NO: 399900 - DNA, 140 bp, Artificial Sequence
  Synthetic
atggccgactcccaagtacgatttccttatattctttatatagtaatacccagattatgactgctattataattgccaccccgagcgctgagaatcccaatgacagcatatatacagtttggagacccagcatggcgtat

SEQ ID NO: 399901 - DNA, 140 bp, Artificial Sequence
  Synthetic
atacgccatgctgggtctccgcttccctggtaaaggaatacaatttgcaaatcactcaggaggggacctagaaattacaacacatagctttaattgtggaggagaatttttctattgcaacgtacttgggagtcggccat

SEQ ID NO: 399902 - DNA, 140 bp, Artificial Sequence
  Synthetic
atggccgactcccaagtacgttgcaatagaaaaattctcctccacaattaaagctatgtgttgtaatttctaggtcccctcctgagtgatttgcaaattgtattcctttaccagggaagcggagacccagcatggcgtat

SEQ ID NO: 399903 - DNA, 140 bp, Artificial Sequence
  Synthetic
aggccctggctgctgatatgaactatagaaattaattgtaccagacccaacaacaatacaagaaaaagtatacgatttggaccaggacaagcgttctatgcaacaggtgacataataggagaccttttgggacagcggtg

SEQ ID NO: 399904 - DNA, 140 bp, Artificial Sequence
  Synthetic
caccgctgtcccaaaaggtctcctattatgtcacctgttgcatagaacgcttgtcctggtccaaatcgtatactttttcttgtattgttgttgggtctggtacaattaatttctatagttcatatcagcagccagggcct

SEQ ID NO: 399905 - DNA, 140 bp, Artificial Sequence
  Synthetic
atacgccatgctgggtctccggcattaagccaacagtaagtactcaactagtattaaatgggacactctctgaaggaaaaataagaattatgggaaaaaatattacagacagtggaaaaacgtacttgggagtcggccat

SEQ ID NO: 399906 - DNA, 140 bp, Artificial Sequence
  Synthetic
atggccgactcccaagtacgtttttccactgtctgtaatattttttcccataattcttatttttccttcagagagtgtcccatttaatactagttgagtacttactgttggcttaatgccggagacccagcatggcgtat

SEQ ID NO: 399907 - DNA, 140 bp, Artificial Sequence
  Synthetic
aggccctggctgctgatatgtgaaggaaaaataagaattatgggaaaaaatattacagacagtggaaaaaatataatagtgaccctagattctgctataaacataacctgtgagagaccagaccttttgggacagcggtg

SEQ ID NO: 399908 - DNA, 140 bp, Artificial Sequence
  Synthetic
caccgctgtcccaaaaggtctggtctctcacaggttatgtttatagcagaatctagggtcactattatattttttccactgtctgtaatattttttcccataattcttatttttccttcacatatcagcagccagggcct

SEQ ID NO: 399909 - DNA, 140 bp, Artificial Sequence
  Synthetic
  misc_feature (72)..(72): n is a, c, g, or t
  misc_feature (105)..(105): n is a, c, g, or t
  misc_feature (120)..(120): n is a, c, g, or t
aggccctggctgctgatatgatgcaagaggacattatcagtttatgggaacagagcttaaagccctgtgttnaattaaccccattatgtgtaactatgcattgtnacaatagcaatgggngaccttttgggacagcggtg

SEQ ID NO: 399910 - DNA, 140 bp, Artificial Sequence
  Synthetic
  misc_feature (21)..(21): n is a, c, g, or t
  misc_feature (36)..(36): n is a, c, g, or t
  misc_feature (69)..(69): n is a, c, g, or t
caccgctgtcccaaaaggtcncccattgctattgtnacaatgcatagttacacataatggggttaattnaacacagggctttaagctctgttcccataaactgataatgtcctcttgcatcatatcagcagccagggcct

SEQ ID NO: 399911 - DNA, 140 bp, Artificial Sequence
  Synthetic
atacgccatgctgggtctcctaacatttgggaacataacatttgaacaatccacaggaggggacctagaaattacaatgcatagttttatctgtagaggagaatttttctattgtaataccgtacttgggagtcggccat

SEQ ID NO: 399912 - DNA, 140 bp, Artificial Sequence
  Synthetic
atggccgactcccaagtacggtattacaatagaaaaattctcctctacagataaaactatgcattgtaatttctaggtcccctcctgtggattgttcaaatgttatgttcccaaatgttaggagacccagcatggcgtat

SEQ ID NO: 399913 - DNA, 140 bp, Artificial Sequence
  Synthetic
atacgccatgctgggtctcccatgggcataagctcaccactctcaaatgcctcaaggttagcttattgccggtataatgccactgagtggaaaaaagccttaaaacaaatagctgaaaggcgtacttgggagtcggccat

SEQ ID NO: 399914 - DNA, 140 bp, Artificial Sequence
  Synthetic
atggccgactcccaagtacgcctttcagctatttgttttaaggcttttttccactcagtggcattataccggcaataagctaaccttgaggcatttgagagtggtgagcttatgcccatgggagacccagcatggcgtat

SEQ ID NO: 399915 - DNA, 140 bp, Artificial Sequence
  Synthetic
atacgccatgctgggtctccaaaaattgttcattcaatgtaaccactgagagaaaagataaaaagaagctagcttactctctgttttatgcagaagatgtagtgcaactcaatgagagtgcgtacttgggagtcggccat

SEQ ID NO: 399916 - DNA, 140 bp, Artificial Sequence
  Synthetic
atggccgactcccaagtacgcactctcattgagttgcactacatcttctgcataaaacagagagtaagctagcttctttttatcttttctctcagtggttacattgaatgaacaatttttggagacccagcatggcgtat

SEQ ID NO: 399917 - DNA, 140 bp, Artificial Sequence
  Synthetic
atacgccatgctgggtctccataaatcctcaggaggggacccagaaattgtaatgcacacttttaactgtggaggggagtttttctactgtaatacaacacaactatttaatttcacttgcgtacttgggagtcggccat

SEQ ID NO: 399918 - DNA, 140 bp, Artificial Sequence
  Synthetic
atggccgactcccaagtacgcaagtgaaattaaatagttgtgttgtattacagtagaaaaactcccctccacagttaaaagtgtgcattacaatttctgggtcccctcctgaggatttatggagacccagcatggcgtat

SEQ ID NO: 399919 - DNA, 140 bp, Artificial Sequence
  Synthetic
atacgccatgctgggtctccgccagggagtctccatagaatggaggaaaaacagatatagcacacaagtagaccctggcctagcagaccaactaattcatctgtattattttgattgtttcgtacttgggagtcggccat

SEQ ID NO: 399920 - DNA, 140 bp, Artificial Sequence
  Synthetic
atggccgactcccaagtacgaaacaatcaaaataatacagatgaattagttggtctgctaggccagggtctacttgtgtgctatatctgtttttcctccattctatggagactccctggcggagacccagcatggcgtat

SEQ ID NO: 399921 - DNA, 140 bp, Artificial Sequence
  Synthetic
atacgccatgctgggtctccttagctgtcatggagagtttttctattgtaacacaacccagatgtttaattataccttctcatgtaacggaaccagctgtactaataaccaaagtaacagcgtacttgggagtcggccat

SEQ ID NO: 399922 - DNA, 140 bp, Artificial Sequence
  Synthetic
atggccgactcccaagtacgctgttactttggttattagtacagctggttccgttacatgagaaggtataattaaacatctgggttgtgttacaatagaaaaactctccatgacagctaaggagacccagcatggcgtat

SEQ ID NO: 399923 - DNA, 140 bp, Artificial Sequence
  Synthetic
aggccctggctgctgatatgtcccatgtagaataaaacaaattgtaaacagatggcaggaagtaggaaaagcaatgtatgcccctcccatcagtggatacattaaatgtgtatcaaatatgaccttttgggacagcggtg

SEQ ID NO: 399924 - DNA, 140 bp, Artificial Sequence
  Synthetic
caccgctgtcccaaaaggtcatatttgatacacatttaatgtatccactgatgggaggggcatacattgcttttcctacttcctgccatctgtttacaatttgttttattctacatgggacatatcagcagccagggcct

SEQ ID NO: 399925 - DNA, 140 bp, Artificial Sequence
  Synthetic
  misc_feature (98)..(98): n is a, c, g, or t
atacgccatgctgggtctccgaaaaggggaatgtaaaaatgtgagtactgtacaatgcacacatggaataaagccaacgatatctactcagttaatcntaaatgggagcctagatacagacgtacttgggagtcggccat

SEQ ID NO: 399926 - DNA, 140 bp, Artificial Sequence
  Synthetic
  misc_feature (43)..(43): n is a, c, g, or t
atggccgactcccaagtacgtctgtatctaggctcccatttangattaactgagtagatatcgttggctttattccatgtgtgcattgtacagtactcacatttttacattccccttttcggagacccagcatggcgtat

SEQ ID NO: 399927 - DNA, 140 bp, Artificial Sequence
  Synthetic
  misc_feature (43)..(43): n is a, c, g, or t
atacgccatgctgggtctcctagtaaggtcatggataaggggngagtcgggactctatgcacctcccatcaaaggtcctctaaaatgtgagtcaaacataactggaatgattctacaaaacgtacttgggagtcggccat

SEQ ID NO: 399928 - DNA, 140 bp, Artificial Sequence
  Synthetic
  misc_feature (98)..(98): n is a, c, g, or t
atggccgactcccaagtacgttttgtagaatcattccagttatgtttgactcacattttagaggacctttgatgggaggtgcatagagtcccgactcnccccttatccatgaccttactaggagacccagcatggcgtat

SEQ ID NO: 399929 - DNA, 140 bp, Artificial Sequence
  Synthetic
atacgccatgctgggtctccgggatagaacaaaagagaaaataaagggcctcctgggaaacaacacaacctttaagtctcgggtgaacattggaggagacccagaagtaagacacttcatcgtacttgggagtcggccat

SEQ ID NO: 399930 - DNA, 140 bp, Artificial Sequence
  Synthetic
atggccgactcccaagtacgatgaagtgtcttacttctgggtctcctccaatgttcacccgagacttaaaggttgtgttgtttcccaggaggccctttattttctcttttgttctatcccggagacccagcatggcgtat

SEQ ID NO: 399931 - DNA, 140 bp, Artificial Sequence
  Synthetic
aggccctggctgctgatatgtttaagtctcgggtgaacattggaggagacccagaagtaagacacttcatgttcaattgtggaggagagtttttcctttgtaacacttccagattatttggaccttttgggacagcggtg

SEQ ID NO: 399932 - DNA, 140 bp, Artificial Sequence
  Synthetic
caccgctgtcccaaaaggtccaaataatctggaagtgttacaaaggaaaaactctcctccacaattgaacatgaagtgtcttacttctgggtctcctccaatgttcacccgagacttaaacatatcagcagccagggcct

SEQ ID NO: 399933 - DNA, 140 bp, Artificial Sequence
  Synthetic
atacgccatgctgggtctccacagcaggacaacctgctaagagcaatacaggcccagcagcaattgctgaggctatctgtatggggtatcagacaactccgagctcgcctgcaagccttacgtacttgggagtcggccat

SEQ ID NO: 399934 - DNA, 140 bp, Artificial Sequence
  Synthetic
atggccgactcccaagtacgtaaggcttgcaggcgagctcggagttgtctgataccccatacagatagcctcagcaattgctgctgggcctgtattgctcttagcaggttgtcctgctgtggagacccagcatggcgtat

SEQ ID NO: 399935 - DNA, 140 bp, Artificial Sequence
  Synthetic
aggccctggctgctgatatgaattgaagaatcgcagaaccagcaggaaaagaatgaacaagacttattggcattggacaagtgggcaagtttgtggacttggtttgacatatcaaactgggaccttttgggacagcggtg

SEQ ID NO: 399936 - DNA, 140 bp, Artificial Sequence
  Synthetic
caccgctgtcccaaaaggtcccagtttgatatgtcaaaccaagtccacaaacttgcccacttgtccaatgccaataagtcttgttcattcttttcctgctggttctgcgattcttcaattcatatcagcagccagggcct

SEQ ID NO: 399937 - DNA, 140 bp, Artificial Sequence
  Synthetic
  misc_feature (73)..(73): n is a, c, g, or t
atacgccatgctgggtctccgcactaatctaaatacaatttgggacaacctaacatggcagcaatgggatcancagatagacaacataagcgacgttatatatggtgaaatacaaaaagccgtacttgggagtcggccat

SEQ ID NO: 399938 - DNA, 140 bp, Artificial Sequence
  Synthetic
  misc_feature (68)..(68): n is a, c, g, or t
atggccgactcccaagtacggctttttgtatttcaccatatataacgtcgcttatgttgtctatctgntgatcccattgctgccatgttaggttgtcccaaattgtatttagattagtgcggagacccagcatggcgtat

SEQ ID NO: 399939 - DNA, 140 bp, Artificial Sequence
  Synthetic
aggccctggctgctgatatgaaaatagcaataatcatagtaggagcactaataggtataagaattgtcatgatagtacttaatctagtgagaaacattaggcagggatatcaacccctctgaccttttgggacagcggtg

SEQ ID NO: 399940 - DNA, 140 bp, Artificial Sequence
  Synthetic
caccgctgtcccaaaaggtcagaggggttgatatccctgcctaatgtttctcactagattaagtactatcatgacaattcttatacctattagtgctcctactatgattattgctattttcatatcagcagccagggcct

SEQ ID NO: 399941 - DNA, 140 bp, Artificial Sequence
  Synthetic
atacgccatgctgggtctccggaatgagacttggagcaatcatacctcctatgattcaatctggggaaatttaacctggcaacaatgggatgagaaagtaagaaactattcaggtgtcatcgtacttgggagtcggccat

SEQ ID NO: 399942 - DNA, 140 bp, Artificial Sequence
  Synthetic
atggccgactcccaagtacgatgacacctgaatagtttcttactttctcatcccattgttgccaggttaaatttccccagattgaatcataggaggtatgattgctccaagtctcattccggagacccagcatggcgtat

SEQ ID NO: 399943 - DNA, 140 bp, Artificial Sequence
  Synthetic
atacgccatgctgggtctccgtaataacacccacaatcagagtgtaaaggaaaagatagaagattgggaagaaacaaaaaattgctctttcaatacaaccactgagttaagagataagatcgtacttgggagtcggccat

SEQ ID NO: 399944 - DNA, 140 bp, Artificial Sequence
  Synthetic
atggccgactcccaagtacgatcttatctcttaactcagtggttgtattgaaagagcaattttttgtttcttcccaatcttctatcttttcctttacactctgattgtgggtgttattacggagacccagcatggcgtat

SEQ ID NO: 399945 - DNA, 140 bp, Artificial Sequence
  Synthetic
atacgccatgctgggtctccgaaaggagaaataaaaaactgctctttcaatatcaccactagcataagagataaggtgcagaaagaatatgcacttttttataaacttgatgtagtaccacgtacttgggagtcggccat

SEQ ID NO: 399946 - DNA, 140 bp, Artificial Sequence
  Synthetic
atggccgactcccaagtacgtggtactacatcaagtttataaaaaagtgcatattctttctgcaccttatctcttatgctagtggtgatattgaaagagcagttttttatttctcctttcggagacccagcatggcgtat

SEQ ID NO: 399947 - DNA, 140 bp, Artificial Sequence
  Synthetic
aggccctggctgctgatatgggagttaccacctcttgagcaacttagcatcagggatccagacggtgatcagccatctgggactgggactgtggatcctaggacagaagataattaatgcgaccttttgggacagcggtg

SEQ ID NO: 399948 - DNA, 140 bp, Artificial Sequence
  Synthetic
caccgctgtcccaaaaggtcgcattaattatcttctgtcctaggatccacagtcccagtcccagatggctgatcaccgtctggatccctgatgctaagttgctcaagaggtggtaactcccatatcagcagccagggcct

SEQ ID NO: 399949 - DNA, 140 bp, Artificial Sequence
  Synthetic
  misc_feature (40)..(40): n is a, c, g, or t
atacgccatgctgggtctccatagtgctacaaacctattngatacccttgcagtagcagttgccaatagaactgacagcatattcttagggatacaaaggataggaagaggaattcttaacgtacttgggagtcggccat

SEQ ID NO: 399950 - DNA, 140 bp, Artificial Sequence
  Synthetic
  misc_feature (101)..(101): n is a, c, g, or t
atggccgactcccaagtacgttaagaattcctcttcctatcctttgtatccctaagaatatgctgtcagttctattggcaactgctactgcaagggtatcnaataggtttgtagcactatggagacccagcatggcgtat

SEQ ID NO: 399951 - DNA, 140 bp, Artificial Sequence
  Synthetic
atacgccatgctgggtctccggaccagacaggccagaaggaacagaagaaggcgttggagagcaagacagaggcagatctgtgcgattagtgaacggattcttagcacttgtctgggaggcgtacttgggagtcggccat

SEQ ID NO: 399952 - DNA, 140 bp, Artificial Sequence
  Synthetic
atggccgactcccaagtacgcctcccagacaagtgctaagaatccgttcactaatcgcacagatctgcctctgtcttgctctccaacgccttcttctgttccttctggcctgtctggtccggagacccagcatggcgtat

SEQ ID NO: 399953 - DNA, 140 bp, Artificial Sequence
  Synthetic
aggccctggctgctgatatgaggcagatctgtgcgattagtgaacggattcttagcacttgtctgggaggactgcaggaacctggtgaccctcctctaccaccgcttgagagacttactcgaccttttgggacagcggtg

SEQ ID NO: 399954 - DNA, 140 bp, Artificial Sequence
  Synthetic
caccgctgtcccaaaaggtcgagtaagtctctcaagcggtggtagaggagggtcaccaggttcctgcagtcctcccagacaagtgctaagaatccgttcactaatcgcacagatctgcctcatatcagcagccagggcct

SEQ ID NO: 399955 - DNA, 140 bp, Artificial Sequence
  Synthetic
aggccctggctgctgatatgaattaattgtacaagacccaacaacaatacaaggaaaagtatacctataggaccagggagagcattttatacaacaggagacataataggagatataagagaccttttgggacagcggtg

SEQ ID NO: 399956 - DNA, 140 bp, Artificial Sequence
  Synthetic
caccgctgtcccaaaaggtctcttatatctcctattatgtctcctgttgtataaaatgctctccctggtcctataggtatacttttccttgtattgttgttgggtcttgtacaattaattcatatcagcagccagggcct

SEQ ID NO: 399957 - DNA, 140 bp, Artificial Sequence
  Synthetic
  misc_feature (91)..(91): n is a, c, g, or t
aggccctggctgctgatatgattggggaaaagagttaaaagatagtgctatcagcttgcttaatacaacagctattgcagtagcagggggnacagataggcttatagaattagcacaaaggaccttttgggacagcggtg

SEQ ID NO: 399958 - DNA, 140 bp, Artificial Sequence
  Synthetic
  misc_feature (50)..(50): n is a, c, g, or t
caccgctgtcccaaaaggtcctttgtgctaattctataagcctatctgtnccccctgctactgcaatagctgttgtattaagcaagctgatagcactatcttttaactcttttccccaatcatatcagcagccagggcct

SEQ ID NO: 399959 - DNA, 140 bp, Artificial Sequence
  Synthetic
atacgccatgctgggtctccgaagaagtaggtttcccagtaagacctcaagttcctgtaagaccaatgacctttaaagcagcatttgacctcagtgtctttttaaaagaaaatgggggaccgtacttgggagtcggccat

SEQ ID NO: 399960 - DNA, 140 bp, Artificial Sequence
  Synthetic
atggccgactcccaagtacggtcccccattttcttttaaaaagacactgaggtcaaatgctgctttaaaggtcattggtcttacaggaacttgaggtcttactgggaaacctacttcttcggagacccagcatggcgtat

SEQ ID NO: 399961 - DNA, 140 bp, Artificial Sequence
  Synthetic
atacgccatgctgggtctcccagcagcagcagcagtaggagtaggagcagcttctcaagacctagctaatcgaggggccatcaccacaagcaatactagagataataatgaaactgtagccgtacttgggagtcggccat

SEQ ID NO: 399962 - DNA, 140 bp, Artificial Sequence
  Synthetic
atggccgactcccaagtacggctacagtttcattattatctctagtattgcttgtggtgatggcccctcgattagctaggtcttgagaagctgctcctactcctactgctgctgctgctgggagacccagcatggcgtat

SEQ ID NO: 399963 - DNA, 140 bp, Artificial Sequence
  Synthetic
atacgccatgctgggtctccttgggtagaagcacaagaagaagaagaggaagtaggctttccagtacgccctcaagtaccattgaggccaatgacctttaaagcagcttttgatctttcccgtacttgggagtcggccat

SEQ ID NO: 399964 - DNA, 140 bp, Artificial Sequence
  Synthetic
atggccgactcccaagtacgggaaagatcaaaagctgctttaaaggtcattggcctcaatggtacttgagggcgtactggaaagcctacttcctcttcttcttcttgtgcttctacccaaggagacccagcatggcgtat

SEQ ID NO: 399965 - DNA, 140 bp, Artificial Sequence
  Synthetic
aggccctggctgctgatatgaaaagagaaaaccacctctgcctagtgttagaaaattagtagaggatcgatggaacaacccccagaagatcaggggccgcagagggaaccatacaatgaagaccttttgggacagcggtg

SEQ ID NO: 399966 - DNA, 140 bp, Artificial Sequence
  Synthetic
caccgctgtcccaaaaggtcttcattgtatggttccctctgcggcccctgatcttctgggggttgttccatcgatcctctactaattttctaacactaggcagaggtggttttctcttttcatatcagcagccagggcct

SEQ ID NO: 399967 - DNA, 140 bp, Artificial Sequence
  Synthetic
atacgccatgctgggtctccttggtcccagaaaagacaagatatccttgatctttgggtctacaacacacaaggctacttccctgattggcaaaactacacaccagggccagggattagacgtacttgggagtcggccat

SEQ ID NO: 399968 - DNA, 140 bp, Artificial Sequence
  Synthetic
atggccgactcccaagtacgtctaatccctggccctggtgtgtagttttgccaatcagggaagtagccttgtgtgttgtagacccaaagatcaaggatatcttgtcttttctgggaccaaggagacccagcatggcgtat

SEQ ID NO: 399969 - DNA, 140 bp, Artificial Sequence
  Synthetic
aggccctggctgctgatatgaaggctacttccctgattggcaaaactacacaccagggccagggattagatatccactgacctttggatggtgcttcgaactagtaccagtggagccaacgaccttttgggacagcggtg

SEQ ID NO: 399970 - DNA, 140 bp, Artificial Sequence
  Synthetic
caccgctgtcccaaaaggtcgttggctccactggtactagttcgaagcaccatccaaaggtcagtggatatctaatccctggccctggtgtgtagttttgccaatcagggaagtagccttcatatcagcagccagggcct

SEQ ID NO: 399971 - DNA, 140 bp, Artificial Sequence
  Synthetic
atacgccatgctgggtctcctatccactgacctttggatggtgcttcgaactagtaccagtggagccaacagaggtagaagagaacactgaaggagagaacaactgcttgttacaccctacgtacttgggagtcggccat

SEQ ID NO: 399972 - DNA, 140 bp, Artificial Sequence
  Synthetic
atggccgactcccaagtacgtagggtgtaacaagcagttgttctctccttcagtgttctcttctacctctgttggctccactggtactagttcgaagcaccatccaaaggtcagtggataggagacccagcatggcgtat

SEQ ID NO: 399973 - DNA, 140 bp, Artificial Sequence
  Synthetic
atacgccatgctgggtctcctttaacagccacctggcatttgagcacaaggcccgagtgaagcatccggagttctacaaagactgctgacacagaagttgctgacaagggactttccgctcgtacttgggagtcggccat

SEQ ID NO: 399974 - DNA, 140 bp, Artificial Sequence
  Synthetic
atggccgactcccaagtacgagcggaaagtcccttgtcagcaacttctgtgtcagcagtctttgtagaactccggatgcttcactcgggccttgtgctcaaatgccaggtggctgttaaaggagacccagcatggcgtat

SEQ ID NO: 399975 - DNA, 140 bp, Artificial Sequence
  Synthetic
aggccctggctgctgatatgttttagaggagcttaagaatgaagctgttagacattttcctaggccatggctccatagcttaggacaacatatctataacacctatggggatacttgggagaccttttgggacagcggtg

SEQ ID NO: 399976 - DNA, 140 bp, Artificial Sequence
  Synthetic
caccgctgtcccaaaaggtctcccaagtatccccataggtgttatagatatgttgtcctaagctatggagccatggcctaggaaaatgtctaacagcttcattcttaagctcctctaaaacatatcagcagccagggcct

SEQ ID NO: 399977 - DNA, 140 bp, Artificial Sequence
  Synthetic
aggccctggctgctgatatgtgtagataggttctttaaaactttaagagctgagcaagctacacaggaagtaaaaaattggatgacagacaccttgttggtccaaaatgcgaacccagatgaccttttgggacagcggtg

SEQ ID NO: 399978 - DNA, 140 bp, Artificial Sequence
  Synthetic
caccgctgtcccaaaaggtcatctgggttcgcattttggaccaacaaggtgtctgtcatccaattttttacttcctgtgtagcttgctcagctcttaaagttttaaagaacctatctacacatatcagcagccagggcct

SEQ ID NO: 399979 - DNA, 140 bp, Artificial Sequence
  Synthetic
atacgccatgctgggtctccctaggactccttgtaccaaatgctattgtaaaaagtgttgctttcattgccaagtttgcttcatatcaaaaggcttaggcatctccaatggcaggaagaacgtacttgggagtcggccat

SEQ ID NO: 399980 - DNA, 140 bp, Artificial Sequence
  Synthetic
atggccgactcccaagtacgttcttcctgccattggagatgcctaagccttttgatatgaagcaaacttggcaatgaaagcaacactttttacaatagcatttggtacaaggagtcctagggagacccagcatggcgtat

SEQ ID NO: 399981 - DNA, 140 bp, Artificial Sequence
  Synthetic
aggccctggctgctgatatgtgttggaaatgtggaaaggaaggacaccaaatgaaagattgtactgagagacaggctaattttttagggaaaatctggccttcccacaaggggaggccaggaccttttgggacagcggtg

SEQ ID NO: 399982 - DNA, 140 bp, Artificial Sequence
  Synthetic
caccgctgtcccaaaaggtcctggcctccccttgtgggaaggccagattttccctaaaaaattagcctgtctctcagtacaatctttcatttggtgtccttcctttccacatttccaacacatatcagcagccagggcct

SEQ ID NO: 399983 - DNA, 140 bp, Artificial Sequence
  Synthetic
aggccctggctgctgatatgattgtcgagcacctagaaagaaaggttgctggaaatgtggacaggaaggtcaccaaatgaaagattgcagaaatggaaaacaggcaaattttttagggaagaccttttgggacagcggtg

SEQ ID NO: 399984 - DNA, 140 bp, Artificial Sequence
  Synthetic
caccgctgtcccaaaaggtcttccctaaaaaatttgcctgttttccatttctgcaatctttcatttggtgaccttcctgtccacatttccagcaacctttctttctaggtgctcgacaatcatatcagcagccagggcct

SEQ ID NO: 399985 - DNA, 140 bp, Artificial Sequence
  Synthetic
aggccctggctgctgatatgaactgtggcaaagaaggacacctagccagaaattgcagggcccctaggaaaaagggctgttggaaatgtggaaaggagggacaccaaatgaaagactgcagaccttttgggacagcggtg

SEQ ID NO: 399986 - DNA, 140 bp, Artificial Sequence
  Synthetic
caccgctgtcccaaaaggtctgcagtctttcatttggtgtccctcctttccacatttccaacagccctttttcctaggggccctgcaatttctggctaggtgtccttctttgccacagttcatatcagcagccagggcct

SEQ ID NO: 399987 - DNA, 140 bp, Artificial Sequence
  Synthetic
atacgccatgctgggtctcccagaagggggatccgaacgaactctatccgtttgcctccctcaaatccctctttgggacagaccagtagttacagcaagggttgggggccatctatgtgacgtacttgggagtcggccat

SEQ ID NO: 399988 - DNA, 140 bp, Artificial Sequence
  Synthetic
atggccgactcccaagtacgtcacatagatggcccccaacccttgctgtaactactggtctgtcccaaagagggatttgagggaggcaaacggatagagttcgttcggatcccccttctgggagacccagcatggcgtat

SEQ ID NO: 399989 - DNA, 140 bp, Artificial Sequence
  Synthetic
aggccctggctgctgatatggggctattgaggcgcaacagcatatgttgcaactcacagtctggggcatcaagcagctccaggcaagagtcctggctctggaaagatacctaagggatcagaccttttgggacagcggtg

SEQ ID NO: 399990 - DNA, 140 bp, Artificial Sequence
  Synthetic
caccgctgtcccaaaaggtctgatcccttaggtatctttccagagccaggactcttgcctggagctgcttgatgccccagactgtgagttgcaacatatgctgttgcgcctcaatagccccatatcagcagccagggcct

SEQ ID NO: 399991 - DNA, 140 bp, Artificial Sequence
  Synthetic
aggccctggctgctgatatgtcagacctggaggaggagatatgagggacaattggagaagtgaattatataagtataaaatagtaaaaattaaaccactaggaatagcacctaccaaggcgaccttttgggacagcggtg

SEQ ID NO: 399992 - DNA, 140 bp, Artificial Sequence
  Synthetic
caccgctgtcccaaaaggtcgccttggtaggtgctattcctagtggtttaatttttactattttatacttatataattcacttctccaattgtccctcatatctcctcctccaggtctgacatatcagcagccagggcct

SEQ ID NO: 399993 - DNA, 140 bp, Artificial Sequence
  Synthetic
atacgccatgctgggtctccacaagaaaagtataaggataggaccaggacaagcattttatgcaacaaatgacataataggagacataagacaagcatattgtaacattagtgctcaggacgtacttgggagtcggccat

SEQ ID NO: 399994 - DNA, 140 bp, Artificial Sequence
  Synthetic
atggccgactcccaagtacgtcctgagcactaatgttacaatatgcttgtcttatgtctcctattatgtcatttgttgcataaaatgcttgtcctggtcctatccttatacttttcttgtggagacccagcatggcgtat

SEQ ID NO: 399995 - DNA, 140 bp, Artificial Sequence
  Synthetic
atacgccatgctgggtctccatttataatgttacaggaaacttgtgggtcacagtatattatggggtgcctgtgtggaaagaagcaaaaaccactttattttgtgcatcagacgctgaagcgtacttgggagtcggccat

SEQ ID NO: 399996 - DNA, 140 bp, Artificial Sequence
  Synthetic
atggccgactcccaagtacgcttcagcgtctgatgcacaaaataaagtggtttttgcttctttccacacaggcaccccataatatactgtgacccacaagtttcctgtaacattataaatggagacccagcatggcgtat

SEQ ID NO: 399997 - DNA, 140 bp, Artificial Sequence
  Synthetic
aggccctggctgctgatatggatatcagtacaatgtgcttccacagggatggaaaggatcaccagcaatatttcagtgtagcatgacaaaaatcttagagccctttagaacaaaaaatccgaccttttgggacagcggtg

SEQ ID NO: 399998 - DNA, 140 bp, Artificial Sequence
  Synthetic
caccgctgtcccaaaaggtcggattttttgttctaaagggctctaagatttttgtcatgctacactgaaatattgctggtgatcctttccatccctgtggaagcacattgtactgatatccatatcagcagccagggcct

SEQ ID NO: 399999 - DNA, 140 bp, Artificial Sequence
  Synthetic
aggccctggctgctgatatgagtatactgcattcaccatacctagtataaacaatgagacaccagggattaggtatcagtacaatgtgcttccacagggatggaaaggatcaccagcaatgaccttttgggacagcggtg

SEQ ID NO: 400000 - DNA, 140 bp, Artificial Sequence
  Synthetic
caccgctgtcccaaaaggtcattgctggtgatcctttccatccctgtggaagcacattgtactgatacctaatccctggtgtctcattgtttatactaggtatggtgaatgcagtatactcatatcagcagccagggcct

SEQ ID NO: 400001 - DNA, 140 bp, Artificial Sequence
  Synthetic
atacgccatgctgggtctcccaaagttagggtcttatttccctaatgcaacaataaaatttaactcatcctcaggaggggacctagaaattacaaggcataattttaattgtatgggagacgtacttgggagtcggccat

SEQ ID NO: 400002 - DNA, 140 bp, Artificial Sequence
  Synthetic
atggccgactcccaagtacgtctcccatacaattaaaattatgccttgtaatttctaggtcccctcctgaggatgagttaaattttattgttgcattagggaaataagaccctaactttgggagacccagcatggcgtat

SEQ ID NO: 400003 - DNA, 140 bp, Artificial Sequence
  Synthetic
aggccctggctgctgatatgttagtgggaaaactaaattgggcaagtcagatttatccagggattaaagtaaaacaactatgtaaactccttaggggggctaaagcactaacagacataggaccttttgggacagcggtg

SEQ ID NO: 400004 - DNA, 140 bp, Artificial Sequence
  Synthetic
caccgctgtcccaaaaggtcctatgtctgttagtgctttagcccccctaaggagtttacatagttgttttactttaatccctggataaatctgacttgcccaatttagttttcccactaacatatcagcagccagggcct

SEQ ID NO: 400005 - DNA, 140 bp, Artificial Sequence
  Synthetic
aggccctggctgctgatatggtaaacatgtggcaggaagtgggacgagcaatgtatgccaatcccattgcaggaaacattacctgtaactcaaatattacaggtctgctattgacaagaggaccttttgggacagcggtg

SEQ ID NO: 400006 - DNA, 140 bp, Artificial Sequence
  Synthetic
caccgctgtcccaaaaggtcctcttgtcaatagcagacctgtaatatttgagttacaggtaatgtttcctgcaatgggattggcatacattgctcgtcccacttcctgccacatgtttaccatatcagcagccagggcct

SEQ ID NO: 400007 - DNA, 140 bp, Artificial Sequence
  Synthetic
aggccctggctgctgatatgtacagaagttagtggggaaattaaattgggcaagtcagatttatccaggaattaaagtaagacaattatgcaaatgccttaggggaaccaaagcactgacgaccttttgggacagcggtg

SEQ ID NO: 400008 - DNA, 140 bp, Artificial Sequence
  Synthetic
caccgctgtcccaaaaggtcgtcagtgctttggttcccctaaggcatttgcataattgtcttactttaattcctggataaatctgacttgcccaatttaatttccccactaacttctgtacatatcagcagccagggcct

SEQ ID NO: 400009 - DNA, 140 bp, Artificial Sequence
  Synthetic
atacgccatgctgggtctccgtatcggttagaaacagaacccataccaggagcagaaacttattatgtagatggggcagctaatagggaaacaaaattaggaaaggcaggatatgttactcgtacttgggagtcggccat

SEQ ID NO: 400010 - DNA, 140 bp, Artificial Sequence
  Synthetic
atggccgactcccaagtacgagtaacatatcctgcctttcctaattttgtttccctattagctgccccatctacataataagtttctgctcctggtatgggttctgtttctaaccgatacggagacccagcatggcgtat

SEQ ID NO: 400011 - DNA, 140 bp, Artificial Sequence
  Synthetic
aggccctggctgctgatatgatggggcagctaatagggaaacaaaattaggaaaggcaggatatgttactgacaaaggaaaacaaaaaattattaccctaactgaaacaacaaatcaaaagaccttttgggacagcggtg

SEQ ID NO: 400012 - DNA, 140 bp, Artificial Sequence
  Synthetic
caccgctgtcccaaaaggtcttttgatttgttgtttcagttagggtaataattttttgttttcctttgtcagtaacatatcctgcctttcctaattttgtttccctattagctgccccatcatatcagcagccagggcct

SEQ ID NO: 400013 - DNA, 140 bp, Artificial Sequence
  Synthetic
aggccctggctgctgatatgtatcaaagcagtaagtagtacatgtaatgcaacctttagaaatattagcaatagtagcattagtagtagcagcaataatagcaatagttgtgtggaccatgaccttttgggacagcggtg

SEQ ID NO: 400014 - DNA, 140 bp, Artificial Sequence
  Synthetic
caccgctgtcccaaaaggtcatggtccacacaactattgctattattgctgctactactaatgctactattgctaatatttctaaaggttgcattacatgtactacttactgctttgatacatatcagcagccagggcct

SEQ ID NO: 400015 - DNA, 140 bp, Artificial Sequence
  Synthetic
aggccctggctgctgatatgcaacatacctagaagaataagacagggcttggaaagggctttgctataaaatgggtggcaagtggtcaaaaagtagtatagttggatggcctgctataaggaccttttgggacagcggtg

SEQ ID NO: 400016 - DNA, 140 bp, Artificial Sequence
  Synthetic
caccgctgtcccaaaaggtccttatagcaggccatccaactatactactttttgaccacttgccacccattttatagcaaagccctttccaagccctgtcttattcttctaggtatgttgcatatcagcagccagggcct

SEQ ID NO: 400017 - DNA, 140 bp, Artificial Sequence
  Synthetic
atacgccatgctgggtctccgccagctcttcagactggatcagaagaacttaaatcattatacaacacagtatcacccctctattgtgtacatgagaagatagatgtacgagacaccaagcgtacttgggagtcggccat

SEQ ID NO: 400018 - DNA, 140 bp, Artificial Sequence
  Synthetic
atggccgactcccaagtacgcttggtgtctcgtacatctatcttctcatgtacacaatagaggggtgatactgtgttgtataatgatttaagttcttctgatccagtctgaagagctggcggagacccagcatggcgtat

SEQ ID NO: 400019 - DNA, 140 bp, Artificial Sequence
  Synthetic
aggccctggctgctgatatggcatttgggtcatggggtctccatagaatggaggcagagagaatatagcacacaaatagatcctgacctagcagaccaactgattcatctgcattattttgaccttttgggacagcggtg

SEQ ID NO: 400020 - DNA, 140 bp, Artificial Sequence
  Synthetic
caccgctgtcccaaaaggtcaaaataatgcagatgaatcagttggtctgctaggtcaggatctatttgtgtgctatattctctctgcctccattctatggagaccccatgacccaaatgccatatcagcagccagggcct

SEQ ID NO: 400021 - DNA, 140 bp, Artificial Sequence
  Synthetic
atacgccatgctgggtctcctcttaacgcttgcctgggacgacctgcggaacctgtgcctcttctgctaccgccgattgagagacttgctattgattgcagcgagaacggtggaacttctcgtacttgggagtcggccat

SEQ ID NO: 400022 - DNA, 140 bp, Artificial Sequence
  Synthetic
atggccgactcccaagtacgagaagttccaccgttctcgctgcaatcaatagcaagtctctcaatcggcggtagcagaagaggcacaggttccgcaggtcgtcccaggcaagcgttaagaggagacccagcatggcgtat

SEQ ID NO: 400023 - DNA, 140 bp, Artificial Sequence
  Synthetic
aggccctggctgctgatatgggccacctttgcctagtgttaggatattaacagagggtagatggaacaagccccagaagaccaggggccacagagagagccacacaatgaatggatgttagaccttttgggacagcggtg

SEQ ID NO: 400024 - DNA, 140 bp, Artificial Sequence
  Synthetic
caccgctgtcccaaaaggtctaacatccattcattgtgtggctctctctgtggcccctggtcttctggggcttgttccatctaccctctgttaatatcctaacactaggcaaaggtggcccatatcagcagccagggcct

SEQ ID NO: 400025 - DNA, 140 bp, Artificial Sequence
  Synthetic
atacgccatgctgggtctccaagttcctctatcaaagcagtaagtagtacatgtaatgcaatctctacaaatattagcaatagtagcattagtagtagcagcaataatagcaatagttgtcgtacttgggagtcggccat

SEQ ID NO: 400026 - DNA, 140 bp, Artificial Sequence
  Synthetic
atggccgactcccaagtacgacaactattgctattattgctgctactactaatgctactattgctaatatttgtagagattgcattacatgtactacttactgctttgatagaggaacttggagacccagcatggcgtat

SEQ ID NO: 400027 - DNA, 140 bp, Artificial Sequence
  Synthetic
aggccctggctgctgatatgtaacttccctcaaatcactctttggcagcgaccccttgtctcaataaaagtagggggccagataaaggaggctctcttagacacaggagcagatgatacagaccttttgggacagcggtg

SEQ ID NO: 400028 - DNA, 140 bp, Artificial Sequence
  Synthetic
caccgctgtcccaaaaggtctgtatcatctgctcctgtgtctaagagagcctcctttatctggccccctacttttattgagacaaggggtcgctgccaaagagtgatttgagggaagttacatatcagcagccagggcct

SEQ ID NO: 400029 - DNA, 140 bp, Artificial Sequence
  Synthetic
aggccctggctgctgatatgcttataaatataattctatggatgtttattcttaaacaatgtatagaacaaaagaaacaaagtagaagagaaagagaaataattgaaaggttaagaagaagaccttttgggacagcggtg

SEQ ID NO: 400030 - DNA, 140 bp, Artificial Sequence
  Synthetic
caccgctgtcccaaaaggtcttcttcttaacctttcaattatttctctttctcttctactttgtttcttttgttctatacattgtttaagaataaacatccatagaattatatttataagcatatcagcagccagggcct

SEQ ID NO: 400031 - DNA, 140 bp, Artificial Sequence
  Synthetic
aggccctggctgctgatatgcctcaaatcactctttggcaacgaccactagtcacaataaaagtagggggacagctaagggaagctctattagatacaggagcagatgatacagtattaggaccttttgggacagcggtg

SEQ ID NO: 400032 - DNA, 140 bp, Artificial Sequence
  Synthetic
caccgctgtcccaaaaggtcctaatactgtatcatctgctcctgtatctaatagagcttcccttagctgtccccctacttttattgtgactagtggtcgttgccaaagagtgatttgaggcatatcagcagccagggcct

SEQ ID NO: 400033 - DNA, 140 bp, Artificial Sequence
  Synthetic
atacgccatgctgggtctcctggagtgggaatgctactaatgtccctaccaatgggagtaacttgggagagatgaaagaagaaatgaaaaactgctctttcaatattaccacacccataacgtacttgggagtcggccat

SEQ ID NO: 400034 - DNA, 140 bp, Artificial Sequence
  Synthetic
atggccgactcccaagtacgttatgggtgtggtaatattgaaagagcagtttttcatttcttctttcatctctcccaagttactcccattggtagggacattagtagcattcccactccaggagacccagcatggcgtat

SEQ ID NO: 400035 - DNA, 140 bp, Artificial Sequence
  Synthetic
aggccctggctgctgatatggaagatgcagccccagtattattctgtgcttcagatgttaacctaacaagcactgagcagcataatatttgggcatcacaagcctgtgttcccacagatcgaccttttgggacagcggtg

SEQ ID NO: 400036 - DNA, 140 bp, Artificial Sequence
  Synthetic
caccgctgtcccaaaaggtcgatctgtgggaacacaggcttgtgatgcccaaatattatgctgctcagtgcttgttaggttaacatctgaagcacagaataatactggggctgcatcttccatatcagcagccagggcct

SEQ ID NO: 400037 - DNA, 140 bp, Artificial Sequence
  Synthetic
  misc_feature (41)..(41): n is a, c, g, or t
atacgccatgctgggtctccaaccaacaataccactgtaancaacaatgaagaaataaaaaactgttctttcaatataaccacagagatacaagataagaagaagacagtatacgcgcttcgtacttgggagtcggccat

SEQ ID NO: 400038 - DNA, 140 bp, Artificial Sequence
  Synthetic
  misc_feature (100)..(100): n is a, c, g, or t
atggccgactcccaagtacgaagcgcgtatactgtcttcttcttatcttgtatctctgtggttatattgaaagaacagttttttatttcttcattgttgnttacagtggtattgttggttggagacccagcatggcgtat

SEQ ID NO: 400039 - DNA, 140 bp, Artificial Sequence
  Synthetic
aggccctggctgctgatatgattgtaatgtctcaaccattaaacaggcttgtccaaaggtgtcttttgaaccaattcccatacattattgtgctccagctggttttgcgattttaaaatggaccttttgggacagcggtg

SEQ ID NO: 400040 - DNA, 140 bp, Artificial Sequence
  Synthetic
caccgctgtcccaaaaggtccattttaaaatcgcaaaaccagctggagcacaataatgtatgggaattggttcaaaagacacctttggacaagcctgtttaatggttgagacattacaatcatatcagcagccagggcct

SEQ ID NO: 400041 - DNA, 140 bp, Artificial Sequence
  Synthetic
atacgccatgctgggtctccacccacaagaaatacatttggaaaatgtaacagaagagtttaacatgtggaaaaataacatggtagagcagatgcatacagatataatcagtctatgggacgtacttgggagtcggccat

SEQ ID NO: 400042 - DNA, 140 bp, Artificial Sequence
  Synthetic
atggccgactcccaagtacgtcccatagactgattatatctgtatgcatctgctctaccatgttatttttccacatgttaaactcttctgttacattttccaaatgtatttcttgtgggtggagacccagcatggcgtat

SEQ ID NO: 400043 - DNA, 140 bp, Artificial Sequence
  Synthetic
atacgccatgctgggtctcccaagagcaacttatgaaacagtgtgagtttaatgtgaccacagttctcaaggacaaaaaggagaaaaaacaggctctattctatgtatcagatttgagtacgtacttgggagtcggccat

SEQ ID NO: 400044 - DNA, 140 bp, Artificial Sequence
  Synthetic
atggccgactcccaagtacgtactcaaatctgatacatagaatagagcctgttttttctcctttttgtccttgagaactgtggtcacattaaactcacactgtttcataagttgctcttgggagacccagcatggcgtat

SEQ ID NO: 400045 - DNA, 140 bp, Artificial Sequence
  Synthetic
aggccctggctgctgatatgattgtagcagtattaacaatagggataacatcacgggggaaatggaagaaataagaaactgctctttcaatacgactacagtgctaagggataagagacagaccttttgggacagcggtg

SEQ ID NO: 400046 - DNA, 140 bp, Artificial Sequence
  Synthetic
caccgctgtcccaaaaggtctgtctcttatcccttagcactgtagtcgtattgaaagagcagtttcttatttcttccatttcccccgtgatgttatccctattgttaatactgctacaatcatatcagcagccagggcct

SEQ ID NO: 400047 - DNA, 140 bp, Artificial Sequence
  Synthetic
atacgccatgctgggtctccggtgctgattgtgtggcaggtagagaggatgaagattagaacatggaatagtttagtaatacatgatttgtatgtctaaacgagagctaatcgatggtctcgtacttgggagtcggccat

SEQ ID NO: 400048 - DNA, 140 bp, Artificial Sequence
  Synthetic
atggccgactcccaagtacgagaccatcgattagctctcgtttagacatacaaatcatgtattactaaactattccatgttctaatcttcatcctctctacctgccacacaatcagcaccggagacccagcatggcgtat

SEQ ID NO: 400049 - DNA, 140 bp, Artificial Sequence
  Synthetic
aggccctggctgctgatatgggacaagcgttctatgcaacaggtgatataataggagatataagacaagcatattgtgaggttaatgaaacacaatggaaggagatgatgcagcaagtaagaccttttgggacagcggtg

SEQ ID NO: 400050 - DNA, 140 bp, Artificial Sequence
  Synthetic
caccgctgtcccaaaaggtcttacttgctgcatcatctccttccattgtgtttcattaacctcacaatatgcttgtcttatatctcctattatatcacctgttgcatagaacgcttgtcccatatcagcagccagggcct

SEQ ID NO: 400051 - DNA, 140 bp, Artificial Sequence
  Synthetic
aggccctggctgctgatatgcaaaaaacatcaaaaagaacccccattcctttggatggggtatgaactccatcctgataaatggacagtgcagcctatacaattgccagacaaggatagcgaccttttgggacagcggtg

SEQ ID NO: 400052 - DNA, 140 bp, Artificial Sequence
  Synthetic
caccgctgtcccaaaaggtcgctatccttgtctggcaattgtataggctgcactgtccatttatcaggatggagttcataccccatccaaaggaatgggggttctttttgatgttttttgcatatcagcagccagggcct

SEQ ID NO: 400053 - DNA, 140 bp, Artificial Sequence
  Synthetic
  misc_feature (120)..(120): n is a, c, g, or t
atacgccatgctgggtctcctcctcaggaggggacctagaaattgcaccacatagttttaattgtggaggagaatttttctattgtaatacatctgacctgtttaatagtagtaataatncgtacttgggagtcggccat

SEQ ID NO: 400054 - DNA, 140 bp, Artificial Sequence
  Synthetic
  misc_feature (21)..(21): n is a, c, g, or t
atggccgactcccaagtacgnattattactactattaaacaggtcagatgtattacaatagaaaaattctcctccacaattaaaactatgtggtgcaatttctaggtcccctcctgaggaggagacccagcatggcgtat

SEQ ID NO: 400055 - DNA, 140 bp, Artificial Sequence
  Synthetic
aggccctggctgctgatatggaggggacagatagggttatagaagtagtacaaggagcttgtagagctattcgccacatacctagaagaataagacagggcttggaaaggattttgctatgaccttttgggacagcggtg

SEQ ID NO: 400056 - DNA, 140 bp, Artificial Sequence
  Synthetic
caccgctgtcccaaaaggtcatagcaaaatcctttccaagccctgtcttattcttctaggtatgtggcgaatagctctacaagctccttgtactacttctataaccctatctgtcccctccatatcagcagccagggcct

SEQ ID NO: 400057 - DNA, 140 bp, Artificial Sequence
  Synthetic
atacgccatgctgggtctccctggtacagcatgggcataatcagagaggaaaaatcctcaaacctctcaaggttagcctattgcaagtataatatcactgactgggaaaaagccttaaaacgtacttgggagtcggccat

SEQ ID NO: 400058 - DNA, 140 bp, Artificial Sequence
  Synthetic
atggccgactcccaagtacgttttaaggctttttcccagtcagtgatattatacttgcaataggctaaccttgagaggtttgaggatttttcctctctgattatgcccatgctgtaccagggagacccagcatggcgtat

SEQ ID NO: 400059 - DNA, 140 bp, Artificial Sequence
  Synthetic
atacgccatgctgggtctccaggataatacaaattgtaagaatgtggcagagagtaggacaagcaatgtatgcccctcccatcgcaggaaacattacatgtggaacaaccatcacagcaccgtacttgggagtcggccat

SEQ ID NO: 400060 - DNA, 140 bp, Artificial Sequence
  Synthetic
atggccgactcccaagtacggtgctgtgatggttgttccacatgtaatgtttcctgcgatgggaggggcatacattgcttgtcctactctctgccacattcttacaatttgtattatcctggagacccagcatggcgtat

SEQ ID NO: 400061 - DNA, 140 bp, Artificial Sequence
  Synthetic
atacgccatgctgggtctcctgcattttaactgtcatggagagttcttctattgtaacacatctgggatgtttaattatactttctcatgtaaaggaaccaactgcactactaaccaaagcgtacttgggagtcggccat

SEQ ID NO: 400062 - DNA, 140 bp, Artificial Sequence
  Synthetic
atggccgactcccaagtacgctttggttagtagtgcagttggttcctttacatgagaaagtataattaaacatcccagatgtgttacaatagaagaactctccatgacagttaaaatgcaggagacccagcatggcgtat

SEQ ID NO: 400063 - DNA, 140 bp, Artificial Sequence
  Synthetic
aggccctggctgctgatatgtttaattatactttctcatgtaaaggaaccaactgcactactaaccaaagtagtaatgaaactagtataccttgcagaataaaacagatagtaaggtcatgaccttttgggacagcggtg

SEQ ID NO: 400064 - DNA, 140 bp, Artificial Sequence
  Synthetic
caccgctgtcccaaaaggtcatgaccttactatctgttttattctgcaaggtatactagtttcattactactttggttagtagtgcagttggttcctttacatgagaaagtataattaaacatatcagcagccagggcct

SEQ ID NO: 400065 - DNA, 140 bp, Artificial Sequence
  Synthetic
atacgccatgctgggtctccacatgtagatcacgaattactggaatgattctacaaatagatatgccatggaataaaagcgaagcaaacgttacatttagaccagtagggggagatatgacgtacttgggagtcggccat

SEQ ID NO: 400066 - DNA, 140 bp, Artificial Sequence
  Synthetic
atggccgactcccaagtacgtcatatctccccctactggtctaaatgtaacgtttgcttcgcttttattccatggcatatctatttgtagaatcattccagtaattcgtgatctacatgtggagacccagcatggcgtat

SEQ ID NO: 400067 - DNA, 140 bp, Artificial Sequence
  Synthetic
aggccctggctgctgatatggacgcagcagtctcaggggactacagagagggtgggaagcccttaagtatctgggaagtctcgtgcagtattggggtctggagctaaaaaagagtgctatgaccttttgggacagcggtg

SEQ ID NO: 400068 - DNA, 140 bp, Artificial Sequence
  Synthetic
caccgctgtcccaaaaggtcatagcactcttttttagctccagaccccaatactgcacgagacttcccagatacttaagggcttcccaccctctctgtagtcccctgagactgctgcgtccatatcagcagccagggcct

SEQ ID NO: 400069 - DNA, 140 bp, Artificial Sequence
  Synthetic
aggccctggctgctgatatgactctctatagtgaatagagttaggcagggatactcacccttgtcattccagaccctcctcccagccacctcgaggggacccgacaggcccgaaggaatcgaccttttgggacagcggtg

SEQ ID NO: 400070 - DNA, 140 bp, Artificial Sequence
  Synthetic
caccgctgtcccaaaaggtcgattccttcgggcctgtcgggtcccctcgaggtggctgggaggagggtctggaatgacaagggtgagtatccctgcctaactctattcactatagagagtcatatcagcagccagggcct

SEQ ID NO: 400071 - DNA, 140 bp, Artificial Sequence
  Synthetic
atacgccatgctgggtctcctgcctgtacggggtctctcttgatagaccagatcgagcctgggagctctctggctagcaggagaacccactgcttaagcctcaataaagcttgccttgagcgtacttgggagtcggccat

SEQ ID NO: 400072 - DNA, 140 bp, Artificial Sequence
  Synthetic
atggccgactcccaagtacgctcaaggcaagctttattgaggcttaagcagtgggttctcctgctagccagagagctcccaggctcgatctggtctatcaagagagaccccgtacaggcaggagacccagcatggcgtat

SEQ ID NO: 400073 - DNA, 140 bp, Artificial Sequence
  Synthetic
aggccctggctgctgatatgaagctgcagaatgggataggttacatccagcacaggcagggcctttgccaccaggccagctgagagaaccaaggggaagtgacatagcaggaaccactaggaccttttgggacagcggtg

SEQ ID NO: 400074 - DNA, 140 bp, Artificial Sequence
  Synthetic
caccgctgtcccaaaaggtcctagtggttcctgctatgtcacttccccttggttctctcagctggcctggtggcaaaggccctgcctgtgctggatgtaacctatcccattctgcagcttcatatcagcagccagggcct

SEQ ID NO: 400075 - DNA, 140 bp, Artificial Sequence
  Synthetic
  misc_feature (26)..(26): n is a, c, g, or t
aggccctggctgctgatatggtatcntttgagccaattcccatacattattgtgccccagctggttttgcaattctaaagtgtaaggatgagaggttcaatggaacaggcccatgcaaaagaccttttgggacagcggtg

SEQ ID NO: 400076 - DNA, 140 bp, Artificial Sequence
  Synthetic
  misc_feature (115)..(115): n is a, c, g, or t
caccgctgtcccaaaaggtcttttgcatgggcctgttccattgaacctctcatccttacactttagaattgcaaaaccagctggggcacaataatgtatgggaattggctcaaangataccatatcagcagccagggcct

SEQ ID NO: 400077 - DNA, 140 bp, Artificial Sequence
  Synthetic
aggccctggctgctgatatggcctgttagaaacatcagaaggctgtagacaaatactggaacagctacaaccagctcttcagacaggatcagaagaacttagatcattatttaatacagtgaccttttgggacagcggtg

SEQ ID NO: 400078 - DNA, 140 bp, Artificial Sequence
  Synthetic
caccgctgtcccaaaaggtcactgtattaaataatgatctaagttcttctgatcctgtctgaagagctggttgtagctgttccagtatttgtctacagccttctgatgtttctaacaggccatatcagcagccagggcct

SEQ ID NO: 400079 - DNA, 140 bp, Artificial Sequence
  Synthetic
atacgccatgctgggtctccagatagggttatagaagcaatacaaagagcttgtagggctgttctcaacgtacctagaaggataagacaaggctttgaaagagcattgctataaaatgggcgtacttgggagtcggccat

SEQ ID NO: 400080 - DNA, 140 bp, Artificial Sequence
  Synthetic
atggccgactcccaagtacgcccattttatagcaatgctctttcaaagccttgtcttatccttctaggtacgttgagaacagccctacaagctctttgtattgcttctataaccctatctggagacccagcatggcgtat

SEQ ID NO: 400081 - DNA, 140 bp, Artificial Sequence
  Synthetic
aggccctggctgctgatatgtacctagaaggataagacaaggctttgaaagagcattgctataaaatgggaagcaaatggtcaaaaagctggcctgcagtatgggaaacaataaggcgaagaccttttgggacagcggtg

SEQ ID NO: 400082 - DNA, 140 bp, Artificial Sequence
  Synthetic
caccgctgtcccaaaaggtcttcgccttattgtttcccatactgcaggccagctttttgaccatttgcttcccattttatagcaatgctctttcaaagccttgtcttatccttctaggtacatatcagcagccagggcct

SEQ ID NO: 400083 - DNA, 140 bp, Artificial Sequence
  Synthetic
atacgccatgctgggtctccaaatcattatataatgcagtagcagtcctctattgtgtccatcaaaggatagacataaaagacaccaaggaagcgctagataaaatagaggaaatacaaacgtacttgggagtcggccat

SEQ ID NO: 400084 - DNA, 140 bp, Artificial Sequence
  Synthetic
atggccgactcccaagtacgtttgtatttcctctattttatctagcgcttccttggtgtcttttatgtctatcctttgatggacacaatagaggactgctactgcattatataatgatttggagacccagcatggcgtat

SEQ ID NO: 400085 - DNA, 140 bp, Artificial Sequence
  Synthetic
aggccctggctgctgatatgacaataaaatttgaaccatcctcaggaggggacctagaaattacaacacatagctttaattgtagaggagaatttttctattgtaatacatcaggcctgtgaccttttgggacagcggtg

SEQ ID NO: 400086 - DNA, 140 bp, Artificial Sequence
  Synthetic
caccgctgtcccaaaaggtcacaggcctgatgtattacaatagaaaaattctcctctacaattaaagctatgtgttgtaatttctaggtcccctcctgaggatggttcaaattttattgtcatatcagcagccagggcct

SEQ ID NO: 400087 - DNA, 140 bp, Artificial Sequence
  Synthetic
  misc_feature (69)..(69): n is a, c, g, or t
atacgccatgctgggtctccaataagagagattaaagatgacagtgactatgaaagtaatgaagaagangaacaggaagttagagatcttgtacatagtcatgggtttgataatcccatgcgtacttgggagtcggccat

SEQ ID NO: 400088 - DNA, 140 bp, Artificial Sequence
  Synthetic
  misc_feature (72)..(72): n is a, c, g, or t
atggccgactcccaagtacgcatgggattatcaaacccatgactatgtacaagatctctaacttcctgttcntcttcttcattactttcatagtcactgtcatctttaatctctcttattggagacccagcatggcgtat

SEQ ID NO: 400089 - DNA, 140 bp, Artificial Sequence
  Synthetic
aggccctggctgctgatatgaccatcataatcccatgcagaataaagcaaattataaacatgtggcaggaggtaggacgagcaatgtatgccccccccattgcaggaaacataacatgtagaccttttgggacagcggtg

SEQ ID NO: 400090 - DNA, 140 bp, Artificial Sequence
  Synthetic
caccgctgtcccaaaaggtctacatgttatgtttcctgcaatggggggggcatacattgctcgtcctacctcctgccacatgtttataatttgctttattctgcatgggattatgatggtcatatcagcagccagggcct

SEQ ID NO: 400091 - DNA, 140 bp, Artificial Sequence
  Synthetic
aggccctggctgctgatatgcaaaattatcctatagtgcagaatgcacaagggcaaatggtacaccaggccatatcacctagaactttaaatgcatgggtaaaagtagtagaagaaaagggaccttttgggacagcggtg

SEQ ID NO: 400092 - DNA, 140 bp, Artificial Sequence
  Synthetic
caccgctgtcccaaaaggtcccttttcttctactacttttacccatgcatttaaagttctaggtgatatggcctggtgtaccatttgcccttgtgcattctgcactataggataattttgcatatcagcagccagggcct

SEQ ID NO: 400093 - DNA, 140 bp, Artificial Sequence
  Synthetic
aggccctggctgctgatatgtataaagttgaagatacacagcgggcaatacaaaaattaaaggaagtcatgagggacaggaagtctgcagaagacacaggcgtaaagcagacgggtcaaagaccttttgggacagcggtg

SEQ ID NO: 400094 - DNA, 140 bp, Artificial Sequence
  Synthetic
caccgctgtcccaaaaggtctttgacccgtctgctttacgcctgtgtcttctgcagacttcctgtccctcatgacttcctttaatttttgtattgcccgctgtgtatcttcaactttatacatatcagcagccagggcct

SEQ ID NO: 400095 - DNA, 140 bp, Artificial Sequence
  Synthetic
aggccctggctgctgatatgctgtggcaaagaaggacacatagccaaaaattgtagggcccctagaaaaaagggctgttggaaatgtgggagggaaggacatcaaatgaaagactgcactgaccttttgggacagcggtg

SEQ ID NO: 400096 - DNA, 140 bp, Artificial Sequence
  Synthetic
caccgctgtcccaaaaggtcagtgcagtctttcatttgatgtccttccctcccacatttccaacagcccttttttctaggggccctacaatttttggctatgtgtccttctttgccacagcatatcagcagccagggcct

SEQ ID NO: 400097 - DNA, 140 bp, Artificial Sequence
  Synthetic
aggccctggctgctgatatgcggaacctgtgcctcttcagctaccaccgcttgagagacttactcttgattgtagcgaggattgtggaacttctgggacgcagggggtgggaagccctcagaccttttgggacagcggtg

SEQ ID NO: 400098 - DNA, 140 bp, Artificial Sequence
  Synthetic
caccgctgtcccaaaaggtctgagggcttcccaccccctgcgtcccagaagttccacaatcctcgctacaatcaagagtaagtctctcaagcggtggtagctgaagaggcacaggttccgcatatcagcagccagggcct

SEQ ID NO: 400099 - DNA, 140 bp, Artificial Sequence
  Synthetic
aggccctggctgctgatatgtggaaaaataacatggtagaacaaatgcatacagatataatcagtttatgggatcaaagcctaaagccatgtgtgaagttaaccccactctgtgttacttgaccttttgggacagcggtg

SEQ ID NO: 400100 - DNA, 140 bp, Artificial Sequence
  Synthetic
caccgctgtcccaaaaggtcaagtaacacagagtggggttaacttcacacatggctttaggctttgatcccataaactgattatatctgtatgcatttgttctaccatgttatttttccacatatcagcagccagggcct

SEQ ID NO: 400101 - DNA, 140 bp, Artificial Sequence
  Synthetic
atacgccatgctgggtctcctaccagtgttaatgatagcctcagggaaataccgggagaaataaaaaattgctctttcaatacaaccacagaattaagagataagaaacaaagagggtatcgtacttgggagtcggccat

SEQ ID NO: 400102 - DNA, 140 bp, Artificial Sequence
  Synthetic
atggccgactcccaagtacgataccctctttgtttcttatctcttaattctgtggttgtattgaaagagcaattttttatttctcccggtatttccctgaggctatcattaacactggtaggagacccagcatggcgtat

SEQ ID NO: 400103 - DNA, 140 bp, Artificial Sequence
  Synthetic
aggccctggctgctgatatgtgtttcaattgtggaaaagaaggacatatagcaaaaaattgtcgagcacctagaaaaaagggttgctggaaatgtggacaggaaggtcaccaaatgaaaggaccttttgggacagcggtg

SEQ ID NO: 400104 - DNA, 140 bp, Artificial Sequence
  Synthetic
caccgctgtcccaaaaggtcctttcatttggtgaccttcctgtccacatttccagcaacccttttttctaggtgctcgacaattttttgctatatgtccttcttttccacaattgaaacacatatcagcagccagggcct

SEQ ID NO: 400105 - DNA, 140 bp, Artificial Sequence
  Synthetic
aggccctggctgctgatatggatatcagtacaatgtacttccacagggatggaaaggatcaccagcaatattccaatgtagcatgacaaaaatcttagagccctttagaacaaaaaatccgaccttttgggacagcggtg

SEQ ID NO: 400106 - DNA, 140 bp, Artificial Sequence
  Synthetic
caccgctgtcccaaaaggtcggattttttgttctaaagggctctaagatttttgtcatgctacattggaatattgctggtgatcctttccatccctgtggaagtacattgtactgatatccatatcagcagccagggcct

SEQ ID NO: 400107 - DNA, 140 bp, Artificial Sequence
  Synthetic
  misc_feature (24)..(24): n is a, c, g, or t
aggccctggctgctgatatgtaantcatcctcaggaggggacctagaaattacaatgcatagttttaattgtagaggagaatttttctactgcaatacatcaggactgtttaatgacacagaccttttgggacagcggtg

SEQ ID NO: 400108 - DNA, 140 bp, Artificial Sequence
  Synthetic
  misc_feature (117)..(117): n is a, c, g, or t
caccgctgtcccaaaaggtctgtgtcattaaacagtcctgatgtattgcagtagaaaaattctcctctacaattaaaactatgcattgtaatttctaggtcccctcctgaggatganttacatatcagcagccagggcct

SEQ ID NO: 400109 - DNA, 140 bp, Artificial Sequence
  Synthetic
atacgccatgctgggtctccaagaatatgacaatgtgacaatagaaatagaaggaagggaagtacaaggaacagtattggtgggacctactcctgttaatattattggaagaaatatattcgtacttgggagtcggccat

SEQ ID NO: 400110 - DNA, 140 bp, Artificial Sequence
  Synthetic
atggccgactcccaagtacgaatatatttcttccaataatattaacaggagtaggtcccaccaatactgttccttgtacttcccttccttctatttctattgtcacattgtcatattcttggagacccagcatggcgtat

SEQ ID NO: 400111 - DNA, 140 bp, Artificial Sequence
  Synthetic
atacgccatgctgggtctccacagtattggtgggacctactcctgttaatattattggaagaaatatattgacaggattaggttgtacactaaatttccctataagccccatagccacagcgtacttgggagtcggccat

SEQ ID NO: 400112 - DNA, 140 bp, Artificial Sequence
  Synthetic
atggccgactcccaagtacgctgtggctatggggcttatagggaaatttagtgtacaacctaatcctgtcaatatatttcttccaataatattaacaggagtaggtcccaccaatactgtggagacccagcatggcgtat

SEQ ID NO: 400113 - DNA, 140 bp, Artificial Sequence
  Synthetic
aggccctggctgctgatatgatgtaaactccttaggggggccaaagcactaacagacatagtaccactgactgcagaagcagaattggaattggcagagaacagggaaattctaaaagaagaccttttgggacagcggtg

SEQ ID NO: 400114 - DNA, 140 bp, Artificial Sequence
  Synthetic
caccgctgtcccaaaaggtcttcttttagaatttccctgttctctgccaattccaattctgcttctgcagtcagtggtactatgtctgttagtgctttggcccccctaaggagtttacatcatatcagcagccagggcct

SEQ ID NO: 400115 - DNA, 140 bp, Artificial Sequence
  Synthetic
atacgccatgctgggtctccctgcagaagcagaattggaattggcagagaacagggaaattctaaaagaacctgtacatggagtctattatgactcatcaaaagaactaatagcagaagtcgtacttgggagtcggccat

SEQ ID NO: 400116 - DNA, 140 bp, Artificial Sequence
  Synthetic
atggccgactcccaagtacgacttctgctattagttcttttgatgagtcataatagactccatgtacaggttcttttagaatttccctgttctctgccaattccaattctgcttctgcagggagacccagcatggcgtat

SEQ ID NO: 400117 - DNA, 140 bp, Artificial Sequence
  Synthetic
aggccctggctgctgatatgaggaagggatactcacctttgtcattacagacccatatcccaagcccgagggaacccgacaggcccgaaggaatcgaagaaggaggtggagagcaaggcagaccttttgggacagcggtg

SEQ ID NO: 400118 - DNA, 140 bp, Artificial Sequence
  Synthetic
caccgctgtcccaaaaggtctgccttgctctccacctccttcttcgattccttcgggcctgtcgggttccctcgggcttgggatatgggtctgtaatgacaaaggtgagtatcccttcctcatatcagcagccagggcct

SEQ ID NO: 400119 - DNA, 140 bp, Artificial Sequence
  Synthetic
aggccctggctgctgatatggccagtcactagagaaacttgggaagcatggtgggcggactattggcaagccacctggattccagaatgggaatttgtcagcacacccccattgatcaaagaccttttgggacagcggtg

SEQ ID NO: 400120 - DNA, 140 bp, Artificial Sequence
  Synthetic
caccgctgtcccaaaaggtctttgatcaatgggggtgtgctgacaaattcccattctggaatccaggtggcttgccaatagtccgcccaccatgcttcccaagtttctctagtgactggccatatcagcagccagggcct

SEQ ID NO: 400121 - DNA, 140 bp, Artificial Sequence
  Synthetic
aggccctggctgctgatatgacaattttaaaagaaaaggggggattggggggtacagtgcaggggaaagaataatagacataatagcaacagacttacaaactaaagaactacaaaaacagaccttttgggacagcggtg

SEQ ID NO: 400122 - DNA, 140 bp, Artificial Sequence
  Synthetic
caccgctgtcccaaaaggtctgtttttgtagttctttagtttgtaagtctgttgctattatgtctattattctttcccctgcactgtaccccccaatccccccttttcttttaaaattgtcatatcagcagccagggcct

SEQ ID NO: 400123 - DNA, 140 bp, Artificial Sequence
  Synthetic
aggccctggctgctgatatggcaaaaccagcaagaaaagaatgaacaagaattattggaattagataaatgggcaagtttgtggagttggtttgacatatcaaactggctgtggtatatagaccttttgggacagcggtg

SEQ ID NO: 400124 - DNA, 140 bp, Artificial Sequence
  Synthetic
caccgctgtcccaaaaggtctatataccacagccagtttgatatgtcaaaccaactccacaaacttgcccatttatctaattccaataattcttgttcattcttttcttgctggttttgccatatcagcagccagggcct

SEQ ID NO: 400125 - DNA, 140 bp, Artificial Sequence
  Synthetic
atacgccatgctgggtctcccccaacctacgcagagtgaatcccctatagttcagcagataatagaggaactaacaaacaaggaacaggtgtatcttacatgggttcctgctcataaaggcgtacttgggagtcggccat

SEQ ID NO: 400126 - DNA, 140 bp, Artificial Sequence
  Synthetic
atggccgactcccaagtacgcctttatgagcaggaacccatgtaagatacacctgttccttgtttgttagttcctctattatctgctgaactataggggattcactctgcgtaggttgggggagacccagcatggcgtat

SEQ ID NO: 400127 - DNA, 140 bp, Artificial Sequence
  Synthetic
aggccctggctgctgatatgggagcacttacaagcagtaacacagcccgcaataatgctgattgtgcctggctgcaagcacaagaggaagaagaagaagtaggctttccagtcagacctcgaccttttgggacagcggtg

SEQ ID NO: 400128 - DNA, 140 bp, Artificial Sequence
  Synthetic
caccgctgtcccaaaaggtcgaggtctgactggaaagcctacttcttcttcttcctcttgtgcttgcagccaggcacaatcagcattattgcgggctgtgttactgcttgtaagtgctcccatatcagcagccagggcct

SEQ ID NO: 400129 - DNA, 140 bp, Artificial Sequence
  Synthetic
aggccctggctgctgatatggtcctggctgtggaaagatacctaaaggatcaacagctcctagggatttggggttgctctggaaaactcatttgcaccactgctgtgccttggaatactagaccttttgggacagcggtg

SEQ ID NO: 400130 - DNA, 140 bp, Artificial Sequence
  Synthetic
caccgctgtcccaaaaggtctagtattccaaggcacagcagtggtgcaaatgagttttccagagcaaccccaaatccctaggagctgttgatcctttaggtatctttccacagccaggaccatatcagcagccagggcct

SEQ ID NO: 400131 - DNA, 140 bp, Artificial Sequence
  Synthetic
aggccctggctgctgatatgttacctagtgttagaaaattagcagaagatagatggaacaagccccagaagaccaggggccgcagagagagccatacaatgaatgggcgttagcaatattgaccttttgggacagcggtg

SEQ ID NO: 400132 - DNA, 140 bp, Artificial Sequence
  Synthetic
caccgctgtcccaaaaggtcaatattgctaacgcccattcattgtatggctctctctgcggcccctggtcttctggggcttgttccatctatcttctgctaattttctaacactaggtaacatatcagcagccagggcct

SEQ ID NO: 400133 - DNA, 140 bp, Artificial Sequence
  Synthetic
atacgccatgctgggtctccgtaagggaccaagcagaacacttaagaacagcagtacaaatggcagtatttgttcacaattttaaaagaaaaggggggattggggggtacactgcaggagcgtacttgggagtcggccat

SEQ ID NO: 400134 - DNA, 140 bp, Artificial Sequence
  Synthetic
atggccgactcccaagtacgctcctgcagtgtaccccccaatccccccttttcttttaaaattgtgaacaaatactgccatttgtactgctgttcttaagtgttctgcttggtcccttacggagacccagcatggcgtat

SEQ ID NO: 400135 - DNA, 140 bp, Artificial Sequence
  Synthetic
aggccctggctgctgatatgggccagataagggaacctaggggaagtgatatagctggaactactagtacccttcaggaacaaatacaatggatgacaagcaacccacctgtcccagtgggaccttttgggacagcggtg

SEQ ID NO: 400136 - DNA, 140 bp, Artificial Sequence
  Synthetic
caccgctgtcccaaaaggtcccactgggacaggtgggttgcttgtcatccattgtatttgttcctgaagggtactagtagttccagctatatcacttcccctaggttcccttatctggcccatatcagcagccagggcct

SEQ ID NO: 400137 - DNA, 140 bp, Artificial Sequence
  Synthetic
atacgccatgctgggtctccagagcagtaagtaaaattaaataattctgtaatgcaacccttacaaatagctagcatagtagcactagtagtagcatctatcatagtaatagttgtatggcgtacttgggagtcggccat

SEQ ID NO: 400138 - DNA, 140 bp, Artificial Sequence
  Synthetic
atggccgactcccaagtacgccatacaactattactatgatagatgctactactagtgctactatgctagctatttgtaagggttgcattacagaattatttaattttacttactgctctggagacccagcatggcgtat

SEQ ID NO: 400139 - DNA, 140 bp, Artificial Sequence
  Synthetic
aggccctggctgctgatatgctagcatagtagcactagtagtagcatctatcatagtaatagttgtatggactatagtaatcatagaatataaaaaactgctaaggcaaaagagaatagagaccttttgggacagcggtg

SEQ ID NO: 400140 - DNA, 140 bp, Artificial Sequence
  Synthetic
caccgctgtcccaaaaggtctctattctcttttgccttagcagttttttatattctatgattactatagtccatacaactattactatgatagatgctactactagtgctactatgctagcatatcagcagccagggcct

SEQ ID NO: 400141 - DNA, 140 bp, Artificial Sequence
  Synthetic
atacgccatgctgggtctccatttcacctgttttacaaagtcagcaatcaggagagccatcttaggggaaaaagtactgccaaagtgtgaataccctgcaggacatagccaggtagggaccgtacttgggagtcggccat

SEQ ID NO: 400142 - DNA, 140 bp, Artificial Sequence
  Synthetic
atggccgactcccaagtacggtccctacctggctatgtcctgcagggtattcacactttggcagtactttttcccctaagatggctctcctgattgctgactttgtaaaacaggtgaaatggagacccagcatggcgtat

SEQ ID NO: 400143 - DNA, 140 bp, Artificial Sequence
  Synthetic
aggccctggctgctgatatggaggaagtaggttttccagtcagacctcaggtacctttaagaccaatgacttataaagcagctgtagatcttagccactttttaaaagaaaaggggggacgaccttttgggacagcggtg

SEQ ID NO: 400144 - DNA, 140 bp, Artificial Sequence
  Synthetic
caccgctgtcccaaaaggtcgtccccccttttcttttaaaaagtggctaagatctacagctgctttataagtcattggtcttaaaggtacctgaggtctgactggaaaacctacttcctccatatcagcagccagggcct

SEQ ID NO: 400145 - DNA, 140 bp, Artificial Sequence
  Synthetic
atacgccatgctgggtctccaaagcagtaagtagtatatgtaatgctatcattaccaatagctgcaatagtaggattaatagtagcatgcatagcagccataattgtgtggaccatagtacgtacttgggagtcggccat

SEQ ID NO: 400146 - DNA, 140 bp, Artificial Sequence
  Synthetic
atggccgactcccaagtacgtactatggtccacacaattatggctgctatgcatgctactattaatcctactattgcagctattggtaatgatagcattacatatactacttactgctttggagacccagcatggcgtat

SEQ ID NO: 400147 - DNA, 140 bp, Artificial Sequence
  Synthetic
atacgccatgctgggtctcccatccggataataaagatcctgtaccagagcagtaagtaacgctaatgcagcatagggatctgataacattaataattattagtgctttgctgcttataacgtacttgggagtcggccat

SEQ ID NO: 400148 - DNA, 140 bp, Artificial Sequence
  Synthetic
atggccgactcccaagtacgttataagcagcaaagcactaataattattaatgttatcagatccctatgctgcattagcgttacttactgctctggtacaggatctttattatccggatgggagacccagcatggcgtat

SEQ ID NO: 400149 - DNA, 140 bp, Artificial Sequence
  Synthetic
atacgccatgctgggtctccttagggaccttgtacatagtcatggctttgataatcccatgtttgagccatgaccagctgtatgcaacagtctttgctggggtacctgtatgggaagatgcgtacttgggagtcggccat

SEQ ID NO: 400150 - DNA, 140 bp, Artificial Sequence
  Synthetic
atggccgactcccaagtacgcatcttcccatacaggtaccccagcaaagactgttgcatacagctggtcatggctcaaacatgggattatcaaagccatgactatgtacaaggtccctaaggagacccagcatggcgtat

SEQ ID NO: 400151 - DNA, 140 bp, Artificial Sequence
  Synthetic
aggccctggctgctgatatgtggttttgcgattctaaaatgtagggatgagaagttcaatggaacaggaccatgtaaaaatgtcagtacagtacaatgtacacatggaattaagccagtggaccttttgggacagcggtg

SEQ ID NO: 400152 - DNA, 140 bp, Artificial Sequence
  Synthetic
caccgctgtcccaaaaggtccactggcttaattccatgtgtacattgtactgtactgacatttttacatggtcctgttccattgaacttctcatccctacattttagaatcgcaaaaccacatatcagcagccagggcct

SEQ ID NO: 400153 - DNA, 140 bp, Artificial Sequence
  Synthetic
aggccctggctgctgatatgcatgtaaaaatgtcagtacagtacaatgtacacatggaattaagccagtggtatcaactcaattactgctgaatggcagtttagcagaaaaagaaataatgaccttttgggacagcggtg

SEQ ID NO: 400154 - DNA, 140 bp, Artificial Sequence
  Synthetic
caccgctgtcccaaaaggtcattatttctttttctgctaaactgccattcagcagtaattgagttgataccactggcttaattccatgtgtacattgtactgtactgacatttttacatgcatatcagcagccagggcct

SEQ ID NO: 400155 - DNA, 140 bp, Artificial Sequence
  Synthetic
aggccctggctgctgatatgagaacccccattcctttggatggggtatgaactccatcctgacaaatggacagtgcagcctatacaattgccagacaaggatagctggactgtcaatgatgaccttttgggacagcggtg

SEQ ID NO: 400156 - DNA, 140 bp, Artificial Sequence
  Synthetic
caccgctgtcccaaaaggtcatcattgacagtccagctatccttgtctggcaattgtataggctgcactgtccatttgtcaggatggagttcataccccatccaaaggaatgggggttctcatatcagcagccagggcct

SEQ ID NO: 400157 - DNA, 140 bp, Artificial Sequence
  Synthetic
aggccctggctgctgatatgacaccaaggaagctttagataagatagaggaagagcaaaacaaaagtaagaaaaaggcacagcaagcagcagctgacacaggaaacagcagccaggtcaggaccttttgggacagcggtg

SEQ ID NO: 400158 - DNA, 140 bp, Artificial Sequence
  Synthetic
caccgctgtcccaaaaggtcctgacctggctgctgtttcctgtgtcagctgctgcttgctgtgcctttttcttacttttgttttgctcttcctctatcttatctaaagcttccttggtgtcatatcagcagccagggcct

SEQ ID NO: 400159 - DNA, 140 bp, Artificial Sequence
  Synthetic
  misc_feature (65)..(65): n is a, c, g, or t
atacgccatgctgggtctccaatatcaccatcacactcccatgtaaaataaaacagattgtgagnatgtggcagagagtaggacaagcaatgtatgcccctcccatcgacggaaacattacgtacttgggagtcggccat

SEQ ID NO: 400160 - DNA, 140 bp, Artificial Sequence
  Synthetic
  misc_feature (76)..(76): n is a, c, g, or t
atggccgactcccaagtacgtaatgtttccgtcgatgggaggggcatacattgcttgtcctactctctgccacatnctcacaatctgttttattttacatgggagtgtgatggtgatattggagacccagcatggcgtat

SEQ ID NO: 400161 - DNA, 140 bp, Artificial Sequence
  Synthetic
aggccctggctgctgatatgatttcctatggcaggaagaagcggagacagcgacgaagcactcctccaagcagtgaggatcatcaaaatcttatatcaaagcagtaagtatatgtaatgtgaccttttgggacagcggtg

SEQ ID NO: 400162 - DNA, 140 bp, Artificial Sequence
  Synthetic
caccgctgtcccaaaaggtcacattacatatacttactgctttgatataagattttgatgatcctcactgcttggaggagtgcttcgtcgctgtctccgcttcttcctgccataggaaatcatatcagcagccagggcct

SEQ ID NO: 400163 - DNA, 140 bp, Artificial Sequence
  Synthetic
aggccctggctgctgatatgctggaaaactcatctgcaccactaatgtgccctggaacactagttggagtaataaatcttatgatgaaatttgggacaacatgacctggatacaatgggagaccttttgggacagcggtg

SEQ ID NO: 400164 - DNA, 140 bp, Artificial Sequence
  Synthetic
caccgctgtcccaaaaggtctcccattgtatccaggtcatgttgtcccaaatttcatcataagatttattactccaactagtgttccagggcacattagtggtgcagatgagttttccagcatatcagcagccagggcct

SEQ ID NO: 400165 - DNA, 140 bp, Artificial Sequence
  Synthetic
atacgccatgctgggtctccagaaaaatactgtttttagatgggatagataaagcacaggaggaacatgaaaaatatcacaacaattggagagcaatggctagtgattttaatctgccaccgtacttgggagtcggccat

SEQ ID NO: 400166 - DNA, 140 bp, Artificial Sequence
  Synthetic
atggccgactcccaagtacggtggcagattaaaatcactagccattgctctccaattgttgtgatatttttcatgttcctcctgtgctttatctatcccatctaaaaacagtatttttctggagacccagcatggcgtat

SEQ ID NO: 400167 - DNA, 140 bp, Artificial Sequence
  Synthetic
  misc_feature (50)..(50): n is a, c, g, or t
  misc_feature (71)..(71): n is a, c, g, or t
  misc_feature (101)..(101): n is a, c, g, or t
  misc_feature (113)..(113): n is a, c, g, or t
aggccctggctgctgatatgagcccagaagtaatacccatgttttcagcnttatcagaaggagccaccccncaagatttaaataccatgctaaatacagtngggggacaccangcagctagaccttttgggacagcggtg

SEQ ID NO: 400168 - DNA, 140 bp, Artificial Sequence
  Synthetic
  misc_feature (28)..(28): n is a, c, g, or t
  misc_feature (40)..(40): n is a, c, g, or t
  misc_feature (70)..(70): n is a, c, g, or t
  misc_feature (91)..(91): n is a, c, g, or t
caccgctgtcccaaaaggtctagctgcntggtgtcccccnactgtatttagcatggtatttaaatcttgnggggtggctccttctgataangctgaaaacatgggtattacttctgggctcatatcagcagccagggcct

SEQ ID NO: 400169 - DNA, 140 bp, Artificial Sequence
  Synthetic
aggccctggctgctgatatgtcactttaaactgcacagataccaagaatggtaccactcatgataataaaaccataggtgcagaaatgaaaaattgctctttcaatgtaaccacagagttgaccttttgggacagcggtg

SEQ ID NO: 400170 - DNA, 140 bp, Artificial Sequence
  Synthetic
caccgctgtcccaaaaggtcaactctgtggttacattgaaagagcaatttttcatttctgcacctatggttttattatcatgagtggtaccattcttggtatctgtgcagtttaaagtgacatatcagcagccagggcct

SEQ ID NO: 400171 - DNA, 140 bp, Artificial Sequence
  Synthetic
  misc_feature (120)..(120): n is a, c, g, or t
atacgccatgctgggtctccgaggggaagtgatatagcaggaactactagtaccctccaggaacaaatagcatggatgacaggcaacccacctatcccagtaggggaaatttataaaagncgtacttgggagtcggccat

SEQ ID NO: 400172 - DNA, 140 bp, Artificial Sequence
  Synthetic
  misc_feature (21)..(21): n is a, c, g, or t
atggccgactcccaagtacgncttttataaatttcccctactgggataggtgggttgcctgtcatccatgctatttgttcctggagggtactagtagttcctgctatatcacttcccctcggagacccagcatggcgtat

SEQ ID NO: 400173 - DNA, 140 bp, Artificial Sequence
  Synthetic
  misc_feature (28)..(28): n is a, c, g, or t
  misc_feature (70)..(70): n is a, c, g, or t
  misc_feature (117)..(117): n is a, c, g, or t
atacgccatgctgggtctcccagcatgncagggagtgggaggacctggtcataaagcaagagttttggcngaagcaatgagccaaatgaccaatacagcaaacataatgatgcaaangggcgtacttgggagtcggccat

SEQ ID NO: 400174 - DNA, 140 bp, Artificial Sequence
  Synthetic
  misc_feature (24)..(24): n is a, c, g, or t
  misc_feature (71)..(71): n is a, c, g, or t
  misc_feature (113)..(113): n is a, c, g, or t
atggccgactcccaagtacgcccntttgcatcattatgtttgctgtattggtcatttggctcattgcttcngccaaaactcttgctttatgaccaggtcctcccactccctgncatgctgggagacccagcatggcgtat

SEQ ID NO: 400175 - DNA, 140 bp, Artificial Sequence
  Synthetic
  misc_feature (67)..(67): n is a, c, g, or t
  misc_feature (74)..(74): n is a, c, g, or t
  misc_feature (86)..(86): n is a, c, g, or t
  misc_feature (116)..(116): n is a, c, g, or t
aggccctggctgctgatatggaagcaatgagccaaatgaccaatacagcaaacataatgatgcaaangggtaantttaagggccanaaaagaatgattaagtgtttcaattgtggnaaacgaccttttgggacagcggtg

SEQ ID NO: 400176 - DNA, 140 bp, Artificial Sequence
  Synthetic
  misc_feature (25)..(25): n is a, c, g, or t
  misc_feature (55)..(55): n is a, c, g, or t
  misc_feature (67)..(67): n is a, c, g, or t
  misc_feature (74)..(74): n is a, c, g, or t
caccgctgtcccaaaaggtcgtttnccacaattgaaacacttaatcattcttttntggcccttaaanttacccntttgcatcattatgtttgctgtattggtcatttggctcattgcttccatatcagcagccagggcct

SEQ ID NO: 400177 - DNA, 140 bp, Artificial Sequence
  Synthetic
atacgccatgctgggtctccgtaggatacttccccggtaaaacaatagaatttgcaccaccttcaggaggggacctagaaattatgacacatagctttaattgtgggggagaatttttctcgtacttgggagtcggccat

SEQ ID NO: 400178 - DNA, 140 bp, Artificial Sequence
  Synthetic
atggccgactcccaagtacgagaaaaattctcccccacaattaaagctatgtgtcataatttctaggtcccctcctgaaggtggtgcaaattctattgttttaccggggaagtatcctacggagacccagcatggcgtat

SEQ ID NO: 400179 - DNA, 140 bp, Artificial Sequence
  Synthetic
aggccctggctgctgatatgagcagctagaggagggataccaagttcccatactcctcaaaacaatgcagcccttgcattcctagaaagccaccaaaatgaagaagtaggtttcccagtagaccttttgggacagcggtg

SEQ ID NO: 400180 - DNA, 140 bp, Artificial Sequence
  Synthetic
caccgctgtcccaaaaggtctactgggaaacctacttcttcattttggtggctttctaggaatgcaagggctgcattgttttgaggagtatgggaacttggtatccctcctctagctgctcatatcagcagccagggcct

SEQ ID NO: 400181 - DNA, 140 bp, Artificial Sequence
  Synthetic
atacgccatgctgggtctcctctctcgacagggtcgaaaggcctgatatcactctggaacacagtagcagtgctctggtgtgttcacaaaggatataaagttagagatacacagcaggcacgtacttgggagtcggccat

SEQ ID NO: 400182 - DNA, 140 bp, Artificial Sequence
  Synthetic
atggccgactcccaagtacgtgcctgctgtgtatctctaactttatatcctttgtgaacacaccagagcactgctactgtgttccagagtgatatcaggcctttcgaccctgtcgagagaggagacccagcatggcgtat

SEQ ID NO: 400183 - DNA, 140 bp, Artificial Sequence
  Synthetic
  misc_feature (22)..(22): n is a, c, g, or t
  misc_feature (37)..(37): n is a, c, g, or t
  misc_feature (43)..(43): n is a, c, g, or t
  misc_feature (88)..(88): n is a, c, g, or t
  misc_feature (115)..(115): n is a, c, g, or t
aggccctggctgctgatatganagaactcaagacttntgggangtgcagttaggaataccacatccagcagggttaaagaagaaaaantcagtcacagtactggatgtgggggangcctagaccttttgggacagcggtg

SEQ ID NO: 400184 - DNA, 140 bp, Artificial Sequence
  Synthetic
  misc_feature (26)..(26): n is a, c, g, or t
  misc_feature (53)..(53): n is a, c, g, or t
  misc_feature (98)..(98): n is a, c, g, or t
  misc_feature (104)..(104): n is a, c, g, or t
  misc_feature (119)..(119): n is a, c, g, or t
caccgctgtcccaaaaggtctaggcntcccccacatccagtactgtgactgantttttcttctttaaccctgctggatgtggtattcctaactgcacntcccanaagtcttgagttctntcatatcagcagccagggcct

SEQ ID NO: 400185 - DNA, 140 bp, Artificial Sequence
  Synthetic
  misc_feature (57)..(57): n is a, c, g, or t
aggccctggctgctgatatgaaaaatattagaacctttcagaacaaaaaacccaganctagtcatctatcagtacatggatgacttgtatgtgggatctgatttagaaatagaacagcacgaccttttgggacagcggtg

SEQ ID NO: 400186 - DNA, 140 bp, Artificial Sequence
  Synthetic
  misc_feature (84)..(84): n is a, c, g, or t
caccgctgtcccaaaaggtcgtgctgttctatttctaaatcagatcccacatacaagtcatccatgtactgatagatgactagntctgggttttttgttctgaaaggttctaatatttttcatatcagcagccagggcct

SEQ ID NO: 400187 - DNA, 140 bp, Artificial Sequence
  Synthetic
aggccctggctgctgatatgtgtgcctcttcagctaccaccgattgagagacttactcttgattgtagcgaggattgtggaacttctgggacgcagggggtgggaagccctcaaatattggaccttttgggacagcggtg

SEQ ID NO: 400188 - DNA, 140 bp, Artificial Sequence
  Synthetic
caccgctgtcccaaaaggtccaatatttgagggcttcccaccccctgcgtcccagaagttccacaatcctcgctacaatcaagagtaagtctctcaatcggtggtagctgaagaggcacacatatcagcagccagggcct

SEQ ID NO: 400189 - DNA, 140 bp, Artificial Sequence
  Synthetic
  misc_feature (67)..(67): n is a, c, g, or t
  misc_feature (108)..(108): n is a, c, g, or t
atacgccatgctgggtctcctccttaggggagctaagtcactaacagacatagtaccattgactaangaagcagaattggaactggcagagaacaaagagattctaanagaaccagtacacgtacttgggagtcggccat

SEQ ID NO: 400190 - DNA, 140 bp, Artificial Sequence
  Synthetic
  misc_feature (33)..(33): n is a, c, g, or t
  misc_feature (74)..(74): n is a, c, g, or t
atggccgactcccaagtacgtgtactggttctnttagaatctctttgttctctgccagttccaattctgcttcnttagtcaatggtactatgtctgttagtgacttagctcccctaaggaggagacccagcatggcgtat

SEQ ID NO: 400191 - DNA, 140 bp, Artificial Sequence
  Synthetic
aggccctggctgctgatatgtagaacaaatgcatacagatataatcagtttatgggatcaaagcctaaagccatgtgtgaagttaaccccactctgtgttactttaaattgtactaatgcgaccttttgggacagcggtg

SEQ ID NO: 400192 - DNA, 140 bp, Artificial Sequence
  Synthetic
caccgctgtcccaaaaggtcgcattagtacaatttaaagtaacacagagtggggttaacttcacacatggctttaggctttgatcccataaactgattatatctgtatgcatttgttctacatatcagcagccagggcct

SEQ ID NO: 400193 - DNA, 140 bp, Artificial Sequence
  Synthetic
  misc_feature (94)..(94): n is a, c, g, or t
atacgccatgctgggtctcccattaatgccactgccattcaagacggggacctgaaggaagaaccaggggcaatacaaaactgttctttcaatntgaccatggaagtaagagataagcagcgtacttgggagtcggccat

SEQ ID NO: 400194 - DNA, 140 bp, Artificial Sequence
  Synthetic
  misc_feature (47)..(47): n is a, c, g, or t
atggccgactcccaagtacgctgcttatctcttacttccatggtcanattgaaagaacagttttgtattgcccctggttcttccttcaggtccccgtcttgaatggcagtggcattaatgggagacccagcatggcgtat

SEQ ID NO: 400195 - DNA, 140 bp, Artificial Sequence
  Synthetic
aggccctggctgctgatatgctggaaatgtggacaggaaggtcaccaaatgaaagattgcagaaatggaaagcaggcgaattttttagggaagtactggcctcctgggggcacgaggccagaccttttgggacagcggtg

SEQ ID NO: 400196 - DNA, 140 bp, Artificial Sequence
  Synthetic
caccgctgtcccaaaaggtctggcctcgtgcccccaggaggccagtacttccctaaaaaattcgcctgctttccatttctgcaatctttcatttggtgaccttcctgtccacatttccagcatatcagcagccagggcct

SEQ ID NO: 400197 - DNA, 140 bp, Artificial Sequence
  Synthetic
  misc_feature (30)..(30): n is a, c, g, or t
  misc_feature (54)..(54): n is a, c, g, or t
  misc_feature (60)..(60): n is a, c, g, or t
  misc_feature (85)..(85): n is a, c, g, or t
  misc_feature (97)..(97): n is a, c, g, or t
  misc_feature (114)..(114): n is a, c, g, or t
atacgccatgctgggtctccagtggttacnttaactgacacaacaaatcagcanactganctgcaagccattttattagctttanaggattcagggntagaagcaaacatagtnacagatcgtacttgggagtcggccat

SEQ ID NO: 400198 - DNA, 140 bp, Artificial Sequence
  Synthetic
  misc_feature (27)..(27): n is a, c, g, or t
  misc_feature (44)..(44): n is a, c, g, or t
  misc_feature (56)..(56): n is a, c, g, or t
  misc_feature (81)..(81): n is a, c, g, or t
  misc_feature (87)..(87): n is a, c, g, or t
  misc_feature (111)..(111): n is a, c, g, or t
atggccgactcccaagtacgatctgtnactatgtttgcttctanccctgaatcctntaaagctaataaaatggcttgcagntcagtntgctgatttgttgtgtcagttaangtaaccactggagacccagcatggcgtat

SEQ ID NO: 400199 - DNA, 140 bp, Artificial Sequence
  Synthetic
aggccctggctgctgatatgatggaattaaaccagtggtatcaactcaattgttgttaaatggcagcctagcagaagaagatataataatcagatctcaaaatatctcagataatgcaaagaccttttgggacagcggtg

SEQ ID NO: 400200 - DNA, 140 bp, Artificial Sequence
  Synthetic
caccgctgtcccaaaaggtctttgcattatctgagatattttgagatctgattattatatcttcttctgctaggctgccatttaacaacaattgagttgataccactggtttaattccatcatatcagcagccagggcct

SEQ ID NO: 400201 - DNA, 140 bp, Artificial Sequence
  Synthetic
atacgccatgctgggtctcctgaaaatctgacaagcaataccaaaacaataatagtacaccttaataagtctctatcaatcgtgtgtacaagacctagcaataatacactaaagagtatacgtacttgggagtcggccat

SEQ ID NO: 400202 - DNA, 140 bp, Artificial Sequence
  Synthetic
atggccgactcccaagtacgtatactctttagtgtattattgctaggtcttgtacacacgattgatagagacttattaaggtgtactattattgttttggtattgcttgtcagattttcaggagacccagcatggcgtat

SEQ ID NO: 400203 - DNA, 140 bp, Artificial Sequence
  Synthetic
atacgccatgctgggtctcccataagagaagcacactgtaacattagtgaaaaagaatggaacacaactttggaaatggtaaagaagaaattaggagaacacttccctaataaaacaatacgtacttgggagtcggccat

SEQ ID NO: 400204 - DNA, 140 bp, Artificial Sequence
  Synthetic
atggccgactcccaagtacgtattgttttattagggaagtgttctcctaatttcttctttaccatttccaaagttgtgttccattctttttcactaatgttacagtgtgcttctcttatgggagacccagcatggcgtat

SEQ ID NO: 400205 - DNA, 140 bp, Artificial Sequence
  Synthetic
atacgccatgctgggtctccagtctcattttcctaatgcaacaataaaatttaattcatcctcaggaggggacctagaaattacaatgcatagttttaattgtagaggagaatttttctacgtacttgggagtcggccat

SEQ ID NO: 400206 - DNA, 140 bp, Artificial Sequence
  Synthetic
atggccgactcccaagtacgtagaaaaattctcctctacaattaaaactatgcattgtaatttctaggtcccctcctgaggatgaattaaattttattgttgcattaggaaaatgagactggagacccagcatggcgtat

SEQ ID NO: 400207 - DNA, 140 bp, Artificial Sequence
  Synthetic
aggccctggctgctgatatgctctggaaaactcatctgcaccactaatgtgccctggaactctagttggagtaataaatctcaggaggagatttgggagaacatgacctggatggaatgggaccttttgggacagcggtg

SEQ ID NO: 400208 - DNA, 140 bp, Artificial Sequence
  Synthetic
caccgctgtcccaaaaggtcccattccatccaggtcatgttctcccaaatctcctcctgagatttattactccaactagagttccagggcacattagtggtgcagatgagttttccagagcatatcagcagccagggcct

SEQ ID NO: 400209 - DNA, 140 bp, Artificial Sequence
  Synthetic
  misc_feature (34)..(34): n is a, c, g, or t
  misc_feature (40)..(40): n is a, c, g, or t
  misc_feature (43)..(43): n is a, c, g, or t
  misc_feature (82)..(82): n is a, c, g, or t
  misc_feature (88)..(88): n is a, c, g, or t
  misc_feature (92)..(92): n is a, c, g, or t
  misc_feature (100)..(100): n is a, c, g, or t
  misc_feature (110)..(110): n is a, c, g, or t
atacgccatgctgggtctccctagaagatggctntatagncancactatgacagcaatcatccaaaaataagctcagtagtntacatnccantaggagangctgaattantaataacaaccgtacttgggagtcggccat

SEQ ID NO: 400210 - DNA, 140 bp, Artificial Sequence
  Synthetic
  misc_feature (31)..(31): n is a, c, g, or t
  misc_feature (41)..(41): n is a, c, g, or t
  misc_feature (49)..(49): n is a, c, g, or t
  misc_feature (53)..(53): n is a, c, g, or t
  misc_feature (59)..(59): n is a, c, g, or t
  misc_feature (98)..(98): n is a, c, g, or t
  misc_feature (101)..(101): n is a, c, g, or t
  misc_feature (107)..(107): n is a, c, g, or t
atggccgactcccaagtacggttgttattantaattcagcntctcctantggnatgtanactactgagcttatttttggatgattgctgtcatagtgntgnctatanagccatcttctagggagacccagcatggcgtat

SEQ ID NO: 400211 - DNA, 140 bp, Artificial Sequence
  Synthetic
aggccctggctgctgatatggaagaagcggagacagcgacgaagagcttctcaaaacagtccagatcatcaagtttctctatcaaagcagtaagtagtgcatggaatgaattctttatacgaccttttgggacagcggtg

SEQ ID NO: 400212 - DNA, 140 bp, Artificial Sequence
  Synthetic
caccgctgtcccaaaaggtcgtataaagaattcattccatgcactacttactgctttgatagagaaacttgatgatctggactgttttgagaagctcttcgtcgctgtctccgcttcttccatatcagcagccagggcct

SEQ ID NO: 400213 - DNA, 140 bp, Artificial Sequence
  Synthetic
aggccctggctgctgatatgaggagcaaaatgaaaaagatttattagcattggacagttggaaaaatctgtggaattggtttgacataacaaattggctgtggtatataaaaatattcatgaccttttgggacagcggtg

SEQ ID NO: 400214 - DNA, 140 bp, Artificial Sequence
  Synthetic
caccgctgtcccaaaaggtcatgaatatttttatataccacagccaatttgttatgtcaaaccaattccacagatttttccaactgtccaatgctaataaatctttttcattttgctcctcatatcagcagccagggcct

SEQ ID NO: 400215 - DNA, 140 bp, Artificial Sequence
  Synthetic
atacgccatgctgggtctccattatctggggaaaattgcctaaatttaagctaccagtcacaagagaaacttgggaagcatggtgggcagactattggcaagccacctggattccagaatcgtacttgggagtcggccat

SEQ ID NO: 400216 - DNA, 140 bp, Artificial Sequence
  Synthetic
atggccgactcccaagtacgattctggaatccaggtggcttgccaatagtctgcccaccatgcttcccaagtttctcttgtgactggtagcttaaatttaggcaattttccccagataatggagacccagcatggcgtat

SEQ ID NO: 400217 - DNA, 140 bp, Artificial Sequence
  Synthetic
  misc_feature (28)..(28): n is a, c, g, or t
  misc_feature (60)..(60): n is a, c, g, or t
  misc_feature (87)..(87): n is a, c, g, or t
  misc_feature (90)..(90): n is a, c, g, or t
  misc_feature (94)..(94): n is a, c, g, or t
  misc_feature (117)..(117): n is a, c, g, or t
aggccctggctgctgatatgggagccanacaatgaatggacactagagcttttggaggancttaaaaatgaagctgtcagacatttnccnaggncatggcttcatggtttaggacancatgaccttttgggacagcggtg

SEQ ID NO: 400218 - DNA, 140 bp, Artificial Sequence
  Synthetic
  misc_feature (24)..(24): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (81)..(81): n is a, c, g, or t
  misc_feature (113)..(113): n is a, c, g, or t
caccgctgtcccaaaaggtcatgntgtcctaaaccatgaagccatgncctnggnaaatgtctgacagcttcatttttaagntcctccaaaagctctagtgtccattcattgtntggctcccatatcagcagccagggcct

SEQ ID NO: 400219 - DNA, 140 bp, Artificial Sequence
  Synthetic
atacgccatgctgggtctccaatactgcaacaactattgtttattcatttcagaatcgggtgccaacatagcagaataggcattatgccacagagaagagggaggaatggagccagtagacgtacttgggagtcggccat

SEQ ID NO: 400220 - DNA, 140 bp, Artificial Sequence
  Synthetic
atggccgactcccaagtacgtctactggctccattcctccctcttctctgtggcataatgcctattctgctatgttggcacccgattctgaaatgaataaacaatagttgttgcagtattggagacccagcatggcgtat

SEQ ID NO: 400221 - DNA, 140 bp, Artificial Sequence
  Synthetic
atacgccatgctgggtctccgttactaataccaagacaaaggatactaataccaatattagtagttgggaagacatgaaaaactgctctttcaatgtcacctcaaacataagagataaagcgtacttgggagtcggccat

SEQ ID NO: 400222 - DNA, 140 bp, Artificial Sequence
  Synthetic
atggccgactcccaagtacgctttatctcttatgtttgaggtgacattgaaagagcagtttttcatgtcttcccaactactaatattggtattagtatcctttgtcttggtattagtaacggagacccagcatggcgtat

SEQ ID NO: 400223 - DNA, 140 bp, Artificial Sequence
  Synthetic
atacgccatgctgggtctccgtactcaatgttattgtaaaaagtgttgctttcattgccaagtgtgctttttgaagaagggcttaggcatttccaatggcaggaagaagcggagacagcgcgtacttgggagtcggccat

SEQ ID NO: 400224 - DNA, 140 bp, Artificial Sequence
  Synthetic
atggccgactcccaagtacgcgctgtctccgcttcttcctgccattggaaatgcctaagcccttcttcaaaaagcacacttggcaatgaaagcaacactttttacaataacattgagtacggagacccagcatggcgtat

SEQ ID NO: 400225 - DNA, 140 bp, Artificial Sequence
  Synthetic
  misc_feature (45)..(45): n is a, c, g, or t
  misc_feature (47)..(47): n is a, c, g, or t
  misc_feature (59)..(59): n is a, c, g, or t
  misc_feature (64)..(64): n is a, c, g, or t
atacgccatgctgggtctccacgagcagctcctcctggcagtaanantcatcaagatcntgtancggagcagtaagtaaatcaattagtctctgtaatgaactctttacaaatagcatcacgtacttgggagtcggccat

SEQ ID NO: 400226 - DNA, 140 bp, Artificial Sequence
  Synthetic
  misc_feature (77)..(77): n is a, c, g, or t
  misc_feature (82)..(82): n is a, c, g, or t
  misc_feature (94)..(94): n is a, c, g, or t
  misc_feature (96)..(96): n is a, c, g, or t
atggccgactcccaagtacgtgatgctatttgtaaagagttcattacagagactaattgatttacttactgctccgntacangatcttgatgantnttactgccaggaggagctgctcgtggagacccagcatggcgtat

SEQ ID NO: 400227 - DNA, 140 bp, Artificial Sequence
  Synthetic
  misc_feature (39)..(39): n is a, c, g, or t
  misc_feature (73)..(73): n is a, c, g, or t
  misc_feature (90)..(90): n is a, c, g, or t
atacgccatgctgggtctccagcatatatagaatatagnaaactggtaaggcaaaggagaatagataagttanttgatagaataagaganagagaagaggacagtggaaatgacagtgatcgtacttgggagtcggccat

SEQ ID NO: 400228 - DNA, 140 bp, Artificial Sequence
  Synthetic
  misc_feature (51)..(51): n is a, c, g, or t
  misc_feature (68)..(68): n is a, c, g, or t
  misc_feature (102)..(102): n is a, c, g, or t
atggccgactcccaagtacgatcactgtcatttccactgtcctcttctctntctcttattctatcaantaacttatctattctcctttgccttaccagtttnctatattctatatatgctggagacccagcatggcgtat

SEQ ID NO: 400229 - DNA, 140 bp, Artificial Sequence
  Synthetic
  misc_feature (23)..(23): n is a, c, g, or t
  misc_feature (40)..(40): n is a, c, g, or t
aggccctggctgctgatatgtanttgatagaataagaganagagaagaggacagtggaaatgacagtgatggagacacagaggagttggcaaaacttgtggaaatggggcctcatgatctgaccttttgggacagcggtg

SEQ ID NO: 400230 - DNA, 140 bp, Artificial Sequence
  Synthetic
  misc_feature (101)..(101): n is a, c, g, or t
  misc_feature (118)..(118): n is a, c, g, or t
caccgctgtcccaaaaggtcagatcatgaggccccatttccacaagttttgccaactcctctgtgtctccatcactgtcatttccactgtcctcttctctntctcttattctatcaantacatatcagcagccagggcct

SEQ ID NO: 400231 - DNA, 140 bp, Artificial Sequence
  Synthetic
aggccctggctgctgatatgtacagtgtacacatgggattaagccagtagtgtcaactcaactgttgttgaatggcagtctagcaaaagaagaaataatattggatcttgaaaatctcacgaccttttgggacagcggtg

SEQ ID NO: 400232 - DNA, 140 bp, Artificial Sequence
  Synthetic
caccgctgtcccaaaaggtcgtgagattttcaagatccaatattatttcttcttttgctagactgccattcaacaacagttgagttgacactactggcttaatcccatgtgtacactgtacatatcagcagccagggcct

SEQ ID NO: 400233 - DNA, 140 bp, Artificial Sequence
  Synthetic
atacgccatgctgggtctcctactatggggtacctgtgtggaaagaggcaaagaccactttattttgtgcatctgatgctaaatcatatagtactgaaagtcataatgtctgggctacaccgtacttgggagtcggccat

SEQ ID NO: 400234 - DNA, 140 bp, Artificial Sequence
  Synthetic
atggccgactcccaagtacggtgtagcccagacattatgactttcagtactatatgatttagcatcagatgcacaaaataaagtggtctttgcctctttccacacaggtaccccatagtaggagacccagcatggcgtat

SEQ ID NO: 400235 - DNA, 140 bp, Artificial Sequence
  Synthetic
aggccctggctgctgatatgtacagtaagaggtatacatataggaccagggagagcattttatgcaacaggatcagtaataggagatataagacaggcacattgtaacattagtgcagcagaccttttgggacagcggtg

SEQ ID NO: 400236 - DNA, 140 bp, Artificial Sequence
  Synthetic
caccgctgtcccaaaaggtctgctgcactaatgttacaatgtgcctgtcttatatctcctattactgatcctgttgcataaaatgctctccctggtcctatatgtatacctcttactgtacatatcagcagccagggcct

SEQ ID NO: 400237 - DNA, 140 bp, Artificial Sequence
  Synthetic
aggccctggctgctgatatgtaagagaacatctattaaaatggggatttaccacaccagacaaaaaacatcagaaagaacccccatttctttggatggggtatgaactccatcctgacaagaccttttgggacagcggtg

SEQ ID NO: 400238 - DNA, 140 bp, Artificial Sequence
  Synthetic
caccgctgtcccaaaaggtcttgtcaggatggagttcataccccatccaaagaaatgggggttctttctgatgttttttgtctggtgtggtaaatccccattttaatagatgttctcttacatatcagcagccagggcct

SEQ ID NO: 400239 - DNA, 140 bp, Artificial Sequence
  Synthetic
atacgccatgctgggtctccggtaaacatcagtgaaattatgaaaaactgttcttttaagatgaccacggaaataagagataaaacaaggagagaatatgcacttttctatagacaagatcgtacttgggagtcggccat

SEQ ID NO: 400240 - DNA, 140 bp, Artificial Sequence
  Synthetic
atggccgactcccaagtacgatcttgtctatagaaaagtgcatattctctccttgttttatctcttatttccgtggtcatcttaaaagaacagtttttcataatttcactgatgtttaccggagacccagcatggcgtat

SEQ ID NO: 400241 - DNA, 140 bp, Artificial Sequence
  Synthetic
aggccctggctgctgatatgtatggaaaacagatggcaggtactgatagtatggcaagtggacagacagaaagtgaaagcatggaacagcctagtgaaataccataagtacaggtctagagaccttttgggacagcggtg

SEQ ID NO: 400242 - DNA, 140 bp, Artificial Sequence
  Synthetic
caccgctgtcccaaaaggtctctagacctgtacttatggtatttcactaggctgttccatgctttcactttctgtctgtccacttgccatactatcagtacctgccatctgttttccatacatatcagcagccagggcct

SEQ ID NO: 400243 - DNA, 140 bp, Artificial Sequence
  Synthetic
aggccctggctgctgatatgaagtgaaagcatggaacagcctagtgaaataccataagtacaggtctagaaagaccaaggactggcattacagacatcattatgaatccagaaatccaaggaccttttgggacagcggtg

SEQ ID NO: 400244 - DNA, 140 bp, Artificial Sequence
  Synthetic
caccgctgtcccaaaaggtccttggatttctggattcataatgatgtctgtaatgccagtccttggtctttctagacctgtacttatggtatttcactaggctgttccatgctttcacttcatatcagcagccagggcct

SEQ ID NO: 400245 - DNA, 140 bp, Artificial Sequence
  Synthetic
atacgccatgctgggtctcctttcagacctaacaacaatacaagaaagggtatacacatgggtccaggacaagtgctctttgcaacagagagagtagtaggggatataagaagagcataccgtacttgggagtcggccat

SEQ ID NO: 400246 - DNA, 140 bp, Artificial Sequence
  Synthetic
atggccgactcccaagtacggtatgctcttcttatatcccctactactctctctgttgcaaagagcacttgtcctggacccatgtgtataccctttcttgtattgttgttaggtctgaaaggagacccagcatggcgtat

SEQ ID NO: 400247 - DNA, 140 bp, Artificial Sequence
  Synthetic
aggccctggctgctgatatgcatggagtcagtatagaatggcaatataagaagtataaaacacagattgaccctgaaacagcagacaggataatacatctgcattatttcaactgttttagaccttttgggacagcggtg

SEQ ID NO: 400248 - DNA, 140 bp, Artificial Sequence
  Synthetic
caccgctgtcccaaaaggtctaaaacagttgaaataatgcagatgtattatcctgtctgctgtttcagggtcaatctgtgttttatacttcttatattgccattctatactgactccatgcatatcagcagccagggcct

SEQ ID NO: 400249 - DNA, 140 bp, Artificial Sequence
  Synthetic
atacgccatgctgggtctcccagactcagcaatcaggaaagccatcttagggcagagaatactgaccaagtgtgaataccctgcaggacatagtcaggtagggacactgcaactactagccgtacttgggagtcggccat

SEQ ID NO: 400250 - DNA, 140 bp, Artificial Sequence
  Synthetic
atggccgactcccaagtacggctagtagttgcagtgtccctacctgactatgtcctgcagggtattcacacttggtcagtattctctgccctaagatggctttcctgattgctgagtctgggagacccagcatggcgtat

SEQ ID NO: 400251 - DNA, 140 bp, Artificial Sequence
  Synthetic
atacgccatgctgggtctcccaggaggggacttagaaattatgacacatacttttaattgtggaggagaatttttctattgtaatacatcaagcctgttcaatagtagctggagtagtaacgtacttgggagtcggccat

SEQ ID NO: 400252 - DNA, 140 bp, Artificial Sequence
  Synthetic
atggccgactcccaagtacgttactactccagctactattgaacaggcttgatgtattacaatagaaaaattctcctccacaattaaaagtatgtgtcataatttctaagtcccctcctgggagacccagcatggcgtat

SEQ ID NO: 400253 - DNA, 140 bp, Artificial Sequence
  Synthetic
atacgccatgctgggtctccgacaaatagtgagaatgtggcagaaagtaggacaagcaatatatgcccctcccattgaaggaaacattacatgctcatcaaatattacaggattaatattcgtacttgggagtcggccat

SEQ ID NO: 400254 - DNA, 140 bp, Artificial Sequence
  Synthetic
atggccgactcccaagtacgaatattaatcctgtaatatttgatgagcatgtaatgtttccttcaatgggaggggcatatattgcttgtcctactttctgccacattctcactatttgtcggagacccagcatggcgtat

SEQ ID NO: 400255 - DNA, 140 bp, Artificial Sequence
  Synthetic
atacgccatgctgggtctccgaatcaggaaagtgctgtttctagatggaatagataaggctcaagaagagcatgaaaagtatcacaacaattggagagcaatggctagtgagtttaatctcgtacttgggagtcggccat

SEQ ID NO: 400256 - DNA, 140 bp, Artificial Sequence
  Synthetic
atggccgactcccaagtacgagattaaactcactagccattgctctccaattgttgtgatacttttcatgctcttcttgagccttatctattccatctagaaacagcactttcctgattcggagacccagcatggcgtat

SEQ ID NO: 400257 - DNA, 140 bp, Artificial Sequence
  Synthetic
aggccctggctgctgatatgggaagaagcggaagcaccgacgaggaactcctcacaacagtaaggatcatcaaaatcctgtaccaaagcagtaagtagtaataattagtatatgtaatgcgaccttttgggacagcggtg

SEQ ID NO: 400258 - DNA, 140 bp, Artificial Sequence
  Synthetic
caccgctgtcccaaaaggtcgcattacatatactaattattactacttactgctttggtacaggattttgatgatccttactgttgtgaggagttcctcgtcggtgcttccgcttcttcccatatcagcagccagggcct

SEQ ID NO: 400259 - DNA, 140 bp, Artificial Sequence
  Synthetic
aggccctggctgctgatatgagatccctttagaacaaaaaatccagacttagttatctaccaatacatggatgatttgtatgtaggatctgacttagaaatagggcagcatagaacaaaagaccttttgggacagcggtg

SEQ ID NO: 400260 - DNA, 140 bp, Artificial Sequence
  Synthetic
caccgctgtcccaaaaggtcttttgttctatgctgccctatttctaagtcagatcctacatacaaatcatccatgtattggtagataactaagtctggattttttgttctaaagggatctcatatcagcagccagggcct

SEQ ID NO: 400261 - DNA, 140 bp, Artificial Sequence
  Synthetic
aggccctggctgctgatatgaaatcattagggattatggaaaacagatggcaggtgatgattgtgtggcaagtagacaggatgaggattaacacatggaaaagtttagtaaaataccatagaccttttgggacagcggtg

SEQ ID NO: 400262 - DNA, 140 bp, Artificial Sequence
  Synthetic
caccgctgtcccaaaaggtctatggtattttactaaacttttccatgtgttaatcctcatcctgtctacttgccacacaatcatcacctgccatctgttttccataatccctaatgatttcatatcagcagccagggcct

SEQ ID NO: 400263 - DNA, 140 bp, Artificial Sequence
  Synthetic
atacgccatgctgggtctccgaacaagagaaaagagaaagagaaatacttgaaaggttaagaagaataagagaaataagggatgatagtgactatgaaagtaatggagaagaagaacaagcgtacttgggagtcggccat

SEQ ID NO: 400264 - DNA, 140 bp, Artificial Sequence
  Synthetic
atggccgactcccaagtacgcttgttcttcttctccattactttcatagtcactatcatcccttatttctcttattcttcttaacctttcaagtatttctctttctcttttctcttgttcggagacccagcatggcgtat

SEQ ID NO: 400265 - DNA, 140 bp, Artificial Sequence
  Synthetic
atacgccatgctgggtctccctgtaaaaagtcatatgcaacagtctatgctggggtgcctgtatgggaagatgcaaaggcaatattattttgtgcttcagatgttaacctaacaagtactcgtacttgggagtcggccat

SEQ ID NO: 400266 - DNA, 140 bp, Artificial Sequence
  Synthetic
atggccgactcccaagtacgagtacttgttaggttaacatctgaagcacaaaataatattgcctttgcatcttcccatacaggcaccccagcatagactgttgcatatgactttttacagggagacccagcatggcgtat

SEQ ID NO: 400267 - DNA, 140 bp, Artificial Sequence
  Synthetic
aggccctggctgctgatatgatgcaaaggcaatattattttgtgcttcagatgttaacctaacaagtactgagaagcataatatttgggcatcacaagcctgtgttcctacagaccccaggaccttttgggacagcggtg

SEQ ID NO: 400268 - DNA, 140 bp, Artificial Sequence
  Synthetic
caccgctgtcccaaaaggtcctggggtctgtaggaacacaggcttgtgatgcccaaatattatgcttctcagtacttgttaggttaacatctgaagcacaaaataatattgcctttgcatcatatcagcagccagggcct

SEQ ID NO: 400269 - DNA, 140 bp, Artificial Sequence
  Synthetic
atacgccatgctgggtctccactgtgagccctgtggttggcaataaagaactaaaaaactgctctttcaatataaccacagaattgagagataagcagaagcaagaatacgcgcttttctcgtacttgggagtcggccat

SEQ ID NO: 400270 - DNA, 140 bp, Artificial Sequence
  Synthetic
atggccgactcccaagtacgagaaaagcgcgtattcttgcttctgcttatctctcaattctgtggttatattgaaagagcagttttttagttctttattgccaaccacagggctcacagtggagacccagcatggcgtat

SEQ ID NO: 400271 - DNA, 140 bp, Artificial Sequence
  Synthetic
atacgccatgctgggtctccttgtacaaacctaaatgaaacatcaaagggaaacagcagctcagaaaatgaaacccctgtaaaaaagtgtgagtttaacgcaaccactgttgttaaggaccgtacttgggagtcggccat

SEQ ID NO: 400272 - DNA, 140 bp, Artificial Sequence
  Synthetic
atggccgactcccaagtacggtccttaacaacagtggttgcgttaaactcacacttttttacaggggtttcattttctgagctgctgtttccctttgatgtttcatttaggtttgtacaaggagacccagcatggcgtat

SEQ ID NO: 400273 - DNA, 140 bp, Artificial Sequence
  Synthetic
  misc_feature (36)..(36): n is a, c, g, or t
  misc_feature (68)..(68): n is a, c, g, or t
atacgccatgctgggtctccccacagcaatagtagnagctgaaggaacagataggatcatagaaatantaagaagagcttttagagctgtacttcatatacctagaagaataagacagggcgtacttgggagtcggccat

SEQ ID NO: 400274 - DNA, 140 bp, Artificial Sequence
  Synthetic
  misc_feature (73)..(73): n is a, c, g, or t
  misc_feature (105)..(105): n is a, c, g, or t
atggccgactcccaagtacgccctgtcttattcttctaggtatatgaagtacagctctaaaagctcttcttantatttctatgatcctatctgttccttcagctnctactattgctgtggggagacccagcatggcgtat

SEQ ID NO: 400275 - DNA, 140 bp, Artificial Sequence
  Synthetic
aggccctggctgctgatatggctgctaaatggcagtttagcagaaggagaaataatggttagatctgaaaacttctcaaacaatgccaaaaccataatagtgcagcttaataggactaatgaccttttgggacagcggtg

SEQ ID NO: 400276 - DNA, 140 bp, Artificial Sequence
  Synthetic
caccgctgtcccaaaaggtcattagtcctattaagctgcactattatggttttggcattgtttgagaagttttcagatctaaccattatttctccttctgctaaactgccatttagcagccatatcagcagccagggcct

SEQ ID NO: 400277 - DNA, 140 bp, Artificial Sequence
  Synthetic
atacgccatgctgggtctccatagttggatggcctcaggtaagggagagaatgaggcgagcagctgctcctgttccagcagcagatggagtaggagcagtgtctcaagatttagctacgccgtacttgggagtcggccat

SEQ ID NO: 400278 - DNA, 140 bp, Artificial Sequence
  Synthetic
atggccgactcccaagtacggcgtagctaaatcttgagacactgctcctactccatctgctgctggaacaggagcagctgctcgcctcattctctcccttacctgaggccatccaactatggagacccagcatggcgtat

SEQ ID NO: 400279 - DNA, 140 bp, Artificial Sequence
  Synthetic
atacgccatgctgggtctccaagcttcgcaccaggacaagcgatctatgcaacaggtgatataataggagatataagacaagcacattgtaatgttagtaaacaaagctggtattatgtgcgtacttgggagtcggccat

SEQ ID NO: 400280 - DNA, 140 bp, Artificial Sequence
  Synthetic
atggccgactcccaagtacgcacataataccagctttgtttactaacattacaatgtgcttgtcttatatctcctattatatcacctgttgcatagatcgcttgtcctggtgcgaagcttggagacccagcatggcgtat

SEQ ID NO: 400281 - DNA, 140 bp, Artificial Sequence
  Synthetic
aggccctggctgctgatatgaactatcatagtgaccctaaattcttccataagcatgacctgtaaaagaccaatggacatagacgtacaagagataaacacaggtccattggcctggtacgaccttttgggacagcggtg

SEQ ID NO: 400282 - DNA, 140 bp, Artificial Sequence
  Synthetic
caccgctgtcccaaaaggtcgtaccaggccaatggacctgtgtttatctcttgtacgtctatgtccattggtcttttacaggtcatgcttatggaagaatttagggtcactatgatagttcatatcagcagccagggcct

SEQ ID NO: 400283 - DNA, 140 bp, Artificial Sequence
  Synthetic
atacgccatgctgggtctcccaacaaatattagtacagctccaaccatcttatcaaacagggacagaagaaattaagtcattatataacacagtagcaaccctctattgcgtacatgaggcgtacttgggagtcggccat

SEQ ID NO: 400284 - DNA, 140 bp, Artificial Sequence
  Synthetic
atggccgactcccaagtacgcctcatgtacgcaatagagggttgctactgtgttatataatgacttaatttcttctgtccctgtttgataagatggttggagctgtactaatatttgttgggagacccagcatggcgtat

SEQ ID NO: 400285 - DNA, 140 bp, Artificial Sequence
  Synthetic
atacgccatgctgggtctccgtataatgcctctgattgggaaacagcattaaaacaaacagctgaaaggtatttacaacttgtaaacaatacaaatacaaatgtgacaataatgtttaagcgtacttgggagtcggccat

SEQ ID NO: 400286 - DNA, 140 bp, Artificial Sequence
  Synthetic
atggccgactcccaagtacgcttaaacattattgtcacatttgtatttgtattgtttacaagttgtaaatacctttcagctgtttgttttaatgctgtttcccaatcagaggcattatacggagacccagcatggcgtat

SEQ ID NO: 400287 - DNA, 140 bp, Artificial Sequence
  Synthetic
aggccctggctgctgatatgatttacaacttgtaaacaatacaaatacaaatgtgacaataatgtttaagcgcagcagctccggtggagatgtagagacaacccatttacattttaactggaccttttgggacagcggtg

SEQ ID NO: 400288 - DNA, 140 bp, Artificial Sequence
  Synthetic
caccgctgtcccaaaaggtccagttaaaatgtaaatgggttgtctctacatctccaccggagctgctgcgcttaaacattattgtcacatttgtatttgtattgtttacaagttgtaaatcatatcagcagccagggcct

SEQ ID NO: 400289 - DNA, 140 bp, Artificial Sequence
  Synthetic
atacgccatgctgggtctcctgatactatcacacttccatgtaggataaaacaaattgtgagaatgtggcagagagtgggacaagcaatgtatgcccctcccatagcaggaaacattacacgtacttgggagtcggccat

SEQ ID NO: 400290 - DNA, 140 bp, Artificial Sequence
  Synthetic
atggccgactcccaagtacgtgtaatgtttcctgctatgggaggggcatacattgcttgtcccactctctgccacattctcacaatttgttttatcctacatggaagtgtgatagtatcaggagacccagcatggcgtat

SEQ ID NO: 400291 - DNA, 140 bp, Artificial Sequence
  Synthetic
aggccctggctgctgatatgagagagtgggacaagcaatgtatgcccctcccatagcaggaaacattacatgtgtgtcaaacattacaggattactattagaaagagatggtgggaatctgaccttttgggacagcggtg

SEQ ID NO: 400292 - DNA, 140 bp, Artificial Sequence
  Synthetic
caccgctgtcccaaaaggtcagattcccaccatctctttctaatagtaatcctgtaatgtttgacacacatgtaatgtttcctgctatgggaggggcatacattgcttgtcccactctctcatatcagcagccagggcct

SEQ ID NO: 400293 - DNA, 140 bp, Artificial Sequence
  Synthetic
atacgccatgctgggtctccttacatgtaatggagccacctgtaatgaaaccatccataaccaaagttaccatagctataagaatcaaagtataataccttgcaaattgaagcaggtggtcgtacttgggagtcggccat

SEQ ID NO: 400294 - DNA, 140 bp, Artificial Sequence
  Synthetic
atggccgactcccaagtacgaccacctgcttcaatttgcaaggtattatactttgattcttatagctatggtaactttggttatggatggtttcattacaggtggctccattacatgtaaggagacccagcatggcgtat

SEQ ID NO: 400295 - DNA, 140 bp, Artificial Sequence
  Synthetic
aggccctggctgctgatatgatacaagaaaaagtatacatatacatagaggaccagggagagcattctatgcgtcaggaggcataataggagatataagacaagcacatagtaacattaggaccttttgggacagcggtg

SEQ ID NO: 400296 - DNA, 140 bp, Artificial Sequence
  Synthetic
caccgctgtcccaaaaggtcctaatgttactatgtgcttgtcttatatctcctattatgcctcctgacgcatagaatgctctccctggtcctctatgtatatgtatactttttcttgtatcatatcagcagccagggcct

SEQ ID NO: 400297 - DNA, 140 bp, Artificial Sequence
  Synthetic
  misc_feature (49)..(49): n is a, c, g, or t
atacgccatgctgggtctcctagggatacaaagaataggaagaggaatntataacatcccaagaagaattagacagggcttagaaaggagtttattgtaacatgggaaacgcattgaggacgtacttgggagtcggccat

SEQ ID NO: 400298 - DNA, 140 bp, Artificial Sequence
  Synthetic
  misc_feature (92)..(92): n is a, c, g, or t
atggccgactcccaagtacgtcctcaatgcgtttcccatgttacaataaactcctttctaagccctgtctaattcttcttgggatgttatanattcctcttcctattctttgtatccctaggagacccagcatggcgtat

SEQ ID NO: 400299 - DNA, 140 bp, Artificial Sequence
  Synthetic
atacgccatgctgggtctccgacataacaaggtaggatctctacaatatttggcactaacagcattaatagctccaaagaagacaaagccgcctttgcctagtgtcaagaaactagtagacgtacttgggagtcggccat

SEQ ID NO: 400300 - DNA, 140 bp, Artificial Sequence
  Synthetic
atggccgactcccaagtacgtctactagtttcttgacactaggcaaaggcggctttgtcttctttggagctattaatgctgttagtgccaaatattgtagagatcctaccttgttatgtcggagacccagcatggcgtat

SEQ ID NO: 400301 - DNA, 140 bp, Artificial Sequence
  Synthetic
aggccctggctgctgatatgggaaagagcagaagacagtggcaatgagagtgagggggatactgaggaattgtcaacaatggtggatatggggcagcttaggcttttggatgttaatgatgaccttttgggacagcggtg

SEQ ID NO: 400302 - DNA, 140 bp, Artificial Sequence
  Synthetic
caccgctgtcccaaaaggtcatcattaacatccaaaagcctaagctgccccatatccaccattgttgacaattcctcagtatccccctcactctcattgccactgtcttctgctctttcccatatcagcagccagggcct

SEQ ID NO: 400303 - DNA, 140 bp, Artificial Sequence
  Synthetic
atacgccatgctgggtctcctttggaagaacctaacctgggtacaatgggaaagggaaattagcaattatacacaagaaatatacaacctacttgaagtagcgcaaacccagcaggaacacgtacttgggagtcggccat

SEQ ID NO: 400304 - DNA, 140 bp, Artificial Sequence
  Synthetic
atggccgactcccaagtacgtgttcctgctgggtttgcgctacttcaagtaggttgtatatttcttgtgtataattgctaatttccctttcccattgtacccaggttaggttcttccaaaggagacccagcatggcgtat

SEQ ID NO: 400305 - DNA, 140 bp, Artificial Sequence
  Synthetic
atacgccatgctgggtctccccagctcttcagacaggatcagaggaacttaaatcaatatataatcttgtagcaaccctctattgcgtacatcaaaggatagaggtaaaagacaccaaagcgtacttgggagtcggccat

SEQ ID NO: 400306 - DNA, 140 bp, Artificial Sequence
  Synthetic
atggccgactcccaagtacgctttggtgtcttttacctctatcctttgatgtacgcaatagagggttgctacaagattatatattgatttaagttcctctgatcctgtctgaagagctggggagacccagcatggcgtat

SEQ ID NO: 400307 - DNA, 140 bp, Artificial Sequence
  Synthetic
atacgccatgctgggtctccataatgataccatgaagggagaaatacaaaattgctctttcaatacaaccacagaaataagagataagatacaaaaggtgtatgcacttttttatagacccgtacttgggagtcggccat

SEQ ID NO: 400308 - DNA, 140 bp, Artificial Sequence
  Synthetic
atggccgactcccaagtacgggtctataaaaaagtgcatacaccttttgtatcttatctcttatttctgtggttgtattgaaagagcaattttgtatttctcccttcatggtatcattatggagacccagcatggcgtat

SEQ ID NO: 400309 - DNA, 140 bp, Artificial Sequence
  Synthetic
aggccctggctgctgatatggcactaataatagcaatagttgtgtggactatagtatatatagaatataggaaactgttaaggcaaagaaaaataaataggttatatgaaagaataagaggaccttttgggacagcggtg

SEQ ID NO: 400310 - DNA, 140 bp, Artificial Sequence
  Synthetic
caccgctgtcccaaaaggtcctcttattctttcatataacctatttatttttctttgccttaacagtttcctatattctatatatactatagtccacacaactattgctattattagtgccatatcagcagccagggcct

SEQ ID NO: 400311 - DNA, 140 bp, Artificial Sequence
  Synthetic
aggccctggctgctgatatgttgtacacggacctcagaacaataatattgtggatttaccacctcttgagcaacttagcatcagggatccagagggtgatcaactatctgggacttggacgaccttttgggacagcggtg

SEQ ID NO: 400312 - DNA, 140 bp, Artificial Sequence
  Synthetic
caccgctgtcccaaaaggtcgtccaagtcccagatagttgatcaccctctggatccctgatgctaagttgctcaagaggtggtaaatccacaatattattgttctgaggtccgtgtacaacatatcagcagccagggcct

SEQ ID NO: 400313 - DNA, 140 bp, Artificial Sequence
  Synthetic
aggccctggctgctgatatgcaacttagcatcagggatccagagggtgatcaactatctgggacttggactgtggatcctgggacagaagataactgatgcttgcagagtttgtgcagctgaccttttgggacagcggtg

SEQ ID NO: 400314 - DNA, 140 bp, Artificial Sequence
  Synthetic
caccgctgtcccaaaaggtcagctgcacaaactctgcaagcatcagttatcttctgtcccaggatccacagtccaagtcccagatagttgatcaccctctggatccctgatgctaagttgcatatcagcagccagggcct

SEQ ID NO: 400315 - DNA, 140 bp, Artificial Sequence
  Synthetic
atacgccatgctgggtctccgtaggacaaagagtaggtagagcttttcttaacatacctgtaagaataagacaaggcttagaaagagctttgctataaaatgggggccaagtggtcaaaacgtacttgggagtcggccat

SEQ ID NO: 400316 - DNA, 140 bp, Artificial Sequence
  Synthetic
atggccgactcccaagtacgttttgaccacttggcccccattttatagcaaagctctttctaagccttgtcttattcttacaggtatgttaagaaaagctctacctactctttgtcctacggagacccagcatggcgtat

SEQ ID NO: 400317 - DNA, 140 bp, Artificial Sequence
  Synthetic
atacgccatgctgggtctccagatacagttgcagtggcagtaggcgattggactgacggcataatctcagggatacaaagaataggaagaggaattaggaacatcccaaatttgcaggatcgtacttgggagtcggccat

SEQ ID NO: 400318 - DNA, 140 bp, Artificial Sequence
  Synthetic
atggccgactcccaagtacgatcctgcaaatttgggatgttcctaattcctcttcctattctttgtatccctgagattatgccgtcagtccaatcgcctactgccactgcaactgtatctggagacccagcatggcgtat

SEQ ID NO: 400319 - DNA, 140 bp, Artificial Sequence
  Synthetic
atacgccatgctgggtctcctcaggcggggacctagaaattacaacacatagttttaattgtagaggggaatttttctattgtaatacatcaaaactgtttaatagtacatacaatcctacgtacttgggagtcggccat

SEQ ID NO: 400320 - DNA, 140 bp, Artificial Sequence
  Synthetic
atggccgactcccaagtacgtaggattgtatgtactattaaacagttttgatgtattacaatagaaaaattcccctctacaattaaaactatgtgttgtaatttctaggtccccgcctgaggagacccagcatggcgtat

SEQ ID NO: 400321 - DNA, 140 bp, Artificial Sequence
  Synthetic
atacgccatgctgggtctccggggaacagtaagagaaagaatgaggaaaaatttccccccgaacctgacccatgtgcacctggagtaggagcagtctccagagaattagcagctagaggacgtacttgggagtcggccat

SEQ ID NO: 400322 - DNA, 140 bp, Artificial Sequence
  Synthetic
atggccgactcccaagtacgtcctctagctgctaattctctggagactgctcctactccaggtgcacatgggtcaggttcggggggaaatttttcctcattctttctcttactgttccccggagacccagcatggcgtat

SEQ ID NO: 400323 - DNA, 140 bp, Artificial Sequence
  Synthetic
atacgccatgctgggtctccatgagcccctcccacaaatacaagaggagggtacacatataggaccagggcgagcactctttacaacagatataataggagatataagccaagcacactgcgtacttgggagtcggccat

SEQ ID NO: 400324 - DNA, 140 bp, Artificial Sequence
  Synthetic
atggccgactcccaagtacgcagtgtgcttggcttatatctcctattatatctgttgtaaagagtgctcgccctggtcctatatgtgtaccctcctcttgtatttgtgggaggggctcatggagacccagcatggcgtat

SEQ ID NO: 400325 - DNA, 140 bp, Artificial Sequence
  Synthetic
aggccctggctgctgatatggggcccaagaagaattgttaaatgtttcaactgtggcaaagaagggcatatagccaaaaattgcagggcccctaggaaaaagggctgttggaaatgtggagaccttttgggacagcggtg

SEQ ID NO: 400326 - DNA, 140 bp, Artificial Sequence
  Synthetic
caccgctgtcccaaaaggtctccacatttccaacagccctttttcctaggggccctgcaatttttggctatatgcccttctttgccacagttgaaacatttaacaattcttcttgggccccatatcagcagccagggcct

SEQ ID NO: 400327 - DNA, 140 bp, Artificial Sequence
  Synthetic
aggccctggctgctgatatgtagcggaggctagaaggagagagatgggtgcgagagcgtcagtattaagcgggggaaaattagatgcatgggaaaaaattcggttgaggccagggggaaagaccttttgggacagcggtg

SEQ ID NO: 400328 - DNA, 140 bp, Artificial Sequence
  Synthetic
caccgctgtcccaaaaggtctttccccctggcctcaaccgaattttttcccatgcatctaattttcccccgcttaatactgacgctctcgcacccatctctctccttctagcctccgctacatatcagcagccagggcct

SEQ ID NO: 400329 - DNA, 140 bp, Artificial Sequence
  Synthetic
aggccctggctgctgatatgattaattgtacaagacccaacaacaatacaagaaaaagtatacatttaggaccaggacgagcattttatgcaacaggagacataataggagacatcagaagaccttttgggacagcggtg

SEQ ID NO: 400330 - DNA, 140 bp, Artificial Sequence
  Synthetic
caccgctgtcccaaaaggtcttctgatgtctcctattatgtctcctgttgcataaaatgctcgtcctggtcctaaatgtatactttttcttgtattgttgttgggtcttgtacaattaatcatatcagcagccagggcct

SEQ ID NO: 400331 - DNA, 140 bp, Artificial Sequence
  Synthetic
aggccctggctgctgatatggtacaaatgcttctgttaatgttagcatgaatggagaaataaaaaattgctctttcaacacaaccacagaattgagagataagataaagaaagagtatgcgaccttttgggacagcggtg

SEQ ID NO: 400332 - DNA, 140 bp, Artificial Sequence
  Synthetic
caccgctgtcccaaaaggtcgcatactctttctttatcttatctctcaattctgtggttgtgttgaaagagcaattttttatttctccattcatgctaacattaacagaagcatttgtaccatatcagcagccagggcct

SEQ ID NO: 400333 - DNA, 140 bp, Artificial Sequence
  Synthetic
aggccctggctgctgatatgagctgttacagcagttagagccagctctcaaaacagggtcagaaagcctgcagtcactctggaacacaatagcagtgctctggtgtgttcacaacagatagaccttttgggacagcggtg

SEQ ID NO: 400334 - DNA, 140 bp, Artificial Sequence
  Synthetic
caccgctgtcccaaaaggtctatctgttgtgaacacaccagagcactgctattgtgttccagagtgactgcaggctttctgaccctgttttgagagctggctctaactgctgtaacagctcatatcagcagccagggcct

SEQ ID NO: 400335 - DNA, 140 bp, Artificial Sequence
  Synthetic
atacgccatgctgggtctcctaaaattggagacacgcagcaggcaatacaaaaactaaaggaagtgatggggagcaggaaacctgccggtgccgctaaggaagacgcaagcgccaggcagcgtacttgggagtcggccat

SEQ ID NO: 400336 - DNA, 140 bp, Artificial Sequence
  Synthetic
atggccgactcccaagtacgctgcctggcgcttgcgtcttccttagcggcaccggcaggtttcctgctccccatcacttcctttagtttttgtattgcctgctgcgtgtctccaattttaggagacccagcatggcgtat

SEQ ID NO: 400337 - DNA, 140 bp, Artificial Sequence
  Synthetic
aggccctggctgctgatatgaaaaaagaaggacagtactaagtggagaaaattagtagatttcagagaactcaataaaaggactcaagatttctgggaagttcaattaggaataccacacgaccttttgggacagcggtg

SEQ ID NO: 400338 - DNA, 140 bp, Artificial Sequence
  Synthetic
caccgctgtcccaaaaggtcgtgtggtattcctaattgaacttcccagaaatcttgagtccttttattgagttctctgaaatctactaattttctccacttagtactgtccttcttttttcatatcagcagccagggcct

SEQ ID NO: 400339 - DNA, 140 bp, Artificial Sequence
  Synthetic
aggccctggctgctgatatggagacaggctaattttttagggaaaatttggccttccaacaaggggaggccagggaattttctccagaacaggccagagccaacagccccacccgcagaggaccttttgggacagcggtg

SEQ ID NO: 400340 - DNA, 140 bp, Artificial Sequence
  Synthetic
caccgctgtcccaaaaggtcctctgcgggtggggctgttggctctggcctgttctggagaaaattccctggcctccccttgttggaaggccaaattttccctaaaaaattagcctgtctccatatcagcagccagggcct

SEQ ID NO: 400341 - DNA, 140 bp, Artificial Sequence
  Synthetic
aggccctggctgctgatatgtacctacaagaataagacagggcttcgaaagggctttgctataaaatgggtggcaaatggtcaaaaagtagtatagttggatggcctgctataagggaaagaccttttgggacagcggtg

SEQ ID NO: 400342 - DNA, 140 bp, Artificial Sequence
  Synthetic
caccgctgtcccaaaaggtctttcccttatagcaggccatccaactatactactttttgaccatttgccacccattttatagcaaagccctttcgaagccctgtcttattcttgtaggtacatatcagcagccagggcct

SEQ ID NO: 400343 - DNA, 140 bp, Artificial Sequence
  Synthetic
atacgccatgctgggtctccaaaaagaccccataatgggagcagagactttctatgtagatggggcagctaacagggagacaaaaaagggaaaagcaggatatgttactgacagaggaagcgtacttgggagtcggccat

SEQ ID NO: 400344 - DNA, 140 bp, Artificial Sequence
  Synthetic
atggccgactcccaagtacgcttcctctgtcagtaacatatcctgcttttcccttttttgtctccctgttagctgccccatctacatagaaagtctctgctcccattatggggtctttttggagacccagcatggcgtat

SEQ ID NO: 400345 - DNA, 140 bp, Artificial Sequence
  Synthetic
aggccctggctgctgatatgtctgttacagtcttagatgtaggagatgcttatttctcatgtcctttagacccagattttagaaaatatactgctttcactattcctagtgtgaacaatggaccttttgggacagcggtg

SEQ ID NO: 400346 - DNA, 140 bp, Artificial Sequence
  Synthetic
caccgctgtcccaaaaggtccattgttcacactaggaatagtgaaagcagtatattttctaaaatctgggtctaaaggacatgagaaataagcatctcctacatctaagactgtaacagacatatcagcagccagggcct

SEQ ID NO: 400347 - DNA, 140 bp, Artificial Sequence
  Synthetic
aggccctggctgctgatatgctaacagaagaagcagagctagaactggcagaaaacagggagattctaaaagaaccagtacatggagtgtattatgacccatcaaaagacttaatagcaggaccttttgggacagcggtg

SEQ ID NO: 400348 - DNA, 140 bp, Artificial Sequence
  Synthetic
caccgctgtcccaaaaggtcctgctattaagtcttttgatgggtcataatacactccatgtactggttcttttagaatctccctgttttctgccagttctagctctgcttcttctgttagcatatcagcagccagggcct

SEQ ID NO: 400349 - DNA, 140 bp, Artificial Sequence
  Synthetic
aggccctggctgctgatatgtaggaaagacaacccagaattagaaatttgtcagtacatggatgacctatatgtaggatcagatttgcccctgacagaacatagaaaaagggttgaatcagaccttttgggacagcggtg

SEQ ID NO: 400350 - DNA, 140 bp, Artificial Sequence
  Synthetic
caccgctgtcccaaaaggtctgattcaaccctttttctatgttctgtcaggggcaaatctgatcctacatataggtcatccatgtactgacaaatttctaattctgggttgtctttcctacatatcagcagccagggcct

SEQ ID NO: 400351 - DNA, 140 bp, Artificial Sequence
  Synthetic
aggccctggctgctgatatggcagcagagggagtaggagcagcatctcaagacttagataaatatggagcacttacaagcagcaacacagctcacaataatgctgattgtgcctggctgcgaccttttgggacagcggtg

SEQ ID NO: 400352 - DNA, 140 bp, Artificial Sequence
  Synthetic
caccgctgtcccaaaaggtcgcagccaggcacaatcagcattattgtgagctgtgttgctgcttgtaagtgctccatatttatctaagtcttgagatgctgctcctactccctctgctgccatatcagcagccagggcct

SEQ ID NO: 400353 - DNA, 140 bp, Artificial Sequence
  Synthetic
aggccctggctgctgatatgagtgtcaactcaactgttattgaatggcagtctagcagaaaaagaaataatgattaggtctgaaaatatcacaaataatgctaaaactataatagtacaagaccttttgggacagcggtg

SEQ ID NO: 400354 - DNA, 140 bp, Artificial Sequence
  Synthetic
caccgctgtcccaaaaggtcttgtactattatagttttagcattatttgtgatattttcagacctaatcattatttctttttctgctagactgccattcaataacagttgagttgacactcatatcagcagccagggcct

SEQ ID NO: 400355 - DNA, 140 bp, Artificial Sequence
  Synthetic
aggccctggctgctgatatgacatgtggaaaaataacatggtagaacagatgcatgaggatataatcagtttatgggatcaaagcctaaagccatgtgtaaaattaaccccactctgtgtgaccttttgggacagcggtg

SEQ ID NO: 400356 - DNA, 140 bp, Artificial Sequence
  Synthetic
caccgctgtcccaaaaggtcacacagagtggggttaattttacacatggctttaggctttgatcccataaactgattatatcctcatgcatctgttctaccatgttatttttccacatgtcatatcagcagccagggcct

SEQ ID NO: 400357 - DNA, 140 bp, Artificial Sequence
  Synthetic
atacgccatgctgggtctccggaaggctaataccactattgatgatatagaaatgaaaaattgctctttcaatattaccacaggcataagagataaggtgaagagagaatatgcactgttcgtacttgggagtcggccat

SEQ ID NO: 400358 - DNA, 140 bp, Artificial Sequence
  Synthetic
atggccgactcccaagtacgaacagtgcatattctctcttcaccttatctcttatgcctgtggtaatattgaaagagcaatttttcatttctatatcatcaatagtggtattagccttccggagacccagcatggcgtat

SEQ ID NO: 400359 - DNA, 140 bp, Artificial Sequence
  Synthetic
aggccctggctgctgatatgaataagaagtctgcaacaactactgtttatccatttcagaattgggtgccaacatagcaggataggcattactcggcagagaagagcaaggcatggacccgaccttttgggacagcggtg

SEQ ID NO: 400360 - DNA, 140 bp, Artificial Sequence
  Synthetic
caccgctgtcccaaaaggtcgggtccatgccttgctcttctctgccgagtaatgcctatcctgctatgttggcacccaattctgaaatggataaacagtagttgttgcagacttcttattcatatcagcagccagggcct

SEQ ID NO: 400361 - DNA, 140 bp, Artificial Sequence
  Synthetic
atacgccatgctgggtctccctgcttgcaacagttgctattgtaaaaggtgttgcttacattgtcaagtttgctttatgacaaaaggcttaggaatttcctatggcaggaagaagcggggcgtacttgggagtcggccat

SEQ ID NO: 400362 - DNA, 140 bp, Artificial Sequence
  Synthetic
atggccgactcccaagtacgccccgcttcttcctgccataggaaattcctaagccttttgtcataaagcaaacttgacaatgtaagcaacaccttttacaatagcaactgttgcaagcagggagacccagcatggcgtat

SEQ ID NO: 400363 - DNA, 140 bp, Artificial Sequence
  Synthetic
aggccctggctgctgatatgtgctttatgacaaaaggcttaggaatttcctatggcaggaagaagcggggaaagcgacgaagaactcctcagagcggtccgaatcatcaaaatattgtatgaccttttgggacagcggtg

SEQ ID NO: 400364 - DNA, 140 bp, Artificial Sequence
  Synthetic
caccgctgtcccaaaaggtcatacaatattttgatgattcggaccgctctgaggagttcttcgtcgctttccccgcttcttcctgccataggaaattcctaagccttttgtcataaagcacatatcagcagccagggcct

SEQ ID NO: 400365 - DNA, 140 bp, Artificial Sequence
  Synthetic
atacgccatgctgggtctccgcaataatagtagcattaatcttagcaatagttgtgtggaccatagtatacatagaatataagagactgttaagacaaagaaaaatagattggttaattgcgtacttgggagtcggccat

SEQ ID NO: 400366 - DNA, 140 bp, Artificial Sequence
  Synthetic
atggccgactcccaagtacgcaattaaccaatctatttttctttgtcttaacagtctcttatattctatgtatactatggtccacacaactattgctaagattaatgctactattattgcggagacccagcatggcgtat

SEQ ID NO: 400367 - DNA, 140 bp, Artificial Sequence
  Synthetic
atacgccatgctgggtctccacagaggaattatcaacacttgtggaaatggagcctgataattttaggaatgataatgatatgtaaagctatagaaaaatcgtgggtcacagtctattatcgtacttgggagtcggccat

SEQ ID NO: 400368 - DNA, 140 bp, Artificial Sequence
  Synthetic
atggccgactcccaagtacgataatagactgtgacccacgatttttctatagctttacatatcattatcattcctaaaattatcaggctccatttccacaagtgttgataattcctctgtggagacccagcatggcgtat

SEQ ID NO: 400369 - DNA, 140 bp, Artificial Sequence
  Synthetic
atacgccatgctgggtctccagaattacaaaaacaaattttaaaaattcaaaattttcgggtctattacagagacagcagagaccctatttggaaaggaccggcacagctcctgtggaaacgtacttgggagtcggccat

SEQ ID NO: 400370 - DNA, 140 bp, Artificial Sequence
  Synthetic
atggccgactcccaagtacgtttccacaggagctgtgccggtcctttccaaatagggtctctgctgtctctgtaatagacccgaaaattttgaatttttaaaatttgtttttgtaattctggagacccagcatggcgtat

SEQ ID NO: 400371 - DNA, 140 bp, Artificial Sequence
  Synthetic
aggccctggctgctgatatgaagaaggaaggcaaaaataatcagagattatggaaaacagatggcaggtactgatagtatggcaagtggacagacagaaagtgaaagcgtggaacagcctgaccttttgggacagcggtg

SEQ ID NO: 400372 - DNA, 140 bp, Artificial Sequence
  Synthetic
caccgctgtcccaaaaggtcaggctgttccacgctttcactttctgtctgtccacttgccatactatcagtacctgccatctgttttccataatctctgattatttttgccttccttcttcatatcagcagccagggcct

SEQ ID NO: 400373 - DNA, 140 bp, Artificial Sequence
  Synthetic
aggccctggctgctgatatgcaggaatggatggcccaaaggttaaacaatggccattgacagaagaaaaaataaaagcattaacagaaatttgtaaagaaatggagaaggaaggaaaaatgaccttttgggacagcggtg

SEQ ID NO: 400374 - DNA, 140 bp, Artificial Sequence
  Synthetic
caccgctgtcccaaaaggtcatttttccttccttctccatttctttacaaatttctgttaatgcttttattttttcttctgtcaatggccattgtttaacctttgggccatccattcctgcatatcagcagccagggcct

SEQ ID NO: 400375 - DNA, 140 bp, Artificial Sequence
  Synthetic
atacgccatgctgggtctccaacactgaagaagctaccatcacaaattgctccttcaaggtacccacagaactgaaagataagacggagacagtacatacacttttttataaactggatgcgtacttgggagtcggccat

SEQ ID NO: 400376 - DNA, 140 bp, Artificial Sequence
  Synthetic
atggccgactcccaagtacgcatccagtttataaaaaagtgtatgtactgtctccgtcttatctttcagttctgtgggtaccttgaaggagcaatttgtgatggtagcttcttcagtgttggagacccagcatggcgtat

SEQ ID NO: 400377 - DNA, 140 bp, Artificial Sequence
  Synthetic
aggccctggctgctgatatgagaagtaaacctcccctacccagtgtccagaaattaacagaagacagatggaacaggcacctgaggaccagggaccagccagagagccattcaatgaatggaccttttgggacagcggtg

SEQ ID NO: 400378 - DNA, 140 bp, Artificial Sequence
  Synthetic
caccgctgtcccaaaaggtccattcattgaatggctctctggctggtccctggtcctcaggtgcctgttccatctgtcttctgttaatttctggacactgggtaggggaggtttacttctcatatcagcagccagggcct

SEQ ID NO: 400379 - DNA, 140 bp, Artificial Sequence
  Synthetic
aggccctggctgctgatatgactattaaatggcagtttatcagaagaagaggtaataattagatctgaaaatatcacaaacaatgccaaaaccataatagtacagcttaatgagactgtagaccttttgggacagcggtg

SEQ ID NO: 400380 - DNA, 140 bp, Artificial Sequence
  Synthetic
caccgctgtcccaaaaggtctacagtctcattaagctgtactattatggttttggcattgtttgtgatattttcagatctaattattacctcttcttctgataaactgccatttaatagtcatatcagcagccagggcct

SEQ ID NO: 400381 - DNA, 140 bp, Artificial Sequence
  Synthetic
aggccctggctgctgatatggaattgggtgccaacatagcagaataggcattattccacagagaagagtaaggaatggacccggtagatcctaacctagagccctggaatcatccagggagaccttttgggacagcggtg

SEQ ID NO: 400382 - DNA, 140 bp, Artificial Sequence
  Synthetic
caccgctgtcccaaaaggtctccctggatgattccagggctctaggttaggatctaccgggtccattccttactcttctctgtggaataatgcctattctgctatgttggcacccaattccatatcagcagccagggcct

SEQ ID NO: 400383 - DNA, 140 bp, Artificial Sequence
  Synthetic
atacgccatgctgggtctccacgtataggaccaggaaaagtattctatgcaaaaggtggaataacaggacaagcacattgtaacattacagatggggaatggaggaatactttacaacagcgtacttgggagtcggccat

SEQ ID NO: 400384 - DNA, 140 bp, Artificial Sequence
  Synthetic
atggccgactcccaagtacgctgttgtaaagtattcctccattccccatctgtaatgttacaatgtgcttgtcctgttattccaccttttgcatagaatacttttcctggtcctatacgtggagacccagcatggcgtat

SEQ ID NO: 400385 - DNA, 140 bp, Artificial Sequence
  Synthetic
aggccctggctgctgatatgaagcacattgtaacattacagatggggaatggaggaatactttacaacaggtagctatcgcattaagaagacaatttaataataaatcaataatatttaagaccttttgggacagcggtg

SEQ ID NO: 400386 - DNA, 140 bp, Artificial Sequence
  Synthetic
caccgctgtcccaaaaggtcttaaatattattgatttattattaaattgtcttcttaatgcgatagctacctgttgtaaagtattcctccattccccatctgtaatgttacaatgtgcttcatatcagcagccagggcct

SEQ ID NO: 400387 - DNA, 140 bp, Artificial Sequence
  Synthetic
aggccctggctgctgatatgggaatcttctgctgtattggagtcaggaactaaagaatagtgctgttagtttgctcaatgctacagctataacagtagctgaggggacagatagggctatgaccttttgggacagcggtg

SEQ ID NO: 400388 - DNA, 140 bp, Artificial Sequence
  Synthetic
caccgctgtcccaaaaggtcatagccctatctgtcccctcagctactgttatagctgtagcattgagcaaactaacagcactattctttagttcctgactccaatacagcagaagattcccatatcagcagccagggcct

SEQ ID NO: 400389 - DNA, 140 bp, Artificial Sequence
  Synthetic
atacgccatgctgggtctccgaggagagtttttctattgcaacacatcagagctgtttactggtatttggaatggtacttgggataagaattgcactagcactgagagtaattgcactggcgtacttgggagtcggccat

SEQ ID NO: 400390 - DNA, 140 bp, Artificial Sequence
  Synthetic
atggccgactcccaagtacgccagtgcaattactctcagtgctagtgcaattcttatcccaagtaccattccaaataccagtaaacagctctgatgtgttgcaatagaaaaactctcctcggagacccagcatggcgtat

SEQ ID NO: 400391 - DNA, 140 bp, Artificial Sequence
  Synthetic
atacgccatgctgggtctcctaagacagggcttggaaagggctttgctataaaatgggtggcaaatggtcaaaacgtagtagggatgggtggtctaccataagggaaagaatgagaagagcgtacttgggagtcggccat

SEQ ID NO: 400392 - DNA, 140 bp, Artificial Sequence
  Synthetic
atggccgactcccaagtacgctcttctcattctttcccttatggtagaccacccatccctactacgttttgaccatttgccacccattttatagcaaagccctttccaagccctgtcttaggagacccagcatggcgtat

SEQ ID NO: 400393 - DNA, 140 bp, Artificial Sequence
  Synthetic
atacgccatgctgggtctccaaatattacactcccatgcaggataaaacaagtggtaagaacatggcagggagtaggacaagcaatgtatgcccctcctatcgaagggacaattaggtgccgtacttgggagtcggccat

SEQ ID NO: 400394 - DNA, 140 bp, Artificial Sequence
  Synthetic
atggccgactcccaagtacggcacctaattgtcccttcgataggaggggcatacattgcttgtcctactccctgccatgttcttaccacttgttttatcctgcatgggagtgtaatatttggagacccagcatggcgtat

SEQ ID NO: 400395 - DNA, 140 bp, Artificial Sequence
  Synthetic
aggccctggctgctgatatgaagagaaagagaaatacttgaaaggataaggaaaataagggaaattagggacgatagtgactatgaaagcaatggagaggaagaacaggaggtcatggatgaccttttgggacagcggtg

SEQ ID NO: 400396 - DNA, 140 bp, Artificial Sequence
  Synthetic
caccgctgtcccaaaaggtcatccatgacctcctgttcttcctctccattgctttcatagtcactatcgtccctaatttcccttattttccttatcctttcaagtatttctctttctcttcatatcagcagccagggcct

SEQ ID NO: 400397 - DNA, 140 bp, Artificial Sequence
  Synthetic
atacgccatgctgggtctcctgtatgcaacaatctatgctggggtgcctgtatgggaagatgcagcaccagtattattttgtgcttcagatgctaacctaacaagccaggaacagcataacgtacttgggagtcggccat

SEQ ID NO: 400398 - DNA, 140 bp, Artificial Sequence
  Synthetic
atggccgactcccaagtacgttatgctgttcctggcttgttaggttagcatctgaagcacaaaataatactggtgctgcatcttcccatacaggcaccccagcatagattgttgcatacaggagacccagcatggcgtat

SEQ ID NO: 400399 - DNA, 140 bp, Artificial Sequence
  Synthetic
aggccctggctgctgatatgtaatttgaatgagactgagagtggtaatagtactactaatagtagtagctggggagaaatgaaaaactgctctttcaatgtcacctcaatcacaagagatgaccttttgggacagcggtg

SEQ ID NO: 400400 - DNA, 140 bp, Artificial Sequence
  Synthetic
caccgctgtcccaaaaggtcatctcttgtgattgaggtgacattgaaagagcagtttttcatttctccccagctactactattagtagtactattaccactctcagtctcattcaaattacatatcagcagccagggcct

SEQ ID NO: 400401 - DNA, 140 bp, Artificial Sequence
  Synthetic
atacgccatgctgggtctccataatacaacagacatgaaaaactgtgagtttaatgcaaccactgtagtcaaggacagaaaggagaaaaagcaggctctgttctatgtgtcagatttgaccgtacttgggagtcggccat

SEQ ID NO: 400402 - DNA, 140 bp, Artificial Sequence
  Synthetic
atggccgactcccaagtacggtcaaatctgacacatagaacagagcctgctttttctcctttctgtccttgactacagtggttgcattaaactcacagtttttcatgtctgttgtattatggagacccagcatggcgtat

SEQ ID NO: 400403 - DNA, 140 bp, Artificial Sequence
  Synthetic
aggccctggctgctgatatggagccaattccaatacactattgtgctccagcaggatatgccatctttaagtgcaatagtacagaatttagtggaagaggcacatgcaaaaacataacaggaccttttgggacagcggtg

SEQ ID NO: 400404 - DNA, 140 bp, Artificial Sequence
  Synthetic
caccgctgtcccaaaaggtcctgttatgtttttgcatgtgcctcttccactaaattctgtactattgcacttaaagatggcatatcctgctggagcacaatagtgtattggaattggctccatatcagcagccagggcct

SEQ ID NO: 400405 - DNA, 140 bp, Artificial Sequence
  Synthetic
atacgccatgctgggtctccttaaatgggacaatctctaagggaaaaataagaatgatggcaaaaaatattacagacaatacgaaaaatatcctagtaaccctaaattataccatagaaacgtacttgggagtcggccat

SEQ ID NO: 400406 - DNA, 140 bp, Artificial Sequence
  Synthetic
atggccgactcccaagtacgtttctatggtataatttagggttactaggatatttttcgtattgtctgtaatattttttgccatcattcttatttttcccttagagattgtcccatttaaggagacccagcatggcgtat

SEQ ID NO: 400407 - DNA, 140 bp, Artificial Sequence
  Synthetic
aggccctggctgctgatatgtacagacaatacgaaaaatatcctagtaaccctaaattataccatagaaatgatctgtgagagaccatggagagagatagctccgatgagcgtagggccagaccttttgggacagcggtg

SEQ ID NO: 400408 - DNA, 140 bp, Artificial Sequence
  Synthetic
caccgctgtcccaaaaggtctggccctacgctcatcggagctatctctctccatggtctctcacagatcatttctatggtataatttagggttactaggatatttttcgtattgtctgtacatatcagcagccagggcct

SEQ ID NO: 400409 - DNA, 140 bp, Artificial Sequence
  Synthetic
atacgccatgctgggtctccggaagctcattgccggtataatcccactgattgggaaagagcactaaaacaaacagctgaaaagtatttagaacttgtcaacaatacaagaaatattacccgtacttgggagtcggccat

SEQ ID NO: 400410 - DNA, 140 bp, Artificial Sequence
  Synthetic
atggccgactcccaagtacgggtaatatttcttgtattgttgacaagttctaaatacttttcagctgtttgttttagtgctctttcccaatcagtgggattataccggcaatgagcttccggagacccagcatggcgtat

SEQ ID NO: 400411 - DNA, 140 bp, Artificial Sequence
  Synthetic
aggccctggctgctgatatgtaatgccacagcaatagtagtagctgagggaacagatagaattatagaagtgggacaaagaatttgtagggctattctcaatatacctagaagaataagagaccttttgggacagcggtg

SEQ ID NO: 400412 - DNA, 140 bp, Artificial Sequence
  Synthetic
caccgctgtcccaaaaggtctcttattcttctaggtatattgagaatagccctacaaattctttgtcccacttctataattctatctgttccctcagctactactattgctgtggcattacatatcagcagccagggcct

SEQ ID NO: 400413 - DNA, 140 bp, Artificial Sequence
  Synthetic
atacgccatgctgggtctccaatggcctgctataagggagagaatgagacgagctaggccagcagctgagccagcagcagatggagtaggagcagcatctcgagacttagagaaatatggcgtacttgggagtcggccat

SEQ ID NO: 400414 - DNA, 140 bp, Artificial Sequence
  Synthetic
atggccgactcccaagtacgccatatttctctaagtctcgagatgctgctcctactccatctgctgctggctcagctgctggcctagctcgtctcattctctcccttatagcaggccattggagacccagcatggcgtat

SEQ ID NO: 400415 - DNA, 140 bp, Artificial Sequence
  Synthetic
atacgccatgctgggtctcctctaagaatcataccatgtatggagaaataaaaaactgctctttcaatgcaaccacagaaataagagataagaaacagaatgtatatgcacttttctatacgtacttgggagtcggccat

SEQ ID NO: 400416 - DNA, 140 bp, Artificial Sequence
  Synthetic
atggccgactcccaagtacgtatagaaaagtgcatatacattctgtttcttatctcttatttctgtggttgcattgaaagagcagttttttatttctccatacatggtatgattcttagaggagacccagcatggcgtat

SEQ ID NO: 400417 - DNA, 140 bp, Artificial Sequence
  Synthetic
aggccctggctgctgatatggccttctagaaacaaaagaaggctgtaaacaaattatagcagcagtacaaccatctcttcagacaggatcagaagagcttaaatcattatataatgcagtgaccttttgggacagcggtg

SEQ ID NO: 400418 - DNA, 140 bp, Artificial Sequence
  Synthetic
caccgctgtcccaaaaggtcactgcattatataatgatttaagctcttctgatcctgtctgaagagatggttgtactgctgctataatttgtttacagccttcttttgtttctagaaggccatatcagcagccagggcct

SEQ ID NO: 400419 - DNA, 140 bp, Artificial Sequence
  Synthetic
atacgccatgctgggtctccctcatggacaggaaatgaaagcatttggaacaacctaacatggcaacaatgggatcagcagataagcaacgtaagcgccatcatatttggggaaatacaccgtacttgggagtcggccat

SEQ ID NO: 400420 - DNA, 140 bp, Artificial Sequence
  Synthetic
atggccgactcccaagtacggtgtatttccccaaatatgatggcgcttacgttgcttatctgctgatcccattgttgccatgttaggttgttccaaatgctttcatttcctgtccatgagggagacccagcatggcgtat

SEQ ID NO: 400421 - DNA, 140 bp, Artificial Sequence
  Synthetic
atacgccatgctgggtctccgaaagaatgagacgagctgagccagctgagccagcagcagatggggtgggagcagtatctcgagacctggaaaaacatggagcaatcacaagtagcaatacgtacttgggagtcggccat

SEQ ID NO: 400422 - DNA, 140 bp, Artificial Sequence
  Synthetic
atggccgactcccaagtacgtattgctacttgtgattgctccatgtttttccaggtctcgagatactgctcccaccccatctgctgctggctcagctggctcagctcgtctcattctttcggagacccagcatggcgtat

SEQ ID NO: 400423 - DNA, 140 bp, Artificial Sequence
  Synthetic
  misc_feature (26)..(26): n is a, c, g, or t
aggccctggctgctgatatggcaggncctatcccaccaggccagatgagggaacctaggggaagtgatatagctggatctactagcacccttcaggaacaaatacaatggataacaagcagaccttttgggacagcggtg

SEQ ID NO: 400424 - DNA, 140 bp, Artificial Sequence
  Synthetic
  misc_feature (115)..(115): n is a, c, g, or t
caccgctgtcccaaaaggtctgcttgttatccattgtatttgttcctgaagggtgctagtagatccagctatatcacttcccctaggttccctcatctggcctggtgggataggncctgccatatcagcagccagggcct

SEQ ID NO: 400425 - DNA, 140 bp, Artificial Sequence
  Synthetic
atacgccatgctgggtctccgtggcgcccgaacagggacccgaaaagtgaaagtaatagggactcgaaagcgaaagttccagagaattctctcgacgcaggactcggcttgctgaaggtgcgtacttgggagtcggccat

SEQ ID NO: 400426 - DNA, 140 bp, Artificial Sequence
  Synthetic
atggccgactcccaagtacgcaccttcagcaagccgagtcctgcgtcgagagaattctctggaactttcgctttcgagtccctattactttcacttttcgggtccctgttcgggcgccacggagacccagcatggcgtat

SEQ ID NO: 400427 - DNA, 140 bp, Artificial Sequence
  Synthetic
aggccctggctgctgatatgcagtctcaagggactgagactggggtgggagggcctcaaatatctgtggaatcttctgttgtattggggtcaggaactaaagaatagtgccattaatttggaccttttgggacagcggtg

SEQ ID NO: 400428 - DNA, 140 bp, Artificial Sequence
  Synthetic
caccgctgtcccaaaaggtccaaattaatggcactattctttagttcctgaccccaatacaacagaagattccacagatatttgaggccctcccaccccagtctcagtcccttgagactgcatatcagcagccagggcct

SEQ ID NO: 400429 - DNA, 140 bp, Artificial Sequence
  Synthetic
  misc_feature (40)..(40): n is a, c, g, or t
  misc_feature (46)..(46): n is a, c, g, or t
  misc_feature (89)..(89): n is a, c, g, or t
atacgccatgctgggtctccccctaagagctgagcaagcntcacangacgtaaagaattggatgacagaaaccttgctggtccgaaatncgaacccagattgtaagaccattttaaccgccgtacttgggagtcggccat

SEQ ID NO: 400430 - DNA, 140 bp, Artificial Sequence
  Synthetic
  misc_feature (52)..(52): n is a, c, g, or t
  misc_feature (95)..(95): n is a, c, g, or t
  misc_feature (101)..(101): n is a, c, g, or t
atggccgactcccaagtacggcggttaaaatggtcttacaatctgggttcgnatttcggaccagcaaggtttctgtcatccaattctttacgtcntgtgangcttgctcagctcttagggggagacccagcatggcgtat

SEQ ID NO: 400431 - DNA, 140 bp, Artificial Sequence
  Synthetic
aggccctggctgctgatatgaatgcttgcagaatttgtacagctgtaacacaatactggctacaagaattgcagaatagtgctacaagtcttctagatacatttgcagtggcagtagccagaccttttgggacagcggtg

SEQ ID NO: 400432 - DNA, 140 bp, Artificial Sequence
  Synthetic
caccgctgtcccaaaaggtctggctactgccactgcaaatgtatctagaagacttgtagcactattctgcaattcttgtagccagtattgtgttacagctgtacaaattctgcaagcattcatatcagcagccagggcct

SEQ ID NO: 400433 - DNA, 140 bp, Artificial Sequence
  Synthetic
aggccctggctgctgatatgacaatgggaaacgtattaggaaaaagcaagtacgatggatgggcatcagtgagagaaagaatgagaaaaactagaaccattagaactagaacttcccctggaccttttgggacagcggtg

SEQ ID NO: 400434 - DNA, 140 bp, Artificial Sequence
  Synthetic
caccgctgtcccaaaaggtccaggggaagttctagttctaatggttctagtttttctcattctttctctcactgatgcccatccatcgtacttgctttttcctaatacgtttcccattgtcatatcagcagccagggcct

SEQ ID NO: 400435 - DNA, 140 bp, Artificial Sequence
  Synthetic
aggccctggctgctgatatgtgcattcctagaaagtcaccaagatgaagaagtaggttttccagtaaggcctcaagtacccctaagaccaatgacctataaaggagcgttgacctcagctgaccttttgggacagcggtg

SEQ ID NO: 400436 - DNA, 140 bp, Artificial Sequence
  Synthetic
caccgctgtcccaaaaggtcagctgaggtcaacgctcctttataggtcattggtcttaggggtacttgaggccttactggaaaacctacttcttcatcttggtgactttctaggaatgcacatatcagcagccagggcct

SEQ ID NO: 400437 - DNA, 140 bp, Artificial Sequence
  Synthetic
atacgccatgctgggtctccgctaataatactaccaatataggtaatactaccagtaatagaaatactacctacaatgctacctacaatgaatacatgaaaaattgctctttcaatataacgtacttgggagtcggccat

SEQ ID NO: 400438 - DNA, 140 bp, Artificial Sequence
  Synthetic
atggccgactcccaagtacgttatattgaaagagcaatttttcatgtattcattgtaggtagcattgtaggtagtatttctattactggtagtattacctatattggtagtattattagcggagacccagcatggcgtat

SEQ ID NO: 400439 - DNA, 140 bp, Artificial Sequence
  Synthetic
aggccctggctgctgatatgacaatgtacacatggaattaagccagtggtatcaactcaactactgttaaatggtagcctagcagaagaggagataataattagatctgaaaatctgacagaccttttgggacagcggtg

SEQ ID NO: 400440 - DNA, 140 bp, Artificial Sequence
  Synthetic
caccgctgtcccaaaaggtctgtcagattttcagatctaattattatctcctcttctgctaggctaccatttaacagtagttgagttgataccactggcttaattccatgtgtacattgtcatatcagcagccagggcct

SEQ ID NO: 400441 - DNA, 140 bp, Artificial Sequence
  Synthetic
aggccctggctgctgatatgcgactcatcaagtttctctatcaaagcagtaagtagtatatgtaatgcaaactttaataatagcatcaatagtagctttagtagtagtaggattaatagcgaccttttgggacagcggtg

SEQ ID NO: 400442 - DNA, 140 bp, Artificial Sequence
  Synthetic
caccgctgtcccaaaaggtcgctattaatcctactactactaaagctactattgatgctattattaaagtttgcattacatatactacttactgctttgatagagaaacttgatgagtcgcatatcagcagccagggcct

SEQ ID NO: 400443 - DNA, 140 bp, Artificial Sequence
  Synthetic
atacgccatgctgggtctcccagtagctgaaggaacagataggataatagaatacatacaaagagtttatagagctatctgcaacatacaagaataagacagggctttgaagcttaaggccgtacttgggagtcggccat

SEQ ID NO: 400444 - DNA, 140 bp, Artificial Sequence
  Synthetic
atggccgactcccaagtacggccttaagcttcaaagccctgtcttattcttgtatgttgcagatagctctataaactctttgtatgtattctattatcctatctgttccttcagctactgggagacccagcatggcgtat

SEQ ID NO: 400445 - DNA, 140 bp, Artificial Sequence
  Synthetic
aggccctggctgctgatatgaaaggaaaatagataggctaattgaaaggatagcagaaagagcagaagacagtggcaatgaaagtgaaggggatcaggaagaactatcagcactggtggagaccttttgggacagcggtg

SEQ ID NO: 400446 - DNA, 140 bp, Artificial Sequence
  Synthetic
caccgctgtcccaaaaggtctccaccagtgctgatagttcttcctgatccccttcactttcattgccactgtcttctgctctttctgctatcctttcaattagcctatctattttcctttcatatcagcagccagggcct

SEQ ID NO: 400447 - DNA, 140 bp, Artificial Sequence
  Synthetic
atacgccatgctgggtctccaaaattaaaagaatactacaaaaagacaatagagtttcaacaacccgtaggaggggatctagaaattacaacacatagctttaattgtagaggagaatttcgtacttgggagtcggccat

SEQ ID NO: 400448 - DNA, 140 bp, Artificial Sequence
  Synthetic
atggccgactcccaagtacgaaattctcctctacaattaaagctatgtgttgtaatttctagatcccctcctacgggttgttgaaactctattgtctttttgtagtattcttttaattttggagacccagcatggcgtat

SEQ ID NO: 400449 - DNA, 140 bp, Artificial Sequence
  Synthetic
aggccctggctgctgatatgtttggggctgctctggaaaactcatctgcaccactgctgtgccttggaactccagttggagtaataaatctctaacagatatttgggataacatgacctggaccttttgggacagcggtg

SEQ ID NO: 400450 - DNA, 140 bp, Artificial Sequence
  Synthetic
caccgctgtcccaaaaggtccaggtcatgttatcccaaatatctgttagagatttattactccaactggagttccaaggcacagcagtggtgcagatgagttttccagagcagccccaaacatatcagcagccagggcct

SEQ ID NO: 400451 - DNA, 140 bp, Artificial Sequence
  Synthetic
aggccctggctgctgatatgggtaatacaaaactgttctttcaatatgaccacagaagtaagagataagcagctgaaagtacatgcacttttttatagacttgatatagtaccaatcagtgaccttttgggacagcggtg

SEQ ID NO: 400452 - DNA, 140 bp, Artificial Sequence
  Synthetic
caccgctgtcccaaaaggtcactgattggtactatatcaagtctataaaaaagtgcatgtactttcagctgcttatctcttacttctgtggtcatattgaaagaacagttttgtattacccatatcagcagccagggcct

SEQ ID NO: 400453 - DNA, 140 bp, Artificial Sequence
  Synthetic
  misc_feature (42)..(42): n is a, c, g, or t
  misc_feature (52)..(52): n is a, c, g, or t
  misc_feature (111)..(111): n is a, c, g, or t
aggccctggctgctgatatgaaattagtcagtgctggaatcnggaaagtacnatttttagatggaatagatagagcccaagaagagcatgaaaaatatcacaacaattggngagcaatgggaccttttgggacagcggtg

SEQ ID NO: 400454 - DNA, 140 bp, Artificial Sequence
  Synthetic
  misc_feature (30)..(30): n is a, c, g, or t
  misc_feature (89)..(89): n is a, c, g, or t
  misc_feature (99)..(99): n is a, c, g, or t
caccgctgtcccaaaaggtcccattgctcnccaattgttgtgatatttttcatgctcttcttgggctctatctattccatctaaaaatngtactttccngattccagcactgactaatttcatatcagcagccagggcct

SEQ ID NO: 400455 - DNA, 140 bp, Artificial Sequence
  Synthetic
aggccctggctgctgatatgtaattgtacaagacccaacaataatacaagaaaaagtatacatataggaccaggacaagcattttatgcaacaggagatataataggagatatcagaaaggaccttttgggacagcggtg

SEQ ID NO: 400456 - DNA, 140 bp, Artificial Sequence
  Synthetic
caccgctgtcccaaaaggtcctttctgatatctcctattatatctcctgttgcataaaatgcttgtcctggtcctatatgtatactttttcttgtattattgttgggtcttgtacaattacatatcagcagccagggcct

SEQ ID NO: 400457 - DNA, 140 bp, Artificial Sequence
  Synthetic
aggccctggctgctgatatgtactggcctccggggggcgcgaggccaggcaattatgtgcagaaacaagtgcccccagcaaccccatcagccccaccgatggaggaggaaatgaagggacgaccttttgggacagcggtg

SEQ ID NO: 400458 - DNA, 140 bp, Artificial Sequence
  Synthetic
caccgctgtcccaaaaggtcgtcccttcatttcctcctccatcggtggggctgatggggttgctgggggcacttgtttctgcacataattgcctggcctcgcgccccccggaggccagtacatatcagcagccagggcct

SEQ ID NO: 400459 - DNA, 140 bp, Artificial Sequence
  Synthetic
aggccctggctgctgatatggatgaagaagtgggtttcccagtcagaccccaggtacctttaagaccaatgactcacagggcagctgtagatcttagccactttttaagaaagaaggggggaccttttgggacagcggtg

SEQ ID NO: 400460 - DNA, 140 bp, Artificial Sequence
  Synthetic
caccgctgtcccaaaaggtccccccttctttcttaaaaagtggctaagatctacagctgccctgtgagtcattggtcttaaaggtacctggggtctgactgggaaacccacttcttcatccatatcagcagccagggcct

SEQ ID NO: 400461 - DNA, 140 bp, Artificial Sequence
  Synthetic
  misc_feature (27)..(27): n is a, c, g, or t
  misc_feature (70)..(70): n is a, c, g, or t
  misc_feature (72)..(72): n is a, c, g, or t
atacgccatgctgggtctccttgtgangatgtggcagggagtaggaagagcaatgtatgctgctcctatngnaggaagcattacctgtaattcaaatattacaggtatacttttaacaagcgtacttgggagtcggccat

SEQ ID NO: 400462 - DNA, 140 bp, Artificial Sequence
  Synthetic
  misc_feature (69)..(69): n is a, c, g, or t
  misc_feature (71)..(71): n is a, c, g, or t
  misc_feature (114)..(114): n is a, c, g, or t
atggccgactcccaagtacgcttgttaaaagtatacctgtaatatttgaattacaggtaatgcttcctncnataggagcagcatacattgctcttcctactccctgccacatcntcacaaggagacccagcatggcgtat

SEQ ID NO: 400463 - DNA, 140 bp, Artificial Sequence
  Synthetic
  misc_feature (73)..(73): n is a, c, g, or t
  misc_feature (114)..(114): n is a, c, g, or t
aggccctggctgctgatatgtgcatggaaaagtttagtcaaataccatatgcatgtttcaaagagagccaaangatggttttatagacatcactttgacagcagacatccaaangtaagtgaccttttgggacagcggtg

SEQ ID NO: 400464 - DNA, 140 bp, Artificial Sequence
  Synthetic
  misc_feature (27)..(27): n is a, c, g, or t
  misc_feature (68)..(68): n is a, c, g, or t
caccgctgtcccaaaaggtcacttacntttggatgtctgctgtcaaagtgatgtctataaaaccatcntttggctctctttgaaacatgcatatggtatttgactaaacttttccatgcacatatcagcagccagggcct

SEQ ID NO: 400465 - DNA, 140 bp, Artificial Sequence
  Synthetic
  misc_feature (64)..(64): n is a, c, g, or t
atacgccatgctgggtctccaagcaggacataacaaggttggatctctacaatatttggcactnacagcattgatagctccaaagaagccaaagccgcctttgcctagtgtccagaagttcgtacttgggagtcggccat

SEQ ID NO: 400466 - DNA, 140 bp, Artificial Sequence
  Synthetic
  misc_feature (77)..(77): n is a, c, g, or t
atggccgactcccaagtacgaacttctggacactaggcaaaggcggctttggcttctttggagctatcaatgctgtnagtgccaaatattgtagagatccaaccttgttatgtcctgcttggagacccagcatggcgtat

SEQ ID NO: 400467 - DNA, 140 bp, Artificial Sequence
  Synthetic
aggccctggctgctgatatgcaagtcattaacagaagtagtacctttaagtaaagaggcagagctggaattagaggaaaacagagaaaagttaaaagaaccagtgcatggtgtatactatgaccttttgggacagcggtg

SEQ ID NO: 400468 - DNA, 140 bp, Artificial Sequence
  Synthetic
caccgctgtcccaaaaggtcatagtatacaccatgcactggttcttttaacttttctctgttttcctctaattccagctctgcctctttacttaaaggtactacttctgttaatgacttgcatatcagcagccagggcct

SEQ ID NO: 400469 - DNA, 140 bp, Artificial Sequence
  Synthetic
aggccctggctgctgatatgtatactgcattcaccatacctagtataaacaatgaaacaccagggattagatatcagtacaatgtgcttccacagggatggaaaggatcaccagcaatatgaccttttgggacagcggtg

SEQ ID NO: 400470 - DNA, 140 bp, Artificial Sequence
  Synthetic
caccgctgtcccaaaaggtcatattgctggtgatcctttccatccctgtggaagcacattgtactgatatctaatccctggtgtttcattgtttatactaggtatggtgaatgcagtatacatatcagcagccagggcct

SEQ ID NO: 400471 - DNA, 140 bp, Artificial Sequence
  Synthetic
atacgccatgctgggtctccactggaagacagaaaccttgttggtccaaaatgcaaacccagattgtaaaaccatcttacaagcattacgaccacaggctacactagaagaaatgctgcccgtacttgggagtcggccat

SEQ ID NO: 400472 - DNA, 140 bp, Artificial Sequence
  Synthetic
atggccgactcccaagtacgggcagcatttcttctagtgtagcctgtggtcgtaatgcttgtaagatggttttacaatctgggtttgcattttggaccaacaaggtttctgtcttccagtggagacccagcatggcgtat

SEQ ID NO: 400473 - DNA, 140 bp, Artificial Sequence
  Synthetic
  misc_feature (26)..(26): n is a, c, g, or t
  misc_feature (37)..(37): n is a, c, g, or t
  misc_feature (39)..(39): n is a, c, g, or t
  misc_feature (41)..(41): n is a, c, g, or t
  misc_feature (48)..(48): n is a, c, g, or t
  misc_feature (52)..(52): n is a, c, g, or t
  misc_feature (54)..(54): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (78)..(78): n is a, c, g, or t
  misc_feature (81)..(81): n is a, c, g, or t
  misc_feature (87)..(87): n is a, c, g, or t
atacgccatgctgggtctccagcagngggggtgggancngnatctcgngacntngnaananatggagcaatcacaagnagnaatacngcagctactaatctgacttgtgcctggctagaacgtacttgggagtcggccat

SEQ ID NO: 400474 - DNA, 140 bp, Artificial Sequence
  Synthetic
  misc_feature (54)..(54): n is a, c, g, or t
  misc_feature (60)..(60): n is a, c, g, or t
  misc_feature (63)..(63): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (87)..(87): n is a, c, g, or t
  misc_feature (89)..(89): n is a, c, g, or t
  misc_feature (93)..(93): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (115)..(115): n is a, c, g, or t
atggccgactcccaagtacgttctagccaggcacaagtcagattagtagctgcngtattnctncttgtgattgctccatntnttncnangtcncgagatncngntcccacccccnctgctggagacccagcatggcgtat

SEQ ID NO: 400475 - DNA, 140 bp, Artificial Sequence
  Synthetic
atacgccatgctgggtctcctaatggtactgaagtgagggggaatactactagtaatgatactactaataccactagtagtagcatggaaacagaaatgaaaaactgctctttcaatattcgtacttgggagtcggccat

SEQ ID NO: 400476 - DNA, 140 bp, Artificial Sequence
  Synthetic
atggccgactcccaagtacgaatattgaaagagcagtttttcatttctgtttccatgctactactagtggtattagtagtatcattactagtagtattccccctcacttcagtaccattaggagacccagcatggcgtat

SEQ ID NO: 400477 - DNA, 140 bp, Artificial Sequence
  Synthetic
  misc_feature (99)..(99): n is a, c, g, or t
  misc_feature (113)..(113): n is a, c, g, or t
  misc_feature (115)..(115): n is a, c, g, or t
atacgccatgctgggtctccgaagaataagacagggccttgaaaggagcttgctataaaatgggtggaaagtggtcaaaacgtagtacagctggatggnctgctgtaagggananaatgacgtacttgggagtcggccat

SEQ ID NO: 400478 - DNA, 140 bp, Artificial Sequence
  Synthetic
  misc_feature (26)..(26): n is a, c, g, or t
  misc_feature (28)..(28): n is a, c, g, or t
  misc_feature (42)..(42): n is a, c, g, or t
atggccgactcccaagtacgtcattntntcccttacagcagnccatccagctgtactacgttttgaccactttccacccattttatagcaagctcctttcaaggccctgtcttattcttcggagacccagcatggcgtat

SEQ ID NO: 400479 - DNA, 140 bp, Artificial Sequence
  Synthetic
aggccctggctgctgatatgcagataatagaggaattaacaaaaaaggaacaggtgtatcttacatgggttcctgctcataaaggcataggaggaaatgaaaaaatagataaattagtaagaccttttgggacagcggtg

SEQ ID NO: 400480 - DNA, 140 bp, Artificial Sequence
  Synthetic
caccgctgtcccaaaaggtcttactaatttatctattttttcatttcctcctatgcctttatgagcaggaacccatgtaagatacacctgttccttttttgttaattcctctattatctgcatatcagcagccagggcct

SEQ ID NO: 400481 - DNA, 140 bp, Artificial Sequence
  Synthetic
  misc_feature (23)..(23): n is a, c, g, or t
atacgccatgctgggtctccgancgggtaaagacaaagttagggccttatttccctaataaaacaataacctttgccccagcctcaggaggggacctagaggttacaatgcatagttttacgtacttgggagtcggccat

SEQ ID NO: 400482 - DNA, 140 bp, Artificial Sequence
  Synthetic
  misc_feature (118)..(118): n is a, c, g, or t
atggccgactcccaagtacgtaaaactatgcattgtaacctctaggtcccctcctgaggctggggcaaaggttattgttttattagggaaataaggccctaactttgtctttacccgntcggagacccagcatggcgtat

SEQ ID NO: 400483 - DNA, 140 bp, Artificial Sequence
  Synthetic
aggccctggctgctgatatgctttgccccagcctcaggaggggacctagaggttacaatgcatagttttaattgtagaggagaatttttctactgcaatacatcaggattgtttaattatgaccttttgggacagcggtg

SEQ ID NO: 400484 - DNA, 140 bp, Artificial Sequence
  Synthetic
caccgctgtcccaaaaggtcataattaaacaatcctgatgtattgcagtagaaaaattctcctctacaattaaaactatgcattgtaacctctaggtcccctcctgaggctggggcaaagcatatcagcagccagggcct

SEQ ID NO: 400485 - DNA, 140 bp, Artificial Sequence
  Synthetic
atacgccatgctgggtctcccactattttgactgtttttcagactctgcaataaggaaggcattattaggagaaatagttagtcctaggtgtgaatatcaagcaggacatactaaggtagcgtacttgggagtcggccat

SEQ ID NO: 400486 - DNA, 140 bp, Artificial Sequence
  Synthetic
atggccgactcccaagtacgctaccttagtatgtcctgcttgatattcacacctaggactaactatttctcctaataatgccttccttattgcagagtctgaaaaacagtcaaaatagtgggagacccagcatggcgtat

SEQ ID NO: 400487 - DNA, 140 bp, Artificial Sequence
  Synthetic
  misc_feature (116)..(116): n is a, c, g, or t
atacgccatgctgggtctccatgccaggggaagaagatgaacagttgggacacggggttagtatagaatggcagtataaagggtataaaacacagattgaccctacaacagcaganaggacgtacttgggagtcggccat

SEQ ID NO: 400488 - DNA, 140 bp, Artificial Sequence
  Synthetic
  misc_feature (25)..(25): n is a, c, g, or t
atggccgactcccaagtacgtcctntctgctgttgtagggtcaatctgtgttttataccctttatactgccattctatactaaccccgtgtcccaactgttcatcttcttcccctggcatggagacccagcatggcgtat

SEQ ID NO: 400489 - DNA, 140 bp, Artificial Sequence
  Synthetic
aggccctggctgctgatatggccccagaggaccaggggccacagagggaaccctacaatgaatggacattagaactgttagaagagcttaaaaatgaagctgttagacattttcctaggcgaccttttgggacagcggtg

SEQ ID NO: 400490 - DNA, 140 bp, Artificial Sequence
  Synthetic
caccgctgtcccaaaaggtcgcctaggaaaatgtctaacagcttcatttttaagctcttctaacagttctaatgtccattcattgtagggttccctctgtggcccctggtcctctggggccatatcagcagccagggcct

SEQ ID NO: 400491 - DNA, 140 bp, Artificial Sequence
  Synthetic
atacgccatgctgggtctcccaaaaagaagtaagcctcccctacccagtgtccagaaattaacagaagatagatggaacaagcaccggagaatcagggaccagctagagagccattcaatcgtacttgggagtcggccat

SEQ ID NO: 400492 - DNA, 140 bp, Artificial Sequence
  Synthetic
atggccgactcccaagtacgattgaatggctctctagctggtccctgattctccggtgcttgttccatctatcttctgttaatttctggacactgggtaggggaggcttacttctttttgggagacccagcatggcgtat

SEQ ID NO: 400493 - DNA, 140 bp, Artificial Sequence
  Synthetic
aggccctggctgctgatatgccatttcagaattgggtgccaacatagcagaataggcattattccacggagaagagtaagggatggacccggtagatcctaacctagagccctggaatcagaccttttgggacagcggtg

SEQ ID NO: 400494 - DNA, 140 bp, Artificial Sequence
  Synthetic
caccgctgtcccaaaaggtctgattccagggctctaggttaggatctaccgggtccatcccttactcttctccgtggaataatgcctattctgctatgttggcacccaattctgaaatggcatatcagcagccagggcct

SEQ ID NO: 400495 - DNA, 140 bp, Artificial Sequence
  Synthetic
aggccctggctgctgatatgtttccctaggccttggctacacgccttgggacaatacatctatgagacttatggagacacttgggtaggagttatggcaattataagaatgttacaacaagaccttttgggacagcggtg

SEQ ID NO: 400496 - DNA, 140 bp, Artificial Sequence
  Synthetic
caccgctgtcccaaaaggtcttgttgtaacattcttataattgccataactcctacccaagtgtctccataagtctcatagatgtattgtcccaaggcgtgtagccaaggcctagggaaacatatcagcagccagggcct

SEQ ID NO: 400497 - DNA, 140 bp, Artificial Sequence
  Synthetic
aggccctggctgctgatatgcaaggcagagacagatccgtgcgcttagtgaacggattcttgtctcttatctgggacgacctgaggaacctgtgcctcttcagctaccgccacttgagaagaccttttgggacagcggtg

SEQ ID NO: 400498 - DNA, 140 bp, Artificial Sequence
  Synthetic
caccgctgtcccaaaaggtcttctcaagtggcggtagctgaagaggcacaggttcctcaggtcgtcccagataagagacaagaatccgttcactaagcgcacggatctgtctctgccttgcatatcagcagccagggcct

SEQ ID NO: 400499 - DNA, 140 bp, Artificial Sequence
  Synthetic
atacgccatgctgggtctccctgaaggaagatccaggggcaatacaaaactgttctttcaatatgaccacagaagtaagagataagcagctgaaagtacatgcacttttttataaacttgcgtacttgggagtcggccat

SEQ ID NO: 400500 - DNA, 140 bp, Artificial Sequence
  Synthetic
atggccgactcccaagtacgcaagtttataaaaaagtgcatgtactttcagctgcttatctcttacttctgtggtcatattgaaagaacagttttgtattgcccctggatcttccttcagggagacccagcatggcgtat

SEQ ID NO: 400501 - DNA, 140 bp, Artificial Sequence
  Synthetic
atacgccatgctgggtctcctcctccacatacctagaagaataagacagggccttgaaagggctttgctataaaatgggtggcaaatggtcaaaacgtaagatggctgactggcctgatgcgtacttgggagtcggccat

SEQ ID NO: 400502 - DNA, 140 bp, Artificial Sequence
  Synthetic
atggccgactcccaagtacgcatcaggccagtcagccatcttacgttttgaccatttgccacccattttatagcaaagccctttcaaggccctgtcttattcttctaggtatgtggaggaggagacccagcatggcgtat

SEQ ID NO: 400503 - DNA, 140 bp, Artificial Sequence
  Synthetic
  misc_feature (77)..(77): n is a, c, g, or t
aggccctggctgctgatatggctgctgcaagcaatccagatcataaagatcctgtaccaaagcagtaagtaacgctnatgcatcatagggacctgctaaccttaatagctgttagtgcttgaccttttgggacagcggtg

SEQ ID NO: 400504 - DNA, 140 bp, Artificial Sequence
  Synthetic
  misc_feature (64)..(64): n is a, c, g, or t
caccgctgtcccaaaaggtcaagcactaacagctattaaggttagcaggtccctatgatgcatnagcgttacttactgctttggtacaggatctttatgatctggattgcttgcagcagccatatcagcagccagggcct

SEQ ID NO: 400505 - DNA, 140 bp, Artificial Sequence
  Synthetic
  misc_feature (79)..(79): n is a, c, g, or t
atacgccatgctgggtctccgaacaaaggaaacaagacagaagggaaagagaaatacttgagaggctaagaagaataanagaaattggggatgatagtgattatgaaagcaatgaagaagcgtacttgggagtcggccat

SEQ ID NO: 400506 - DNA, 140 bp, Artificial Sequence
  Synthetic
  misc_feature (62)..(62): n is a, c, g, or t
atggccgactcccaagtacgcttcttcattgctttcataatcactatcatccccaatttctnttattcttcttagcctctcaagtatttctctttcccttctgtcttgtttcctttgttcggagacccagcatggcgtat

SEQ ID NO: 400507 - DNA, 140 bp, Artificial Sequence
  Synthetic
  misc_feature (29)..(29): n is a, c, g, or t
aggccctggctgctgatatgaagaataanagaaattggggatgatagtgattatgaaagcaatgaagaagaagaacaagaagttatggatcttgtacataatcatggctttgataaccctgaccttttgggacagcggtg

SEQ ID NO: 400508 - DNA, 140 bp, Artificial Sequence
  Synthetic
  misc_feature (112)..(112): n is a, c, g, or t
caccgctgtcccaaaaggtcagggttatcaaagccatgattatgtacaagatccataacttcttgttcttcttcttcattgctttcataatcactatcatccccaatttctnttattcttcatatcagcagccagggcct

SEQ ID NO: 400509 - DNA, 140 bp, Artificial Sequence
  Synthetic
  misc_feature (63)..(63): n is a, c, g, or t
  misc_feature (76)..(76): n is a, c, g, or t
atacgccatgctgggtctcccggccagagccaacagccccgccagcagagagcttcgggttcngagaggagataancccctctccgaggcaggagcagcaaaacgagggaaagtaccctccgtacttgggagtcggccat

SEQ ID NO: 400510 - DNA, 140 bp, Artificial Sequence
  Synthetic
  misc_feature (65)..(65): n is a, c, g, or t
  misc_feature (78)..(78): n is a, c, g, or t
atggccgactcccaagtacggagggtactttccctcgttttgctgctcctgcctcggagaggggnttatctcctctcngaacccgaagctctctgctggcggggctgttggctctggccgggagacccagcatggcgtat

SEQ ID NO: 400511 - DNA, 140 bp, Artificial Sequence
  Synthetic
atacgccatgctgggtctccatgccggcacgacaaccagtagcccagatctcaaacaagatctcaaacagtgtgagtttaatatgaccacagttgttaaggacaaaaaggagaaaaaacacgtacttgggagtcggccat

SEQ ID NO: 400512 - DNA, 140 bp, Artificial Sequence
  Synthetic
atggccgactcccaagtacgtgttttttctcctttttgtccttaacaactgtggtcatattaaactcacactgtttgagatcttgtttgagatctgggctactggttgtcgtgccggcatggagacccagcatggcgtat

SEQ ID NO: 400513 - DNA, 140 bp, Artificial Sequence
  Synthetic
aggccctggctgctgatatggcctgtccaaaggtatcttttgagccaattccaatacactattgtgctccagcaggatatgccatttttaagtgtaacagcacagaatttaatggaacaggaccttttgggacagcggtg

SEQ ID NO: 400514 - DNA, 140 bp, Artificial Sequence
  Synthetic
caccgctgtcccaaaaggtcctgttccattaaattctgtgctgttacacttaaaaatggcatatcctgctggagcacaatagtgtattggaattggctcaaaagatacctttggacaggccatatcagcagccagggcct

SEQ ID NO: 400515 - DNA, 140 bp, Artificial Sequence
  Synthetic
aggccctggctgctgatatggcttcacaggaggtaaaaaattggatgacagaaaccttgttggtccaaaatgcgaacccagattgtaagactattttaaaagcattgggaccagcagctagaccttttgggacagcggtg

SEQ ID NO: 400516 - DNA, 140 bp, Artificial Sequence
  Synthetic
caccgctgtcccaaaaggtctagctgctggtcccaatgcttttaaaatagtcttacaatctgggttcgcattttggaccaacaaggtttctgtcatccaattttttacctcctgtgaagccatatcagcagccagggcct

SEQ ID NO: 400517 - DNA, 140 bp, Artificial Sequence
  Synthetic
atacgccatgctgggtctccgcgaagaaaagatagaggcaggagagatgaagaattgctctttcaatatcaccacaaacataaaagataaggtaacaaaagaatatgcactattctataacgtacttgggagtcggccat

SEQ ID NO: 400518 - DNA, 140 bp, Artificial Sequence
  Synthetic
atggccgactcccaagtacgttatagaatagtgcatattcttttgttaccttatcttttatgtttgtggtgatattgaaagagcaattcttcatctctcctgcctctatcttttcttcgcggagacccagcatggcgtat

SEQ ID NO: 400519 - DNA, 140 bp, Artificial Sequence
  Synthetic
atacgccatgctgggtctccccctaaattctaccctaaacatgacctgtgagagaccatacagggagatacaacaggtaatcgcaggtccaatggccttgaacagcatggccctaacaaccgtacttgggagtcggccat

SEQ ID NO: 400520 - DNA, 140 bp, Artificial Sequence
  Synthetic
atggccgactcccaagtacggttgttagggccatgctgttcaaggccattggacctgcgattacctgttgtatctccctgtatggtctctcacaggtcatgtttagggtagaatttagggggagacccagcatggcgtat

SEQ ID NO: 400521 - DNA, 140 bp, Artificial Sequence
  Synthetic
atacgccatgctgggtctcctggtaatgctaactatactattaccgtggatgaaataagaaattgctctttcaatacaaccacagaaataagagataagcaaaagaaagcgtatgcacttcgtacttgggagtcggccat

SEQ ID NO: 400522 - DNA, 140 bp, Artificial Sequence
  Synthetic
atggccgactcccaagtacgaagtgcatacgctttcttttgcttatctcttatttctgtggttgtattgaaagagcaatttcttatttcatccacggtaatagtatagttagcattaccaggagacccagcatggcgtat

SEQ ID NO: 400523 - DNA, 140 bp, Artificial Sequence
  Synthetic
atacgccatgctgggtctccgtaaacaatacaggtaaggtcagcatgatattcaatcacagcagtgatggagatgcggagatagtaaatttacattttaactgtcatggggaattcttttcgtacttgggagtcggccat

SEQ ID NO: 400524 - DNA, 140 bp, Artificial Sequence
  Synthetic
atggccgactcccaagtacgaaaagaattccccatgacagttaaaatgtaaatttactatctccgcatctccatcactgctgtgattgaatatcatgctgaccttacctgtattgtttacggagacccagcatggcgtat

SEQ ID NO: 400525 - DNA, 140 bp, Artificial Sequence
  Synthetic
aggccctggctgctgatatgagatgcggagatagtaaatttacattttaactgtcatggggaattcttttattgtaacacatctaagatgtttaattatagcttctcatgtgtagaaaacgaccttttgggacagcggtg

SEQ ID NO: 400526 - DNA, 140 bp, Artificial Sequence
  Synthetic
caccgctgtcccaaaaggtcgttttctacacatgagaagctataattaaacatcttagatgtgttacaataaaagaattccccatgacagttaaaatgtaaatttactatctccgcatctcatatcagcagccagggcct

SEQ ID NO: 400527 - DNA, 140 bp, Artificial Sequence
  Synthetic
atacgccatgctgggtctccttgtaagctgagacaggtggtaaggtcatggatacagggagggtcgggaatctatgcacctcccatccaaggtaagctaagatgtgaatcaaacataactcgtacttgggagtcggccat

SEQ ID NO: 400528 - DNA, 140 bp, Artificial Sequence
  Synthetic
atggccgactcccaagtacgagttatgtttgattcacatcttagcttaccttggatgggaggtgcatagattcccgaccctccctgtatccatgaccttaccacctgtctcagcttacaaggagacccagcatggcgtat

SEQ ID NO: 400529 - DNA, 140 bp, Artificial Sequence
  Synthetic
atacgccatgctgggtctccaaccaaaaatgatagggggaattggaggttttatcaaagtaagacagtcatgttcaaatacccccttagaaatctgtgggcataaagctattggtacagtcgtacttgggagtcggccat

SEQ ID NO: 400530 - DNA, 140 bp, Artificial Sequence
  Synthetic
atggccgactcccaagtacgactgtaccaatagctttatgcccacagatttctaagggggtatttgaacatgactgtcttactttgataaaacctccaattccccctatcatttttggttggagacccagcatggcgtat

SEQ ID NO: 400531 - DNA, 140 bp, Artificial Sequence
  Synthetic
atacgccatgctgggtctccagctatagaaattaattgtacaagacccggcaataatacaagacaaagcataaggataggaccaggacaagcattctatgcaacaggagccataataggacgtacttgggagtcggccat

SEQ ID NO: 400532 - DNA, 140 bp, Artificial Sequence
  Synthetic
atggccgactcccaagtacgtcctattatggctcctgttgcatagaatgcttgtcctggtcctatccttatgctttgtcttgtattattgccgggtcttgtacaattaatttctatagctggagacccagcatggcgtat

SEQ ID NO: 400533 - DNA, 140 bp, Artificial Sequence
  Synthetic
aggccctggctgctgatatgtaaaatttgaaccacattcaggaggggacccagaaattacaacacatagctttaattgtggaggagaatttttctattgtaatacaacaaagctgtttaagaccttttgggacagcggtg

SEQ ID NO: 400534 - DNA, 140 bp, Artificial Sequence
  Synthetic
caccgctgtcccaaaaggtcttaaacagctttgttgtattacaatagaaaaattctcctccacaattaaagctatgtgttgtaatttctgggtcccctcctgaatgtggttcaaattttacatatcagcagccagggcct

SEQ ID NO: 400535 - DNA, 140 bp, Artificial Sequence
  Synthetic
atacgccatgctgggtctccaataatggtagtgctacctacaaggaggatgacatgaagggagaaataaaaaattgctctttcaatacaaccacagaactaagagataagaaacagcaaacgtacttgggagtcggccat

SEQ ID NO: 400536 - DNA, 140 bp, Artificial Sequence
  Synthetic
atggccgactcccaagtacgtttgctgtttcttatctcttagttctgtggttgtattgaaagagcaattttttatttctcccttcatgtcatcctccttgtaggtagcactaccattattggagacccagcatggcgtat

SEQ ID NO: 400537 - DNA, 140 bp, Artificial Sequence
  Synthetic
atacgccatgctgggtctccctgtggggctgtagaggaaggctagtctgctacacatcagtaccatggaatacatcatggacaggaaacgaaagcatttgggacctactaacatggcaggcgtacttgggagtcggccat

SEQ ID NO: 400538 - DNA, 140 bp, Artificial Sequence
  Synthetic
atggccgactcccaagtacgcctgccatgttagtaggtcccaaatgctttcgtttcctgtccatgatgtattccatggtactgatgtgtagcagactagccttcctctacagccccacagggagacccagcatggcgtat

SEQ ID NO: 400539 - DNA, 140 bp, Artificial Sequence
  Synthetic
aggccctggctgctgatatgctccaagcagtgaggatcatcaaaatcttatatcaaagcagtaagtatatgtaatgttaagttcaatgttaagttttctggcaagagtagattatagattgaccttttgggacagcggtg

SEQ ID NO: 400540 - DNA, 140 bp, Artificial Sequence
  Synthetic
caccgctgtcccaaaaggtcaatctataatctactcttgccagaaaacttaacattgaacttaacattacatatacttactgctttgatataagattttgatgatcctcactgcttggagcatatcagcagccagggcct

SEQ ID NO: 400541 - DNA, 140 bp, Artificial Sequence
  Synthetic
atacgccatgctgggtctcctctctagaacagatttggaataacacgacctggatggagtgggaaagagaagttaataattatacaggcttaatataccacttaattgaagagtcgcagacgtacttgggagtcggccat

SEQ ID NO: 400542 - DNA, 140 bp, Artificial Sequence
  Synthetic
atggccgactcccaagtacgtctgcgactcttcaattaagtggtatattaagcctgtataattattaacttctctttcccactccatccaggtcgtgttattccaaatctgttctagagaggagacccagcatggcgtat

SEQ ID NO: 400543 - DNA, 140 bp, Artificial Sequence
  Synthetic
aggccctggctgctgatatgattatcatgatagtacttaatctagtgaaaaacattaggcagggatatcaacccctctcgttacagatccccatccagcaccgggaggaagcagaagcgcgaccttttgggacagcggtg

SEQ ID NO: 400544 - DNA, 140 bp, Artificial Sequence
  Synthetic
caccgctgtcccaaaaggtcgcgcttctgcttcctcccggtgctggatggggatctgtaacgagaggggttgatatccctgcctaatgtttttcactagattaagtactatcatgataatcatatcagcagccagggcct

SEQ ID NO: 400545 - DNA, 140 bp, Artificial Sequence
  Synthetic
aggccctggctgctgatatgagaagaaggtggagaacaagacagagacacatccagttgcttagtagatggcttcttgacacttatctgggtcgacctgaagagcctgttcctcttcagcgaccttttgggacagcggtg

SEQ ID NO: 400546 - DNA, 140 bp, Artificial Sequence
  Synthetic
caccgctgtcccaaaaggtcgctgaagaggaacaggctcttcaggtcgacccagataagtgtcaagaagccatctactaagcaactggatgtgtctctgtcttgttctccaccttcttctcatatcagcagccagggcct

SEQ ID NO: 400547 - DNA, 140 bp, Artificial Sequence
  Synthetic
aggccctggctgctgatatggagtgatcagctatctgggacttggactggggatcctagggcagaagataattaatgcttgcagaatttgtggagcttttacacaatactggctacaagagaccttttgggacagcggtg

SEQ ID NO: 400548 - DNA, 140 bp, Artificial Sequence
  Synthetic
caccgctgtcccaaaaggtctcttgtagccagtattgtgtaaaagctccacaaattctgcaagcattaattatcttctgccctaggatccccagtccaagtcccagatagctgatcactccatatcagcagccagggcct

SEQ ID NO: 400549 - DNA, 140 bp, Artificial Sequence
  Synthetic
atacgccatgctgggtctccccaattggactgacagcataatctcaggaatacaaagaataggaagaggaattaggaacatcccaaggagaattagacagggctttgaacgagctttattcgtacttgggagtcggccat

SEQ ID NO: 400550 - DNA, 140 bp, Artificial Sequence
  Synthetic
atggccgactcccaagtacgaataaagctcgttcaaagccctgtctaattctccttgggatgttcctaattcctcttcctattctttgtattcctgagattatgctgtcagtccaattggggagacccagcatggcgtat

SEQ ID NO: 400551 - DNA, 140 bp, Artificial Sequence
  Synthetic
aggccctggctgctgatatgattaggaacatcccaaggagaattagacagggctttgaacgagctttattgtaacatgggaaacgtattgggaaaaggtaaatttgcaggatgggatagagaccttttgggacagcggtg

SEQ ID NO: 400552 - DNA, 140 bp, Artificial Sequence
  Synthetic
caccgctgtcccaaaaggtctctatcccatcctgcaaatttaccttttcccaatacgtttcccatgttacaataaagctcgttcaaagccctgtctaattctccttgggatgttcctaatcatatcagcagccagggcct

SEQ ID NO: 400553 - DNA, 140 bp, Artificial Sequence
  Synthetic
atacgccatgctgggtctccgaagggcgaagtctctaggggaggaagatgggtgcgagtgcgtctgtgttgacaggaagcaaattggatgcatgggaacaaattaggttaaagccaggatcgtacttgggagtcggccat

SEQ ID NO: 400554 - DNA, 140 bp, Artificial Sequence
  Synthetic
atggccgactcccaagtacgatcctggctttaacctaatttgttcccatgcatccaatttgcttcctgtcaacacagacgcactcgcacccatcttcctcccctagagacttcgcccttcggagacccagcatggcgtat

SEQ ID NO: 400555 - DNA, 140 bp, Artificial Sequence
  Synthetic
aggccctggctgctgatatgctaaaaagaaatatagactaaaacacttagtatgggcaagcagagagctggaaagattcgcatgtaatcctgagctactagaaactgcagagggtaatgagaccttttgggacagcggtg

SEQ ID NO: 400556 - DNA, 140 bp, Artificial Sequence
  Synthetic
caccgctgtcccaaaaggtctcattaccctctgcagtttctagtagctcaggattacatgcgaatctttccagctctctgcttgcccatactaagtgttttagtctatatttctttttagcatatcagcagccagggcct

SEQ ID NO: 400557 - DNA, 140 bp, Artificial Sequence
  Synthetic
  misc_feature (23)..(23): n is a, c, g, or t
  misc_feature (57)..(57): n is a, c, g, or t
  misc_feature (64)..(64): n is a, c, g, or t
  misc_feature (78)..(78): n is a, c, g, or t
  misc_feature (83)..(83): n is a, c, g, or t
  misc_feature (91)..(91): n is a, c, g, or t
atacgccatgctgggtctccganatgacacaatcacactcccatgcaaaataaaacnaattatnaacttgtggcaggnagtangaaaagcnatgtatgcccctcccatcagtggactaatcgtacttgggagtcggccat

SEQ ID NO: 400558 - DNA, 140 bp, Artificial Sequence
  Synthetic
  misc_feature (50)..(50): n is a, c, g, or t
  misc_feature (58)..(58): n is a, c, g, or t
  misc_feature (63)..(63): n is a, c, g, or t
  misc_feature (77)..(77): n is a, c, g, or t
  misc_feature (84)..(84): n is a, c, g, or t
  misc_feature (118)..(118): n is a, c, g, or t
atggccgactcccaagtacgattagtccactgatgggaggggcatacatngcttttcntactncctgccacaagttnataattngttttattttgcatgggagtgtgattgtgtcatntcggagacccagcatggcgtat

SEQ ID NO: 400559 - DNA, 140 bp, Artificial Sequence
  Synthetic
aggccctggctgctgatatgcatcaggccatctcccccaggactttaaatgcatgggtaaaggcagtagaagaaaaagcctttaaccctgaaatcattcctatgttcatggcattgtcaggaccttttgggacagcggtg

SEQ ID NO: 400560 - DNA, 140 bp, Artificial Sequence
  Synthetic
caccgctgtcccaaaaggtcctgacaatgccatgaacataggaatgatttcagggttaaaggctttttcttctactgcctttacccatgcatttaaagtcctgggggagatggcctgatgcatatcagcagccagggcct

SEQ ID NO: 400561 - DNA, 140 bp, Artificial Sequence
  Synthetic
aggccctggctgctgatatggaaaattttaacatgtggaaaaataacatggtagaacagatgcatgaggatataatcagtttatgggatcaaagcctaaagccatgtgtaaaattaacccgaccttttgggacagcggtg

SEQ ID NO: 400562 - DNA, 140 bp, Artificial Sequence
  Synthetic
caccgctgtcccaaaaggtcgggttaattttacacatggctttaggctttgatcccataaactgattatatcctcatgcatctgttctaccatgttatttttccacatgttaaaattttccatatcagcagccagggcct

SEQ ID NO: 400563 - DNA, 140 bp, Artificial Sequence
  Synthetic
aggccctggctgctgatatgactaggggatgctaaattggtaataacaacatattggggtctgcatacaggagaaagagactggcatttgggtcagggagtctccatagaatggaggaaagaccttttgggacagcggtg

SEQ ID NO: 400564 - DNA, 140 bp, Artificial Sequence
  Synthetic
caccgctgtcccaaaaggtctttcctccattctatggagactccctgacccaaatgccagtctctttctcctgtatgcagaccccaatatgttgttattaccaatttagcatcccctagtcatatcagcagccagggcct

SEQ ID NO: 400565 - DNA, 140 bp, Artificial Sequence
  Synthetic
atacgccatgctgggtctccttagaagagatgatggtagcctgtcagggagtaggaggaccaactcataaggccagagtgctagcagaagcaatggctacagcccagcaagatttgaaagcgtacttgggagtcggccat

SEQ ID NO: 400566 - DNA, 140 bp, Artificial Sequence
  Synthetic
atggccgactcccaagtacgctttcaaatcttgctgggctgtagccattgcttctgctagcactctggccttatgagttggtcctcctactccctgacaggctaccatcatctcttctaaggagacccagcatggcgtat

SEQ ID NO: 400567 - DNA, 140 bp, Artificial Sequence
  Synthetic
atacgccatgctgggtctcccaaagaaaccccttagagactatgtagacaggtcttataaaactctaagagctgagcaggctacacaggagttaaagaattggatgacagacaccttgttcgtacttgggagtcggccat

SEQ ID NO: 400568 - DNA, 140 bp, Artificial Sequence
  Synthetic
atggccgactcccaagtacgaacaaggtgtctgtcatccaattctttaactcctgtgtagcctgctcagctcttagagttttataagacctgtctacatagtctctaaggggtttctttgggagacccagcatggcgtat

SEQ ID NO: 400569 - DNA, 140 bp, Artificial Sequence
  Synthetic
aggccctggctgctgatatgtgagaccccaggaataagataccagtacaatgtcctcccgcaaggatggaaaggttcaccagctatattccaaagttcaatgacaaaaattctagatccagaccttttgggacagcggtg

SEQ ID NO: 400570 - DNA, 140 bp, Artificial Sequence
  Synthetic
caccgctgtcccaaaaggtctggatctagaatttttgtcattgaactttggaatatagctggtgaacctttccatccttgcgggaggacattgtactggtatcttattcctggggtctcacatatcagcagccagggcct

SEQ ID NO: 400571 - DNA, 140 bp, Artificial Sequence
  Synthetic
aggccctggctgctgatatgagaactcaagatttttgggaggttcaattaggaataccacatcctgcagggttaaaaaagaaaaaatcagtaacagtactggatgtgggggatgcatattgaccttttgggacagcggtg

SEQ ID NO: 400572 - DNA, 140 bp, Artificial Sequence
  Synthetic
caccgctgtcccaaaaggtcaatatgcatcccccacatccagtactgttactgattttttcttttttaaccctgcaggatgtggtattcctaattgaacctcccaaaaatcttgagttctcatatcagcagccagggcct

SEQ ID NO: 400573 - DNA, 140 bp, Artificial Sequence
  Synthetic
atacgccatgctgggtctccactgatgctgattggaagaataatactaataccaatagtggagagggaaaggcagagagaggagaaataaaaaactgctctttcaaggtcaccacaagcgcgtacttgggagtcggccat

SEQ ID NO: 400574 - DNA, 140 bp, Artificial Sequence
  Synthetic
atggccgactcccaagtacgcgcttgtggtgaccttgaaagagcagttttttatttctcctctctctgcctttccctctccactattggtattagtattattcttccaatcagcatcagtggagacccagcatggcgtat

SEQ ID NO: 400575 - DNA, 140 bp, Artificial Sequence
  Synthetic
atacgccatgctgggtctccactgagactgctcccgctaatagtagctggacttacaatagtagtagcttaagggaagaagtaaaaaactgctctttcaatgtcaccacaaacataagagcgtacttgggagtcggccat

SEQ ID NO: 400576 - DNA, 140 bp, Artificial Sequence
  Synthetic
atggccgactcccaagtacgctcttatgtttgtggtgacattgaaagagcagttttttacttcttcccttaagctactactattgtaagtccagctactattagcgggagcagtctcagtggagacccagcatggcgtat

SEQ ID NO: 400577 - DNA, 140 bp, Artificial Sequence
  Synthetic
atacgccatgctgggtctccgacttaccagatatatcaggaagaacataagaacctcaaaacagggaaatatactaggcaaaaggcctcccacacaaatgatataagacaattagcagaacgtacttgggagtcggccat

SEQ ID NO: 400578 - DNA, 140 bp, Artificial Sequence
  Synthetic
atggccgactcccaagtacgttctgctaattgtcttatatcatttgtgtgggaggccttttgcctagtatatttccctgttttgaggttcttatgttcttcctgatatatctggtaagtcggagacccagcatggcgtat

SEQ ID NO: 400579 - DNA, 140 bp, Artificial Sequence
  Synthetic
aggccctggctgctgatatggtccaaaatgcgaacccagattgtaagaccattttaagagcattaggaccaggggctacattagaagaaatgatgacagcatgtcagggagtgggaggacgaccttttgggacagcggtg

SEQ ID NO: 400580 - DNA, 140 bp, Artificial Sequence
  Synthetic
caccgctgtcccaaaaggtcgtcctcccactccctgacatgctgtcatcatttcttctaatgtagcccctggtcctaatgctcttaaaatggtcttacaatctgggttcgcattttggaccatatcagcagccagggcct

SEQ ID NO: 400581 - DNA, 140 bp, Artificial Sequence
  Synthetic
atacgccatgctgggtctcctacaagacccagcaataatacaagaaggagtatacatatagcaccagggagagcattttatacaacaggagccataataggagacataagacaagcacatcgtacttgggagtcggccat

SEQ ID NO: 400582 - DNA, 140 bp, Artificial Sequence
  Synthetic
atggccgactcccaagtacgatgtgcttgtcttatgtctcctattatggctcctgttgtataaaatgctctccctggtgctatatgtatactccttcttgtattattgctgggtcttgtaggagacccagcatggcgtat

SEQ ID NO: 400583 - DNA, 140 bp, Artificial Sequence
  Synthetic
aggccctggctgctgatatggccaaagaagagaaagccacctctgcctagtgtgcagaaattagtagaggatagatggaacaacccccagaagaccaggggccacagagggagccatacagaccttttgggacagcggtg

SEQ ID NO: 400584 - DNA, 140 bp, Artificial Sequence
  Synthetic
caccgctgtcccaaaaggtctgtatggctccctctgtggcccctggtcttctgggggttgttccatctatcctctactaatttctgcacactaggcagaggtggctttctcttctttggccatatcagcagccagggcct

SEQ ID NO: 400585 - DNA, 140 bp, Artificial Sequence
  Synthetic
aggccctggctgctgatatgtaaccccactctgtgttactttaaattgcactaatttcaagaataatgctaatgccacagggaatagtagtacccacagagtactactactgccaataatgaccttttgggacagcggtg

SEQ ID NO: 400586 - DNA, 140 bp, Artificial Sequence
  Synthetic
caccgctgtcccaaaaggtcattattggcagtagtagtactctgtgggtactactattccctgtggcattagcattattcttgaaattagtgcaatttaaagtaacacagagtggggttacatatcagcagccagggcct

SEQ ID NO: 400587 - DNA, 140 bp, Artificial Sequence
  Synthetic
  misc_feature (108)..(108): n is a, c, g, or t
atacgccatgctgggtctccaagataaggtgcagagagaatctgcagttttttataaatctgaattagaaccaataggtaagaatacatattatactagctataatanctatatattgatcgtacttgggagtcggccat

SEQ ID NO: 400588 - DNA, 140 bp, Artificial Sequence
  Synthetic
  misc_feature (33)..(33): n is a, c, g, or t
atggccgactcccaagtacgatcaatatatagntattatagctagtataatatgtattcttacctattggttctaattcagatttataaaaaactgcagattctctctgcaccttatcttggagacccagcatggcgtat

SEQ ID NO: 400589 - DNA, 140 bp, Artificial Sequence
  Synthetic
  misc_feature (58)..(58): n is a, c, g, or t
aggccctggctgctgatatgccaataggtaagaatacatattatactagctataatanctatatattgatacattgtaatacctcaaccattacacaggcttgtccaaaggtatcttggagaccttttgggacagcggtg

SEQ ID NO: 400590 - DNA, 140 bp, Artificial Sequence
  Synthetic
  misc_feature (83)..(83): n is a, c, g, or t
caccgctgtcccaaaaggtctccaagatacctttggacaagcctgtgtaatggttgaggtattacaatgtatcaatatatagntattatagctagtataatatgtattcttacctattggcatatcagcagccagggcct

SEQ ID NO: 400591 - DNA, 140 bp, Artificial Sequence
  Synthetic
aggccctggctgctgatatgatccacaaagtcaaggagtagtagaagccatgaataaggaattaaaatcaattatacagcaggtgagggaccaagcagaacacttaagaacagcagtacagaccttttgggacagcggtg

SEQ ID NO: 400592 - DNA, 140 bp, Artificial Sequence
  Synthetic
caccgctgtcccaaaaggtctgtactgctgttcttaagtgttctgcttggtccctcacctgctgtataattgattttaattccttattcatggcttctactactccttgactttgtggatcatatcagcagccagggcct

SEQ ID NO: 400593 - DNA, 140 bp, Artificial Sequence
  Synthetic
  misc_feature (97)..(97): n is a, c, g, or t
  misc_feature (100)..(100): n is a, c, g, or t
aggccctggctgctgatatgattacaatttacacatggaattagcccattattatcaactcaactgcttttaaaccgcaccctagcagaagaagagntantaatcagatctgtcaatttcgaccttttgggacagcggtg

SEQ ID NO: 400594 - DNA, 140 bp, Artificial Sequence
  Synthetic
  misc_feature (41)..(41): n is a, c, g, or t
  misc_feature (44)..(44): n is a, c, g, or t
caccgctgtcccaaaaggtcgaaattgacagatctgattantanctcttcttctgctagggtgcggtttaaaagcagttgagttgataataatgggctaattccatgtgtaaattgtaatcatatcagcagccagggcct

SEQ ID NO: 400595 - DNA, 140 bp, Artificial Sequence
  Synthetic
  misc_feature (32)..(32): n is a, c, g, or t
  misc_feature (34)..(34): n is a, c, g, or t
  misc_feature (45)..(45): n is a, c, g, or t
  misc_feature (58)..(58): n is a, c, g, or t
  misc_feature (70)..(70): n is a, c, g, or t
atacgccatgctgggtctcctaacaaattaananaacaatttggnaataaaacaatancctttaagcaancctcaggaggggacgcagaaattgtaatgcacacttttaattgtggagggcgtacttgggagtcggccat

SEQ ID NO: 400596 - DNA, 140 bp, Artificial Sequence
  Synthetic
  misc_feature (71)..(71): n is a, c, g, or t
  misc_feature (83)..(83): n is a, c, g, or t
  misc_feature (96)..(96): n is a, c, g, or t
  misc_feature (107)..(107): n is a, c, g, or t
  misc_feature (109)..(109): n is a, c, g, or t
atggccgactcccaagtacgccctccacaattaaaagtgtgcattacaatttctgcgtcccctcctgaggnttgcttaaaggntattgttttattnccaaattgttntnttaatttgttaggagacccagcatggcgtat

SEQ ID NO: 400597 - DNA, 140 bp, Artificial Sequence
  Synthetic
aggccctggctgctgatatgcctcaggaggggacgcagaaattgtaatgcacacttttaattgtggaggggagtttttcttctgtaatacaacacaactgttcaatagtacttggacatagaccttttgggacagcggtg

SEQ ID NO: 400598 - DNA, 140 bp, Artificial Sequence
  Synthetic
caccgctgtcccaaaaggtctatgtccaagtactattgaacagttgtgttgtattacagaagaaaaactcccctccacaattaaaagtgtgcattacaatttctgcgtcccctcctgaggcatatcagcagccagggcct

SEQ ID NO: 400599 - DNA, 140 bp, Artificial Sequence
  Synthetic
atacgccatgctgggtctcccactcccatgcagaataaaacaaattgtacacatgtggcagagagtaggaaaagcaatgtacgcccctcccatcgaaggaaacattagctgttcatcaaacgtacttgggagtcggccat

SEQ ID NO: 400600 - DNA, 140 bp, Artificial Sequence
  Synthetic
atggccgactcccaagtacgtttgatgaacagctaatgtttccttcgatgggaggggcgtacattgcttttcctactctctgccacatgtgtacaatttgttttattctgcatgggagtgggagacccagcatggcgtat

SEQ ID NO: 400601 - DNA, 140 bp, Artificial Sequence
  Synthetic
aggccctggctgctgatatgtgggcactagagctcttagaagagctaaaagcagaagcagtaagacatttccctaggccttggctacacgccttgggacaatacatttatgagacttatggaccttttgggacagcggtg

SEQ ID NO: 400602 - DNA, 140 bp, Artificial Sequence
  Synthetic
caccgctgtcccaaaaggtccataagtctcataaatgtattgtcccaaggcgtgtagccaaggcctagggaaatgtcttactgcttctgcttttagctcttctaagagctctagtgcccacatatcagcagccagggcct

SEQ ID NO: 400603 - DNA, 140 bp, Artificial Sequence
  Synthetic
aggccctggctgctgatatgaatagtttttgctatattgtctatagtgaatagagttaggcaggggtactcaccattatcattacagaccctcctcccaaccccgaggggactcgacagggaccttttgggacagcggtg

SEQ ID NO: 400604 - DNA, 140 bp, Artificial Sequence
  Synthetic
caccgctgtcccaaaaggtccctgtcgagtcccctcggggttgggaggagggtctgtaatgataatggtgagtacccctgcctaactctattcactatagacaatatagcaaaaactattcatatcagcagccagggcct

SEQ ID NO: 400605 - DNA, 140 bp, Artificial Sequence
  Synthetic
atacgccatgctgggtctcctgggaatctcctatggcaggaagaagcgaggacgaccagctgctgcaagccatccagatcataaagatcctgtaccaaagcagtaagtaacgctaatgcacgtacttgggagtcggccat

SEQ ID NO: 400606 - DNA, 140 bp, Artificial Sequence
  Synthetic
atggccgactcccaagtacgtgcattagcgttacttactgctttggtacaggatctttatgatctggatggcttgcagcagctggtcgtcctcgcttcttcctgccataggagattcccaggagacccagcatggcgtat

SEQ ID NO: 400607 - DNA, 140 bp, Artificial Sequence
  Synthetic
aggccctggctgctgatatgtatcacctagaactttaaatgcatgggtaaaagtagtagaagagaaggctttcagcccagaagtaatacccatgttttcagcattatcagaaggagccacgaccttttgggacagcggtg

SEQ ID NO: 400608 - DNA, 140 bp, Artificial Sequence
  Synthetic
caccgctgtcccaaaaggtcgtggctccttctgataatgctgaaaacatgggtattacttctgggctgaaagccttctcttctactacttttacccatgcatttaaagttctaggtgatacatatcagcagccagggcct

SEQ ID NO: 400609 - DNA, 140 bp, Artificial Sequence
  Synthetic
aggccctggctgctgatatgatgatatggtggatcagatgcatgaggatgtaatcagtttatgggaccaaagcctaaagccatgtgtaaagttgaccccactttgtgtcactttaaactggaccttttgggacagcggtg

SEQ ID NO: 400610 - DNA, 140 bp, Artificial Sequence
  Synthetic
caccgctgtcccaaaaggtccagtttaaagtgacacaaagtggggtcaactttacacatggctttaggctttggtcccataaactgattacatcctcatgcatctgatccaccatatcatcatatcagcagccagggcct

SEQ ID NO: 400611 - DNA, 140 bp, Artificial Sequence
  Synthetic
aggccctggctgctgatatgcagtagcaaccctctattgtgtacagcaaaagatagagttaaaagacaccaaggaagctttagataagatagaggaagagcaacacaaaagcaagaaaaagaccttttgggacagcggtg

SEQ ID NO: 400612 - DNA, 140 bp, Artificial Sequence
  Synthetic
caccgctgtcccaaaaggtctttttcttgcttttgtgttgctcttcctctatcttatctaaagcttccttggtgtcttttaactctatcttttgctgtacacaatagagggttgctactgcatatcagcagccagggcct

SEQ ID NO: 400613 - DNA, 140 bp, Artificial Sequence
  Synthetic
atacgccatgctgggtctcctacaaacatagctggaacaacaaatgaaaaccttatgaagaagtgtgagtttaatgtaaccactgttatcaaagacaaaaaggagaaaaaacaggctctacgtacttgggagtcggccat

SEQ ID NO: 400614 - DNA, 140 bp, Artificial Sequence
  Synthetic
atggccgactcccaagtacgtagagcctgttttttctcctttttgtctttgataacagtggttacattaaactcacacttcttcataaggttttcatttgttgttccagctatgtttgtaggagacccagcatggcgtat

SEQ ID NO: 400615 - DNA, 140 bp, Artificial Sequence
  Synthetic
  misc_feature (31)..(31): n is a, c, g, or t
  misc_feature (48)..(48): n is a, c, g, or t
  misc_feature (90)..(90): n is a, c, g, or t
  misc_feature (96)..(96): n is a, c, g, or t
atacgccatgctgggtctccacaagacccgncaacaatacaagaaagngtatacacataggaccagggagagcattttatacaataggantaacangagatataagaaaagcacattgtacgtacttgggagtcggccat

SEQ ID NO: 400616 - DNA, 140 bp, Artificial Sequence
  Synthetic
  misc_feature (45)..(45): n is a, c, g, or t
  misc_feature (51)..(51): n is a, c, g, or t
  misc_feature (93)..(93): n is a, c, g, or t
  misc_feature (110)..(110): n is a, c, g, or t
atggccgactcccaagtacgtacaatgtgcttttcttatatctcntgttantcctattgtataaaatgctctccctggtcctatgtgtatacnctttcttgtattgttgncgggtcttgtggagacccagcatggcgtat

SEQ ID NO: 400617 - DNA, 140 bp, Artificial Sequence
  Synthetic
aggccctggctgctgatatggctccagcaggatatgctatctttaagtgtaacagcacagaatttaatggaacaggcacatgcagaaacataacggtagttacttgtacacatggcattagaccttttgggacagcggtg

SEQ ID NO: 400618 - DNA, 140 bp, Artificial Sequence
  Synthetic
caccgctgtcccaaaaggtctaatgccatgtgtacaagtaactaccgttatgtttctgcatgtgcctgttccattaaattctgtgctgttacacttaaagatagcatatcctgctggagccatatcagcagccagggcct

SEQ ID NO: 400619 - DNA, 140 bp, Artificial Sequence
  Synthetic
atacgccatgctgggtctccaacaggcacatgcagaaacataacggtagttacttgtacacatggcattaggccaacagtaagtactcagctaatattaaatgggacactctctaaaggacgtacttgggagtcggccat

SEQ ID NO: 400620 - DNA, 140 bp, Artificial Sequence
  Synthetic
atggccgactcccaagtacgtcctttagagagtgtcccatttaatattagctgagtacttactgttggcctaatgccatgtgtacaagtaactaccgttatgtttctgcatgtgcctgttggagacccagcatggcgtat

SEQ ID NO: 400621 - DNA, 140 bp, Artificial Sequence
  Synthetic
atacgccatgctgggtctccagtgaccctaaactctaccctaaacatgacctgtgaaagaccacaaatagacatacaagagatgagaataggtccaatggcctggtacagcatgggaatacgtacttgggagtcggccat

SEQ ID NO: 400622 - DNA, 140 bp, Artificial Sequence
  Synthetic
atggccgactcccaagtacgtattcccatgctgtaccaggccattggacctattctcatctcttgtatgtctatttgtggtctttcacaggtcatgtttagggtagagtttagggtcactggagacccagcatggcgtat

SEQ ID NO: 400623 - DNA, 140 bp, Artificial Sequence
  Synthetic
atacgccatgctgggtctccagtacatctgaatcaatctgtagaaattaattgtacaagacccaacaacaatacaagaaaaagtatacctatgggaccaggcaaagcattttttacaacacgtacttgggagtcggccat

SEQ ID NO: 400624 - DNA, 140 bp, Artificial Sequence
  Synthetic
atggccgactcccaagtacgtgttgtaaaaaatgctttgcctggtcccataggtatactttttcttgtattgttgttgggtcttgtacaattaatttctacagattgattcagatgtactggagacccagcatggcgtat

SEQ ID NO: 400625 - DNA, 140 bp, Artificial Sequence
  Synthetic
aggccctggctgctgatatgatacaagaaaaagtatacctatgggaccaggcaaagcattttttacaacaggaagcataatagggaatataagacaagcacattgcaaccttagtagagcgaccttttgggacagcggtg

SEQ ID NO: 400626 - DNA, 140 bp, Artificial Sequence
  Synthetic
caccgctgtcccaaaaggtcgctctactaaggttgcaatgtgcttgtcttatattccctattatgcttcctgttgtaaaaaatgctttgcctggtcccataggtatactttttcttgtatcatatcagcagccagggcct

SEQ ID NO: 400627 - DNA, 140 bp, Artificial Sequence
  Synthetic
atacgccatgctgggtctcctagtaaacaatacaggtagtattaacatgacattcaatcacagcagcggtggagatctagaggtaacccatttacactttaactgtcatggagaattcttcgtacttgggagtcggccat

SEQ ID NO: 400628 - DNA, 140 bp, Artificial Sequence
  Synthetic
atggccgactcccaagtacgaagaattctccatgacagttaaagtgtaaatgggttacctctagatctccaccgctgctgtgattgaatgtcatgttaatactacctgtattgtttactaggagacccagcatggcgtat

SEQ ID NO: 400629 - DNA, 140 bp, Artificial Sequence
  Synthetic
aggccctggctgctgatatgttaaagataaaacaataatctttaatcaatcctcaggaggggacccagaaattgtaatgcacagttttaattgtagaggggaattcttctattgtaatacgaccttttgggacagcggtg

SEQ ID NO: 400630 - DNA, 140 bp, Artificial Sequence
  Synthetic
caccgctgtcccaaaaggtcgtattacaatagaagaattcccctctacaattaaaactgtgcattacaatttctgggtcccctcctgaggattgattaaagattattgttttatctttaacatatcagcagccagggcct

SEQ ID NO: 400631 - DNA, 140 bp, Artificial Sequence
  Synthetic
aggccctggctgctgatatggctttagacaagatagaggaagagcaaaacaaatgtaagaaacaagcacagcaagcaacagccaacacaggaaacagcagccagatgagtcagaattttcgaccttttgggacagcggtg

SEQ ID NO: 400632 - DNA, 140 bp, Artificial Sequence
  Synthetic
caccgctgtcccaaaaggtcgaaaattctgactcatctggctgctgtttcctgtgttggctgttgcttgctgtgcttgtttcttacatttgttttgctcttcctctatcttgtctaaagccatatcagcagccagggcct

SEQ ID NO: 400633 - DNA, 140 bp, Artificial Sequence
  Synthetic
atacgccatgctgggtctccccacctgtagtgttagtaatgttagtcaaggtaacaatggcactctaccttgcaaactgagacaggtggtaaggtcatggataaggggacagtcgggactcgtacttgggagtcggccat

SEQ ID NO: 400634 - DNA, 140 bp, Artificial Sequence
  Synthetic
atggccgactcccaagtacgagtcccgactgtccccttatccatgaccttaccacctgtctcagtttgcaaggtagagtgccattgttaccttgactaacattactaacactacaggtggggagacccagcatggcgtat

SEQ ID NO: 400635 - DNA, 140 bp, Artificial Sequence
  Synthetic
aggccctggctgctgatatgtgcaaactgagacaggtggtaaggtcatggataaggggacagtcgggactctatgcacctcccatcaaaggtaatctaacatgtatgtcaaacataactggaccttttgggacagcggtg

SEQ ID NO: 400636 - DNA, 140 bp, Artificial Sequence
  Synthetic
caccgctgtcccaaaaggtccagttatgtttgacatacatgttagattacctttgatgggaggtgcatagagtcccgactgtccccttatccatgaccttaccacctgtctcagtttgcacatatcagcagccagggcct

SEQ ID NO: 400637 - DNA, 140 bp, Artificial Sequence
  Synthetic
atacgccatgctgggtctccacatttagaccaatagggggagacatgaaagatatatggagaactgaattgttcaactacaaagtagtaagggtaaaaccttttagtgtggcacccacaccgtacttgggagtcggccat

SEQ ID NO: 400638 - DNA, 140 bp, Artificial Sequence
  Synthetic
atggccgactcccaagtacggtgtgggtgccacactaaaaggttttacccttactactttgtagttgaacaattcagttctccatatatctttcatgtctccccctattggtctaaatgtggagacccagcatggcgtat

SEQ ID NO: 400639 - DNA, 140 bp, Artificial Sequence
  Synthetic
atacgccatgctgggtctccggatcggcagataagcaacataagctccaccatatatgaggaaatacaaaaggcacaagtacagcaggaacaaaatgagaaaaagttgctggagttagatcgtacttgggagtcggccat

SEQ ID NO: 400640 - DNA, 140 bp, Artificial Sequence
  Synthetic
atggccgactcccaagtacgatctaactccagcaactttttctcattttgttcctgctgtacttgtgccttttgtatttcctcatatatggtggagcttatgttgcttatctgccgatccggagacccagcatggcgtat

SEQ ID NO: 400641 - DNA, 140 bp, Artificial Sequence
  Synthetic
aggccctggctgctgatatgaggcacaagtacagcaggaacaaaatgagaaaaagttgctggagttagatgaatgggcctctatttggaattggcttgacataactaaatggttgtggtagaccttttgggacagcggtg

SEQ ID NO: 400642 - DNA, 140 bp, Artificial Sequence
  Synthetic
caccgctgtcccaaaaggtctaccacaaccatttagttatgtcaagccaattccaaatagaggcccattcatctaactccagcaactttttctcattttgttcctgctgtacttgtgcctcatatcagcagccagggcct

SEQ ID NO: 400643 - DNA, 140 bp, Artificial Sequence
  Synthetic
aggccctggctgctgatatgttaggaagggatactcaccattatcgttccagacccgcctcccagctcagaggggacccgacaggcccggaggaacagaagaagaaggtggagagcaagagaccttttgggacagcggtg

SEQ ID NO: 400644 - DNA, 140 bp, Artificial Sequence
  Synthetic
caccgctgtcccaaaaggtctcttgctctccaccttcttcttctgttcctccgggcctgtcgggtcccctctgagctgggaggcgggtctggaacgataatggtgagtatcccttcctaacatatcagcagccagggcct

SEQ ID NO: 400645 - DNA, 140 bp, Artificial Sequence
  Synthetic
atacgccatgctgggtctcctcatgatagtacttaatatagtgaaaaacattaggcagggatatcaacccctctcgttacagatccccaaccatcaccaagaggaagcaggaacgccaggcgtacttgggagtcggccat

SEQ ID NO: 400646 - DNA, 140 bp, Artificial Sequence
  Synthetic
atggccgactcccaagtacgcctggcgttcctgcttcctcttggtgatggttggggatctgtaacgagaggggttgatatccctgcctaatgtttttcactatattaagtactatcatgaggagacccagcatggcgtat

SEQ ID NO: 400647 - DNA, 140 bp, Artificial Sequence
  Synthetic
aggccctggctgctgatatgagctatcctccacatacctagaagaataagacagggctttgaagtagctttgctataaaatgggaagcaaatggtcaaaaagcagtatagttgggtggccgaccttttgggacagcggtg

SEQ ID NO: 400648 - DNA, 140 bp, Artificial Sequence
  Synthetic
caccgctgtcccaaaaggtcggccacccaactatactgctttttgaccatttgcttcccattttatagcaaagctacttcaaagccctgtcttattcttctaggtatgtggaggatagctcatatcagcagccagggcct

SEQ ID NO: 400649 - DNA, 140 bp, Artificial Sequence
  Synthetic
  misc_feature (115)..(115): n is a, c, g, or t
aggccctggctgctgatatgttggactgacaacattatctcaggtgtgcaaaggataggaagaggaattcttaacatcccaaggagaattagacagggtgcagaaagaatcttantataagaccttttgggacagcggtg

SEQ ID NO: 400650 - DNA, 140 bp, Artificial Sequence
  Synthetic
  misc_feature (26)..(26): n is a, c, g, or t
caccgctgtcccaaaaggtcttatantaagattctttctgcaccctgtctaattctccttgggatgttaagaattcctcttcctatcctttgcacacctgagataatgttgtcagtccaacatatcagcagccagggcct

SEQ ID NO: 400651 - DNA, 140 bp, Artificial Sequence
  Synthetic
atacgccatgctgggtctccttggactgacggcataatcgcagggatacaaagaataggaacaggaattcgtaacatcccaaggagaattagacagggcttagaaagaagtttattgtaacgtacttgggagtcggccat

SEQ ID NO: 400652 - DNA, 140 bp, Artificial Sequence
  Synthetic
atggccgactcccaagtacgttacaataaacttctttctaagccctgtctaattctccttgggatgttacgaattcctgttcctattctttgtatccctgcgattatgccgtcagtccaaggagacccagcatggcgtat

SEQ ID NO: 400653 - DNA, 140 bp, Artificial Sequence
  Synthetic
  misc_feature (100)..(100): n is a, c, g, or t
atacgccatgctgggtctcccggggggcagttacaagcagcaatactgcagctactaatcctgatgtggcctgggtggaagcacaagaggaagaaggggnagtaggctttccagtcagaccgtacttgggagtcggccat

SEQ ID NO: 400654 - DNA, 140 bp, Artificial Sequence
  Synthetic
  misc_feature (41)..(41): n is a, c, g, or t
atggccgactcccaagtacggtctgactggaaagcctactnccccttcttcctcttgtgcttccacccaggccacatcaggattagtagctgcagtattgctgcttgtaactgccccccgggagacccagcatggcgtat

SEQ ID NO: 400655 - DNA, 140 bp, Artificial Sequence
  Synthetic
aggccctggctgctgatatgcttccctaataaaacaataacatttaatacatcctcaggaggagatctagaaattacaacacatagttttaattgtagaggagaatttttctattgcgatgaccttttgggacagcggtg

SEQ ID NO: 400656 - DNA, 140 bp, Artificial Sequence
  Synthetic
caccgctgtcccaaaaggtcatcgcaatagaaaaattctcctctacaattaaaactatgtgttgtaatttctagatctcctcctgaggatgtattaaatgttattgttttattagggaagcatatcagcagccagggcct

SEQ ID NO: 400657 - DNA, 140 bp, Artificial Sequence
  Synthetic
aggccctggctgctgatatgaaaaattacaaaaattgggcctgaaaatccatataacactccagtatttgccataaaaaagaaggacagtactaagtggagaaaattagtagatttcagggaccttttgggacagcggtg

SEQ ID NO: 400658 - DNA, 140 bp, Artificial Sequence
  Synthetic
caccgctgtcccaaaaggtccctgaaatctactaattttctccacttagtactgtccttcttttttatggcaaatactggagtgttatatggattttcaggcccaatttttgtaatttttcatatcagcagccagggcct

SEQ ID NO: 400659 - DNA, 140 bp, Artificial Sequence
  Synthetic
atacgccatgctgggtctcccaaataatgggacagttgcaaccagctctcaagacaggaacagaggagattagatcattatttaatacagtagcaacactctattgtgtacatcaaaagacgtacttgggagtcggccat

SEQ ID NO: 400660 - DNA, 140 bp, Artificial Sequence
  Synthetic
atggccgactcccaagtacgtcttttgatgtacacaatagagtgttgctactgtattaaataatgatctaatctcctctgttcctgtcttgagagctggttgcaactgtcccattatttgggagacccagcatggcgtat

SEQ ID NO: 400661 - DNA, 140 bp, Artificial Sequence
  Synthetic
aggccctggctgctgatatgagcaactctctattgtgtacatgaaaagatagaggtacgagacaccaaggaagccttagacaagatagaggaagaacaaaacaaaagtcagcaaaaaacagaccttttgggacagcggtg

SEQ ID NO: 400662 - DNA, 140 bp, Artificial Sequence
  Synthetic
caccgctgtcccaaaaggtctgttttttgctgacttttgttttgttcttcctctatcttgtctaaggcttccttggtgtctcgtacctctatcttttcatgtacacaatagagagttgctcatatcagcagccagggcct

SEQ ID NO: 400663 - DNA, 140 bp, Artificial Sequence
  Synthetic
aggccctggctgctgatatggcggcgactggtgagtacgccaattttatttgactagcggaggctagaaggagagagatgggtgcgagagcgtcaatattaagaggaggaaaattagatagaccttttgggacagcggtg

SEQ ID NO: 400664 - DNA, 140 bp, Artificial Sequence
  Synthetic
caccgctgtcccaaaaggtctatctaattttcctcctcttaatattgacgctctcgcacccatctctctccttctagcctccgctagtcaaataaaattggcgtactcaccagtcgccgccatatcagcagccagggcct

SEQ ID NO: 400665 - DNA, 140 bp, Artificial Sequence
  Synthetic
  misc_feature (83)..(83): n is a, c, g, or t
aggccctggctgctgatatgtatcaagttatagacacgcaggaggcaatacaaaagttaaaggaagtcatggggagcaggaantctgcggaggccgctaaagaaaacaaaagcacaaagcgaccttttgggacagcggtg

SEQ ID NO: 400666 - DNA, 140 bp, Artificial Sequence
  Synthetic
  misc_feature (58)..(58): n is a, c, g, or t
caccgctgtcccaaaaggtcgctttgtgcttttgttttctttagcggcctccgcaganttcctgctccccatgacttcctttaacttttgtattgcctcctgcgtgtctataacttgatacatatcagcagccagggcct

SEQ ID NO: 400667 - DNA, 140 bp, Artificial Sequence
  Synthetic
atacgccatgctgggtctccgtggcgcgcgaacagggactagaaagcgaaagtagacccagaggagctctctcggacgcaggactcggcttgctgaagcgcgcacggcaagaggcgagggcgtacttgggagtcggccat

SEQ ID NO: 400668 - DNA, 140 bp, Artificial Sequence
  Synthetic
atggccgactcccaagtacgccctcgcctcttgccgtgcgcgcttcagcaagccgagtcctgcgtccgagagagctcctctgggtctactttcgctttctagtccctgttcgcgcgccacggagacccagcatggcgtat

SEQ ID NO: 400669 - DNA, 140 bp, Artificial Sequence
  Synthetic
atacgccatgctgggtctccagattgggatagaactcacccaccaccggtagggccgttgccaccagggcagataagggaaccaacaggaagtgacattgctggaacaactagcacccagcgtacttgggagtcggccat

SEQ ID NO: 400670 - DNA, 140 bp, Artificial Sequence
  Synthetic
atggccgactcccaagtacgctgggtgctagttgttccagcaatgtcacttcctgttggttcccttatctgccctggtggcaacggccctaccggtggtgggtgagttctatcccaatctggagacccagcatggcgtat

SEQ ID NO: 400671 - DNA, 140 bp, Artificial Sequence
  Synthetic
atacgccatgctgggtctccaatgctactaatgccaatagtagtaaagtagagggaggagaaataaaaaactgctctttcaatatcaccacaaacatgagagataagatgcagaaagtatcgtacttgggagtcggccat

SEQ ID NO: 400672 - DNA, 140 bp, Artificial Sequence
  Synthetic
atggccgactcccaagtacgatactttctgcatcttatctctcatgtttgtggtgatattgaaagagcagttttttatttctcctccctctactttactactattggcattagtagcattggagacccagcatggcgtat

SEQ ID NO: 400673 - DNA, 140 bp, Artificial Sequence
  Synthetic
aggccctggctgctgatatgaatggaggaaaaagagatatagcacacaagtagaccctgacctagcagaccaactaattcatctgtattattttgattgtttttcagaatctgctataaggaccttttgggacagcggtg

SEQ ID NO: 400674 - DNA, 140 bp, Artificial Sequence
  Synthetic
caccgctgtcccaaaaggtccttatagcagattctgaaaaacaatcaaaataatacagatgaattagttggtctgctaggtcagggtctacttgtgtgctatatctctttttcctccattcatatcagcagccagggcct

SEQ ID NO: 400675 - DNA, 140 bp, Artificial Sequence
  Synthetic
aggccctggctgctgatatgaagacccaacaacaatacaagaaaaagtatacctataggaccagggagagcattttatacaacaggagacataataggagatataagacaagcatattgtgaccttttgggacagcggtg

SEQ ID NO: 400676 - DNA, 140 bp, Artificial Sequence
  Synthetic
caccgctgtcccaaaaggtcacaatatgcttgtcttatatctcctattatgtctcctgttgtataaaatgctctccctggtcctataggtatactttttcttgtattgttgttgggtcttcatatcagcagccagggcct

SEQ ID NO: 400677 - DNA, 140 bp, Artificial Sequence
  Synthetic
aggccctggctgctgatatgtttggccttcccacaaggggaggccggggaatttcattcagagcagaccagagccaacagccccccttcagccaacagccccaccagcagagagcttcaggaccttttgggacagcggtg

SEQ ID NO: 400678 - DNA, 140 bp, Artificial Sequence
  Synthetic
caccgctgtcccaaaaggtcctgaagctctctgctggtggggctgttggctgaaggggggctgttggctctggtctgctctgaatgaaattccccggcctccccttgtgggaaggccaaacatatcagcagccagggcct

SEQ ID NO: 400679 - DNA, 140 bp, Artificial Sequence
  Synthetic
aggccctggctgctgatatgcctatacgaaaagaaacatgggaagtatggtggacagaatattggcaggccacctggattcctgattgggaatttgtcaatacccctcctctagtaaaatgaccttttgggacagcggtg

SEQ ID NO: 400680 - DNA, 140 bp, Artificial Sequence
  Synthetic
caccgctgtcccaaaaggtcattttactagaggaggggtattgacaaattcccaatcaggaatccaggtggcctgccaatattctgtccaccatacttcccatgtttcttttcgtataggcatatcagcagccagggcct

SEQ ID NO: 400681 - DNA, 140 bp, Artificial Sequence
  Synthetic
atacgccatgctgggtctccactagtggcgctaatagtactaatagtactaatagttgggaaaagatgccagtaggagaaataaaaaactgctctttcaatatcaccacaagtgtaagagcgtacttgggagtcggccat

SEQ ID NO: 400682 - DNA, 140 bp, Artificial Sequence
  Synthetic
atggccgactcccaagtacgctcttacacttgtggtgatattgaaagagcagttttttatttctcctactggcatcttttcccaactattagtactattagtactattagcgccactagtggagacccagcatggcgtat

SEQ ID NO: 400683 - DNA, 140 bp, Artificial Sequence
  Synthetic
aggccctggctgctgatatgccagcaagaaaagaatgaacaagaattattggaattggataaatgggcaagtttgtggaattggtttaacataacacaatggctgtggtatataaaaatagaccttttgggacagcggtg

SEQ ID NO: 400684 - DNA, 140 bp, Artificial Sequence
  Synthetic
caccgctgtcccaaaaggtctatttttatataccacagccattgtgttatgttaaaccaattccacaaacttgcccatttatccaattccaataattcttgttcattcttttcttgctggcatatcagcagccagggcct

SEQ ID NO: 400685 - DNA, 140 bp, Artificial Sequence
  Synthetic
aggccctggctgctgatatgatccagtagatcctaacttagagccctggaaccatccaggaagtcagcctaggactccttgtaaccaatgttattgtaaaaagtgttgttatcattgccagaccttttgggacagcggtg

SEQ ID NO: 400686 - DNA, 140 bp, Artificial Sequence
  Synthetic
caccgctgtcccaaaaggtctggcaatgataacaacactttttacaataacattggttacaaggagtcctaggctgacttcctggatggttccagggctctaagttaggatctactggatcatatcagcagccagggcct

SEQ ID NO: 400687 - DNA, 140 bp, Artificial Sequence
  Synthetic
atacgccatgctgggtctccggagacagcgacgaagaactcctcagaatcgtcaggaccataaaaatcctgtaccagagcagtaagtaataataataagtatatgtgatgcaacctttagcgtacttgggagtcggccat

SEQ ID NO: 400688 - DNA, 140 bp, Artificial Sequence
  Synthetic
atggccgactcccaagtacgctaaaggttgcatcacatatacttattattattacttactgctctggtacaggatttttatggtcctgacgattctgaggagttcttcgtcgctgtctccggagacccagcatggcgtat

SEQ ID NO: 400689 - DNA, 140 bp, Artificial Sequence
  Synthetic
atacgccatgctgggtctccgactttgatccttgggttggtgataatttgtagtgcctcagacaacctgtgggtcacggtctactatggggtacctgtatggaaagaggcaaagaccacccgtacttgggagtcggccat

SEQ ID NO: 400690 - DNA, 140 bp, Artificial Sequence
  Synthetic
atggccgactcccaagtacgggtggtctttgcctctttccatacaggtaccccatagtagaccgtgacccacaggttgtctgaggcactacaaattatcaccaacccaaggatcaaagtcggagacccagcatggcgtat

SEQ ID NO: 400691 - DNA, 140 bp, Artificial Sequence
  Synthetic
atacgccatgctgggtctccatgttaccagtaatggtaatactagtagcataaaggaagctggagaaataaaaaattgctctttcaatgcaaccacagagataagaaataagagaaaaaacgtacttgggagtcggccat

SEQ ID NO: 400692 - DNA, 140 bp, Artificial Sequence
  Synthetic
atggccgactcccaagtacgttttttctcttatttcttatctctgtggttgcattgaaagagcaattttttatttctccagcttcctttatgctactagtattaccattactggtaacatggagacccagcatggcgtat

SEQ ID NO: 400693 - DNA, 140 bp, Artificial Sequence
  Synthetic
atacgccatgctgggtctccagagataataattagatctgaaaatctaacagacaataccaaaacaataatagtacatctcaatcaatctgtaaacattacatgtataagacccaccaatcgtacttgggagtcggccat

SEQ ID NO: 400694 - DNA, 140 bp, Artificial Sequence
  Synthetic
atggccgactcccaagtacgattggtgggtcttatacatgtaatgtttacagattgattgagatgtactattattgttttggtattgtctgttagattttcagatctaattattatctctggagacccagcatggcgtat

SEQ ID NO: 400695 - DNA, 140 bp, Artificial Sequence
  Synthetic
aggccctggctgctgatatggcaagaaaagaatgaacaagaattattggaattggacaagtgggcaagtttgtggaattggtttgacataacaaactggctgtggtatataaaaatattcgaccttttgggacagcggtg

SEQ ID NO: 400696 - DNA, 140 bp, Artificial Sequence
  Synthetic
caccgctgtcccaaaaggtcgaatatttttatataccacagccagtttgttatgtcaaaccaattccacaaacttgcccacttgtccaattccaataattcttgttcattcttttcttgccatatcagcagccagggcct

SEQ ID NO: 400697 - DNA, 140 bp, Artificial Sequence
  Synthetic
aggccctggctgctgatatgtgtggaattggtttgacataacaaactggctgtggtatataaaaatattcataatgatagtaggaggcttgataggtttaagaatagtttttgctgtactgaccttttgggacagcggtg

SEQ ID NO: 400698 - DNA, 140 bp, Artificial Sequence
  Synthetic
caccgctgtcccaaaaggtcagtacagcaaaaactattcttaaacctatcaagcctcctactatcattatgaatatttttatataccacagccagtttgttatgtcaaaccaattccacacatatcagcagccagggcct

SEQ ID NO: 400699 - DNA, 140 bp, Artificial Sequence
  Synthetic
aggccctggctgctgatatgcctaataaaaaaatagaatttaaaccatcctcaggaggagatgtagaaattacaacacatagttttaattgtggaggagaatttttcttttgcaatacatgaccttttgggacagcggtg

SEQ ID NO: 400700 - DNA, 140 bp, Artificial Sequence
  Synthetic
caccgctgtcccaaaaggtcatgtattgcaaaagaaaaattctcctccacaattaaaactatgtgttgtaatttctacatctcctcctgaggatggtttaaattctatttttttattaggcatatcagcagccagggcct

SEQ ID NO: 400701 - DNA, 140 bp, Artificial Sequence
  Synthetic
atacgccatgctgggtctccgaccccccaaatagcactaacatcctgaaagaagacccaggggcaatacaaaactgtactttcaatatgaccacagaaataagagataagcagataaaagcgtacttgggagtcggccat

SEQ ID NO: 400702 - DNA, 140 bp, Artificial Sequence
  Synthetic
atggccgactcccaagtacgcttttatctgcttatctcttatttctgtggtcatattgaaagtacagttttgtattgcccctgggtcttctttcaggatgttagtgctatttggggggtcggagacccagcatggcgtat

SEQ ID NO: 400703 - DNA, 140 bp, Artificial Sequence
  Synthetic
aggccctggctgctgatatgtgtaaatatgtggcagagagtaggacaagcaatatatgccccccccatccaaggaataataaggtgtgaatcaaacattacaggaatactactaacaagagaccttttgggacagcggtg

SEQ ID NO: 400704 - DNA, 140 bp, Artificial Sequence
  Synthetic
caccgctgtcccaaaaggtctcttgttagtagtattcctgtaatgtttgattcacaccttattattccttggatggggggggcatatattgcttgtcctactctctgccacatatttacacatatcagcagccagggcct

SEQ ID NO: 400705 - DNA, 140 bp, Artificial Sequence
  Synthetic
aggccctggctgctgatatgcatagaatggagattgagaaaatataacacacaaatagaacctggcctggcagaccagctaattcatatgtattattttgattgttttgcagactctgccgaccttttgggacagcggtg

SEQ ID NO: 400706 - DNA, 140 bp, Artificial Sequence
  Synthetic
caccgctgtcccaaaaggtcggcagagtctgcaaaacaatcaaaataatacatatgaattagctggtctgccaggccaggttctatttgtgtgttatattttctcaatctccattctatgcatatcagcagccagggcct

SEQ ID NO: 400707 - DNA, 140 bp, Artificial Sequence
  Synthetic
atacgccatgctgggtctccgcgggctttactataaaatggggggtaagtggtcaaaaattaaggcgggatggccttctgtaagggaaagaatgcagcgagcggagccagcagcagatggcgtacttgggagtcggccat

SEQ ID NO: 400708 - DNA, 140 bp, Artificial Sequence
  Synthetic
atggccgactcccaagtacgccatctgctgctggctccgctcgctgcattctttcccttacagaaggccatcccgccttaatttttgaccacttaccccccattttatagtaaagcccgcggagacccagcatggcgtat

SEQ ID NO: 400709 - DNA, 140 bp, Artificial Sequence
  Synthetic
aggccctggctgctgatatgtggccttctgtaagggaaagaatgcagcgagcggagccagcagcagatggggtgggagcagcatctcgagacctggataaatatggagcaatcacaagtagaccttttgggacagcggtg

SEQ ID NO: 400710 - DNA, 140 bp, Artificial Sequence
  Synthetic
caccgctgtcccaaaaggtctacttgtgattgctccatatttatccaggtctcgagatgctgctcccaccccatctgctgctggctccgctcgctgcattctttcccttacagaaggccacatatcagcagccagggcct

SEQ ID NO: 400711 - DNA, 140 bp, Artificial Sequence
  Synthetic
aggccctggctgctgatatggatgggtgcgagagcgtcaatattaagcggcggacaattagatagatgggaaaaaattcggttaaggccagggggaaagaaacaatataaattaaagcatgaccttttgggacagcggtg

SEQ ID NO: 400712 - DNA, 140 bp, Artificial Sequence
  Synthetic
caccgctgtcccaaaaggtcatgctttaatttatattgtttctttccccctggccttaaccgaattttttcccatctatctaattgtccgccgcttaatattgacgctctcgcacccatccatatcagcagccagggcct

SEQ ID NO: 400713 - DNA, 140 bp, Artificial Sequence
  Synthetic
atacgccatgctgggtctcctttagattatatttggaataacatgacctgggcgcagtgggaaagagaaattgataactacacagacttaatatacaacttaattgaagaatcaaataaccgtacttgggagtcggccat

SEQ ID NO: 400714 - DNA, 140 bp, Artificial Sequence
  Synthetic
atggccgactcccaagtacggttatttgattcttcaattaagttgtatattaagtctgtgtagttatcaatttctctttcccactgcgcccaggtcatgttattccaaatataatctaaaggagacccagcatggcgtat

SEQ ID NO: 400715 - DNA, 140 bp, Artificial Sequence
  Synthetic
atacgccatgctgggtctccaatgcatcatagggacctgctaacattaataattggtagtgctttgctgcttataaatgtactgttatggatgtttatgcttagaaaatatttagaacaacgtacttgggagtcggccat

SEQ ID NO: 400716 - DNA, 140 bp, Artificial Sequence
  Synthetic
atggccgactcccaagtacgttgttctaaatattttctaagcataaacatccataacagtacatttataagcagcaaagcactaccaattattaatgttagcaggtccctatgatgcattggagacccagcatggcgtat

SEQ ID NO: 400717 - DNA, 140 bp, Artificial Sequence
  Synthetic
  misc_feature (24)..(24): n is a, c, g, or t
  misc_feature (84)..(84): n is a, c, g, or t
atacgccatgctgggtctccaagngaaattagggatgacagtgactatgaaagtaatggagaggaggaacaagaagttatggancttgtacttagccatggctttgataaccccatgtttcgtacttgggagtcggccat

SEQ ID NO: 400718 - DNA, 140 bp, Artificial Sequence
  Synthetic
  misc_feature (57)..(57): n is a, c, g, or t
  misc_feature (117)..(117): n is a, c, g, or t
atggccgactcccaagtacgaaacatggggttatcaaagccatggctaagtacaagntccataacttcttgttcctcctctccattactttcatagtcactgtcatccctaatttcncttggagacccagcatggcgtat

SEQ ID NO: 400719 - DNA, 140 bp, Artificial Sequence
  Synthetic
atacgccatgctgggtctccaataataccatgagtggagaaataaaaaattgctcttttaatgtaaccacagaaataagggataagaaaaataaagagtatgcacttttttatagacttgcgtacttgggagtcggccat

SEQ ID NO: 400720 - DNA, 140 bp, Artificial Sequence
  Synthetic
atggccgactcccaagtacgcaagtctataaaaaagtgcatactctttatttttcttatcccttatttctgtggttacattaaaagagcaattttttatttctccactcatggtattattggagacccagcatggcgtat

SEQ ID NO: 400721 - DNA, 140 bp, Artificial Sequence
  Synthetic
aggccctggctgctgatatgagagctagtggatggttttacagacatcattatgaaagcagacatccaaaaataagttcagaagtacacataccattaggggaggctagattagtaataagaccttttgggacagcggtg

SEQ ID NO: 400722 - DNA, 140 bp, Artificial Sequence
  Synthetic
caccgctgtcccaaaaggtcttattactaatctagcctcccctaatggtatgtgtacttctgaacttatttttggatgtctgctttcataatgatgtctgtaaaaccatccactagctctcatatcagcagccagggcct

SEQ ID NO: 400723 - DNA, 140 bp, Artificial Sequence
  Synthetic
atacgccatgctgggtctccgcagatagggtaagaactgagccagcagcagatggagtgggagcagcatctcgagacctagaaagacatggggcaatcacaagtagcaatacagcagctacgtacttgggagtcggccat

SEQ ID NO: 400724 - DNA, 140 bp, Artificial Sequence
  Synthetic
atggccgactcccaagtacgtagctgctgtattgctacttgtgattgccccatgtctttctaggtctcgagatgctgctcccactccatctgctgctggctcagttcttaccctatctgcggagacccagcatggcgtat

SEQ ID NO: 400725 - DNA, 140 bp, Artificial Sequence
  Synthetic
atacgccatgctgggtctccctgtgttactttaaattgcactgatgtggagaatgatactagtataaatagggtggtggaggaaagagaaataaaaaattgctctttcaatatcaccacacgtacttgggagtcggccat

SEQ ID NO: 400726 - DNA, 140 bp, Artificial Sequence
  Synthetic
atggccgactcccaagtacgtgtggtgatattgaaagagcaattttttatttctctttcctccaccaccctatttatactagtatcattctccacatcagtgcaatttaaagtaacacagggagacccagcatggcgtat

SEQ ID NO: 400727 - DNA, 140 bp, Artificial Sequence
  Synthetic
atacgccatgctgggtctcctgggaagaatatcatagtgaccctaaattctaccataaacatgacctgtagtagaccagcattggaagtacagagcatgggcgtaggtccaatggccgtacgtacttgggagtcggccat

SEQ ID NO: 400728 - DNA, 140 bp, Artificial Sequence
  Synthetic
atggccgactcccaagtacgtacggccattggacctacgcccatgctctgtacttccaatgctggtctactacaggtcatgtttatggtagaatttagggtcactatgatattcttcccaggagacccagcatggcgtat

SEQ ID NO: 400729 - DNA, 140 bp, Artificial Sequence
  Synthetic
aggccctggctgctgatatggtagaccagcattggaagtacagagcatgggcgtaggtccaatggccgtatacagtgcacacctaagggaatcagggacaaacggatcaaggatagcttagaccttttgggacagcggtg

SEQ ID NO: 400730 - DNA, 140 bp, Artificial Sequence
  Synthetic
caccgctgtcccaaaaggtctaagctatccttgatccgtttgtccctgattcccttaggtgtgcactgtatacggccattggacctacgcccatgctctgtacttccaatgctggtctaccatatcagcagccagggcct

SEQ ID NO: 400731 - DNA, 140 bp, Artificial Sequence
  Synthetic
aggccctggctgctgatatgtcagaagaacttaaatcattatataatacaatagcaaccctctattgtgtacatcaacggatagatgtaaaagacaccaaggaagctttagataaaataggaccttttgggacagcggtg

SEQ ID NO: 400732 - DNA, 140 bp, Artificial Sequence
  Synthetic
caccgctgtcccaaaaggtcctattttatctaaagcttccttggtgtcttttacatctatccgttgatgtacacaatagagggttgctattgtattatataatgatttaagttcttctgacatatcagcagccagggcct

SEQ ID NO: 400733 - DNA, 140 bp, Artificial Sequence
  Synthetic
atacgccatgctgggtctccagaggtatttagaacttgtaaacaacacaggtagtattagcatgacattcaacaaaagcaacgatggtggagatccagagacaacccatttacattttaacgtacttgggagtcggccat

SEQ ID NO: 400734 - DNA, 140 bp, Artificial Sequence
  Synthetic
atggccgactcccaagtacgttaaaatgtaaatgggttgtctctggatctccaccatcgttgcttttgttgaatgtcatgctaatactacctgtgttgtttacaagttctaaatacctctggagacccagcatggcgtat

SEQ ID NO: 400735 - DNA, 140 bp, Artificial Sequence
  Synthetic
atacgccatgctgggtctccagagatattcagacctggaggaggaaatatgaaggacaattggagaagtgaattatacaaatataaagtggtagaaattaagccattgggaatagcaccccgtacttgggagtcggccat

SEQ ID NO: 400736 - DNA, 140 bp, Artificial Sequence
  Synthetic
atggccgactcccaagtacggggtgctattcccaatggcttaatttctaccactttatatttgtataattcacttctccaattgtccttcatatttcctcctccaggtctgaatatctctggagacccagcatggcgtat

SEQ ID NO: 400737 - DNA, 140 bp, Artificial Sequence
  Synthetic
atacgccatgctgggtctccgacacacagataccttgcaaactgagacaggtagtaaggtcatggataaaaggacagtcaggattctatgcacctcccatcaagggtaacctgacatgtacgtacttgggagtcggccat

SEQ ID NO: 400738 - DNA, 140 bp, Artificial Sequence
  Synthetic
atggccgactcccaagtacgtacatgtcaggttacccttgatgggaggtgcatagaatcctgactgtccttttatccatgaccttactacctgtctcagtttgcaaggtatctgtgtgtcggagacccagcatggcgtat

SEQ ID NO: 400739 - DNA, 140 bp, Artificial Sequence
  Synthetic
aggccctggctgctgatatgcatatatagaatataggaaattgttaagacaaagaaaaatagacaggttaattaaaagaattagggaaagagcagaagacagtggcaatgagagtgaggggaccttttgggacagcggtg

SEQ ID NO: 400740 - DNA, 140 bp, Artificial Sequence
  Synthetic
caccgctgtcccaaaaggtcccctcactctcattgccactgtcttctgctctttccctaattcttttaattaacctgtctatttttctttgtcttaacaatttcctatattctatatatgcatatcagcagccagggcct

SEQ ID NO: 400741 - DNA, 140 bp, Artificial Sequence
  Synthetic
atacgccatgctgggtctccctcccttgcagaataaaacaaattataaacatgtgacaggaagtaggaagagcaatatatgcccctcccattgaaggacaaattagatgtatatcaaatacgtacttgggagtcggccat

SEQ ID NO: 400742 - DNA, 140 bp, Artificial Sequence
  Synthetic
atggccgactcccaagtacgtatttgatatacatctaatttgtccttcaatgggaggggcatatattgctcttcctacttcctgtcacatgtttataatttgttttattctgcaagggagggagacccagcatggcgtat

SEQ ID NO: 400743 - DNA, 140 bp, Artificial Sequence
  Synthetic
aggccctggctgctgatatgaaatgaaaaattgctctttcaatacaaccacagaaataagagataagaatcggaaagaatatgcacttttttatagacctgatatagtaccacttaatgggaccttttgggacagcggtg

SEQ ID NO: 400744 - DNA, 140 bp, Artificial Sequence
  Synthetic
caccgctgtcccaaaaggtcccattaagtggtactatatcaggtctataaaaaagtgcatattctttccgattcttatctcttatttctgtggttgtattgaaagagcaatttttcatttcatatcagcagccagggcct

SEQ ID NO: 400745 - DNA, 140 bp, Artificial Sequence
  Synthetic
aggccctggctgctgatatggaggagctctctcgacgcaggactcggcttgctgaagcgcgcgcggcaagaggcgaggggcggcgaccggtgagtacgccaaaatttttgactagcggaggaccttttgggacagcggtg

SEQ ID NO: 400746 - DNA, 140 bp, Artificial Sequence
  Synthetic
caccgctgtcccaaaaggtcctccgctagtcaaaaattttggcgtactcaccggtcgccgcccctcgcctcttgccgcgcgcgcttcagcaagccgagtcctgcgtcgagagagctcctccatatcagcagccagggcct

SEQ ID NO: 400747 - DNA, 140 bp, Artificial Sequence
  Synthetic
atacgccatgctgggtctccgatacaatagcaatagcagtagctaactggacagatagagctatagaagtagtgcatagagttggtagggcttttctcaacatacctagaagaataagaccgtacttgggagtcggccat

SEQ ID NO: 400748 - DNA, 140 bp, Artificial Sequence
  Synthetic
atggccgactcccaagtacggtcttattcttctaggtatgttgagaaaagccctaccaactctatgcactacttctatagctctatctgtccagttagctactgctattgctattgtatcggagacccagcatggcgtat

SEQ ID NO: 400749 - DNA, 140 bp, Artificial Sequence
  Synthetic
atacgccatgctgggtctccagtaataccagctataggttgataagttgtaacacctcagtcattacacaggcctgtccaaaggtatcctttgagccaattcccatacattattgtgccccgtacttgggagtcggccat

SEQ ID NO: 400750 - DNA, 140 bp, Artificial Sequence
  Synthetic
atggccgactcccaagtacggggcacaataatgtatgggaattggctcaaaggatacctttggacaggcctgtgtaatgactgaggtgttacaacttatcaacctatagctggtattactggagacccagcatggcgtat

SEQ ID NO: 400751 - DNA, 140 bp, Artificial Sequence
  Synthetic
atacgccatgctgggtctccgaccagccactgttgaacgccatcaagataataaagatcttgtaccagagcagtaagtaacgctaatgcagcatagggacctgctaataattattagtgccgtacttgggagtcggccat

SEQ ID NO: 400752 - DNA, 140 bp, Artificial Sequence
  Synthetic
atggccgactcccaagtacggcactaataattattagcaggtccctatgctgcattagcgttacttactgctctggtacaagatctttattatcttgatggcgttcaacagtggctggtcggagacccagcatggcgtat

SEQ ID NO: 400753 - DNA, 140 bp, Artificial Sequence
  Synthetic
aggccctggctgctgatatgaatagtccaccttaatgaatctgtagaaattaattgtacaagacccaacaataatacaagaaaaagtgtaaggataggaccaggacaagcattctatgcagaccttttgggacagcggtg

SEQ ID NO: 400754 - DNA, 140 bp, Artificial Sequence
  Synthetic
caccgctgtcccaaaaggtctgcatagaatgcttgtcctggtcctatccttacactttttcttgtattattgttgggtcttgtacaattaatttctacagattcattaaggtggactattcatatcagcagccagggcct

SEQ ID NO: 400755 - DNA, 140 bp, Artificial Sequence
  Synthetic
aggccctggctgctgatatgactaccctaataaaacaatagaattccaaccacactcaggaggggatctagaagttacaacgcatagctttaattgtagaggagagtttttctattgcaagaccttttgggacagcggtg

SEQ ID NO: 400756 - DNA, 140 bp, Artificial Sequence
  Synthetic
caccgctgtcccaaaaggtcttgcaatagaaaaactctcctctacaattaaagctatgcgttgtaacttctagatcccctcctgagtgtggttggaattctattgttttattagggtagtcatatcagcagccagggcct

SEQ ID NO: 400757 - DNA, 140 bp, Artificial Sequence
  Synthetic
aggccctggctgctgatatgtaaacaatggccattgacagaagaaaaaataaaagcattaacagaaatttgtaaagagatggaaaaggaaggaaaaatttcaaaaattgggcctgaaaatgaccttttgggacagcggtg

SEQ ID NO: 400758 - DNA, 140 bp, Artificial Sequence
  Synthetic
caccgctgtcccaaaaggtcattttcaggcccaatttttgaaatttttccttccttttccatctctttacaaatttctgttaatgcttttattttttcttctgtcaatggccattgtttacatatcagcagccagggcct

SEQ ID NO: 400759 - DNA, 140 bp, Artificial Sequence
  Synthetic
  misc_feature (58)..(58): n is a, c, g, or t
  misc_feature (120)..(120): n is a, c, g, or t
atacgccatgctgggtctccagacagggcttagagagaagtctattgtaacatggganacgtattgggaaaaaataaatatgagggatgggcagcagtaagacaaagaatgaggagaacncgtacttgggagtcggccat

SEQ ID NO: 400760 - DNA, 140 bp, Artificial Sequence
  Synthetic
  misc_feature (21)..(21): n is a, c, g, or t
  misc_feature (83)..(83): n is a, c, g, or t
atggccgactcccaagtacgngttctcctcattctttgtcttactgctgcccatccctcatatttattttttcccaatacgtntcccatgttacaatagacttctctctaagccctgtctggagacccagcatggcgtat

SEQ ID NO: 400761 - DNA, 140 bp, Artificial Sequence
  Synthetic
aggccctggctgctgatatggcatctcgagacctggaagaacatggagcaatcacaagtagcaatacagcagctactaatgctgatgtggcctggctggaagcacaagaggaggaggagggaccttttgggacagcggtg

SEQ ID NO: 400762 - DNA, 140 bp, Artificial Sequence
  Synthetic
caccgctgtcccaaaaggtccctcctcctcctcttgtgcttccagccaggccacatcagcattagtagctgctgtattgctacttgtgattgctccatgttcttccaggtctcgagatgccatatcagcagccagggcct

SEQ ID NO: 400763 - DNA, 140 bp, Artificial Sequence
  Synthetic
aggccctggctgctgatatggtggcgcccgaacagggacgcgaaagcgaaagtagaaccagaggagatctctcgacgcaggactcggcttgctgaaagcgcgctcggcaagaggcgaggggaccttttgggacagcggtg

SEQ ID NO: 400764 - DNA, 140 bp, Artificial Sequence
  Synthetic
caccgctgtcccaaaaggtcccctcgcctcttgccgagcgcgctttcagcaagccgagtcctgcgtcgagagatctcctctggttctactttcgctttcgcgtccctgttcgggcgccaccatatcagcagccagggcct

SEQ ID NO: 400765 - DNA, 140 bp, Artificial Sequence
  Synthetic
atacgccatgctgggtctccagaagaataagagaaattagagatgatagtgactatgagagcaatggagaagaagaacaagaagttagggatcttgtacatagttatggctttgataatccgtacttgggagtcggccat

SEQ ID NO: 400766 - DNA, 140 bp, Artificial Sequence
  Synthetic
atggccgactcccaagtacggattatcaaagccataactatgtacaagatccctaacttcttgttcttcttctccattgctctcatagtcactatcatctctaatttctcttattcttctggagacccagcatggcgtat

SEQ ID NO: 400767 - DNA, 140 bp, Artificial Sequence
  Synthetic
aggccctggctgctgatatgccctcaaatcactctttggcagcgacccctagtcacagtaagaatagggggacagctaatagaagccctgttagacacaggagcagatgatacagtgttagaccttttgggacagcggtg

SEQ ID NO: 400768 - DNA, 140 bp, Artificial Sequence
  Synthetic
caccgctgtcccaaaaggtctaacactgtatcatctgctcctgtgtctaacagggcttctattagctgtccccctattcttactgtgactaggggtcgctgccaaagagtgatttgagggcatatcagcagccagggcct

SEQ ID NO: 400769 - DNA, 140 bp, Artificial Sequence
  Synthetic
aggccctggctgctgatatgaacacagcccacaataatgctgcttgtgcctggctgcaagcacaagaggaggaagaagaagtaggctttccagtcagacctcaggtgcctttaagaccaagaccttttgggacagcggtg

SEQ ID NO: 400770 - DNA, 140 bp, Artificial Sequence
  Synthetic
caccgctgtcccaaaaggtcttggtcttaaaggcacctgaggtctgactggaaagcctacttcttcttcctcctcttgtgcttgcagccaggcacaagcagcattattgtgggctgtgttcatatcagcagccagggcct

SEQ ID NO: 400771 - DNA, 140 bp, Artificial Sequence
  Synthetic
aggccctggctgctgatatgtgtaagaccattttaaaagcattgggaccaggggctacactagaagaaatgatgacagcatgtcagggagtgggaggacctggccataaggcaagggtttgaccttttgggacagcggtg

SEQ ID NO: 400772 - DNA, 140 bp, Artificial Sequence
  Synthetic
caccgctgtcccaaaaggtcaaacccttgccttatggccaggtcctcccactccctgacatgctgtcatcatttcttctagtgtagcccctggtcccaatgcttttaaaatggtcttacacatatcagcagccagggcct

SEQ ID NO: 400773 - DNA, 140 bp, Artificial Sequence
  Synthetic
aggccctggctgctgatatggtagatcctagactagagccctggaagcatccaggaagtcagcctaagactgcttgtaccaattgctattgtaaaaagtgttgctttcattgccaagtttgaccttttgggacagcggtg

SEQ ID NO: 400774 - DNA, 140 bp, Artificial Sequence
  Synthetic
caccgctgtcccaaaaggtcaaacttggcaatgaaagcaacactttttacaatagcaattggtacaagcagtcttaggctgacttcctggatgcttccagggctctagtctaggatctaccatatcagcagccagggcct

SEQ ID NO: 400775 - DNA, 140 bp, Artificial Sequence
  Synthetic
aggccctggctgctgatatgtggcagtattcattcacaattttaaaagaaaaggggggattggggggtacagtgcaggggaaagaataatagacataatagcaacagacatacaaactaagaccttttgggacagcggtg

SEQ ID NO: 400776 - DNA, 140 bp, Artificial Sequence
  Synthetic
caccgctgtcccaaaaggtcttagtttgtatgtctgttgctattatgtctattattctttcccctgcactgtaccccccaatccccccttttcttttaaaattgtgaatgaatactgccacatatcagcagccagggcct

SEQ ID NO: 400777 - DNA, 140 bp, Artificial Sequence
  Synthetic
atacgccatgctgggtctcccagcgacgaagagctcatcaggacagtcagattcatcaagttcctgtaccaaagcagtaagtaatacatgtaatgtaccctttacaaatattagcaatagcgtacttgggagtcggccat

SEQ ID NO: 400778 - DNA, 140 bp, Artificial Sequence
  Synthetic
atggccgactcccaagtacgctattgctaatatttgtaaagggtacattacatgtattacttactgctttggtacaggaacttgatgaatctgactgtcctgatgagctcttcgtcgctgggagacccagcatggcgtat

SEQ ID NO: 400779 - DNA, 140 bp, Artificial Sequence
  Synthetic
atacgccatgctgggtctccggcatagaatatatgaaaataagaaaacataggaaaatagacaggttaattgatagaataacagaaagagcagaagatagtggcaatgacagtgatggggcgtacttgggagtcggccat

SEQ ID NO: 400780 - DNA, 140 bp, Artificial Sequence
  Synthetic
atggccgactcccaagtacgccccatcactgtcattgccactatcttctgctctttctgttattctatcaattaacctgtctattttcctatgttttcttattttcatatattctatgccggagacccagcatggcgtat

SEQ ID NO: 400781 - DNA, 140 bp, Artificial Sequence
  Synthetic
aggccctggctgctgatatgaggaaaatatgcaaaaagggggtctgcccacactaatgatgtaaaacaattaacagaagtggtgcaaaaaatagccacagagagcatagtaatatggggagaccttttgggacagcggtg

SEQ ID NO: 400782 - DNA, 140 bp, Artificial Sequence
  Synthetic
caccgctgtcccaaaaggtctccccatattactatgctctctgtggctattttttgcaccacttctgttaattgttttacatcattagtgtgggcagaccccctttttgcatattttcctcatatcagcagccagggcct

SEQ ID NO: 400783 - DNA, 140 bp, Artificial Sequence
  Synthetic
atacgccatgctgggtctccccactataatagagacaggagaaataaaaaactgctctttcaaaatctccacaattgtaaaagataaggtaaagaaacaatatgcacttttttatagtctcgtacttgggagtcggccat

SEQ ID NO: 400784 - DNA, 140 bp, Artificial Sequence
  Synthetic
atggccgactcccaagtacgagactataaaaaagtgcatattgtttctttaccttatcttttacaattgtggagattttgaaagagcagttttttatttctcctgtctctattatagtggggagacccagcatggcgtat

SEQ ID NO: 400785 - DNA, 140 bp, Artificial Sequence
  Synthetic
atacgccatgctgggtctccaagataaaaccacctctgcctagtgttagaaaattaacagaagatagatggaacaaaccccagaagatcaggggccacaaagagaacctttacaatgaatcgtacttgggagtcggccat

SEQ ID NO: 400786 - DNA, 140 bp, Artificial Sequence
  Synthetic
atggccgactcccaagtacgattcattgtaaaggttctctttgtggcccctgatcttctggggtttgttccatctatcttctgttaattttctaacactaggcagaggtggttttatcttggagacccagcatggcgtat

SEQ ID NO: 400787 - DNA, 140 bp, Artificial Sequence
  Synthetic
aggccctggctgctgatatgggaagaaatatgttgactcagcttggatgcacactaaattttccaattagtcccattgaaactgtaccagtaaaattaaagccaggaatggatggcccaagaccttttgggacagcggtg

SEQ ID NO: 400788 - DNA, 140 bp, Artificial Sequence
  Synthetic
caccgctgtcccaaaaggtcttgggccatccattcctggctttaattttactggtacagtttcaatgggactaattggaaaatttagtgtgcatccaagctgagtcaacatatttcttcccatatcagcagccagggcct

SEQ ID NO: 400789 - DNA, 140 bp, Artificial Sequence
  Synthetic
atacgccatgctgggtctccggaccagggagagcattttatgcaacaggagacataataggagacataagacaggcacattgtaacgttagtgaagtaaaatggaataagactctacaaccgtacttgggagtcggccat

SEQ ID NO: 400790 - DNA, 140 bp, Artificial Sequence
  Synthetic
atggccgactcccaagtacggttgtagagtcttattccattttacttcactaacgttacaatgtgcctgtcttatgtctcctattatgtctcctgttgcataaaatgctctccctggtccggagacccagcatggcgtat

SEQ ID NO: 400791 - DNA, 140 bp, Artificial Sequence
  Synthetic
atacgccatgctgggtctccagaaataaaaaactgctctttcaatataaccacagtactaagagataagcaaaagaaagagtatgcacttttttatagacatgatatagtacaacttgatcgtacttgggagtcggccat

SEQ ID NO: 400792 - DNA, 140 bp, Artificial Sequence
  Synthetic
atggccgactcccaagtacgatcaagttgtactatatcatgtctataaaaaagtgcatactctttcttttgcttatctcttagtactgtggttatattgaaagagcagttttttatttctggagacccagcatggcgtat

SEQ ID NO: 400793 - DNA, 140 bp, Artificial Sequence
  Synthetic
aggccctggctgctgatatgagggataaggggttcaatggaacaggatcatgcaaaaatgttagcacagtacaatgtacacatggaatcaagccagtagtaacaactcagctgctgttaagaccttttgggacagcggtg

SEQ ID NO: 400794 - DNA, 140 bp, Artificial Sequence
  Synthetic
caccgctgtcccaaaaggtcttaacagcagctgagttgttactactggcttgattccatgtgtacattgtactgtgctaacatttttgcatgatcctgttccattgaaccccttatccctcatatcagcagccagggcct

SEQ ID NO: 400795 - DNA, 140 bp, Artificial Sequence
  Synthetic
aggccctggctgctgatatgatcagtgagattagtgagcggattcttatcgattgcctgggacgacctccggaacctgtgcatcttcctttaccaccacttgagggactttctattggtggaccttttgggacagcggtg

SEQ ID NO: 400796 - DNA, 140 bp, Artificial Sequence
  Synthetic
caccgctgtcccaaaaggtccaccaatagaaagtccctcaagtggtggtaaaggaagatgcacaggttccggaggtcgtcccaggcaatcgataagaatccgctcactaatctcactgatcatatcagcagccagggcct

SEQ ID NO: 400797 - DNA, 140 bp, Artificial Sequence
  Synthetic
atacgccatgctgggtctccaataatgccaaaaccatactagtacagttagttaatcctgtagaaattaattgttccagacctggcaacaatacaagaaaaagtatacatataggaccagcgtacttgggagtcggccat

SEQ ID NO: 400798 - DNA, 140 bp, Artificial Sequence
  Synthetic
atggccgactcccaagtacgctggtcctatatgtatactttttcttgtattgttgccaggtctggaacaattaatttctacaggattaactaactgtactagtatggttttggcattattggagacccagcatggcgtat

SEQ ID NO: 400799 - DNA, 140 bp, Artificial Sequence
  Synthetic
aggccctggctgctgatatgttgttccagacctggcaacaatacaagaaaaagtatacatataggaccagggcaagcattatatgcaagaggtgacataataggggacataagacaagcagaccttttgggacagcggtg

SEQ ID NO: 400800 - DNA, 140 bp, Artificial Sequence
  Synthetic
caccgctgtcccaaaaggtctgcttgtcttatgtcccctattatgtcacctcttgcatataatgcttgccctggtcctatatgtatactttttcttgtattgttgccaggtctggaacaacatatcagcagccagggcct

SEQ ID NO: 400801 - DNA, 140 bp, Artificial Sequence
  Synthetic
atacgccatgctgggtctcctaaacaattagggaagtactttaataataaaacaataatctttgctaatcactcaggaggggatgtagaaattacaacaccatattttatttgtggaaggcgtacttgggagtcggccat

SEQ ID NO: 400802 - DNA, 140 bp, Artificial Sequence
  Synthetic
atggccgactcccaagtacgccttccacaaataaaatatggtgttgtaatttctacatcccctcctgagtgattagcaaagattattgttttattattaaagtacttccctaattgtttaggagacccagcatggcgtat

SEQ ID NO: 400803 - DNA, 140 bp, Artificial Sequence
  Synthetic
aggccctggctgctgatatgactcaggaggggatgtagaaattacaacaccatattttatttgtggaagggaatttttatattgcaatacatcagaattatttaatagcacttggaatgggaccttttgggacagcggtg

SEQ ID NO: 400804 - DNA, 140 bp, Artificial Sequence
  Synthetic
caccgctgtcccaaaaggtcccattccaagtgctattaaataattctgatgtattgcaatataaaaattcccttccacaaataaaatatggtgttgtaatttctacatcccctcctgagtcatatcagcagccagggcct

SEQ ID NO: 400805 - DNA, 140 bp, Artificial Sequence
  Synthetic
atacgccatgctgggtctccctattctccacatacctagaaggataagacaaggtttagaactttctttgctataagatgggtggcaagtggtcaaaaagtagtttagttggatggcctccgtacttgggagtcggccat

SEQ ID NO: 400806 - DNA, 140 bp, Artificial Sequence
  Synthetic
atggccgactcccaagtacggaggccatccaactaaactactttttgaccacttgccacccatcttatagcaaagaaagttctaaaccttgtcttatccttctaggtatgtggagaatagggagacccagcatggcgtat

SEQ ID NO: 400807 - DNA, 140 bp, Artificial Sequence
  Synthetic
aggccctggctgctgatatgctgctctttcaatatcaccacaagcataagagataagatgcagaaagaatatgcacttttttataaacttgatgtagtaccaatagataatgataataccgaccttttgggacagcggtg

SEQ ID NO: 400808 - DNA, 140 bp, Artificial Sequence
  Synthetic
caccgctgtcccaaaaggtcggtattatcattatctattggtactacatcaagtttataaaaaagtgcatattctttctgcatcttatctcttatgcttgtggtgatattgaaagagcagcatatcagcagccagggcct

SEQ ID NO: 400809 - DNA, 140 bp, Artificial Sequence
  Synthetic
aggccctggctgctgatatgatgcacttttttataaacttgatgtagtaccaatagataatgataataccagctataggttgataagttgtaacacctcagtcattacacaggcctgtccgaccttttgggacagcggtg

SEQ ID NO: 400810 - DNA, 140 bp, Artificial Sequence
  Synthetic
caccgctgtcccaaaaggtcggacaggcctgtgtaatgactgaggtgttacaacttatcaacctatagctggtattatcattatctattggtactacatcaagtttataaaaaagtgcatcatatcagcagccagggcct

SEQ ID NO: 400811 - DNA, 140 bp, Artificial Sequence
  Synthetic
aggccctggctgctgatatgttatctgggacgatctgcggagcctgtgcctcttcagctaccaccgcttgagagacttactcttgattgtaacgaggattgtggaacttctgggacgcaggaccttttgggacagcggtg

SEQ ID NO: 400812 - DNA, 140 bp, Artificial Sequence
  Synthetic
caccgctgtcccaaaaggtcctgcgtcccagaagttccacaatcctcgttacaatcaagagtaagtctctcaagcggtggtagctgaagaggcacaggctccgcagatcgtcccagataacatatcagcagccagggcct

SEQ ID NO: 400813 - DNA, 140 bp, Artificial Sequence
  Synthetic
atacgccatgctgggtctccgagatataagacaagcacattgtaaccttagtagaacaaaatggaatgacactttaaaacagatagttgaaaaattaagagaacaatttgggaataaaaccgtacttgggagtcggccat

SEQ ID NO: 400814 - DNA, 140 bp, Artificial Sequence
  Synthetic
atggccgactcccaagtacggttttattcccaaattgttctcttaatttttcaactatctgttttaaagtgtcattccattttgttctactaaggttacaatgtgcttgtcttatatctcggagacccagcatggcgtat

SEQ ID NO: 400815 - DNA, 140 bp, Artificial Sequence
  Synthetic
aggccctggctgctgatatgactttaaaacagatagttgaaaaattaagagaacaatttgggaataaaacaataatctttaatcaatcctcaggaggggacccagaaattgtaatgcacagaccttttgggacagcggtg

SEQ ID NO: 400816 - DNA, 140 bp, Artificial Sequence
  Synthetic
caccgctgtcccaaaaggtctgtgcattacaatttctgggtcccctcctgaggattgattaaagattattgttttattcccaaattgttctcttaatttttcaactatctgttttaaagtcatatcagcagccagggcct

SEQ ID NO: 400817 - DNA, 140 bp, Artificial Sequence
  Synthetic
atacgccatgctgggtctccgaccggaaggaacgttagtagtgaaatgaaggaagaaataaaaaactgctctttcaatatgaccacagaattaagagataagaaaaagagagtgtctgcacgtacttgggagtcggccat

SEQ ID NO: 400818 - DNA, 140 bp, Artificial Sequence
  Synthetic
atggccgactcccaagtacgtgcagacactctctttttcttatctcttaattctgtggtcatattgaaagagcagttttttatttcttccttcatttcactactaacgttccttccggtcggagacccagcatggcgtat

SEQ ID NO: 400819 - DNA, 140 bp, Artificial Sequence
  Synthetic
aggccctggctgctgatatgatgggaaagaattcggttaaggccagggggaaagaaacaatataaattaaagcatttaatatgggcaggcagagaactagaaagattcgcggtcaatcctgaccttttgggacagcggtg

SEQ ID NO: 400820 - DNA, 140 bp, Artificial Sequence
  Synthetic
caccgctgtcccaaaaggtcaggattgaccgcgaatctttctagttctctgcctgcccatattaaatgctttaatttatattgtttctttccccctggccttaaccgaattctttcccatcatatcagcagccagggcct

SEQ ID NO: 400821 - DNA, 140 bp, Artificial Sequence
  Synthetic
aggccctggctgctgatatgtagtgagtatagattaataaattgtaatacctcaaccataacacaggcctgtccaaaggtctcttttgacccaattcctatacattattgtgctccagctgaccttttgggacagcggtg

SEQ ID NO: 400822 - DNA, 140 bp, Artificial Sequence
  Synthetic
caccgctgtcccaaaaggtcagctggagcacaataatgtataggaattgggtcaaaagagacctttggacaggcctgtgttatggttgaggtattacaatttattaatctatactcactacatatcagcagccagggcct

SEQ ID NO: 400823 - DNA, 140 bp, Artificial Sequence
  Synthetic
atacgccatgctgggtctccatttgcttgatatattagcaatagcagtagtaactggacatgatagggttatagaattagcacataggagcttggagagctttttctcaacatacctagacgtacttgggagtcggccat

SEQ ID NO: 400824 - DNA, 140 bp, Artificial Sequence
  Synthetic
atggccgactcccaagtacgtctaggtatgttgagaaaaagctctccaagctcctatgtgctaattctataaccctatcatgtccagttactactgctattgctaatatatcaagcaaatggagacccagcatggcgtat

SEQ ID NO: 400825 - DNA, 140 bp, Artificial Sequence
  Synthetic
atacgccatgctgggtctccaacaccactgagtgggaaaaagccttaaaaaacacagctgaaaggtatttggaacttataaataagacagaagagaatacaacaataatgttcaaccggacgtacttgggagtcggccat

SEQ ID NO: 400826 - DNA, 140 bp, Artificial Sequence
  Synthetic
atggccgactcccaagtacgtccggttgaacattattgttgtattctcttctgtcttatttataagttccaaatacctttcagctgtgttttttaaggctttttcccactcagtggtgttggagacccagcatggcgtat

SEQ ID NO: 400827 - DNA, 140 bp, Artificial Sequence
  Synthetic
aggccctggctgctgatatggaaaatgtgtccgaaaactttaatatgtggaaaaataacgtggtataccagatgcaggaggatattatcagtttatgggatgaaagcctacaaccatgtggaccttttgggacagcggtg

SEQ ID NO: 400828 - DNA, 140 bp, Artificial Sequence
  Synthetic
caccgctgtcccaaaaggtccacatggttgtaggctttcatcccataaactgataatatcctcctgcatctggtataccacgttatttttccacatattaaagttttcggacacattttccatatcagcagccagggcct

SEQ ID NO: 400829 - DNA, 140 bp, Artificial Sequence
  Synthetic
atacgccatgctgggtctccaaactataaaatttaacacatcctcaggaggggacttagaaattataacacataactttaattgtagaggagagtttttctattgcaacacatcaaacctcgtacttgggagtcggccat

SEQ ID NO: 400830 - DNA, 140 bp, Artificial Sequence
  Synthetic
atggccgactcccaagtacgaggtttgatgtgttgcaatagaaaaactctcctctacaattaaagttatgtgttataatttctaagtcccctcctgaggatgtgttaaattttatagtttggagacccagcatggcgtat

SEQ ID NO: 400831 - DNA, 140 bp, Artificial Sequence
  Synthetic
aggccctggctgctgatatgtggcctgctatcagggaaagaatgagacgaacccctacatcagcagaaaggagacaaacccctgcagcagcagaaggggcgggagcagtgtcccaagatcgaccttttgggacagcggtg

SEQ ID NO: 400832 - DNA, 140 bp, Artificial Sequence
  Synthetic
caccgctgtcccaaaaggtcgatcttgggacactgctcccgccccttctgctgctgcaggggtttgtctcctttctgctgatgtaggggttcgtctcattctttccctgatagcaggccacatatcagcagccagggcct

SEQ ID NO: 400833 - DNA, 140 bp, Artificial Sequence
  Synthetic
aggccctggctgctgatatgataaattgtaatacctcaaccattacacaggcttgtccaaaggtatcttgggatccaattcccatacattattgtgctccagctggttatgcgattctaagaccttttgggacagcggtg

SEQ ID NO: 400834 - DNA, 140 bp, Artificial Sequence
  Synthetic
caccgctgtcccaaaaggtcttagaatcgcataaccagctggagcacaataatgtatgggaattggatcccaagatacctttggacaagcctgtgtaatggttgaggtattacaatttatcatatcagcagccagggcct

SEQ ID NO: 400835 - DNA, 140 bp, Artificial Sequence
  Synthetic
aggccctggctgctgatatgatattcataatgatagtaggaggcttggtaggtttaagaatagtttttgctgtactttctatagtgaatagagttaggcagggatactcaccattatcgtgaccttttgggacagcggtg

SEQ ID NO: 400836 - DNA, 140 bp, Artificial Sequence
  Synthetic
caccgctgtcccaaaaggtcacgataatggtgagtatccctgcctaactctattcactatagaaagtacagcaaaaactattcttaaacctaccaagcctcctactatcattatgaatatcatatcagcagccagggcct

SEQ ID NO: 400837 - DNA, 140 bp, Artificial Sequence
  Synthetic
aggccctggctgctgatatgccatagccatagcagtagctgaggggacagatagggttatagaagtattacaaagagcttgtagagctattctccacatacctacaagaataagacaggggaccttttgggacagcggtg

SEQ ID NO: 400838 - DNA, 140 bp, Artificial Sequence
  Synthetic
caccgctgtcccaaaaggtcccctgtcttattcttgtaggtatgtggagaatagctctacaagctctttgtaatacttctataaccctatctgtcccctcagctactgctatggctatggcatatcagcagccagggcct

SEQ ID NO: 400839 - DNA, 140 bp, Artificial Sequence
  Synthetic
atacgccatgctgggtctccatgtaaaataaaacagatgataaacatgtggcaggaagtaggacgagcaatgtatgctgcccccgtggcaggaaacattatctgtaactcaaatattacacgtacttgggagtcggccat

SEQ ID NO: 400840 - DNA, 140 bp, Artificial Sequence
  Synthetic
atggccgactcccaagtacgtgtaatatttgagttacagataatgtttcctgccacgggggcagcatacattgctcgtcctacttcctgccacatgtttatcatctgttttattttacatggagacccagcatggcgtat

SEQ ID NO: 400841 - DNA, 140 bp, Artificial Sequence
  Synthetic
aggccctggctgctgatatgactagtgtagactgtaataccagaaattgcactgaaggaatcaacaggactacaaactatgaagacataaaaaactgctctttcaatgcaaccacagaaagaccttttgggacagcggtg

SEQ ID NO: 400842 - DNA, 140 bp, Artificial Sequence
  Synthetic
caccgctgtcccaaaaggtctttctgtggttgcattgaaagagcagttttttatgtcttcatagtttgtagtcctgttgattccttcagtgcaatttctggtattacagtctacactagtcatatcagcagccagggcct

SEQ ID NO: 400843 - DNA, 140 bp, Artificial Sequence
  Synthetic
atacgccatgctgggtctccccagcagcagagggagcaggagcagcagaaggagtaggaacagcatctcaagacttagacaaacatggagcacttacaaccagcaacacagccaccaatacgtacttgggagtcggccat

SEQ ID NO: 400844 - DNA, 140 bp, Artificial Sequence
  Synthetic
atggccgactcccaagtacgtattggtggctgtgttgctggttgtaagtgctccatgtttgtctaagtcttgagatgctgttcctactccttctgctgctcctgctccctctgctgctggggagacccagcatggcgtat

SEQ ID NO: 400845 - DNA, 140 bp, Artificial Sequence
  Synthetic
aggccctggctgctgatatgacccaacaataatacaagaaaaagtgtgagaatagggccaggacaaacattctatgcaacaggaggaataataggaaacataagagaagcacattgtaacgaccttttgggacagcggtg

SEQ ID NO: 400846 - DNA, 140 bp, Artificial Sequence
  Synthetic
caccgctgtcccaaaaggtcgttacaatgtgcttctcttatgtttcctattattcctcctgttgcatagaatgtttgtcctggccctattctcacactttttcttgtattattgttgggtcatatcagcagccagggcct

SEQ ID NO: 400847 - DNA, 140 bp, Artificial Sequence
  Synthetic
aggccctggctgctgatatgggggaggccaggaaattttcctcagagcagaccagagccaacagccccaccagcagagagctttgggatgggggaagagataacctcctccccgaagcaggaccttttgggacagcggtg

SEQ ID NO: 400848 - DNA, 140 bp, Artificial Sequence
  Synthetic
caccgctgtcccaaaaggtcctgcttcggggaggaggttatctcttcccccatcccaaagctctctgctggtggggctgttggctctggtctgctctgaggaaaatttcctggcctcccccatatcagcagccagggcct

SEQ ID NO: 400849 - DNA, 140 bp, Artificial Sequence
  Synthetic
atacgccatgctgggtctccgagtagtacttggaggactaaatctctggatgacatttgggacaacatgacctggatggagtgggagagggaaattgacaattacacaagaacaatatatcgtacttgggagtcggccat

SEQ ID NO: 400850 - DNA, 140 bp, Artificial Sequence
  Synthetic
atggccgactcccaagtacgatatattgttcttgtgtaattgtcaatttccctctcccactccatccaggtcatgttgtcccaaatgtcatccagagatttagtcctccaagtactactcggagacccagcatggcgtat

SEQ ID NO: 400851 - DNA, 140 bp, Artificial Sequence
  Synthetic
atacgccatgctgggtctcctattggtggaatctcctgcagtattggggtcaggaactaaagaatagtgctattagcttgcttaataccacagcaatagtagtagctgaggggacagatacgtacttgggagtcggccat

SEQ ID NO: 400852 - DNA, 140 bp, Artificial Sequence
  Synthetic
atggccgactcccaagtacgtatctgtcccctcagctactactattgctgtggtattaagcaagctaatagcactattctttagttcctgaccccaatactgcaggagattccaccaataggagacccagcatggcgtat

SEQ ID NO: 400853 - DNA, 140 bp, Artificial Sequence
  Synthetic
atacgccatgctgggtctccaagtatttgtggagcctcctgcagtactggagtcaggaactgaagaatagtgctgttagcttgctgaataccatagctatagcagtagctgagggaacagcgtacttgggagtcggccat

SEQ ID NO: 400854 - DNA, 140 bp, Artificial Sequence
  Synthetic
atggccgactcccaagtacgctgttccctcagctactgctatagctatggtattcagcaagctaacagcactattcttcagttcctgactccagtactgcaggaggctccacaaatacttggagacccagcatggcgtat

SEQ ID NO: 400855 - DNA, 140 bp, Artificial Sequence
  Synthetic
aggccctggctgctgatatgcctagaagaataagacaaggctttgaaaggagtttgctataagatgggtggcaagtggtcaaaaggtcgtgtgcccggatggcctgagataagggaaagagaccttttgggacagcggtg

SEQ ID NO: 400856 - DNA, 140 bp, Artificial Sequence
  Synthetic
caccgctgtcccaaaaggtctctttcccttatctcaggccatccgggcacacgaccttttgaccacttgccacccatcttatagcaaactcctttcaaagccttgtcttattcttctaggcatatcagcagccagggcct

SEQ ID NO: 400857 - DNA, 140 bp, Artificial Sequence
  Synthetic
atacgccatgctgggtctccaggatcatcaggatcctttatcaaagcagtaagtatatgcaatgataaatttattagaaagagtagattaggagtaggagcattgggaatagcactaatccgtacttgggagtcggccat

SEQ ID NO: 400858 - DNA, 140 bp, Artificial Sequence
  Synthetic
atggccgactcccaagtacggattagtgctattcccaatgctcctactcctaatctactctttctaataaatttatcattgcatatacttactgctttgataaaggatcctgatgatcctggagacccagcatggcgtat

SEQ ID NO: 400859 - DNA, 140 bp, Artificial Sequence
  Synthetic
aggccctggctgctgatatgtacagtagcaaccctctattgtgtacataaaaggatagaggtaaaagacaccaaggaagctttagacaaggtagaggaagagcaaaacaaaagtaagaaagaccttttgggacagcggtg

SEQ ID NO: 400860 - DNA, 140 bp, Artificial Sequence
  Synthetic
caccgctgtcccaaaaggtctttcttacttttgttttgctcttcctctaccttgtctaaagcttccttggtgtcttttacctctatccttttatgtacacaatagagggttgctactgtacatatcagcagccagggcct

SEQ ID NO: 400861 - DNA, 140 bp, Artificial Sequence
  Synthetic
atacgccatgctgggtctccccagcagcagaaggagggagaagaaaccctccagcagcagaaggggtgggggcagtatctcaggacttagaaagacggggggcaattacaagcagcaacacgtacttgggagtcggccat

SEQ ID NO: 400862 - DNA, 140 bp, Artificial Sequence
  Synthetic
atggccgactcccaagtacgtgttgctgcttgtaattgccccccgtctttctaagtcctgagatactgcccccaccccttctgctgctggagggtttcttctccctccttctgctgctggggagacccagcatggcgtat

SEQ ID NO: 400863 - DNA, 140 bp, Artificial Sequence
  Synthetic
aggccctggctgctgatatgggagtctccatagaatggaggaaaaggagatatagcacacaagtagaccctgacctagcagaccaactaattcatctgtattattttgattgtttttcaggaccttttgggacagcggtg

SEQ ID NO: 400864 - DNA, 140 bp, Artificial Sequence
  Synthetic
caccgctgtcccaaaaggtcctgaaaaacaatcaaaataatacagatgaattagttggtctgctaggtcagggtctacttgtgtgctatatctccttttcctccattctatggagactcccatatcagcagccagggcct

SEQ ID NO: 400865 - DNA, 140 bp, Artificial Sequence
  Synthetic
aggccctggctgctgatatgtaattgatagaataagagaaagagcagaagacagtggcaatgagagcgaaggagatcaggaagaattatcagcacttgtggagatggggcaccatgctccgaccttttgggacagcggtg

SEQ ID NO: 400866 - DNA, 140 bp, Artificial Sequence
  Synthetic
caccgctgtcccaaaaggtcggagcatggtgccccatctccacaagtgctgataattcttcctgatctccttcgctctcattgccactgtcttctgctctttctcttattctatcaattacatatcagcagccagggcct

SEQ ID NO: 400867 - DNA, 140 bp, Artificial Sequence
  Synthetic
atacgccatgctgggtctccctgctgcaaatgttactgctaccactaatggtagtatagctgaagaaatgagaaattgctcttttaatgcaaccacagaactaacagatagaaaagagaacgtacttgggagtcggccat

SEQ ID NO: 400868 - DNA, 140 bp, Artificial Sequence
  Synthetic
atggccgactcccaagtacgttctcttttctatctgttagttctgtggttgcattaaaagagcaatttctcatttcttcagctatactaccattagtggtagcagtaacatttgcagcagggagacccagcatggcgtat

SEQ ID NO: 400869 - DNA, 140 bp, Artificial Sequence
  Synthetic
aggccctggctgctgatatgagtatcaactcaactgctgttaaatggcagtctagcagaagaagaggtagtaattagatctgacaatttcacggacaatgctaaaaccataatagtacaggaccttttgggacagcggtg

SEQ ID NO: 400870 - DNA, 140 bp, Artificial Sequence
  Synthetic
caccgctgtcccaaaaggtcctgtactattatggttttagcattgtccgtgaaattgtcagatctaattactacctcttcttctgctagactgccatttaacagcagttgagttgatactcatatcagcagccagggcct

SEQ ID NO: 400871 - DNA, 140 bp, Artificial Sequence
  Synthetic
atacgccatgctgggtctccgggatgacattagcaggaaggacgtaatgaaagactgctctttcagtttctccacgggcatagcaaatataatgaatagggaatatgcactttatgataccgtacttgggagtcggccat

SEQ ID NO: 400872 - DNA, 140 bp, Artificial Sequence
  Synthetic
atggccgactcccaagtacggtatcataaagtgcatattccctattcattatatttgctatgcccgtggagaaactgaaagagcagtctttcattacgtccttcctgctaatgtcatcccggagacccagcatggcgtat

SEQ ID NO: 400873 - DNA, 140 bp, Artificial Sequence
  Synthetic
aggccctggctgctgatatgactcaactgctgttaaatggcagtctagcagaagaagaaataataattagatctgaaaatatcacaaacaatgctaaaactataatagtacagctgaatggaccttttgggacagcggtg

SEQ ID NO: 400874 - DNA, 140 bp, Artificial Sequence
  Synthetic
caccgctgtcccaaaaggtccattcagctgtactattatagttttagcattgtttgtgatattttcagatctaattattatttcttcttctgctagactgccatttaacagcagttgagtcatatcagcagccagggcct

SEQ ID NO: 400875 - DNA, 140 bp, Artificial Sequence
  Synthetic
atacgccatgctgggtctccaggctagttctacccggggtaatagcacagtagaaatggaagatgcaagaaattgttcttttaatataaccacagtactaagagataagaaaaagaaagtcgtacttgggagtcggccat

SEQ ID NO: 400876 - DNA, 140 bp, Artificial Sequence
  Synthetic
atggccgactcccaagtacgactttctttttcttatctcttagtactgtggttatattaaaagaacaatttcttgcatcttccatttctactgtgctattaccccgggtagaactagcctggagacccagcatggcgtat

SEQ ID NO: 400877 - DNA, 140 bp, Artificial Sequence
  Synthetic
atacgccatgctgggtctccataataagatttaataaatcctcggggggggacccagaaattgtaatgcacacttttaattgcggaggggaatttttctactgtaatacatcaaagctgtcgtacttgggagtcggccat

SEQ ID NO: 400878 - DNA, 140 bp, Artificial Sequence
  Synthetic
atggccgactcccaagtacgacagctttgatgtattacagtagaaaaattcccctccgcaattaaaagtgtgcattacaatttctgggtccccccccgaggatttattaaatcttattatggagacccagcatggcgtat

SEQ ID NO: 400879 - DNA, 140 bp, Artificial Sequence
  Synthetic
aggccctggctgctgatatgcacttttaattgcggaggggaatttttctactgtaatacatcaaagctgtttaatagtacttggtcgcgtaatagtactaatggtacttggacgcttaacgaccttttgggacagcggtg

SEQ ID NO: 400880 - DNA, 140 bp, Artificial Sequence
  Synthetic
caccgctgtcccaaaaggtcgttaagcgtccaagtaccattagtactattacgcgaccaagtactattaaacagctttgatgtattacagtagaaaaattcccctccgcaattaaaagtgcatatcagcagccagggcct

SEQ ID NO: 400881 - DNA, 140 bp, Artificial Sequence
  Synthetic
atacgccatgctgggtctccagcaaaaggggaggtagtaatcagatctgaaaatctcacaaacaatgccaaaatcataatactacaattggccaagcctgtaaatattacttgtatcagacgtacttgggagtcggccat

SEQ ID NO: 400882 - DNA, 140 bp, Artificial Sequence
  Synthetic
atggccgactcccaagtacgtctgatacaagtaatatttacaggcttggccaattgtagtattatgattttggcattgtttgtgagattttcagatctgattactacctccccttttgctggagacccagcatggcgtat

SEQ ID NO: 400883 - DNA, 140 bp, Artificial Sequence
  Synthetic
aggccctggctgctgatatgaaatcataatactacaattggccaagcctgtaaatattacttgtatcagacctaataacaatacaagaaaaagtatacatataggaccaggacaagccttgaccttttgggacagcggtg

SEQ ID NO: 400884 - DNA, 140 bp, Artificial Sequence
  Synthetic
caccgctgtcccaaaaggtcaaggcttgtcctggtcctatatgtatactttttcttgtattgttattaggtctgatacaagtaatatttacaggcttggccaattgtagtattatgatttcatatcagcagccagggcct

SEQ ID NO: 400885 - DNA, 140 bp, Artificial Sequence
  Synthetic
  misc_feature (26)..(26): n is a, c, g, or t
  misc_feature (29)..(29): n is a, c, g, or t
  misc_feature (55)..(55): n is a, c, g, or t
  misc_feature (58)..(58): n is a, c, g, or t
  misc_feature (60)..(60): n is a, c, g, or t
  misc_feature (66)..(66): n is a, c, g, or t
  misc_feature (72)..(72): n is a, c, g, or t
  misc_feature (75)..(75): n is a, c, g, or t
atacgccatgctgggtctccaaacanaanaaaatacaaaggatacttgatagaanaananaaaganaagaanacngtgcaaatggaagtgaaggggacacagaggaattggcaacccttgcgtacttgggagtcggccat

SEQ ID NO: 400886 - DNA, 140 bp, Artificial Sequence
  Synthetic
  misc_feature (66)..(66): n is a, c, g, or t
  misc_feature (69)..(69): n is a, c, g, or t
  misc_feature (75)..(75): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (112)..(112): n is a, c, g, or t
  misc_feature (115)..(115): n is a, c, g, or t
atggccgactcccaagtacgcaagggttgccaattcctctgtgtccccttcacttccatttgcacngtnttcttntctttntnttnttctatcaagtatcctttgtattttnttntgtttggagacccagcatggcgtat

SEQ ID NO: 400887 - DNA, 140 bp, Artificial Sequence
  Synthetic
atacgccatgctgggtctccaggggattagatattagtaacgcacagttttaattgtggaggggaatttttctattgcaatacatcaggactgttcaatagcacttggactgacaacacgcgtacttgggagtcggccat

SEQ ID NO: 400888 - DNA, 140 bp, Artificial Sequence
  Synthetic
atggccgactcccaagtacgcgtgttgtcagtccaagtgctattgaacagtcctgatgtattgcaatagaaaaattcccctccacaattaaaactgtgcgttactaatatctaatcccctggagacccagcatggcgtat

SEQ ID NO: 400889 - DNA, 140 bp, Artificial Sequence
  Synthetic
aggccctggctgctgatatgaacagctcctggggatttggggttgctctggaaaactcatctgcaccactgctgtgccttggaatgctagttggagtaataaatcttataatgagatttggaccttttgggacagcggtg

SEQ ID NO: 400890 - DNA, 140 bp, Artificial Sequence
  Synthetic
caccgctgtcccaaaaggtccaaatctcattataagatttattactccaactagcattccaaggcacagcagtggtgcagatgagttttccagagcaaccccaaatccccaggagctgttcatatcagcagccagggcct

SEQ ID NO: 400891 - DNA, 140 bp, Artificial Sequence
  Synthetic
atacgccatgctgggtctccgtagtagcctagaaatgatgatagagaaaggagaaataaaaaactgctctttcaataccaccacagacctaagagataagacaaagagagaatatgcactcgtacttgggagtcggccat

SEQ ID NO: 400892 - DNA, 140 bp, Artificial Sequence
  Synthetic
atggccgactcccaagtacgagtgcatattctctctttgtcttatctcttaggtctgtggtggtattgaaagagcagttttttatttctcctttctctatcatcatttctaggctactacggagacccagcatggcgtat

SEQ ID NO: 400893 - DNA, 140 bp, Artificial Sequence
  Synthetic
aggccctggctgctgatatgccaggaagtcagcctaaaactccttgtaataagtgctattgtaaacactgtagctaccattgtctagtttgctttcagacaaaaggcttaggcatttcctgaccttttgggacagcggtg

SEQ ID NO: 400894 - DNA, 140 bp, Artificial Sequence
  Synthetic
caccgctgtcccaaaaggtcaggaaatgcctaagccttttgtctgaaagcaaactagacaatggtagctacagtgtttacaatagcacttattacaaggagttttaggctgacttcctggcatatcagcagccagggcct

SEQ ID NO: 400895 - DNA, 140 bp, Artificial Sequence
  Synthetic
  misc_feature (36)..(36): n is a, c, g, or t
  misc_feature (73)..(73): n is a, c, g, or t
  misc_feature (75)..(75): n is a, c, g, or t
  misc_feature (89)..(89): n is a, c, g, or t
  misc_feature (94)..(94): n is a, c, g, or t
aggccctggctgctgatatgcagtacaatgtacacntggaattaggccagtagtatcaactcaactgctgctnantggcagtctagcanaagangaaatagtaattaggtctaaaaacttgaccttttgggacagcggtg

SEQ ID NO: 400896 - DNA, 140 bp, Artificial Sequence
  Synthetic
  misc_feature (47)..(47): n is a, c, g, or t
  misc_feature (52)..(52): n is a, c, g, or t
  misc_feature (66)..(66): n is a, c, g, or t
  misc_feature (68)..(68): n is a, c, g, or t
  misc_feature (105)..(105): n is a, c, g, or t
caccgctgtcccaaaaggtcaagtttttagacctaattactatttcntcttntgctagactgccantnagcagcagttgagttgatactactggcctaattccangtgtacattgtactgcatatcagcagccagggcct

SEQ ID NO: 400897 - DNA, 140 bp, Artificial Sequence
  Synthetic
aggccctggctgctgatatgttgaccccactttgtgtcactttaagatgtacaaatgttaatactactgtgaacaatactactgtgaacaatactactgggaatggtactggtccctttggaccttttgggacagcggtg

SEQ ID NO: 400898 - DNA, 140 bp, Artificial Sequence
  Synthetic
caccgctgtcccaaaaggtccaaagggaccagtaccattcccagtagtattgttcacagtagtattgttcacagtagtattaacatttgtacatcttaaagtgacacaaagtggggtcaacatatcagcagccagggcct

SEQ ID NO: 400899 - DNA, 140 bp, Artificial Sequence
  Synthetic
atacgccatgctgggtctccgataagacaaagaaagagtatgcacttttttataaactagatatagtacaacttaatgatggcaactctagtgagtatagattaataaattgtaatacctcgtacttgggagtcggccat

SEQ ID NO: 400900 - DNA, 140 bp, Artificial Sequence
  Synthetic
atggccgactcccaagtacgaggtattacaatttattaatctatactcactagagttgccatcattaagttgtactatatctagtttataaaaaagtgcatactctttctttgtcttatcggagacccagcatggcgtat

SEQ ID NO: 400901 - DNA, 140 bp, Artificial Sequence
  Synthetic
aggccctggctgctgatatgcacatacctagaagaatcagacagggcttagaaagggctttgctataacatggggggcaagtggtcaaaaagtagcatagtgggatggcctcaggtcagggaccttttgggacagcggtg

SEQ ID NO: 400902 - DNA, 140 bp, Artificial Sequence
  Synthetic
caccgctgtcccaaaaggtccctgacctgaggccatcccactatgctactttttgaccacttgccccccatgttatagcaaagccctttctaagccctgtctgattcttctaggtatgtgcatatcagcagccagggcct

SEQ ID NO: 400903 - DNA, 140 bp, Artificial Sequence
  Synthetic
atacgccatgctgggtctccaagaacacttccctaataaaacaataaaatttgaaccacattcaggaggggacctagaaattacaacacatagctttaattgtggaggagaatttttctacgtacttgggagtcggccat

SEQ ID NO: 400904 - DNA, 140 bp, Artificial Sequence
  Synthetic
atggccgactcccaagtacgtagaaaaattctcctccacaattaaagctatgtgttgtaatttctaggtcccctcctgaatgtggttcaaattttattgttttattagggaagtgttcttggagacccagcatggcgtat

SEQ ID NO: 400905 - DNA, 140 bp, Artificial Sequence
  Synthetic
atacgccatgctgggtctcccaacactctagaggaagagtcaggggcaatacaaaactgttctttcaatgtgactacagaagtaagagataagccgcaggaagtacatgcactcttttatcgtacttgggagtcggccat

SEQ ID NO: 400906 - DNA, 140 bp, Artificial Sequence
  Synthetic
atggccgactcccaagtacgataaaagagtgcatgtacttcctgcggcttatctcttacttctgtagtcacattgaaagaacagttttgtattgcccctgactcttcctctagagtgttgggagacccagcatggcgtat

SEQ ID NO: 400907 - DNA, 140 bp, Artificial Sequence
  Synthetic
atacgccatgctgggtctcctaccagtaatgttaatggtactgaggttaatgttaccagtgctgaagaaataaaaaattgcactttcaatacaaccacagaaataagagataagaaacaacgtacttgggagtcggccat

SEQ ID NO: 400908 - DNA, 140 bp, Artificial Sequence
  Synthetic
atggccgactcccaagtacgttgtttcttatctcttatttctgtggttgtattgaaagtgcaattttttatttcttcagcactggtaacattaacctcagtaccattaacattactggtaggagacccagcatggcgtat

SEQ ID NO: 400909 - DNA, 140 bp, Artificial Sequence
  Synthetic
aggccctggctgctgatatggccaggtcagccacaattaccctatagtgcaaaacctccaggggcaaatggtacatcagcccatatcacctagaactttaaatgcatgggtaaaagtagtgaccttttgggacagcggtg

SEQ ID NO: 400910 - DNA, 140 bp, Artificial Sequence
  Synthetic
caccgctgtcccaaaaggtcactacttttacccatgcatttaaagttctaggtgatatgggctgatgtaccatttgcccctggaggttttgcactatagggtaattgtggctgacctggccatatcagcagccagggcct

SEQ ID NO: 400911 - DNA, 140 bp, Artificial Sequence
  Synthetic
aggccctggctgctgatatggcctcaaatatctgtggaatcttctgttgtattggggtcgggaactaaagaatagtgccattaatttgcttgatacagtagcaatagcagtagctaactggaccttttgggacagcggtg

SEQ ID NO: 400912 - DNA, 140 bp, Artificial Sequence
  Synthetic
caccgctgtcccaaaaggtccagttagctactgctattgctactgtatcaagcaaattaatggcactattctttagttcccgaccccaatacaacagaagattccacagatatttgaggccatatcagcagccagggcct

SEQ ID NO: 400913 - DNA, 140 bp, Artificial Sequence
  Synthetic
atacgccatgctgggtctccatgggcagcagtaagagagagaatgagaaaaacttcctctgatcctgatcctcaaccatgtgcacctggagtagggccagtgtccagggaactagcagctcgtacttgggagtcggccat

SEQ ID NO: 400914 - DNA, 140 bp, Artificial Sequence
  Synthetic
atggccgactcccaagtacgagctgctagttccctggacactggccctactccaggtgcacatggttgaggatcaggatcagaggaagtttttctcattctctctcttactgctgcccatggagacccagcatggcgtat

SEQ ID NO: 400915 - DNA, 140 bp, Artificial Sequence
  Synthetic
atacgccatgctgggtctccataaaacaataacatttcaacaactagcaggaggggatctagaaattacaacacatagctttaattgtagaggagaatttttctattgcaatacaacagacgtacttgggagtcggccat

SEQ ID NO: 400916 - DNA, 140 bp, Artificial Sequence
  Synthetic
atggccgactcccaagtacgtctgttgtattgcaatagaaaaattctcctctacaattaaagctatgtgttgtaatttctagatcccctcctgctagttgttgaaatgttattgttttatggagacccagcatggcgtat

SEQ ID NO: 400917 - DNA, 140 bp, Artificial Sequence
  Synthetic
aggccctggctgctgatatgaaactgtaccagtaaaattaaagccaggaatggatggcccaaaagttaaacaatggcctttgacagaagaaaaaataaaagcattagtagaaatttgtacgaccttttgggacagcggtg

SEQ ID NO: 400918 - DNA, 140 bp, Artificial Sequence
  Synthetic
caccgctgtcccaaaaggtcgtacaaatttctactaatgcttttattttttcttctgtcaaaggccattgtttaacttttgggccatccattcctggctttaattttactggtacagtttcatatcagcagccagggcct

SEQ ID NO: 400919 - DNA, 140 bp, Artificial Sequence
  Synthetic
aggccctggctgctgatatgaattggttgcaatcatagcagaataggcattctccgaaggagaagaggcagggatggagctggtagatcctaaactagagccctggaaccatccgggaaggaccttttgggacagcggtg

SEQ ID NO: 400920 - DNA, 140 bp, Artificial Sequence
  Synthetic
caccgctgtcccaaaaggtccttcccggatggttccagggctctagtttaggatctaccagctccatccctgcctcttctccttcggagaatgcctattctgctatgattgcaaccaattcatatcagcagccagggcct

SEQ ID NO: 400921 - DNA, 140 bp, Artificial Sequence
  Synthetic
aggccctggctgctgatatggtggaatctcctgcagtattggattcaggaactaaagaatagtgctactagcttgcttaacactatagctataacagtagctgagggaacagatagggttgaccttttgggacagcggtg

SEQ ID NO: 400922 - DNA, 140 bp, Artificial Sequence
  Synthetic
caccgctgtcccaaaaggtcaaccctatctgttccctcagctactgttatagctatagtgttaagcaagctagtagcactattctttagttcctgaatccaatactgcaggagattccaccatatcagcagccagggcct

SEQ ID NO: 400923 - DNA, 140 bp, Artificial Sequence
  Synthetic
atacgccatgctgggtctccaataagacagggcttagaaagggctttgcaataagatgggtggcaagtggtcaaaaagtcgtgtgcccggatggaatgaaataagggaaagaatgagacgcgtacttgggagtcggccat

SEQ ID NO: 400924 - DNA, 140 bp, Artificial Sequence
  Synthetic
atggccgactcccaagtacgcgtctcattctttcccttatttcattccatccgggcacacgactttttgaccacttgccacccatcttattgcaaagccctttctaagccctgtcttattggagacccagcatggcgtat

SEQ ID NO: 400925 - DNA, 140 bp, Artificial Sequence
  Synthetic
aggccctggctgctgatatgtcaaaaagtcgtgtgcccggatggaatgaaataagggaaagaatgagacgagctgggccacgagctgagccagcagcagatggggtgggagcagcatctagaccttttgggacagcggtg

SEQ ID NO: 400926 - DNA, 140 bp, Artificial Sequence
  Synthetic
caccgctgtcccaaaaggtctagatgctgctcccaccccatctgctgctggctcagctcgtggcccagctcgtctcattctttcccttatttcattccatccgggcacacgactttttgacatatcagcagccagggcct

SEQ ID NO: 400927 - DNA, 140 bp, Artificial Sequence
  Synthetic
aggccctggctgctgatatgccaagaataagttcagaagtacacatcccactaggggatgctaaattggtagtaacaacatattggggtctgcatacaggagaaagagactggcatttaggaccttttgggacagcggtg

SEQ ID NO: 400928 - DNA, 140 bp, Artificial Sequence
  Synthetic
caccgctgtcccaaaaggtcctaaatgccagtctctttctcctgtatgcagaccccaatatgttgttactaccaatttagcatcccctagtgggatgtgtacttctgaacttattcttggcatatcagcagccagggcct

SEQ ID NO: 400929 - DNA, 140 bp, Artificial Sequence
  Synthetic
aggccctggctgctgatatggtggcgcccgaacagggacttgaaagcgaaagtagaaccagaggagctctctcgacgcaggactcggcttgctgaaagcgcgctcggcaagaggcgaggggaccttttgggacagcggtg

SEQ ID NO: 400930 - DNA, 140 bp, Artificial Sequence
  Synthetic
caccgctgtcccaaaaggtcccctcgcctcttgccgagcgcgctttcagcaagccgagtcctgcgtcgagagagctcctctggttctactttcgctttcaagtccctgttcgggcgccaccatatcagcagccagggcct

SEQ ID NO: 400931 - DNA, 140 bp, Artificial Sequence
  Synthetic
aggccctggctgctgatatgtgtggcaggaggtaggaaaagcaatgtatgcccctcccattgcaggaaacataatatgtaactcaagtatcacaggactactattgacacgtgatggagggaccttttgggacagcggtg

SEQ ID NO: 400932 - DNA, 140 bp, Artificial Sequence
  Synthetic
caccgctgtcccaaaaggtccctccatcacgtgtcaatagtagtcctgtgatacttgagttacatattatgtttcctgcaatgggaggggcatacattgcttttcctacctcctgccacacatatcagcagccagggcct

SEQ ID NO: 400933 - DNA, 140 bp, Artificial Sequence
  Synthetic
aggccctggctgctgatatgaatgtgacagaaaattttaacatgtggaaaaataatatggtagaacagatgcatgaggatataatcagtctatgggatcaaagcctaaagccatgtgtaagaccttttgggacagcggtg

SEQ ID NO: 400934 - DNA, 140 bp, Artificial Sequence
  Synthetic
caccgctgtcccaaaaggtcttacacatggctttaggctttgatcccatagactgattatatcctcatgcatctgttctaccatattatttttccacatgttaaaattttctgtcacattcatatcagcagccagggcct

SEQ ID NO: 400935 - DNA, 140 bp, Artificial Sequence
  Synthetic
aggccctggctgctgatatggcatgaggatataatcagtctatgggatcaaagcctaaagccatgtgtaaaattaaccccactctgtgttactttaaattgcactgattatgtggggaacgaccttttgggacagcggtg

SEQ ID NO: 400936 - DNA, 140 bp, Artificial Sequence
  Synthetic
caccgctgtcccaaaaggtcgttccccacataatcagtgcaatttaaagtaacacagagtggggttaattttacacatggctttaggctttgatcccatagactgattatatcctcatgccatatcagcagccagggcct

SEQ ID NO: 400937 - DNA, 140 bp, Artificial Sequence
  Synthetic
atacgccatgctgggtctccaattaaccccactctgtgttactttaaattgcactgattatgtggggaacgttactaataccactagtatgaaaaactgctctttcaatatcaccacaggcgtacttgggagtcggccat

SEQ ID NO: 400938 - DNA, 140 bp, Artificial Sequence
  Synthetic
atggccgactcccaagtacgcctgtggtgatattgaaagagcagtttttcatactagtggtattagtaacgttccccacataatcagtgcaatttaaagtaacacagagtggggttaattggagacccagcatggcgtat

SEQ ID NO: 400939 - DNA, 140 bp, Artificial Sequence
  Synthetic
atacgccatgctgggtctccgaacaatttgggaataataaaacaatagtctttaagccatcctcaggaggggacccagaaattgtaatgcacagttttaattgtggaggggaatttttctcgtacttgggagtcggccat

SEQ ID NO: 400940 - DNA, 140 bp, Artificial Sequence
  Synthetic
atggccgactcccaagtacgagaaaaattcccctccacaattaaaactgtgcattacaatttctgggtcccctcctgaggatggcttaaagactattgttttattattcccaaattgttcggagacccagcatggcgtat

SEQ ID NO: 400941 - DNA, 140 bp, Artificial Sequence
  Synthetic
aggccctggctgctgatatgaagcccaagaagagcatgaaaaatatcacagtaattggagagcaatggctagtgattttaatctgccacctgtagtagcaaaagaaatagtggccagctggaccttttgggacagcggtg

SEQ ID NO: 400942 - DNA, 140 bp, Artificial Sequence
  Synthetic
caccgctgtcccaaaaggtccagctggccactatttcttttgctactacaggtggcagattaaaatcactagccattgctctccaattactgtgatatttttcatgctcttcttgggcttcatatcagcagccagggcct

SEQ ID NO: 400943 - DNA, 140 bp, Artificial Sequence
  Synthetic
atacgccatgctgggtctccaaatgtacaaatttaaatgttactaaatttaatgctactggtacaaattttactactactgtgaacagtactgctactgtgaacagtactgctagggaagcgtacttgggagtcggccat

SEQ ID NO: 400944 - DNA, 140 bp, Artificial Sequence
  Synthetic
atggccgactcccaagtacgcttccctagcagtactgttcacagtagcagtactgttcacagtagtagtaaaatttgtaccagtagcattaaatttagtaacatttaaatttgtacatttggagacccagcatggcgtat

SEQ ID NO: 400945 - DNA, 140 bp, Artificial Sequence
  Synthetic
atacgccatgctgggtctccccaccgatagtagcgggaaagtgatagaaaatggagaagtaaaaaactgctctttcaatatcaccacaactgtaagagataaggtgaaaaaagaatatgccgtacttgggagtcggccat

SEQ ID NO: 400946 - DNA, 140 bp, Artificial Sequence
  Synthetic
atggccgactcccaagtacggcatattcttttttcaccttatctcttacagttgtggtgatattgaaagagcagttttttacttctccattttctatcactttcccgctactatcggtggggagacccagcatggcgtat

SEQ ID NO: 400947 - DNA, 140 bp, Artificial Sequence
  Synthetic
aggccctggctgctgatatgtgtcccttttagtaattagtgcaattgcaggactggtagtagcgctaatcttagcaatagcagtgtggactttagtattcatacaatatagaaaagtattgaccttttgggacagcggtg

SEQ ID NO: 400948 - DNA, 140 bp, Artificial Sequence
  Synthetic
caccgctgtcccaaaaggtcaatacttttctatattgtatgaatactaaagtccacactgctattgctaagattagcgctactaccagtcctgcaattgcactaattactaaaagggacacatatcagcagccagggcct

SEQ ID NO: 400949 - DNA, 140 bp, Artificial Sequence
  Synthetic
aggccctggctgctgatatgaatagagttaggcagggatactcaccattatcgtttcagacccacctcccagctccgaggggacccgacaggcccgaaggaatcgaagaagaaggtggaggaccttttgggacagcggtg

SEQ ID NO: 400950 - DNA, 140 bp, Artificial Sequence
  Synthetic
caccgctgtcccaaaaggtcctccaccttcttcttcgattccttcgggcctgtcgggtcccctcggagctgggaggtgggtctgaaacgataatggtgagtatccctgcctaactctattcatatcagcagccagggcct

SEQ ID NO: 400951 - DNA, 140 bp, Artificial Sequence
  Synthetic
  misc_feature (38)..(38): n is a, c, g, or t
atacgccatgctgggtctcctagatctaaaaacttctnggaaaatgctgaaatcataatagtacagctaaatgcatctgtacaaattaattgtacaaggcccagcaataatacaagaaaacgtacttgggagtcggccat

SEQ ID NO: 400952 - DNA, 140 bp, Artificial Sequence
  Synthetic
  misc_feature (103)..(103): n is a, c, g, or t
atggccgactcccaagtacgttttcttgtattattgctgggccttgtacaattaatttgtacagatgcatttagctgtactattatgatttcagcattttccnagaagtttttagatctaggagacccagcatggcgtat

SEQ ID NO: 400953 - DNA, 140 bp, Artificial Sequence
  Synthetic
  misc_feature (70)..(70): n is a, c, g, or t
atacgccatgctgggtctccactgagagaacctagaggaagtgatatagcagggacaactagtactctgntggaacaggtgacctggatgacttctaatcctcctgttccagtaggagaacgtacttgggagtcggccat

SEQ ID NO: 400954 - DNA, 140 bp, Artificial Sequence
  Synthetic
  misc_feature (71)..(71): n is a, c, g, or t
atggccgactcccaagtacgttctcctactggaacaggaggattagaagtcatccaggtcacctgttccancagagtactagttgtccctgctatatcacttcctctaggttctctcagtggagacccagcatggcgtat

SEQ ID NO: 400955 - DNA, 140 bp, Artificial Sequence
  Synthetic
aggccctggctgctgatatgatagtctttgataaacactcaggaggggatccagaagttgtagcacacagttttaattgtggaggggaattcttctactgtaatacaacgcaactgtttagaccttttgggacagcggtg

SEQ ID NO: 400956 - DNA, 140 bp, Artificial Sequence
  Synthetic
caccgctgtcccaaaaggtctaaacagttgcgttgtattacagtagaagaattcccctccacaattaaaactgtgtgctacaacttctggatcccctcctgagtgtttatcaaagactatcatatcagcagccagggcct

SEQ ID NO: 400957 - DNA, 140 bp, Artificial Sequence
  Synthetic
aggccctggctgctgatatgagataagggaaagaatgagacgagctgagccagcagcagatggggtgggagcagtatctcgagacctggaaaagcatggagcaatcacaagtagcaatacgaccttttgggacagcggtg

SEQ ID NO: 400958 - DNA, 140 bp, Artificial Sequence
  Synthetic
caccgctgtcccaaaaggtcgtattgctacttgtgattgctccatgcttttccaggtctcgagatactgctcccaccccatctgctgctggctcagctcgtctcattctttcccttatctcatatcagcagccagggcct

SEQ ID NO: 400959 - DNA, 140 bp, Artificial Sequence
  Synthetic
aggccctggctgctgatatgcaaaggcttaggcatctcctatggcaggaagaagcggaagcaccgacgaggacctcctcagagcagtaaggatcatcaaaatcctgtaccaaagcagtaagaccttttgggacagcggtg

SEQ ID NO: 400960 - DNA, 140 bp, Artificial Sequence
  Synthetic
caccgctgtcccaaaaggtcttactgctttggtacaggattttgatgatccttactgctctgaggaggtcctcgtcggtgcttccgcttcttcctgccataggagatgcctaagcctttgcatatcagcagccagggcct

SEQ ID NO: 400961 - DNA, 140 bp, Artificial Sequence
  Synthetic
aggccctggctgctgatatggctctggaaaactcatttgcaccactgctgtgccttggaatgctagttggagtaataaatctcacgatgagatttggaataacatgacttggatggagtggaccttttgggacagcggtg

SEQ ID NO: 400962 - DNA, 140 bp, Artificial Sequence
  Synthetic
caccgctgtcccaaaaggtccactccatccaagtcatgttattccaaatctcatcgtgagatttattactccaactagcattccaaggcacagcagtggtgcaaatgagttttccagagccatatcagcagccagggcct

SEQ ID NO: 400963 - DNA, 140 bp, Artificial Sequence
  Synthetic
atacgccatgctgggtctcctttatacaatataaggaaataagaaaacagaagaaaatacaaaagatacttgatagaataagagaaagagcagaagacagtggaaatgaaagcgaaggggcgtacttgggagtcggccat

SEQ ID NO: 400964 - DNA, 140 bp, Artificial Sequence
  Synthetic
atggccgactcccaagtacgccccttcgctttcatttccactgtcttctgctctttctcttattctatcaagtatcttttgtattttcttctgttttcttatttccttatattgtataaaggagacccagcatggcgtat

SEQ ID NO: 400965 - DNA, 140 bp, Artificial Sequence
  Synthetic
aggccctggctgctgatatgacagctcctagggatttggggctgctctggaaaactcatctgcaccactgctgtgccttggaactccagttggagtaataaaactcaagatgagatttgggaccttttgggacagcggtg

SEQ ID NO: 400966 - DNA, 140 bp, Artificial Sequence
  Synthetic
caccgctgtcccaaaaggtcccaaatctcatcttgagttttattactccaactggagttccaaggcacagcagtggtgcagatgagttttccagagcagccccaaatccctaggagctgtcatatcagcagccagggcct

SEQ ID NO: 400967 - DNA, 140 bp, Artificial Sequence
  Synthetic
aggccctggctgctgatatgaccatagcaatagcagtagctgaaggaacagataggattatagaattaatacaaagactttgtagagctatccttaatatacctagaagaataagacagggaccttttgggacagcggtg

SEQ ID NO: 400968 - DNA, 140 bp, Artificial Sequence
  Synthetic
caccgctgtcccaaaaggtccctgtcttattcttctaggtatattaaggatagctctacaaagtctttgtattaattctataatcctatctgttccttcagctactgctattgctatggtcatatcagcagccagggcct

SEQ ID NO: 400969 - DNA, 140 bp, Artificial Sequence
  Synthetic
  misc_feature (39)..(39): n is a, c, g, or t
atacgccatgctgggtctccctataaaatgggtggcaantggtcaaaaagcaaaatgtttggatgggctactgtaagggaaagaatgatgcgagctgagccagcagcaactggggtgggacgtacttgggagtcggccat

SEQ ID NO: 400970 - DNA, 140 bp, Artificial Sequence
  Synthetic
  misc_feature (102)..(102): n is a, c, g, or t
atggccgactcccaagtacgtcccaccccagttgctgctggctcagctcgcatcattctttcccttacagtagcccatccaaacattttgctttttgaccanttgccacccattttatagggagacccagcatggcgtat

SEQ ID NO: 400971 - DNA, 140 bp, Artificial Sequence
  Synthetic
aggccctggctgctgatatgctgtaagggaaagaatgatgcgagctgagccagcagcaactggggtgggagcagtatctcaagacctagaaaaacatggagcaatcacaagtagcagtatgaccttttgggacagcggtg

SEQ ID NO: 400972 - DNA, 140 bp, Artificial Sequence
  Synthetic
caccgctgtcccaaaaggtcatactgctacttgtgattgctccatgtttttctaggtcttgagatactgctcccaccccagttgctgctggctcagctcgcatcattctttcccttacagcatatcagcagccagggcct

SEQ ID NO: 400973 - DNA, 140 bp, Artificial Sequence
  Synthetic
aggccctggctgctgatatgaatacaagaaaaaggataaccatgggaccagggagagtattgtatacaacaggacaaataataggagatataagaaaagcacattgtaacattagcagaagaccttttgggacagcggtg

SEQ ID NO: 400974 - DNA, 140 bp, Artificial Sequence
  Synthetic
caccgctgtcccaaaaggtcttctgctaatgttacaatgtgcttttcttatatctcctattatttgtcctgttgtatacaatactctccctggtcccatggttatcctttttcttgtattcatatcagcagccagggcct

SEQ ID NO: 400975 - DNA, 140 bp, Artificial Sequence
  Synthetic
atacgccatgctgggtctccaagaaatgatgacggcctgtcagggagtggggggaccagcgcataaggcaagagtgctagcagaggctatgtcacaggtacagacagcaactagtgtcttcgtacttgggagtcggccat

SEQ ID NO: 400976 - DNA, 140 bp, Artificial Sequence
  Synthetic
atggccgactcccaagtacgaagacactagttgctgtctgtacctgtgacatagcctctgctagcactcttgccttatgcgctggtccccccactccctgacaggccgtcatcatttcttggagacccagcatggcgtat

SEQ ID NO: 400977 - DNA, 140 bp, Artificial Sequence
  Synthetic
aggccctggctgctgatatgaatgctagttggagtaataaatctctgaatgacatttggcataacatgacctggatggagtgggaaagagaaattgacaattacacaggcttaatatacagaccttttgggacagcggtg

SEQ ID NO: 400978 - DNA, 140 bp, Artificial Sequence
  Synthetic
caccgctgtcccaaaaggtctgtatattaagcctgtgtaattgtcaatttctctttcccactccatccaggtcatgttatgccaaatgtcattcagagatttattactccaactagcattcatatcagcagccagggcct

SEQ ID NO: 400979 - DNA, 140 bp, Artificial Sequence
  Synthetic
aggccctggctgctgatatggccagggggaaagaaaaaatataggatgaaacatttagtatgggcaagcaggaagttggaaagattcgcgcttaaccctggccttttagaaacagcagaagaccttttgggacagcggtg

SEQ ID NO: 400980 - DNA, 140 bp, Artificial Sequence
  Synthetic
caccgctgtcccaaaaggtcttctgctgtttctaaaaggccagggttaagcgcgaatctttccaacttcctgcttgcccatactaaatgtttcatcctatattttttctttccccctggccatatcagcagccagggcct

SEQ ID NO: 400981 - DNA, 140 bp, Artificial Sequence
  Synthetic
aggccctggctgctgatatggtaatatggggaaagactcctaaatttagattacccatacaaaaagaaacatgggacacatggtggacggagtattggcaggccacctggattcctgagtgaccttttgggacagcggtg

SEQ ID NO: 400982 - DNA, 140 bp, Artificial Sequence
  Synthetic
caccgctgtcccaaaaggtcactcaggaatccaggtggcctgccaatactccgtccaccatgtgtcccatgtttctttttgtatgggtaatctaaatttaggagtctttccccatattaccatatcagcagccagggcct

SEQ ID NO: 400983 - DNA, 140 bp, Artificial Sequence
  Synthetic
aggccctggctgctgatatgaattcaagaaaaagtataaggatagggccagggcaaacattctatgcaacaaatgcaataataggagacataagagaagcatattgtaaccttaatgggagaccttttgggacagcggtg

SEQ ID NO: 400984 - DNA, 140 bp, Artificial Sequence
  Synthetic
caccgctgtcccaaaaggtctcccattaaggttacaatatgcttctcttatgtctcctattattgcatttgttgcatagaatgtttgccctggccctatccttatactttttcttgaattcatatcagcagccagggcct

SEQ ID NO: 400985 - DNA, 140 bp, Artificial Sequence
  Synthetic
aggccctggctgctgatatgtcagaggtaggctttccagtcagaccacaggtacctctgagaccaatgacttataaggctgcttttgatctcagcttctttttaaaagaaaaggggggacgaccttttgggacagcggtg

SEQ ID NO: 400986 - DNA, 140 bp, Artificial Sequence
  Synthetic
caccgctgtcccaaaaggtcgtccccccttttcttttaaaaagaagctgagatcaaaagcagccttataagtcattggtctcagaggtacctgtggtctgactggaaagcctacctctgacatatcagcagccagggcct

SEQ ID NO: 400987 - DNA, 140 bp, Artificial Sequence
  Synthetic
atacgccatgctgggtctccacagacaccaacatcacactcccatgccgaataaaacaaattataaacatgtggcagggagtaggaaaagcaatgtatgccccccccattgaaggacaaacgtacttgggagtcggccat

SEQ ID NO: 400988 - DNA, 140 bp, Artificial Sequence
  Synthetic
atggccgactcccaagtacgtttgtccttcaatggggggggcatacattgcttttcctactccctgccacatgtttataatttgttttattcggcatgggagtgtgatgttggtgtctgtggagacccagcatggcgtat

SEQ ID NO: 400989 - DNA, 140 bp, Artificial Sequence
  Synthetic
aggccctggctgctgatatgggaaagaaaaaatatagactgaaacatttagtatgggcaagcagggagctggaaagatttgcacttaaccctggccttttagaaacagcagaaggttgtcgaccttttgggacagcggtg

SEQ ID NO: 400990 - DNA, 140 bp, Artificial Sequence
  Synthetic
caccgctgtcccaaaaggtcgacaaccttctgctgtttctaaaaggccagggttaagtgcaaatctttccagctccctgcttgcccatactaaatgtttcagtctatattttttctttcccatatcagcagccagggcct

SEQ ID NO: 400991 - DNA, 140 bp, Artificial Sequence
  Synthetic
aggccctggctgctgatatgctgagagacaggctaattttttagggaaaatttggccttccaacaagggaaggccagggaattttcctcagagcagaccagagccaacagccccaccagcgaccttttgggacagcggtg

SEQ ID NO: 400992 - DNA, 140 bp, Artificial Sequence
  Synthetic
caccgctgtcccaaaaggtcgctggtggggctgttggctctggtctgctctgaggaaaattccctggccttcccttgttggaaggccaaattttccctaaaaaattagcctgtctctcagcatatcagcagccagggcct

SEQ ID NO: 400993 - DNA, 140 bp, Artificial Sequence
  Synthetic
aggccctggctgctgatatgagaaagacagggaacatcctcctccttcagtttccctcaaatcactctttggcaacgaccccttgtcacagtaaaagtaggaggacagctgaaagaagctgaccttttgggacagcggtg

SEQ ID NO: 400994 - DNA, 140 bp, Artificial Sequence
  Synthetic
caccgctgtcccaaaaggtcagcttctttcagctgtcctcctacttttactgtgacaaggggtcgttgccaaagagtgatttgagggaaactgaaggaggaggatgttccctgtctttctcatatcagcagccagggcct

SEQ ID NO: 400995 - DNA, 140 bp, Artificial Sequence
  Synthetic
aggccctggctgctgatatgtaggaggcttagtaggtttaagaatagtttttactgtactttctatagtgaatagagttaggcagggatactcaccattatcattccagacccgcctcccgaccttttgggacagcggtg

SEQ ID NO: 400996 - DNA, 140 bp, Artificial Sequence
  Synthetic
caccgctgtcccaaaaggtcgggaggcgggtctggaatgataatggtgagtatccctgcctaactctattcactatagaaagtacagtaaaaactattcttaaacctactaagcctcctacatatcagcagccagggcct

SEQ ID NO: 400997 - DNA, 140 bp, Artificial Sequence
  Synthetic
aggccctggctgctgatatgaatagagttaggcagggatactcaccattatcattccagacccgcctcccagccccgaggggacccgacaggcccgaaggaatcgaagaagaaggtggaggaccttttgggacagcggtg

SEQ ID NO: 400998 - DNA, 140 bp, Artificial Sequence
  Synthetic
caccgctgtcccaaaaggtcctccaccttcttcttcgattccttcgggcctgtcgggtcccctcggggctgggaggcgggtctggaatgataatggtgagtatccctgcctaactctattcatatcagcagccagggcct

SEQ ID NO: 400999 - DNA, 140 bp, Artificial Sequence
  Synthetic
aggccctggctgctgatatgaatagtctttaagcaatcctcaggaggggacccagaaattgtaatgcacagttttaattgtggaggggaatttttctactgtaattcaacacaactgtttgaccttttgggacagcggtg

SEQ ID NO: 401000 - DNA, 140 bp, Artificial Sequence
  Synthetic
caccgctgtcccaaaaggtcaaacagttgtgttgaattacagtagaaaaattcccctccacaattaaaactgtgcattacaatttctgggtcccctcctgaggattgcttaaagactattcatatcagcagccagggcct

SEQ ID NO: 401001 - DNA, 140 bp, Artificial Sequence
  Synthetic
atacgccatgctgggtctccaggtgagggaacagatagggtcatagaagcagcacaagtaattggtaggggtatcctccacatacctagaagaataagacaagggcttgaaagggctttgcgtacttgggagtcggccat

SEQ ID NO: 401002 - DNA, 140 bp, Artificial Sequence
  Synthetic
atggccgactcccaagtacgcaaagccctttcaagcccttgtcttattcttctaggtatgtggaggatacccctaccaattacttgtgctgcttctatgaccctatctgttccctcacctggagacccagcatggcgtat

SEQ ID NO: 401003 - DNA, 140 bp, Artificial Sequence
  Synthetic
aggccctggctgctgatatgccttagaagaaatgatgatagcttgtcagggagtaggaggaccaactcataaggccagagtactagcagaagcaatgtctgcagcccaagatctgaaggggaccttttgggacagcggtg

SEQ ID NO: 401004 - DNA, 140 bp, Artificial Sequence
  Synthetic
caccgctgtcccaaaaggtccccttcagatcttgggctgcagacattgcttctgctagtactctggccttatgagttggtcctcctactccctgacaagctatcatcatttcttctaaggcatatcagcagccagggcct

SEQ ID NO: 401005 - DNA, 140 bp, Artificial Sequence
  Synthetic
aggccctggctgctgatatgctataagatgggtggcaagtggtcaaaatgtcgtgtacccggatggcctgagataagggaaaaaatgagaagagctgagccagcagcagatggggtgggagaccttttgggacagcggtg

SEQ ID NO: 401006 - DNA, 140 bp, Artificial Sequence
  Synthetic
caccgctgtcccaaaaggtctcccaccccatctgctgctggctcagctcttctcattttttcccttatctcaggccatccgggtacacgacattttgaccacttgccacccatcttatagcatatcagcagccagggcct

SEQ ID NO: 401007 - DNA, 140 bp, Artificial Sequence
  Synthetic
aggccctggctgctgatatgatctgatttagaaatagggcagcacagaacaaaaatagaggagctgagagctcatctattgagctggggatttactacaccagacaaaaagcatcagaaagaccttttgggacagcggtg

SEQ ID NO: 401008 - DNA, 140 bp, Artificial Sequence
  Synthetic
caccgctgtcccaaaaggtctttctgatgctttttgtctggtgtagtaaatccccagctcaatagatgagctctcagctcctctatttttgttctgtgctgccctatttctaaatcagatcatatcagcagccagggcct

SEQ ID NO: 401009 - DNA, 140 bp, Artificial Sequence
  Synthetic
aggccctggctgctgatatgcttaggcatctcccatggcaggaagaagcggagacaacgacaaagaactcctccaagcagtcggatacatcaagatcttgtaccaaagcagtaagtattggaccttttgggacagcggtg

SEQ ID NO: 401010 - DNA, 140 bp, Artificial Sequence
  Synthetic
caccgctgtcccaaaaggtccaatacttactgctttggtacaagatcttgatgtatccgactgcttggaggagttctttgtcgttgtctccgcttcttcctgccatgggagatgcctaagcatatcagcagccagggcct

SEQ ID NO: 401011 - DNA, 140 bp, Artificial Sequence
  Synthetic
aggccctggctgctgatatggagcctgtgcctcttcagctaccaccgcttgagagacttactcttgattgtaacgaggattgtggaacttctgggacgcagggggtgggaaatcctcaaagaccttttgggacagcggtg

SEQ ID NO: 401012 - DNA, 140 bp, Artificial Sequence
  Synthetic
caccgctgtcccaaaaggtctttgaggatttcccaccccctgcgtcccagaagttccacaatcctcgttacaatcaagagtaagtctctcaagcggtggtagctgaagaggcacaggctccatatcagcagccagggcct

SEQ ID NO: 401013 - DNA, 140 bp, Artificial Sequence
  Synthetic
aggccctggctgctgatatgcttcagacaggatcagaagaacttagatcattatataatacagtagcaaccctctattgtgtgcatcaaaggatagaggtaaaagacaccaaggaagcttgaccttttgggacagcggtg

SEQ ID NO: 401014 - DNA, 140 bp, Artificial Sequence
  Synthetic
caccgctgtcccaaaaggtcaagcttccttggtgtcttttacctctatcctttgatgcacacaatagagggttgctactgtattatataatgatctaagttcttctgatcctgtctgaagcatatcagcagccagggcct

SEQ ID NO: 401015 - DNA, 140 bp, Artificial Sequence
  Synthetic
atacgccatgctgggtctccagagcggcggaacttctgggacgcagcagcctcaagggactgagactggggtgggaaggcctcaagtatcttgggaatcttctactgtattggagacaggcgtacttgggagtcggccat

SEQ ID NO: 401016 - DNA, 140 bp, Artificial Sequence
  Synthetic
atggccgactcccaagtacgcctgtctccaatacagtagaagattcccaagatacttgaggccttcccaccccagtctcagtcccttgaggctgctgcgtcccagaagttccgccgctctggagacccagcatggcgtat

SEQ ID NO: 401017 - DNA, 140 bp, Artificial Sequence
  Synthetic
atacgccatgctgggtctcctgttaataataccatgacgggagaaataaaaaattgctctttcaatgcaaccacagaactaaaagataagaaagagggggtgtatgcacttttttataaacgtacttgggagtcggccat

SEQ ID NO: 401018 - DNA, 140 bp, Artificial Sequence
  Synthetic
atggccgactcccaagtacgtttataaaaaagtgcatacaccccctctttcttatcttttagttctgtggttgcattgaaagagcaattttttatttctcccgtcatggtattattaacaggagacccagcatggcgtat

SEQ ID NO: 401019 - DNA, 140 bp, Artificial Sequence
  Synthetic
atacgccatgctgggtctcccgggaagtcagcctacaactgcttgtagcaagtgttactgtaaaaaatgttgctggcattgccaattatgctttctgaaaaaaggcttaggcatctcctacgtacttgggagtcggccat

SEQ ID NO: 401020 - DNA, 140 bp, Artificial Sequence
  Synthetic
atggccgactcccaagtacgtaggagatgcctaagccttttttcagaaagcataattggcaatgccagcaacattttttacagtaacacttgctacaagcagttgtaggctgacttcccgggagacccagcatggcgtat

SEQ ID NO: 401021 - DNA, 140 bp, Artificial Sequence
  Synthetic
aggccctggctgctgatatgcaatagtagtgtggactatagtagttatagaatataggaaaatactaaggcaaagaaaaatagacagattagttgagagaataagagaaagagcagaagagaccttttgggacagcggtg

SEQ ID NO: 401022 - DNA, 140 bp, Artificial Sequence
  Synthetic
caccgctgtcccaaaaggtctcttctgctctttctcttattctctcaactaatctgtctatttttctttgccttagtattttcctatattctataactactatagtccacactactattgcatatcagcagccagggcct

SEQ ID NO: 401023 - DNA, 140 bp, Artificial Sequence
  Synthetic
aggccctggctgctgatatgttaaaccacattcaggaggggacccagaaattacaacacatagctttaattgtagaggagaatttttctattgcgatacaacaggactgtttaatagtacgaccttttgggacagcggtg

SEQ ID NO: 401024 - DNA, 140 bp, Artificial Sequence
  Synthetic
caccgctgtcccaaaaggtcgtactattaaacagtcctgttgtatcgcaatagaaaaattctcctctacaattaaagctatgtgttgtaatttctgggtcccctcctgaatgtggtttaacatatcagcagccagggcct

SEQ ID NO: 401025 - DNA, 140 bp, Artificial Sequence
  Synthetic
atacgccatgctgggtctcccaagggctagatcagtggacatatcaaatatttcaagagccattcaaaaacctgaaaacagggaaatatgcaaaaaggaggactgcccacactaatgatgcgtacttgggagtcggccat

SEQ ID NO: 401026 - DNA, 140 bp, Artificial Sequence
  Synthetic
atggccgactcccaagtacgcatcattagtgtgggcagtcctcctttttgcatatttccctgttttcaggtttttgaatggctcttgaaatatttgatatgtccactgatctagcccttgggagacccagcatggcgtat

SEQ ID NO: 401027 - DNA, 140 bp, Artificial Sequence
  Synthetic
atacgccatgctgggtctccaagctaatattagtagatgggaaaggatggatccaggagaaataaaaaactgctctttcaatgtcaccagtaatataagtgataagaggcaaaaagaatacgtacttgggagtcggccat

SEQ ID NO: 401028 - DNA, 140 bp, Artificial Sequence
  Synthetic
atggccgactcccaagtacgtattctttttgcctcttatcacttatattactggtgacattgaaagagcagttttttatttctcctggatccatcctttcccatctactaatattagcttggagacccagcatggcgtat

SEQ ID NO: 401029 - DNA, 140 bp, Artificial Sequence
  Synthetic
aggccctggctgctgatatggaagcagagctagaactggcagaaaacagggaaattctaaaagaaccagtacatggagtgtattatgacccatcaaaagacttaatagcagaaatacagagaccttttgggacagcggtg

SEQ ID NO: 401030 - DNA, 140 bp, Artificial Sequence
  Synthetic
caccgctgtcccaaaaggtctctgtatttctgctattaagtcttttgatgggtcataatacactccatgtactggttcttttagaatttccctgttttctgccagttctagctctgcttccatatcagcagccagggcct

SEQ ID NO: 401031 - DNA, 140 bp, Artificial Sequence
  Synthetic
atacgccatgctgggtctccccagttggagtaatagaactaaaaaggaaatttgggataacatgacctggatgcagtgggatagagaaattagcaattacacaaacataatatatgacttcgtacttgggagtcggccat

SEQ ID NO: 401032 - DNA, 140 bp, Artificial Sequence
  Synthetic
atggccgactcccaagtacgaagtcatatattatgtttgtgtaattgctaatttctctatcccactgcatccaggtcatgttatcccaaatttcctttttagttctattactccaactggggagacccagcatggcgtat

SEQ ID NO: 401033 - DNA, 140 bp, Artificial Sequence
  Synthetic
aggccctggctgctgatatgatatacataggaccagggaaaaaagtttatacaacagatagaataataggcgatataagaaaagcacattgcaacattactagagcgagaaatggagtaagaccttttgggacagcggtg

SEQ ID NO: 401034 - DNA, 140 bp, Artificial Sequence
  Synthetic
caccgctgtcccaaaaggtcttactccatttctcgctctagtaatgttgcaatgtgcttttcttatatcgcctattattctatctgttgtataaacttttttccctggtcctatgtatatcatatcagcagccagggcct

SEQ ID NO: 401035 - DNA, 140 bp, Artificial Sequence
  Synthetic
aggccctggctgctgatatggttgacaagttgtaacacctcaatcattaaacaggcctgtccaaaagtatcctttacgccaattcccatacattattgtgccccggctggttttgtgattgaccttttgggacagcggtg

SEQ ID NO: 401036 - DNA, 140 bp, Artificial Sequence
  Synthetic
caccgctgtcccaaaaggtcaatcacaaaaccagccggggcacaataatgtatgggaattggcgtaaaggatacttttggacaggcctgtttaatgattgaggtgttacaacttgtcaaccatatcagcagccagggcct

SEQ ID NO: 401037 - DNA, 140 bp, Artificial Sequence
  Synthetic
atacgccatgctgggtctcctattaagacaaagaaagatagacaggttaattgataaaataagaaaaagagaagaagacagtggtaacgagagtgatggagatcaagaagaattatcagccgtacttgggagtcggccat

SEQ ID NO: 401038 - DNA, 140 bp, Artificial Sequence
  Synthetic
atggccgactcccaagtacggctgataattcttcttgatctccatcactctcgttaccactgtcttcttctctttttcttattttatcaattaacctgtctatctttctttgtcttaataggagacccagcatggcgtat

SEQ ID NO: 401039 - DNA, 140 bp, Artificial Sequence
  Synthetic
aggccctggctgctgatatgactaatttgacattgagtaatgctactgagggaataaataacaatagtagtattgctagtgaggaaatgaagaactgctctttcaacgtcaccacaagcagaccttttgggacagcggtg

SEQ ID NO: 401040 - DNA, 140 bp, Artificial Sequence
  Synthetic
caccgctgtcccaaaaggtctgcttgtggtgacgttgaaagagcagttcttcatttcctcactagcaatactactattgttatttattccctcagtagcattactcaatgtcaaattagtcatatcagcagccagggcct

SEQ ID NO: 401041 - DNA, 140 bp, Artificial Sequence
  Synthetic
aggccctggctgctgatatgtcaaagcagtaagtatatgtaatgttagatttactagcaagagtagattatagattaggagtaggagcattgataatagcattaatcatagcaatagttggaccttttgggacagcggtg

SEQ ID NO: 401042 - DNA, 140 bp, Artificial Sequence
  Synthetic
caccgctgtcccaaaaggtccaactattgctatgattaatgctattatcaatgctcctactcctaatctataatctactcttgctagtaaatctaacattacatatacttactgctttgacatatcagcagccagggcct

SEQ ID NO: 401043 - DNA, 140 bp, Artificial Sequence
  Synthetic
aggccctggctgctgatatgtgtggaccatagcatatatagaatataggaaattattaagacaaagaaaaatagactggttaattaaaagaattagggaaagagcagaagacagtggcaagaccttttgggacagcggtg

SEQ ID NO: 401044 - DNA, 140 bp, Artificial Sequence
  Synthetic
caccgctgtcccaaaaggtcttgccactgtcttctgctctttccctaattcttttaattaaccagtctatttttctttgtcttaataatttcctatattctatatatgctatggtccacacatatcagcagccagggcct

SEQ ID NO: 401045 - DNA, 140 bp, Artificial Sequence
  Synthetic
aggccctggctgctgatatgaagtagtacaaagagcttatagagctattctccacatacccacaagaataagacagggcttcgaaagggctttgctataagatgggtggcaagtggtcaagaccttttgggacagcggtg

SEQ ID NO: 401046 - DNA, 140 bp, Artificial Sequence
  Synthetic
caccgctgtcccaaaaggtcttgaccacttgccacccatcttatagcaaagccctttcgaagccctgtcttattcttgtgggtatgtggagaatagctctataagctctttgtactacttcatatcagcagccagggcct

SEQ ID NO: 401047 - DNA, 140 bp, Artificial Sequence
  Synthetic
atacgccatgctgggtctcccattctatgcaacaggagaaataatagaagatataaggaaagcacattgtaaccttagtcaaacaaaatggaataacactttaaaacagatagttacaaacgtacttgggagtcggccat

SEQ ID NO: 401048 - DNA, 140 bp, Artificial Sequence
  Synthetic
atggccgactcccaagtacgtttgtaactatctgttttaaagtgttattccattttgtttgactaaggttacaatgtgctttccttatatcttctattatttctcctgttgcatagaatgggagacccagcatggcgtat

SEQ ID NO: 401049 - DNA, 140 bp, Artificial Sequence
  Synthetic
aggccctggctgctgatatgataaaacaaattataaacaggtggcaggaagtaggaaaagcaatgtatgcccctcccatcagaggactaattagatgttcatcaaatatcacagggctgcgaccttttgggacagcggtg

SEQ ID NO: 401050 - DNA, 140 bp, Artificial Sequence
  Synthetic
caccgctgtcccaaaaggtcgcagccctgtgatatttgatgaacatctaattagtcctctgatgggaggggcatacattgcttttcctacttcctgccacctgtttataatttgttttatcatatcagcagccagggcct

SEQ ID NO: 401051 - DNA, 140 bp, Artificial Sequence
  Synthetic
atacgccatgctgggtctccaaaaggtaaaggcgaaattaagagaacacttccctaataaaaccataagatttgatccatcctcaggaggggatctagaagttgtaacacatagttttaacgtacttgggagtcggccat

SEQ ID NO: 401052 - DNA, 140 bp, Artificial Sequence
  Synthetic
atggccgactcccaagtacgttaaaactatgtgttacaacttctagatcccctcctgaggatggatcaaatcttatggttttattagggaagtgttctcttaatttcgcctttaccttttggagacccagcatggcgtat

SEQ ID NO: 401053 - DNA, 140 bp, Artificial Sequence
  Synthetic
atacgccatgctgggtctcctagtaggaatactactactaataccactagtagtagcgatggagtgatggaaaaaggagaaataaaaaactgctctttcaatattaccacaagcataagacgtacttgggagtcggccat

SEQ ID NO: 401054 - DNA, 140 bp, Artificial Sequence
  Synthetic
atggccgactcccaagtacgtcttatgcttgtggtaatattgaaagagcagttttttatttctcctttttccatcactccatcgctactactagtggtattagtagtagtattcctactaggagacccagcatggcgtat

SEQ ID NO: 401055 - DNA, 140 bp, Artificial Sequence
  Synthetic
aggccctggctgctgatatgtaataaaacaataaaatttaattcatcctcaggaggggacctagaaattacaatgcatagttttaattgtagaggagaatttttctactgcaatacatcagaccttttgggacagcggtg

SEQ ID NO: 401056 - DNA, 140 bp, Artificial Sequence
  Synthetic
caccgctgtcccaaaaggtctgatgtattgcagtagaaaaattctcctctacaattaaaactatgcattgtaatttctaggtcccctcctgaggatgaattaaattttattgttttattacatatcagcagccagggcct

SEQ ID NO: 401057 - DNA, 140 bp, Artificial Sequence
  Synthetic
atacgccatgctgggtctcccccatgtaaaataaaacaaatagtaaatatgtggcaagaagtaggacgagcaatgtatgccgcccccattgcaggaaacattacctgtaactcaagtattcgtacttgggagtcggccat

SEQ ID NO: 401058 - DNA, 140 bp, Artificial Sequence
  Synthetic
atggccgactcccaagtacgaatacttgagttacaggtaatgtttcctgcaatgggggcggcatacattgctcgtcctacttcttgccacatatttactatttgttttattttacatgggggagacccagcatggcgtat

SEQ ID NO: 401059 - DNA, 140 bp, Artificial Sequence
  Synthetic
atacgccatgctgggtctcctactgagaccttcagacctgggggaggaaatatgaaggacaattggagaagtgaattatataaatataaagtagtaaaaattgagccattaggagtagcacgtacttgggagtcggccat

SEQ ID NO: 401060 - DNA, 140 bp, Artificial Sequence
  Synthetic
atggccgactcccaagtacgtgctactcctaatggctcaatttttactactttatatttatataattcacttctccaattgtccttcatatttcctcccccaggtctgaaggtctcagtaggagacccagcatggcgtat

SEQ ID NO: 401061 - DNA, 140 bp, Artificial Sequence
  Synthetic
aggccctggctgctgatatgacaacaatacaataaaaggtatacatataggaccagggagagcattttatacaacaggacaaatagtaggagatataagacaagcacattgtaacattaggaccttttgggacagcggtg

SEQ ID NO: 401062 - DNA, 140 bp, Artificial Sequence
  Synthetic
caccgctgtcccaaaaggtcctaatgttacaatgtgcttgtcttatatctcctactatttgtcctgttgtataaaatgctctccctggtcctatatgtataccttttattgtattgttgtcatatcagcagccagggcct

SEQ ID NO: 401063 - DNA, 140 bp, Artificial Sequence
  Synthetic
atacgccatgctgggtctccaagactttgtagagctatttgcaacatacctagaagaatcagacagggcttcgaaagggctttgcaataaagatgggtggcaagtggtcaaaacctagcccgtacttgggagtcggccat

SEQ ID NO: 401064 - DNA, 140 bp, Artificial Sequence
  Synthetic
atggccgactcccaagtacgggctaggttttgaccacttgccacccatctttattgcaaagccctttcgaagccctgtctgattcttctaggtatgttgcaaatagctctacaaagtcttggagacccagcatggcgtat

SEQ ID NO: 401065 - DNA, 140 bp, Artificial Sequence
  Synthetic
aggccctggctgctgatatgccctcaaatcactctttggcaacgaccccttgtcacagtaaaagtaggaggacagctgaaagaagctctattagatacaggagcagatgatacagtattagaccttttgggacagcggtg

SEQ ID NO: 401066 - DNA, 140 bp, Artificial Sequence
  Synthetic
caccgctgtcccaaaaggtctaatactgtatcatctgctcctgtatctaatagagcttctttcagctgtcctcctacttttactgtgacaaggggtcgttgccaaagagtgatttgagggcatatcagcagccagggcct

SEQ ID NO: 401067 - DNA, 140 bp, Artificial Sequence
  Synthetic
aggccctggctgctgatatgcggcgactggtgagtacgccaaaaattttttgactagcggaggctagaaggagagagatgggtgcgagagcgtcagtattaagcgggggagaattagatagaccttttgggacagcggtg

SEQ ID NO: 401068 - DNA, 140 bp, Artificial Sequence
  Synthetic
caccgctgtcccaaaaggtctatctaattctcccccgcttaatactgacgctctcgcacccatctctctccttctagcctccgctagtcaaaaaatttttggcgtactcaccagtcgccgcatatcagcagccagggcct

SEQ ID NO: 401069 - DNA, 140 bp, Artificial Sequence
  Synthetic
aggccctggctgctgatatgaaagaaaaaatcagtaacagtactagatgtgggagatgcatatttttcagttcctttagatgaaagctttagaaagtatactgcattcaccatacctagtgaccttttgggacagcggtg

SEQ ID NO: 401070 - DNA, 140 bp, Artificial Sequence
  Synthetic
caccgctgtcccaaaaggtcactaggtatggtgaatgcagtatactttctaaagctttcatctaaaggaactgaaaaatatgcatctcccacatctagtactgttactgattttttctttcatatcagcagccagggcct

SEQ ID NO: 401071 - DNA, 140 bp, Artificial Sequence
  Synthetic
aggccctggctgctgatatgagcacaagaggaggaagaagaagtaggctttccagtcagacctcaggtgcctttaagaccaatgacttataagggagcattcgatctcagcttctttttagaccttttgggacagcggtg

SEQ ID NO: 401072 - DNA, 140 bp, Artificial Sequence
  Synthetic
caccgctgtcccaaaaggtctaaaaagaagctgagatcgaatgctcccttataagtcattggtcttaaaggcacctgaggtctgactggaaagcctacttcttcttcctcctcttgtgctcatatcagcagccagggcct

SEQ ID NO: 401073 - DNA, 140 bp, Artificial Sequence
  Synthetic
atacgccatgctgggtctccaagcagtacaaagaattggcaggggtatcctccacatacctagaagaataagacaaggcttagaaagaagtttgctataagatgggtggcaagtggtcaacgtacttgggagtcggccat

SEQ ID NO: 401074 - DNA, 140 bp, Artificial Sequence
  Synthetic
atggccgactcccaagtacgttgaccacttgccacccatcttatagcaaacttctttctaagccttgtcttattcttctaggtatgtggaggatacccctgccaattctttgtactgcttggagacccagcatggcgtat

SEQ ID NO: 401075 - DNA, 140 bp, Artificial Sequence
  Synthetic
atacgccatgctgggtctccataatgccgattgtgcctggctggaagcacaagagaatgaggaagtaggctttccagtcagacctcaggtacctttaagaccaatgactcatagggcagccgtacttgggagtcggccat

SEQ ID NO: 401076 - DNA, 140 bp, Artificial Sequence
  Synthetic
atggccgactcccaagtacggctgccctatgagtcattggtcttaaaggtacctgaggtctgactggaaagcctacttcctcattctcttgtgcttccagccaggcacaatcggcattatggagacccagcatggcgtat

SEQ ID NO: 401077 - DNA, 140 bp, Artificial Sequence
  Synthetic
aggccctggctgctgatatgattggagtcaggaactaaagaatagtgctattagcttgctcaatgccacagccatagcagtagctgaggggacagataggattatagaaatattacaaaggaccttttgggacagcggtg

SEQ ID NO: 401078 - DNA, 140 bp, Artificial Sequence
  Synthetic
caccgctgtcccaaaaggtcctttgtaatatttctataatcctatctgtcccctcagctactgctatggctgtggcattgagcaagctaatagcactattctttagttcctgactccaatcatatcagcagccagggcct

SEQ ID NO: 401079 - DNA, 140 bp, Artificial Sequence
  Synthetic
aggccctggctgctgatatggggtgggagcagcatctcgagacctggaaaaacatggagcactcacaagtagcaatacagcagctaacaatgctgattgtgcctggctagaagcacaagagaccttttgggacagcggtg

SEQ ID NO: 401080 - DNA, 140 bp, Artificial Sequence
  Synthetic
caccgctgtcccaaaaggtctcttgtgcttctagccaggcacaatcagcattgttagctgctgtattgctacttgtgagtgctccatgtttttccaggtctcgagatgctgctcccaccccatatcagcagccagggcct

SEQ ID NO: 401081 - DNA, 140 bp, Artificial Sequence
  Synthetic
aggccctggctgctgatatgagcaatacagcagctaacaatgctgattgtgcctggctagaagcacaagaggatgaggaggtgggtttcccagtcagacctcaggtacctttaagaccaagaccttttgggacagcggtg

SEQ ID NO: 401082 - DNA, 140 bp, Artificial Sequence
  Synthetic
caccgctgtcccaaaaggtcttggtcttaaaggtacctgaggtctgactgggaaacccacctcctcatcctcttgtgcttctagccaggcacaatcagcattgttagctgctgtattgctcatatcagcagccagggcct

SEQ ID NO: 401083 - DNA, 140 bp, Artificial Sequence
  Synthetic
aggccctggctgctgatatgatcacaataattggagagcaatggctagtgattttaatctgccacctgtagtagcaaaagaaatagtggccagctgtgataaatgtcagctaaaaggggagaccttttgggacagcggtg

SEQ ID NO: 401084 - DNA, 140 bp, Artificial Sequence
  Synthetic
caccgctgtcccaaaaggtctccccttttagctgacatttatcacagctggccactatttcttttgctactacaggtggcagattaaaatcactagccattgctctccaattattgtgatcatatcagcagccagggcct

SEQ ID NO: 401085 - DNA, 140 bp, Artificial Sequence
  Synthetic
atacgccatgctgggtctcctggactttagagatattagaagaactcaagcaggaagcggtcagacattttcctagaccatggcttcataacttaggacaatatatctatgaaatccatgcgtacttgggagtcggccat

SEQ ID NO: 401086 - DNA, 140 bp, Artificial Sequence
  Synthetic
atggccgactcccaagtacgcatggatttcatagatatattgtcctaagttatgaagccatggtctaggaaaatgtctgaccgcttcctgcttgagttcttctaatatctctaaagtccaggagacccagcatggcgtat

SEQ ID NO: 401087 - DNA, 140 bp, Artificial Sequence
  Synthetic
aggccctggctgctgatatgaggagttgaagccataataagaatactacaacagctattgtttatccatttcagaattgggtgccaacatagcagaataggcattattccacggagaagagaccttttgggacagcggtg

SEQ ID NO: 401088 - DNA, 140 bp, Artificial Sequence
  Synthetic
caccgctgtcccaaaaggtctcttctccgtggaataatgcctattctgctatgttggcacccaattctgaaatggataaacaatagctgttgtagtattcttattatggcttcaactcctcatatcagcagccagggcct

SEQ ID NO: 401089 - DNA, 140 bp, Artificial Sequence
  Synthetic
atacgccatgctgggtctccaagaaacaaattgctctaaagatgaaagtgttacccataatggtgccacatgtgaagaaatgagaaattgctctttcaatataaccacagaactaagagacgtacttgggagtcggccat

SEQ ID NO: 401090 - DNA, 140 bp, Artificial Sequence
  Synthetic
atggccgactcccaagtacgtctcttagttctgtggttatattgaaagagcaatttctcatttcttcacatgtggcaccattatgggtaacactttcatctttagagcaatttgtttcttggagacccagcatggcgtat

SEQ ID NO: 401091 - DNA, 140 bp, Artificial Sequence
  Synthetic
atacgccatgctgggtctccatcaaaatcctgtaccaaagcagtaagtagtaataattagtatatgtaatgcaaccattagaaatatctgcaatagtaggactaatagtagcaggcatagcgtacttgggagtcggccat

SEQ ID NO: 401092 - DNA, 140 bp, Artificial Sequence
  Synthetic
atggccgactcccaagtacgctatgcctgctactattagtcctactattgcagatatttctaatggttgcattacatatactaattattactacttactgctttggtacaggattttgatggagacccagcatggcgtat

SEQ ID NO: 401093 - DNA, 140 bp, Artificial Sequence
  Synthetic
atacgccatgctgggtctcccttagaaattataacacatagctttaattgtggaggagaatttttctattgcaatacaacaaaactgtttaatagtacatacatgcctgtatacaatggtcgtacttgggagtcggccat

SEQ ID NO: 401094 - DNA, 140 bp, Artificial Sequence
  Synthetic
atggccgactcccaagtacgaccattgtatacaggcatgtatgtactattaaacagttttgttgtattgcaatagaaaaattctcctccacaattaaagctatgtgttataatttctaagggagacccagcatggcgtat

SEQ ID NO: 401095 - DNA, 140 bp, Artificial Sequence
  Synthetic
atacgccatgctgggtctccagagtggtggagagagaaaaaagagcagtgggaataggagctgtgttccttgggttcttaggagcagcaggaagcactatgggcgcggcgtcaataacgccgtacttgggagtcggccat

SEQ ID NO: 401096 - DNA, 140 bp, Artificial Sequence
  Synthetic
atggccgactcccaagtacggcgttattgacgccgcgcccatagtgcttcctgctgctcctaagaacccaaggaacacagctcctattcccactgctcttttttctctctccaccactctggagacccagcatggcgtat

SEQ ID NO: 401097 - DNA, 140 bp, Artificial Sequence
  Synthetic
aggccctggctgctgatatgacaggacaaataataggagatataagacaagcacattgtaacattagcaaaacaaaatggaataacactttaggacagatagttaataaattaagagaacgaccttttgggacagcggtg

SEQ ID NO: 401098 - DNA, 140 bp, Artificial Sequence
  Synthetic
caccgctgtcccaaaaggtcgttctcttaatttattaactatctgtcctaaagtgttattccattttgttttgctaatgttacaatgtgcttgtcttatatctcctattatttgtcctgtcatatcagcagccagggcct

SEQ ID NO: 401099 - DNA, 140 bp, Artificial Sequence
  Synthetic
aggccctggctgctgatatgtgacaaatgccagctaaaaggggaagccatacatggacaggtcaattgtagtccaggagtgtggcagctagattgtacacatttagaaggaaaaatcattgaccttttgggacagcggtg

SEQ ID NO: 401100 - DNA, 140 bp, Artificial Sequence
  Synthetic
caccgctgtcccaaaaggtcaatgatttttccttctaaatgtgtacaatctagctgccacactcctggactacaattgacctgtccatgtatggcttccccttttagctggcatttgtcacatatcagcagccagggcct

SEQ ID NO: 401101 - DNA, 140 bp, Artificial Sequence
  Synthetic
aggccctggctgctgatatgcatgtggcagggagcaggacaagcaatgtatgctcctcccatcaggggaagaattagttgtgtatcaaatattacaggaatactattgacaagagatggtgaccttttgggacagcggtg

SEQ ID NO: 401102 - DNA, 140 bp, Artificial Sequence
  Synthetic
caccgctgtcccaaaaggtcaccatctcttgtcaatagtattcctgtaatatttgatacacaactaattcttcccctgatgggaggagcatacattgcttgtcctgctccctgccacatgcatatcagcagccagggcct

SEQ ID NO: 401103 - DNA, 140 bp, Artificial Sequence
  Synthetic
aggccctggctgctgatatggtaggatctctacaatacttggcactgacagcattgataaaaccaaaaaagagaaagccacctctgcctagtgttaggaaattagcagaggatagatggagaccttttgggacagcggtg

SEQ ID NO: 401104 - DNA, 140 bp, Artificial Sequence
  Synthetic
caccgctgtcccaaaaggtctccatctatcctctgctaatttcctaacactaggcagaggtggctttctcttttttggttttatcaatgctgtcagtgccaagtattgtagagatcctaccatatcagcagccagggcct

SEQ ID NO: 401105 - DNA, 140 bp, Artificial Sequence
  Synthetic
atacgccatgctgggtctcccgaatggcactgattggaataccactaatagtaataataccactattagtaaagaggaaacgatagagggaggagaaatgaagaactgctctttcaatatcgtacttgggagtcggccat

SEQ ID NO: 401106 - DNA, 140 bp, Artificial Sequence
  Synthetic
atggccgactcccaagtacgatattgaaagagcagttcttcatttctcctccctctatcgtttcctctttactaatagtggtattattactattagtggtattccaatcagtgccattcgggagacccagcatggcgtat

SEQ ID NO: 401107 - DNA, 140 bp, Artificial Sequence
  Synthetic
aggccctggctgctgatatgagtgcaaagaattggtagggctattatccatatacctgtaagaataagacaaggcttagaaagagctcttttataacatggggagcaagtggtcaaaatggaccttttgggacagcggtg

SEQ ID NO: 401108 - DNA, 140 bp, Artificial Sequence
  Synthetic
caccgctgtcccaaaaggtccattttgaccacttgctccccatgttataaaagagctctttctaagccttgtcttattcttacaggtatatggataatagccctaccaattctttgcactcatatcagcagccagggcct

SEQ ID NO: 401109 - DNA, 140 bp, Artificial Sequence
  Synthetic
aggccctggctgctgatatggaattgggtgtcgacatagcagaataggcatccttcaacagaggagaacaagaaatggagccagtagaccctagtctagagccctggaagcatccaggaagaccttttgggacagcggtg

SEQ ID NO: 401110 - DNA, 140 bp, Artificial Sequence
  Synthetic
caccgctgtcccaaaaggtcttcctggatgcttccagggctctagactagggtctactggctccatttcttgttctcctctgttgaaggatgcctattctgctatgtcgacacccaattccatatcagcagccagggcct

SEQ ID NO: 401111 - DNA, 140 bp, Artificial Sequence
  Synthetic
aggccctggctgctgatatggagagcctggtatgcaacaggagatataataggagatataagaaaagcatattgtaacattagtgaagcaaaatggaataacactttaaaacagataactgaccttttgggacagcggtg

SEQ ID NO: 401112 - DNA, 140 bp, Artificial Sequence
  Synthetic
caccgctgtcccaaaaggtcagttatctgttttaaagtgttattccattttgcttcactaatgttacaatatgcttttcttatatctcctattatatctcctgttgcataccaggctctccatatcagcagccagggcct

SEQ ID NO: 401113 - DNA, 140 bp, Artificial Sequence
  Synthetic
aggccctggctgctgatatggaagaagcggagacagcgacgaagacctcctaaaagcggtcagactcatcaagttcctctatcagagcagtaagtagtgcatgtaatgtctcaactgtatgaccttttgggacagcggtg

SEQ ID NO: 401114 - DNA, 140 bp, Artificial Sequence
  Synthetic
caccgctgtcccaaaaggtcatacagttgagacattacatgcactacttactgctctgatagaggaacttgatgagtctgaccgcttttaggaggtcttcgtcgctgtctccgcttcttccatatcagcagccagggcct

SEQ ID NO: 401115 - DNA, 140 bp, Artificial Sequence
  Synthetic
atacgccatgctgggtctccggatattagaagagtcctattcctagaaggaatagaccaggcacaagaagatcatgaaaagtatcatagcaattggagagcattagctagtgattttggacgtacttgggagtcggccat

SEQ ID NO: 401116 - DNA, 140 bp, Artificial Sequence
  Synthetic
atggccgactcccaagtacgtccaaaatcactagctaatgctctccaattgctatgatacttttcatgatcttcttgtgcctggtctattccttctaggaataggactcttctaatatccggagacccagcatggcgtat

SEQ ID NO: 401117 - DNA, 140 bp, Artificial Sequence
  Synthetic
atacgccatgctgggtctccgggagaaataaaaaactgcactttcaatgtcaccacaatgatagaaaataagcaaaagaaagaatatgcacttttttataaacttgatatagcaccagtacgtacttgggagtcggccat

SEQ ID NO: 401118 - DNA, 140 bp, Artificial Sequence
  Synthetic
atggccgactcccaagtacgtactggtgctatatcaagtttataaaaaagtgcatattctttcttttgcttattttctatcattgtggtgacattgaaagtgcagttttttatttctcccggagacccagcatggcgtat

SEQ ID NO: 401119 - DNA, 140 bp, Artificial Sequence
  Synthetic
atacgccatgctgggtctccatttggggagaataaaacaataaaatttgagccatcttcgggaggggacccagaaattacaatgcacagttttaattgtggaggggaatttttctactgtcgtacttgggagtcggccat

SEQ ID NO: 401120 - DNA, 140 bp, Artificial Sequence
  Synthetic
atggccgactcccaagtacgacagtagaaaaattcccctccacaattaaaactgtgcattgtaatttctgggtcccctcccgaagatggctcaaattttattgttttattctccccaaatggagacccagcatggcgtat

SEQ ID NO: 401121 - DNA, 140 bp, Artificial Sequence
  Synthetic
aggccctggctgctgatatgtagggaaaatctggccctcccacaagggaaggccagggaattttcttcagagcagaccagagccaacagccccaccagaggagagcttcaggtttggggagaccttttgggacagcggtg

SEQ ID NO: 401122 - DNA, 140 bp, Artificial Sequence
  Synthetic
caccgctgtcccaaaaggtctccccaaacctgaagctctcctctggtggggctgttggctctggtctgctctgaagaaaattccctggccttcccttgtgggagggccagattttccctacatatcagcagccagggcct

SEQ ID NO: 401123 - DNA, 140 bp, Artificial Sequence
  Synthetic
atacgccatgctgggtctccgatggcctaaagtaagagagagaatgagaagagttgagccagcagcagatggggtgggagcagtatctcgagacttggatcaacgtggagcagtcacaatcgtacttgggagtcggccat

SEQ ID NO: 401124 - DNA, 140 bp, Artificial Sequence
  Synthetic
atggccgactcccaagtacgattgtgactgctccacgttgatccaagtctcgagatactgctcccaccccatctgctgctggctcaactcttctcattctctctcttactttaggccatcggagacccagcatggcgtat

SEQ ID NO: 401125 - DNA, 140 bp, Artificial Sequence
  Synthetic
aggccctggctgctgatatgtaataaaaaaggaaaaggtctacctgtcatgggtaccagcacacaaaggaattggaggaaatgaacaagtagataaattagtcagtagtggaatcaggaagaccttttgggacagcggtg

SEQ ID NO: 401126 - DNA, 140 bp, Artificial Sequence
  Synthetic
caccgctgtcccaaaaggtcttcctgattccactactgactaatttatctacttgttcatttcctccaattcctttgtgtgctggtacccatgacaggtagaccttttccttttttattacatatcagcagccagggcct

SEQ ID NO: 401127 - DNA, 140 bp, Artificial Sequence
  Synthetic
aggccctggctgctgatatgcttcacatacctagaagaataagacagggcttcgaaagggctttgctataagatgggtggcaagtggtcaaaacttagaggatgggatgatgtaagggaagaccttttgggacagcggtg

SEQ ID NO: 401128 - DNA, 140 bp, Artificial Sequence
  Synthetic
caccgctgtcccaaaaggtcttcccttacatcatcccatcctctaagttttgaccacttgccacccatcttatagcaaagccctttcgaagccctgtcttattcttctaggtatgtgaagcatatcagcagccagggcct

SEQ ID NO: 401129 - DNA, 140 bp, Artificial Sequence
  Synthetic
aggccctggctgctgatatgctacaatatttggcactgaaagcattagtaacaccaacaaaggcaaagccacctttgcctagtgttaggaaattaacagaggatagatggaacaagccccgaccttttgggacagcggtg

SEQ ID NO: 401130 - DNA, 140 bp, Artificial Sequence
  Synthetic
caccgctgtcccaaaaggtcggggcttgttccatctatcctctgttaatttcctaacactaggcaaaggtggctttgcctttgttggtgttactaatgctttcagtgccaaatattgtagcatatcagcagccagggcct

SEQ ID NO: 401131 - DNA, 140 bp, Artificial Sequence
  Synthetic
aggccctggctgctgatatggaatagataaggcccaagaagaacatgaaagatatcacagtaattggagaacaatggctagtgattttaatctgccacctatagtagcaaaggaaatagtgaccttttgggacagcggtg

SEQ ID NO: 401132 - DNA, 140 bp, Artificial Sequence
  Synthetic
caccgctgtcccaaaaggtcactatttcctttgctactataggtggcagattaaaatcactagccattgttctccaattactgtgatatctttcatgttcttcttgggccttatctattccatatcagcagccagggcct

SEQ ID NO: 401133 - DNA, 140 bp, Artificial Sequence
  Synthetic
aggccctggctgctgatatgttacaagcaattcatctagctttgcaggattcagaatcagaagtaaacatagtaacagactcacagtatgcattaggaatcattcaagcacaaccagatagaccttttgggacagcggtg

SEQ ID NO: 401134 - DNA, 140 bp, Artificial Sequence
  Synthetic
caccgctgtcccaaaaggtctatctggttgtgcttgaatgattcctaatgcatactgtgagtctgttactatgtttacttctgattctgaatcctgcaaagctagatgaattgcttgtaacatatcagcagccagggcct

SEQ ID NO: 401135 - DNA, 140 bp, Artificial Sequence
  Synthetic
aggccctggctgctgatatgtgttagagttaacagcaagagtagattatagattaggagtaggagcattgatagtagcactaatcatagcaatagttgtgtggaccatagcatatttagagaccttttgggacagcggtg

SEQ ID NO: 401136 - DNA, 140 bp, Artificial Sequence
  Synthetic
caccgctgtcccaaaaggtctctaaatatgctatggtccacacaactattgctatgattagtgctactatcaatgctcctactcctaatctataatctactcttgctgttaactctaacacatatcagcagccagggcct

SEQ ID NO: 401137 - DNA, 140 bp, Artificial Sequence
  Synthetic
atacgccatgctgggtctccgttactgatactactacaggaataaaaaattgctctttcaatgcaaccacagaagtaaatgataggaaagagaaagtgtatgcacttttttacagactagcgtacttgggagtcggccat

SEQ ID NO: 401138 - DNA, 140 bp, Artificial Sequence
  Synthetic
atggccgactcccaagtacgctagtctgtaaaaaagtgcatacactttctctttcctatcatttacttctgtggttgcattgaaagagcaattttttattcctgtagtagtatcagtaacggagacccagcatggcgtat

SEQ ID NO: 401139 - DNA, 140 bp, Artificial Sequence
  Synthetic
aggccctggctgctgatatgagctataggttgataagttgtaacacctcagtcattacacaggcctgtccaaaggtatcctttgagccaattcccatacattattgtaccccggctggttgaccttttgggacagcggtg

SEQ ID NO: 401140 - DNA, 140 bp, Artificial Sequence
  Synthetic
caccgctgtcccaaaaggtcaaccagccggggtacaataatgtatgggaattggctcaaaggatacctttggacaggcctgtgtaatgactgaggtgttacaacttatcaacctatagctcatatcagcagccagggcct

SEQ ID NO: 401141 - DNA, 140 bp, Artificial Sequence
  Synthetic
aggccctggctgctgatatgactgatagtatggcaagtggacagacagagagtgaaaacgtggaacagcctggtgaaataccataaatacaggtcagggaagaccagagactggtattacgaccttttgggacagcggtg

SEQ ID NO: 401142 - DNA, 140 bp, Artificial Sequence
  Synthetic
caccgctgtcccaaaaggtcgtaataccagtctctggtcttccctgacctgtatttatggtatttcaccaggctgttccacgttttcactctctgtctgtccacttgccatactatcagtcatatcagcagccagggcct

SEQ ID NO: 401143 - DNA, 140 bp, Artificial Sequence
  Synthetic
atacgccatgctgggtctcctgggttggtgataatttgtagtgcctcagacaacttgtgggttacagtttattatggggttcctgtgtggagagatgcagataccaccctattttgtgcacgtacttgggagtcggccat

SEQ ID NO: 401144 - DNA, 140 bp, Artificial Sequence
  Synthetic
atggccgactcccaagtacgtgcacaaaatagggtggtatctgcatctctccacacaggaaccccataataaactgtaacccacaagttgtctgaggcactacaaattatcaccaacccaggagacccagcatggcgtat

SEQ ID NO: 401145 - DNA, 140 bp, Artificial Sequence
  Synthetic
aggccctggctgctgatatggacagagacagatccgtgcgattagtgagcggattcttagcacttgcctgggacgacctacggagcctgtgcctcttcagctaccaccgattgagagactgaccttttgggacagcggtg

SEQ ID NO: 401146 - DNA, 140 bp, Artificial Sequence
  Synthetic
caccgctgtcccaaaaggtcagtctctcaatcggtggtagctgaagaggcacaggctccgtaggtcgtcccaggcaagtgctaagaatccgctcactaatcgcacggatctgtctctgtccatatcagcagccagggcct

SEQ ID NO: 401147 - DNA, 140 bp, Artificial Sequence
  Synthetic
aggccctggctgctgatatggaatcgcaaaaccaacaagaaaagaatgaacaagaattattggaattggataaatgggcaagtttgtggaattggtttgacataacaaaatggctgtggtgaccttttgggacagcggtg

SEQ ID NO: 401148 - DNA, 140 bp, Artificial Sequence
  Synthetic
caccgctgtcccaaaaggtcaccacagccattttgttatgtcaaaccaattccacaaacttgcccatttatccaattccaataattcttgttcattcttttcttgttggttttgcgattccatatcagcagccagggcct

SEQ ID NO: 401149 - DNA, 140 bp, Artificial Sequence
  Synthetic
atacgccatgctgggtctccccactctgtgtcactttacactgtaatgataccaacaataagaaactaaatgacagcctaaatgaagtaaaagggtgctctttcaataccaccacaggaacgtacttgggagtcggccat

SEQ ID NO: 401150 - DNA, 140 bp, Artificial Sequence
  Synthetic
atggccgactcccaagtacgttcctgtggtggtattgaaagagcacccttttacttcatttaggctgtcatttagtttcttattgttggtatcattacagtgtaaagtgacacagagtggggagacccagcatggcgtat

SEQ ID NO: 401151 - DNA, 140 bp, Artificial Sequence
  Synthetic
aggccctggctgctgatatggagggagtaggagcagcatctcaagacttagataaacatggagcacttacaagcagcaacacagcccacaataatgctgattgtgcctggctggaagcacgaccttttgggacagcggtg

SEQ ID NO: 401152 - DNA, 140 bp, Artificial Sequence
  Synthetic
caccgctgtcccaaaaggtcgtgcttccagccaggcacaatcagcattattgtgggctgtgttgctgcttgtaagtgctccatgtttatctaagtcttgagatgctgctcctactccctccatatcagcagccagggcct

SEQ ID NO: 401153 - DNA, 140 bp, Artificial Sequence
  Synthetic
atacgccatgctgggtctccgtacaagaccccacaacaatacaaggaaaagtatacatataggaccagggagagcctggtatgcaacaggagatataataggagatataagaaaagcatacgtacttgggagtcggccat

SEQ ID NO: 401154 - DNA, 140 bp, Artificial Sequence
  Synthetic
atggccgactcccaagtacgtatgcttttcttatatctcctattatatctcctgttgcataccaggctctccctggtcctatatgtatacttttccttgtattgttgtggggtcttgtacggagacccagcatggcgtat

SEQ ID NO: 401155 - DNA, 140 bp, Artificial Sequence
  Synthetic
aggccctggctgctgatatggagccagcagcagatggggtgggagcagcatctcgagacctggaaaaacatggagcaatcacaagtagcaatacagcagctaacaatgctgattgtgcctgaccttttgggacagcggtg

SEQ ID NO: 401156 - DNA, 140 bp, Artificial Sequence
  Synthetic
caccgctgtcccaaaaggtcaggcacaatcagcattgttagctgctgtattgctacttgtgattgctccatgtttttccaggtctcgagatgctgctcccaccccatctgctgctggctccatatcagcagccagggcct

SEQ ID NO: 401157 - DNA, 140 bp, Artificial Sequence
  Synthetic
atacgccatgctgggtctccagcagcagtcaaaattaccccatagtgcaaaatgcacaagggcagatggtacaccagcccctgtcacctaggactttgaatgcatgggtcaaagtagtagcgtacttgggagtcggccat

SEQ ID NO: 401158 - DNA, 140 bp, Artificial Sequence
  Synthetic
atggccgactcccaagtacgctactactttgacccatgcattcaaagtcctaggtgacaggggctggtgtaccatctgcccttgtgcattttgcactatggggtaattttgactgctgctggagacccagcatggcgtat

SEQ ID NO: 401159 - DNA, 140 bp, Artificial Sequence
  Synthetic
atacgccatgctgggtctcctccctctaccaaagcagtaagtagtagatgtaatgcaacccttagtaatagcttcaatagtagcattagtagtagtagcaataatagcaataattgtgtgcgtacttgggagtcggccat

SEQ ID NO: 401160 - DNA, 140 bp, Artificial Sequence
  Synthetic
atggccgactcccaagtacgcacacaattattgctattattgctactactactaatgctactattgaagctattactaagggttgcattacatctactacttactgctttggtagagggaggagacccagcatggcgtat

SEQ ID NO: 401161 - DNA, 140 bp, Artificial Sequence
  Synthetic
aggccctggctgctgatatgacagatagggttatagaagtattacaaagagcttgtagagctatcctccacatacctacaagaataagacagggcttggaaagggctttgctataagatggaccttttgggacagcggtg

SEQ ID NO: 401162 - DNA, 140 bp, Artificial Sequence
  Synthetic
caccgctgtcccaaaaggtccatcttatagcaaagccctttccaagccctgtcttattcttgtaggtatgtggaggatagctctacaagctctttgtaatacttctataaccctatctgtcatatcagcagccagggcct

SEQ ID NO: 401163 - DNA, 140 bp, Artificial Sequence
  Synthetic
  misc_feature (86)..(86): n is a, c, g, or t
atacgccatgctgggtctccgatggagaaaggagaaataaaaaactgcactttcaatatcaccaccaacacagaagaaaagcaganagaccatgcattcttttataaacttgatctagtacgtacttgggagtcggccat

SEQ ID NO: 401164 - DNA, 140 bp, Artificial Sequence
  Synthetic
  misc_feature (55)..(55): n is a, c, g, or t
atggccgactcccaagtacgtactagatcaagtttataaaagaatgcatggtctntctgcttttcttctgtgttggtggtgatattgaaagtgcagttttttatttctcctttctccatcggagacccagcatggcgtat

SEQ ID NO: 401165 - DNA, 140 bp, Artificial Sequence
  Synthetic
  misc_feature (58)..(58): n is a, c, g, or t
aggccctggctgctgatatgcagaagaagaggtagtaattaagtctgccaatttctcngacaatgctaaaatcataatagtacagctaaatgaaactgtagaaattaattgtacaagaccgaccttttgggacagcggtg

SEQ ID NO: 401166 - DNA, 140 bp, Artificial Sequence
  Synthetic
  misc_feature (83)..(83): n is a, c, g, or t
caccgctgtcccaaaaggtcggtcttgtacaattaatttctacagtttcatttagctgtactattatgattttagcattgtcngagaaattggcagacttaattactacctcttcttctgcatatcagcagccagggcct

SEQ ID NO: 401167 - DNA, 140 bp, Artificial Sequence
  Synthetic
aggccctggctgctgatatgaaattataaacatgtggcagaaagtaggaaaagcaatgtatgcccctcccatcagaggacaaattaattgtttatcaaatattacagggttgctattaacgaccttttgggacagcggtg

SEQ ID NO: 401168 - DNA, 140 bp, Artificial Sequence
  Synthetic
caccgctgtcccaaaaggtcgttaatagcaaccctgtaatatttgataaacaattaatttgtcctctgatgggaggggcatacattgcttttcctactttctgccacatgtttataatttcatatcagcagccagggcct

SEQ ID NO: 401169 - DNA, 140 bp, Artificial Sequence
  Synthetic
aggccctggctgctgatatggatctgacttagaaatagggcagcatagaataaaaatagaggaattaagggaacacctattgaagtggggatttaccacaccagacaaaaagcatcagaagaccttttgggacagcggtg

SEQ ID NO: 401170 - DNA, 140 bp, Artificial Sequence
  Synthetic
caccgctgtcccaaaaggtcttctgatgctttttgtctggtgtggtaaatccccacttcaataggtgttcccttaattcctctatttttattctatgctgccctatttctaagtcagatccatatcagcagccagggcct

SEQ ID NO: 401171 - DNA, 140 bp, Artificial Sequence
  Synthetic
aggccctggctgctgatatgagaggacctagaaattacaacacacagctttaattgtagaagagaatttttctattgcaatacatcaaaactatttaatagtacagacagttctaaatacgaccttttgggacagcggtg

SEQ ID NO: 401172 - DNA, 140 bp, Artificial Sequence
  Synthetic
caccgctgtcccaaaaggtcgtatttagaactgtctgtactattaaatagttttgatgtattgcaatagaaaaattctcttctacaattaaagctgtgtgttgtaatttctaggtcctctcatatcagcagccagggcct

SEQ ID NO: 401173 - DNA, 140 bp, Artificial Sequence
  Synthetic
aggccctggctgctgatatggaaattgacaattacacaagagaaatatacaacttaattgaagaagcgcagaaccagcaagaaaagaatgaacaagacttattggaattggataagtggggaccttttgggacagcggtg

SEQ ID NO: 401174 - DNA, 140 bp, Artificial Sequence
  Synthetic
caccgctgtcccaaaaggtccccacttatccaattccaataagtcttgttcattcttttcttgctggttctgcgcttcttcaattaagttgtatatttctcttgtgtaattgtcaatttccatatcagcagccagggcct

SEQ ID NO: 401175 - DNA, 140 bp, Artificial Sequence
  Synthetic
atacgccatgctgggtctccaagtgctattgcaaagcgtgctgctaccattgctatgtttgttttgcaagcaagggtttgggactctcctatggcaggaagaagcgacggagaccagccgcgtacttgggagtcggccat

SEQ ID NO: 401176 - DNA, 140 bp, Artificial Sequence
  Synthetic
atggccgactcccaagtacgcggctggtctccgtcgcttcttcctgccataggagagtcccaaacccttgcttgcaaaacaaacatagcaatggtagcagcacgctttgcaatagcacttggagacccagcatggcgtat

SEQ ID NO: 401177 - DNA, 140 bp, Artificial Sequence
  Synthetic
atacgccatgctgggtctccaagctaatgcatcatagggacctgctaacattaataattattagtgctttgctgcttacaaatgtaattctatgggcatttattcttagacaatatttaacgtacttgggagtcggccat

SEQ ID NO: 401178 - DNA, 140 bp, Artificial Sequence
  Synthetic
atggccgactcccaagtacgttaaatattgtctaagaataaatgcccatagaattacatttgtaagcagcaaagcactaataattattaatgttagcaggtccctatgatgcattagcttggagacccagcatggcgtat

SEQ ID NO: 401179 - DNA, 140 bp, Artificial Sequence
  Synthetic
aggccctggctgctgatatgtcattgccaagtttgcttcataacaaaaggcttaggcatatcctatggcaggaagaagcggaggcagcgacagagagctcctgacagcagtcagaatcatgaccttttgggacagcggtg

SEQ ID NO: 401180 - DNA, 140 bp, Artificial Sequence
  Synthetic
caccgctgtcccaaaaggtcatgattctgactgctgtcaggagctctctgtcgctgcctccgcttcttcctgccataggatatgcctaagccttttgttatgaagcaaacttggcaatgacatatcagcagccagggcct

SEQ ID NO: 401181 - DNA, 140 bp, Artificial Sequence
  Synthetic
atacgccatgctgggtctccagaaaggagaaataaaaaactgctctttcaatatcaccacaagcctaagagataagatgaagaaagaatatgcacttttttataaccttgatatagtacacgtacttgggagtcggccat

SEQ ID NO: 401182 - DNA, 140 bp, Artificial Sequence
  Synthetic
atggccgactcccaagtacgtgtactatatcaaggttataaaaaagtgcatattctttcttcatcttatctcttaggcttgtggtgatattgaaagagcagttttttatttctcctttctggagacccagcatggcgtat

SEQ ID NO: 401183 - DNA, 140 bp, Artificial Sequence
  Synthetic
atacgccatgctgggtctccaagcaagttcagaagtacacatgccactaggggatgctagattagtaggaacatattggggtctgcatccaggagaaagagactggcacttgggtcatggcgtacttgggagtcggccat

SEQ ID NO: 401184 - DNA, 140 bp, Artificial Sequence
  Synthetic
atggccgactcccaagtacgccatgacccaagtgccagtctctttctcctggatgcagaccccaatatgttcctactaatctagcatcccctagtggcatgtgtacttctgaacttgcttggagacccagcatggcgtat

SEQ ID NO: 401185 - DNA, 140 bp, Artificial Sequence
  Synthetic
aggccctggctgctgatatgaacaggaccatgtacaaatgtcagcacagtacaatgtacacatggaattaggccagtagtatcaactcaactgctgctaaatggcagtctagcagaagaagaccttttgggacagcggtg

SEQ ID NO: 401186 - DNA, 140 bp, Artificial Sequence
  Synthetic
caccgctgtcccaaaaggtcttcttctgctagactgccatttagcagcagttgagttgatactactggcctaattccatgtgtacattgtactgtgctgacatttgtacatggtcctgttcatatcagcagccagggcct

SEQ ID NO: 401187 - DNA, 140 bp, Artificial Sequence
  Synthetic
atacgccatgctgggtctcctaatggtactgttacctataatgataccataaatggagaaataaaaaattgctctttcaatgtaaccacagagctaagagataagagaaagaatgaacatcgtacttgggagtcggccat

SEQ ID NO: 401188 - DNA, 140 bp, Artificial Sequence
  Synthetic
atggccgactcccaagtacgatgttcattctttctcttatctcttagctctgtggttacattgaaagagcaattttttatttctccatttatggtatcattataggtaacagtaccattaggagacccagcatggcgtat

SEQ ID NO: 401189 - DNA, 140 bp, Artificial Sequence
  Synthetic
  misc_feature (44)..(44): n is a, c, g, or t
atacgccatgctgggtctcctcatgaataaaacaatagtctttnagcgttcctcaggaggagacccagaaattgtaatgcacagtttcaattgtggaggagaatttttttactgtaataccgtacttgggagtcggccat

SEQ ID NO: 401190 - DNA, 140 bp, Artificial Sequence
  Synthetic
  misc_feature (97)..(97): n is a, c, g, or t
atggccgactcccaagtacggtattacagtaaaaaaattctcctccacaattgaaactgtgcattacaatttctgggtctcctcctgaggaacgctnaaagactattgttttattcatgaggagacccagcatggcgtat

SEQ ID NO: 401191 - DNA, 140 bp, Artificial Sequence
  Synthetic
atacgccatgctgggtctccgagagaaccctacaatgaatggacattagaactgttagaggagcttaaaaatgaagctgttagacattttcctaggccctggctccatggcttaggacagcgtacttgggagtcggccat

SEQ ID NO: 401192 - DNA, 140 bp, Artificial Sequence
  Synthetic
atggccgactcccaagtacgctgtcctaagccatggagccagggcctaggaaaatgtctaacagcttcatttttaagctcctctaacagttctaatgtccattcattgtagggttctctcggagacccagcatggcgtat

SEQ ID NO: 401193 - DNA, 140 bp, Artificial Sequence
  Synthetic
atacgccatgctgggtctccagctgtaacacaagcttgtcctaagactacctttgagccaattccaatacattactgtgcaccaccaggctttgccattatgaaatgtaatgaagcaaatcgtacttgggagtcggccat

SEQ ID NO: 401194 - DNA, 140 bp, Artificial Sequence
  Synthetic
atggccgactcccaagtacgatttgcttcattacatttcataatggcaaagcctggtggtgcacagtaatgtattggaattggctcaaaggtagtcttaggacaagcttgtgttacagctggagacccagcatggcgtat

SEQ ID NO: 401195 - DNA, 140 bp, Artificial Sequence
  Synthetic
aggccctggctgctgatatgatgaaggacaattggagaagtgaattatataaatataaagtagtaaaaattgaaccattaggagtagcacccaccaaggcaaagagaagagtggtgcagagaccttttgggacagcggtg

SEQ ID NO: 401196 - DNA, 140 bp, Artificial Sequence
  Synthetic
caccgctgtcccaaaaggtctctgcaccactcttctctttgccttggtgggtgctactcctaatggttcaatttttactactttatatttatataattcacttctccaattgtccttcatcatatcagcagccagggcct

SEQ ID NO: 401197 - DNA, 140 bp, Artificial Sequence
  Synthetic
atacgccatgctgggtctcctgatgctcctaaggttactactgatgctcctaatgttacgactaatgctaatggagaaatgacaaattgctctttcaatacaactgcagtgctaagagatcgtacttgggagtcggccat

SEQ ID NO: 401198 - DNA, 140 bp, Artificial Sequence
  Synthetic
atggccgactcccaagtacgatctcttagcactgcagttgtattgaaagagcaatttgtcatttctccattagcattagtcgtaacattaggagcatcagtagtaaccttaggagcatcaggagacccagcatggcgtat

SEQ ID NO: 401199 - DNA, 140 bp, Artificial Sequence
  Synthetic
aggccctggctgctgatatgttatggggttcctgtgtggaaagatgcagataccaccctattttgtgcatcagatgccaaagcacatgagacagaagtgcacaatgtctgggccacacatgaccttttgggacagcggtg

SEQ ID NO: 401200 - DNA, 140 bp, Artificial Sequence
  Synthetic
caccgctgtcccaaaaggtcatgtgtggcccagacattgtgcacttctgtctcatgtgctttggcatctgatgcacaaaatagggtggtatctgcatctttccacacaggaaccccataacatatcagcagccagggcct

SEQ ID NO: 401201 - DNA, 140 bp, Artificial Sequence
  Synthetic
aggccctggctgctgatatgacttccctaataaaacaataagatttgaaccatcctcaggaggggacctagaaattacaacacatagctttaattgtagaggagaatttttctattgcaagaccttttgggacagcggtg

SEQ ID NO: 401202 - DNA, 140 bp, Artificial Sequence
  Synthetic
caccgctgtcccaaaaggtcttgcaatagaaaaattctcctctacaattaaagctatgtgttgtaatttctaggtcccctcctgaggatggttcaaatcttattgttttattagggaagtcatatcagcagccagggcct

SEQ ID NO: 401203 - DNA, 140 bp, Artificial Sequence
  Synthetic
atacgccatgctgggtctcctgcagaataaaacaaattataaacatgtggcagagggtaggacaagcaatgtatgcccctcccattgcaggaccaatcaagtgtacatcaaatattacagcgtacttgggagtcggccat

SEQ ID NO: 401204 - DNA, 140 bp, Artificial Sequence
  Synthetic
atggccgactcccaagtacgctgtaatatttgatgtacacttgattggtcctgcaatgggaggggcatacattgcttgtcctaccctctgccacatgtttataatttgttttattctgcaggagacccagcatggcgtat

SEQ ID NO: 401205 - DNA, 140 bp, Artificial Sequence
  Synthetic
aggccctggctgctgatatgagccagtggtatcaactcaattgctgttaaatggcagtctagcagaagaagagataataatcagatctgaaaatctcacaaacaatgccaaaaccataatgaccttttgggacagcggtg

SEQ ID NO: 401206 - DNA, 140 bp, Artificial Sequence
  Synthetic
caccgctgtcccaaaaggtcattatggttttggcattgtttgtgagattttcagatctgattattatctcttcttctgctagactgccatttaacagcaattgagttgataccactggctcatatcagcagccagggcct

SEQ ID NO: 401207 - DNA, 140 bp, Artificial Sequence
  Synthetic
aggccctggctgctgatatgtccttcagaacaggccagagccaacagccccgccagcagagagcttcgggtttggagaggagacaaccccctctccgaagcaggagcagaaagacgaggggaccttttgggacagcggtg

SEQ ID NO: 401208 - DNA, 140 bp, Artificial Sequence
  Synthetic
caccgctgtcccaaaaggtcccctcgtctttctgctcctgcttcggagagggggttgtctcctctccaaacccgaagctctctgctggcggggctgttggctctggcctgttctgaaggacatatcagcagccagggcct

SEQ ID NO: 401209 - DNA, 140 bp, Artificial Sequence
  Synthetic
aggccctggctgctgatatgctccatagcttaggacaatatatctatgaaacttatggggatacttgggcaggagtggaagccataataagaattctgcaacaactgctgtttattcattgaccttttgggacagcggtg

SEQ ID NO: 401210 - DNA, 140 bp, Artificial Sequence
  Synthetic
caccgctgtcccaaaaggtcaatgaataaacagcagttgttgcagaattcttattatggcttccactcctgcccaagtatccccataagtttcatagatatattgtcctaagctatggagcatatcagcagccagggcct

SEQ ID NO: 401211 - DNA, 140 bp, Artificial Sequence
  Synthetic
atacgccatgctgggtctcctgataccagcagctcagagaaccttatgaaaaagtgtgagtttaatgtaaccacagttctcaaagacaaaaaggagaaacaacaggctctattctatgtacgtacttgggagtcggccat

SEQ ID NO: 401212 - DNA, 140 bp, Artificial Sequence
  Synthetic
atggccgactcccaagtacgtacatagaatagagcctgttgtttctcctttttgtctttgagaactgtggttacattaaactcacactttttcataaggttctctgagctgctggtatcaggagacccagcatggcgtat

SEQ ID NO: 401213 - DNA, 140 bp, Artificial Sequence
  Synthetic
atacgccatgctgggtctcctgacaaattgctctttcaatgcaaccacagaaataaaagataagaaaaagctagaatatgcacttttttataaacttgatgtagtaacacttgaggaaaacgtacttgggagtcggccat

SEQ ID NO: 401214 - DNA, 140 bp, Artificial Sequence
  Synthetic
atggccgactcccaagtacgttttcctcaagtgttactacatcaagtttataaaaaagtgcatattctagctttttcttatcttttatttctgtggttgcattgaaagagcaatttgtcaggagacccagcatggcgtat

SEQ ID NO: 401215 - DNA, 140 bp, Artificial Sequence
  Synthetic
  misc_feature (106)..(106): n is a, c, g, or t
  misc_feature (119)..(119): n is a, c, g, or t
atacgccatgctgggtctcccagcagcagaagaaactagaccagcagcagaaggggtgggagcagcatctcaggacctgggaaaacatggggcaagcacaagtagnaatacagcacagnccgtacttgggagtcggccat

SEQ ID NO: 401216 - DNA, 140 bp, Artificial Sequence
  Synthetic
  misc_feature (22)..(22): n is a, c, g, or t
  misc_feature (35)..(35): n is a, c, g, or t
atggccgactcccaagtacggnctgtgctgtattnctacttgtgcttgccccatgttttcccaggtcctgagatgctgctcccaccccttctgctgctggtctagtttcttctgctgctgggagacccagcatggcgtat

SEQ ID NO: 401217 - DNA, 140 bp, Artificial Sequence
  Synthetic
atacgccatgctgggtctccaaactcaatgaacacttctctagtaaagaaataaaatttgctccaagctcaggaggagatccagaagttgcgacacatagttttaattgtagaggagaatcgtacttgggagtcggccat

SEQ ID NO: 401218 - DNA, 140 bp, Artificial Sequence
  Synthetic
atggccgactcccaagtacgattctcctctacaattaaaactatgtgtcgcaacttctggatctcctcctgagcttggagcaaattttatttctttactagagaagtgttcattgagtttggagacccagcatggcgtat

SEQ ID NO: 401219 - DNA, 140 bp, Artificial Sequence
  Synthetic
  misc_feature (68)..(68): n is a, c, g, or t
  misc_feature (110)..(110): n is a, c, g, or t
atacgccatgctgggtctccgagcagtaaggatcatcaaaatcctataccaaagcagtaagtagcagnaattaatatatgtaatgaatcagttgcaaatcttggcaatantaggactggtcgtacttgggagtcggccat

SEQ ID NO: 401220 - DNA, 140 bp, Artificial Sequence
  Synthetic
  misc_feature (31)..(31): n is a, c, g, or t
  misc_feature (73)..(73): n is a, c, g, or t
atggccgactcccaagtacgaccagtcctantattgccaagatttgcaactgattcattacatatattaattnctgctacttactgctttggtataggattttgatgatccttactgctcggagacccagcatggcgtat

SEQ ID NO: 401221 - DNA, 140 bp, Artificial Sequence
  Synthetic
atacgccatgctgggtctccgcacattgtaaccttagtagacaagactgggaaaagactttaaaaaagatagttataaaattaaaagaacaatttaatataacaaaaaacattacctttacgtacttgggagtcggccat

SEQ ID NO: 401222 - DNA, 140 bp, Artificial Sequence
  Synthetic
atggccgactcccaagtacgtaaaggtaatgttttttgttatattaaattgttcttttaattttataactatcttttttaaagtcttttcccagtcttgtctactaaggttacaatgtgcggagacccagcatggcgtat

SEQ ID NO: 401223 - DNA, 140 bp, Artificial Sequence
  Synthetic
aggccctggctgctgatatgtctcttgacgcaggactcggcttgctgaggtgcacacagcaagaggcgagagcggcgactggtgagtacgccaaatcttgactagcggaggctagaaggagaccttttgggacagcggtg

SEQ ID NO: 401224 - DNA, 140 bp, Artificial Sequence
  Synthetic
caccgctgtcccaaaaggtctccttctagcctccgctagtcaagatttggcgtactcaccagtcgccgctctcgcctcttgctgtgtgcacctcagcaagccgagtcctgcgtcaagagacatatcagcagccagggcct

SEQ ID NO: 401225 - DNA, 140 bp, Artificial Sequence
  Synthetic
  misc_feature (52)..(52): n is a, c, g, or t
  misc_feature (55)..(55): n is a, c, g, or t
atacgccatgctgggtctccactaaatataatactactattacaaataatantgngagtactcctatgaatagtactcaggaaaagatggaggtaggagaaataaaaaactgcactttcacgtacttgggagtcggccat

SEQ ID NO: 401226 - DNA, 140 bp, Artificial Sequence
  Synthetic
  misc_feature (86)..(86): n is a, c, g, or t
  misc_feature (89)..(89): n is a, c, g, or t
atggccgactcccaagtacgtgaaagtgcagttttttatttctcctacctccatcttttcctgagtactattcataggagtactcncantattatttgtaatagtagtattatatttagtggagacccagcatggcgtat

SEQ ID NO: 401227 - DNA, 140 bp, Artificial Sequence
  Synthetic
aggccctggctgctgatatgtaatacaaagaatttgtagagccatccgcaacatacctacaagaataagacagggctttgaagcagctttgctataaaatggggggcaagtggtcaaaaagaccttttgggacagcggtg

SEQ ID NO: 401228 - DNA, 140 bp, Artificial Sequence
  Synthetic
caccgctgtcccaaaaggtctttttgaccacttgccccccattttatagcaaagctgcttcaaagccctgtcttattcttgtaggtatgttgcggatggctctacaaattctttgtattacatatcagcagccagggcct

SEQ ID NO: 401229 - DNA, 140 bp, Artificial Sequence
  Synthetic
aggccctggctgctgatatgatcattagaaatatttgcaatagtaggactaatagtagcaggcatagcagccataattgtgtggaccatagtttttatacaatataaggaaataagaaaagaccttttgggacagcggtg

SEQ ID NO: 401230 - DNA, 140 bp, Artificial Sequence
  Synthetic
caccgctgtcccaaaaggtcttttcttatttccttatattgtataaaaactatggtccacacaattatggctgctatgcctgctactattagtcctactattgcaaatatttctaatgatcatatcagcagccagggcct

SEQ ID NO: 401231 - DNA, 140 bp, Artificial Sequence
  Synthetic
atacgccatgctgggtctccaatttaagccaccctccccaggaggggacccagaaattgtaatgcatagtgttaattgtggaggggaatttttctactgtaatacaacattactgtttaacgtacttgggagtcggccat

SEQ ID NO: 401232 - DNA, 140 bp, Artificial Sequence
  Synthetic
atggccgactcccaagtacgttaaacagtaatgttgtattacagtagaaaaattcccctccacaattaacactatgcattacaatttctgggtcccctcctggggagggtggcttaaattggagacccagcatggcgtat

SEQ ID NO: 401233 - DNA, 140 bp, Artificial Sequence
  Synthetic
aggccctggctgctgatatgtttccctcaaatcactctttggcagcgacccattgttacaataaaaatagggggacaactaaaagaagctctgttagatacaggagcagatgatacagtagaccttttgggacagcggtg

SEQ ID NO: 401234 - DNA, 140 bp, Artificial Sequence
  Synthetic
caccgctgtcccaaaaggtctactgtatcatctgctcctgtatctaacagagcttcttttagttgtccccctatttttattgtaacaatgggtcgctgccaaagagtgatttgagggaaacatatcagcagccagggcct

SEQ ID NO: 401235 - DNA, 140 bp, Artificial Sequence
  Synthetic
aggccctggctgctgatatgaagaataatttttactgtgctttctatagtaaatagatgtaggcagggatactcacctctgtcatttcagacccttaccccaaaccacaaggaagccgacgaccttttgggacagcggtg

SEQ ID NO: 401236 - DNA, 140 bp, Artificial Sequence
  Synthetic
caccgctgtcccaaaaggtcgtcggcttccttgtggtttggggtaagggtctgaaatgacagaggtgagtatccctgcctacatctatttactatagaaagcacagtaaaaattattcttcatatcagcagccagggcct

SEQ ID NO: 401237 - DNA, 140 bp, Artificial Sequence
  Synthetic
  misc_feature (27)..(27): n is a, c, g, or t
  misc_feature (93)..(93): n is a, c, g, or t
atacgccatgctgggtctcctggaganaggagaaataaaaagctgttctttcaataccaccacagacctaagagataagataaagaaagattntgcacttttttataaccttgatgtactcgtacttgggagtcggccat

SEQ ID NO: 401238 - DNA, 140 bp, Artificial Sequence
  Synthetic
  misc_feature (48)..(48): n is a, c, g, or t
  misc_feature (114)..(114): n is a, c, g, or t
atggccgactcccaagtacgagtacatcaaggttataaaaaagtgcanaatctttctttatcttatctcttaggtctgtggtggtattgaaagaacagctttttatttctcctntctccaggagacccagcatggcgtat

SEQ ID NO: 401239 - DNA, 140 bp, Artificial Sequence
  Synthetic
atacgccatgctgggtctcccagtggcctggtacagcatgggcctgaaaaataacctaactaactcaagggcagcctcttgcaagtataacagctctgtttgggaagaagccttaaaacacgtacttgggagtcggccat

SEQ ID NO: 401240 - DNA, 140 bp, Artificial Sequence
  Synthetic
atggccgactcccaagtacgtgttttaaggcttcttcccaaacagagctgttatacttgcaagaggctgcccttgagttagttaggttatttttcaggcccatgctgtaccaggccactgggagacccagcatggcgtat

SEQ ID NO: 401241 - DNA, 140 bp, Artificial Sequence
  Synthetic
aggccctggctgctgatatggacccaacaacaatacaagaaaaagcataactatgggaccagggagagtatggtatacaacaggacaaataataggagatataagaaaagcacattgtaagaccttttgggacagcggtg

SEQ ID NO: 401242 - DNA, 140 bp, Artificial Sequence
  Synthetic
caccgctgtcccaaaaggtcttacaatgtgcttttcttatatctcctattatttgtcctgttgtataccatactctccctggtcccatagttatgctttttcttgtattgttgttgggtccatatcagcagccagggcct

SEQ ID NO: 401243 - DNA, 140 bp, Artificial Sequence
  Synthetic
aggccctggctgctgatatgcatcccttcagacaggatcagaagaacttagatcattatataatacagtagcaaccctctattgtgtgcatcaaaggatagatgtaaaagacaccaaggagaccttttgggacagcggtg

SEQ ID NO: 401244 - DNA, 140 bp, Artificial Sequence
  Synthetic
caccgctgtcccaaaaggtctccttggtgtcttttacatctatcctttgatgcacacaatagagggttgctactgtattatataatgatctaagttcttctgatcctgtctgaagggatgcatatcagcagccagggcct

SEQ ID NO: 401245 - DNA, 140 bp, Artificial Sequence
  Synthetic
aggccctggctgctgatatgacctacaagaataagacagggcttagaaagggctttgctataagatgggtggcaagtggtcaaaaagtagtgtggttggatggcctgctataagggaaaggaccttttgggacagcggtg

SEQ ID NO: 401246 - DNA, 140 bp, Artificial Sequence
  Synthetic
caccgctgtcccaaaaggtcctttcccttatagcaggccatccaaccacactactttttgaccacttgccacccatcttatagcaaagccctttctaagccctgtcttattcttgtaggtcatatcagcagccagggcct

SEQ ID NO: 401247 - DNA, 140 bp, Artificial Sequence
  Synthetic
aggccctggctgctgatatgcataggagatataagacaagcacattgtaccattaatggaacaaaatggaataaaactttagaacaaatagctgaaaaattaaaagaacaatttggggaggaccttttgggacagcggtg

SEQ ID NO: 401248 - DNA, 140 bp, Artificial Sequence
  Synthetic
caccgctgtcccaaaaggtcctccccaaattgttcttttaatttttcagctatttgttctaaagttttattccattttgttccattaatggtacaatgtgcttgtcttatatctcctatgcatatcagcagccagggcct

SEQ ID NO: 401249 - DNA, 140 bp, Artificial Sequence
  Synthetic
aggccctggctgctgatatgagatacaggagcagatgatacagtattagaagaaatgaatttgccaggaagatggaaaccaaaaataatagggggaattggaggttttatcaaagtaagagaccttttgggacagcggtg

SEQ ID NO: 401250 - DNA, 140 bp, Artificial Sequence
  Synthetic
caccgctgtcccaaaaggtctcttactttgataaaacctccaattccccctattatttttggtttccatcttcctggcaaattcatttcttctaatactgtatcatctgctcctgtatctcatatcagcagccagggcct

SEQ ID NO: 401251 - DNA, 140 bp, Artificial Sequence
  Synthetic
aggccctggctgctgatatgaggtttggggaggagacaacaaccccctctcagaaacaggagccgatagacaaggagctgtatcccttaacctccctcagatcactctttggcaacgaccgaccttttgggacagcggtg

SEQ ID NO: 401252 - DNA, 140 bp, Artificial Sequence
  Synthetic
caccgctgtcccaaaaggtcggtcgttgccaaagagtgatctgagggaggttaagggatacagctccttgtctatcggctcctgtttctgagagggggttgttgtctcctccccaaacctcatatcagcagccagggcct

SEQ ID NO: 401253 - DNA, 140 bp, Artificial Sequence
  Synthetic
aggccctggctgctgatatgtttcagaattgggtgccagcatagcagaataggaatcttgcgacagagaagagcaagaaatggagccagtagatcctaacctagagccctggaaccatccgaccttttgggacagcggtg

SEQ ID NO: 401254 - DNA, 140 bp, Artificial Sequence
  Synthetic
caccgctgtcccaaaaggtcggatggttccagggctctaggttaggatctactggctccatttcttgctcttctctgtcgcaagattcctattctgctatgctggcacccaattctgaaacatatcagcagccagggcct

SEQ ID NO: 401255 - DNA, 140 bp, Artificial Sequence
  Synthetic
atacgccatgctgggtctccaccaccagtaatgatactatttataaatataccacaagtgacataagaaattgccctttcaatgtaaccacagaactaaaagataagagaaggaaggaatcgtacttgggagtcggccat

SEQ ID NO: 401256 - DNA, 140 bp, Artificial Sequence
  Synthetic
atggccgactcccaagtacgattccttccttctcttatcttttagttctgtggttacattgaaagggcaatttcttatgtcacttgtggtatatttataaatagtatcattactggtggtggagacccagcatggcgtat

SEQ ID NO: 401257 - DNA, 140 bp, Artificial Sequence
  Synthetic
atacgccatgctgggtctccaattccagtgagtatagattaataaattgtaatacctcagccgtaacacaagcctgtccaaaggtctcttttgacccaattcctatacattattgtgctccgtacttgggagtcggccat

SEQ ID NO: 401258 - DNA, 140 bp, Artificial Sequence
  Synthetic
atggccgactcccaagtacggagcacaataatgtataggaattgggtcaaaagagacctttggacaggcttgtgttacggctgaggtattacaatttattaatctatactcactggaattggagacccagcatggcgtat

SEQ ID NO: 401259 - DNA, 140 bp, Artificial Sequence
  Synthetic
atacgccatgctgggtctccgttaagacaaaggagaataaactggttatttaaaagaatagcagaaagagcagaagacagtggcaatgagagtgagggggatacagaggaattggccacacgtacttgggagtcggccat

SEQ ID NO: 401260 - DNA, 140 bp, Artificial Sequence
  Synthetic
atggccgactcccaagtacgtgtggccaattcctctgtatccccctcactctcattgccactgtcttctgctctttctgctattcttttaaataaccagtttattctcctttgtcttaacggagacccagcatggcgtat

SEQ ID NO: 401261 - DNA, 140 bp, Artificial Sequence
  Synthetic
aggccctggctgctgatatgttaaaaatgaagctgttagacattttcctaggccctggctccatggcttaggacagtacatctataacacttatggggatacttgggaaggggttgaagcgaccttttgggacagcggtg

SEQ ID NO: 401262 - DNA, 140 bp, Artificial Sequence
  Synthetic
caccgctgtcccaaaaggtcgcttcaaccccttcccaagtatccccataagtgttatagatgtactgtcctaagccatggagccagggcctaggaaaatgtctaacagcttcatttttaacatatcagcagccagggcct

SEQ ID NO: 401263 - DNA, 140 bp, Artificial Sequence
  Synthetic
atacgccatgctgggtctcctaataaaacaataaaatttcaaccacactcaggaggggatccagaaattacaatgcatagctttacttgtggaggagaatttttctattgcaatacatcacgtacttgggagtcggccat

SEQ ID NO: 401264 - DNA, 140 bp, Artificial Sequence
  Synthetic
atggccgactcccaagtacgtgatgtattgcaatagaaaaattctcctccacaagtaaagctatgcattgtaatttctggatcccctcctgagtgtggttgaaattttattgttttattaggagacccagcatggcgtat

SEQ ID NO: 401265 - DNA, 140 bp, Artificial Sequence
  Synthetic
aggccctggctgctgatatgctataatggtagtagcaggcattataggcataagaatcataagtgtaataataactataatagcaagagttaggcagggatattctcccctctcgttgcagaccttttgggacagcggtg

SEQ ID NO: 401266 - DNA, 140 bp, Artificial Sequence
  Synthetic
caccgctgtcccaaaaggtctgcaacgagaggggagaatatccctgcctaactcttgctattatagttattattacacttatgattcttatgcctataatgcctgctactaccattatagcatatcagcagccagggcct

SEQ ID NO: 401267 - DNA, 140 bp, Artificial Sequence
  Synthetic
atacgccatgctgggtctccgtaataacatcaccatcaacagaaataataccaatattactgctgaaatgaatgaagaaataagaaattgctctttcaatatgaccacagaactgagagacgtacttgggagtcggccat

SEQ ID NO: 401268 - DNA, 140 bp, Artificial Sequence
  Synthetic
atggccgactcccaagtacgtctctcagttctgtggtcatattgaaagagcaatttcttatttcttcattcatttcagcagtaatattggtattatttctgttgatggtgatgttattacggagacccagcatggcgtat

SEQ ID NO: 401269 - DNA, 140 bp, Artificial Sequence
  Synthetic
aggccctggctgctgatatgagactgcttgtaccaattgctattgtaaaaagtgctgctttcattgccaagtttgtttcatgaaaaaaggcttaggcatctcctatggcaggaagaagcggaccttttgggacagcggtg

SEQ ID NO: 401270 - DNA, 140 bp, Artificial Sequence
  Synthetic
caccgctgtcccaaaaggtccgcttcttcctgccataggagatgcctaagccttttttcatgaaacaaacttggcaatgaaagcagcactttttacaatagcaattggtacaagcagtctcatatcagcagccagggcct

SEQ ID NO: 401271 - DNA, 140 bp, Artificial Sequence
  Synthetic
atacgccatgctgggtctccgaagcaccgacgaggaactcctcagagcagtaaggatcgtcaaaatcctataccaaagcagtaagtaataagtatatgtaatgtcacctttggaaattagcgtacttgggagtcggccat

SEQ ID NO: 401272 - DNA, 140 bp, Artificial Sequence
  Synthetic
atggccgactcccaagtacgctaatttccaaaggtgacattacatatacttattacttactgctttggtataggattttgacgatccttactgctctgaggagttcctcgtcggtgcttcggagacccagcatggcgtat

SEQ ID NO: 401273 - DNA, 140 bp, Artificial Sequence
  Synthetic
aggccctggctgctgatatgttgtgccccagctggttttgcgattctaaagtgcaaggacacagcctgtagaaattaattgtaccagacctagcaacaatacaagaagaagtatatctttgaccttttgggacagcggtg

SEQ ID NO: 401274 - DNA, 140 bp, Artificial Sequence
  Synthetic
caccgctgtcccaaaaggtcaaagatatacttcttcttgtattgttgctaggtctggtacaattaatttctacaggctgtgtccttgcactttagaatcgcaaaaccagctggggcacaacatatcagcagccagggcct

SEQ ID NO: 401275 - DNA, 140 bp, Artificial Sequence
  Synthetic
atacgccatgctgggtctccgacatgcatattgtactgtcaatagaacagaatggaataacaccttacaacaggtagcagcaaaattaggacaacactttgggaacaaaacaataaccttcgtacttgggagtcggccat

SEQ ID NO: 401276 - DNA, 140 bp, Artificial Sequence
  Synthetic
atggccgactcccaagtacgaaggttattgttttgttcccaaagtgttgtcctaattttgctgctacctgttgtaaggtgttattccattctgttctattgacagtacaatatgcatgtcggagacccagcatggcgtat

SEQ ID NO: 401277 - DNA, 140 bp, Artificial Sequence
  Synthetic
atacgccatgctgggtctcctacagagtcctcaggaggggatttagaaattacaacacatagttttaattgtggaggggaatttttctattgcaatacatcaggcctgtttaagggcactcgtacttgggagtcggccat

SEQ ID NO: 401278 - DNA, 140 bp, Artificial Sequence
  Synthetic
atggccgactcccaagtacgagtgcccttaaacaggcctgatgtattgcaatagaaaaattcccctccacaattaaaactatgtgttgtaatttctaaatcccctcctgaggactctgtaggagacccagcatggcgtat

SEQ ID NO: 401279 - DNA, 140 bp, Artificial Sequence
  Synthetic
atacgccatgctgggtctccctgaacagcaaatttggaatagcacgacctggatggaatgggatagagaaattagtaattacacagacataatatacaggttgcttgaaaactcgcaatacgtacttgggagtcggccat

SEQ ID NO: 401280 - DNA, 140 bp, Artificial Sequence
  Synthetic
atggccgactcccaagtacgtattgcgagttttcaagcaacctgtatattatgtctgtgtaattactaatttctctatcccattccatccaggtcgtgctattccaaatttgctgttcagggagacccagcatggcgtat

SEQ ID NO: 401281 - DNA, 140 bp, Artificial Sequence
  Synthetic
atacgccatgctgggtctcccagaagaaggcgttggaggacaaggcagagacagatccgtgagattagtcagcggattcttgacacttgtctgggaggacttcaggaacctgttgatcttcgtacttgggagtcggccat

SEQ ID NO: 401282 - DNA, 140 bp, Artificial Sequence
  Synthetic
atggccgactcccaagtacgaagatcaacaggttcctgaagtcctcccagacaagtgtcaagaatccgctgactaatctcacggatctgtctctgccttgtcctccaacgccttcttctgggagacccagcatggcgtat

SEQ ID NO: 401283 - DNA, 140 bp, Artificial Sequence
  Synthetic
atacgccatgctgggtctcctactgctactgtcaataatagcatgcctggagaaataaaaaattgctctttcaatgtaaccacagaaagaagagataagaaacagaaagagtatgcacttcgtacttgggagtcggccat

SEQ ID NO: 401284 - DNA, 140 bp, Artificial Sequence
  Synthetic
atggccgactcccaagtacgaagtgcatactctttctgtttcttatctcttctttctgtggttacattgaaagagcaattttttatttctccaggcatgctattattgacagtagcagtaggagacccagcatggcgtat

SEQ ID NO: 401285 - DNA, 140 bp, Artificial Sequence
  Synthetic
atacgccatgctgggtctccagaatgagacgaactccagtaacagaagaagtaagggcagcagaaggagtaggagcggtatctcgagatctagagagacatggagcaatcacaagcagtacgtacttgggagtcggccat

SEQ ID NO: 401286 - DNA, 140 bp, Artificial Sequence
  Synthetic
atggccgactcccaagtacgtactgcttgtgattgctccatgtctctctagatctcgagataccgctcctactccttctgctgcccttacttcttctgttactggagttcgtctcattctggagacccagcatggcgtat

SEQ ID NO: 401287 - DNA, 140 bp, Artificial Sequence
  Synthetic
aggccctggctgctgatatgaacaataaaatttgaaccacactcaggaggagatctagaagttacaacacacagctttaattgtggaggagaatttttctattgcaatacaacaacactggaccttttgggacagcggtg

SEQ ID NO: 401288 - DNA, 140 bp, Artificial Sequence
  Synthetic
caccgctgtcccaaaaggtccagtgttgttgtattgcaatagaaaaattctcctccacaattaaagctgtgtgttgtaacttctagatctcctcctgagtgtggttcaaattttattgttcatatcagcagccagggcct

SEQ ID NO: 401289 - DNA, 140 bp, Artificial Sequence
  Synthetic
aggccctggctgctgatatgtcctcaggaggagacccagaaattgtaatgcacagtttcaattgtggaggagaatttttttactgtaatacaacacaattgtttaacagtacttggaggtgaccttttgggacagcggtg

SEQ ID NO: 401290 - DNA, 140 bp, Artificial Sequence
  Synthetic
caccgctgtcccaaaaggtcacctccaagtactgttaaacaattgtgttgtattacagtaaaaaaattctcctccacaattgaaactgtgcattacaatttctgggtctcctcctgaggacatatcagcagccagggcct

SEQ ID NO: 401291 - DNA, 140 bp, Artificial Sequence
  Synthetic
aggccctggctgctgatatgggagcctgtgcctcttcagctaccaccgcttgagagacttaatcttgattgcagcgaggactgtggaacttctgggacacagcagtctcaagggactgaggaccttttgggacagcggtg

SEQ ID NO: 401292 - DNA, 140 bp, Artificial Sequence
  Synthetic
caccgctgtcccaaaaggtcctcagtcccttgagactgctgtgtcccagaagttccacagtcctcgctgcaatcaagattaagtctctcaagcggtggtagctgaagaggcacaggctcccatatcagcagccagggcct

SEQ ID NO: 401293 - DNA, 140 bp, Artificial Sequence
  Synthetic
aggccctggctgctgatatgaagagtcctggctgtggaaagatacctaaaggatcaacagctcctggggatttggggttgctctggaaaactcatttgcaccactactgtgccttggaatgaccttttgggacagcggtg

SEQ ID NO: 401294 - DNA, 140 bp, Artificial Sequence
  Synthetic
caccgctgtcccaaaaggtcattccaaggcacagtagtggtgcaaatgagttttccagagcaaccccaaatccccaggagctgttgatcctttaggtatctttccacagccaggactcttcatatcagcagccagggcct

SEQ ID NO: 401295 - DNA, 140 bp, Artificial Sequence
  Synthetic
aggccctggctgctgatatgtagcctagcagaagaaatggtaataattagatctgataatatgaccaacgctgccacaacaataatagttcatcttaaggaccctgtagaaattgtgtgtgaccttttgggacagcggtg

SEQ ID NO: 401296 - DNA, 140 bp, Artificial Sequence
  Synthetic
caccgctgtcccaaaaggtcacacacaatttctacagggtccttaagatgaactattattgttgtggcagcgttggtcatattatcagatctaattattaccatttcttctgctaggctacatatcagcagccagggcct

SEQ ID NO: 401297 - DNA, 140 bp, Artificial Sequence
  Synthetic
  misc_feature (24)..(24): n is a, c, g, or t
  misc_feature (117)..(117): n is a, c, g, or t
atacgccatgctgggtctccaatnatacaaatagtactcataccaatagtaatagtagtaagatggaggaaggagaaatgaaaaactgcactttcaatatcaccaccaatatagganagacgtacttgggagtcggccat

SEQ ID NO: 401298 - DNA, 140 bp, Artificial Sequence
  Synthetic
  misc_feature (24)..(24): n is a, c, g, or t
  misc_feature (117)..(117): n is a, c, g, or t
atggccgactcccaagtacgtctntcctatattggtggtgatattgaaagtgcagtttttcatttctccttcctccatcttactactattactattggtatgagtactatttgtatnattggagacccagcatggcgtat

SEQ ID NO: 401299 - DNA, 140 bp, Artificial Sequence
  Synthetic
atacgccatgctgggtctcctcattatataatacagtagcaaccctctggtgtgtacaccaagggataaaggtaacagacaccaaggaagctttagataaattagaggaagtacaacagacgtacttgggagtcggccat

SEQ ID NO: 401300 - DNA, 140 bp, Artificial Sequence
  Synthetic
atggccgactcccaagtacgtctgttgtacttcctctaatttatctaaagcttccttggtgtctgttacctttatcccttggtgtacacaccagagggttgctactgtattatataatgaggagacccagcatggcgtat

SEQ ID NO: 401301 - DNA, 140 bp, Artificial Sequence
  Synthetic
aggccctggctgctgatatgtactcaccattgtcattccagacccttacccaccaccagagggaacccgacaggcccggaagaatcgaagaagaaggtggagagcaagacaaagacagatgaccttttgggacagcggtg

SEQ ID NO: 401302 - DNA, 140 bp, Artificial Sequence
  Synthetic
caccgctgtcccaaaaggtcatctgtctttgtcttgctctccaccttcttcttcgattcttccgggcctgtcgggttccctctggtggtgggtaagggtctggaatgacaatggtgagtacatatcagcagccagggcct

SEQ ID NO: 401303 - DNA, 140 bp, Artificial Sequence
  Synthetic
aggccctggctgctgatatgacctagaagaataagacagggctttgaagcagctttgctataaaatggggggcaaatggtcaaaaagcagcatagttggatggcctgaagtaagagaaaggaccttttgggacagcggtg

SEQ ID NO: 401304 - DNA, 140 bp, Artificial Sequence
  Synthetic
caccgctgtcccaaaaggtcctttctcttacttcaggccatccaactatgctgctttttgaccatttgccccccattttatagcaaagctgcttcaaagccctgtcttattcttctaggtcatatcagcagccagggcct

SEQ ID NO: 401305 - DNA, 140 bp, Artificial Sequence
  Synthetic
aggccctggctgctgatatgataagacagggcttagaaagggctttgctataagatgggtggcaagtggtcaaaacgtagtttggggggatggtctgctgtaagggaaagaatgagacgagaccttttgggacagcggtg

SEQ ID NO: 401306 - DNA, 140 bp, Artificial Sequence
  Synthetic
caccgctgtcccaaaaggtctcgtctcattctttcccttacagcagaccatccccccaaactacgttttgaccacttgccacccatcttatagcaaagccctttctaagccctgtcttatcatatcagcagccagggcct

SEQ ID NO: 401307 - DNA, 140 bp, Artificial Sequence
  Synthetic
atacgccatgctgggtctccgtggcgcccgaacagggacttgaaaacgaaagtagaaccggaggctgaatctctcgacgcaaggactcggctcgttggtgcacacagcgagaggcgaggccgtacttgggagtcggccat

SEQ ID NO: 401308 - DNA, 140 bp, Artificial Sequence
  Synthetic
atggccgactcccaagtacggcctcgcctctcgctgtgtgcaccaacgagccgagtccttgcgtcgagagattcagcctccggttctactttcgttttcaagtccctgttcgggcgccacggagacccagcatggcgtat

SEQ ID NO: 401309 - DNA, 140 bp, Artificial Sequence
  Synthetic
aggccctggctgctgatatgagctggggatttactacaccagacaaaaagcatcagaaggaacctccattcctttggatgggatatgaactccatcctgacaaatggacagtccagcctagaccttttgggacagcggtg

SEQ ID NO: 401310 - DNA, 140 bp, Artificial Sequence
  Synthetic
caccgctgtcccaaaaggtctaggctggactgtccatttgtcaggatggagttcatatcccatccaaaggaatggaggttccttctgatgctttttgtctggtgtagtaaatccccagctcatatcagcagccagggcct

SEQ ID NO: 401311 - DNA, 140 bp, Artificial Sequence
  Synthetic
atacgccatgctgggtctcccattcacaactagcaatacagcagaaaataatgctgatcgtgcctgggtagaagcacaagaggacggggaggaggtgggctttccagtcagacctcaggtcgtacttgggagtcggccat

SEQ ID NO: 401312 - DNA, 140 bp, Artificial Sequence
  Synthetic
atggccgactcccaagtacgacctgaggtctgactggaaagcccacctcctccccgtcctcttgtgcttctacccaggcacgatcagcattattttctgctgtattgctagttgtgaatgggagacccagcatggcgtat

SEQ ID NO: 401313 - DNA, 140 bp, Artificial Sequence
  Synthetic
atacgccatgctgggtctccgcaaggaagaaatgaaaaactgctctttcaatataaccacagaactaagagataagacaaaaaaggtatattcacttttttataaacttgatatagtacccgtacttgggagtcggccat

SEQ ID NO: 401314 - DNA, 140 bp, Artificial Sequence
  Synthetic
atggccgactcccaagtacgggtactatatcaagtttataaaaaagtgaatataccttttttgtcttatctcttagttctgtggttatattgaaagagcagtttttcatttcttccttgcggagacccagcatggcgtat

SEQ ID NO: 401315 - DNA, 140 bp, Artificial Sequence
  Synthetic
aggccctggctgctgatatggaaatggatccagtagatcctaacctaaagccctggaaccatccgggaagtcagcctaaaacagcttgtaacaagtgctattgtaaagtgtgttgctatcgaccttttgggacagcggtg

SEQ ID NO: 401316 - DNA, 140 bp, Artificial Sequence
  Synthetic
caccgctgtcccaaaaggtcgatagcaacacactttacaatagcacttgttacaagctgttttaggctgacttcccggatggttccagggctttaggttaggatctactggatccatttccatatcagcagccagggcct

SEQ ID NO: 401317 - DNA, 140 bp, Artificial Sequence
  Synthetic
aggccctggctgctgatatggccacctctgcctagtgttaggaaattagtagaggatagatggaacaacccccagaagaccaggggccgcagagggaaccatacaatgaatggacactaggaccttttgggacagcggtg

SEQ ID NO: 401318 - DNA, 140 bp, Artificial Sequence
  Synthetic
caccgctgtcccaaaaggtcctagtgtccattcattgtatggttccctctgcggcccctggtcttctgggggttgttccatctatcctctactaatttcctaacactaggcagaggtggccatatcagcagccagggcct

SEQ ID NO: 401319 - DNA, 140 bp, Artificial Sequence
  Synthetic
aggccctggctgctgatatgcagtatttgccataaagaaaaagaacagtactagatggagaaaattagtagatttcagagaacttaataaaagaactcaagacttctgggaagttcaattgaccttttgggacagcggtg

SEQ ID NO: 401320 - DNA, 140 bp, Artificial Sequence
  Synthetic
caccgctgtcccaaaaggtcaattgaacttcccagaagtcttgagttcttttattaagttctctgaaatctactaattttctccatctagtactgttctttttctttatggcaaatactgcatatcagcagccagggcct

SEQ ID NO: 401321 - DNA, 140 bp, Artificial Sequence
  Synthetic
aggccctggctgctgatatggagtctccatagaatggagattgagaaaatatagcacacaagtagaccctggcctggcagaccaactaatccatatgcattattttgattgttttacagagaccttttgggacagcggtg

SEQ ID NO: 401322 - DNA, 140 bp, Artificial Sequence
  Synthetic
caccgctgtcccaaaaggtctctgtaaaacaatcaaaataatgcatatggattagttggtctgccaggccagggtctacttgtgtgctatattttctcaatctccattctatggagactccatatcagcagccagggcct

SEQ ID NO: 401323 - DNA, 140 bp, Artificial Sequence
  Synthetic
atacgccatgctgggtctccttttaacaaaacaagggaacaaatgagaaactgctctttcaatgtaaccacagaactaagagataagaagaaatcagagtatgcacttttttataaaattcgtacttgggagtcggccat

SEQ ID NO: 401324 - DNA, 140 bp, Artificial Sequence
  Synthetic
atggccgactcccaagtacgaattttataaaaaagtgcatactctgatttcttcttatctcttagttctgtggttacattgaaagagcagtttctcatttgttcccttgttttgttaaaaggagacccagcatggcgtat

SEQ ID NO: 401325 - DNA, 140 bp, Artificial Sequence
  Synthetic
  misc_feature (111)..(111): n is a, c, g, or t
atacgccatgctgggtctcctgcaataataggactggtagtagcgctaatcatagcaatagttgtgtggactatagcaggtatagaatataggagaatactaaagcaaagnaaaataaaccgtacttgggagtcggccat

SEQ ID NO: 401326 - DNA, 140 bp, Artificial Sequence
  Synthetic
  misc_feature (30)..(30): n is a, c, g, or t
atggccgactcccaagtacggtttattttnctttgctttagtattctcctatattctatacctgctatagtccacacaactattgctatgattagcgctactaccagtcctattattgcaggagacccagcatggcgtat

SEQ ID NO: 401327 - DNA, 140 bp, Artificial Sequence
  Synthetic
  misc_feature (61)..(61): n is a, c, g, or t
aggccctggctgctgatatgctatagcaggtatagaatataggagaatactaaagcaaagnaaaataaacagattaattgagagaataagagaaagagcagaagatagtggcaatgagaggaccttttgggacagcggtg

SEQ ID NO: 401328 - DNA, 140 bp, Artificial Sequence
  Synthetic
  misc_feature (80)..(80): n is a, c, g, or t
caccgctgtcccaaaaggtcctctcattgccactatcttctgctctttctcttattctctcaattaatctgtttattttnctttgctttagtattctcctatattctatacctgctatagcatatcagcagccagggcct

SEQ ID NO: 401329 - DNA, 140 bp, Artificial Sequence
  Synthetic
aggccctggctgctgatatggaagctataataagaattttgcaacaactactgtttgttcatttcagaattgggtgtcaacatagcaggataggcattataccagggagaagaggcaggagaccttttgggacagcggtg

SEQ ID NO: 401330 - DNA, 140 bp, Artificial Sequence
  Synthetic
caccgctgtcccaaaaggtctcctgcctcttctccctggtataatgcctatcctgctatgttgacacccaattctgaaatgaacaaacagtagttgttgcaaaattcttattatagcttccatatcagcagccagggcct

SEQ ID NO: 401331 - DNA, 140 bp, Artificial Sequence
  Synthetic
atacgccatgctgggtctcccagtaaacatgacaaatgaaataaaaaactgctctttcaatataaccacagaaataaaggataggaaaaagcaagtgtattcacttttttataagcttgacgtacttgggagtcggccat

SEQ ID NO: 401332 - DNA, 140 bp, Artificial Sequence
  Synthetic
atggccgactcccaagtacgtcaagcttataaaaaagtgaatacacttgctttttcctatcctttatttctgtggttatattgaaagagcagttttttatttcatttgtcatgtttactgggagacccagcatggcgtat

SEQ ID NO: 401333 - DNA, 140 bp, Artificial Sequence
  Synthetic
aggccctggctgctgatatggacagatagagctatagaaatagtgcaaagaattggtagggctgttctcaatatacctgtaagaatacgacaaggcttcgaaagagctcttttataacatgaccttttgggacagcggtg

SEQ ID NO: 401334 - DNA, 140 bp, Artificial Sequence
  Synthetic
caccgctgtcccaaaaggtcatgttataaaagagctctttcgaagccttgtcgtattcttacaggtatattgagaacagccctaccaattctttgcactatttctatagctctatctgtccatatcagcagccagggcct

SEQ ID NO: 401335 - DNA, 140 bp, Artificial Sequence
  Synthetic
atacgccatgctgggtctccaatcaagccagtagtttcaactcaactattgttaaatggcagtttaacaaatggaacagagataaagattacatctgaaaatatcacagacaatgctaagcgtacttgggagtcggccat

SEQ ID NO: 401336 - DNA, 140 bp, Artificial Sequence
  Synthetic
atggccgactcccaagtacgcttagcattgtctgtgatattttcagatgtaatctttatctctgttccatttgttaaactgccatttaacaatagttgagttgaaactactggcttgattggagacccagcatggcgtat

SEQ ID NO: 401337 - DNA, 140 bp, Artificial Sequence
  Synthetic
aggccctggctgctgatatgatgcaacaggtgacataataggggatataagacaagcacattgtaatatcagtaaagcaaactggaataacacattaaaagacctagccatacaattaaggaccttttgggacagcggtg

SEQ ID NO: 401338 - DNA, 140 bp, Artificial Sequence
  Synthetic
caccgctgtcccaaaaggtccttaattgtatggctaggtcttttaatgtgttattccagtttgctttactgatattacaatgtgcttgtcttatatcccctattatgtcacctgttgcatcatatcagcagccagggcct

SEQ ID NO: 401339 - DNA, 140 bp, Artificial Sequence
  Synthetic
atacgccatgctgggtctccccaatagtacgagtagtaatgctactaataccaatagtactgctactaatataatggaggtaggagaactaaaaaattgctctttcaatatcaccacaagcgtacttgggagtcggccat

SEQ ID NO: 401340 - DNA, 140 bp, Artificial Sequence
  Synthetic
atggccgactcccaagtacgcttgtggtgatattgaaagagcaattttttagttctcctacctccattatattagtagcagtactattggtattagtagcattactactcgtactattggggagacccagcatggcgtat

SEQ ID NO: 401341 - DNA, 140 bp, Artificial Sequence
  Synthetic
atacgccatgctgggtctccatttagaaattacaacacatagttttaattgtcaaggagagtttttctattgtaatacatcacaactgtttaatagcacttgggacaaaaatggcacttgcgtacttgggagtcggccat

SEQ ID NO: 401342 - DNA, 140 bp, Artificial Sequence
  Synthetic
atggccgactcccaagtacgcaagtgccatttttgtcccaagtgctattaaacagttgtgatgtattacaatagaaaaactctccttgacaattaaaactatgtgttgtaatttctaaatggagacccagcatggcgtat

SEQ ID NO: 401343 - DNA, 140 bp, Artificial Sequence
  Synthetic
atacgccatgctgggtctccgaataaagcaaattataaatatgtggcagcgagtaggaaaagcaatgtatgcccctcccatccaaggagtaatagaatgtagatcagagattacaggactcgtacttgggagtcggccat

SEQ ID NO: 401344 - DNA, 140 bp, Artificial Sequence
  Synthetic
atggccgactcccaagtacgagtcctgtaatctctgatctacattctattactccttggatgggaggggcatacattgcttttcctactcgctgccacatatttataatttgctttattcggagacccagcatggcgtat

SEQ ID NO: 401345 - DNA, 140 bp, Artificial Sequence
  Synthetic
aggccctggctgctgatatgcatggaattaggccagtagtatcaactcaattgctgttaaatggcagtttagcagaagaagaggtagtaattagatctagcaatttcacaaacaatgctagaccttttgggacagcggtg

SEQ ID NO: 401346 - DNA, 140 bp, Artificial Sequence
  Synthetic
caccgctgtcccaaaaggtctagcattgtttgtgaaattgctagatctaattactacctcttcttctgctaaactgccatttaacagcaattgagttgatactactggcctaattccatgcatatcagcagccagggcct

SEQ ID NO: 401347 - DNA, 140 bp, Artificial Sequence
  Synthetic
aggccctggctgctgatatgagcagaagaagaggtagtaattagatctagcaatttcacaaacaatgctaaagtcataatagtacagctgaatgaatcagtagaaattaattgtacaagagaccttttgggacagcggtg

SEQ ID NO: 401348 - DNA, 140 bp, Artificial Sequence
  Synthetic
caccgctgtcccaaaaggtctcttgtacaattaatttctactgattcattcagctgtactattatgactttagcattgtttgtgaaattgctagatctaattactacctcttcttctgctcatatcagcagccagggcct

SEQ ID NO: 401349 - DNA, 140 bp, Artificial Sequence
  Synthetic
aggccctggctgctgatatgcccaacaacaatacaagaaaaagtatacatctaggacaagggagcacatggtatgcacatggagaaatagtgggagatataagacaagcacattgtaatcgaccttttgggacagcggtg

SEQ ID NO: 401350 - DNA, 140 bp, Artificial Sequence
  Synthetic
caccgctgtcccaaaaggtcgattacaatgtgcttgtcttatatctcccactatttctccatgtgcataccatgtgctcccttgtcctagatgtatactttttcttgtattgttgttgggcatatcagcagccagggcct

SEQ ID NO: 401351 - DNA, 140 bp, Artificial Sequence
  Synthetic
aggccctggctgctgatatgttagaggaacttaagagtgaagctgttagacattttcctaggccatggctccatagcttaggacaatatatctatgaaacttatggggatacttgggcaggaccttttgggacagcggtg

SEQ ID NO: 401352 - DNA, 140 bp, Artificial Sequence
  Synthetic
caccgctgtcccaaaaggtcctgcccaagtatccccataagtttcatagatatattgtcctaagctatggagccatggcctaggaaaatgtctaacagcttcactcttaagttcctctaacatatcagcagccagggcct

SEQ ID NO: 401353 - DNA, 140 bp, Artificial Sequence
  Synthetic
aggccctggctgctgatatgaattataaacatgtggcaggaagtaggaaaagcaatgtatgcccctcccatcaagggacaaattagctgttcatcaaatattacagggttgatattaacagaccttttgggacagcggtg

SEQ ID NO: 401354 - DNA, 140 bp, Artificial Sequence
  Synthetic
caccgctgtcccaaaaggtctgttaatatcaaccctgtaatatttgatgaacagctaatttgtcccttgatgggaggggcatacattgcttttcctacttcctgccacatgtttataattcatatcagcagccagggcct

SEQ ID NO: 401355 - DNA, 140 bp, Artificial Sequence
  Synthetic
atacgccatgctgggtctcctagaaagggtaaaggagaaattaagagaacacttccctaataaaacaataacgtttgcacaacccgcaggaggggacctagaagttacaacacatagtttcgtacttgggagtcggccat

SEQ ID NO: 401356 - DNA, 140 bp, Artificial Sequence
  Synthetic
atggccgactcccaagtacgaaactatgtgttgtaacttctaggtcccctcctgcgggttgtgcaaacgttattgttttattagggaagtgttctcttaatttctcctttaccctttctaggagacccagcatggcgtat

SEQ ID NO: 401357 - DNA, 140 bp, Artificial Sequence
  Synthetic
aggccctggctgctgatatgcttagcacttgcctggaacgacctgaggaacctgtgccttttctgctaccaccaattgagagacttaacattgattgtagcgaggacggtggaaattctggaccttttgggacagcggtg

SEQ ID NO: 401358 - DNA, 140 bp, Artificial Sequence
  Synthetic
caccgctgtcccaaaaggtccagaatttccaccgtcctcgctacaatcaatgttaagtctctcaattggtggtagcagaaaaggcacaggttcctcaggtcgttccaggcaagtgctaagcatatcagcagccagggcct

SEQ ID NO: 401359 - DNA, 140 bp, Artificial Sequence
  Synthetic
aggccctggctgctgatatgcaatagcagtagctgagggaacagatagaattatagaattaatacaaggatttggcagagctatctataacatacctgtaagaataagacaaggcttagagaccttttgggacagcggtg

SEQ ID NO: 401360 - DNA, 140 bp, Artificial Sequence
  Synthetic
caccgctgtcccaaaaggtctctaagccttgtcttattcttacaggtatgttatagatagctctgccaaatccttgtattaattctataattctatctgttccctcagctactgctattgcatatcagcagccagggcct

SEQ ID NO: 401361 - DNA, 140 bp, Artificial Sequence
  Synthetic
atacgccatgctgggtctccggatggcaggttgtaagggaaagaataagaaaaactgatccagcagcagaaagagcaggagcagcatcccaagcagcagagggagtaggagcagcgtccccgtacttgggagtcggccat

SEQ ID NO: 401362 - DNA, 140 bp, Artificial Sequence
  Synthetic
atggccgactcccaagtacggggacgctgctcctactccctctgctgcttgggatgctgctcctgctctttctgctgctggatcagtttttcttattctttcccttacaacctgccatccggagacccagcatggcgtat

SEQ ID NO: 401363 - DNA, 140 bp, Artificial Sequence
  Synthetic
atacgccatgctgggtctccgaatgatactgctaatagcaacagtactactaataacaatagtattgattgggaatgggtaaataaagaaatgacaaactgctctttcaatgtcaccacacgtacttgggagtcggccat

SEQ ID NO: 401364 - DNA, 140 bp, Artificial Sequence
  Synthetic
atggccgactcccaagtacgtgtggtgacattgaaagagcagtttgtcatttctttatttacccattcccaatcaatactattgttattagtagtactgttgctattagcagtatcattcggagacccagcatggcgtat

SEQ ID NO: 401365 - DNA, 140 bp, Artificial Sequence
  Synthetic
aggccctggctgctgatatggaagaggtaggctttccagtcaaacctcaggtacctttaagaccaatgacttataagggagcatttgatctcagcttctttttaaaagaaaaggggggacgaccttttgggacagcggtg

SEQ ID NO: 401366 - DNA, 140 bp, Artificial Sequence
  Synthetic
caccgctgtcccaaaaggtcgtccccccttttcttttaaaaagaagctgagatcaaatgctcccttataagtcattggtcttaaaggtacctgaggtttgactggaaagcctacctcttccatatcagcagccagggcct

SEQ ID NO: 401367 - DNA, 140 bp, Artificial Sequence
  Synthetic
aggccctggctgctgatatgtgaaagcgaaagtaagaccagaggagatctctcgacgcgggactcggcttgctgaaagtgcactcggcaagaggcgagagcggcggctggtgagtacgccgaccttttgggacagcggtg

SEQ ID NO: 401368 - DNA, 140 bp, Artificial Sequence
  Synthetic
caccgctgtcccaaaaggtcggcgtactcaccagccgccgctctcgcctcttgccgagtgcactttcagcaagccgagtcccgcgtcgagagatctcctctggtcttactttcgctttcacatatcagcagccagggcct

SEQ ID NO: 401369 - DNA, 140 bp, Artificial Sequence
  Synthetic
aggccctggctgctgatatgattagatgcatgggaaaaaattcggttacggccagggggaaagaaaaaatataggatgaaacatttagtatgggcaagcagagagttggaaagatttgcagaccttttgggacagcggtg

SEQ ID NO: 401370 - DNA, 140 bp, Artificial Sequence
  Synthetic
caccgctgtcccaaaaggtctgcaaatctttccaactctctgcttgcccatactaaatgtttcatcctatattttttctttccccctggccgtaaccgaattttttcccatgcatctaatcatatcagcagccagggcct

SEQ ID NO: 401371 - DNA, 140 bp, Artificial Sequence
  Synthetic
aggccctggctgctgatatgacaagcagcaacacagcccacaataatgctgattgtgcctggctgcaagcacaagaggaggcagaagaagtaggctttccagtcagacctcaggtgccttgaccttttgggacagcggtg

SEQ ID NO: 401372 - DNA, 140 bp, Artificial Sequence
  Synthetic
caccgctgtcccaaaaggtcaaggcacctgaggtctgactggaaagcctacttcttctgcctcctcttgtgcttgcagccaggcacaatcagcattattgtgggctgtgttgctgcttgtcatatcagcagccagggcct

SEQ ID NO: 401373 - DNA, 140 bp, Artificial Sequence
  Synthetic
aggccctggctgctgatatgagatcttcagacctggaggaggagatatgagggacaattggagaagtgaattatataaatataaagtagtaaaaattgaaccattaggagtagcacccacgaccttttgggacagcggtg

SEQ ID NO: 401374 - DNA, 140 bp, Artificial Sequence
  Synthetic
caccgctgtcccaaaaggtcgtgggtgctactcctaatggttcaatttttactactttatatttatataattcacttctccaattgtccctcatatctcctcctccaggtctgaagatctcatatcagcagccagggcct

SEQ ID NO: 401375 - DNA, 140 bp, Artificial Sequence
  Synthetic
aggccctggctgctgatatgatagcacaaagaatttatagagctattctccacatacctacaagaataagacagggcttggaaagggctttgctataagatgggtggcaagtggtcaaaagaccttttgggacagcggtg

SEQ ID NO: 401376 - DNA, 140 bp, Artificial Sequence
  Synthetic
caccgctgtcccaaaaggtcttttgaccacttgccacccatcttatagcaaagccctttccaagccctgtcttattcttgtaggtatgtggagaatagctctataaattctttgtgctatcatatcagcagccagggcct

SEQ ID NO: 401377 - DNA, 140 bp, Artificial Sequence
  Synthetic
aggccctggctgctgatatgtacactagtagtaaaaacatattggggtctgcatacaggagaacaagcttggcatctgggtaatggggtctccatagagtggaggcagggaagatatagcgaccttttgggacagcggtg

SEQ ID NO: 401378 - DNA, 140 bp, Artificial Sequence
  Synthetic
caccgctgtcccaaaaggtcgctatatcttccctgcctccactctatggagaccccattacccagatgccaagcttgttctcctgtatgcagaccccaatatgtttttactactagtgtacatatcagcagccagggcct

SEQ ID NO: 401379 - DNA, 140 bp, Artificial Sequence
  Synthetic
  misc_feature (38)..(38): n is a, c, g, or t
  misc_feature (43)..(43): n is a, c, g, or t
  misc_feature (95)..(95): n is a, c, g, or t
  misc_feature (115)..(115): n is a, c, g, or t
atacgccatgctgggtctcctagtagtagtagtgaggnggganagatggagagaggagaaataaaaaactgcacttttaatatcaccaccaacanaggagataagcagagagacnatgcacgtacttgggagtcggccat

SEQ ID NO: 401380 - DNA, 140 bp, Artificial Sequence
  Synthetic
  misc_feature (26)..(26): n is a, c, g, or t
  misc_feature (46)..(46): n is a, c, g, or t
  misc_feature (98)..(98): n is a, c, g, or t
  misc_feature (103)..(103): n is a, c, g, or t
atggccgactcccaagtacgtgcatngtctctctgcttatctcctntgttggtggtgatattaaaagtgcagttttttatttctcctctctccatctntcccncctcactactactactaggagacccagcatggcgtat

SEQ ID NO: 401381 - DNA, 140 bp, Artificial Sequence
  Synthetic
  misc_feature (39)..(39): n is a, c, g, or t
  misc_feature (51)..(51): n is a, c, g, or t
  misc_feature (53)..(53): n is a, c, g, or t
  misc_feature (55)..(55): n is a, c, g, or t
  misc_feature (109)..(109): n is a, c, g, or t
atacgccatgctgggtctcctaggaccagggagagcatngtatgcaacagncnanataataggagatataaggaaagcacattgtaacattagtggaacacaatggaanaaaactttaagcgtacttgggagtcggccat

SEQ ID NO: 401382 - DNA, 140 bp, Artificial Sequence
  Synthetic
  misc_feature (32)..(32): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (102)..(102): n is a, c, g, or t
atggccgactcccaagtacgcttaaagttttnttccattgtgttccactaatgttacaatgtgctttccttatatctcctattatntngnctgttgcatacnatgctctccctggtcctaggagacccagcatggcgtat

SEQ ID NO: 401383 - DNA, 140 bp, Artificial Sequence
  Synthetic
aggccctggctgctgatatgcaaccagcccttcaaacaggatcagaagagcttagatcattatttaatacagtagcagtcctctattgtgtacatcaaaggatagaggtaaaagacaccagaccttttgggacagcggtg

SEQ ID NO: 401384 - DNA, 140 bp, Artificial Sequence
  Synthetic
caccgctgtcccaaaaggtctggtgtcttttacctctatcctttgatgtacacaatagaggactgctactgtattaaataatgatctaagctcttctgatcctgtttgaagggctggttgcatatcagcagccagggcct

SEQ ID NO: 401385 - DNA, 140 bp, Artificial Sequence
  Synthetic
  misc_feature (75)..(75): n is a, c, g, or t
atacgccatgctgggtctccaccaatcagaactaaaaaactgctctttcaatgtaaccacagaaataagagatangcagaagcaagaatacgcgcttttctataaacttgatatagtatccgtacttgggagtcggccat

SEQ ID NO: 401386 - DNA, 140 bp, Artificial Sequence
  Synthetic
  misc_feature (66)..(66): n is a, c, g, or t
atggccgactcccaagtacggatactatatcaagtttatagaaaagcgcgtattcttgcttctgcntatctcttatttctgtggttacattgaaagagcagttttttagttctgattggtggagacccagcatggcgtat

SEQ ID NO: 401387 - DNA, 140 bp, Artificial Sequence
  Synthetic
aggccctggctgctgatatgggctaattttttagggaagatctggccttcccacaaggggaggccagggaactttcttcagagcagaccagagccaacagctccaccagcagagagcttcgaccttttgggacagcggtg

SEQ ID NO: 401388 - DNA, 140 bp, Artificial Sequence
  Synthetic
caccgctgtcccaaaaggtcgaagctctctgctggtggagctgttggctctggtctgctctgaagaaagttccctggcctccccttgtgggaaggccagatcttccctaaaaaattagcccatatcagcagccagggcct

SEQ ID NO: 401389 - DNA, 140 bp, Artificial Sequence
  Synthetic
atacgccatgctgggtctccttgctctttcaatgcaagcacagaactaagagataagaaagagaaagtatatgcacttttttataggcttgatatagtaccacttaatggggatagcaaccgtacttgggagtcggccat

SEQ ID NO: 401390 - DNA, 140 bp, Artificial Sequence
  Synthetic
atggccgactcccaagtacggttgctatccccattaagtggtactatatcaagcctataaaaaagtgcatatactttctctttcttatctcttagttctgtgcttgcattgaaagagcaaggagacccagcatggcgtat

SEQ ID NO: 401391 - DNA, 140 bp, Artificial Sequence
  Synthetic
aggccctggctgctgatatgtcaacagctcctaggaatttggggttgctctggaaggctcatctgcaccactaatgtaccttggaatactagttggagtaacaaatcttatactgacattgaccttttgggacagcggtg

SEQ ID NO: 401392 - DNA, 140 bp, Artificial Sequence
  Synthetic
caccgctgtcccaaaaggtcaatgtcagtataagatttgttactccaactagtattccaaggtacattagtggtgcagatgagccttccagagcaaccccaaattcctaggagctgttgacatatcagcagccagggcct

SEQ ID NO: 401393 - DNA, 140 bp, Artificial Sequence
  Synthetic
atacgccatgctgggtctcctcatagtgatagttgtgtggactttagcaggtatagaatataagaaattgctaaagcaaaggaaaatagataggttaattaagaaaataagagaaagagccgtacttgggagtcggccat

SEQ ID NO: 401394 - DNA, 140 bp, Artificial Sequence
  Synthetic
atggccgactcccaagtacggctctttctcttattttcttaattaacctatctattttcctttgctttagcaatttcttatattctatacctgctaaagtccacacaactatcactatgaggagacccagcatggcgtat

SEQ ID NO: 401395 - DNA, 140 bp, Artificial Sequence
  Synthetic
aggccctggctgctgatatggcaagacaacgacagatccatacgattagtcagcggattcttgacacttgcctgggaagatctacggagcctgttcattttcagctaccaccgcttgagagaccttttgggacagcggtg

SEQ ID NO: 401396 - DNA, 140 bp, Artificial Sequence
  Synthetic
caccgctgtcccaaaaggtctctcaagcggtggtagctgaaaatgaacaggctccgtagatcttcccaggcaagtgtcaagaatccgctgactaatcgtatggatctgtcgttgtcttgccatatcagcagccagggcct

SEQ ID NO: 401397 - DNA, 140 bp, Artificial Sequence
  Synthetic
aggccctggctgctgatatgatgggcgcggcgtcaataacgctgacggtacaggccagacaactgttgtctggtatagtgcaacagcaaagcaatttgctgagggctatagaggcgcaacgaccttttgggacagcggtg

SEQ ID NO: 401398 - DNA, 140 bp, Artificial Sequence
  Synthetic
caccgctgtcccaaaaggtcgttgcgcctctatagccctcagcaaattgctttgctgttgcactataccagacaacagttgtctggcctgtaccgtcagcgttattgacgccgcgcccatcatatcagcagccagggcct

SEQ ID NO: 401399 - DNA, 140 bp, Artificial Sequence
  Synthetic
aggccctggctgctgatatgaaaataacatggtagagcagatgcatacagatataatcagtctatgggaccaaagcctaaagccatgtgtaaagttaacccctctctgcgttactttagagaccttttgggacagcggtg

SEQ ID NO: 401400 - DNA, 140 bp, Artificial Sequence
  Synthetic
caccgctgtcccaaaaggtctctaaagtaacgcagagaggggttaactttacacatggctttaggctttggtcccatagactgattatatctgtatgcatctgctctaccatgttattttcatatcagcagccagggcct

SEQ ID NO: 401401 - DNA, 140 bp, Artificial Sequence
  Synthetic
atacgccatgctgggtctccagtacaaagaggtggtagggctatacttcacatacctacaagaataagacaaggttttgaaagagctttgctataaaatggggggcaagttgtcaaaacgcgtacttgggagtcggccat

SEQ ID NO: 401402 - DNA, 140 bp, Artificial Sequence
  Synthetic
atggccgactcccaagtacgcgttttgacaacttgccccccattttatagcaaagctctttcaaaaccttgtcttattcttgtaggtatgtgaagtatagccctaccacctctttgtactggagacccagcatggcgtat

SEQ ID NO: 401403 - DNA, 140 bp, Artificial Sequence
  Synthetic
atacgccatgctgggtctccctgatttgaggaatgctaccaatattacaatagagggaagagaactaaaaaattgctctttcaatatcaccacaagcataaaaactgaagtgaaagactacgtacttgggagtcggccat

SEQ ID NO: 401404 - DNA, 140 bp, Artificial Sequence
  Synthetic
atggccgactcccaagtacgtagtctttcacttcagtttttatgcttgtggtgatattgaaagagcaattttttagttctcttccctctattgtaatattggtagcattcctcaaatcagggagacccagcatggcgtat

SEQ ID NO: 401405 - DNA, 140 bp, Artificial Sequence
  Synthetic
atacgccatgctgggtctccagggtggtggaacttctgggacgcaacagtctcgggggactacggaaggggtgggaagcccttaagtatctgggaaatattatacaatattggggtttagcgtacttgggagtcggccat

SEQ ID NO: 401406 - DNA, 140 bp, Artificial Sequence
  Synthetic
atggccgactcccaagtacgctaaaccccaatattgtataatatttcccagatacttaagggcttcccaccccttccgtagtcccccgagactgttgcgtcccagaagttccaccaccctggagacccagcatggcgtat

SEQ ID NO: 401407 - DNA, 140 bp, Artificial Sequence
  Synthetic
aggccctggctgctgatatggggacgcagcagcctcaagggactgagactggggtgggagggcctcaaatatctatggaatcttctagtatattggggccgggagctaaagaatagtgctgaccttttgggacagcggtg

SEQ ID NO: 401408 - DNA, 140 bp, Artificial Sequence
  Synthetic
caccgctgtcccaaaaggtcagcactattctttagctcccggccccaatatactagaagattccatagatatttgaggccctcccaccccagtctcagtcccttgaggctgctgcgtccccatatcagcagccagggcct

SEQ ID NO: 401409 - DNA, 140 bp, Artificial Sequence
  Synthetic
atacgccatgctgggtctccctaagaaagaaatagaatttggaccatcctcaggaggagatctagaagttacaacacatagctttaactgtaaaggagaatttttctattgtaatacaaccgtacttgggagtcggccat

SEQ ID NO: 401410 - DNA, 140 bp, Artificial Sequence
  Synthetic
atggccgactcccaagtacggttgtattacaatagaaaaattctcctttacagttaaagctatgtgttgtaacttctagatctcctcctgaggatggtccaaattctatttctttcttagggagacccagcatggcgtat

SEQ ID NO: 401411 - DNA, 140 bp, Artificial Sequence
  Synthetic
aggccctggctgctgatatgcgcagaaccagcaggaaaagaatgaacaagacttattggcattggacaagtgggcaaatctgtggaattggtttgacatatcaaattggctgtggtatatgaccttttgggacagcggtg

SEQ ID NO: 401412 - DNA, 140 bp, Artificial Sequence
  Synthetic
caccgctgtcccaaaaggtcatataccacagccaatttgatatgtcaaaccaattccacagatttgcccacttgtccaatgccaataagtcttgttcattcttttcctgctggttctgcgcatatcagcagccagggcct

SEQ ID NO: 401413 - DNA, 140 bp, Artificial Sequence
  Synthetic
atacgccatgctgggtctcctggtgccatagatgggaaggaagaaataagaaattgtactttcaatacaaccacagtaataaatgataggaagcagtcagtgcatgcacttttttataagcgtacttgggagtcggccat

SEQ ID NO: 401414 - DNA, 140 bp, Artificial Sequence
  Synthetic
atggccgactcccaagtacgcttataaaaaagtgcatgcactgactgcttcctatcatttattactgtggttgtattgaaagtacaatttcttatttcttccttcccatctatggcaccaggagacccagcatggcgtat

SEQ ID NO: 401415 - DNA, 140 bp, Artificial Sequence
  Synthetic
aggccctggctgctgatatgccctcaaatcactctttggcaacgacccctagtcacagtaaaaatagggggacagctaatagaagctctattagacacaggagcagatgatacagtattagaccttttgggacagcggtg

SEQ ID NO: 401416 - DNA, 140 bp, Artificial Sequence
  Synthetic
caccgctgtcccaaaaggtctaatactgtatcatctgctcctgtgtctaatagagcttctattagctgtccccctatttttactgtgactaggggtcgttgccaaagagtgatttgagggcatatcagcagccagggcct

SEQ ID NO: 401417 - DNA, 140 bp, Artificial Sequence
  Synthetic
atacgccatgctgggtctccacatacctagcagaataagacagggctttgaagcagctttgcaataaaatgggaagcaagtggtcaaaatgtagtccagtaggatggcctgctgtaagagcgtacttgggagtcggccat

SEQ ID NO: 401418 - DNA, 140 bp, Artificial Sequence
  Synthetic
atggccgactcccaagtacgctcttacagcaggccatcctactggactacattttgaccacttgcttcccattttattgcaaagctgcttcaaagccctgtcttattctgctaggtatgtggagacccagcatggcgtat

SEQ ID NO: 401419 - DNA, 140 bp, Artificial Sequence
  Synthetic
aggccctggctgctgatatgtagaactaaccccactctgtgttactttaaattgcactgattataatggtaataatacaaatagtactcataccaatagtagtagtagtgaaggggaaaagaccttttgggacagcggtg

SEQ ID NO: 401420 - DNA, 140 bp, Artificial Sequence
  Synthetic
caccgctgtcccaaaaggtcttttccccttcactactactactattggtatgagtactatttgtattattaccattataatcagtgcaatttaaagtaacacagagtggggttagttctacatatcagcagccagggcct

SEQ ID NO: 401421 - DNA, 140 bp, Artificial Sequence
  Synthetic
atacgccatgctgggtctccaataatacaaatagtactcataccaatagtagtagtagtgaaggggaaaagctggagaaaggagaaataaaaaactgcacttttaatatcaccaccaacacgtacttgggagtcggccat

SEQ ID NO: 401422 - DNA, 140 bp, Artificial Sequence
  Synthetic
atggccgactcccaagtacgtgttggtggtgatattaaaagtgcagttttttatttctcctttctccagcttttccccttcactactactactattggtatgagtactatttgtattattggagacccagcatggcgtat

SEQ ID NO: 401423 - DNA, 140 bp, Artificial Sequence
  Synthetic
aggccctggctgctgatatgaattgcagggcccctaggaaaaagggctgttggaaatgtggaaaggaaggacaccaaatgaaagactgtactgaaagacaggctaattttttagggaaaagaccttttgggacagcggtg

SEQ ID NO: 401424 - DNA, 140 bp, Artificial Sequence
  Synthetic
caccgctgtcccaaaaggtcttttccctaaaaaattagcctgtctttcagtacagtctttcatttggtgtccttcctttccacatttccaacagccctttttcctaggggccctgcaattcatatcagcagccagggcct

SEQ ID NO: 401425 - DNA, 140 bp, Artificial Sequence
  Synthetic
atacgccatgctgggtctccgacgagctcctgctcctgctccagcagcaagaggagtaggaccagtatctcaagatttagataaatatggagcagtcacaagcaggaacacctcaactaccgtacttgggagtcggccat

SEQ ID NO: 401426 - DNA, 140 bp, Artificial Sequence
  Synthetic
atggccgactcccaagtacggtagttgaggtgttcctgcttgtgactgctccatatttatctaaatcttgagatactggtcctactcctcttgctgctggagcaggagcaggagctcgtcggagacccagcatggcgtat

SEQ ID NO: 401427 - DNA, 140 bp, Artificial Sequence
  Synthetic
aggccctggctgctgatatggaggaggtaggctttccagtcaggccgcaggtacctctaagaccaatgactttcaagggagcttttgatcttagcttctttttaaaagaaaaggggggacgaccttttgggacagcggtg

SEQ ID NO: 401428 - DNA, 140 bp, Artificial Sequence
  Synthetic
caccgctgtcccaaaaggtcgtccccccttttcttttaaaaagaagctaagatcaaaagctcccttgaaagtcattggtcttagaggtacctgcggcctgactggaaagcctacctcctccatatcagcagccagggcct

SEQ ID NO: 401429 - DNA, 140 bp, Artificial Sequence
  Synthetic
atacgccatgctgggtctccgtggcgcccgaacagggacttgaaagcgaaagttaatagggactcgaaagcgaaagttccagagaagttctctcgacgcaggactcggcttgctgaggtgcgtacttgggagtcggccat

SEQ ID NO: 401430 - DNA, 140 bp, Artificial Sequence
  Synthetic
atggccgactcccaagtacgcacctcagcaagccgagtcctgcgtcgagagaacttctctggaactttcgctttcgagtccctattaactttcgctttcaagtccctgttcgggcgccacggagacccagcatggcgtat

SEQ ID NO: 401431 - DNA, 140 bp, Artificial Sequence
  Synthetic
aggccctggctgctgatatgaagacagggctttgaagcagctttgctataaaatggggggcaagtggtcaaagagcagcatagttggatggcctgagataagagaaagaataagaagagcgaccttttgggacagcggtg

SEQ ID NO: 401432 - DNA, 140 bp, Artificial Sequence
  Synthetic
caccgctgtcccaaaaggtcgctcttcttattctttctcttatctcaggccatccaactatgctgctctttgaccacttgccccccattttatagcaaagctgcttcaaagccctgtcttcatatcagcagccagggcct

SEQ ID NO: 401433 - DNA, 140 bp, Artificial Sequence
  Synthetic
aggccctggctgctgatatgttataaacatgtggcagaaagtaggaaaagcaatgtatgcccctcccatcagaggacaaattaattgtttatcaaatattacagggctgctattaacaaggaccttttgggacagcggtg

SEQ ID NO: 401434 - DNA, 140 bp, Artificial Sequence
  Synthetic
caccgctgtcccaaaaggtccttgttaatagcagccctgtaatatttgataaacaattaatttgtcctctgatgggaggggcatacattgcttttcctactttctgccacatgtttataacatatcagcagccagggcct

SEQ ID NO: 401435 - DNA, 140 bp, Artificial Sequence
  Synthetic
aggccctggctgctgatatgacatagcaggaactactagtacccttcaggaacaaatagcatggataacaggtaacccacctgttccagtgggagaaatctataaaagatggataattctgaccttttgggacagcggtg

SEQ ID NO: 401436 - DNA, 140 bp, Artificial Sequence
  Synthetic
caccgctgtcccaaaaggtcagaattatccatcttttatagatttctcccactggaacaggtgggttacctgttatccatgctatttgttcctgaagggtactagtagttcctgctatgtcatatcagcagccagggcct

SEQ ID NO: 401437 - DNA, 140 bp, Artificial Sequence
  Synthetic
atacgccatgctgggtctccaaacacctagtatgggcaagcagggagctggaaagatttgcacttaaccctggccttttagaaacatcagaaggctgtaaacaaataatgaaacagctaccgtacttgggagtcggccat

SEQ ID NO: 401438 - DNA, 140 bp, Artificial Sequence
  Synthetic
atggccgactcccaagtacggtagctgtttcattatttgtttacagccttctgatgtttctaaaaggccagggttaagtgcaaatctttccagctccctgcttgcccatactaggtgtttggagacccagcatggcgtat

SEQ ID NO: 401439 - DNA, 140 bp, Artificial Sequence
  Synthetic
aggccctggctgctgatatggtggacagaatattggcaggccacctggattcctgactgggaatttgtcaatacccctcctctagtaaaattatggtatcagttagaaacagaacccatagaccttttgggacagcggtg

SEQ ID NO: 401440 - DNA, 140 bp, Artificial Sequence
  Synthetic
caccgctgtcccaaaaggtctatgggttctgtttctaactgataccataattttactagaggaggggtattgacaaattcccagtcaggaatccaggtggcctgccaatattctgtccaccatatcagcagccagggcct

SEQ ID NO: 401441 - DNA, 140 bp, Artificial Sequence
  Synthetic
atacgccatgctgggtctccatcacactcccatgtagaataagacaagttgtaaacctatggcaggaagtaggaaaagcaatgtatgcccctcccatcagaggatccattagatgtaactcgtacttgggagtcggccat

SEQ ID NO: 401442 - DNA, 140 bp, Artificial Sequence
  Synthetic
atggccgactcccaagtacgagttacatctaatggatcctctgatgggaggggcatacattgcttttcctacttcctgccataggtttacaacttgtcttattctacatgggagtgtgatggagacccagcatggcgtat

SEQ ID NO: 401443 - DNA, 140 bp, Artificial Sequence
  Synthetic
aggccctggctgctgatatgatgatagtaggaggcttgataggtttaagaatagtttttgctgtactttctatagtaaatagagttaggcagggatactcaccattgtcattgcagacccgaccttttgggacagcggtg

SEQ ID NO: 401444 - DNA, 140 bp, Artificial Sequence
  Synthetic
caccgctgtcccaaaaggtcgggtctgcaatgacaatggtgagtatccctgcctaactctatttactatagaaagtacagcaaaaactattcttaaacctatcaagcctcctactatcatcatatcagcagccagggcct

SEQ ID NO: 401445 - DNA, 140 bp, Artificial Sequence
  Synthetic
atacgccatgctgggtctccccagatagagaaccaatgaaaaactgctctttcgatgtcaccacaagcctaagagataagattacaaaagaatatgcacttttttatagacctgatgtagcgtacttgggagtcggccat

SEQ ID NO: 401446 - DNA, 140 bp, Artificial Sequence
  Synthetic
atggccgactcccaagtacgctacatcaggtctataaaaaagtgcatattcttttgtaatcttatctcttaggcttgtggtgacatcgaaagagcagtttttcattggttctctatctggggagacccagcatggcgtat

SEQ ID NO: 401447 - DNA, 140 bp, Artificial Sequence
  Synthetic
atacgccatgctgggtctccgtagaaattaattgtacaagacccggctacaacacaataaaaagggtatcgataggaccaggaagaggaagagcaattgttgcaacaaaaaagatagaagcgtacttgggagtcggccat

SEQ ID NO: 401448 - DNA, 140 bp, Artificial Sequence
  Synthetic
atggccgactcccaagtacgcttctatcttttttgttgcaacaattgctcttcctcttcctggtcctatcgataccctttttattgtgttgtagccgggtcttgtacaattaatttctacggagacccagcatggcgtat

SEQ ID NO: 401449 - DNA, 140 bp, Artificial Sequence
  Synthetic
atacgccatgctgggtctccaaatagcaacatcacactcccgtgtagaataagacaaattgtaaacatgtggcagacagtaggaaaagcaatgtatgcccctcccatcagcggatacattcgtacttgggagtcggccat

SEQ ID NO: 401450 - DNA, 140 bp, Artificial Sequence
  Synthetic
atggccgactcccaagtacgaatgtatccgctgatgggaggggcatacattgcttttcctactgtctgccacatgtttacaatttgtcttattctacacgggagtgtgatgttgctatttggagacccagcatggcgtat

SEQ ID NO: 401451 - DNA, 140 bp, Artificial Sequence
  Synthetic
atacgccatgctgggtctccgggatactcaccattatcattgcagacccttatcccagtctcgaggggaccacccgacaggcccgacggaatcgaagaagaaggtggagagagaggcagacgtacttgggagtcggccat

SEQ ID NO: 401452 - DNA, 140 bp, Artificial Sequence
  Synthetic
atggccgactcccaagtacgtctgcctctctctccaccttcttcttcgattccgtcgggcctgtcgggtggtcccctcgagactgggataagggtctgcaatgataatggtgagtatcccggagacccagcatggcgtat

SEQ ID NO: 401453 - DNA, 140 bp, Artificial Sequence
  Synthetic
aggccctggctgctgatatggcacataaaggaattggaggaaatgaacaagtagataaattagtaagtagtggaatcaggaaagtgctgtttctagatggaatagataaggctcaagaaggaccttttgggacagcggtg

SEQ ID NO: 401454 - DNA, 140 bp, Artificial Sequence
  Synthetic
caccgctgtcccaaaaggtccttcttgagccttatctattccatctagaaacagcactttcctgattccactacttactaatttatctacttgttcatttcctccaattcctttatgtgccatatcagcagccagggcct

SEQ ID NO: 401455 - DNA, 140 bp, Artificial Sequence
  Synthetic
aggccctggctgctgatatgtagaataaaagaaagagcagaagacagtggaaatgaaagtgaaggggatacagaggaattggcagcacttgtggagatgggggactttgatgcttgggttgaccttttgggacagcggtg

SEQ ID NO: 401456 - DNA, 140 bp, Artificial Sequence
  Synthetic
caccgctgtcccaaaaggtcaacccaagcatcaaagtcccccatctccacaagtgctgccaattcctctgtatccccttcactttcatttccactgtcttctgctctttcttttattctacatatcagcagccagggcct

SEQ ID NO: 401457 - DNA, 140 bp, Artificial Sequence
  Synthetic
aggccctggctgctgatatgatactgcatttaccatacctagtataaacaatgagacaccaggaattagatatcagtacaatgtgcttccacagggatggaaaggatcaccagcaatattgaccttttgggacagcggtg

SEQ ID NO: 401458 - DNA, 140 bp, Artificial Sequence
  Synthetic
caccgctgtcccaaaaggtcaatattgctggtgatcctttccatccctgtggaagcacattgtactgatatctaattcctggtgtctcattgtttatactaggtatggtaaatgcagtatcatatcagcagccagggcct

SEQ ID NO: 401459 - DNA, 140 bp, Artificial Sequence
  Synthetic
aggccctggctgctgatatggcagcctgttggtgggcaggtatccaacaggaatttgggattccctacaatccccaaagtcagggagtagtagaatctatgaataaagaattaaagaaaagaccttttgggacagcggtg

SEQ ID NO: 401460 - DNA, 140 bp, Artificial Sequence
  Synthetic
caccgctgtcccaaaaggtcttttctttaattctttattcatagattctactactccctgactttggggattgtagggaatcccaaattcctgttggatacctgcccaccaacaggctgccatatcagcagccagggcct

SEQ ID NO: 401461 - DNA, 140 bp, Artificial Sequence
  Synthetic
atacgccatgctgggtctccgaactaaaaaactgctctttcaatataaccacagaaataagagataagaagaaacaagagtatgcgcttttctataaacttgatatagtaccaattgatgcgtacttgggagtcggccat

SEQ ID NO: 401462 - DNA, 140 bp, Artificial Sequence
  Synthetic
atggccgactcccaagtacgcatcaattggtactatatcaagtttatagaaaagcgcatactcttgtttcttcttatctcttatttctgtggttatattgaaagagcagttttttagttcggagacccagcatggcgtat

SEQ ID NO: 401463 - DNA, 140 bp, Artificial Sequence
  Synthetic
aggccctggctgctgatatgaagaattacaaaaacaaattataaaaattcaaaattttcgggtttattacagagacagcagagaccctatttggaaaggaccagccaaactactctggaagaccttttgggacagcggtg

SEQ ID NO: 401464 - DNA, 140 bp, Artificial Sequence
  Synthetic
caccgctgtcccaaaaggtcttccagagtagtttggctggtcctttccaaatagggtctctgctgtctctgtaataaacccgaaaattttgaatttttataatttgtttttgtaattcttcatatcagcagccagggcct

SEQ ID NO: 401465 - DNA, 140 bp, Artificial Sequence
  Synthetic
atacgccatgctgggtctcctaatgataccttgtatggagagataaaaaattgctctttcaatgtaaccacagaaataagagataagaaaaggaaggaacatgcattgttttatagacttcgtacttgggagtcggccat

SEQ ID NO: 401466 - DNA, 140 bp, Artificial Sequence
  Synthetic
atggccgactcccaagtacgaagtctataaaacaatgcatgttccttccttttcttatctcttatttctgtggttacattgaaagagcaattttttatctctccatacaaggtatcattaggagacccagcatggcgtat

SEQ ID NO: 401467 - DNA, 140 bp, Artificial Sequence
  Synthetic
aggccctggctgctgatatgcagcaagcagcagctgacacaggaaacagcagccaggtcagccaaaattaccctatagtgcagaacatccaggggcaaatggtacatcaggccatatcacgaccttttgggacagcggtg

SEQ ID NO: 401468 - DNA, 140 bp, Artificial Sequence
  Synthetic
caccgctgtcccaaaaggtcgtgatatggcctgatgtaccatttgcccctggatgttctgcactatagggtaattttggctgacctggctgctgtttcctgtgtcagctgctgcttgctgcatatcagcagccagggcct

SEQ ID NO: 401469 - DNA, 140 bp, Artificial Sequence
  Synthetic
aggccctggctgctgatatgaacaacaatacaagaaaaagtataccaatcggaccaggacaagcgttctatgcaacaggtgacataataggagatataagacaagcatattgtaatattagaccttttgggacagcggtg

SEQ ID NO: 401470 - DNA, 140 bp, Artificial Sequence
  Synthetic
caccgctgtcccaaaaggtctaatattacaatatgcttgtcttatatctcctattatgtcacctgttgcatagaacgcttgtcctggtccgattggtatactttttcttgtattgttgttcatatcagcagccagggcct

SEQ ID NO: 401471 - DNA, 140 bp, Artificial Sequence
  Synthetic
atacgccatgctgggtctccaatgaaaatatcacacttccatgtaagataaaacaaattgtgagaatgtggcagagagtgggacaagcaatgtatgtccctcccatcaggggagaaattacgtacttgggagtcggccat

SEQ ID NO: 401472 - DNA, 140 bp, Artificial Sequence
  Synthetic
atggccgactcccaagtacgtaatttctcccctgatgggagggacatacattgcttgtcccactctctgccacattctcacaatttgttttatcttacatggaagtgtgatattttcattggagacccagcatggcgtat

SEQ ID NO: 401473 - DNA, 140 bp, Artificial Sequence
  Synthetic
aggccctggctgctgatatggtggcaggtagacaggatgaggattagaacatggaatagtttagtaaaacatcatatgtatatctcaaagaaaactaaaaagtggtcttatagacatcatgaccttttgggacagcggtg

SEQ ID NO: 401474 - DNA, 140 bp, Artificial Sequence
  Synthetic
caccgctgtcccaaaaggtcatgatgtctataagaccactttttagttttctttgagatatacatatgatgttttactaaactattccatgttctaatcctcatcctgtctacctgccaccatatcagcagccagggcct

SEQ ID NO: 401475 - DNA, 140 bp, Artificial Sequence
  Synthetic
aggccctggctgctgatatgtaaaacaaattataaacatgtggcaggaggtaggacgagcaatgtatgcccctcccattgaaggaaacataacatgtaaatcaaatatcacaggactactgaccttttgggacagcggtg

SEQ ID NO: 401476 - DNA, 140 bp, Artificial Sequence
  Synthetic
caccgctgtcccaaaaggtcagtagtcctgtgatatttgatttacatgttatgtttccttcaatgggaggggcatacattgctcgtcctacctcctgccacatgtttataatttgttttacatatcagcagccagggcct

SEQ ID NO: 401477 - DNA, 140 bp, Artificial Sequence
  Synthetic
atacgccatgctgggtctcctagcgctattcgcagcaataattgtgtggactatagtatttatagaatataagaaaataaggaagcaaaagaaaatagataggctaatcaataggataagcgtacttgggagtcggccat

SEQ ID NO: 401478 - DNA, 140 bp, Artificial Sequence
  Synthetic
atggccgactcccaagtacgcttatcctattgattagcctatctattttcttttgcttccttattttcttatattctataaatactatagtccacacaattattgctgcgaatagcgctaggagacccagcatggcgtat

SEQ ID NO: 401479 - DNA, 140 bp, Artificial Sequence
  Synthetic
atacgccatgctgggtctcctaccaacacttgtggagatgtgggattatgatcattggattaatgataatttgtagggctaaagaagacttgtgggttacagtttattatggggtacctgcgtacttgggagtcggccat

SEQ ID NO: 401480 - DNA, 140 bp, Artificial Sequence
  Synthetic
atggccgactcccaagtacgcaggtaccccataataaactgtaacccacaagtcttctttagccctacaaattatcattaatccaatgatcataatcccacatctccacaagtgttggtaggagacccagcatggcgtat

SEQ ID NO: 401481 - DNA, 140 bp, Artificial Sequence
  Synthetic
atacgccatgctgggtctcctactttaaattgcactaacgccaacatcaacaatactagcatcaacaataatagcactgtcaatatttctaaggacatgcaagaagacataaaaaactgccgtacttgggagtcggccat

SEQ ID NO: 401482 - DNA, 140 bp, Artificial Sequence
  Synthetic
atggccgactcccaagtacggcagttttttatgtcttcttgcatgtccttagaaatattgacagtgctattattgttgatgctagtattgttgatgttggcgttagtgcaatttaaagtaggagacccagcatggcgtat

SEQ ID NO: 401483 - DNA, 140 bp, Artificial Sequence
  Synthetic
atacgccatgctgggtctccgtagggctttgcgcaacgtgcctagaagaataagacaaggcgccgaaaggcttttgctataaaatggggggcaaatggtcaaaaagttccatagttgggtcgtacttgggagtcggccat

SEQ ID NO: 401484 - DNA, 140 bp, Artificial Sequence
  Synthetic
atggccgactcccaagtacgacccaactatggaactttttgaccatttgccccccattttatagcaaaagcctttcggcgccttgtcttattcttctaggcacgttgcgcaaagccctacggagacccagcatggcgtat

SEQ ID NO: 401485 - DNA, 140 bp, Artificial Sequence
  Synthetic
atacgccatgctgggtctccacttttttatggacttgatgtagtaccatttaatgaaggtaatgatacacattatagactaataaattgtaatacctcaaccattacacaggcttgtccacgtacttgggagtcggccat

SEQ ID NO: 401486 - DNA, 140 bp, Artificial Sequence
  Synthetic
atggccgactcccaagtacgtggacaagcctgtgtaatggttgaggtattacaatttattagtctataatgtgtatcattaccttcattaaatggtactacatcaagtccataaaaaagtggagacccagcatggcgtat

SEQ ID NO: 401487 - DNA, 140 bp, Artificial Sequence
  Synthetic
aggccctggctgctgatatggcctagtgttgcgaaactgacagaggatagatggaacaagccccagaagaccaagggccacagagggagccatacaatgaatggacactagagcttttaggaccttttgggacagcggtg

SEQ ID NO: 401488 - DNA, 140 bp, Artificial Sequence
  Synthetic
caccgctgtcccaaaaggtcctaaaagctctagtgtccattcattgtatggctccctctgtggcccttggtcttctggggcttgttccatctatcctctgtcagtttcgcaacactaggccatatcagcagccagggcct

SEQ ID NO: 401489 - DNA, 140 bp, Artificial Sequence
  Synthetic
aggccctggctgctgatatgacatggtagaacagatgcatgaagatataatcagtttatgggatcaaagcctaaagccatgtgtaaagttaactcctctctgtgttactttaaattgtacgaccttttgggacagcggtg

SEQ ID NO: 401490 - DNA, 140 bp, Artificial Sequence
  Synthetic
caccgctgtcccaaaaggtcgtacaatttaaagtaacacagagaggagttaactttacacatggctttaggctttgatcccataaactgattatatcttcatgcatctgttctaccatgtcatatcagcagccagggcct

SEQ ID NO: 401491 - DNA, 140 bp, Artificial Sequence
  Synthetic
aggccctggctgctgatatgaagaataagacagggctttgaagcagctttgcaataaaatggggggcaagtggtcaaaaagcagtatagttggatggcctgaggtaagagaaagaataaggaccttttgggacagcggtg

SEQ ID NO: 401492 - DNA, 140 bp, Artificial Sequence
  Synthetic
caccgctgtcccaaaaggtccttattctttctcttacctcaggccatccaactatactgctttttgaccacttgccccccattttattgcaaagctgcttcaaagccctgtcttattcttcatatcagcagccagggcct

SEQ ID NO: 401493 - DNA, 140 bp, Artificial Sequence
  Synthetic
atacgccatgctgggtctccatacgtataggaccaggacaagcactctatacaaataaaataattggggatataagaaaagcacattgtaatatcagtagatcagactggaataaaacttcgtacttgggagtcggccat

SEQ ID NO: 401494 - DNA, 140 bp, Artificial Sequence
  Synthetic
atggccgactcccaagtacgaagttttattccagtctgatctactgatattacaatgtgcttttcttatatccccaattattttatttgtatagagtgcttgtcctggtcctatacgtatggagacccagcatggcgtat

SEQ ID NO: 401495 - DNA, 140 bp, Artificial Sequence
  Synthetic
aggccctggctgctgatatggactagcggaggctagaaggagagagatgggtgcgagagcgtcagtattaagcgggggaaaattagatgcatgggaaaaaattcggttaaggccaggggggaccttttgggacagcggtg

SEQ ID NO: 401496 - DNA, 140 bp, Artificial Sequence
  Synthetic
caccgctgtcccaaaaggtcccccctggccttaaccgaattttttcccatgcatctaattttcccccgcttaatactgacgctctcgcacccatctctctccttctagcctccgctagtccatatcagcagccagggcct

SEQ ID NO: 401497 - DNA, 140 bp, Artificial Sequence
  Synthetic
aggccctggctgctgatatgaagcttgtccaaaggtatcctttgagccaattcccatacattattgtaccccggctggttttgcgattctaaagtgtaacaataaaaagttcaatggaacgaccttttgggacagcggtg

SEQ ID NO: 401498 - DNA, 140 bp, Artificial Sequence
  Synthetic
caccgctgtcccaaaaggtcgttccattgaactttttattgttacactttagaatcgcaaaaccagccggggtacaataatgtatgggaattggctcaaaggatacctttggacaagcttcatatcagcagccagggcct

SEQ ID NO: 401499 - DNA, 140 bp, Artificial Sequence
  Synthetic
atacgccatgctgggtctcccttctccaccaaagcagtaagtagtagatgtaatgcaacctttagtaatagtgtcaatagtagcattagtagtagtaacaataatagcaataattgtgtgcgtacttgggagtcggccat

SEQ ID NO: 401500 - DNA, 140 bp, Artificial Sequence
  Synthetic
atggccgactcccaagtacgcacacaattattgctattattgttactactactaatgctactattgacactattactaaaggttgcattacatctactacttactgctttggtggagaagggagacccagcatggcgtat

SEQ ID NO: 401501 - DNA, 140 bp, Artificial Sequence
  Synthetic
atacgccatgctgggtctccgaggatataactatcccatgcagaataaaacaaattataaacatgtggcagagagtaggacaagcaatgtatgcccctcccattgcaggagtaataaaatcgtacttgggagtcggccat

SEQ ID NO: 401502 - DNA, 140 bp, Artificial Sequence
  Synthetic
atggccgactcccaagtacgattttattactcctgcaatgggaggggcatacattgcttgtcctactctctgccacatgtttataatttgttttattctgcatgggatagttatatcctcggagacccagcatggcgtat

SEQ ID NO: 401503 - DNA, 140 bp, Artificial Sequence
  Synthetic
atacgccatgctgggtctcctgagactgggacgggagggtctcaatcatctgtggaatctcctgttatactggggcggggagataaagagtagtgctattagtttgcttgataccacagccgtacttgggagtcggccat

SEQ ID NO: 401504 - DNA, 140 bp, Artificial Sequence
  Synthetic
atggccgactcccaagtacggctgtggtatcaagcaaactaatagcactactctttatctccccgccccagtataacaggagattccacagatgattgagaccctcccgtcccagtctcaggagacccagcatggcgtat

SEQ ID NO: 401505 - DNA, 140 bp, Artificial Sequence
  Synthetic
aggccctggctgctgatatgccactaatgtgccttggaactccagttggagtaataaatctcaaacagatatttggaataacatgacctggatgcagtgggataaagaaattagtaattagaccttttgggacagcggtg

SEQ ID NO: 401506 - DNA, 140 bp, Artificial Sequence
  Synthetic
caccgctgtcccaaaaggtctaattactaatttctttatcccactgcatccaggtcatgttattccaaatatctgtttgagatttattactccaactggagttccaaggcacattagtggcatatcagcagccagggcct

SEQ ID NO: 401507 - DNA, 140 bp, Artificial Sequence
  Synthetic
aggccctggctgctgatatgagtggtgcagagagaaaaaagagcagtaggaacaataggagctatgttccttgggttcttgggagcagcaggaagcactatgggcgcagcgtcaataacggaccttttgggacagcggtg

SEQ ID NO: 401508 - DNA, 140 bp, Artificial Sequence
  Synthetic
caccgctgtcccaaaaggtccgttattgacgctgcgcccatagtgcttcctgctgctcccaagaacccaaggaacatagctcctattgttcctactgctcttttttctctctgcaccactcatatcagcagccagggcct

SEQ ID NO: 401509 - DNA, 140 bp, Artificial Sequence
  Synthetic
aggccctggctgctgatatgtggtttgacatatcaaattggctgtggtatataagaatattcatcatgatagtaggaggcttgataggtttgagaataatttttggtgtactctctataggaccttttgggacagcggtg

SEQ ID NO: 401510 - DNA, 140 bp, Artificial Sequence
  Synthetic
caccgctgtcccaaaaggtcctatagagagtacaccaaaaattattctcaaacctatcaagcctcctactatcatgatgaatattcttatataccacagccaatttgatatgtcaaaccacatatcagcagccagggcct

SEQ ID NO: 401511 - DNA, 140 bp, Artificial Sequence
  Synthetic
atacgccatgctgggtctccagaggaagtacaaaagaagagccagcaaaagacacagcaggcagcagctggcacaggaagcagcagcaaagtcagccaaaattaccctatagtgcaaaatcgtacttgggagtcggccat

SEQ ID NO: 401512 - DNA, 140 bp, Artificial Sequence
  Synthetic
atggccgactcccaagtacgattttgcactatagggtaattttggctgactttgctgctgcttcctgtgccagctgctgcctgctgtgtcttttgctggctcttcttttgtacttcctctggagacccagcatggcgtat

SEQ ID NO: 401513 - DNA, 140 bp, Artificial Sequence
  Synthetic
aggccctggctgctgatatgagtggcaatgagagtgatggagaccaggaagaattggcagcactggtggtggaaagggggcatcatgctccttgggatgttaatgatctgtaatgctgaagaccttttgggacagcggtg

SEQ ID NO: 401514 - DNA, 140 bp, Artificial Sequence
  Synthetic
caccgctgtcccaaaaggtcttcagcattacagatcattaacatcccaaggagcatgatgccccctttccaccaccagtgctgccaattcttcctggtctccatcactctcattgccactcatatcagcagccagggcct

SEQ ID NO: 401515 - DNA, 140 bp, Artificial Sequence
  Synthetic
  misc_feature (46)..(46): n is a, c, g, or t
atacgccatgctgggtctccgggcaagtggtcaaaacgtaaggttnactggcctcaggtaagggaaagaatggaaagaactgagccagcagcagaaggggtgggagcagtatccagagaccgtacttgggagtcggccat

SEQ ID NO: 401516 - DNA, 140 bp, Artificial Sequence
  Synthetic
  misc_feature (95)..(95): n is a, c, g, or t
atggccgactcccaagtacggtctctggatactgctcccaccccttctgctgctggctcagttctttccattctttcccttacctgaggccagtnaaccttacgttttgaccacttgcccggagacccagcatggcgtat

SEQ ID NO: 401517 - DNA, 140 bp, Artificial Sequence
  Synthetic
atacgccatgctgggtctccaactactattaccccactaatgatggagaagggagaaataaaaaattgctctttcaaaatcaccacaaacatgagagataaggtgcagaaagaatttgcacgtacttgggagtcggccat

SEQ ID NO: 401518 - DNA, 140 bp, Artificial Sequence
  Synthetic
atggccgactcccaagtacgtgcaaattctttctgcaccttatctctcatgtttgtggtgattttgaaagagcaattttttatttctcccttctccatcattagtggggtaatagtagttggagacccagcatggcgtat

SEQ ID NO: 401519 - DNA, 140 bp, Artificial Sequence
  Synthetic
aggccctggctgctgatatgggacaaggagctacactagaagaaatgatgacagcatgccagggagtgggaggacctagccataaagcaagggttttggctgaggcaatgagccaagcacgaccttttgggacagcggtg

SEQ ID NO: 401520 - DNA, 140 bp, Artificial Sequence
  Synthetic
caccgctgtcccaaaaggtcgtgcttggctcattgcctcagccaaaacccttgctttatggctaggtcctcccactccctggcatgctgtcatcatttcttctagtgtagctccttgtcccatatcagcagccagggcct

SEQ ID NO: 401521 - DNA, 140 bp, Artificial Sequence
  Synthetic
aggccctggctgctgatatgagaagtgaattatataaatataaagtagtaaaaattgaaccattaggaatagcacccaccaaggcaaagagaagagtggtgcagagagaaaaaagagcaggaccttttgggacagcggtg

SEQ ID NO: 401522 - DNA, 140 bp, Artificial Sequence
  Synthetic
caccgctgtcccaaaaggtcctgctcttttttctctctgcaccactcttctctttgccttggtgggtgctattcctaatggttcaatttttactactttatatttatataattcacttctcatatcagcagccagggcct

SEQ ID NO: 401523 - DNA, 140 bp, Artificial Sequence
  Synthetic
aggccctggctgctgatatgggaagttcaattaggaataccacatccagcaggtttaaaaaagaaaaaatcagtaacagtactagatgtgggagatgcatatttttcagttcctttagatgaccttttgggacagcggtg

SEQ ID NO: 401524 - DNA, 140 bp, Artificial Sequence
  Synthetic
caccgctgtcccaaaaggtcatctaaaggaactgaaaaatatgcatctcccacatctagtactgttactgattttttcttttttaaacctgctggatgtggtattcctaattgaacttcccatatcagcagccagggcct

SEQ ID NO: 401525 - DNA, 140 bp, Artificial Sequence
  Synthetic
atacgccatgctgggtctccggaacaagccccagaagaccaggggccgcagagggaaccatacaatgaatggacactagagattctagaggaactcaagcaggaagctgtcagacactttcgtacttgggagtcggccat

SEQ ID NO: 401526 - DNA, 140 bp, Artificial Sequence
  Synthetic
atggccgactcccaagtacgaaagtgtctgacagcttcctgcttgagttcctctagaatctctagtgtccattcattgtatggttccctctgcggcccctggtcttctggggcttgttccggagacccagcatggcgtat

SEQ ID NO: 401527 - DNA, 140 bp, Artificial Sequence
  Synthetic
aggccctggctgctgatatgtactaatgtgactaatgtaatcaacagtagcaaggtaggtgacacaggcctaaaaaactgctctttctatacaaccacagaaataagagataagaaaaaggaccttttgggacagcggtg

SEQ ID NO: 401528 - DNA, 140 bp, Artificial Sequence
  Synthetic
caccgctgtcccaaaaggtcctttttcttatctcttatttctgtggttgtatagaaagagcagttttttaggcctgtgtcacctaccttgctactgttgattacattagtcacattagtacatatcagcagccagggcct

SEQ ID NO: 401529 - DNA, 140 bp, Artificial Sequence
  Synthetic
aggccctggctgctgatatgtggaacaggaccatgtggaaatgtcagtacagtacaatgtacacatggaattaaaccagtgatatcaactcaattgctgctaaatggcagtttagcagaagaccttttgggacagcggtg

SEQ ID NO: 401530 - DNA, 140 bp, Artificial Sequence
  Synthetic
caccgctgtcccaaaaggtcttctgctaaactgccatttagcagcaattgagttgatatcactggtttaattccatgtgtacattgtactgtactgacatttccacatggtcctgttccacatatcagcagccagggcct

SEQ ID NO: 401531 - DNA, 140 bp, Artificial Sequence
  Synthetic
atacgccatgctgggtctccgatgatggaagaaggagaaataaaaaactgcaccttcaatgtcaccaccaacataaaagaaaagaagaaagaatatgcactcttttataaacttgatgtacgtacttgggagtcggccat

SEQ ID NO: 401532 - DNA, 140 bp, Artificial Sequence
  Synthetic
atggccgactcccaagtacgtacatcaagtttataaaagagtgcatattctttcttcttttcttttatgttggtggtgacattgaaggtgcagttttttatttctccttcttccatcatcggagacccagcatggcgtat

SEQ ID NO: 401533 - DNA, 140 bp, Artificial Sequence
  Synthetic
atacgccatgctgggtctccatcagaatggactgagatgatacaaaatgtaactaacaaactaaatgaaacttttaaaaaggatataatctttaacacatcctcagggggggacgtagaacgtacttgggagtcggccat

SEQ ID NO: 401534 - DNA, 140 bp, Artificial Sequence
  Synthetic
atggccgactcccaagtacgttctacgtccccccctgaggatgtgttaaagattatatcctttttaaaagtttcatttagtttgttagttacattttgtatcatctcagtccattctgatggagacccagcatggcgtat

SEQ ID NO: 401535 - DNA, 140 bp, Artificial Sequence
  Synthetic
aggccctggctgctgatatgcttttaaaaaggatataatctttaacacatcctcagggggggacgtagaaattacaacacatagttttaattgtagaggagaattcttctattgtaatacgaccttttgggacagcggtg

SEQ ID NO: 401536 - DNA, 140 bp, Artificial Sequence
  Synthetic
caccgctgtcccaaaaggtcgtattacaatagaagaattctcctctacaattaaaactatgtgttgtaatttctacgtccccccctgaggatgtgttaaagattatatcctttttaaaagcatatcagcagccagggcct

SEQ ID NO: 401537 - DNA, 140 bp, Artificial Sequence
  Synthetic
atacgccatgctgggtctcctaccagtaacagggatgaaatgaaaaattgctctttcaacacaaccacagaactaagagataagcagaaacaccagtatgcacttttttataaacttgatcgtacttgggagtcggccat

SEQ ID NO: 401538 - DNA, 140 bp, Artificial Sequence
  Synthetic
atggccgactcccaagtacgatcaagtttataaaaaagtgcatactggtgtttctgcttatctcttagttctgtggttgtgttgaaagagcaatttttcatttcatccctgttactggtaggagacccagcatggcgtat

SEQ ID NO: 401539 - DNA, 140 bp, Artificial Sequence
  Synthetic
aggccctggctgctgatatgaataaattgtaatacctcaaccataacacaagcctgtccaaaggtctcttttgatccaattcctatacattattgtgctccagctggttatgcgattctagaccttttgggacagcggtg

SEQ ID NO: 401540 - DNA, 140 bp, Artificial Sequence
  Synthetic
caccgctgtcccaaaaggtctagaatcgcataaccagctggagcacaataatgtataggaattggatcaaaagagacctttggacaggcttgtgttatggttgaggtattacaatttattcatatcagcagccagggcct

SEQ ID NO: 401541 - DNA, 140 bp, Artificial Sequence
  Synthetic
aggccctggctgctgatatggaggaggggacccagaaattgtaatgcatacttttaattgtggaggggaatttttctactgtaatacatcatcactgtttaattggagtactaatgggtcgaccttttgggacagcggtg

SEQ ID NO: 401542 - DNA, 140 bp, Artificial Sequence
  Synthetic
caccgctgtcccaaaaggtcgacccattagtactccaattaaacagtgatgatgtattacagtagaaaaattcccctccacaattaaaagtatgcattacaatttctgggtcccctcctccatatcagcagccagggcct

SEQ ID NO: 401543 - DNA, 140 bp, Artificial Sequence
  Synthetic
atacgccatgctgggtctccagcagtaagtatacttaattaagttctgtaatggtatctctacaaatagtaagcatagcagcattaatagtagcatttattatagcagtagttgtgtggacgtacttgggagtcggccat

SEQ ID NO: 401544 - DNA, 140 bp, Artificial Sequence
  Synthetic
atggccgactcccaagtacgtccacacaactactgctataataaatgctactattaatgctgctatgcttactatttgtagagataccattacagaacttaattaagtatacttactgctggagacccagcatggcgtat

SEQ ID NO: 401545 - DNA, 140 bp, Artificial Sequence
  Synthetic
aggccctggctgctgatatgaaaggcttaggcatctcctatggcaggaagaagcggagacccagacgaggagctcctcaaagcagtaaggatcatcaacatcctatacaaaagcagtaaggaccttttgggacagcggtg

SEQ ID NO: 401546 - DNA, 140 bp, Artificial Sequence
  Synthetic
caccgctgtcccaaaaggtccttactgcttttgtataggatgttgatgatccttactgctttgaggagctcctcgtctgggtctccgcttcttcctgccataggagatgcctaagcctttcatatcagcagccagggcct

SEQ ID NO: 401547 - DNA, 140 bp, Artificial Sequence
  Synthetic
aggccctggctgctgatatgagctcctcaaagcagtaaggatcatcaacatcctatacaaaagcagtaagtatatgtaatggttgatttactagcaaaagtagattataaattaggagtagaccttttgggacagcggtg

SEQ ID NO: 401548 - DNA, 140 bp, Artificial Sequence
  Synthetic
caccgctgtcccaaaaggtctactcctaatttataatctacttttgctagtaaatcaaccattacatatacttactgcttttgtataggatgttgatgatccttactgctttgaggagctcatatcagcagccagggcct

SEQ ID NO: 401549 - DNA, 140 bp, Artificial Sequence
  Synthetic
aggccctggctgctgatatgcaggaagcactatgggcgcagcgtcagtgacgctgacggtacaggccagacaattattgtctggtatagtgcaacagcagaacaatctgctgagggctatgaccttttgggacagcggtg

SEQ ID NO: 401550 - DNA, 140 bp, Artificial Sequence
  Synthetic
caccgctgtcccaaaaggtcatagccctcagcagattgttctgctgttgcactataccagacaataattgtctggcctgtaccgtcagcgtcactgacgctgcgcccatagtgcttcctgcatatcagcagccagggcct

SEQ ID NO: 401551 - DNA, 140 bp, Artificial Sequence
  Synthetic
aggccctggctgctgatatgggcttttctcaacgtacctagaagaataagacaaggcttggaaagagctctgctataacatggggggcaagtggtcaaaatggaatgggtggactgaaatgaccttttgggacagcggtg

SEQ ID NO: 401552 - DNA, 140 bp, Artificial Sequence
  Synthetic
caccgctgtcccaaaaggtcatttcagtccacccattccattttgaccacttgccccccatgttatagcagagctctttccaagccttgtcttattcttctaggtacgttgagaaaagcccatatcagcagccagggcct

SEQ ID NO: 401553 - DNA, 140 bp, Artificial Sequence
  Synthetic
aggccctggctgctgatatgttaaaagaattagagaaagagcagaagacagtggcaatgagagtgagggggatatcgaggaattggccacaatggtggatatggggcatcttaggcttttgaccttttgggacagcggtg

SEQ ID NO: 401554 - DNA, 140 bp, Artificial Sequence
  Synthetic
caccgctgtcccaaaaggtcaaaagcctaagatgccccatatccaccattgtggccaattcctcgatatccccctcactctcattgccactgtcttctgctctttctctaattcttttaacatatcagcagccagggcct

SEQ ID NO: 401555 - DNA, 140 bp, Artificial Sequence
  Synthetic
aggccctggctgctgatatgagttaacccctctctgtgttactttaaattgcaccaacgccaatgccactgtcactgacactgacatgcaaggagaaataaaaaactgttcttacaatgtgaccttttgggacagcggtg

SEQ ID NO: 401556 - DNA, 140 bp, Artificial Sequence
  Synthetic
caccgctgtcccaaaaggtcacattgtaagaacagttttttatttctccttgcatgtcagtgtcagtgacagtggcattggcgttggtgcaatttaaagtaacacagagaggggttaactcatatcagcagccagggcct

SEQ ID NO: 401557 - DNA, 140 bp, Artificial Sequence
  Synthetic
atacgccatgctgggtctccgcatggatggagaaataaaaaattgctctttcaatgcaaccacagaaataagagataagaaacggaaagtgcaggcacttttttataaacttgatgtagtcgtacttgggagtcggccat

SEQ ID NO: 401558 - DNA, 140 bp, Artificial Sequence
  Synthetic
atggccgactcccaagtacgactacatcaagtttataaaaaagtgcctgcactttccgtttcttatctcttatttctgtggttgcattgaaagagcaattttttatttctccatccatgcggagacccagcatggcgtat

SEQ ID NO: 401559 - DNA, 140 bp, Artificial Sequence
  Synthetic
atacgccatgctgggtctccattaattgtaccagacccaacaacaatacaaggagaagtgtgcgtataggaccaggacaagcattctatacaagtgacataattggggatataagggaagcgtacttgggagtcggccat

SEQ ID NO: 401560 - DNA, 140 bp, Artificial Sequence
  Synthetic
atggccgactcccaagtacgcttcccttatatccccaattatgtcacttgtatagaatgcttgtcctggtcctatacgcacacttctccttgtattgttgttgggtctggtacaattaatggagacccagcatggcgtat

SEQ ID NO: 401561 - DNA, 140 bp, Artificial Sequence
  Synthetic
aggccctggctgctgatatgaccaggacaagcattctatacaagtgacataattggggatataagggaagcacattgtaatatcaatggatcagaatggaatgcaactttactagaggtagaccttttgggacagcggtg

SEQ ID NO: 401562 - DNA, 140 bp, Artificial Sequence
  Synthetic
caccgctgtcccaaaaggtctacctctagtaaagttgcattccattctgatccattgatattacaatgtgcttcccttatatccccaattatgtcacttgtatagaatgcttgtcctggtcatatcagcagccagggcct

SEQ ID NO: 401563 - DNA, 140 bp, Artificial Sequence
  Synthetic
atacgccatgctgggtctccatcctcaggaggagacctagaaattacaacgcatagttttaattgtgcaggagagtttttctactgcaatacatcaagactgtttaatagcacatttgatcgtacttgggagtcggccat

SEQ ID NO: 401564 - DNA, 140 bp, Artificial Sequence
  Synthetic
atggccgactcccaagtacgatcaaatgtgctattaaacagtcttgatgtattgcagtagaaaaactctcctgcacaattaaaactatgcgttgtaatttctaggtctcctcctgaggatggagacccagcatggcgtat

SEQ ID NO: 401565 - DNA, 140 bp, Artificial Sequence
  Synthetic
atacgccatgctgggtctccaaatgacactatatatattccatgcagaataaaacagattataaacatgtggcaaagagtgggacaagcaatgtatgcccctcccattgcaggagtaatacgtacttgggagtcggccat

SEQ ID NO: 401566 - DNA, 140 bp, Artificial Sequence
  Synthetic
atggccgactcccaagtacgtattactcctgcaatgggaggggcatacattgcttgtcccactctttgccacatgtttataatctgttttattctgcatggaatatatatagtgtcatttggagacccagcatggcgtat

SEQ ID NO: 401567 - DNA, 140 bp, Artificial Sequence
  Synthetic
atacgccatgctgggtctcccaatcaccctcaggaggggatctagaagttacaacacatcactttaattgtagaggagaatttttctattgcaatacaacaaatctgttcaatgaactggcgtacttgggagtcggccat

SEQ ID NO: 401568 - DNA, 140 bp, Artificial Sequence
  Synthetic
atggccgactcccaagtacgccagttcattgaacagatttgttgtattgcaatagaaaaattctcctctacaattaaagtgatgtgttgtaacttctagatcccctcctgagggtgattgggagacccagcatggcgtat

SEQ ID NO: 401569 - DNA, 140 bp, Artificial Sequence
  Synthetic
atacgccatgctgggtctccataaacatgtggcaacaagtgggacgagcaatgtatgcccctcccattgaaggaaaaattacatgtaactcaaatatcacaggaattctattgacaagggcgtacttgggagtcggccat

SEQ ID NO: 401570 - DNA, 140 bp, Artificial Sequence
  Synthetic
atggccgactcccaagtacgcccttgtcaatagaattcctgtgatatttgagttacatgtaatttttccttcaatgggaggggcatacattgctcgtcccacttgttgccacatgtttatggagacccagcatggcgtat

SEQ ID NO: 401571 - DNA, 140 bp, Artificial Sequence
  Synthetic
aggccctggctgctgatatggaactctagttggagtaataaatcctatgatgacatttggggaaacatgacctggttgcagtgggatagagaaattagcaattacacaaacacaatatacgaccttttgggacagcggtg

SEQ ID NO: 401572 - DNA, 140 bp, Artificial Sequence
  Synthetic
caccgctgtcccaaaaggtcgtatattgtgtttgtgtaattgctaatttctctatcccactgcaaccaggtcatgtttccccaaatgtcatcataggatttattactccaactagagttccatatcagcagccagggcct

SEQ ID NO: 401573 - DNA, 140 bp, Artificial Sequence
  Synthetic
aggccctggctgctgatatgagatcgattcgattagtgagcggattcttagcacttgcctgggacgacctgaggagcctgtgcctcttcagctaccaccgcttgagagacttcatcttgagaccttttgggacagcggtg

SEQ ID NO: 401574 - DNA, 140 bp, Artificial Sequence
  Synthetic
caccgctgtcccaaaaggtctcaagatgaagtctctcaagcggtggtagctgaagaggcacaggctcctcaggtcgtcccaggcaagtgctaagaatccgctcactaatcgaatcgatctcatatcagcagccagggcct

SEQ ID NO: 401575 - DNA, 140 bp, Artificial Sequence
  Synthetic
aggccctggctgctgatatgagttgtgtggaccatagtatatatagaatataggaaattgataaaacaaagaaaaatagactggttaattaaaagaattagggaaagagcagaagacagtgaccttttgggacagcggtg

SEQ ID NO: 401576 - DNA, 140 bp, Artificial Sequence
  Synthetic
caccgctgtcccaaaaggtcactgtcttctgctctttccctaattcttttaattaaccagtctatttttctttgttttatcaatttcctatattctatatatactatggtccacacaactcatatcagcagccagggcct

SEQ ID NO: 401577 - DNA, 140 bp, Artificial Sequence
  Synthetic
aggccctggctgctgatatgaaaatatttataatgatagtaggaggtttaataggtttaagaataatttttgctgtgctttctatagtaaatagagttaggcagggatactcacctttgtgaccttttgggacagcggtg

SEQ ID NO: 401578 - DNA, 140 bp, Artificial Sequence
  Synthetic
caccgctgtcccaaaaggtcacaaaggtgagtatccctgcctaactctatttactatagaaagcacagcaaaaattattcttaaacctattaaacctcctactatcattataaatattttcatatcagcagccagggcct

SEQ ID NO: 401579 - DNA, 140 bp, Artificial Sequence
  Synthetic
aggccctggctgctgatatgagctttgctataaaatggggggcaagtggtcaaaaagcagcatagttggatggcctgagataagagaaagaataagacgagctgagccagcagcagaggggaccttttgggacagcggtg

SEQ ID NO: 401580 - DNA, 140 bp, Artificial Sequence
  Synthetic
caccgctgtcccaaaaggtcccctctgctgctggctcagctcgtcttattctttctcttatctcaggccatccaactatgctgctttttgaccacttgccccccattttatagcaaagctcatatcagcagccagggcct

SEQ ID NO: 401581 - DNA, 140 bp, Artificial Sequence
  Synthetic
aggccctggctgctgatatgcccctcagaagcaggagccggtagacaaggaactgtatcctttagcttccctcagatcactctttggcaacgacccctcgtcacaataaagatagggggggaccttttgggacagcggtg

SEQ ID NO: 401582 - DNA, 140 bp, Artificial Sequence
  Synthetic
caccgctgtcccaaaaggtccccccctatctttattgtgacgaggggtcgttgccaaagagtgatctgagggaagctaaaggatacagttccttgtctaccggctcctgcttctgaggggcatatcagcagccagggcct

SEQ ID NO: 401583 - DNA, 140 bp, Artificial Sequence
  Synthetic
aggccctggctgctgatatggaggaagaagaagtaggctttccagtcagacctcaggtacctttaagaccaatgacttataagggagcattcgatctcagcttctttttaaaagaaaagggaccttttgggacagcggtg

SEQ ID NO: 401584 - DNA, 140 bp, Artificial Sequence
  Synthetic
caccgctgtcccaaaaggtcccttttcttttaaaaagaagctgagatcgaatgctcccttataagtcattggtcttaaaggtacctgaggtctgactggaaagcctacttcttcttcctccatatcagcagccagggcct

SEQ ID NO: 401585 - DNA, 140 bp, Artificial Sequence
  Synthetic
aggccctggctgctgatatggaagaagtaggctttccagtcagacctcaggtacctttaagaccaatgacttataagggagcattcgatctcagcttctttttaaaagaaaaggggggacgaccttttgggacagcggtg

SEQ ID NO: 401586 - DNA, 140 bp, Artificial Sequence
  Synthetic
caccgctgtcccaaaaggtcgtccccccttttcttttaaaaagaagctgagatcgaatgctcccttataagtcattggtcttaaaggtacctgaggtctgactggaaagcctacttcttccatatcagcagccagggcct

SEQ ID NO: 401587 - DNA, 140 bp, Artificial Sequence
  Synthetic
aggccctggctgctgatatgagggattactcctcaaaggagaagaaatggagccagtagatcctagattagagccctggaatcatccaggaagccaacccaaaacagcttgcaataattggaccttttgggacagcggtg

SEQ ID NO: 401588 - DNA, 140 bp, Artificial Sequence
  Synthetic
caccgctgtcccaaaaggtccaattattgcaagctgttttgggttggcttcctggatgattccagggctctaatctaggatctactggctccatttcttctcctttgaggagtaatccctcatatcagcagccagggcct

SEQ ID NO: 401589 - DNA, 140 bp, Artificial Sequence
  Synthetic
aggccctggctgctgatatggttaatagggactcgaaagcgaaagttccagagaagttctctcgacgcaggactcggcttgctgaggtgcacacggcaagaggcgagagcggcgactggtgaccttttgggacagcggtg

SEQ ID NO: 401590 - DNA, 140 bp, Artificial Sequence
  Synthetic
caccgctgtcccaaaaggtcaccagtcgccgctctcgcctcttgccgtgtgcacctcagcaagccgagtcctgcgtcgagagaacttctctggaactttcgctttcgagtccctattaaccatatcagcagccagggcct

SEQ ID NO: 401591 - DNA, 140 bp, Artificial Sequence
  Synthetic
aggccctggctgctgatatgggctgacgggaaggtcagtcaaaattatcctatagtgcagaatctccaagggcaaatggtacaccaggccatatcacctagaactttgaatgcatgggtagaccttttgggacagcggtg

SEQ ID NO: 401592 - DNA, 140 bp, Artificial Sequence
  Synthetic
caccgctgtcccaaaaggtctacccatgcattcaaagttctaggtgatatggcctggtgtaccatttgcccttggagattctgcactataggataattttgactgaccttcccgtcagcccatatcagcagccagggcct

SEQ ID NO: 401593 - DNA, 140 bp, Artificial Sequence
  Synthetic
aggccctggctgctgatatgggcatttgggtcatggggtctccatagaatggaggcagagaagatatagcacacaaatagatcctgacctagcagaccaactaattcatctgcactatttgaccttttgggacagcggtg

SEQ ID NO: 401594 - DNA, 140 bp, Artificial Sequence
  Synthetic
caccgctgtcccaaaaggtcaaatagtgcagatgaattagttggtctgctaggtcaggatctatttgtgtgctatatcttctctgcctccattctatggagaccccatgacccaaatgcccatatcagcagccagggcct

SEQ ID NO: 401595 - DNA, 140 bp, Artificial Sequence
  Synthetic
  misc_feature (99)..(99): n is a, c, g, or t
aggccctggctgctgatatgcaggatcagaagaaattaaatcattatttaatgcagtagcaaccctctggtgtgtacatcaaaggatagaggtaaaagncaccaaggaagctttggataagaccttttgggacagcggtg

SEQ ID NO: 401596 - DNA, 140 bp, Artificial Sequence
  Synthetic
  misc_feature (42)..(42): n is a, c, g, or t
caccgctgtcccaaaaggtcttatccaaagcttccttggtgncttttacctctatcctttgatgtacacaccagagggttgctactgcattaaataatgatttaatttcttctgatcctgcatatcagcagccagggcct

SEQ ID NO: 401597 - DNA, 140 bp, Artificial Sequence
  Synthetic
aggccctggctgctgatatgggactgttaatgacatacagaagttagtgggaaaattgaattgggcaagtcagatttatgcagggattaaggtaaagcaattatgtaaactccttagggggaccttttgggacagcggtg

SEQ ID NO: 401598 - DNA, 140 bp, Artificial Sequence
  Synthetic
caccgctgtcccaaaaggtccccctaaggagtttacataattgctttaccttaatccctgcataaatctgacttgcccaattcaattttcccactaacttctgtatgtcattaacagtcccatatcagcagccagggcct

SEQ ID NO: 401599 - DNA, 140 bp, Artificial Sequence
  Synthetic
aggccctggctgctgatatgaggagcagaaactttctatgtagatggggcagctaatagagaaactaaattaggaaaagcaggatatgttactgacagaggaagacaaaaggttgttcccgaccttttgggacagcggtg

SEQ ID NO: 401600 - DNA, 140 bp, Artificial Sequence
  Synthetic
caccgctgtcccaaaaggtcgggaacaaccttttgtcttcctctgtcagtaacatatcctgcttttcctaatttagtttctctattagctgccccatctacatagaaagtttctgctcctcatatcagcagccagggcct

SEQ ID NO: 401601 - DNA, 140 bp, Artificial Sequence
  Synthetic
aggccctggctgctgatatgataccactctattttgtgcatctgatgctaaagcatatagtactgaaagccataatgtctgggctacacatgcctgtgtacccacagaccccaacccacagaccttttgggacagcggtg

SEQ ID NO: 401602 - DNA, 140 bp, Artificial Sequence
  Synthetic
caccgctgtcccaaaaggtctgtgggttggggtctgtgggtacacaggcatgtgtagcccagacattatggctttcagtactatatgctttagcatcagatgcacaaaatagagtggtatcatatcagcagccagggcct

SEQ ID NO: 401603 - DNA, 140 bp, Artificial Sequence
  Synthetic
aggccctggctgctgatatgcataatgtctgggctacacatgcctgtgtacccacagaccccaacccacaagagatacctctgaaaaatgtaacagaaaattttaacatgtggaaaaatagaccttttgggacagcggtg

SEQ ID NO: 401604 - DNA, 140 bp, Artificial Sequence
  Synthetic
caccgctgtcccaaaaggtctatttttccacatgttaaaattttctgttacatttttcagaggtatctcttgtgggttggggtctgtgggtacacaggcatgtgtagcccagacattatgcatatcagcagccagggcct

SEQ ID NO: 401605 - DNA, 140 bp, Artificial Sequence
  Synthetic
atacgccatgctgggtctccaacagtaatcaaaccaaaaattgcactgaagaaagcaacagcactgtgataaactgtaaagaaataaaaaactgctctttcaatataaccacagagctaccgtacttgggagtcggccat

SEQ ID NO: 401606 - DNA, 140 bp, Artificial Sequence
  Synthetic
atggccgactcccaagtacggtagctctgtggttatattgaaagagcagttttttatttctttacagtttatcacagtgctgttgctttcttcagtgcaatttttggtttgattactgttggagacccagcatggcgtat

SEQ ID NO: 401607 - DNA, 140 bp, Artificial Sequence
  Synthetic
aggccctggctgctgatatgcccattaggggaagcaagattaataataaaaacatattggggtttgcaaacaggagaaagggattggcatttgggtcatggatgctccatagaatggagagaccttttgggacagcggtg

SEQ ID NO: 401608 - DNA, 140 bp, Artificial Sequence
  Synthetic
caccgctgtcccaaaaggtctctccattctatggagcatccatgacccaaatgccaatccctttctcctgtttgcaaaccccaatatgtttttattattaatcttgcttcccctaatgggcatatcagcagccagggcct

SEQ ID NO: 401609 - DNA, 140 bp, Artificial Sequence
  Synthetic
atacgccatgctgggtctcccaaaaacataatagtgcagcttaaggaagctatagacattatatgtaccagacccaacaacaatacaagaaaaagtataagcttaggaccaggacaagcgcgtacttgggagtcggccat

SEQ ID NO: 401610 - DNA, 140 bp, Artificial Sequence
  Synthetic
atggccgactcccaagtacgcgcttgtcctggtcctaagcttatactttttcttgtattgttgttgggtctggtacatataatgtctatagcttccttaagctgcactattatgtttttgggagacccagcatggcgtat

SEQ ID NO: 401611 - DNA, 140 bp, Artificial Sequence
  Synthetic
  misc_feature (27)..(27): n is a, c, g, or t
  misc_feature (102)..(102): n is a, c, g, or t
atacgccatgctgggtctccttctacncaacaggtgctataataggagatataagacaagcacattgtaatattagtagaaaaaaatgggataatatgatangtaatgtgtctgaaaaaccgtacttgggagtcggccat

SEQ ID NO: 401612 - DNA, 140 bp, Artificial Sequence
  Synthetic
  misc_feature (39)..(39): n is a, c, g, or t
  misc_feature (114)..(114): n is a, c, g, or t
atggccgactcccaagtacggtttttcagacacattacntatcatattatcccatttttttctactaatattacaatgtgcttgtcttatatctcctattatagcacctgttgngtagaaggagacccagcatggcgtat

SEQ ID NO: 401613 - DNA, 140 bp, Artificial Sequence
  Synthetic
aggccctggctgctgatatggcaaccctctattgtgtgcatcaaaagatagatgtaaaagacaccaaggaagctttagagaaggtagaggaagagcaaaacaaaagtaagaaaaaagcacgaccttttgggacagcggtg

SEQ ID NO: 401614 - DNA, 140 bp, Artificial Sequence
  Synthetic
caccgctgtcccaaaaggtcgtgcttttttcttacttttgttttgctcttcctctaccttctctaaagcttccttggtgtcttttacatctatcttttgatgcacacaatagagggttgccatatcagcagccagggcct

SEQ ID NO: 401615 - DNA, 140 bp, Artificial Sequence
  Synthetic
atacgccatgctgggtctccgagaggagaaataaaaaactgctctttcaatatcaccactagcataagagataaggtgcagaaagaatatgcactttttttttataaacttgatgtagtacgtacttgggagtcggccat

SEQ ID NO: 401616 - DNA, 140 bp, Artificial Sequence
  Synthetic
atggccgactcccaagtacgtactacatcaagtttataaaaaaaaagtgcatattctttctgcaccttatctcttatgctagtggtgatattgaaagagcagttttttatttctcctctcggagacccagcatggcgtat

SEQ ID NO: 401617 - DNA, 140 bp, Artificial Sequence
  Synthetic
aggccctggctgctgatatgtagtatcaatagtagcattagtagtagtagcaataatagcaataattgtgtggaccatagtattcatagaatataggaaaatattaagagaaaggaaaatgaccttttgggacagcggtg

SEQ ID NO: 401618 - DNA, 140 bp, Artificial Sequence
  Synthetic
caccgctgtcccaaaaggtcattttcctttctcttaatattttcctatattctatgaatactatggtccacacaattattgctattattgctactactactaatgctactattgatactacatatcagcagccagggcct

SEQ ID NO: 401619 - DNA, 140 bp, Artificial Sequence
  Synthetic
atacgccatgctgggtctccatcagaagactgaattgcaagcaatttgtatagctttacaagattcaggaccagaagtaaacatagtaacagattcacaatatgcattagggatcattcacgtacttgggagtcggccat

SEQ ID NO: 401620 - DNA, 140 bp, Artificial Sequence
  Synthetic
atggccgactcccaagtacgtgaatgatccctaatgcatattgtgaatctgttactatgtttacttctggtcctgaatcttgtaaagctatacaaattgcttgcaattcagtcttctgatggagacccagcatggcgtat

SEQ ID NO: 401621 - DNA, 140 bp, Artificial Sequence
  Synthetic
aggccctggctgctgatatgggggctataataggggacataaggaaagcacattgtaatatcagtggatggaaaaacacgttagaacaggtagctatgcaattaagaaaacagtttaacagaccttttgggacagcggtg

SEQ ID NO: 401622 - DNA, 140 bp, Artificial Sequence
  Synthetic
caccgctgtcccaaaaggtctgttaaactgttttcttaattgcatagctacctgttctaacgtgtttttccatccactgatattacaatgtgctttccttatgtcccctattatagcccccatatcagcagccagggcct

SEQ ID NO: 401623 - DNA, 140 bp, Artificial Sequence
  Synthetic
atacgccatgctgggtctccggggaagaggtgatggaaaaaggagaaataaaaaactgcactttcaatatcaccaccaacataagaggaaagcataaagactatgcactcttttatagaacgtacttgggagtcggccat

SEQ ID NO: 401624 - DNA, 140 bp, Artificial Sequence
  Synthetic
atggccgactcccaagtacgttctataaaagagtgcatagtctttatgctttcctcttatgttggtggtgatattgaaagtgcagttttttatttctcctttttccatcacctcttccccggagacccagcatggcgtat

SEQ ID NO: 401625 - DNA, 140 bp, Artificial Sequence
  Synthetic
atacgccatgctgggtctcctagtgacatgaagtcagaagtaaaaaattgctctttcaatgcaaccacagaactaagagataagaaacagaaagtgcatgcacttttttataaacttgatcgtacttgggagtcggccat

SEQ ID NO: 401626 - DNA, 140 bp, Artificial Sequence
  Synthetic
atggccgactcccaagtacgatcaagtttataaaaaagtgcatgcactttctgtttcttatctcttagttctgtggttgcattgaaagagcaattttttacttctgacttcatgtcactaggagacccagcatggcgtat

SEQ ID NO: 401627 - DNA, 140 bp, Artificial Sequence
  Synthetic
aggccctggctgctgatatgttgcttgatacagtagcactagcagtggctaactggacagatagcgctatagaagtagggcaaagagttggtagggcttttttcaacatacctgtaagaagaccttttgggacagcggtg

SEQ ID NO: 401628 - DNA, 140 bp, Artificial Sequence
  Synthetic
caccgctgtcccaaaaggtcttcttacaggtatgttgaaaaaagccctaccaactctttgccctacttctatagcgctatctgtccagttagccactgctagtgctactgtatcaagcaacatatcagcagccagggcct

SEQ ID NO: 401629 - DNA, 140 bp, Artificial Sequence
  Synthetic
aggccctggctgctgatatgctccagcagcagtaggagtaggagcagtatctcaagatttagctaggcatggagcaattacaagcagcaatacagcagccaataatcctgattgtgcctggaccttttgggacagcggtg

SEQ ID NO: 401630 - DNA, 140 bp, Artificial Sequence
  Synthetic
caccgctgtcccaaaaggtccaggcacaatcaggattattggctgctgtattgctgcttgtaattgctccatgcctagctaaatcttgagatactgctcctactcctactgctgctggagcatatcagcagccagggcct

SEQ ID NO: 401631 - DNA, 140 bp, Artificial Sequence
  Synthetic
aggccctggctgctgatatgagagaccccatttggaaaggaccagccaaactactctggaaaggtgaaggggcagtagtaatacaagataatagtgacataaaggtagtaccaagaaggagaccttttgggacagcggtg

SEQ ID NO: 401632 - DNA, 140 bp, Artificial Sequence
  Synthetic
caccgctgtcccaaaaggtctccttcttggtactacctttatgtcactattatcttgtattactactgccccttcacctttccagagtagtttggctggtcctttccaaatggggtctctcatatcagcagccagggcct

SEQ ID NO: 401633 - DNA, 140 bp, Artificial Sequence
  Synthetic
atacgccatgctgggtctcctaggatttaagccacactcaggaggggacccagaaattacaacacatagctttaattgtggaggagaatttttctactgtaatacatcaaatctgtttaacgtacttgggagtcggccat

SEQ ID NO: 401634 - DNA, 140 bp, Artificial Sequence
  Synthetic
atggccgactcccaagtacgttaaacagatttgatgtattacagtagaaaaattctcctccacaattaaagctatgtgttgtaatttctgggtcccctcctgagtgtggcttaaatcctaggagacccagcatggcgtat

SEQ ID NO: 401635 - DNA, 140 bp, Artificial Sequence
  Synthetic
aggccctggctgctgatatgagacccaacaacaatacaagaaaaagtatacatatgggatgggggagagcattttatgcaacaggagaaataataggaaatataagacaagcacattgtagaccttttgggacagcggtg

SEQ ID NO: 401636 - DNA, 140 bp, Artificial Sequence
  Synthetic
caccgctgtcccaaaaggtctacaatgtgcttgtcttatatttcctattatttctcctgttgcataaaatgctctcccccatcccatatgtatactttttcttgtattgttgttgggtctcatatcagcagccagggcct

SEQ ID NO: 401637 - DNA, 140 bp, Artificial Sequence
  Synthetic
aggccctggctgctgatatgtagattaggagtaggagcactgataatagcgttgatcatagcaatagttgtgtggatcatagcatatatagaatataggaaattgttaagacaaaggaaagaccttttgggacagcggtg

SEQ ID NO: 401638 - DNA, 140 bp, Artificial Sequence
  Synthetic
caccgctgtcccaaaaggtctttcctttgtcttaacaatttcctatattctatatatgctatgatccacacaactattgctatgatcaacgctattatcagtgctcctactcctaatctacatatcagcagccagggcct

SEQ ID NO: 401639 - DNA, 140 bp, Artificial Sequence
  Synthetic
atacgccatgctgggtctccttagcattaggaataggagcattgatagtagcactaatcatagcaatagttgtgtggaccatagcatatatagaatataaaaaattgaaaaaacaagaaacgtacttgggagtcggccat

SEQ ID NO: 401640 - DNA, 140 bp, Artificial Sequence
  Synthetic
atggccgactcccaagtacgtttcttgttttttcaattttttatattctatatatgctatggtccacacaactattgctatgattagtgctactatcaatgctcctattcctaatgctaaggagacccagcatggcgtat

SEQ ID NO: 401641 - DNA, 140 bp, Artificial Sequence
  Synthetic
atacgccatgctgggtctcctgtgtaaagttgaccccactctgtgtcaccttacagtgtaacgatactcgcagtaatggtactgctgataaccaggaaagaatgaaaaattgctctttcacgtacttgggagtcggccat

SEQ ID NO: 401642 - DNA, 140 bp, Artificial Sequence
  Synthetic
atggccgactcccaagtacgtgaaagagcaatttttcattctttcctggttatcagcagtaccattactgcgagtatcgttacactgtaaggtgacacagagtggggtcaactttacacaggagacccagcatggcgtat

SEQ ID NO: 401643 - DNA, 140 bp, Artificial Sequence
  Synthetic
atacgccatgctgggtctccagcagatggagtaggagcagcatctagagacctagaaaaacatggagcattgacaactagcaatacagcagaaaataatgctgattgtgcctgggtagaacgtacttgggagtcggccat

SEQ ID NO: 401644 - DNA, 140 bp, Artificial Sequence
  Synthetic
atggccgactcccaagtacgttctacccaggcacaatcagcattattttctgctgtattgctagttgtcaatgctccatgtttttctaggtctctagatgctgctcctactccatctgctggagacccagcatggcgtat

SEQ ID NO: 401645 - DNA, 140 bp, Artificial Sequence
  Synthetic
atacgccatgctgggtctccctgctctttcaaaatcaccacaagcataaatactaaggtgaaagaccatgctcttttctataaaggtgatatagtatcaatgggtaggaagaatatgactcgtacttgggagtcggccat

SEQ ID NO: 401646 - DNA, 140 bp, Artificial Sequence
  Synthetic
atggccgactcccaagtacgagtcatattcttcctacccattgatactatatcacctttatagaaaagagcatggtctttcaccttagtatttatgcttgtggtgattttgaaagagcagggagacccagcatggcgtat

SEQ ID NO: 401647 - DNA, 140 bp, Artificial Sequence
  Synthetic
atacgccatgctgggtctccgtaataagtgtcattgtaaaaagtgttgctatcattgccaagtttgcttcataacgaaaggcttaggcatctcctatggcaggaagaagcggagacagcgcgtacttgggagtcggccat

SEQ ID NO: 401648 - DNA, 140 bp, Artificial Sequence
  Synthetic
atggccgactcccaagtacgcgctgtctccgcttcttcctgccataggagatgcctaagcctttcgttatgaagcaaacttggcaatgatagcaacactttttacaatgacacttattacggagacccagcatggcgtat

SEQ ID NO: 401649 - DNA, 140 bp, Artificial Sequence
  Synthetic
aggccctggctgctgatatgaaagaaaaagtcagtaacagtactggatgtgggggatgcatatttttcagttcccttagataaggagttcaggaagtacactgcattcaccatacctagtgaccttttgggacagcggtg

SEQ ID NO: 401650 - DNA, 140 bp, Artificial Sequence
  Synthetic
caccgctgtcccaaaaggtcactaggtatggtgaatgcagtgtacttcctgaactccttatctaagggaactgaaaaatatgcatcccccacatccagtactgttactgactttttctttcatatcagcagccagggcct

SEQ ID NO: 401651 - DNA, 140 bp, Artificial Sequence
  Synthetic
aggccctggctgctgatatgccagcccttcagacaggatcagaagaacttaaatcattatttaatacagtagcaactctctattgtgtacatcaaaagatagaggtaaaagacaccaagggaccttttgggacagcggtg

SEQ ID NO: 401652 - DNA, 140 bp, Artificial Sequence
  Synthetic
caccgctgtcccaaaaggtcccttggtgtcttttacctctatcttttgatgtacacaatagagagttgctactgtattaaataatgatttaagttcttctgatcctgtctgaagggctggcatatcagcagccagggcct

SEQ ID NO: 401653 - DNA, 140 bp, Artificial Sequence
  Synthetic
aggccctggctgctgatatgagcaactctctattgtgtacatcaaaagatagaggtaaaagacaccaaggaagctttagagaagatagaggaagagcaaaacaaaagtaagaaaaaggcagaccttttgggacagcggtg

SEQ ID NO: 401654 - DNA, 140 bp, Artificial Sequence
  Synthetic
caccgctgtcccaaaaggtctgcctttttcttacttttgttttgctcttcctctatcttctctaaagcttccttggtgtcttttacctctatcttttgatgtacacaatagagagttgctcatatcagcagccagggcct

SEQ ID NO: 401655 - DNA, 140 bp, Artificial Sequence
  Synthetic
aggccctggctgctgatatggtttaagaatagtttttgctgtactttctatagtaaatagagttaggcagggatactcacctttgtctttccagacccttacccaccaccagagggaaccgaccttttgggacagcggtg

SEQ ID NO: 401656 - DNA, 140 bp, Artificial Sequence
  Synthetic
caccgctgtcccaaaaggtcggttccctctggtggtgggtaagggtctggaaagacaaaggtgagtatccctgcctaactctatttactatagaaagtacagcaaaaactattcttaaaccatatcagcagccagggcct

SEQ ID NO: 401657 - DNA, 140 bp, Artificial Sequence
  Synthetic
aggccctggctgctgatatgggcaaatggtacaccaggccatatcacctagaactttaaatgcatgggtaaaagtaatagaggagaaggcttttagcccagaggtaatacccatgtttacgaccttttgggacagcggtg

SEQ ID NO: 401658 - DNA, 140 bp, Artificial Sequence
  Synthetic
caccgctgtcccaaaaggtcgtaaacatgggtattacctctgggctaaaagccttctcctctattacttttacccatgcatttaaagttctaggtgatatggcctggtgtaccatttgcccatatcagcagccagggcct

SEQ ID NO: 401659 - DNA, 140 bp, Artificial Sequence
  Synthetic
aggccctggctgctgatatgacaagagatacctctggaaaatgtaacagaaaattttaacatgtggaaaaataacatggtagaacagatgcatgaggatataatcagtttatgggatgaagaccttttgggacagcggtg

SEQ ID NO: 401660 - DNA, 140 bp, Artificial Sequence
  Synthetic
caccgctgtcccaaaaggtcttcatcccataaactgattatatcctcatgcatctgttctaccatgttatttttccacatgttaaaattttctgttacattttccagaggtatctcttgtcatatcagcagccagggcct

SEQ ID NO: 401661 - DNA, 140 bp, Artificial Sequence
  Synthetic
aggccctggctgctgatatgctattgcaatacatcaggactatttaatagcacttggagtaggaatagcactgataacagcacttggaatatcaatgacactgtcagctcaaatcacacagaccttttgggacagcggtg

SEQ ID NO: 401662 - DNA, 140 bp, Artificial Sequence
  Synthetic
caccgctgtcccaaaaggtctgtgtgatttgagctgacagtgtcattgatattccaagtgctgttatcagtgctattcctactccaagtgctattaaatagtcctgatgtattgcaatagcatatcagcagccagggcct

SEQ ID NO: 401663 - DNA, 140 bp, Artificial Sequence
  Synthetic
aggccctggctgctgatatgggacaagcgttctatgcaacaggtgacataataggaaatataagacaggcatattgtaatattaatagaacagaatggaataatatgataaataatgtgtgaccttttgggacagcggtg

SEQ ID NO: 401664 - DNA, 140 bp, Artificial Sequence
  Synthetic
caccgctgtcccaaaaggtcacacattatttatcatattattccattctgttctattaatattacaatatgcctgtcttatatttcctattatgtcacctgttgcatagaacgcttgtcccatatcagcagccagggcct

SEQ ID NO: 401665 - DNA, 140 bp, Artificial Sequence
  Synthetic
atacgccatgctgggtctccccctcaggaggggacttagaaattacaacacatagttttaattgtagaggagaattcttctattgtaatacatcacagctgtttaatagtagtctgtctacgtacttgggagtcggccat

SEQ ID NO: 401666 - DNA, 140 bp, Artificial Sequence
  Synthetic
atggccgactcccaagtacgtagacagactactattaaacagctgtgatgtattacaatagaagaattctcctctacaattaaaactatgtgttgtaatttctaagtcccctcctgagggggagacccagcatggcgtat

SEQ ID NO: 401667 - DNA, 140 bp, Artificial Sequence
  Synthetic
aggccctggctgctgatatgagacctgcaggaggagacatgaaggacaattggagaagtgaattatataagtataaaatagtaaaaattaaaccactaggagtagcacccaccagggcaagaccttttgggacagcggtg

SEQ ID NO: 401668 - DNA, 140 bp, Artificial Sequence
  Synthetic
caccgctgtcccaaaaggtcttgccctggtgggtgctactcctagtggtttaatttttactattttatacttatataattcacttctccaattgtccttcatgtctcctcctgcaggtctcatatcagcagccagggcct

SEQ ID NO: 401669 - DNA, 140 bp, Artificial Sequence
  Synthetic
aggccctggctgctgatatgatacctagaggatcaacagctcctagggatttggggatgctctggaaggctcatctgcaccactaatgtgccctggaatgctagttggagtaataaatctgaccttttgggacagcggtg

SEQ ID NO: 401670 - DNA, 140 bp, Artificial Sequence
  Synthetic
caccgctgtcccaaaaggtcagatttattactccaactagcattccagggcacattagtggtgcagatgagccttccagagcatccccaaatccctaggagctgttgatcctctaggtatcatatcagcagccagggcct

SEQ ID NO: 401671 - DNA, 140 bp, Artificial Sequence
  Synthetic
aggccctggctgctgatatgattaattgtacaagacccaacaacaatacaagaaaaagtatacctctaggaccagggagaacattttatgcaacaggagacataataggagatataagacgaccttttgggacagcggtg

SEQ ID NO: 401672 - DNA, 140 bp, Artificial Sequence
  Synthetic
caccgctgtcccaaaaggtcgtcttatatctcctattatgtctcctgttgcataaaatgttctccctggtcctagaggtatactttttcttgtattgttgttgggtcttgtacaattaatcatatcagcagccagggcct

SEQ ID NO: 401673 - DNA, 140 bp, Artificial Sequence
  Synthetic
aggccctggctgctgatatgactgagacaacaaatcaaaagactgaattacatgcaatctatttagccttgcaggattcaggatcagaagtaaatatagtaacagactcacaatatgcatgaccttttgggacagcggtg

SEQ ID NO: 401674 - DNA, 140 bp, Artificial Sequence
  Synthetic
caccgctgtcccaaaaggtcatgcatattgtgagtctgttactatatttacttctgatcctgaatcctgcaaggctaaatagattgcatgtaattcagtcttttgatttgttgtctcagtcatatcagcagccagggcct

SEQ ID NO: 401675 - DNA, 140 bp, Artificial Sequence
  Synthetic
  misc_feature (62)..(62): n is a, c, g, or t
  misc_feature (68)..(68): n is a, c, g, or t
  misc_feature (83)..(83): n is a, c, g, or t
aggccctggctgctgatatgcaccgcttgagagacttactcttgattgcaacgaggacagtngaactnttgggacacaggagnctgaagggactgaaactggggtgggatggcctcaaatgaccttttgggacagcggtg

SEQ ID NO: 401676 - DNA, 140 bp, Artificial Sequence
  Synthetic
  misc_feature (58)..(58): n is a, c, g, or t
  misc_feature (73)..(73): n is a, c, g, or t
  misc_feature (79)..(79): n is a, c, g, or t
caccgctgtcccaaaaggtcatttgaggccatcccaccccagtttcagtcccttcagnctcctgtgtcccaanagttcnactgtcctcgttgcaatcaagagtaagtctctcaagcggtgcatatcagcagccagggcct

SEQ ID NO: 401677 - DNA, 140 bp, Artificial Sequence
  Synthetic
aggccctggctgctgatatgaattgtattaatgctacaaattctaataatagtacctacaacaatagcataaaggaagaaatgaaaaattgctctttcaatataaccacagaaataagaggaccttttgggacagcggtg

SEQ ID NO: 401678 - DNA, 140 bp, Artificial Sequence
  Synthetic
caccgctgtcccaaaaggtcctcttatttctgtggttatattgaaagagcaatttttcatttcttcctttatgctattgttgtaggtactattattagaatttgtagcattaatacaattcatatcagcagccagggcct

SEQ ID NO: 401679 - DNA, 140 bp, Artificial Sequence
  Synthetic
atacgccatgctgggtctccgtgaataagactgaagaagagaaagaaatgaaaaactgctctttcaatatcacctcaagagtaggaaagggattgcagaaagagtatgcactcttttatacgtacttgggagtcggccat

SEQ ID NO: 401680 - DNA, 140 bp, Artificial Sequence
  Synthetic
atggccgactcccaagtacgtataaaagagtgcatactctttctgcaatccctttcctactcttgaggtgatattgaaagagcagtttttcatttctttctcttcttcagtcttattcacggagacccagcatggcgtat

SEQ ID NO: 401681 - DNA, 140 bp, Artificial Sequence
  Synthetic
aggccctggctgctgatatgctctccagacaggaacagaggagcttagatcattatttaatacagtagcaacactctattgtgtacatcaaaagatagaggtaaaagacaccaaagaagcgaccttttgggacagcggtg

SEQ ID NO: 401682 - DNA, 140 bp, Artificial Sequence
  Synthetic
caccgctgtcccaaaaggtcgcttctttggtgtcttttacctctatcttttgatgtacacaatagagtgttgctactgtattaaataatgatctaagctcctctgttcctgtctggagagcatatcagcagccagggcct

SEQ ID NO: 401683 - DNA, 140 bp, Artificial Sequence
  Synthetic
atacgccatgctgggtctccatttcacgaataatgctaaaactataatagtacagctgaaggaacctgtaaaaattaactgtacaagacccaacaacaatacaagaaaaagtatacacctcgtacttgggagtcggccat

SEQ ID NO: 401684 - DNA, 140 bp, Artificial Sequence
  Synthetic
atggccgactcccaagtacgaggtgtatactttttcttgtattgttgttgggtcttgtacagttaatttttacaggttccttcagctgtactattatagttttagcattattcgtgaaatggagacccagcatggcgtat

SEQ ID NO: 401685 - DNA, 140 bp, Artificial Sequence
  Synthetic
atacgccatgctgggtctccgacaagcacattgtaacattagttgggaagactggaataaagctttaaaccagacagctataaaattaagagaacaatttgagaataaaacaatagtctacgtacttgggagtcggccat

SEQ ID NO: 401686 - DNA, 140 bp, Artificial Sequence
  Synthetic
atggccgactcccaagtacgtagactattgttttattctcaaattgttctcttaattttatagctgtctggtttaaagctttattccagtcttcccaactaatgttacaatgtgcttgtcggagacccagcatggcgtat

SEQ ID NO: 401687 - DNA, 140 bp, Artificial Sequence
  Synthetic
atacgccatgctgggtctcctcagaattcctcaggaggggactcggaaattgtaatgcacagttttaattgcggaggagaatttttctactgtaatacaacaacactgtttaacagtactcgtacttgggagtcggccat

SEQ ID NO: 401688 - DNA, 140 bp, Artificial Sequence
  Synthetic
atggccgactcccaagtacgagtactgttaaacagtgttgttgtattacagtagaaaaattctcctccgcaattaaaactgtgcattacaatttccgagtcccctcctgaggaattctgaggagacccagcatggcgtat

SEQ ID NO: 401689 - DNA, 140 bp, Artificial Sequence
  Synthetic
atacgccatgctgggtctccgtaagggaaaaataaaacgagctgagccagcagcagaaggggtgggagccaacaactaacaattctggttgcgcctggctagaagcacactttttaaaagcgtacttgggagtcggccat

SEQ ID NO: 401690 - DNA, 140 bp, Artificial Sequence
  Synthetic
atggccgactcccaagtacgcttttaaaaagtgtgcttctagccaggcgcaaccagaattgttagttgttggctcccaccccttctgctgctggctcagctcgttttatttttcccttacggagacccagcatggcgtat

SEQ ID NO: 401691 - DNA, 140 bp, Artificial Sequence
  Synthetic
aggccctggctgctgatatggtgtcactttaaagtgcacaaatgctacctataataatagcaatggagaagtaaaaaattgcactttcaatacaaccacagaaataagggataggaaacagaccttttgggacagcggtg

SEQ ID NO: 401692 - DNA, 140 bp, Artificial Sequence
  Synthetic
caccgctgtcccaaaaggtctgtttcctatcccttatttctgtggttgtattgaaagtgcaattttttacttctccattgctattattataggtagcatttgtgcactttaaagtgacaccatatcagcagccagggcct

SEQ ID NO: 401693 - DNA, 140 bp, Artificial Sequence
  Synthetic
atacgccatgctgggtctccctctgtgtcactttaaattgtacaaatgttaaacttaatactaccagtacagaggctaatgctaacagtactgttaatgataatgctaccagtaatgttacgtacttgggagtcggccat

SEQ ID NO: 401694 - DNA, 140 bp, Artificial Sequence
  Synthetic
atggccgactcccaagtacgtaacattactggtagcattatcattaacagtactgttagcattagcctctgtactggtagtattaagtttaacatttgtacaatttaaagtgacacagagggagacccagcatggcgtat

SEQ ID NO: 401695 - DNA, 140 bp, Artificial Sequence
  Synthetic
aggccctggctgctgatatgatttggggttgctctggaaaactcatctgcaccactgctgtgccttggaatgctagttggagtaataaatctctaaatgatatttgggataacatgacctgaccttttgggacagcggtg

SEQ ID NO: 401696 - DNA, 140 bp, Artificial Sequence
  Synthetic
caccgctgtcccaaaaggtcaggtcatgttatcccaaatatcatttagagatttattactccaactagcattccaaggcacagcagtggtgcagatgagttttccagagcaaccccaaatcatatcagcagccagggcct

SEQ ID NO: 401697 - DNA, 140 bp, Artificial Sequence
  Synthetic
aggccctggctgctgatatgatgatagtaggaggcttgataggtttaagaatagtttttgctgtgctttctatagtaaatagagttaggcagggatactcacctttatcgtttcagacccgaccttttgggacagcggtg

SEQ ID NO: 401698 - DNA, 140 bp, Artificial Sequence
  Synthetic
caccgctgtcccaaaaggtcgggtctgaaacgataaaggtgagtatccctgcctaactctatttactatagaaagcacagcaaaaactattcttaaacctatcaagcctcctactatcatcatatcagcagccagggcct

SEQ ID NO: 401699 - DNA, 140 bp, Artificial Sequence
  Synthetic
atacgccatgctgggtctccttaaaggaacactataataaaacaatagaatttaaacaaccagtctcagggggggatctagaagttacaacacatagctttaattgtagaggagaattttcgtacttgggagtcggccat

SEQ ID NO: 401700 - DNA, 140 bp, Artificial Sequence
  Synthetic
atggccgactcccaagtacgaaaattctcctctacaattaaagctatgtgttgtaacttctagatccccccctgagactggttgtttaaattctattgttttattatagtgttcctttaaggagacccagcatggcgtat

SEQ ID NO: 401701 - DNA, 140 bp, Artificial Sequence
  Synthetic
aggccctggctgctgatatggtagtaccaagaagaaaagcaaagatcattagggattatggaaaacagatggcaggtgatgattgtgtggcaggtagacaggatgaggattagaacatgggaccttttgggacagcggtg

SEQ ID NO: 401702 - DNA, 140 bp, Artificial Sequence
  Synthetic
caccgctgtcccaaaaggtcccatgttctaatcctcatcctgtctacctgccacacaatcatcacctgccatctgttttccataatccctaatgatctttgcttttcttcttggtactaccatatcagcagccagggcct

SEQ ID NO: 401703 - DNA, 140 bp, Artificial Sequence
  Synthetic
aggccctggctgctgatatggacaataaaatttcaaccaccctcaggaggagatctagaaattacaatgcatcattttaattgtagaggggagtttttctattgcaatacaacaaaactagaccttttgggacagcggtg

SEQ ID NO: 401704 - DNA, 140 bp, Artificial Sequence
  Synthetic
caccgctgtcccaaaaggtctagttttgttgtattgcaatagaaaaactcccctctacaattaaaatgatgcattgtaatttctagatctcctcctgagggtggttgaaattttattgtccatatcagcagccagggcct

SEQ ID NO: 401705 - DNA, 140 bp, Artificial Sequence
  Synthetic
aggccctggctgctgatatgaataatgctgattgtgcctggctggaagcacaagaggagggagaagaggtaggatttccagtcagacctcaggtgcctttaagaccaatgacttataagggaccttttgggacagcggtg

SEQ ID NO: 401706 - DNA, 140 bp, Artificial Sequence
  Synthetic
caccgctgtcccaaaaggtcccttataagtcattggtcttaaaggcacctgaggtctgactggaaatcctacctcttctccctcctcttgtgcttccagccaggcacaatcagcattattcatatcagcagccagggcct

SEQ ID NO: 401707 - DNA, 140 bp, Artificial Sequence
  Synthetic
aggccctggctgctgatatgagtggtcaaaaagtagtatagttggatggcctgctataagggaaagaatgagacgagctgagccagcagcagatggggtgggggcagtatctcgagacctgaccttttgggacagcggtg

SEQ ID NO: 401708 - DNA, 140 bp, Artificial Sequence
  Synthetic
caccgctgtcccaaaaggtcaggtctcgagatactgcccccaccccatctgctgctggctcagctcgtctcattctttcccttatagcaggccatccaactatactactttttgaccactcatatcagcagccagggcct

SEQ ID NO: 401709 - DNA, 140 bp, Artificial Sequence
  Synthetic
aggccctggctgctgatatggaggaagtaggctttccagtcagacctcaggtgcctttaagaccaatgacttataaggcagcatttgatctcagcttctttttaaaagaaaaggggggacgaccttttgggacagcggtg

SEQ ID NO: 401710 - DNA, 140 bp, Artificial Sequence
  Synthetic
caccgctgtcccaaaaggtcgtccccccttttcttttaaaaagaagctgagatcaaatgctgccttataagtcattggtcttaaaggcacctgaggtctgactggaaagcctacttcctccatatcagcagccagggcct

SEQ ID NO: 401711 - DNA, 140 bp, Artificial Sequence
  Synthetic
aggccctggctgctgatatgcaatgcacacatggaatcaagccagtagtaacaactcaactgctgttaaatggcagtctagcagaaaataggacaatgattagatctaaaaacattacaggaccttttgggacagcggtg

SEQ ID NO: 401712 - DNA, 140 bp, Artificial Sequence
  Synthetic
caccgctgtcccaaaaggtcctgtaatgtttttagatctaatcattgtcctattttctgctagactgccatttaacagcagttgagttgttactactggcttgattccatgtgtgcattgcatatcagcagccagggcct

SEQ ID NO: 401713 - DNA, 140 bp, Artificial Sequence
  Synthetic
aggccctggctgctgatatggattgtagcgagagcagtgggacttctgggacacagcagtctcaggggcctacagaaggggtgggaagcccttaaatatctgggaaaccttgtgctatatgaccttttgggacagcggtg

SEQ ID NO: 401714 - DNA, 140 bp, Artificial Sequence
  Synthetic
caccgctgtcccaaaaggtcatatagcacaaggtttcccagatatttaagggcttcccaccccttctgtaggcccctgagactgctgtgtcccagaagtcccactgctctcgctacaatccatatcagcagccagggcct

SEQ ID NO: 401715 - DNA, 140 bp, Artificial Sequence
  Synthetic
  misc_feature (39)..(39): n is a, c, g, or t
  misc_feature (66)..(66): n is a, c, g, or t
  misc_feature (75)..(75): n is a, c, g, or t
  misc_feature (92)..(92): n is a, c, g, or t
aggccctggctgctgatatgcacttgtctgggaggactncaggaacctggtgatcctcctctgccnccgcttganagacttactcttgatantacagaggactctggagctcctgggacagaccttttgggacagcggtg

SEQ ID NO: 401716 - DNA, 140 bp, Artificial Sequence
  Synthetic
  misc_feature (49)..(49): n is a, c, g, or t
  misc_feature (66)..(66): n is a, c, g, or t
  misc_feature (75)..(75): n is a, c, g, or t
  misc_feature (102)..(102): n is a, c, g, or t
caccgctgtcccaaaaggtctgtcccaggagctccagagtcctctgtantatcaagagtaagtctntcaagcggnggcagaggaggatcaccaggttcctgnagtcctcccagacaagtgcatatcagcagccagggcct

SEQ ID NO: 401717 - DNA, 140 bp, Artificial Sequence
  Synthetic
aggccctggctgctgatatgaactttctatgtagatggggcagctaatagggagactaaattaggaaaagcaggatatgttactaacaaaggaagacaaaaagttgtcactctaactgacgaccttttgggacagcggtg

SEQ ID NO: 401718 - DNA, 140 bp, Artificial Sequence
  Synthetic
caccgctgtcccaaaaggtcgtcagttagagtgacaactttttgtcttcctttgttagtaacatatcctgcttttcctaatttagtctccctattagctgccccatctacatagaaagttcatatcagcagccagggcct

SEQ ID NO: 401719 - DNA, 140 bp, Artificial Sequence
  Synthetic
aggccctggctgctgatatgaggcatccaaaagtaagttcagaagtacacatcccattaggagatgctaaactagtagtaagaacatattggggtctgcatacaggagaaaaagattggcgaccttttgggacagcggtg

SEQ ID NO: 401720 - DNA, 140 bp, Artificial Sequence
  Synthetic
caccgctgtcccaaaaggtcgccaatctttttctcctgtatgcagaccccaatatgttcttactactagtttagcatctcctaatgggatgtgtacttctgaacttacttttggatgcctcatatcagcagccagggcct

SEQ ID NO: 401721 - DNA, 140 bp, Artificial Sequence
  Synthetic
aggccctggctgctgatatgagaattagcacaaagaataggaaggggaatattacacgtccctagaagaattagacagggcctagaaaggacacttgtataagatggggaaaattttgtcgaccttttgggacagcggtg

SEQ ID NO: 401722 - DNA, 140 bp, Artificial Sequence
  Synthetic
caccgctgtcccaaaaggtcgacaaaattttccccatcttatacaagtgtcctttctaggccctgtctaattcttctagggacgtgtaatattccccttcctattctttgtgctaattctcatatcagcagccagggcct

SEQ ID NO: 401723 - DNA, 140 bp, Artificial Sequence
  Synthetic
atacgccatgctgggtctcccctgtagaaattaagtgtacaagacccggcaacaatacaagaaaaggtatatatatgggaccagggagagcatggtatacaacaagaagaataataggagcgtacttgggagtcggccat

SEQ ID NO: 401724 - DNA, 140 bp, Artificial Sequence
  Synthetic
atggccgactcccaagtacgctcctattattcttcttgttgtataccatgctctccctggtcccatatatataccttttcttgtattgttgccgggtcttgtacacttaatttctacaggggagacccagcatggcgtat

SEQ ID NO: 401725 - DNA, 140 bp, Artificial Sequence
  Synthetic
aggccctggctgctgatatgaagaaaatacaaaggatacttgatagaataagagaaagagcagaagacagtggaaatgaaagcgaaggggacacagatgaattggcaacccttgtggagagaccttttgggacagcggtg

SEQ ID NO: 401726 - DNA, 140 bp, Artificial Sequence
  Synthetic
caccgctgtcccaaaaggtctctccacaagggttgccaattcatctgtgtccccttcgctttcatttccactgtcttctgctctttctcttattctatcaagtatcctttgtattttcttcatatcagcagccagggcct

SEQ ID NO: 401727 - DNA, 140 bp, Artificial Sequence
  Synthetic
aggccctggctgctgatatgctttagataaaatagaggaaatacaaaataagagcaagcaaaagacacagcaggcagcagctgacacaggaaacagcagcaaggtcagtcaaaattacccgaccttttgggacagcggtg

SEQ ID NO: 401728 - DNA, 140 bp, Artificial Sequence
  Synthetic
caccgctgtcccaaaaggtcgggtaattttgactgaccttgctgctgtttcctgtgtcagctgctgcctgctgtgtcttttgcttgctcttattttgtatttcctctattttatctaaagcatatcagcagccagggcct

SEQ ID NO: 401729 - DNA, 140 bp, Artificial Sequence
  Synthetic
aggccctggctgctgatatgtggtagaacagatgcatgaggatataatcagtttatgggatgaaagcctaaagccatgtgtaaagctaacccctctctgtgttactttaaactgtactaagaccttttgggacagcggtg

SEQ ID NO: 401730 - DNA, 140 bp, Artificial Sequence
  Synthetic
caccgctgtcccaaaaggtcttagtacagtttaaagtaacacagagaggggttagctttacacatggctttaggctttcatcccataaactgattatatcctcatgcatctgttctaccacatatcagcagccagggcct

SEQ ID NO: 401731 - DNA, 140 bp, Artificial Sequence
  Synthetic
atacgccatgctgggtctccagccagtgatatcaactcaattgctgctaaacggcagtgtggcagaaaagaaaataatgattagatctgaaaacatcacaaacaatgccaaaaacataatcgtacttgggagtcggccat

SEQ ID NO: 401732 - DNA, 140 bp, Artificial Sequence
  Synthetic
atggccgactcccaagtacgattatgtttttggcattgtttgtgatgttttcagatctaatcattattttcttttctgccacactgccgtttagcagcaattgagttgatatcactggctggagacccagcatggcgtat

SEQ ID NO: 401733 - DNA, 140 bp, Artificial Sequence
  Synthetic
aggccctggctgctgatatggcatcttctatggcaggaagaagcgaaggcagcgacgaagagctcctcaagacagtcagactcatcaaactcctctatcagagcagtaagtagtaaatgtgaccttttgggacagcggtg

SEQ ID NO: 401734 - DNA, 140 bp, Artificial Sequence
  Synthetic
caccgctgtcccaaaaggtcacatttactacttactgctctgatagaggagtttgatgagtctgactgtcttgaggagctcttcgtcgctgccttcgcttcttcctgccatagaagatgccatatcagcagccagggcct

SEQ ID NO: 401735 - DNA, 140 bp, Artificial Sequence
  Synthetic
atacgccatgctgggtctccttaacaagagcaaagggaacataacctttaacccatccgcaggaggggacttagaaattacaacacatagttttaattgtagaggagaatttttttattgcgtacttgggagtcggccat

SEQ ID NO: 401736 - DNA, 140 bp, Artificial Sequence
  Synthetic
atggccgactcccaagtacgcaataaaaaaattctcctctacaattaaaactatgtgttgtaatttctaagtcccctcctgcggatgggttaaaggttatgttccctttgctcttgttaaggagacccagcatggcgtat

SEQ ID NO: 401737 - DNA, 140 bp, Artificial Sequence
  Synthetic
atacgccatgctgggtctccgtggcgcccgaacagggacccgaaaagtgaaagtaagaccagagaagatctctcgacgcagggctcggcttgctgaagtgcactcggcaagaggcgagagcgtacttgggagtcggccat

SEQ ID NO: 401738 - DNA, 140 bp, Artificial Sequence
  Synthetic
atggccgactcccaagtacgctctcgcctcttgccgagtgcacttcagcaagccgagccctgcgtcgagagatcttctctggtcttactttcacttttcgggtccctgttcgggcgccacggagacccagcatggcgtat

SEQ ID NO: 401739 - DNA, 140 bp, Artificial Sequence
  Synthetic
atacgccatgctgggtctccacaatggtacccacaatgggttccacaatgagagaaggcgggaaatgaaaaattgctctttcaatgcaaccacagaattaaatgataggaagcaaaaggtcgtacttgggagtcggccat

SEQ ID NO: 401740 - DNA, 140 bp, Artificial Sequence
  Synthetic
atggccgactcccaagtacgaccttttgcttcctatcatttaattctgtggttgcattgaaagagcaatttttcatttcccgccttctctcattgtggaacccattgtgggtaccattgtggagacccagcatggcgtat

SEQ ID NO: 401741 - DNA, 140 bp, Artificial Sequence
  Synthetic
aggccctggctgctgatatgacaaatatacaacctacttgaagaatcgcagaaccagcaggaaaagaatgaacaagacttattggcattggacaagtgggcaagtttgtggaattggtttgaccttttgggacagcggtg

SEQ ID NO: 401742 - DNA, 140 bp, Artificial Sequence
  Synthetic
caccgctgtcccaaaaggtcaaaccaattccacaaacttgcccacttgtccaatgccaataagtcttgttcattcttttcctgctggttctgcgattcttcaagtaggttgtatatttgtcatatcagcagccagggcct

SEQ ID NO: 401743 - DNA, 140 bp, Artificial Sequence
  Synthetic
aggccctggctgctgatatgaacaagacttattggcattggacaagtgggcaagtttgtggaattggtttgacatatcaaactggctatggtatataaaaatatttataatgatagtagggaccttttgggacagcggtg

SEQ ID NO: 401744 - DNA, 140 bp, Artificial Sequence
  Synthetic
caccgctgtcccaaaaggtccctactatcattataaatatttttatataccatagccagtttgatatgtcaaaccaattccacaaacttgcccacttgtccaatgccaataagtcttgttcatatcagcagccagggcct

SEQ ID NO: 401745 - DNA, 140 bp, Artificial Sequence
  Synthetic
atacgccatgctgggtctcctacaaatagtacaaatagtacccccatagataaggacatgtatggagaaataaaaaattgctctttcaatacaaccacagtgctaacagataagaaacaacgtacttgggagtcggccat

SEQ ID NO: 401746 - DNA, 140 bp, Artificial Sequence
  Synthetic
atggccgactcccaagtacgttgtttcttatctgttagcactgtggttgtattgaaagagcaattttttatttctccatacatgtccttatctatgggggtactatttgtactatttgtaggagacccagcatggcgtat

SEQ ID NO: 401747 - DNA, 140 bp, Artificial Sequence
  Synthetic
aggccctggctgctgatatgaaactttacatcatcctcaggaggggacccagaaattacaacacatagctttaattgtagaggagaatttttctactgtaatacaacaaaactgtttaatgaccttttgggacagcggtg

SEQ ID NO: 401748 - DNA, 140 bp, Artificial Sequence
  Synthetic
caccgctgtcccaaaaggtcattaaacagttttgttgtattacagtagaaaaattctcctctacaattaaagctatgtgttgtaatttctgggtcccctcctgaggatgatgtaaagtttcatatcagcagccagggcct

SEQ ID NO: 401749 - DNA, 140 bp, Artificial Sequence
  Synthetic
aggccctggctgctgatatgtccttgggttcttgggagcagcaggaagcactatgggcgcagcgtcaataacgctgacggtacaggccagacaattgttgtctggtatagtgcaacagcagaccttttgggacagcggtg

SEQ ID NO: 401750 - DNA, 140 bp, Artificial Sequence
  Synthetic
caccgctgtcccaaaaggtctgctgttgcactataccagacaacaattgtctggcctgtaccgtcagcgttattgacgctgcgcccatagtgcttcctgctgctcccaagaacccaaggacatatcagcagccagggcct

SEQ ID NO: 401751 - DNA, 140 bp, Artificial Sequence
  Synthetic
atacgccatgctgggtctccgtggctggggaacggtagtaaatgaagaagtaaaaaactgctctttcaatattaccacaagcataaaagataaggtgcagacagaatatgcacttttttacgtacttgggagtcggccat

SEQ ID NO: 401752 - DNA, 140 bp, Artificial Sequence
  Synthetic
atggccgactcccaagtacgtaaaaaagtgcatattctgtctgcaccttatcttttatgcttgtggtaatattgaaagagcagttttttacttcttcatttactaccgttccccagccacggagacccagcatggcgtat

SEQ ID NO: 401753 - DNA, 140 bp, Artificial Sequence
  Synthetic
aggccctggctgctgatatgataatgatagtaggaggcttaataggtttaagaatagtttttgctgtactttctatagtaaatagagttaggcagggatactcaccattgtcatttcagagaccttttgggacagcggtg

SEQ ID NO: 401754 - DNA, 140 bp, Artificial Sequence
  Synthetic
caccgctgtcccaaaaggtctctgaaatgacaatggtgagtatccctgcctaactctatttactatagaaagtacagcaaaaactattcttaaacctattaagcctcctactatcattatcatatcagcagccagggcct

SEQ ID NO: 401755 - DNA, 140 bp, Artificial Sequence
  Synthetic
aggccctggctgctgatatgcccaacaacaatacaagaaaaggcatacatatgggaccaggaggagcactgtttacaacagaaataacaggaaatataagacaggcacattgcaacattagaccttttgggacagcggtg

SEQ ID NO: 401756 - DNA, 140 bp, Artificial Sequence
  Synthetic
caccgctgtcccaaaaggtctaatgttgcaatgtgcctgtcttatatttcctgttatttctgttgtaaacagtgctcctcctggtcccatatgtatgccttttcttgtattgttgttgggcatatcagcagccagggcct

SEQ ID NO: 401757 - DNA, 140 bp, Artificial Sequence
  Synthetic
aggccctggctgctgatatggcttgtagagctattcgcaacatacctagaagaataagacagggcttagaaaggtctttactataagatgggtggcaagtggtcaaaaagtagtatagtggaccttttgggacagcggtg

SEQ ID NO: 401758 - DNA, 140 bp, Artificial Sequence
  Synthetic
caccgctgtcccaaaaggtccactatactactttttgaccacttgccacccatcttatagtaaagacctttctaagccctgtcttattcttctaggtatgttgcgaatagctctacaagccatatcagcagccagggcct

SEQ ID NO: 401759 - DNA, 140 bp, Artificial Sequence
  Synthetic
atacgccatgctgggtctccccataatgtgagcaaggaaatgacgggagaaataaaaaactgctctttcaatgcaaccacagaaataatagataagaaaaagaaagcgtatgcactttttcgtacttgggagtcggccat

SEQ ID NO: 401760 - DNA, 140 bp, Artificial Sequence
  Synthetic
atggccgactcccaagtacgaaaaagtgcatacgctttctttttcttatctattatttctgtggttgcattgaaagagcagttttttatttctcccgtcatttccttgctcacattatggggagacccagcatggcgtat

SEQ ID NO: 401761 - DNA, 140 bp, Artificial Sequence
  Synthetic
atacgccatgctgggtctccaaccacaatcactctcagggggggacctagaaattacaacacatagttttaattgcagaggagaatttttctattgcaatacatcaagactgtttaatgacgtacttgggagtcggccat

SEQ ID NO: 401762 - DNA, 140 bp, Artificial Sequence
  Synthetic
atggccgactcccaagtacgtcattaaacagtcttgatgtattgcaatagaaaaattctcctctgcaattaaaactatgtgttgtaatttctaggtccccccctgagagtgattgtggttggagacccagcatggcgtat

SEQ ID NO: 401763 - DNA, 140 bp, Artificial Sequence
  Synthetic
aggccctggctgctgatatggcttgaagactcgcatatccagcaggaaaaaaatgaaaaagatttactagcattggacagttggaacaatttgtggaattggtttaacataacaaattgggaccttttgggacagcggtg

SEQ ID NO: 401764 - DNA, 140 bp, Artificial Sequence
  Synthetic
caccgctgtcccaaaaggtcccaatttgttatgttaaaccaattccacaaattgttccaactgtccaatgctagtaaatctttttcatttttttcctgctggatatgcgagtcttcaagccatatcagcagccagggcct

SEQ ID NO: 401765 - DNA, 140 bp, Artificial Sequence
  Synthetic
aggccctggctgctgatatgtttggggttgctctggaaaactcatttgcaccactactgtgccttggaatactagttggagtaataaatctcatgatgacatttgggataatatgacttggaccttttgggacagcggtg

SEQ ID NO: 401766 - DNA, 140 bp, Artificial Sequence
  Synthetic
caccgctgtcccaaaaggtccaagtcatattatcccaaatgtcatcatgagatttattactccaactagtattccaaggcacagtagtggtgcaaatgagttttccagagcaaccccaaacatatcagcagccagggcct

SEQ ID NO: 401767 - DNA, 140 bp, Artificial Sequence
  Synthetic
atacgccatgctgggtctccttgctataacatgggaagcaagtggtcaaaaagtagcctagtgggatggcctcagatcagggaaagaataaggcaaactcccccagcagcagaaggagtacgtacttgggagtcggccat

SEQ ID NO: 401768 - DNA, 140 bp, Artificial Sequence
  Synthetic
atggccgactcccaagtacgtactccttctgctgctgggggagtttgccttattctttccctgatctgaggccatcccactaggctactttttgaccacttgcttcccatgttatagcaaggagacccagcatggcgtat

SEQ ID NO: 401769 - DNA, 140 bp, Artificial Sequence
  Synthetic
atacgccatgctgggtctcccctcagagcagtgaggatcatcaaaatcttatatcaaagcagtaagtattaatgtaatgctatctttaaccattttagcaatagtagccttagtagtagccgtacttgggagtcggccat

SEQ ID NO: 401770 - DNA, 140 bp, Artificial Sequence
  Synthetic
atggccgactcccaagtacggctactactaaggctactattgctaaaatggttaaagatagcattacattaatacttactgctttgatataagattttgatgatcctcactgctctgaggggagacccagcatggcgtat

SEQ ID NO: 401771 - DNA, 140 bp, Artificial Sequence
  Synthetic
aggccctggctgctgatatgtctctcgacgcaggactcggcttgctgaggtgcacacagcaagaggcgagagcggcgactggtgagtacgccaaaattttgactagcagaggctagaagggaccttttgggacagcggtg

SEQ ID NO: 401772 - DNA, 140 bp, Artificial Sequence
  Synthetic
caccgctgtcccaaaaggtcccttctagcctctgctagtcaaaattttggcgtactcaccagtcgccgctctcgcctcttgctgtgtgcacctcagcaagccgagtcctgcgtcgagagacatatcagcagccagggcct

SEQ ID NO: 401773 - DNA, 140 bp, Artificial Sequence
  Synthetic
atacgccatgctgggtctcctgtgagcagcataagaattctagtaactctgtgagacagtataggatgatacattgtaacacctcaaccatcacacaggcttgtccaaaagtatcctttgcgtacttgggagtcggccat

SEQ ID NO: 401774 - DNA, 140 bp, Artificial Sequence
  Synthetic
atggccgactcccaagtacgcaaaggatacttttggacaagcctgtgtgatggttgaggtgttacaatgtatcatcctatactgtctcacagagttactagaattcttatgctgctcacaggagacccagcatggcgtat

SEQ ID NO: 401775 - DNA, 140 bp, Artificial Sequence
  Synthetic
atacgccatgctgggtctcccaattgtacaagaccccacaacaatacaagaaaaaggatacggataggaccagggagaacatggcatacaacaaaacagataataggaggtataagagcacgtacttgggagtcggccat

SEQ ID NO: 401776 - DNA, 140 bp, Artificial Sequence
  Synthetic
atggccgactcccaagtacgtgctcttatacctcctattatctgttttgttgtatgccatgttctccctggtcctatccgtatcctttttcttgtattgttgtggggtcttgtacaattgggagacccagcatggcgtat

SEQ ID NO: 401777 - DNA, 140 bp, Artificial Sequence
  Synthetic
aggccctggctgctgatatgcagggagaacatggcatacaacaaaacagataataggaggtataagagcagcacattgtaacattagtaccacaaaatggaataacacattaaggctgatgaccttttgggacagcggtg

SEQ ID NO: 401778 - DNA, 140 bp, Artificial Sequence
  Synthetic
caccgctgtcccaaaaggtcatcagccttaatgtgttattccattttgtggtactaatgttacaatgtgctgctcttatacctcctattatctgttttgttgtatgccatgttctccctgcatatcagcagccagggcct

SEQ ID NO: 401779 - DNA, 140 bp, Artificial Sequence
  Synthetic
atacgccatgctgggtctccgcagaataaagcaaattgtaaatatgtggcaggaagtaggacgagcaatgtatgcccctcccattgaaggactaattagatgtacatcaagtattacaggcgtacttgggagtcggccat

SEQ ID NO: 401780 - DNA, 140 bp, Artificial Sequence
  Synthetic
atggccgactcccaagtacgcctgtaatacttgatgtacatctaattagtccttcaatgggaggggcatacattgctcgtcctacttcctgccacatatttacaatttgctttattctgcggagacccagcatggcgtat

SEQ ID NO: 401781 - DNA, 140 bp, Artificial Sequence
  Synthetic
aggccctggctgctgatatgcaaataacttgtgggtcacagtctattatggggtacctgtgtgggaggatgcagataccactctattttgtgcatctgatgctaaagcatatagtactgagaccttttgggacagcggtg

SEQ ID NO: 401782 - DNA, 140 bp, Artificial Sequence
  Synthetic
caccgctgtcccaaaaggtctcagtactatatgctttagcatcagatgcacaaaatagagtggtatctgcatcctcccacacaggtaccccataatagactgtgacccacaagttatttgcatatcagcagccagggcct

SEQ ID NO: 401783 - DNA, 140 bp, Artificial Sequence
  Synthetic
aggccctggctgctgatatggtactaatgtaactattaatgtaaccagcagtagcaacagtagtgtaaccagcactagcactgtgggtagcactaccagcactagcactgtgggtagcacgaccttttgggacagcggtg

SEQ ID NO: 401784 - DNA, 140 bp, Artificial Sequence
  Synthetic
caccgctgtcccaaaaggtcgtgctacccacagtgctagtgctggtagtgctacccacagtgctagtgctggttacactactgttgctactgctggttacattaatagttacattagtaccatatcagcagccagggcct

SEQ ID NO: 401785 - DNA, 140 bp, Artificial Sequence
  Synthetic
atacgccatgctgggtctccaaaactgctctttcaatataaccacagaaataaaagataggaggaagcaagaatacgcgcttttttataaacttgatatagtaccaattaatgatggtagcgtacttgggagtcggccat

SEQ ID NO: 401786 - DNA, 140 bp, Artificial Sequence
  Synthetic
atggccgactcccaagtacgctaccatcattaattggtactatatcaagtttataaaaaagcgcgtattcttgcttcctcctatcttttatttctgtggttatattgaaagagcagttttggagacccagcatggcgtat

SEQ ID NO: 401787 - DNA, 140 bp, Artificial Sequence
  Synthetic
aggccctggctgctgatatgtgtgctgccacagggatggaaaggatcaccagcaatattccagagtagcatgacaaaaatcttagagccctttagaataaaaaatccagaaatggttatcgaccttttgggacagcggtg

SEQ ID NO: 401788 - DNA, 140 bp, Artificial Sequence
  Synthetic
caccgctgtcccaaaaggtcgataaccatttctggattttttattctaaagggctctaagatttttgtcatgctactctggaatattgctggtgatcctttccatccctgtggcagcacacatatcagcagccagggcct

SEQ ID NO: 401789 - DNA, 140 bp, Artificial Sequence
  Synthetic
atacgccatgctgggtctccggggaaataatgattagatctgaaaacatcacgaacaatgccaaaaacataatagtacagctcaatgaaactgtacccattacgtgtgccagacccagcacgtacttgggagtcggccat

SEQ ID NO: 401790 - DNA, 140 bp, Artificial Sequence
  Synthetic
atggccgactcccaagtacgtgctgggtctggcacacgtaatgggtacagtttcattgagctgtactattatgtttttggcattgttcgtgatgttttcagatctaatcattatttccccggagacccagcatggcgtat

SEQ ID NO: 401791 - DNA, 140 bp, Artificial Sequence
  Synthetic
aggccctggctgctgatatggcctcttcagctaccaccgcttgagagacttactcttgattgtggcgagagtggtggaacttctgggacgcagcagtctcaggggaatacagagggggtggaccttttgggacagcggtg

SEQ ID NO: 401792 - DNA, 140 bp, Artificial Sequence
  Synthetic
caccgctgtcccaaaaggtccaccccctctgtattcccctgagactgctgcgtcccagaagttccaccactctcgccacaatcaagagtaagtctctcaagcggtggtagctgaagaggccatatcagcagccagggcct

SEQ ID NO: 401793 - DNA, 140 bp, Artificial Sequence
  Synthetic
aggccctggctgctgatatggaagaccaggggccgcagagggaaccatacaatgagtggacactagagcttctagaggaactcaagcaggaagctgtcagacactttcctagaccatggcgaccttttgggacagcggtg

SEQ ID NO: 401794 - DNA, 140 bp, Artificial Sequence
  Synthetic
caccgctgtcccaaaaggtcgccatggtctaggaaagtgtctgacagcttcctgcttgagttcctctagaagctctagtgtccactcattgtatggttccctctgcggcccctggtcttccatatcagcagccagggcct

SEQ ID NO: 401795 - DNA, 140 bp, Artificial Sequence
  Synthetic
atacgccatgctgggtctccacagatgccataataggagatataagacaagcacattgtaatattagtagaataagatgggaaaatatgaaacaaaatgtaactgcaaaactagaaaaaacgtacttgggagtcggccat

SEQ ID NO: 401796 - DNA, 140 bp, Artificial Sequence
  Synthetic
atggccgactcccaagtacgttttttctagttttgcagttacattttgtttcatattttcccatcttattctactaatattacaatgtgcttgtcttatatctcctattatggcatctgtggagacccagcatggcgtat

SEQ ID NO: 401797 - DNA, 140 bp, Artificial Sequence
  Synthetic
atacgccatgctgggtctcctatttaaaaagaacataacctttaacccacctgcaggaggggacttagaaattacaacacatagttttatttgtagaggaggatttttttattgtaataccgtacttgggagtcggccat

SEQ ID NO: 401798 - DNA, 140 bp, Artificial Sequence
  Synthetic
atggccgactcccaagtacggtattacaataaaaaaatcctcctctacaaataaaactatgtgttgtaatttctaagtcccctcctgcaggtgggttaaaggttatgttctttttaaataggagacccagcatggcgtat

SEQ ID NO: 401799 - DNA, 140 bp, Artificial Sequence
  Synthetic
atacgccatgctgggtctcccagaattgggtgccagcatagcagaatagacaagctaattacaagaattagagaaagagaagaagacagtggcaatgagagtgagggggatattgaagaacgtacttgggagtcggccat

SEQ ID NO: 401800 - DNA, 140 bp, Artificial Sequence
  Synthetic
atggccgactcccaagtacgttcttcaatatccccctcactctcattgccactgtcttcttctctttctctaattcttgtaattagcttgtctattctgctatgctggcacccaattctgggagacccagcatggcgtat

SEQ ID NO: 401801 - DNA, 140 bp, Artificial Sequence
  Synthetic
aggccctggctgctgatatgaaaatggggggcaagcgttcaaaatatagcagatggcctgagataagagagagaatgagaagaactagagagccagcagcagatggggtgggagcagtatgaccttttgggacagcggtg

SEQ ID NO: 401802 - DNA, 140 bp, Artificial Sequence
  Synthetic
caccgctgtcccaaaaggtcatactgctcccaccccatctgctgctggctctctagttcttctcattctctctcttatctcaggccatctgctatattttgaacgcttgccccccattttcatatcagcagccagggcct

SEQ ID NO: 401803 - DNA, 140 bp, Artificial Sequence
  Synthetic
aggccctggctgctgatatggaagaagtaggctttccagtcagacctcaggtgcctttaagaccaatgacttataaaggagcattagatctcagcttctttttaaaagaaaaggggggacgaccttttgggacagcggtg

SEQ ID NO: 401804 - DNA, 140 bp, Artificial Sequence
  Synthetic
caccgctgtcccaaaaggtcgtccccccttttcttttaaaaagaagctgagatctaatgctcctttataagtcattggtcttaaaggcacctgaggtctgactggaaagcctacttcttccatatcagcagccagggcct

SEQ ID NO: 401805 - DNA, 140 bp, Artificial Sequence
  Synthetic
atacgccatgctgggtctcctggtcccaacaatatgacccacaatgatgacgggatgggaataaaaaattgctctttcaatgcgaccacagaaatgagagataagaagcaaaaagtgtatcgtacttgggagtcggccat

SEQ ID NO: 401806 - DNA, 140 bp, Artificial Sequence
  Synthetic
atggccgactcccaagtacgatacactttttgcttcttatctctcatttctgtggtcgcattgaaagagcaattttttattcccatcccgtcatcattgtgggtcatattgttgggaccaggagacccagcatggcgtat

SEQ ID NO: 401807 - DNA, 140 bp, Artificial Sequence
  Synthetic
atacgccatgctgggtctccaatgtcacctctgagaataaggagggagaaatgaaaaattgctctttcaatataaccacagaattaataaataagaaacagcgagagtatgcattgttttcgtacttgggagtcggccat

SEQ ID NO: 401808 - DNA, 140 bp, Artificial Sequence
  Synthetic
atggccgactcccaagtacgaaaacaatgcatactctcgctgtttcttatttattaattctgtggttatattgaaagagcaatttttcatttctccctccttattctcagaggtgacattggagacccagcatggcgtat

SEQ ID NO: 401809 - DNA, 140 bp, Artificial Sequence
  Synthetic
aggccctggctgctgatatgctggttatgcgattctaaagtgtaataataagacattcaatggaacaggaccatgcaataatgtcagcacagtacaatgtacacatggaattaagccagtgaccttttgggacagcggtg

SEQ ID NO: 401810 - DNA, 140 bp, Artificial Sequence
  Synthetic
caccgctgtcccaaaaggtcactggcttaattccatgtgtacattgtactgtgctgacattattgcatggtcctgttccattgaatgtcttattattacactttagaatcgcataaccagcatatcagcagccagggcct

SEQ ID NO: 401811 - DNA, 140 bp, Artificial Sequence
  Synthetic
atacgccatgctgggtctccatagcagtagctaactggacagatagagctatagaagtagtgcaaagagttggtagggctattctcaacatacctgtaagaataagacaaggcttggaaacgtacttgggagtcggccat

SEQ ID NO: 401812 - DNA, 140 bp, Artificial Sequence
  Synthetic
atggccgactcccaagtacgtttccaagccttgtcttattcttacaggtatgttgagaatagccctaccaactctttgcactacttctatagctctatctgtccagttagctactgctatggagacccagcatggcgtat

SEQ ID NO: 401813 - DNA, 140 bp, Artificial Sequence
  Synthetic
aggccctggctgctgatatggagtaggagcagtatctcaagatttagctaggcatggagcaattacaagcagcaatacagcagccaataatcctgattgtgcctggctggaagcacaaaagaccttttgggacagcggtg

SEQ ID NO: 401814 - DNA, 140 bp, Artificial Sequence
  Synthetic
caccgctgtcccaaaaggtcttttgtgcttccagccaggcacaatcaggattattggctgctgtattgctgcttgtaattgctccatgcctagctaaatcttgagatactgctcctactccatatcagcagccagggcct

SEQ ID NO: 401815 - DNA, 140 bp, Artificial Sequence
  Synthetic
aggccctggctgctgatatgtgacctagcagaccaactgattcatctaaattattttgactgtttttcagaatctgccataaggacagccatattaggacaagtagttagacgtaggtgtgaccttttgggacagcggtg

SEQ ID NO: 401816 - DNA, 140 bp, Artificial Sequence
  Synthetic
caccgctgtcccaaaaggtcacacctacgtctaactacttgtcctaatatggctgtccttatggcagattctgaaaaacagtcaaaataatttagatgaatcagttggtctgctaggtcacatatcagcagccagggcct

SEQ ID NO: 401817 - DNA, 140 bp, Artificial Sequence
  Synthetic
atacgccatgctgggtctccaataatgccactaataccaataatagtactgtggaaaagatggaacaaggagaaataaaaaactgttcttttaatatcaccacaagcataacaaataagacgtacttgggagtcggccat

SEQ ID NO: 401818 - DNA, 140 bp, Artificial Sequence
  Synthetic
atggccgactcccaagtacgtcttatttgttatgcttgtggtgatattaaaagaacagttttttatttctccttgttccatcttttccacagtactattattggtattagtggcattattggagacccagcatggcgtat

SEQ ID NO: 401819 - DNA, 140 bp, Artificial Sequence
  Synthetic
aggccctggctgctgatatgacataataggagacataagaaaagcatattgtgaaattaatgcaacactatggaacgaaactttagatcaggtaaaggaaaaattaaaagaacaatacaagaccttttgggacagcggtg

SEQ ID NO: 401820 - DNA, 140 bp, Artificial Sequence
  Synthetic
caccgctgtcccaaaaggtcttgtattgttcttttaatttttcctttacctgatctaaagtttcgttccatagtgttgcattaatttcacaatatgcttttcttatgtctcctattatgtcatatcagcagccagggcct

SEQ ID NO: 401821 - DNA, 140 bp, Artificial Sequence
  Synthetic
atacgccatgctgggtctccatagaaatagtacaaagagcctgtagagctattatcaacatacctagaagaataagacagggccttgaaagggctttgatataagatgggtggcaagtggcgtacttgggagtcggccat

SEQ ID NO: 401822 - DNA, 140 bp, Artificial Sequence
  Synthetic
atggccgactcccaagtacgccacttgccacccatcttatatcaaagccctttcaaggccctgtcttattcttctaggtatgttgataatagctctacaggctctttgtactatttctatggagacccagcatggcgtat

SEQ ID NO: 401823 - DNA, 140 bp, Artificial Sequence
  Synthetic
atacgccatgctgggtctccagcaatactaacattactagcataaataatagcagcatgaatggagaaataaaaaattgctctttcaatacaaccacagaaataagagataagcaacagacgtacttgggagtcggccat

SEQ ID NO: 401824 - DNA, 140 bp, Artificial Sequence
  Synthetic
atggccgactcccaagtacgtctgttgcttatctcttatttctgtggttgtattgaaagagcaattttttatttctccattcatgctgctattatttatgctagtaatgttagtattgctggagacccagcatggcgtat

SEQ ID NO: 401825 - DNA, 140 bp, Artificial Sequence
  Synthetic
aggccctggctgctgatatggaataaaacaatagtctttaatcactcctcaggaggggacccagaaattgtaatgcacagttttaattgtggaggggaatttttctactgtaattcaacagaccttttgggacagcggtg

SEQ ID NO: 401826 - DNA, 140 bp, Artificial Sequence
  Synthetic
caccgctgtcccaaaaggtctgttgaattacagtagaaaaattcccctccacaattaaaactgtgcattacaatttctgggtcccctcctgaggagtgattaaagactattgttttattccatatcagcagccagggcct

SEQ ID NO: 401827 - DNA, 140 bp, Artificial Sequence
  Synthetic
aggccctggctgctgatatgcttgtgcctggctgagagcgcaagaggaggaagaagaagtaggctttccagtcacacctcaggtacctttaaggcagcgttcgatctcagcttctttttagaccttttgggacagcggtg

SEQ ID NO: 401828 - DNA, 140 bp, Artificial Sequence
  Synthetic
caccgctgtcccaaaaggtctaaaaagaagctgagatcgaacgctgccttaaaggtacctgaggtgtgactggaaagcctacttcttcttcctcctcttgcgctctcagccaggcacaagcatatcagcagccagggcct

SEQ ID NO: 401829 - DNA, 140 bp, Artificial Sequence
  Synthetic
aggccctggctgctgatatgcaacaataatacaagaagaagtataaggataggaccaggacaaacattctatgcaaataatgacataataggagacataagacaagcacattgtaacattgaccttttgggacagcggtg

SEQ ID NO: 401830 - DNA, 140 bp, Artificial Sequence
  Synthetic
caccgctgtcccaaaaggtcaatgttacaatgtgcttgtcttatgtctcctattatgtcattatttgcatagaatgtttgtcctggtcctatccttatacttcttcttgtattattgttgcatatcagcagccagggcct

SEQ ID NO: 401831 - DNA, 140 bp, Artificial Sequence
  Synthetic
atacgccatgctgggtctccaagatactactttaatggaacaatagatggaacaatacaatttcaaccatcctcgggaggggatctagaaattacaacacacacctttaattgtatgggacgtacttgggagtcggccat

SEQ ID NO: 401832 - DNA, 140 bp, Artificial Sequence
  Synthetic
atggccgactcccaagtacgtcccatacaattaaaggtgtgtgttgtaatttctagatcccctcccgaggatggttgaaattgtattgttccatctattgttccattaaagtagtatcttggagacccagcatggcgtat

SEQ ID NO: 401833 - DNA, 140 bp, Artificial Sequence
  Synthetic
aggccctggctgctgatatgccctccaacaatacaagaacaagtatacatataggaccaggacaagtattttatagaacaggagacataacaggaaatataagaaaagcatattgtgagagaccttttgggacagcggtg

SEQ ID NO: 401834 - DNA, 140 bp, Artificial Sequence
  Synthetic
caccgctgtcccaaaaggtctctcacaatatgcttttcttatatttcctgttatgtctcctgttctataaaatacttgtcctggtcctatatgtatacttgttcttgtattgttggagggcatatcagcagccagggcct

SEQ ID NO: 401835 - DNA, 140 bp, Artificial Sequence
  Synthetic
aggccctggctgctgatatgtagaaagtatactgcattcactatacctagtataaataatgagacaccagggattagatatcagtacaatgtgctcccacagggatggaaaggatcaccagaccttttgggacagcggtg

SEQ ID NO: 401836 - DNA, 140 bp, Artificial Sequence
  Synthetic
caccgctgtcccaaaaggtctggtgatcctttccatccctgtgggagcacattgtactgatatctaatccctggtgtctcattatttatactaggtatagtgaatgcagtatactttctacatatcagcagccagggcct

SEQ ID NO: 401837 - DNA, 140 bp, Artificial Sequence
  Synthetic
aggccctggctgctgatatgtcgattagtgaacggattcttagcacttgcctgggacgacctgcggagcctgtgcctcttcagctaccaccaattgagagacttcatattgattgtagcggaccttttgggacagcggtg

SEQ ID NO: 401838 - DNA, 140 bp, Artificial Sequence
  Synthetic
caccgctgtcccaaaaggtccgctacaatcaatatgaagtctctcaattggtggtagctgaagaggcacaggctccgcaggtcgtcccaggcaagtgctaagaatccgttcactaatcgacatatcagcagccagggcct

SEQ ID NO: 401839 - DNA, 140 bp, Artificial Sequence
  Synthetic
aggccctggctgctgatatgtgtgcctcttcagctaccaccaattgagagacttcatattgattgtagcgagagcagtggaacttctgggacagagggggtgggaagctcttaagtatctgaccttttgggacagcggtg

SEQ ID NO: 401840 - DNA, 140 bp, Artificial Sequence
  Synthetic
caccgctgtcccaaaaggtcagatacttaagagcttcccaccccctctgtcccagaagttccactgctctcgctacaatcaatatgaagtctctcaattggtggtagctgaagaggcacacatatcagcagccagggcct

SEQ ID NO: 401841 - DNA, 140 bp, Artificial Sequence
  Synthetic
aggccctggctgctgatatgggaattggaggttttatcaaagtaagacaatatgatcaaatacctatagaaatttgtggaaaaaaggctataggtacagtattagtaggacctacacctggaccttttgggacagcggtg

SEQ ID NO: 401842 - DNA, 140 bp, Artificial Sequence
  Synthetic
caccgctgtcccaaaaggtccaggtgtaggtcctactaatactgtacctatagccttttttccacaaatttctataggtatttgatcatattgtcttactttgataaaacctccaattcccatatcagcagccagggcct

SEQ ID NO: 401843 - DNA, 140 bp, Artificial Sequence
  Synthetic
atacgccatgctgggtctcctgaacatcactaatacaatgaagaaaggagaaataaaaaactgcactttcaaaatcaccacaagcttaaatgataaagtgaaagactctgcacttttttacgtacttgggagtcggccat

SEQ ID NO: 401844 - DNA, 140 bp, Artificial Sequence
  Synthetic
atggccgactcccaagtacgtaaaaaagtgcagagtctttcactttatcatttaagcttgtggtgattttgaaagtgcagttttttatttctcctttcttcattgtattagtgatgttcaggagacccagcatggcgtat

SEQ ID NO: 401845 - DNA, 140 bp, Artificial Sequence
  Synthetic
aggccctggctgctgatatgagtcattgacagaaatagtacctttaagtaaagaagcagagctggaattagaggagaacagagaaaggctaaaagaaccagtacatggtgtatattatcagaccttttgggacagcggtg

SEQ ID NO: 401846 - DNA, 140 bp, Artificial Sequence
  Synthetic
caccgctgtcccaaaaggtctgataatatacaccatgtactggttcttttagcctttctctgttctcctctaattccagctctgcttctttacttaaaggtactatttctgtcaatgactcatatcagcagccagggcct

SEQ ID NO: 401847 - DNA, 140 bp, Artificial Sequence
  Synthetic
atacgccatgctgggtctcctaatattaccaagaataataatgccacgaatgagacaatccctgaggccatgaagggagaactaaaaaattgctctttcaatgtaaccacagtaataagacgtacttgggagtcggccat

SEQ ID NO: 401848 - DNA, 140 bp, Artificial Sequence
  Synthetic
atggccgactcccaagtacgtcttattactgtggttacattgaaagagcaattttttagttctcccttcatggcctcagggattgtctcattcgtggcattattattcttggtaatattaggagacccagcatggcgtat

SEQ ID NO: 401849 - DNA, 140 bp, Artificial Sequence
  Synthetic
atacgccatgctgggtctccatgaaagcagacatccaaaagtaagttcagaagtacacatcccactaggagatgccaccctagtagtaaaaacatattggggcctgcatacaggagaacacgtacttgggagtcggccat

SEQ ID NO: 401850 - DNA, 140 bp, Artificial Sequence
  Synthetic
atggccgactcccaagtacgtgttctcctgtatgcaggccccaatatgtttttactactagggtggcatctcctagtgggatgtgtacttctgaacttacttttggatgtctgctttcatggagacccagcatggcgtat

SEQ ID NO: 401851 - DNA, 140 bp, Artificial Sequence
  Synthetic
aggccctggctgctgatatggctggcattgtcaagtttgctttttgaacaaaggcttaggcatctcctatggcaggaagaagcggaagcaacgacgaggaactcctcagggcagtaaggagaccttttgggacagcggtg

SEQ ID NO: 401852 - DNA, 140 bp, Artificial Sequence
  Synthetic
caccgctgtcccaaaaggtctccttactgccctgaggagttcctcgtcgttgcttccgcttcttcctgccataggagatgcctaagcctttgttcaaaaagcaaacttgacaatgccagccatatcagcagccagggcct

SEQ ID NO: 401853 - DNA, 140 bp, Artificial Sequence
  Synthetic
aggccctggctgctgatatgtggacatatcaaatttaccaagaaccatttaaaaatctgaaaacaggaaagtatgcaaaaatgaggactgcccacactaatgatgtaaaacagttaacaggaccttttgggacagcggtg

SEQ ID NO: 401854 - DNA, 140 bp, Artificial Sequence
  Synthetic
caccgctgtcccaaaaggtcctgttaactgttttacatcattagtgtgggcagtcctcatttttgcatactttcctgttttcagatttttaaatggttcttggtaaatttgatatgtccacatatcagcagccagggcct

SEQ ID NO: 401855 - DNA, 140 bp, Artificial Sequence
  Synthetic
aggccctggctgctgatatgaaagcctaaagccatgtgtaaagctaacccctctctgtgttactctaaactgtactgacattgtctattctaattgtactagaaagcatcccaatggcacgaccttttgggacagcggtg

SEQ ID NO: 401856 - DNA, 140 bp, Artificial Sequence
  Synthetic
caccgctgtcccaaaaggtcgtgccattgggatgctttctagtacaattagaatagacaatgtcagtacagtttagagtaacacagagaggggttagctttacacatggctttaggctttcatatcagcagccagggcct

SEQ ID NO: 401857 - DNA, 140 bp, Artificial Sequence
  Synthetic
aggccctggctgctgatatgtacgcgctcttctataggcctgatgtagtaccaattgatggtaatgataatagtacttatagtgattataggctaataaattgtaatgtctcatctatcagaccttttgggacagcggtg

SEQ ID NO: 401858 - DNA, 140 bp, Artificial Sequence
  Synthetic
caccgctgtcccaaaaggtctgatagatgagacattacaatttattagcctataatcactataagtactattatcattaccatcaattggtactacatcaggcctatagaagagcgcgtacatatcagcagccagggcct

SEQ ID NO: 401859 - DNA, 140 bp, Artificial Sequence
  Synthetic
atacgccatgctgggtctccgctccagctggttttgcgattttaaaatgtggggataagaaagttcaaattggaacagggacttatgtaaccaatgttagtacagtacaatgcacacatgcgtacttgggagtcggccat

SEQ ID NO: 401860 - DNA, 140 bp, Artificial Sequence
  Synthetic
atggccgactcccaagtacgcatgtgtgcattgtactgtactaacattggttacataagtccctgttccaatttgaactttcttatccccacattttaaaatcgcaaaaccagctggagcggagacccagcatggcgtat

SEQ ID NO: 401861 - DNA, 140 bp, Artificial Sequence
  Synthetic
aggccctggctgctgatatgtggaacagggacttatgtaaccaatgttagtacagtacaatgcacacatggaattaagccagtggtatcaacccaactactgctgaatggcagtgtgacagaccttttgggacagcggtg

SEQ ID NO: 401862 - DNA, 140 bp, Artificial Sequence
  Synthetic
caccgctgtcccaaaaggtctgtcacactgccattcagcagtagttgggttgataccactggcttaattccatgtgtgcattgtactgtactaacattggttacataagtccctgttccacatatcagcagccagggcct

SEQ ID NO: 401863 - DNA, 140 bp, Artificial Sequence
  Synthetic
atacgccatgctgggtctcccataatagtacagtttaatgatactgtagaaattaattgtaccagacccggcaacaatacaagaagaagtataagattcggaccaggacaagcattctatcgtacttgggagtcggccat

SEQ ID NO: 401864 - DNA, 140 bp, Artificial Sequence
  Synthetic
atggccgactcccaagtacgatagaatgcttgtcctggtccgaatcttatacttcttcttgtattgttgccgggtctggtacaattaatttctacagtatcattaaactgtactattatgggagacccagcatggcgtat

SEQ ID NO: 401865 - DNA, 140 bp, Artificial Sequence
  Synthetic
aggccctggctgctgatatggcaacaatacaagaagaagtataagattcggaccaggacaagcattctatgcaacaggtgacataataggaaacataagacaagcacattgtattgttaagaccttttgggacagcggtg

SEQ ID NO: 401866 - DNA, 140 bp, Artificial Sequence
  Synthetic
caccgctgtcccaaaaggtcttaacaatacaatgtgcttgtcttatgtttcctattatgtcacctgttgcatagaatgcttgtcctggtccgaatcttatacttcttcttgtattgttgccatatcagcagccagggcct

SEQ ID NO: 401867 - DNA, 140 bp, Artificial Sequence
  Synthetic
atacgccatgctgggtctccaatatagaaaaatattaagacagagaaaaatagacaggttaattgaaagaataagagaaagagcagaagacagtggcaatgagagagtgatggggacactcgtacttgggagtcggccat

SEQ ID NO: 401868 - DNA, 140 bp, Artificial Sequence
  Synthetic
atggccgactcccaagtacgagtgtccccatcactctctcattgccactgtcttctgctctttctcttattctttcaattaacctgtctatttttctctgtcttaatatttttctatattggagacccagcatggcgtat

SEQ ID NO: 401869 - DNA, 140 bp, Artificial Sequence
  Synthetic
atacgccatgctgggtctccaaatctataataagaccataatctttagctcatccgcaggaggggacctagaaattacaacacatagtttcaattgtagaggagaattcttctattgtaacgtacttgggagtcggccat

SEQ ID NO: 401870 - DNA, 140 bp, Artificial Sequence
  Synthetic
atggccgactcccaagtacgttacaatagaagaattctcctctacaattgaaactatgtgttgtaatttctaggtcccctcctgcggatgagctaaagattatggtcttattatagatttggagacccagcatggcgtat

SEQ ID NO: 401871 - DNA, 140 bp, Artificial Sequence
  Synthetic
atacgccatgctgggtctcctccactcccatgtaaataaacaaattgtagaatgtggcagagagtgggacaagcaatgtatgcccctcccatcgaaggagaaattagatgtgacctcaaccgtacttgggagtcggccat

SEQ ID NO: 401872 - DNA, 140 bp, Artificial Sequence
  Synthetic
atggccgactcccaagtacggttgaggtcacatctaatttctccttcgatgggaggggcatacattgcttgtcccactctctgccacattctacaatttgtttatttacatgggagtggaggagacccagcatggcgtat

SEQ ID NO: 401873 - DNA, 140 bp, Artificial Sequence
  Synthetic
atacgccatgctgggtctcctggaaattttaccagtggaaatgttaccaacaatgggcaggaaataaaaaattgctctttcaatgcaaccacagtattaaacgataagaaggagaaaatgcgtacttgggagtcggccat

SEQ ID NO: 401874 - DNA, 140 bp, Artificial Sequence
  Synthetic
atggccgactcccaagtacgcattttctccttcttatcgtttaatactgtggttgcattgaaagagcaattttttatttcctgcccattgttggtaacatttccactggtaaaatttccaggagacccagcatggcgtat

SEQ ID NO: 401875 - DNA, 140 bp, Artificial Sequence
  Synthetic
atacgccatgctgggtctccaccagtaatagtactactaataccagtagtgtgagggagggaggagaaatgaaaaactgctctttcaatatcaccacaagcacaggcgctaaggtgacagcgtacttgggagtcggccat

SEQ ID NO: 401876 - DNA, 140 bp, Artificial Sequence
  Synthetic
atggccgactcccaagtacgctgtcaccttagcgcctgtgcttgtggtgatattgaaagagcagtttttcatttctcctccctccctcacactactggtattagtagtactattactggtggagacccagcatggcgtat

SEQ ID NO: 401877 - DNA, 140 bp, Artificial Sequence
  Synthetic
aggccctggctgctgatatgtgcagcacactcaggaggggacctagaagttacaacccatagctttaattgtggaggagaatttttctattgtaatacatcaggcctgtttaatggtaccgaccttttgggacagcggtg

SEQ ID NO: 401878 - DNA, 140 bp, Artificial Sequence
  Synthetic
caccgctgtcccaaaaggtcggtaccattaaacaggcctgatgtattacaatagaaaaattctcctccacaattaaagctatgggttgtaacttctaggtcccctcctgagtgtgctgcacatatcagcagccagggcct

SEQ ID NO: 401879 - DNA, 140 bp, Artificial Sequence
  Synthetic
aggccctggctgctgatatgccaaataatagaggagctaataaaaaaggaaaaagtctacctgtcatgggtaccagcacacaaggggattggaggaaatgaacaagtagataaattagtcgaccttttgggacagcggtg

SEQ ID NO: 401880 - DNA, 140 bp, Artificial Sequence
  Synthetic
caccgctgtcccaaaaggtcgactaatttatctacttgttcatttcctccaatccccttgtgtgctggtacccatgacaggtagactttttccttttttattagctcctctattatttggcatatcagcagccagggcct

SEQ ID NO: 401881 - DNA, 140 bp, Artificial Sequence
  Synthetic
atacgccatgctgggtctccctggttttgcgattctaaagtgtaataataaaacattcaatggaacaggaccatgtacaaatgtcagtacagtacaatgtacacatggaattaggccagtcgtacttgggagtcggccat

SEQ ID NO: 401882 - DNA, 140 bp, Artificial Sequence
  Synthetic
atggccgactcccaagtacgactggcctaattccatgtgtacattgtactgtactgacatttgtacatggtcctgttccattgaatgttttattattacactttagaatcgcaaaaccagggagacccagcatggcgtat

SEQ ID NO: 401883 - DNA, 140 bp, Artificial Sequence
  Synthetic
aggccctggctgctgatatgataatacaagaaaaagtataaggataggaccaggacaaacattctatgcaacaggagatataataggagatataagacaagcacattgtaacattagtaagaccttttgggacagcggtg

SEQ ID NO: 401884 - DNA, 140 bp, Artificial Sequence
  Synthetic
caccgctgtcccaaaaggtcttactaatgttacaatgtgcttgtcttatatctcctattatatctcctgttgcatagaatgtttgtcctggtcctatccttatactttttcttgtattatcatatcagcagccagggcct

SEQ ID NO: 401885 - DNA, 140 bp, Artificial Sequence
  Synthetic
aggccctggctgctgatatgcaagcagtaaggatcatcaaaatcctctatcaaagcagtaagtatatgtaatgttggatttactagcaagagtagattatagattaggagtaggagcactgaccttttgggacagcggtg

SEQ ID NO: 401886 - DNA, 140 bp, Artificial Sequence
  Synthetic
caccgctgtcccaaaaggtcagtgctcctactcctaatctataatctactcttgctagtaaatccaacattacatatacttactgctttgatagaggattttgatgatccttactgcttgcatatcagcagccagggcct

SEQ ID NO: 401887 - DNA, 140 bp, Artificial Sequence
  Synthetic
atacgccatgctgggtctcctagtacctgggaaatgatggagaaaggagaaataaaaaattgctctttcaatgtcaccacaaacatgagagataagttacagaaagtatatgcactctttcgtacttgggagtcggccat

SEQ ID NO: 401888 - DNA, 140 bp, Artificial Sequence
  Synthetic
atggccgactcccaagtacgaaagagtgcatatactttctgtaacttatctctcatgtttgtggtgacattgaaagagcaattttttatttctcctttctccatcatttcccaggtactaggagacccagcatggcgtat

SEQ ID NO: 401889 - DNA, 140 bp, Artificial Sequence
  Synthetic
atacgccatgctgggtctcctgatagcatgaatggagaaataaaaaattgctctttcaatacaaccacagaaataagagataagaaacagcaagcatatgcacttttttatagatctgatcgtacttgggagtcggccat

SEQ ID NO: 401890 - DNA, 140 bp, Artificial Sequence
  Synthetic
atggccgactcccaagtacgatcagatctataaaaaagtgcatatgcttgctgtttcttatctcttatttctgtggttgtattgaaagagcaattttttatttctccattcatgctatcaggagacccagcatggcgtat

SEQ ID NO: 401891 - DNA, 140 bp, Artificial Sequence
  Synthetic
atacgccatgctgggtctccgaattaatggcacaatcatactcccatgcagaataaaacaaattgctatcttgcggttggaagtaggtaaagcaatgtatgccccccccccaattaaacacgtacttgggagtcggccat

SEQ ID NO: 401892 - DNA, 140 bp, Artificial Sequence
  Synthetic
atggccgactcccaagtacgtgtttaattggggggggggcatacattgctttacctacttccaaccgcaagatagcaatttgttttattctgcatgggagtatgattgtgccattaattcggagacccagcatggcgtat

SEQ ID NO: 401893 - DNA, 140 bp, Artificial Sequence
  Synthetic
atacgccatgctgggtctccaaagaaaaaattaaaggaacactattactactccaataaaacaataacatttgcaccatcctcaggaggggatctagaagttacaacacatttctttaatcgtacttgggagtcggccat

SEQ ID NO: 401894 - DNA, 140 bp, Artificial Sequence
  Synthetic
atggccgactcccaagtacgattaaagaaatgtgttgtaacttctagatcccctcctgaggatggtgcaaatgttattgttttattggagtagtaatagtgttcctttaattttttctttggagacccagcatggcgtat

SEQ ID NO: 401895 - DNA, 140 bp, Artificial Sequence
  Synthetic
aggccctggctgctgatatggctcctggggatttggggttgctctggaaaactcatctgcaccactgctgtgccctggaataaaacttggagtaagaataaaactctgagtcagatctgggaccttttgggacagcggtg

SEQ ID NO: 401896 - DNA, 140 bp, Artificial Sequence
  Synthetic
caccgctgtcccaaaaggtcccagatctgactcagagttttattcttactccaagttttattccagggcacagcagtggtgcagatgagttttccagagcaaccccaaatccccaggagccatatcagcagccagggcct

SEQ ID NO: 401897 - DNA, 140 bp, Artificial Sequence
  Synthetic
aggccctggctgctgatatggaaatataacagatgaagtaaaaaactgttcttttaatataaccacagaaataagagataagaagcagaaggtctatgcacttttttatagggttgatatgaccttttgggacagcggtg

SEQ ID NO: 401898 - DNA, 140 bp, Artificial Sequence
  Synthetic
caccgctgtcccaaaaggtcatatcaaccctataaaaaagtgcatagaccttctgcttcttatctcttatttctgtggttatattaaaagaacagttttttacttcatctgttatatttccatatcagcagccagggcct

SEQ ID NO: 401899 - DNA, 140 bp, Artificial Sequence
  Synthetic
atacgccatgctgggtctccacaaggtttggaagcagccttgctataaaatggggggcaagtgttcaaaattagctggatggtctgctgtaagagaaagaataagacagactgagcctgccgtacttgggagtcggccat

SEQ ID NO: 401900 - DNA, 140 bp, Artificial Sequence
  Synthetic
atggccgactcccaagtacggcaggctcagtctgtcttattctttctcttacagcagaccatccagctaattttgaacacttgccccccattttatagcaaggctgcttccaaaccttgtggagacccagcatggcgtat

SEQ ID NO: 401901 - DNA, 140 bp, Artificial Sequence
  Synthetic
atacgccatgctgggtctccgaggggacagataggattttagaagggttacaaagagcttttagagctattatacacatacctagaagaataagacagggcgcggaaagggccttgcaatcgtacttgggagtcggccat

SEQ ID NO: 401902 - DNA, 140 bp, Artificial Sequence
  Synthetic
atggccgactcccaagtacgattgcaaggccctttccgcgccctgtcttattcttctaggtatgtgtataatagctctaaaagctctttgtaacccttctaaaatcctatctgtcccctcggagacccagcatggcgtat

SEQ ID NO: 401903 - DNA, 140 bp, Artificial Sequence
  Synthetic
atacgccatgctgggtctccaactttaaaacaggtaacaagaaaattaagagagcaccttaatgggacaatgacaataagctttcgaccatcctcaggaggagatccagaaatcacaatgcgtacttgggagtcggccat

SEQ ID NO: 401904 - DNA, 140 bp, Artificial Sequence
  Synthetic
atggccgactcccaagtacgcattgtgatttctggatctcctcctgaggatggtcgaaagcttattgtcattgtcccattaaggtgctctcttaattttcttgttacctgttttaaagttggagacccagcatggcgtat

SEQ ID NO: 401905 - DNA, 140 bp, Artificial Sequence
  Synthetic
aggccctggctgctgatatgtgacaataagctttcgaccatcctcaggaggagatccagaaatcacaatgcatcattttaattgtagaggggaatttttctattgcaatacaacagcactgaccttttgggacagcggtg

SEQ ID NO: 401906 - DNA, 140 bp, Artificial Sequence
  Synthetic
caccgctgtcccaaaaggtcagtgctgttgtattgcaatagaaaaattcccctctacaattaaaatgatgcattgtgatttctggatctcctcctgaggatggtcgaaagcttattgtcacatatcagcagccagggcct

SEQ ID NO: 401907 - DNA, 140 bp, Artificial Sequence
  Synthetic
aggccctggctgctgatatgcatagcaggaactactagtacccttcaggaacaaataacatggatgacaaataacccacctattccagtgggggacatctataaaagatggataattctggaccttttgggacagcggtg

SEQ ID NO: 401908 - DNA, 140 bp, Artificial Sequence
  Synthetic
caccgctgtcccaaaaggtccagaattatccatcttttatagatgtcccccactggaataggtgggttatttgtcatccatgttatttgttcctgaagggtactagtagttcctgctatgcatatcagcagccagggcct

SEQ ID NO: 401909 - DNA, 140 bp, Artificial Sequence
  Synthetic
aggccctggctgctgatatgagtctttaatcaatcctcaggaggggacccagaaattgtaatgcacaattttaattgtggaggagaatttttctactgtaatacatcaaaactgtttaatgaccttttgggacagcggtg

SEQ ID NO: 401910 - DNA, 140 bp, Artificial Sequence
  Synthetic
caccgctgtcccaaaaggtcattaaacagttttgatgtattacagtagaaaaattctcctccacaattaaaattgtgcattacaatttctgggtcccctcctgaggattgattaaagactcatatcagcagccagggcct

SEQ ID NO: 401911 - DNA, 140 bp, Artificial Sequence
  Synthetic
aggccctggctgctgatatgaaaaaattcggttacggccagggggaaagaaaaaatataagctaaaacatttagtatgggcaagcagagagttagaaagattcgcacttaaccctggcctgaccttttgggacagcggtg

SEQ ID NO: 401912 - DNA, 140 bp, Artificial Sequence
  Synthetic
caccgctgtcccaaaaggtcaggccagggttaagtgcgaatctttctaactctctgcttgcccatactaaatgttttagcttatattttttctttccccctggccgtaaccgaattttttcatatcagcagccagggcct

SEQ ID NO: 401913 - DNA, 140 bp, Artificial Sequence
  Synthetic
aggccctggctgctgatatgtttgcaataaaatggggggcaagtgttcaaaatatagcagatggcctgagataagagagagaatgacgagactagaactgagccagcagcagatggggtggaccttttgggacagcggtg

SEQ ID NO: 401914 - DNA, 140 bp, Artificial Sequence
  Synthetic
caccgctgtcccaaaaggtccaccccatctgctgctggctcagttctagtctcgtcattctctctcttatctcaggccatctgctatattttgaacacttgccccccattttattgcaaacatatcagcagccagggcct

SEQ ID NO: 401915 - DNA, 140 bp, Artificial Sequence
  Synthetic
aggccctggctgctgatatgagcagaagacagtggaaatgagagtgaaggggatacagacgaattggcagcacttgtggaaatgggggactttgatccttgggttggtgataatttgtaggaccttttgggacagcggtg

SEQ ID NO: 401916 - DNA, 140 bp, Artificial Sequence
  Synthetic
caccgctgtcccaaaaggtcctacaaattatcaccaacccaaggatcaaagtcccccatttccacaagtgctgccaattcgtctgtatccccttcactctcatttccactgtcttctgctcatatcagcagccagggcct

SEQ ID NO: 401917 - DNA, 140 bp, Artificial Sequence
  Synthetic
aggccctggctgctgatatgttgtgtgtacaagacccaacaataatacaagaaaaagtataaggataggaccaggacaaacattctatgcagcaggagacataataggaaacataagacagaccttttgggacagcggtg

SEQ ID NO: 401918 - DNA, 140 bp, Artificial Sequence
  Synthetic
caccgctgtcccaaaaggtctgtcttatgtttcctattatgtctcctgctgcatagaatgtttgtcctggtcctatccttatactttttcttgtattattgttgggtcttgtacacacaacatatcagcagccagggcct

SEQ ID NO: 401919 - DNA, 140 bp, Artificial Sequence
  Synthetic
aggccctggctgctgatatgccacactcaggaggggatccagaaattacaacacatagctttaattgtagaggagaatttttctattgcaatacatcactactgtttaatagcagttatagaccttttgggacagcggtg

SEQ ID NO: 401920 - DNA, 140 bp, Artificial Sequence
  Synthetic
caccgctgtcccaaaaggtctataactgctattaaacagtagtgatgtattgcaatagaaaaattctcctctacaattaaagctatgtgttgtaatttctggatcccctcctgagtgtggcatatcagcagccagggcct

SEQ ID NO: 401921 - DNA, 140 bp, Artificial Sequence
  Synthetic
aggccctggctgctgatatgttgaagaatcgcagaaccagcaggaaaagaatgaacaagaattattggcattggacaaatgggcaagtttgtggagttggtttgacataacaaaatggctgaccttttgggacagcggtg

SEQ ID NO: 401922 - DNA, 140 bp, Artificial Sequence
  Synthetic
caccgctgtcccaaaaggtcagccattttgttatgtcaaaccaactccacaaacttgcccatttgtccaatgccaataattcttgttcattcttttcctgctggttctgcgattcttcaacatatcagcagccagggcct

SEQ ID NO: 401923 - DNA, 140 bp, Artificial Sequence
  Synthetic
aggccctggctgctgatatgcaatgcagaataaaacaagttataaacatgtggcagagggtaggacaagcaatatatgcccctcccattgaaggaataataacatgtaactcaagtatcagaccttttgggacagcggtg

SEQ ID NO: 401924 - DNA, 140 bp, Artificial Sequence
  Synthetic
caccgctgtcccaaaaggtctgatacttgagttacatgttattattccttcaatgggaggggcatatattgcttgtcctaccctctgccacatgtttataacttgttttattctgcattgcatatcagcagccagggcct

SEQ ID NO: 401925 - DNA, 140 bp, Artificial Sequence
  Synthetic
aggccctggctgctgatatgctgtgcctcttcagctaccaccgcttgagagactttgccttgattgcagcgaggacagtggaacttctgggacgcagcagtctcaagggactgagactgggaccttttgggacagcggtg

SEQ ID NO: 401926 - DNA, 140 bp, Artificial Sequence
  Synthetic
caccgctgtcccaaaaggtcccagtctcagtcccttgagactgctgcgtcccagaagttccactgtcctcgctgcaatcaaggcaaagtctctcaagcggtggtagctgaagaggcacagcatatcagcagccagggcct

SEQ ID NO: 401927 - DNA, 140 bp, Artificial Sequence
  Synthetic
aggccctggctgctgatatgccatgcaataatgtcagcactgtacaatgtacacatggaattaagccagtagtatcaactcaactactgttaaatggtagcctagcagaaggaggagagagaccttttgggacagcggtg

SEQ ID NO: 401928 - DNA, 140 bp, Artificial Sequence
  Synthetic
caccgctgtcccaaaaggtctctctcctccttctgctaggctaccatttaacagtagttgagttgatactactggcttaattccatgtgtacattgtacagtgctgacattattgcatggcatatcagcagccagggcct

SEQ ID NO: 401929 - DNA, 140 bp, Artificial Sequence
  Synthetic
aggccctggctgctgatatgttcctatggcaagaagaagcggcgacagcgacgaagcgctcctctgcgcagtgcagatcatcaagatcttatatcaaagcagtaagtatatgtaatgctagaccttttgggacagcggtg

SEQ ID NO: 401930 - DNA, 140 bp, Artificial Sequence
  Synthetic
caccgctgtcccaaaaggtctagcattacatatacttactgctttgatataagatcttgatgatctgcactgcgcagaggagcgcttcgtcgctgtcgccgcttcttcttgccataggaacatatcagcagccagggcct

SEQ ID NO: 401931 - DNA, 140 bp, Artificial Sequence
  Synthetic
atacgccatgctgggtctccataactacagaactaagagacaaaagtaagaaagagtacgcgctcttctataggcctgatgtagtaccaattgatggtaatgataatagtacttatagtgcgtacttgggagtcggccat

SEQ ID NO: 401932 - DNA, 140 bp, Artificial Sequence
  Synthetic
atggccgactcccaagtacgcactataagtactattatcattaccatcaattggtactacatcaggcctatagaagagcgcgtactctttcttacttttgtctcttagttctgtagttatggagacccagcatggcgtat

SEQ ID NO: 401933 - DNA, 140 bp, Artificial Sequence
  Synthetic
atacgccatgctgggtctccaaacaaattgtaagaatgtggcagagagtgggacaagcaatgtatgcccctcccatcgaaggagaaattagatgtgactcaacaattacaggactaatatcgtacttgggagtcggccat

SEQ ID NO: 401934 - DNA, 140 bp, Artificial Sequence
  Synthetic
atggccgactcccaagtacgatattagtcctgtaattgttgagtcacatctaatttctccttcgatgggaggggcatacattgcttgtcccactctctgccacattcttacaatttgtttggagacccagcatggcgtat

SEQ ID NO: 401935 - DNA, 140 bp, Artificial Sequence
  Synthetic
aggccctggctgctgatatgaggagttggccaaacttgtggaaatgggggactttgatccttgggttggtgataatgtgtagtgcctcagacaacttgtgggttacagtttattatgggggaccttttgggacagcggtg

SEQ ID NO: 401936 - DNA, 140 bp, Artificial Sequence
  Synthetic
caccgctgtcccaaaaggtcccccataataaactgtaacccacaagttgtctgaggcactacacattatcaccaacccaaggatcaaagtcccccatttccacaagtttggccaactcctcatatcagcagccagggcct

SEQ ID NO: 401937 - DNA, 140 bp, Artificial Sequence
  Synthetic
aggccctggctgctgatatgcgacctgaggagcctgtgcctcttcagctaccaccgcttgagagacttactcttgattgtaacgaggattgtggaacttctgggacgcagggggtgggaagaccttttgggacagcggtg

SEQ ID NO: 401938 - DNA, 140 bp, Artificial Sequence
  Synthetic
caccgctgtcccaaaaggtcttcccaccccctgcgtcccagaagttccacaatcctcgttacaatcaagagtaagtctctcaagcggtggtagctgaagaggcacaggctcctcaggtcgcatatcagcagccagggcct

SEQ ID NO: 401939 - DNA, 140 bp, Artificial Sequence
  Synthetic
atacgccatgctgggtctccatatgtcagataacacagtaggaaatatgtcaaatgaggtaagaaactgttcttttaatatgaccacagaaataagggataggaagcaacaggtctatgccgtacttgggagtcggccat

SEQ ID NO: 401940 - DNA, 140 bp, Artificial Sequence
  Synthetic
atggccgactcccaagtacggcatagacctgttgcttcctatcccttatttctgtggtcatattaaaagaacagtttcttacctcatttgacatatttcctactgtgttatctgacatatggagacccagcatggcgtat

SEQ ID NO: 401941 - DNA, 140 bp, Artificial Sequence
  Synthetic
atacgccatgctgggtctccggacagatagggttatagaagtaatacaaagaggatttagagcttttctgcacatacctgcaagaataagacagggcttggaaagggctttgctataaaacgtacttgggagtcggccat

SEQ ID NO: 401942 - DNA, 140 bp, Artificial Sequence
  Synthetic
atggccgactcccaagtacgttttatagcaaagccctttccaagccctgtcttattcttgcaggtatgtgcagaaaagctctaaatcctctttgtattacttctataaccctatctgtccggagacccagcatggcgtat

SEQ ID NO: 401943 - DNA, 140 bp, Artificial Sequence
  Synthetic
aggccctggctgctgatatgcacatacctgcaagaataagacagggcttggaaagggctttgctataaaatgggtggcaagtggtcaaaaagcagtatatgtggatggcctgctgtaagggaccttttgggacagcggtg

SEQ ID NO: 401944 - DNA, 140 bp, Artificial Sequence
  Synthetic
caccgctgtcccaaaaggtcccttacagcaggccatccacatatactgctttttgaccacttgccacccattttatagcaaagccctttccaagccctgtcttattcttgcaggtatgtgcatatcagcagccagggcct

SEQ ID NO: 401945 - DNA, 140 bp, Artificial Sequence
  Synthetic
aggccctggctgctgatatgagcaggaaaagaatgaacaagaattattggcattggacaaatgggcaagtttgtggagttggtttgacataacaaaatggctatggtatataaaaatattgaccttttgggacagcggtg

SEQ ID NO: 401946 - DNA, 140 bp, Artificial Sequence
  Synthetic
caccgctgtcccaaaaggtcaatatttttatataccatagccattttgttatgtcaaaccaactccacaaacttgcccatttgtccaatgccaataattcttgttcattcttttcctgctcatatcagcagccagggcct

SEQ ID NO: 401947 - DNA, 140 bp, Artificial Sequence
  Synthetic
aggccctggctgctgatatgatgtcagctcagtacaatgcacacatggaattaagccagtggtatcaactcaattgctgttaaatggcagtctagcagaagaagagataataatcagatcgaccttttgggacagcggtg

SEQ ID NO: 401948 - DNA, 140 bp, Artificial Sequence
  Synthetic
caccgctgtcccaaaaggtcgatctgattattatctcttcttctgctagactgccatttaacagcaattgagttgataccactggcttaattccatgtgtgcattgtactgagctgacatcatatcagcagccagggcct

SEQ ID NO: 401949 - DNA, 140 bp, Artificial Sequence
  Synthetic
aggccctggctgctgatatgataatctttgcaccaccctcaggaggagatatagaaattacaatgcatcactttaattgtaaaggggaatttttctattgcaatacatcagaactgtttagaccttttgggacagcggtg

SEQ ID NO: 401950 - DNA, 140 bp, Artificial Sequence
  Synthetic
caccgctgtcccaaaaggtctaaacagttctgatgtattgcaatagaaaaattcccctttacaattaaagtgatgcattgtaatttctatatctcctcctgagggtggtgcaaagattatcatatcagcagccagggcct

SEQ ID NO: 401951 - DNA, 140 bp, Artificial Sequence
  Synthetic
atacgccatgctgggtctccgtggtcaaaaagaagcataagggaatggcctaaggtgagggaacagataagacaagcccctgcagcagcagaaggagtaggagcagcatcccaagatttacgtacttgggagtcggccat

SEQ ID NO: 401952 - DNA, 140 bp, Artificial Sequence
  Synthetic
atggccgactcccaagtacgtaaatcttgggatgctgctcctactccttctgctgctgcaggggcttgtcttatctgttccctcaccttaggccattcccttatgcttctttttgaccacggagacccagcatggcgtat

SEQ ID NO: 401953 - DNA, 140 bp, Artificial Sequence
  Synthetic
atacgccatgctgggtctcctataatgaaggaaggagaaataaaaaactgcactttcaaaatcagcacaagcttacaagataaagtgaaagactatgcacttttttatacacttgatatacgtacttgggagtcggccat

SEQ ID NO: 401954 - DNA, 140 bp, Artificial Sequence
  Synthetic
atggccgactcccaagtacgtatatcaagtgtataaaaaagtgcatagtctttcactttatcttgtaagcttgtgctgattttgaaagtgcagttttttatttctccttccttcattataggagacccagcatggcgtat

SEQ ID NO: 401955 - DNA, 140 bp, Artificial Sequence
  Synthetic
atacgccatgctgggtctccacttctgggacacagggggtgggaactcctcaaatatctggggaacctcctgctgtattggggccaggaactaaagaatagtgctgttagcttgctcaaccgtacttgggagtcggccat

SEQ ID NO: 401956 - DNA, 140 bp, Artificial Sequence
  Synthetic
atggccgactcccaagtacggttgagcaagctaacagcactattctttagttcctggccccaatacagcaggaggttccccagatatttgaggagttcccaccccctgtgtcccagaagtggagacccagcatggcgtat

SEQ ID NO: 401957 - DNA, 140 bp, Artificial Sequence
  Synthetic
atacgccatgctgggtctccatttaggaccagggagagcatggtttacaacaggacaaataataggagatataagagcagcacattgtaaccttagtaccacaaaatggaataacacattcgtacttgggagtcggccat

SEQ ID NO: 401958 - DNA, 140 bp, Artificial Sequence
  Synthetic
atggccgactcccaagtacgaatgtgttattccattttgtggtactaaggttacaatgtgctgctcttatatctcctattatttgtcctgttgtaaaccatgctctccctggtcctaaatggagacccagcatggcgtat

SEQ ID NO: 401959 - DNA, 140 bp, Artificial Sequence
  Synthetic
atacgccatgctgggtctcctggatggcctgctataagggaaagaatgaggcgagctgcaccaccagcagagccagcagcaattggggtgggagcagcatctcaagatctagataaacatcgtacttgggagtcggccat

SEQ ID NO: 401960 - DNA, 140 bp, Artificial Sequence
  Synthetic
atggccgactcccaagtacgatgtttatctagatcttgagatgctgctcccaccccaattgctgctggctctgctggtggtgcagctcgcctcattctttcccttatagcaggccatccaggagacccagcatggcgtat

SEQ ID NO: 401961 - DNA, 140 bp, Artificial Sequence
  Synthetic
aggccctggctgctgatatgaggaccaggagctacactagaagaaatgatgacagcatgtcagggagtgggaggacccagccataaagcaagagttttagctgaggcaatgagccaggcagaccttttgggacagcggtg

SEQ ID NO: 401962 - DNA, 140 bp, Artificial Sequence
  Synthetic
caccgctgtcccaaaaggtctgcctggctcattgcctcagctaaaactcttgctttatggctgggtcctcccactccctgacatgctgtcatcatttcttctagtgtagctcctggtcctcatatcagcagccagggcct

SEQ ID NO: 401963 - DNA, 140 bp, Artificial Sequence
  Synthetic
aggccctggctgctgatatgttgatgatctgtagtgctgcagaaaacttgtgggtcacagtttattatggggtacctgtatggaaagaagcaaacaccactctattttgtgcatcagatggaccttttgggacagcggtg

SEQ ID NO: 401964 - DNA, 140 bp, Artificial Sequence
  Synthetic
caccgctgtcccaaaaggtccatctgatgcacaaaatagagtggtgtttgcttctttccatacaggtaccccataataaactgtgacccacaagttttctgcagcactacagatcatcaacatatcagcagccagggcct

SEQ ID NO: 401965 - DNA, 140 bp, Artificial Sequence
  Synthetic
aggccctggctgctgatatgtgaaaatccatacaatactccagtatttgccataaagaaaaaagacagtactaaatggagaaaattagtagatttcagagaacttaataagagaactcaagaccttttgggacagcggtg

SEQ ID NO: 401966 - DNA, 140 bp, Artificial Sequence
  Synthetic
caccgctgtcccaaaaggtcttgagttctcttattaagttctctgaaatctactaattttctccatttagtactgtcttttttctttatggcaaatactggagtattgtatggattttcacatatcagcagccagggcct

SEQ ID NO: 401967 - DNA, 140 bp, Artificial Sequence
  Synthetic
aggccctggctgctgatatgctctcaagacaggatcagaagaacttaaatcattatttaatacaatagtaaccctctggtgcgtacaccaaaggatagaaataaaagacaccaaggaagcgaccttttgggacagcggtg

SEQ ID NO: 401968 - DNA, 140 bp, Artificial Sequence
  Synthetic
caccgctgtcccaaaaggtcgcttccttggtgtcttttatttctatcctttggtgtacgcaccagagggttactattgtattaaataatgatttaagttcttctgatcctgtcttgagagcatatcagcagccagggcct

SEQ ID NO: 401969 - DNA, 140 bp, Artificial Sequence
  Synthetic
atacgccatgctgggtctccctctgtgtcactttagaatgtagagaggctatcattaatggtacggttctctacaatgggacccacaaagagatcaaaaattgctctttcaatacaaccacgtacttgggagtcggccat

SEQ ID NO: 401970 - DNA, 140 bp, Artificial Sequence
  Synthetic
atggccgactcccaagtacgtggttgtattgaaagagcaatttttgatctctttgtgggtcccattgtagagaaccgtaccattaatgatagcctctctacattctaaagtgacacagagggagacccagcatggcgtat

SEQ ID NO: 401971 - DNA, 140 bp, Artificial Sequence
  Synthetic
atacgccatgctgggtctcccaggtttagcaatgctattcttgaagattctaagtgcagcaagaagcactataggcgcagcagcaacagcgctgacagtacagacccagcatctgataaacgtacttgggagtcggccat

SEQ ID NO: 401972 - DNA, 140 bp, Artificial Sequence
  Synthetic
atggccgactcccaagtacgtttatcagatgctgggtctgtactgtcagcgctgttgctgctgcgcctatagtgcttcttgctgcacttagaatcttcaagaatagcattgctaaacctgggagacccagcatggcgtat

SEQ ID NO: 401973 - DNA, 140 bp, Artificial Sequence
  Synthetic
aggccctggctgctgatatgcatgcagaataaagcaaattataaacatgtggcagggggtaggacgagcaatgtatgcccctcccattgaaggaaacataacatgtaaatcaaatatcacgaccttttgggacagcggtg

SEQ ID NO: 401974 - DNA, 140 bp, Artificial Sequence
  Synthetic
caccgctgtcccaaaaggtcgtgatatttgatttacatgttatgtttccttcaatgggaggggcatacattgctcgtcctaccccctgccacatgtttataatttgctttattctgcatgcatatcagcagccagggcct

SEQ ID NO: 401975 - DNA, 140 bp, Artificial Sequence
  Synthetic
aggccctggctgctgatatgagaaagaatgagaagaactgagccagcagcagatggggtgggagcagtatctcaagacctggaaaaacatggagcaatcacaagtagcaatacagatactgaccttttgggacagcggtg

SEQ ID NO: 401976 - DNA, 140 bp, Artificial Sequence
  Synthetic
caccgctgtcccaaaaggtcagtatctgtattgctacttgtgattgctccatgtttttccaggtcttgagatactgctcccaccccatctgctgctggctcagttcttctcattctttctcatatcagcagccagggcct

SEQ ID NO: 401977 - DNA, 140 bp, Artificial Sequence
  Synthetic
aggccctggctgctgatatgataggcattatacgacaaagaagagcaagaaatggagccagtagatcctaaactagagccctggaaccatccaggaagtcaacctaaaaccccttgtaatgaccttttgggacagcggtg

SEQ ID NO: 401978 - DNA, 140 bp, Artificial Sequence
  Synthetic
caccgctgtcccaaaaggtcattacaaggggttttaggttgacttcctggatggttccagggctctagtttaggatctactggctccatttcttgctcttctttgtcgtataatgcctatcatatcagcagccagggcct

SEQ ID NO: 401979 - DNA, 140 bp, Artificial Sequence
  Synthetic
aggccctggctgctgatatgaaaaggcttaggcatttcctatggcaggaagaagcgaggaccgcgacgacgcactcctccaagcaataaggaccatcaagatcttataccaaagcagtaagaccttttgggacagcggtg

SEQ ID NO: 401980 - DNA, 140 bp, Artificial Sequence
  Synthetic
caccgctgtcccaaaaggtcttactgctttggtataagatcttgatggtccttattgcttggaggagtgcgtcgtcgcggtcctcgcttcttcctgccataggaaatgcctaagccttttcatatcagcagccagggcct

SEQ ID NO: 401981 - DNA, 140 bp, Artificial Sequence
  Synthetic
aggccctggctgctgatatggcactcctccaagcaataaggaccatcaagatcttataccaaagcagtaagtatatgtaatgctgaatttactagaaaaagtagattatagaatagcagtgaccttttgggacagcggtg

SEQ ID NO: 401982 - DNA, 140 bp, Artificial Sequence
  Synthetic
caccgctgtcccaaaaggtcactgctattctataatctactttttctagtaaattcagcattacatatacttactgctttggtataagatcttgatggtccttattgcttggaggagtgccatatcagcagccagggcct

SEQ ID NO: 401983 - DNA, 140 bp, Artificial Sequence
  Synthetic
aggccctggctgctgatatgcttctgggacgcagggggtgggaagccctcagatattggtggaatctcctacaatattggattcaggaactaaagaatagtgctgttagtttgctcaatagaccttttgggacagcggtg

SEQ ID NO: 401984 - DNA, 140 bp, Artificial Sequence
  Synthetic
caccgctgtcccaaaaggtctattgagcaaactaacagcactattctttagttcctgaatccaatattgtaggagattccaccaatatctgagggcttcccaccccctgcgtcccagaagcatatcagcagccagggcct

SEQ ID NO: 401985 - DNA, 140 bp, Artificial Sequence
  Synthetic
atacgccatgctgggtctccaaatgaattgcacaaacgtaaacgacacaacaaacgcaacagcggccagcagcgcagtgaaaaagtgtgagtttaatgtaaccacagttctcaaagacaacgtacttgggagtcggccat

SEQ ID NO: 401986 - DNA, 140 bp, Artificial Sequence
  Synthetic
atggccgactcccaagtacgttgtctttgagaactgtggttacattaaactcacactttttcactgcgctgctggccgctgttgcgtttgttgtgtcgtttacgtttgtgcaattcatttggagacccagcatggcgtat

SEQ ID NO: 401987 - DNA, 140 bp, Artificial Sequence
  Synthetic
atacgccatgctgggtctcctgttactgtgaatggtactgctgctgaagaaatgaaaaattgctctttcaatgtgaccacagaactaagagataagaaacggaacgtgtatgcactttttcgtacttgggagtcggccat

SEQ ID NO: 401988 - DNA, 140 bp, Artificial Sequence
  Synthetic
atggccgactcccaagtacgaaaaagtgcatacacgttccgtttcttatctcttagttctgtggtcacattgaaagagcaatttttcatttcttcagcagcagtaccattcacagtaacaggagacccagcatggcgtat

SEQ ID NO: 401989 - DNA, 140 bp, Artificial Sequence
  Synthetic
aggccctggctgctgatatgaccaaaaaggagaaagccacctttgcctagtgttaggaaactgacagaggatagatggaacaagccccagaagaccaagggccacagagggagccacacagaccttttgggacagcggtg

SEQ ID NO: 401990 - DNA, 140 bp, Artificial Sequence
  Synthetic
caccgctgtcccaaaaggtctgtgtggctccctctgtggcccttggtcttctggggcttgttccatctatcctctgtcagtttcctaacactaggcaaaggtggctttctcctttttggtcatatcagcagccagggcct

SEQ ID NO: 401991 - DNA, 140 bp, Artificial Sequence
  Synthetic
atacgccatgctgggtctcctataacctttgaacaatcctcaggaggagacctagaaattacaacacatagctttaattgtggaggagagtttttctattgcaatacatcaggcctgtttcgtacttgggagtcggccat

SEQ ID NO: 401992 - DNA, 140 bp, Artificial Sequence
  Synthetic
atggccgactcccaagtacgaaacaggcctgatgtattgcaatagaaaaactctcctccacaattaaagctatgtgttgtaatttctaggtctcctcctgaggattgttcaaaggttataggagacccagcatggcgtat

SEQ ID NO: 401993 - DNA, 140 bp, Artificial Sequence
  Synthetic
aggccctggctgctgatatgaacaaaggcttaggcatctcctatggcaggaagaagcggagaccccgacgaggaactcctcagggcagtaaggatcatcaaaaccctgtaccaaagcagtgaccttttgggacagcggtg

SEQ ID NO: 401994 - DNA, 140 bp, Artificial Sequence
  Synthetic
caccgctgtcccaaaaggtcactgctttggtacagggttttgatgatccttactgccctgaggagttcctcgtcggggtctccgcttcttcctgccataggagatgcctaagcctttgttcatatcagcagccagggcct

SEQ ID NO: 401995 - DNA, 140 bp, Artificial Sequence
  Synthetic
atacgccatgctgggtctccctttcaatattaccacagagataagagatagggtgcaagaagaatatgcacttttttataaacttgatgtagtaccaatagataataaagatagtagtagcgtacttgggagtcggccat

SEQ ID NO: 401996 - DNA, 140 bp, Artificial Sequence
  Synthetic
atggccgactcccaagtacgctactactatctttattatctattggtactacatcaagtttataaaaaagtgcatattcttcttgcaccctatctcttatctctgtggtaatattgaaagggagacccagcatggcgtat

SEQ ID NO: 401997 - DNA, 140 bp, Artificial Sequence
  Synthetic
atacgccatgctgggtctccggaaaggtgaaggggcagtagtaatacaagataatagtgaaataaaagtagtaccaagaagaaaagcaaagatcattagggattatggaaaacagatggccgtacttgggagtcggccat

SEQ ID NO: 401998 - DNA, 140 bp, Artificial Sequence
  Synthetic
atggccgactcccaagtacggccatctgttttccataatccctaatgatctttgcttttcttcttggtactacttttatttcactattatcttgtattactactgccccttcacctttccggagacccagcatggcgtat

SEQ ID NO: 401999 - DNA, 140 bp, Artificial Sequence
  Synthetic
aggccctggctgctgatatgtgtgcttcagatgctaaagcccatagtacagaggctcacaacatctgggccacacaagcatgtgttcccactgatcccaatccacaagaagtgccattaagaccttttgggacagcggtg

SEQ ID NO: 402000 - DNA, 140 bp, Artificial Sequence
  Synthetic
caccgctgtcccaaaaggtcttaatggcacttcttgtggattgggatcagtgggaacacatgcttgtgtggcccagatgttgtgagcctctgtactatgggctttagcatctgaagcacacatatcagcagccagggcct

SEQ ID NO: 402001 - DNA, 140 bp, Artificial Sequence
  Synthetic
aggccctggctgctgatatgatttttctattgcaatacatcagaactgtttaactatacatactcacctaatagtacagaaagtaattcaaccatcacactcccatgcagaataaaacaagaccttttgggacagcggtg

SEQ ID NO: 402002 - DNA, 140 bp, Artificial Sequence
  Synthetic
caccgctgtcccaaaaggtcttgttttattctgcatgggagtgtgatggttgaattactttctgtactattaggtgagtatgtatagttaaacagttctgatgtattgcaatagaaaaatcatatcagcagccagggcct

SEQ ID NO: 402003 - DNA, 140 bp, Artificial Sequence
  Synthetic
atacgccatgctgggtctccaataacactgtagaaaacaaagaagaaataaaaaactgctctttcaagataaccacagaaaggggaggcaagaagaaggaagaatacgcgcttttctatacgtacttgggagtcggccat

SEQ ID NO: 402004 - DNA, 140 bp, Artificial Sequence
  Synthetic
atggccgactcccaagtacgtatagaaaagcgcgtattcttccttcttcttgcctcccctttctgtggttatcttgaaagagcagttttttatttcttctttgttttctacagtgttattggagacccagcatggcgtat

SEQ ID NO: 402005 - DNA, 140 bp, Artificial Sequence
  Synthetic
aggccctggctgctgatatgacagtacaatgtacacatggaattaagccagtggtatcaactcaactactgctgaatggcagtttagcagaagaagatataagaattagatctgaaaattgaccttttgggacagcggtg

SEQ ID NO: 402006 - DNA, 140 bp, Artificial Sequence
  Synthetic
caccgctgtcccaaaaggtcaattttcagatctaattcttatatcttcttctgctaaactgccattcagcagtagttgagttgataccactggcttaattccatgtgtacattgtactgtcatatcagcagccagggcct

SEQ ID NO: 402007 - DNA, 140 bp, Artificial Sequence
  Synthetic
aggccctggctgctgatatgaaaggcttaggcatttcctatggcaggaagaagcggagacagcgacgaagcgctcctcagagcagtgaggatcatcaaaatcctatatcaaagcagtaaggaccttttgggacagcggtg

SEQ ID NO: 402008 - DNA, 140 bp, Artificial Sequence
  Synthetic
caccgctgtcccaaaaggtccttactgctttgatataggattttgatgatcctcactgctctgaggagcgcttcgtcgctgtctccgcttcttcctgccataggaaatgcctaagcctttcatatcagcagccagggcct

SEQ ID NO: 402009 - DNA, 140 bp, Artificial Sequence
  Synthetic
aggccctggctgctgatatggcaccactactgtgccttggaatgctagttggagtaataaatctctagataaaatttggaataacatgacctggatgcagtgggaaaaagaaattgacaagaccttttgggacagcggtg

SEQ ID NO: 402010 - DNA, 140 bp, Artificial Sequence
  Synthetic
caccgctgtcccaaaaggtcttgtcaatttctttttcccactgcatccaggtcatgttattccaaattttatctagagatttattactccaactagcattccaaggcacagtagtggtgccatatcagcagccagggcct

SEQ ID NO: 402011 - DNA, 140 bp, Artificial Sequence
  Synthetic
aggccctggctgctgatatgcctaaaggatcaacagctcctagggctttggggctgctctggaaaactcatctgcaccactaatgtgccctggaactctagttggagtaataaatctctggaccttttgggacagcggtg

SEQ ID NO: 402012 - DNA, 140 bp, Artificial Sequence
  Synthetic
caccgctgtcccaaaaggtccagagatttattactccaactagagttccagggcacattagtggtgcagatgagttttccagagcagccccaaagccctaggagctgttgatcctttaggcatatcagcagccagggcct

SEQ ID NO: 402013 - DNA, 140 bp, Artificial Sequence
  Synthetic
atacgccatgctgggtctcctgtgaggatgtggcagaaagtgggacaagcaatgtatgcccttcccatcgcaggaaaccttgtatgtaaatcaaacattacaggattaatattaacaagacgtacttgggagtcggccat

SEQ ID NO: 402014 - DNA, 140 bp, Artificial Sequence
  Synthetic
atggccgactcccaagtacgtcttgttaatattaatcctgtaatgtttgatttacatacaaggtttcctgcgatgggaagggcatacattgcttgtcccactttctgccacatcctcacaggagacccagcatggcgtat

SEQ ID NO: 402015 - DNA, 140 bp, Artificial Sequence
  Synthetic
atacgccatgctgggtctcctgcaagaaacataacatgtagatcaaatatcacaggactactattgacacataatagaagagtaagtaataagacagaaaataatacagaaatattcagacgtacttgggagtcggccat

SEQ ID NO: 402016 - DNA, 140 bp, Artificial Sequence
  Synthetic
atggccgactcccaagtacgtctgaatatttctgtattattttctgtcttattacttactcttctattatgtgtcaatagtagtcctgtgatatttgatctacatgttatgtttcttgcaggagacccagcatggcgtat

SEQ ID NO: 402017 - DNA, 140 bp, Artificial Sequence
  Synthetic
aggccctggctgctgatatgatcaacagctcctagggatttggggctgctctggaaaactcatctgcaccactaatgtgccctggaacactagttggagtaataaatcttataatgagatgaccttttgggacagcggtg

SEQ ID NO: 402018 - DNA, 140 bp, Artificial Sequence
  Synthetic
caccgctgtcccaaaaggtcatctcattataagatttattactccaactagtgttccagggcacattagtggtgcagatgagttttccagagcagccccaaatccctaggagctgttgatcatatcagcagccagggcct

SEQ ID NO: 402019 - DNA, 140 bp, Artificial Sequence
  Synthetic
  misc_feature (105)..(105): n is a, c, g, or t
aggccctggctgctgatatgggtataatgccactgagtggaaaaaagccttaaaacaaatagctgaaaggtacttagaacttgtaaacaatacaaacaatacagntgacaatgttagcatgaccttttgggacagcggtg

SEQ ID NO: 402020 - DNA, 140 bp, Artificial Sequence
  Synthetic
  misc_feature (36)..(36): n is a, c, g, or t
caccgctgtcccaaaaggtcatgctaacattgtcanctgtattgtttgtattgtttacaagttctaagtacctttcagctatttgttttaaggcttttttccactcagtggcattatacccatatcagcagccagggcct

SEQ ID NO: 402021 - DNA, 140 bp, Artificial Sequence
  Synthetic
aggccctggctgctgatatgcgaggagacaacccccgctccgaagcaggagctgaaagacagggaacccttaatttccctcaaatcactctttggcagcgaccccttgtctcaataaaaggaccttttgggacagcggtg

SEQ ID NO: 402022 - DNA, 140 bp, Artificial Sequence
  Synthetic
caccgctgtcccaaaaggtccttttattgagacaaggggtcgctgccaaagagtgatttgagggaaattaagggttccctgtctttcagctcctgcttcggagcgggggttgtctcctcgcatatcagcagccagggcct

SEQ ID NO: 402023 - DNA, 140 bp, Artificial Sequence
  Synthetic
aggccctggctgctgatatgtttggccttcccacaagggggggaggccaggaaatttcctccagaacaggccagagccaacagccccaccagcagagccaacagccccacctgccagaaagaccttttgggacagcggtg

SEQ ID NO: 402024 - DNA, 140 bp, Artificial Sequence
  Synthetic
caccgctgtcccaaaaggtctttctggcaggtggggctgttggctctgctggtggggctgttggctctggcctgttctggaggaaatttcctggcctcccccccttgtgggaaggccaaacatatcagcagccagggcct

SEQ ID NO: 402025 - DNA, 140 bp, Artificial Sequence
  Synthetic
atacgccatgctgggtctccccaccagcagagccagcagcaataggggtgggagcagcatctcgagacttggaaaaatatggagcagtaacaagtactaatatgaataatgctgatagtgcgtacttgggagtcggccat

SEQ ID NO: 402026 - DNA, 140 bp, Artificial Sequence
  Synthetic
atggccgactcccaagtacgcactatcagcattattcatattagtacttgttactgctccatatttttccaagtctcgagatgctgctcccacccctattgctgctggctctgctggtggggagacccagcatggcgtat

SEQ ID NO: 402027 - DNA, 140 bp, Artificial Sequence
  Synthetic
atacgccatgctgggtctcccctaaaggatcagcagctcctaaggttgtaaggctgctctgaaaagctcatctgcaccactgctgtgcaatgaaactccagttagagtaataaaaatcaacgtacttgggagtcggccat

SEQ ID NO: 402028 - DNA, 140 bp, Artificial Sequence
  Synthetic
atggccgactcccaagtacgttgatttttattactctaactggagtttcattgcacagcagtggtgcagatgagcttttcagagcagccttacaaccttaggagctgctgatcctttaggggagacccagcatggcgtat

SEQ ID NO: 402029 - DNA, 140 bp, Artificial Sequence
  Synthetic
atacgccatgctgggtctcctgagacctaccaggagaatgtgagggaaataaaaaattgctctttcaataccaccacagtagtaagagataagaagaagaaggagtatgcacttttttatcgtacttgggagtcggccat

SEQ ID NO: 402030 - DNA, 140 bp, Artificial Sequence
  Synthetic
atggccgactcccaagtacgataaaaaagtgcatactccttcttcttcttatctcttactactgtggtggtattgaaagagcaattttttatttccctcacattctcctggtaggtctcaggagacccagcatggcgtat

SEQ ID NO: 402031 - DNA, 140 bp, Artificial Sequence
  Synthetic
aggccctggctgctgatatgaaagtataaggataggaccaggacaaacattctatgcaacaggagacataataggagacataagacaagcacattgtaacattagtaaagataaatgggagaccttttgggacagcggtg

SEQ ID NO: 402032 - DNA, 140 bp, Artificial Sequence
  Synthetic
caccgctgtcccaaaaggtctcccatttatctttactaatgttacaatgtgcttgtcttatgtctcctattatgtctcctgttgcatagaatgtttgtcctggtcctatccttatactttcatatcagcagccagggcct

SEQ ID NO: 402033 - DNA, 140 bp, Artificial Sequence
  Synthetic
atacgccatgctgggtctccaattaaccccactctgtgtcactttaaactgcatagatgaagtgatggagaatgtcacaatgaagaataataatgtcacagaggaaataagaatgaaaaacgtacttgggagtcggccat

SEQ ID NO: 402034 - DNA, 140 bp, Artificial Sequence
  Synthetic
atggccgactcccaagtacgtttttcattcttatttcctctgtgacattattattcttcattgtgacattctccatcacttcatctatgcagtttaaagtgacacagagtggggttaattggagacccagcatggcgtat

SEQ ID NO: 402035 - DNA, 140 bp, Artificial Sequence
  Synthetic
aggccctggctgctgatatgttacaagcaattcatctagctttgcaggattcaggattagaagtaaacatagtaacagactcacaatatgcattaggaatcattcaagcacaaccagatagaccttttgggacagcggtg

SEQ ID NO: 402036 - DNA, 140 bp, Artificial Sequence
  Synthetic
caccgctgtcccaaaaggtctatctggttgtgcttgaatgattcctaatgcatattgtgagtctgttactatgtttacttctaatcctgaatcctgcaaagctagatgaattgcttgtaacatatcagcagccagggcct

SEQ ID NO: 402037 - DNA, 140 bp, Artificial Sequence
  Synthetic
aggccctggctgctgatatgtagcatatatagaatataggaaattgttaaaacaaagaaaaatagactggttaattaaaagaattagggaaagagcagaagacagtggcaatgagagtgagaccttttgggacagcggtg

SEQ ID NO: 402038 - DNA, 140 bp, Artificial Sequence
  Synthetic
caccgctgtcccaaaaggtctcactctcattgccactgtcttctgctctttccctaattcttttaattaaccagtctatttttctttgttttaacaatttcctatattctatatatgctacatatcagcagccagggcct

SEQ ID NO: 402039 - DNA, 140 bp, Artificial Sequence
  Synthetic
atacgccatgctgggtctccgtggcgcccgaacagggcacgcgaaaacgaaagtgagaccagaggagctctctcgacgcaggactcggcttgctgaagcgcgcgcagcaagaggcgagagcgtacttgggagtcggccat

SEQ ID NO: 402040 - DNA, 140 bp, Artificial Sequence
  Synthetic
atggccgactcccaagtacgctctcgcctcttgctgcgcgcgcttcagcaagccgagtcctgcgtcgagagagctcctctggtctcactttcgttttcgcgtgccctgttcgggcgccacggagacccagcatggcgtat

SEQ ID NO: 402041 - DNA, 140 bp, Artificial Sequence
  Synthetic
atacgccatgctgggtctcctagcgcttgcctaagacgacctacagagcctgtgcctcttcagctaccaccgattaaaagacttcatattaattgcagcgagagtagtagaacttctaagcgtacttgggagtcggccat

SEQ ID NO: 402042 - DNA, 140 bp, Artificial Sequence
  Synthetic
atggccgactcccaagtacgcttagaagttctactactctcgctgcaattaatatgaagtcttttaatcggtggtagctgaagaggcacaggctctgtaggtcgtcttaggcaagcgctaggagacccagcatggcgtat

SEQ ID NO: 402043 - DNA, 140 bp, Artificial Sequence
  Synthetic
aggccctggctgctgatatgtaggacaatatatctatgaaacttatggggatacttgggcaggagtggaagccataataagaattctgcaacaactgctgtttattcatttcagaattgggaccttttgggacagcggtg

SEQ ID NO: 402044 - DNA, 140 bp, Artificial Sequence
  Synthetic
caccgctgtcccaaaaggtcccaattctgaaatgaataaacagcagttgttgcagaattcttattatggcttccactcctgcccaagtatccccataagtttcatagatatattgtcctacatatcagcagccagggcct

SEQ ID NO: 402045 - DNA, 140 bp, Artificial Sequence
  Synthetic
atacgccatgctgggtctccaaaggttgtctccctaactgacacaacaaatcagaagactgaattacaagcaatttatctagctctacaggattcgggatcagaagtaaacatagtaacacgtacttgggagtcggccat

SEQ ID NO: 402046 - DNA, 140 bp, Artificial Sequence
  Synthetic
atggccgactcccaagtacgtgttactatgtttacttctgatcccgaatcctgtagagctagataaattgcttgtaattcagtcttctgatttgttgtgtcagttagggagacaacctttggagacccagcatggcgtat

SEQ ID NO: 402047 - DNA, 140 bp, Artificial Sequence
  Synthetic
aggccctggctgctgatatgtctatcaaagcagtaagtagtacatgtaatgcagcctttacatatattagcaatagtagcattagtagtagcagcaataatagcaatagttgtgtggaccgaccttttgggacagcggtg

SEQ ID NO: 402048 - DNA, 140 bp, Artificial Sequence
  Synthetic
caccgctgtcccaaaaggtcggtccacacaactattgctattattgctgctactactaatgctactattgctaatatatgtaaaggctgcattacatgtactacttactgctttgatagacatatcagcagccagggcct

SEQ ID NO: 402049 - DNA, 140 bp, Artificial Sequence
  Synthetic
atacgccatgctgggtctccggtgaaggggcagtagtaatacaagataatagtgacataaaggtagtaccaaggaggaaagcaaaaatcattaaggactatggaaaacagatggcaggtgcgtacttgggagtcggccat

SEQ ID NO: 402050 - DNA, 140 bp, Artificial Sequence
  Synthetic
atggccgactcccaagtacgcacctgccatctgttttccatagtccttaatgatttttgctttcctccttggtactacctttatgtcactattatcttgtattactactgccccttcaccggagacccagcatggcgtat

SEQ ID NO: 402051 - DNA, 140 bp, Artificial Sequence
  Synthetic
atacgccatgctgggtctccagaatgatagcaatacccttacaatggagaaaggagaaataaaaaactgctctttcaatgtcaccacaagcctaagaaataaggtgcagaaagaatatgccgtacttgggagtcggccat

SEQ ID NO: 402052 - DNA, 140 bp, Artificial Sequence
  Synthetic
atggccgactcccaagtacggcatattctttctgcaccttatttcttaggcttgtggtgacattgaaagagcagttttttatttctcctttctccattgtaagggtattgctatcattctggagacccagcatggcgtat

SEQ ID NO: 402053 - DNA, 140 bp, Artificial Sequence
  Synthetic
atacgccatgctgggtctccctgtaaaaattaattgtacaagacccaacaacatatcaaaaagaagaagtatgcatataggaacagggagagtattttacacagcaaacaataggaaatacgtacttgggagtcggccat

SEQ ID NO: 402054 - DNA, 140 bp, Artificial Sequence
  Synthetic
atggccgactcccaagtacgtatttcctattgtttgctgtgtaaaatactctccctgttcctatatgcatacttcttctttttgatatgttgttgggtcttgtacaattaatttttacagggagacccagcatggcgtat

SEQ ID NO: 402055 - DNA, 140 bp, Artificial Sequence
  Synthetic
aggccctggctgctgatatgatagcaatagcagtagctgaaggaacagataggattatagaattagtacaaagaattggtaggggtatctacaacatacctagaagaataagacagggctgaccttttgggacagcggtg

SEQ ID NO: 402056 - DNA, 140 bp, Artificial Sequence
  Synthetic
caccgctgtcccaaaaggtcagccctgtcttattcttctaggtatgttgtagatacccctaccaattctttgtactaattctataatcctatctgttccttcagctactgctattgctatcatatcagcagccagggcct

SEQ ID NO: 402057 - DNA, 140 bp, Artificial Sequence
  Synthetic
atacgccatgctgggtctcctagcactgaaaccaacaatagcactgtggataacccaggagaaataaaaaactgctctttcaatgtaaccacagaaataagagataagaaaaagaaagaacgtacttgggagtcggccat

SEQ ID NO: 402058 - DNA, 140 bp, Artificial Sequence
  Synthetic
atggccgactcccaagtacgttctttctttttcttatctcttatttctgtggttacattgaaagagcagttttttatttctcctgggttatccacagtgctattgttggtttcagtgctaggagacccagcatggcgtat

SEQ ID NO: 402059 - DNA, 140 bp, Artificial Sequence
  Synthetic
aggccctggctgctgatatggcgattttaaagtgtagggataaggagttcaatggaacaggaccatgtaaaaatgtcagtacagtacaatgtacacatggaattaagccagtggtatcaagaccttttgggacagcggtg

SEQ ID NO: 402060 - DNA, 140 bp, Artificial Sequence
  Synthetic
caccgctgtcccaaaaggtcttgataccactggcttaattccatgtgtacattgtactgtactgacatttttacatggtcctgttccattgaactccttatccctacactttaaaatcgccatatcagcagccagggcct

SEQ ID NO: 402061 - DNA, 140 bp, Artificial Sequence
  Synthetic
aggccctggctgctgatatgctcaactactactgaatggcagtttagcagaaggaaaaataaaagttagatctgaaaatttcacagacaataccaaagtcataatagtacagcttaataagaccttttgggacagcggtg

SEQ ID NO: 402062 - DNA, 140 bp, Artificial Sequence
  Synthetic
caccgctgtcccaaaaggtcttattaagctgtactattatgactttggtattgtctgtgaaattttcagatctaacttttatttttccttctgctaaactgccattcagtagtagttgagcatatcagcagccagggcct

SEQ ID NO: 402063 - DNA, 140 bp, Artificial Sequence
  Synthetic
atacgccatgctgggtctcctaagaatgggaattggaccaggacaaacgttctatgcaacaggtgccataataggagacataagacaagcacattgtaatgttactaaaagaaaatggaacgtacttgggagtcggccat

SEQ ID NO: 402064 - DNA, 140 bp, Artificial Sequence
  Synthetic
atggccgactcccaagtacgttccattttcttttagtaacattacaatgtgcttgtcttatgtctcctattatggcacctgttgcatagaacgtttgtcctggtccaattcccattcttaggagacccagcatggcgtat

SEQ ID NO: 402065 - DNA, 140 bp, Artificial Sequence
  Synthetic
atacgccatgctgggtctccgcagcgagaacataacctttaactcatctgcaggaggggacctagaaattacaacacatagtttcatttgtagaggagagtttttctattgtaatacatccgtacttgggagtcggccat

SEQ ID NO: 402066 - DNA, 140 bp, Artificial Sequence
  Synthetic
atggccgactcccaagtacggatgtattacaatagaaaaactctcctctacaaatgaaactatgtgttgtaatttctaggtcccctcctgcagatgagttaaaggttatgttctcgctgcggagacccagcatggcgtat

SEQ ID NO: 402067 - DNA, 140 bp, Artificial Sequence
  Synthetic
aggccctggctgctgatatgctatcacactcccatgtaagataaaacaaattgtgagaatgtggcagagggtgggacaagcaatgtatgcccctcccatcgcaggaaacattgaatgtaagaccttttgggacagcggtg

SEQ ID NO: 402068 - DNA, 140 bp, Artificial Sequence
  Synthetic
caccgctgtcccaaaaggtcttacattcaatgtttcctgcgatgggaggggcatacattgcttgtcccaccctctgccacattctcacaatttgttttatcttacatgggagtgtgatagcatatcagcagccagggcct

SEQ ID NO: 402069 - DNA, 140 bp, Artificial Sequence
  Synthetic
aggccctggctgctgatatgagggacaattggagaagtgaattatataagtataaaacagtaaaaatcaaatcactaggagtagcacccaccagggcaaggagaagagtggtggagagaggaccttttgggacagcggtg

SEQ ID NO: 402070 - DNA, 140 bp, Artificial Sequence
  Synthetic
caccgctgtcccaaaaggtcctctctccaccactcttctccttgccctggtgggtgctactcctagtgatttgatttttactgttttatacttatataattcacttctccaattgtccctcatatcagcagccagggcct

SEQ ID NO: 402071 - DNA, 140 bp, Artificial Sequence
  Synthetic
aggccctggctgctgatatgtaggttaataaattgtaatacttcagtcattaagcaggcttgtccaaaggtatcctttgatccaattcccatacattattgtactccagctggttatgcggaccttttgggacagcggtg

SEQ ID NO: 402072 - DNA, 140 bp, Artificial Sequence
  Synthetic
caccgctgtcccaaaaggtccgcataaccagctggagtacaataatgtatgggaattggatcaaaggatacctttggacaagcctgcttaatgactgaagtattacaatttattaacctacatatcagcagccagggcct

SEQ ID NO: 402073 - DNA, 140 bp, Artificial Sequence
  Synthetic
aggccctggctgctgatatgaattgtagaggagaatttttctattgcaatacaacaaagttgtttaatagtacttggataatggagaatgatacttggacagataataaaaccatggaaggaccttttgggacagcggtg

SEQ ID NO: 402074 - DNA, 140 bp, Artificial Sequence
  Synthetic
caccgctgtcccaaaaggtccttccatggttttattatctgtccaagtatcattctccattatccaagtactattaaacaactttgttgtattgcaatagaaaaattctcctctacaattcatatcagcagccagggcct

SEQ ID NO: 402075 - DNA, 140 bp, Artificial Sequence
  Synthetic
aggccctggctgctgatatgaggataaagcaaattgtaaacatgtggcagggaacagggcaagcaatgtatgctcctcccatcagaggaccaattaattgtgtatcaaatattacaggaagaccttttgggacagcggtg

SEQ ID NO: 402076 - DNA, 140 bp, Artificial Sequence
  Synthetic
caccgctgtcccaaaaggtcttcctgtaatatttgatacacaattaattggtcctctgatgggaggagcatacattgcttgccctgttccctgccacatgtttacaatttgctttatcctcatatcagcagccagggcct

SEQ ID NO: 402077 - DNA, 140 bp, Artificial Sequence
  Synthetic
atacgccatgctgggtctccaataagacagggcttagaaagaattttgctataagatgggtggcaagtggtccaaacgttgtgggtgggataatgtaagggaaagaatgagacgagctgacgtacttgggagtcggccat

SEQ ID NO: 402078 - DNA, 140 bp, Artificial Sequence
  Synthetic
atggccgactcccaagtacgtcagctcgtctcattctttcccttacattatcccacccacaacgtttggaccacttgccacccatcttatagcaaaattctttctaagccctgtcttattggagacccagcatggcgtat

SEQ ID NO: 402079 - DNA, 140 bp, Artificial Sequence
  Synthetic
aggccctggctgctgatatgcatcaagcagccatgcaaatgttaaaagagaccatcaatgaggaagctgcagaatgggatagattgcatccaccgcaggcagggcctgttgcaccaggccgaccttttgggacagcggtg

SEQ ID NO: 402080 - DNA, 140 bp, Artificial Sequence
  Synthetic
caccgctgtcccaaaaggtcggcctggtgcaacaggccctgcctgcggtggatgcaatctatcccattctgcagcttcctcattgatggtctcttttaacatttgcatggctgcttgatgcatatcagcagccagggcct

SEQ ID NO: 402081 - DNA, 140 bp, Artificial Sequence
  Synthetic
atacgccatgctgggtctccgcccttaaatatctgggaagccttattcagtattggagtttggagctaaaaaagagtactattagcctgattgataccatagcaatagcagtagctgaagcgtacttgggagtcggccat

SEQ ID NO: 402082 - DNA, 140 bp, Artificial Sequence
  Synthetic
atggccgactcccaagtacgcttcagctactgctattgctatggtatcaatcaggctaatagtactcttttttagctccaaactccaatactgaataaggcttcccagatatttaagggcggagacccagcatggcgtat

SEQ ID NO: 402083 - DNA, 140 bp, Artificial Sequence
  Synthetic
aggccctggctgctgatatgaaagagtactattagcctgattgataccatagcaatagcagtagctgaaggaacagataggattatagaaccaatacaaagactttgtagagctacccgcgaccttttgggacagcggtg

SEQ ID NO: 402084 - DNA, 140 bp, Artificial Sequence
  Synthetic
caccgctgtcccaaaaggtcgcgggtagctctacaaagtctttgtattggttctataatcctatctgttccttcagctactgctattgctatggtatcaatcaggctaatagtactctttcatatcagcagccagggcct

SEQ ID NO: 402085 - DNA, 140 bp, Artificial Sequence
  Synthetic
aggccctggctgctgatatgactgacagcatattcttagggatacaaaggataggaagaggaattcttaacatcccaagaagaattagacagggcttagaacaggctttagtgtaacatggaccttttgggacagcggtg

SEQ ID NO: 402086 - DNA, 140 bp, Artificial Sequence
  Synthetic
caccgctgtcccaaaaggtccatgttacactaaagcctgttctaagccctgtctaattcttcttgggatgttaagaattcctcttcctatcctttgtatccctaagaatatgctgtcagtcatatcagcagccagggcct

SEQ ID NO: 402087 - DNA, 140 bp, Artificial Sequence
  Synthetic
aggccctggctgctgatatgaccccttcccatcatcagagggaacccgacagacccgaaagaatcgaagaaggaggtggcgagcaaggcagagacagatccgtgcgattagtgagcggatgaccttttgggacagcggtg

SEQ ID NO: 402088 - DNA, 140 bp, Artificial Sequence
  Synthetic
caccgctgtcccaaaaggtcatccgctcactaatcgcacggatctgtctctgccttgctcgccacctccttcttcgattctttcgggtctgtcgggttccctctgatgatgggaaggggtcatatcagcagccagggcct

SEQ ID NO: 402089 - DNA, 140 bp, Artificial Sequence
  Synthetic
atacgccatgctgggtctccgtggcgcccgaacagggacttgaaagcgaaagtaatagggactcgaaagcgaaagttccagagaagttctctcgacgcaggactcggcttgctgaagtgccgtacttgggagtcggccat

SEQ ID NO: 402090 - DNA, 140 bp, Artificial Sequence
  Synthetic
atggccgactcccaagtacggcacttcagcaagccgagtcctgcgtcgagagaacttctctggaactttcgctttcgagtccctattactttcgctttcaagtccctgttcgggcgccacggagacccagcatggcgtat

SEQ ID NO: 402091 - DNA, 140 bp, Artificial Sequence
  Synthetic
aggccctggctgctgatatgctagcggaggctagaaggagagagatgggtgcgagagcgtcaatattaagaggggaaaaattagataaatgggaaaaaattaggttaaggccagggggaagaccttttgggacagcggtg

SEQ ID NO: 402092 - DNA, 140 bp, Artificial Sequence
  Synthetic
caccgctgtcccaaaaggtcttccccctggccttaacctaattttttcccatttatctaatttttcccctcttaatattgacgctctcgcacccatctctctccttctagcctccgctagcatatcagcagccagggcct

SEQ ID NO: 402093 - DNA, 140 bp, Artificial Sequence
  Synthetic
aggccctggctgctgatatgagcacaaggagctgggagagctattctccacatacctagaagaatcagacagggcttagaaaggtctttgctataacatgggaagcaagtggtcaaaaaggaccttttgggacagcggtg

SEQ ID NO: 402094 - DNA, 140 bp, Artificial Sequence
  Synthetic
caccgctgtcccaaaaggtcctttttgaccacttgcttcccatgttatagcaaagacctttctaagccctgtctgattcttctaggtatgtggagaatagctctcccagctccttgtgctcatatcagcagccagggcct

SEQ ID NO: 402095 - DNA, 140 bp, Artificial Sequence
  Synthetic
atacgccatgctgggtctccactgcaactattgaatgaactcagaaaacgcttgtggggaatactagcatattggggaaaagagttaaaagatagtgctatcagcttgcttaatacaacacgtacttgggagtcggccat

SEQ ID NO: 402096 - DNA, 140 bp, Artificial Sequence
  Synthetic
atggccgactcccaagtacgtgttgtattaagcaagctgatagcactatcttttaactcttttccccaatatgctagtattccccacaagcgttttctgagttcattcaatagttgcagtggagacccagcatggcgtat

SEQ ID NO: 402097 - DNA, 140 bp, Artificial Sequence
  Synthetic
atacgccatgctgggtctccgcactaccacagccgatgtctctgacggaataggaaatataacagatgaagtaagaaactgtacttttaatatgactacagagataagagataagacgaacgtacttgggagtcggccat

SEQ ID NO: 402098 - DNA, 140 bp, Artificial Sequence
  Synthetic
atggccgactcccaagtacgttcgtcttatctcttatctctgtagtcatattaaaagtacagtttcttacttcatctgttatatttcctattccgtcagagacatcggctgtggtagtgcggagacccagcatggcgtat

SEQ ID NO: 402099 - DNA, 140 bp, Artificial Sequence
  Synthetic
aggccctggctgctgatatgtggataatcctgggattaaataaaatagtaagaatgtatagccctgttagcattttggacataagacaagggccaaaagaacccttcagagactatgtaggaccttttgggacagcggtg

SEQ ID NO: 402100 - DNA, 140 bp, Artificial Sequence
  Synthetic
caccgctgtcccaaaaggtcctacatagtctctgaagggttcttttggcccttgtcttatgtccaaaatgctaacagggctatacattcttactattttatttaatcccaggattatccacatatcagcagccagggcct

SEQ ID NO: 402101 - DNA, 140 bp, Artificial Sequence
  Synthetic
atacgccatgctgggtctccactttaaaatgtacaaactacagtacaaactacagtaataccatgaatgctactagctataacaataataccactgaagaaataaaaaattgcactttcacgtacttgggagtcggccat

SEQ ID NO: 402102 - DNA, 140 bp, Artificial Sequence
  Synthetic
atggccgactcccaagtacgtgaaagtgcaattttttatttcttcagtggtattattgttatagctagtagcattcatggtattactgtagtttgtactgtagtttgtacattttaaagtggagacccagcatggcgtat

SEQ ID NO: 402103 - DNA, 140 bp, Artificial Sequence
  Synthetic
aggccctggctgctgatatgggagaaagagactggcatttgggtcagggagtctccatagaatggaggaaaaggagatatagcacacaagtagaccctgacctagcagaccaactaattcgaccttttgggacagcggtg

SEQ ID NO: 402104 - DNA, 140 bp, Artificial Sequence
  Synthetic
caccgctgtcccaaaaggtcgaattagttggtctgctaggtcagggtctacttgtgtgctatatctccttttcctccattctatggagactccctgacccaaatgccagtctctttctcccatatcagcagccagggcct

SEQ ID NO: 402105 - DNA, 140 bp, Artificial Sequence
  Synthetic
aggccctggctgctgatatgttcaaccatcctcaggaggggacctagaaattacaacacatagctttaattgtagaggagaatttttctattgcaatacatcaaaactgtttaatagcaggaccttttgggacagcggtg

SEQ ID NO: 402106 - DNA, 140 bp, Artificial Sequence
  Synthetic
caccgctgtcccaaaaggtcctgctattaaacagttttgatgtattgcaatagaaaaattctcctctacaattaaagctatgtgttgtaatttctaggtcccctcctgaggatggttgaacatatcagcagccagggcct

SEQ ID NO: 402107 - DNA, 140 bp, Artificial Sequence
  Synthetic
atacgccatgctgggtctccgaagaagtaaaaaattgctctttcaatataaccacagaactaagagataagaaacagaaagcgtatgcacttttttatagacctgatgtagtaccacttacgtacttgggagtcggccat

SEQ ID NO: 402108 - DNA, 140 bp, Artificial Sequence
  Synthetic
atggccgactcccaagtacgtaagtggtactacatcaggtctataaaaaagtgcatacgctttctgtttcttatctcttagttctgtggttatattgaaagagcaattttttacttcttcggagacccagcatggcgtat

SEQ ID NO: 402109 - DNA, 140 bp, Artificial Sequence
  Synthetic
aggccctggctgctgatatgctgttagaaacagcagaaggctgtaggcaaatattggaacagctacagccatcccttcagacaggatcagaagaaattaaatcattacacaatacagtaggaccttttgggacagcggtg

SEQ ID NO: 402110 - DNA, 140 bp, Artificial Sequence
  Synthetic
caccgctgtcccaaaaggtcctactgtattgtgtaatgatttaatttcttctgatcctgtctgaagggatggctgtagctgttccaatatttgcctacagccttctgctgtttctaacagcatatcagcagccagggcct

SEQ ID NO: 402111 - DNA, 140 bp, Artificial Sequence
  Synthetic
atacgccatgctgggtctccacagtgttgctatcattgccaaaagtgtttcttaacaaaaggcttaggcatttcatatggcaggaagaagcggagacagcgacgaagagctcctcaagaccgtacttgggagtcggccat

SEQ ID NO: 402112 - DNA, 140 bp, Artificial Sequence
  Synthetic
atggccgactcccaagtacggtcttgaggagctcttcgtcgctgtctccgcttcttcctgccatatgaaatgcctaagccttttgttaagaaacacttttggcaatgatagcaacactgtggagacccagcatggcgtat

SEQ ID NO: 402113 - DNA, 140 bp, Artificial Sequence
  Synthetic
atacgccatgctgggtctccaaattaagagaacacttccttaatagaacaatagaatttgaatcaccctcagggggggatctagaagttacaacacatagctttaattgtggaggagaatcgtacttgggagtcggccat

SEQ ID NO: 402114 - DNA, 140 bp, Artificial Sequence
  Synthetic
atggccgactcccaagtacgattctcctccacaattaaagctatgtgttgtaacttctagatccccccctgagggtgattcaaattctattgttctattaaggaagtgttctcttaatttggagacccagcatggcgtat

SEQ ID NO: 402115 - DNA, 140 bp, Artificial Sequence
  Synthetic
aggccctggctgctgatatgattgggggttgcaaacaggagaaagagattggcatttgggtcatggagtctccatagaatggagattgagaagatataccacacaaatagaacctggcctgaccttttgggacagcggtg

SEQ ID NO: 402116 - DNA, 140 bp, Artificial Sequence
  Synthetic
caccgctgtcccaaaaggtcaggccaggttctatttgtgtggtatatcttctcaatctccattctatggagactccatgacccaaatgccaatctctttctcctgtttgcaacccccaatcatatcagcagccagggcct

SEQ ID NO: 402117 - DNA, 140 bp, Artificial Sequence
  Synthetic
aggccctggctgctgatatgaagaccaggggccacagagggagccgttcaatgaatggacactagaactgttagaagagcttaaacatgaagctgttagacattttcccaggccgtggctgaccttttgggacagcggtg

SEQ ID NO: 402118 - DNA, 140 bp, Artificial Sequence
  Synthetic
caccgctgtcccaaaaggtcagccacggcctgggaaaatgtctaacagcttcatgtttaagctcttctaacagttctagtgtccattcattgaacggctccctctgtggcccctggtcttcatatcagcagccagggcct

SEQ ID NO: 402119 - DNA, 140 bp, Artificial Sequence
  Synthetic
atacgccatgctgggtctcctaatggagaaaggagaaataaaaaactgctcttttaatatcaccgcaagcataaaaaataaggtgaaacaggaatctgtactttttaatagacttgatgtcgtacttgggagtcggccat

SEQ ID NO: 402120 - DNA, 140 bp, Artificial Sequence
  Synthetic
atggccgactcccaagtacgacatcaagtctattaaaaagtacagattcctgtttcaccttattttttatgcttgcggtgatattaaaagagcagttttttatttctcctttctccattaggagacccagcatggcgtat

SEQ ID NO: 402121 - DNA, 140 bp, Artificial Sequence
  Synthetic
aggccctggctgctgatatgaattagtagaggatagatggaacaatccccagaagatcaggggccgcagagggaaccatacaatgaatggacactagagcttctagaggaactcaagcaggaccttttgggacagcggtg

SEQ ID NO: 402122 - DNA, 140 bp, Artificial Sequence
  Synthetic
caccgctgtcccaaaaggtcctgcttgagttcctctagaagctctagtgtccattcattgtatggttccctctgcggcccctgatcttctggggattgttccatctatcctctactaattcatatcagcagccagggcct

SEQ ID NO: 402123 - DNA, 140 bp, Artificial Sequence
  Synthetic
aggccctggctgctgatatggcattgccaattatgctttctgaacaagggcttaggcatctcctatggcaggaagaagcggagacgccgacgaggaactcctcagagtcgtcaggatcatgaccttttgggacagcggtg

SEQ ID NO: 402124 - DNA, 140 bp, Artificial Sequence
  Synthetic
caccgctgtcccaaaaggtcatgatcctgacgactctgaggagttcctcgtcggcgtctccgcttcttcctgccataggagatgcctaagcccttgttcagaaagcataattggcaatgccatatcagcagccagggcct

SEQ ID NO: 402125 - DNA, 140 bp, Artificial Sequence
  Synthetic
aggccctggctgctgatatgcaaaatcctgtaccaaagcagtaagtagttataattagcatatgtaatgataccattagcaatagctgcaatagtaggattagtagtagcattcatagcagaccttttgggacagcggtg

SEQ ID NO: 402126 - DNA, 140 bp, Artificial Sequence
  Synthetic
caccgctgtcccaaaaggtctgctatgaatgctactactaatcctactattgcagctattgctaatggtatcattacatatgctaattataactacttactgctttggtacaggattttgcatatcagcagccagggcct

SEQ ID NO: 402127 - DNA, 140 bp, Artificial Sequence
  Synthetic
aggccctggctgctgatatgacagaaaaaaatagatagattaattgatagaataagagaaagagcagaagacagtggaaatgagagtgaaggggatacagaggaattggcaacacttgtggaccttttgggacagcggtg

SEQ ID NO: 402128 - DNA, 140 bp, Artificial Sequence
  Synthetic
caccgctgtcccaaaaggtccacaagtgttgccaattcctctgtatccccttcactctcatttccactgtcttctgctctttctcttattctatcaattaatctatctatttttttctgtcatatcagcagccagggcct

SEQ ID NO: 402129 - DNA, 140 bp, Artificial Sequence
  Synthetic
atacgccatgctgggtctccgacccaacaataatacaagaaaaaggataactatgggaccaggaagagtatattatgcaacaggaggcatagtaggagatataagacaagcacattgtaacgtacttgggagtcggccat

SEQ ID NO: 402130 - DNA, 140 bp, Artificial Sequence
  Synthetic
atggccgactcccaagtacgttacaatgtgcttgtcttatatctcctactatgcctcctgttgcataatatactcttcctggtcccatagttatcctttttcttgtattattgttgggtcggagacccagcatggcgtat

SEQ ID NO: 402131 - DNA, 140 bp, Artificial Sequence
  Synthetic
atacgccatgctgggtctcccacgagatggtggtgggaatgggtccgacaccaccgcctccttaacaccaggaggaggagatatgaggaacagttggagaaatgaattatataattatgacgtacttgggagtcggccat

SEQ ID NO: 402132 - DNA, 140 bp, Artificial Sequence
  Synthetic
atggccgactcccaagtacgtcataattatataattcatttctccaactgttcctcatatctcctcctcctggtgttaaggaggcggtggtgtcggacccattcccaccaccatctcgtgggagacccagcatggcgtat

SEQ ID NO: 402133 - DNA, 140 bp, Artificial Sequence
  Synthetic
aggccctggctgctgatatgttgggtgcagtcatagcagaataggcattttccgaagcagaagaggcaggaatggagccggtagaccgtaacatagacccctggaaccatccgggaagtcgaccttttgggacagcggtg

SEQ ID NO: 402134 - DNA, 140 bp, Artificial Sequence
  Synthetic
caccgctgtcccaaaaggtcgacttcccggatggttccaggggtctatgttacggtctaccggctccattcctgcctcttctgcttcggaaaatgcctattctgctatgactgcacccaacatatcagcagccagggcct

SEQ ID NO: 402135 - DNA, 140 bp, Artificial Sequence
  Synthetic
atacgccatgctgggtctcccaactaggaaagatctataataacacaaatataacaaatataatctttaaaccacacgcaggaggggacctagaaattacaactcatagttttaattgtacgtacttgggagtcggccat

SEQ ID NO: 402136 - DNA, 140 bp, Artificial Sequence
  Synthetic
atggccgactcccaagtacgtacaattaaaactatgagttgtaatttctaggtcccctcctgcgtgtggtttaaagattatatttgttatatttgtgttattatagatctttcctagttgggagacccagcatggcgtat

SEQ ID NO: 402137 - DNA, 140 bp, Artificial Sequence
  Synthetic
aggccctggctgctgatatggttctacaaagactgctgacacagaagttgctgacaagggactttccgctggggactttccaggggaggtgtggtttgggcggagttggggagtggctaagaccttttgggacagcggtg

SEQ ID NO: 402138 - DNA, 140 bp, Artificial Sequence
  Synthetic
caccgctgtcccaaaaggtcttagccactccccaactccgcccaaaccacacctcccctggaaagtccccagcggaaagtcccttgtcagcaacttctgtgtcagcagtctttgtagaaccatatcagcagccagggcct

SEQ ID NO: 402139 - DNA, 140 bp, Artificial Sequence
  Synthetic
aggccctggctgctgatatggatacctaaaggatcaacagctcctagggatttggggctgctctggaaaactcatctgcaccactaatgtgccttggaacactagttggagtaataaatcgaccttttgggacagcggtg

SEQ ID NO: 402140 - DNA, 140 bp, Artificial Sequence
  Synthetic
caccgctgtcccaaaaggtcgatttattactccaactagtgttccaaggcacattagtggtgcagatgagttttccagagcagccccaaatccctaggagctgttgatcctttaggtatccatatcagcagccagggcct

SEQ ID NO: 402141 - DNA, 140 bp, Artificial Sequence
  Synthetic
aggccctggctgctgatatggaagcggagaccccgacgaggcacttctcggagcaatcaggatcatcaaaatcctctaccaaagcagtaagtagtattgtaatgacccccttacaaatctgaccttttgggacagcggtg

SEQ ID NO: 402142 - DNA, 140 bp, Artificial Sequence
  Synthetic
caccgctgtcccaaaaggtcagatttgtaagggggtcattacaatactacttactgctttggtagaggattttgatgatcctgattgctccgagaagtgcctcgtcggggtctccgcttccatatcagcagccagggcct

SEQ ID NO: 402143 - DNA, 140 bp, Artificial Sequence
  Synthetic
aggccctggctgctgatatgaagaaaagcacattgtaatgtcagcagagcaaaatggaatacaacgttacaaaaactaagtgaaagattaagaaaatactttgtaaacaaaacaataatcgaccttttgggacagcggtg

SEQ ID NO: 402144 - DNA, 140 bp, Artificial Sequence
  Synthetic
caccgctgtcccaaaaggtcgattattgttttgtttacaaagtattttcttaatctttcacttagtttttgtaacgttgtattccattttgctctgctgacattacaatgtgcttttcttcatatcagcagccagggcct

SEQ ID NO: 402145 - DNA, 140 bp, Artificial Sequence
  Synthetic
aggccctggctgctgatatggctatgatctttgggttcttaggagcagcaggaagcactatgggcgcggcgtcaataacgctgacggtacaggccagacaattattgtctggtatagtgcgaccttttgggacagcggtg

SEQ ID NO: 402146 - DNA, 140 bp, Artificial Sequence
  Synthetic
caccgctgtcccaaaaggtcgcactataccagacaataattgtctggcctgtaccgtcagcgttattgacgccgcgcccatagtgcttcctgctgctcctaagaacccaaagatcatagccatatcagcagccagggcct

SEQ ID NO: 402147 - DNA, 140 bp, Artificial Sequence
  Synthetic
aggccctggctgctgatatgagaaggataagacaaggccttgaaagagctttgcaataaaatgggaggcaaatggtcaaaaagtagcatagttggatggcccgcggtaagggagagaatagaccttttgggacagcggtg

SEQ ID NO: 402148 - DNA, 140 bp, Artificial Sequence
  Synthetic
caccgctgtcccaaaaggtctattctctcccttaccgcgggccatccaactatgctactttttgaccatttgcctcccattttattgcaaagctctttcaaggccttgtcttatccttctcatatcagcagccagggcct

SEQ ID NO: 402149 - DNA, 140 bp, Artificial Sequence
  Synthetic
aggccctggctgctgatatggtggaacttctgggacgcagcagtctcaggggactacagagggggtgggaagcccttaagtatctgggaagtcttgtgcagtattggggtctggaactaagaccttttgggacagcggtg

SEQ ID NO: 402150 - DNA, 140 bp, Artificial Sequence
  Synthetic
caccgctgtcccaaaaggtcttagttccagaccccaatactgcacaagacttcccagatacttaagggcttcccaccccctctgtagtcccctgagactgctgcgtcccagaagttccaccatatcagcagccagggcct

SEQ ID NO: 402151 - DNA, 140 bp, Artificial Sequence
  Synthetic
atacgccatgctgggtctcctaagaatagatctctggatgatatttgggataacatgacctggatgcaatgggaaagagaaattgacaattacacaggcttaatatacaccttgattgagcgtacttgggagtcggccat

SEQ ID NO: 402152 - DNA, 140 bp, Artificial Sequence
  Synthetic
atggccgactcccaagtacgctcaatcaaggtgtatattaagcctgtgtaattgtcaatttctctttcccattgcatccaggtcatgttatcccaaatatcatccagagatctattcttaggagacccagcatggcgtat

SEQ ID NO: 402153 - DNA, 140 bp, Artificial Sequence
  Synthetic
aggccctggctgctgatatgagcaaccctctggtgtgtacatcaaaggatagatgtaaaagacaccaaggaagctttagataaactagaggaagtacaaaagaagagccagcaaaagacagaccttttgggacagcggtg

SEQ ID NO: 402154 - DNA, 140 bp, Artificial Sequence
  Synthetic
caccgctgtcccaaaaggtctgtcttttgctggctcttcttttgtacttcctctagtttatctaaagcttccttggtgtcttttacatctatcctttgatgtacacaccagagggttgctcatatcagcagccagggcct

SEQ ID NO: 402155 - DNA, 140 bp, Artificial Sequence
  Synthetic
aggccctggctgctgatatgccatagtattcatagaatataggaaaataagaagacagaagaaaatagacaggttaattgatagaataagagaaagagcagaggacagtggcaatgagaggaccttttgggacagcggtg

SEQ ID NO: 402156 - DNA, 140 bp, Artificial Sequence
  Synthetic
caccgctgtcccaaaaggtcctctcattgccactgtcctctgctctttctcttattctatcaattaacctgtctattttcttctgtcttcttattttcctatattctatgaatactatggcatatcagcagccagggcct

SEQ ID NO: 402157 - DNA, 140 bp, Artificial Sequence
  Synthetic
aggccctggctgctgatatgatgcaaatccagattgtaaatccatcttaagagcattaggaacaggagctacattagaagaaatgatgacagcatgccagggagtaggaggacccggccagaccttttgggacagcggtg

SEQ ID NO: 402158 - DNA, 140 bp, Artificial Sequence
  Synthetic
caccgctgtcccaaaaggtctggccgggtcctcctactccctggcatgctgtcatcatttcttctaatgtagctcctgttcctaatgctcttaagatggatttacaatctggatttgcatcatatcagcagccagggcct

SEQ ID NO: 402159 - DNA, 140 bp, Artificial Sequence
  Synthetic
aggccctggctgctgatatgttaaccccactctgtgttactttaaattgcactaatttgaatgctactaatactaatagtacggctaatattaccagtagtccaatgggggtaggagaaagaccttttgggacagcggtg

SEQ ID NO: 402160 - DNA, 140 bp, Artificial Sequence
  Synthetic
caccgctgtcccaaaaggtctttctcctacccccattggactactggtaatattagccgtactattagtattagtagcattcaaattagtgcaatttaaagtaacacagagtggggttaacatatcagcagccagggcct

SEQ ID NO: 402161 - DNA, 140 bp, Artificial Sequence
  Synthetic
atacgccatgctgggtctccgactatgcacttttttataaagttgatgtaataccaatagataattctaccaattataggttaagagagtgtaacacttcagtcattacacaagcttgtccgtacttgggagtcggccat

SEQ ID NO: 402162 - DNA, 140 bp, Artificial Sequence
  Synthetic
atggccgactcccaagtacggacaagcttgtgtaatgactgaagtgttacactctcttaacctataattggtagaattatctattggtattacatcaactttataaaaaagtgcatagtcggagacccagcatggcgtat

SEQ ID NO: 402163 - DNA, 140 bp, Artificial Sequence
  Synthetic
aggccctggctgctgatatgaagacagggcttagaaagggctttgctataagatgggtggcaagtggtcaaaaagtagtatagttggatggcctactgtaagggaaagaatgagacgagcgaccttttgggacagcggtg

SEQ ID NO: 402164 - DNA, 140 bp, Artificial Sequence
  Synthetic
caccgctgtcccaaaaggtcgctcgtctcattctttcccttacagtaggccatccaactatactactttttgaccacttgccacccatcttatagcaaagccctttctaagccctgtcttcatatcagcagccagggcct

SEQ ID NO: 402165 - DNA, 140 bp, Artificial Sequence
  Synthetic
atacgccatgctgggtctccacttttaattgtagaggggaatttttctactgtaatacatcaaaactgtttaatagttcttggaatattaatggtacttggaatggtactacaggaaatgcgtacttgggagtcggccat

SEQ ID NO: 402166 - DNA, 140 bp, Artificial Sequence
  Synthetic
atggccgactcccaagtacgcatttcctgtagtaccattccaagtaccattaatattccaagaactattaaacagttttgatgtattacagtagaaaaattcccctctacaattaaaagtggagacccagcatggcgtat

SEQ ID NO: 402167 - DNA, 140 bp, Artificial Sequence
  Synthetic
aggccctggctgctgatatgccagacaagtgttgtctggtatagtgcaacagcaaagcaatttgctgagggctatagaggcgcaacagcatctgttgcaactcacggtctggggcattaagaccttttgggacagcggtg

SEQ ID NO: 402168 - DNA, 140 bp, Artificial Sequence
  Synthetic
caccgctgtcccaaaaggtcttaatgccccagaccgtgagttgcaacagatgctgttgcgcctctatagccctcagcaaattgctttgctgttgcactataccagacaacacttgtctggcatatcagcagccagggcct

SEQ ID NO: 402169 - DNA, 140 bp, Artificial Sequence
  Synthetic
atacgccatgctgggtctccacacttccaatgataacataaaggaagaaataaaaaattgctctttcaatacaaccacagaaataagagataaggaacagaaagcgtatgcgcttttttacgtacttgggagtcggccat

SEQ ID NO: 402170 - DNA, 140 bp, Artificial Sequence
  Synthetic
atggccgactcccaagtacgtaaaaaagcgcatacgctttctgttccttatctcttatttctgtggttgtattgaaagagcaattttttatttcttcctttatgttatcattggaagtgtggagacccagcatggcgtat

SEQ ID NO: 402171 - DNA, 140 bp, Artificial Sequence
  Synthetic
aggccctggctgctgatatgaatgctgcttgtgcctggctagaagcacaagaggaggaggaggtgggttttccagtcagacctcaggtacctttaagaccaatgacttacaaggcagctcgaccttttgggacagcggtg

SEQ ID NO: 402172 - DNA, 140 bp, Artificial Sequence
  Synthetic
caccgctgtcccaaaaggtcgagctgccttgtaagtcattggtcttaaaggtacctgaggtctgactggaaaacccacctcctcctcctcttgtgcttctagccaggcacaagcagcattcatatcagcagccagggcct

SEQ ID NO: 402173 - DNA, 140 bp, Artificial Sequence
  Synthetic
atacgccatgctgggtctccgtaagttcagaagtacatatcccactaggagaagctagattagtaataagaacatattggggtctgcagacaggagaaaaggactggcacttgggtcatgcgtacttgggagtcggccat

SEQ ID NO: 402174 - DNA, 140 bp, Artificial Sequence
  Synthetic
atggccgactcccaagtacgcatgacccaagtgccagtccttttctcctgtctgcagaccccaatatgttcttattactaatctagcttctcctagtgggatatgtacttctgaacttacggagacccagcatggcgtat

SEQ ID NO: 402175 - DNA, 140 bp, Artificial Sequence
  Synthetic
aggccctggctgctgatatgaacatggagcaatcacaagtagcaatacagcagctaccaatgctgcttgtgcctggctagaagcacaagaggaggaggaggtgggttttccagtcagaccgaccttttgggacagcggtg

SEQ ID NO: 402176 - DNA, 140 bp, Artificial Sequence
  Synthetic
caccgctgtcccaaaaggtcggtctgactggaaaacccacctcctcctcctcttgtgcttctagccaggcacaagcagcattggtagctgctgtattgctacttgtgattgctccatgttcatatcagcagccagggcct

SEQ ID NO: 402177 - DNA, 140 bp, Artificial Sequence
  Synthetic
atacgccatgctgggtctccctggcaattgggtcatggggtctccatagaatggaggcagaaaagatatagcacacaaatagatcctgacctagcagaccaactgattcacctgcattatcgtacttgggagtcggccat

SEQ ID NO: 402178 - DNA, 140 bp, Artificial Sequence
  Synthetic
atggccgactcccaagtacgataatgcaggtgaatcagttggtctgctaggtcaggatctatttgtgtgctatatcttttctgcctccattctatggagaccccatgacccaattgccagggagacccagcatggcgtat

SEQ ID NO: 402179 - DNA, 140 bp, Artificial Sequence
  Synthetic
aggccctggctgctgatatggtagcaactctctattgtgtacataaaggcatagaagtacgagacaccaaggaagccttagacaaaatagaggaagaacaaaacaaaagtcagcaaaaaagaccttttgggacagcggtg

SEQ ID NO: 402180 - DNA, 140 bp, Artificial Sequence
  Synthetic
caccgctgtcccaaaaggtcttttttgctgacttttgttttgttcttcctctattttgtctaaggcttccttggtgtctcgtacttctatgcctttatgtacacaatagagagttgctaccatatcagcagccagggcct

SEQ ID NO: 402181 - DNA, 140 bp, Artificial Sequence
  Synthetic
atacgccatgctgggtctccaaatgaaaaactgctctttcaaaataaccacaggcatgagagataagatgcagaaagcatatgcacttttttataagcttgatatagtaccaatagatgacgtacttgggagtcggccat

SEQ ID NO: 402182 - DNA, 140 bp, Artificial Sequence
  Synthetic
atggccgactcccaagtacgtcatctattggtactatatcaagcttataaaaaagtgcatatgctttctgcatcttatctctcatgcctgtggttattttgaaagagcagtttttcatttggagacccagcatggcgtat

SEQ ID NO: 402183 - DNA, 140 bp, Artificial Sequence
  Synthetic
aggccctggctgctgatatgtaggggatataagaaaagcatattgtaatgtcagtaaagcaaaatggaatagaactttacaactggtggctagtaaattaaataaatactttaataagacgaccttttgggacagcggtg

SEQ ID NO: 402184 - DNA, 140 bp, Artificial Sequence
  Synthetic
caccgctgtcccaaaaggtcgtcttattaaagtatttatttaatttactagccaccagttgtaaagttctattccattttgctttactgacattacaatatgcttttcttatatcccctacatatcagcagccagggcct

SEQ ID NO: 402185 - DNA, 140 bp, Artificial Sequence
  Synthetic
atacgccatgctgggtctcctaacagatgaagtaagaaactgtacttttaatgtgaccacagagataagagataagcagcatcgggtccaggcactgttttataagcttgatatagtacccgtacttgggagtcggccat

SEQ ID NO: 402186 - DNA, 140 bp, Artificial Sequence
  Synthetic
atggccgactcccaagtacgggtactatatcaagcttataaaacagtgcctggacccgatgctgcttatctcttatctctgtggtcacattaaaagtacagtttcttacttcatctgttaggagacccagcatggcgtat

SEQ ID NO: 402187 - DNA, 140 bp, Artificial Sequence
  Synthetic
atacgccatgctgggtctcctatgtgtgaagaacaaggaaacttaaaaaactgctctttcaatataaccacagaaataagagataagaggaagacagaatatgcgcttttctatagatttcgtacttgggagtcggccat

SEQ ID NO: 402188 - DNA, 140 bp, Artificial Sequence
  Synthetic
atggccgactcccaagtacgaaatctatagaaaagcgcatattctgtcttcctcttatctcttatttctgtggttatattgaaagagcagttttttaagtttccttgttcttcacacataggagacccagcatggcgtat

SEQ ID NO: 402189 - DNA, 140 bp, Artificial Sequence
  Synthetic
atacgccatgctgggtctcctaatgttacctacaacgatactacgaatggagcaataagaaattgctctttcaatataaccacagaactaagagataagcaaaagaaagagtatgcacttcgtacttgggagtcggccat

SEQ ID NO: 402190 - DNA, 140 bp, Artificial Sequence
  Synthetic
atggccgactcccaagtacgaagtgcatactctttcttttgcttatctcttagttctgtggttatattgaaagagcaatttcttattgctccattcgtagtatcgttgtaggtaacattaggagacccagcatggcgtat

SEQ ID NO: 402191 - DNA, 140 bp, Artificial Sequence
  Synthetic
atacgccatgctgggtctccttcagtacaatgtacacatggaattaaaccagtggtatcaactcaattactactaaatggtagtttagcagaagaagaaatagtaattagatctgaaaaccgtacttgggagtcggccat

SEQ ID NO: 402192 - DNA, 140 bp, Artificial Sequence
  Synthetic
atggccgactcccaagtacggttttcagatctaattactatttcttcttctgctaaactaccatttagtagtaattgagttgataccactggtttaattccatgtgtacattgtactgaaggagacccagcatggcgtat

SEQ ID NO: 402193 - DNA, 140 bp, Artificial Sequence
  Synthetic
aggccctggctgctgatatgggcaaaagaggctgacgggaaggtcagtcaaaattatcctatagtacagaatctccaagggcaaatggtacatcagcccatatcacctagaactttaaatgaccttttgggacagcggtg

SEQ ID NO: 402194 - DNA, 140 bp, Artificial Sequence
  Synthetic
caccgctgtcccaaaaggtcatttaaagttctaggtgatatgggctgatgtaccatttgcccttggagattctgtactataggataattttgactgaccttcccgtcagcctcttttgcccatatcagcagccagggcct

SEQ ID NO: 402195 - DNA, 140 bp, Artificial Sequence
  Synthetic
aggccctggctgctgatatgaattaattgtaccagacccaacaacaatacaagaaaaagtataagaatcggtcctggacaagcgttctacgcaacaggtgacataataggagatataagagaccttttgggacagcggtg

SEQ ID NO: 402196 - DNA, 140 bp, Artificial Sequence
  Synthetic
caccgctgtcccaaaaggtctcttatatctcctattatgtcacctgttgcgtagaacgcttgtccaggaccgattcttatactttttcttgtattgttgttgggtctggtacaattaattcatatcagcagccagggcct

SEQ ID NO: 402197 - DNA, 140 bp, Artificial Sequence
  Synthetic
aggccctggctgctgatatggtcctggacaagcgttctacgcaacaggtgacataataggagatataagacaagcacattgtaatgtaagtggaaaagcatggaatgaaatgttgcggaagaccttttgggacagcggtg

SEQ ID NO: 402198 - DNA, 140 bp, Artificial Sequence
  Synthetic
caccgctgtcccaaaaggtcttccgcaacatttcattccatgcttttccacttacattacaatgtgcttgtcttatatctcctattatgtcacctgttgcgtagaacgcttgtccaggaccatatcagcagccagggcct

SEQ ID NO: 402199 - DNA, 140 bp, Artificial Sequence
  Synthetic
aggccctggctgctgatatggacgagcaatatatgcccctcccatcgaagggaacataacatgtagctcgagtatcacaggactactcttggcacgtgatggaggcttagataatgtcacgaccttttgggacagcggtg

SEQ ID NO: 402200 - DNA, 140 bp, Artificial Sequence
  Synthetic
caccgctgtcccaaaaggtcgtgacattatctaagcctccatcacgtgccaagagtagtcctgtgatactcgagctacatgttatgttcccttcgatgggaggggcatatattgctcgtccatatcagcagccagggcct

SEQ ID NO: 402201 - DNA, 140 bp, Artificial Sequence
  Synthetic
atacgccatgctgggtctccgacccaacaataatacaagaaaatatgtaaggatggggataggacgaggacaaacattccaggcaataggagccataataggagacataaaacaagcacacgtacttgggagtcggccat

SEQ ID NO: 402202 - DNA, 140 bp, Artificial Sequence
  Synthetic
atggccgactcccaagtacgtgtgcttgttttatgtctcctattatggctcctattgcctggaatgtttgtcctcgtcctatccccatccttacatattttcttgtattattgttgggtcggagacccagcatggcgtat

SEQ ID NO: 402203 - DNA, 140 bp, Artificial Sequence
  Synthetic
aggccctggctgctgatatgttaactcatccacaggaggggacctagaaattacaacacatagttttaattgtagaggagaatttttctattgcaacacatcaggactgtttaatacatcgaccttttgggacagcggtg

SEQ ID NO: 402204 - DNA, 140 bp, Artificial Sequence
  Synthetic
caccgctgtcccaaaaggtcgatgtattaaacagtcctgatgtgttgcaatagaaaaattctcctctacaattaaaactatgtgttgtaatttctaggtcccctcctgtggatgagttaacatatcagcagccagggcct

SEQ ID NO: 402205 - DNA, 140 bp, Artificial Sequence
  Synthetic
atacgccatgctgggtctccaagaattagaaaaacacttccctaataagacaataaaatttgcaccatcctcaggaggggatctagaaattacaacacatagctttaattgtagaggagacgtacttgggagtcggccat

SEQ ID NO: 402206 - DNA, 140 bp, Artificial Sequence
  Synthetic
atggccgactcccaagtacgtctcctctacaattaaagctatgtgttgtaatttctagatcccctcctgaggatggtgcaaattttattgtcttattagggaagtgtttttctaattcttggagacccagcatggcgtat

SEQ ID NO: 402207 - DNA, 140 bp, Artificial Sequence
  Synthetic
atacgccatgctgggtctccaccctccaatgcaggataagacaaattgtaaacatgtggcaagaggtaggaaaagcaatgtatgctgctcccattcaaggaagcataacatgtgcatcaacgtacttgggagtcggccat

SEQ ID NO: 402208 - DNA, 140 bp, Artificial Sequence
  Synthetic
atggccgactcccaagtacgttgatgcacatgttatgcttccttgaatgggagcagcatacattgcttttcctacctcttgccacatgtttacaatttgtcttatcctgcattggagggtggagacccagcatggcgtat

SEQ ID NO: 402209 - DNA, 140 bp, Artificial Sequence
  Synthetic
atacgccatgctgggtctccaaggagaagagtggtggagagagaaaaaagggcagttggactgggagctgtcttccttgggttcttaggagcagcaggaagcactatgggcgcggcgtcacgtacttgggagtcggccat

SEQ ID NO: 402210 - DNA, 140 bp, Artificial Sequence
  Synthetic
atggccgactcccaagtacgtgacgccgcgcccatagtgcttcctgctgctcctaagaacccaaggaagacagctcccagtccaactgcccttttttctctctccaccactcttctccttggagacccagcatggcgtat

SEQ ID NO: 402211 - DNA, 140 bp, Artificial Sequence
  Synthetic
aggccctggctgctgatatgtatcaggaaccatataaaaatctgaaaacaggaaagtatgcaaaaatgaggggtgcccacactaatgatgtaaaacaattaacagaggcagtgcaaaaaagaccttttgggacagcggtg

SEQ ID NO: 402212 - DNA, 140 bp, Artificial Sequence
  Synthetic
caccgctgtcccaaaaggtcttttttgcactgcctctgttaattgttttacatcattagtgtgggcacccctcatttttgcatactttcctgttttcagatttttatatggttcctgatacatatcagcagccagggcct

SEQ ID NO: 402213 - DNA, 140 bp, Artificial Sequence
  Synthetic
aggccctggctgctgatatgtcacagtctggggcattaaacagctccaggcaagagtcctggctgtagaaagatacctaaaggatcaacagctcctagggatttggggctgctctggaaagaccttttgggacagcggtg

SEQ ID NO: 402214 - DNA, 140 bp, Artificial Sequence
  Synthetic
caccgctgtcccaaaaggtctttccagagcagccccaaatccctaggagctgttgatcctttaggtatctttctacagccaggactcttgcctggagctgtttaatgccccagactgtgacatatcagcagccagggcct

SEQ ID NO: 402215 - DNA, 140 bp, Artificial Sequence
  Synthetic
aggccctggctgctgatatggctgctctggaaaactcatctgcaccacttctgtgccttggaatagtagttggagtaataaatctctagacaatatttgggagaacatgacatggatggagaccttttgggacagcggtg

SEQ ID NO: 402216 - DNA, 140 bp, Artificial Sequence
  Synthetic
caccgctgtcccaaaaggtctccatccatgtcatgttctcccaaatattgtctagagatttattactccaactactattccaaggcacagaagtggtgcagatgagttttccagagcagccatatcagcagccagggcct

SEQ ID NO: 402217 - DNA, 140 bp, Artificial Sequence
  Synthetic
aggccctggctgctgatatgaaatggggggcaagtggtcaaaaagcagtatagttggatggcctgctgtaagagaaagaataagaagaactgagccagcagcagagggagtaggagcagcgaccttttgggacagcggtg

SEQ ID NO: 402218 - DNA, 140 bp, Artificial Sequence
  Synthetic
caccgctgtcccaaaaggtcgctgctcctactccctctgctgctggctcagttcttcttattctttctcttacagcaggccatccaactatactgctttttgaccacttgccccccatttcatatcagcagccagggcct

SEQ ID NO: 402219 - DNA, 140 bp, Artificial Sequence
  Synthetic
aggccctggctgctgatatgccaataatgctgattgtgcctggctagaagcacaagaggaggcagatgaagtaggctttccagtcagacctcaggtgcctttaagaccaatgacttataagaccttttgggacagcggtg

SEQ ID NO: 402220 - DNA, 140 bp, Artificial Sequence
  Synthetic
caccgctgtcccaaaaggtcttataagtcattggtcttaaaggcacctgaggtctgactggaaagcctacttcatctgcctcctcttgtgcttctagccaggcacaatcagcattattggcatatcagcagccagggcct

SEQ ID NO: 402221 - DNA, 140 bp, Artificial Sequence
  Synthetic
aggccctggctgctgatatgatatagtatgggcaagcagggagctagaacgattcgcactaaatcctggcctgttagaaacatcagaaggctgtaaacaaataatggggcagatacaaccgaccttttgggacagcggtg

SEQ ID NO: 402222 - DNA, 140 bp, Artificial Sequence
  Synthetic
caccgctgtcccaaaaggtcggttgtatctgccccattatttgtttacagccttctgatgtttctaacaggccaggatttagtgcgaatcgttctagctccctgcttgcccatactatatcatatcagcagccagggcct

SEQ ID NO: 402223 - DNA, 140 bp, Artificial Sequence
  Synthetic
atacgccatgctgggtctcctaagacagggtcttgaaagagctttgcaataaaatgggaaacaagtggtcaaagggatggcctgctgtaagggaaagaataagaagaactaacccagtaccgtacttgggagtcggccat

SEQ ID NO: 402224 - DNA, 140 bp, Artificial Sequence
  Synthetic
atggccgactcccaagtacggtactgggttagttcttcttattctttcccttacagcaggccatccctttgaccacttgtttcccattttattgcaaagctctttcaagaccctgtcttaggagacccagcatggcgtat

SEQ ID NO: 402225 - DNA, 140 bp, Artificial Sequence
  Synthetic
aggccctggctgctgatatgaaagggatggcctgctgtaagggaaagaataagaagaactaacccagtaccagaaagagcagcagagggagtaggagcagtgtctcgagacttggatagagaccttttgggacagcggtg

SEQ ID NO: 402226 - DNA, 140 bp, Artificial Sequence
  Synthetic
caccgctgtcccaaaaggtctctatccaagtctcgagacactgctcctactccctctgctgctctttctggtactgggttagttcttcttattctttcccttacagcaggccatccctttcatatcagcagccagggcct

SEQ ID NO: 402227 - DNA, 140 bp, Artificial Sequence
  Synthetic
aggccctggctgctgatatgactcaagacaggatcagaagaacttagatcattatttaatacaatagcaaccctctggtgcgtgcaccaaaggatagaggtaaaggacaccaaagaagctgaccttttgggacagcggtg

SEQ ID NO: 402228 - DNA, 140 bp, Artificial Sequence
  Synthetic
caccgctgtcccaaaaggtcagcttctttggtgtcctttacctctatcctttggtgcacgcaccagagggttgctattgtattaaataatgatctaagttcttctgatcctgtcttgagtcatatcagcagccagggcct

SEQ ID NO: 402229 - DNA, 140 bp, Artificial Sequence
  Synthetic
aggccctggctgctgatatggacacagcaggcagaggctggcacaggaagcagcagcaaggtcagccaaaattaccctatagtgcaaaatgcacaagggcaaatggtacatcagcctgttgaccttttgggacagcggtg

SEQ ID NO: 402230 - DNA, 140 bp, Artificial Sequence
  Synthetic
caccgctgtcccaaaaggtcaacaggctgatgtaccatttgcccttgtgcattttgcactatagggtaattttggctgaccttgctgctgcttcctgtgccagcctctgcctgctgtgtccatatcagcagccagggcct

SEQ ID NO: 402231 - DNA, 140 bp, Artificial Sequence
  Synthetic
atacgccatgctgggtctcctgctattgtaaaagtgctgcttcatgcagttgtttcataaaaaaaggcttaggcatcttctatggcaggaagaagcgaagacaagacgaacagcctcctccgtacttgggagtcggccat

SEQ ID NO: 402232 - DNA, 140 bp, Artificial Sequence
  Synthetic
atggccgactcccaagtacggaggaggctgttcgtcttgtcttcgcttcttcctgccatagaagatgcctaagcctttttttatgaaacaactgcatgaagcagcacttttacaatagcaggagacccagcatggcgtat

SEQ ID NO: 402233 - DNA, 140 bp, Artificial Sequence
  Synthetic
atacgccatgctgggtctcctactgctactaataccactagtacaaccaatagtacaatagagggaggagaaatgaaaaactgctctttcaatatcaccacaagcataaaaaaggtgaaacgtacttgggagtcggccat

SEQ ID NO: 402234 - DNA, 140 bp, Artificial Sequence
  Synthetic
atggccgactcccaagtacgtttcaccttttttatgcttgtggtgatattgaaagagcagtttttcatttctcctccctctattgtactattggttgtactagtggtattagtagcagtaggagacccagcatggcgtat

SEQ ID NO: 402235 - DNA, 140 bp, Artificial Sequence
  Synthetic
atacgccatgctgggtctccaggcaaaaggcctcccacacaaatgatataagactattagcagaagtaatccagaaggtgtctcaagaatctatagttatctggggaaaattgcctaaatcgtacttgggagtcggccat

SEQ ID NO: 402236 - DNA, 140 bp, Artificial Sequence
  Synthetic
atggccgactcccaagtacgatttaggcaattttccccagataactatagattcttgagacaccttctggattacttctgctaatagtcttatatcatttgtgtgggaggccttttgcctggagacccagcatggcgtat

SEQ ID NO: 402237 - DNA, 140 bp, Artificial Sequence
  Synthetic
atacgccatgctgggtctccaattaccctgatagcatgaaagaagaaatgaaaaattgttctttcaatgtaaccacagaaataagagataagaaaaagaatgtgtatgcacttttttatacgtacttgggagtcggccat

SEQ ID NO: 402238 - DNA, 140 bp, Artificial Sequence
  Synthetic
atggccgactcccaagtacgtataaaaaagtgcatacacattctttttcttatctcttatttctgtggttacattgaaagaacaatttttcatttcttctttcatgctatcagggtaattggagacccagcatggcgtat

SEQ ID NO: 402239 - DNA, 140 bp, Artificial Sequence
  Synthetic
atacgccatgctgggtctccgcccagaggggacccggcaggcccgaaggaatcgaaggagaaggtggagagcaagacagaggcagatcagacagatttgtgaacggattcttgacgcttacgtacttgggagtcggccat

SEQ ID NO: 402240 - DNA, 140 bp, Artificial Sequence
  Synthetic
atggccgactcccaagtacgtaagcgtcaagaatccgttcacaaatctgtctgatctgcctctgtcttgctctccaccttctccttcgattccttcgggcctgccgggtcccctctgggcggagacccagcatggcgtat

SEQ ID NO: 402241 - DNA, 140 bp, Artificial Sequence
  Synthetic
atacgccatgctgggtctccggcaagtggtcaaaatgcagtctgggtggatggcctagggtaagggaaagaatgagacgcgctgagccagcagcagatggggtgggagcagtatctcgagcgtacttgggagtcggccat

SEQ ID NO: 402242 - DNA, 140 bp, Artificial Sequence
  Synthetic
atggccgactcccaagtacgctcgagatactgctcccaccccatctgctgctggctcagcgcgtctcattctttcccttaccctaggccatccacccagactgcattttgaccacttgccggagacccagcatggcgtat

SEQ ID NO: 402243 - DNA, 140 bp, Artificial Sequence
  Synthetic
atacgccatgctgggtctccataaaggaaaaattagcaaaatacttccaaaatataacgtttgaaccacactcaggaggggatctagaagttacaacacatagctttaattgtcaaggagcgtacttgggagtcggccat

SEQ ID NO: 402244 - DNA, 140 bp, Artificial Sequence
  Synthetic
atggccgactcccaagtacgctccttgacaattaaagctatgtgttgtaacttctagatcccctcctgagtgtggttcaaacgttatattttggaagtattttgctaatttttcctttatggagacccagcatggcgtat

SEQ ID NO: 402245 - DNA, 140 bp, Artificial Sequence
  Synthetic
aggccctggctgctgatatgagaatgtatagtaatatggggaaagactcctaagtttagactacccatacaaaaggaaacatgggaaacatggtggacagactattggcaggccacctgggaccttttgggacagcggtg

SEQ ID NO: 402246 - DNA, 140 bp, Artificial Sequence
  Synthetic
caccgctgtcccaaaaggtcccaggtggcctgccaatagtctgtccaccatgtttcccatgtttccttttgtatgggtagtctaaacttaggagtctttccccatattactatacattctcatatcagcagccagggcct

SEQ ID NO: 402247 - DNA, 140 bp, Artificial Sequence
  Synthetic
aggccctggctgctgatatgaggctaatgttaccaatgttgccatggatggtactgtccttaatgataccaatggagaaataaaaaattgctctttcaatgccaccacagaaataagagagaccttttgggacagcggtg

SEQ ID NO: 402248 - DNA, 140 bp, Artificial Sequence
  Synthetic
caccgctgtcccaaaaggtctctcttatttctgtggtggcattgaaagagcaattttttatttctccattggtatcattaaggacagtaccatccatggcaacattggtaacattagcctcatatcagcagccagggcct

SEQ ID NO: 402249 - DNA, 140 bp, Artificial Sequence
  Synthetic
aggccctggctgctgatatgttaatcactcctcaggaggggacccagaaattgtaaagcactcttttaattgtgcaggggaatttttctactgtgatacaacaaaactgtttaatagtacgaccttttgggacagcggtg

SEQ ID NO: 402250 - DNA, 140 bp, Artificial Sequence
  Synthetic
caccgctgtcccaaaaggtcgtactattaaacagttttgttgtatcacagtagaaaaattcccctgcacaattaaaagagtgctttacaatttctgggtcccctcctgaggagtgattaacatatcagcagccagggcct

SEQ ID NO: 402251 - DNA, 140 bp, Artificial Sequence
  Synthetic
atacgccatgctgggtctcccccttagtaatagctgcaatagtaggactaatagtagcattcatagcagccatagttgtgtggacaatagtatttatagaatataggaaaataagaagaccgtacttgggagtcggccat

SEQ ID NO: 402252 - DNA, 140 bp, Artificial Sequence
  Synthetic
atggccgactcccaagtacggtcttcttattttcctatattctataaatactattgtccacacaactatggctgctatgaatgctactattagtcctactattgcagctattactaagggggagacccagcatggcgtat

SEQ ID NO: 402253 - DNA, 140 bp, Artificial Sequence
  Synthetic
atacgccatgctgggtctccagaagcagctgacacaggaaaaaacagtcaggtcagccaaaattaccccatagtacagaatcttcaggggcaaatggtacaccaggccttatcacctagacgtacttgggagtcggccat

SEQ ID NO: 402254 - DNA, 140 bp, Artificial Sequence
  Synthetic
atggccgactcccaagtacgtctaggtgataaggcctggtgtaccatttgcccctgaagattctgtactatggggtaattttggctgacctgactgttttttcctgtgtcagctgcttctggagacccagcatggcgtat

SEQ ID NO: 402255 - DNA, 140 bp, Artificial Sequence
  Synthetic
atacgccatgctgggtctccaagcggagacagcgacgagcagctcctcacgacaataagaatcatcaagatcttataccaaagcagtaagtataatttaagtaaggtctgtaatgcaatccgtacttgggagtcggccat

SEQ ID NO: 402256 - DNA, 140 bp, Artificial Sequence
  Synthetic
atggccgactcccaagtacggattgcattacagaccttacttaaattatacttactgctttggtataagatcttgatgattcttattgtcgtgaggagctgctcgtcgctgtctccgcttggagacccagcatggcgtat

SEQ ID NO: 402257 - DNA, 140 bp, Artificial Sequence
  Synthetic
atacgccatgctgggtctccagaaaacataaaaaactgctctttcaatgtaaccacagaaataagagataggagtaagaaagaatatgcacttttctataaacttgatatagtaccaattcgtacttgggagtcggccat

SEQ ID NO: 402258 - DNA, 140 bp, Artificial Sequence
  Synthetic
atggccgactcccaagtacgaattggtactatatcaagtttatagaaaagtgcatattctttcttactcctatctcttatttctgtggttacattgaaagagcagttttttatgttttctggagacccagcatggcgtat

SEQ ID NO: 402259 - DNA, 140 bp, Artificial Sequence
  Synthetic
aggccctggctgctgatatgaccagctcttcagacaggaacagaggaacttagatcattatacaacacagtagcaactctctattgtgtacatgaaaagatagatgtacgagacaccaaggaccttttgggacagcggtg

SEQ ID NO: 402260 - DNA, 140 bp, Artificial Sequence
  Synthetic
caccgctgtcccaaaaggtccttggtgtctcgtacatctatcttttcatgtacacaatagagagttgctactgtgttgtataatgatctaagttcctctgttcctgtctgaagagctggtcatatcagcagccagggcct

SEQ ID NO: 402261 - DNA, 140 bp, Artificial Sequence
  Synthetic
aggccctggctgctgatatgtagcaactctctattgtgtacatgaaaagatagatgtacgagacaccaaggaagccttagacaaaatagaggaagaacaaaacaaaagtcagcaaaaagcgaccttttgggacagcggtg

SEQ ID NO: 402262 - DNA, 140 bp, Artificial Sequence
  Synthetic
caccgctgtcccaaaaggtcgctttttgctgacttttgttttgttcttcctctattttgtctaaggcttccttggtgtctcgtacatctatcttttcatgtacacaatagagagttgctacatatcagcagccagggcct

SEQ ID NO: 402263 - DNA, 140 bp, Artificial Sequence
  Synthetic
atacgccatgctgggtctccaccaccctcaggaggagatctagaagtcacaatgcatcattttaattgtagaggggaatttttctattgtaatacaacaaatttatttaatatttgcatacgtacttgggagtcggccat

SEQ ID NO: 402264 - DNA, 140 bp, Artificial Sequence
  Synthetic
atggccgactcccaagtacgtatgcaaatattaaataaatttgttgtattacaatagaaaaattcccctctacaattaaaatgatgcattgtgacttctagatctcctcctgagggtggtggagacccagcatggcgtat

SEQ ID NO: 402265 - DNA, 140 bp, Artificial Sequence
  Synthetic
atacgccatgctgggtctcccactcccatgtagaataaaacaaattgtgagaatgtggcagagagtgggacaagcaatgtatgcccctcccatagcaggagcaattacatgtagatcaaacgtacttgggagtcggccat

SEQ ID NO: 402266 - DNA, 140 bp, Artificial Sequence
  Synthetic
atggccgactcccaagtacgtttgatctacatgtaattgctcctgctatgggaggggcatacattgcttgtcccactctctgccacattctcacaatttgttttattctacatgggagtgggagacccagcatggcgtat

SEQ ID NO: 402267 - DNA, 140 bp, Artificial Sequence
  Synthetic
atacgccatgctgggtctccagctgtactaattatggtaatattccccacaacaataccataaggggagaaataaaaaattgcactttcaatacgaccacagaaataaaagataagaaaacgtacttgggagtcggccat

SEQ ID NO: 402268 - DNA, 140 bp, Artificial Sequence
  Synthetic
atggccgactcccaagtacgttttcttatcttttatttctgtggtcgtattgaaagtgcaattttttatttctccccttatggtattgttgtggggaatattaccataattagtacagctggagacccagcatggcgtat

SEQ ID NO: 402269 - DNA, 140 bp, Artificial Sequence
  Synthetic
aggccctggctgctgatatgctgggattaaataaaatagtaagaatgtatagccctattagcattttggacataagacaagggccaaaagaacccttcagagattatgtagataggttctgaccttttgggacagcggtg

SEQ ID NO: 402270 - DNA, 140 bp, Artificial Sequence
  Synthetic
caccgctgtcccaaaaggtcagaacctatctacataatctctgaagggttcttttggcccttgtcttatgtccaaaatgctaatagggctatacattcttactattttatttaatcccagcatatcagcagccagggcct

SEQ ID NO: 402271 - DNA, 140 bp, Artificial Sequence
  Synthetic
atacgccatgctgggtctcccaggacaaacattctatgcaacaggtggcataataggagacataagaaaagcatattgtaacatttctagaagcaattggaacacaactttagaaaaagtcgtacttgggagtcggccat

SEQ ID NO: 402272 - DNA, 140 bp, Artificial Sequence
  Synthetic
atggccgactcccaagtacgactttttctaaagttgtgttccaattgcttctagaaatgttacaatatgcttttcttatgtctcctattatgccacctgttgcatagaatgtttgtcctgggagacccagcatggcgtat

SEQ ID NO: 402273 - DNA, 140 bp, Artificial Sequence
  Synthetic
  misc_feature (61)..(61): n is a, c, g, or t
  misc_feature (68)..(68): n is a, c, g, or t
  misc_feature (83)..(83): n is a, c, g, or t
atacgccatgctgggtctccatggcccgagataagggagagattaagaagaactagaaccncccctgnagcagcagaaggagnaggagcagcatctaaagatttagctaaacatggagcacgtacttgggagtcggccat

SEQ ID NO: 402274 - DNA, 140 bp, Artificial Sequence
  Synthetic
  misc_feature (58)..(58): n is a, c, g, or t
  misc_feature (73)..(73): n is a, c, g, or t
  misc_feature (80)..(80): n is a, c, g, or t
atggccgactcccaagtacgtgctccatgtttagctaaatctttagatgctgctcctnctccttctgctgctncaggggnggttctagttcttcttaatctctcccttatctcgggccatggagacccagcatggcgtat

SEQ ID NO: 402275 - DNA, 140 bp, Artificial Sequence
  Synthetic
  misc_feature (95)..(95): n is a, c, g, or t
atacgccatgctgggtctccatttgtagagctatttataacatacctagaagaatcagacagggttttgaagcagctttgcagtaacatggggancaaatggtcaaaaagtagcatagtgcgtacttgggagtcggccat

SEQ ID NO: 402276 - DNA, 140 bp, Artificial Sequence
  Synthetic
  misc_feature (46)..(46): n is a, c, g, or t
atggccgactcccaagtacgcactatgctactttttgaccatttgntccccatgttactgcaaagctgcttcaaaaccctgtctgattcttctaggtatgttataaatagctctacaaatggagacccagcatggcgtat

SEQ ID NO: 402277 - DNA, 140 bp, Artificial Sequence
  Synthetic
aggccctggctgctgatatgccagagccaacagccccaccagcggagagcttcaggtttggggaagagacaacaactccatctcagaagcaggagccgatagacaaggaactatatccttgaccttttgggacagcggtg

SEQ ID NO: 402278 - DNA, 140 bp, Artificial Sequence
  Synthetic
caccgctgtcccaaaaggtcaaggatatagttccttgtctatcggctcctgcttctgagatggagttgttgtctcttccccaaacctgaagctctccgctggtggggctgttggctctggcatatcagcagccagggcct

SEQ ID NO: 402279 - DNA, 140 bp, Artificial Sequence
  Synthetic
aggccctggctgctgatatggtcaacataattggaagaaatctgttgactcagattggttgcactttaaattttcccattagtcctattgaaactgtaccagtaaaattaaagccaggaagaccttttgggacagcggtg

SEQ ID NO: 402280 - DNA, 140 bp, Artificial Sequence
  Synthetic
caccgctgtcccaaaaggtcttcctggctttaattttactggtacagtttcaataggactaatgggaaaatttaaagtgcaaccaatctgagtcaacagatttcttccaattatgttgaccatatcagcagccagggcct

SEQ ID NO: 402281 - DNA, 140 bp, Artificial Sequence
  Synthetic
atacgccatgctgggtctccaaaactgctctttcaatatcaccacaagcacaggaactaaggtaagagactctgcactttttaataagcttgatgtattaccaatagataatagtagtaccgtacttgggagtcggccat

SEQ ID NO: 402282 - DNA, 140 bp, Artificial Sequence
  Synthetic
atggccgactcccaagtacggtactactattatctattggtaatacatcaagcttattaaaaagtgcagagtctcttaccttagttcctgtgcttgtggtgatattgaaagagcagttttggagacccagcatggcgtat

SEQ ID NO: 402283 - DNA, 140 bp, Artificial Sequence
  Synthetic
atacgccatgctgggtctccattgtacaagacccaacaacaatacaagaaaaaggataactatgggaccagggagagtattgtatacaacaggacaaatagtaggagatataagaaaagccgtacttgggagtcggccat

SEQ ID NO: 402284 - DNA, 140 bp, Artificial Sequence
  Synthetic
atggccgactcccaagtacggcttttcttatatctcctactatttgtcctgttgtatacaatactctccctggtcccatagttatcctttttcttgtattgttgttgggtcttgtacaatggagacccagcatggcgtat

SEQ ID NO: 402285 - DNA, 140 bp, Artificial Sequence
  Synthetic
atacgccatgctgggtctcctctgcaggaggggatccagaggttgtaatgcacatttctaattgtggaggggaatttttctactgtaatacctcacgactgtttaatagtacttggtatacgtacttgggagtcggccat

SEQ ID NO: 402286 - DNA, 140 bp, Artificial Sequence
  Synthetic
atggccgactcccaagtacgtataccaagtactattaaacagtcgtgaggtattacagtagaaaaattcccctccacaattagaaatgtgcattacaacctctggatcccctcctgcagaggagacccagcatggcgtat

SEQ ID NO: 402287 - DNA, 140 bp, Artificial Sequence
  Synthetic
aggccctggctgctgatatgctcccttgcagaataaaacaaattgtaaacaggtggcaggaagtagggaaagcaatatatgcccctcccattgcaggaccaattaattgttcatcaaaaagaccttttgggacagcggtg

SEQ ID NO: 402288 - DNA, 140 bp, Artificial Sequence
  Synthetic
caccgctgtcccaaaaggtctttttgatgaacaattaattggtcctgcaatgggaggggcatatattgctttccctacttcctgccacctgtttacaatttgttttattctgcaagggagcatatcagcagccagggcct

SEQ ID NO: 402289 - DNA, 140 bp, Artificial Sequence
  Synthetic
atacgccatgctgggtctcctgagaggagaaataaaaaattgctctttcaatacaaccacagaactaagggataagaagcagaaagtgtatgcacttttttatagacctgatatagtacccgtacttgggagtcggccat

SEQ ID NO: 402290 - DNA, 140 bp, Artificial Sequence
  Synthetic
atggccgactcccaagtacgggtactatatcaggtctataaaaaagtgcatacactttctgcttcttatcccttagttctgtggttgtattgaaagagcaattttttatttctcctctcaggagacccagcatggcgtat

SEQ ID NO: 402291 - DNA, 140 bp, Artificial Sequence
  Synthetic
aggccctggctgctgatatgggtgctgattgtgtggcaggtagacaggatgaagattagaacatggaatagtttagtaaagcaccatatgtatgtttcaaggagagctaatggatggtttgaccttttgggacagcggtg

SEQ ID NO: 402292 - DNA, 140 bp, Artificial Sequence
  Synthetic
caccgctgtcccaaaaggtcaaaccatccattagctctccttgaaacatacatatggtgctttactaaactattccatgttctaatcttcatcctgtctacctgccacacaatcagcacccatatcagcagccagggcct

SEQ ID NO: 402293 - DNA, 140 bp, Artificial Sequence
  Synthetic
atacgccatgctgggtctcctctctaatcactcctcaggaggggacctagaaattgtaacacacagttttatttgtggaggggaattcttctactgtaatacatcacaattgtttacttgcgtacttgggagtcggccat

SEQ ID NO: 402294 - DNA, 140 bp, Artificial Sequence
  Synthetic
atggccgactcccaagtacgcaagtaaacaattgtgatgtattacagtagaagaattcccctccacaaataaaactgtgtgttacaatttctaggtcccctcctgaggagtgattagagaggagacccagcatggcgtat

SEQ ID NO: 402295 - DNA, 140 bp, Artificial Sequence
  Synthetic
aggccctggctgctgatatggaccatagtgctcatagaatacaggaaaatattaagacaaagaaaaatagacaggttaattgatagaataatagaaagagcagaagacagtggcaatgaggaccttttgggacagcggtg

SEQ ID NO: 402296 - DNA, 140 bp, Artificial Sequence
  Synthetic
caccgctgtcccaaaaggtcctcattgccactgtcttctgctctttctattattctatcaattaacctgtctatttttctttgtcttaatattttcctgtattctatgagcactatggtccatatcagcagccagggcct

SEQ ID NO: 402297 - DNA, 140 bp, Artificial Sequence
  Synthetic
aggccctggctgctgatatgaggaatcgaagaagaaggtggagagcgagacagaggcagatccgagagattagtgaacggattcttgacacttatctgggaggatctacggagcctgtgcgaccttttgggacagcggtg

SEQ ID NO: 402298 - DNA, 140 bp, Artificial Sequence
  Synthetic
caccgctgtcccaaaaggtcgcacaggctccgtagatcctcccagataagtgtcaagaatccgttcactaatctctcggatctgcctctgtctcgctctccaccttcttcttcgattcctcatatcagcagccagggcct

SEQ ID NO: 402299 - DNA, 140 bp, Artificial Sequence
  Synthetic
atacgccatgctgggtctccaagaacacttccctaataaaacaacaataaaatttcaaccatcctcaggaggggatctagaagtgacaacacatacctttaattgtagaggagaatttttcgtacttgggagtcggccat

SEQ ID NO: 402300 - DNA, 140 bp, Artificial Sequence
  Synthetic
atggccgactcccaagtacgaaaaattctcctctacaattaaaggtatgtgttgtcacttctagatcccctcctgaggatggttgaaattttattgttgttttattagggaagtgttcttggagacccagcatggcgtat

SEQ ID NO: 402301 - DNA, 140 bp, Artificial Sequence
  Synthetic
atacgccatgctgggtctccactaccattaatggtgctaataacgctaatagaacaatagaggataagatgggggaactaataaaaagctgctctttcaatatcaccacaagcataggagcgtacttgggagtcggccat

SEQ ID NO: 402302 - DNA, 140 bp, Artificial Sequence
  Synthetic
atggccgactcccaagtacgctcctatgcttgtggtgatattgaaagagcagctttttattagttcccccatcttatcctctattgttctattagcgttattagcaccattaatggtagtggagacccagcatggcgtat

SEQ ID NO: 402303 - DNA, 140 bp, Artificial Sequence
  Synthetic
aggccctggctgctgatatgatagaatataggaaattgttaagacaaagaaaaatagactggttaattaaaagaattagggaaagagcagaagacagtggcaatgagagtgagggggatagaccttttgggacagcggtg

SEQ ID NO: 402304 - DNA, 140 bp, Artificial Sequence
  Synthetic
caccgctgtcccaaaaggtctatccccctcactctcattgccactgtcttctgctctttccctaattcttttaattaaccagtctatttttctttgtcttaacaatttcctatattctatcatatcagcagccagggcct

SEQ ID NO: 402305 - DNA, 140 bp, Artificial Sequence
  Synthetic
aggccctggctgctgatatgtgtacccacagaccccaacccacaagaaatggttttgggaaatgtaacagaaaattttaacatgtgggaaaatgacatggtggatcagatgcatgaggatgaccttttgggacagcggtg

SEQ ID NO: 402306 - DNA, 140 bp, Artificial Sequence
  Synthetic
caccgctgtcccaaaaggtcatcctcatgcatctgatccaccatgtcattttcccacatgttaaaattttctgttacatttcccaaaaccatttcttgtgggttggggtctgtgggtacacatatcagcagccagggcct

SEQ ID NO: 402307 - DNA, 140 bp, Artificial Sequence
  Synthetic
aggccctggctgctgatatgactctgtgtcgctttaaactgtactgatgtttccagtgaagatcacaatatgactggagaaataaaaaattgctctttcaaaacaaccacagaactaaaagaccttttgggacagcggtg

SEQ ID NO: 402308 - DNA, 140 bp, Artificial Sequence
  Synthetic
caccgctgtcccaaaaggtcttttagttctgtggttgttttgaaagagcaattttttatttctccagtcatattgtgatcttcactggaaacatcagtacagtttaaagcgacacagagtcatatcagcagccagggcct

SEQ ID NO: 402309 - DNA, 140 bp, Artificial Sequence
  Synthetic
atacgccatgctgggtctccccacccatagtagcaaaagaaatagtagctagctgtgataaatgtcagctaaaaaaagaagccatacatggacaagtagactgtagtccaaggatatggccgtacttgggagtcggccat

SEQ ID NO: 402310 - DNA, 140 bp, Artificial Sequence
  Synthetic
atggccgactcccaagtacggccatatccttggactacagtctacttgtccatgtatggcttctttttttagctgacatttatcacagctagctactatttcttttgctactatgggtggggagacccagcatggcgtat

SEQ ID NO: 402311 - DNA, 140 bp, Artificial Sequence
  Synthetic
aggccctggctgctgatatgaccatagcaatagcagtagctgaaggaacagataggattattgaaataatacaaagaatctgtagagctatccgcaacatacctacaagaataagacagggaccttttgggacagcggtg

SEQ ID NO: 402312 - DNA, 140 bp, Artificial Sequence
  Synthetic
caccgctgtcccaaaaggtccctgtcttattcttgtaggtatgttgcggatagctctacagattctttgtattatttcaataatcctatctgttccttcagctactgctattgctatggtcatatcagcagccagggcct

SEQ ID NO: 402313 - DNA, 140 bp, Artificial Sequence
  Synthetic
aggccctggctgctgatatgagtcagcctacaactgcttgtagcaagtgttactgtaaaaagtgctgctggcattgccaattatgctttctgaacaagggcttaggcatctcctatggcagaccttttgggacagcggtg

SEQ ID NO: 402314 - DNA, 140 bp, Artificial Sequence
  Synthetic
caccgctgtcccaaaaggtctgccataggagatgcctaagcccttgttcagaaagcataattggcaatgccagcagcactttttacagtaacacttgctacaagcagttgtaggctgactcatatcagcagccagggcct

SEQ ID NO: 402315 - DNA, 140 bp, Artificial Sequence
  Synthetic
atacgccatgctgggtctcctccctggtaaaacaaacataacatttcaaccacactcaggaggggacctagaaattacaacacatagctttaattgtagaggagaatttttttattgtgacgtacttgggagtcggccat

SEQ ID NO: 402316 - DNA, 140 bp, Artificial Sequence
  Synthetic
atggccgactcccaagtacgtcacaataaaaaaattctcctctacaattaaagctatgtgttgtaatttctaggtcccctcctgagtgtggttgaaatgttatgtttgttttaccagggaggagacccagcatggcgtat

SEQ ID NO: 402317 - DNA, 140 bp, Artificial Sequence
  Synthetic
atacgccatgctgggtctccctaatgccacttgtaataagaccaatgttaaatgtgaagatgtgggaaacttaaaaaactgctctttcaatgtaaccacagaattaagagataagaagaacgtacttgggagtcggccat

SEQ ID NO: 402318 - DNA, 140 bp, Artificial Sequence
  Synthetic
atggccgactcccaagtacgttcttcttatctcttaattctgtggttacattgaaagagcagttttttaagtttcccacatcttcacatttaacattggtcttattacaagtggcattagggagacccagcatggcgtat

SEQ ID NO: 402319 - DNA, 140 bp, Artificial Sequence
  Synthetic
aggccctggctgctgatatgacagataggattatagaagtagtacaaagaattggtagagctattctccacatacctagaagaataagacagggctttgaaagggctttgctataagatggaccttttgggacagcggtg

SEQ ID NO: 402320 - DNA, 140 bp, Artificial Sequence
  Synthetic
caccgctgtcccaaaaggtccatcttatagcaaagccctttcaaagccctgtcttattcttctaggtatgtggagaatagctctaccaattctttgtactacttctataatcctatctgtcatatcagcagccagggcct

SEQ ID NO: 402321 - DNA, 140 bp, Artificial Sequence
  Synthetic
atacgccatgctgggtctccgggaccaggacatgtattctatagcacaggagaaataacaggagaagtaaagaaagcatattgtgaggttaatggaacaacatggagtaaagttctaacacgtacttgggagtcggccat

SEQ ID NO: 402322 - DNA, 140 bp, Artificial Sequence
  Synthetic
atggccgactcccaagtacgtgttagaactttactccatgttgttccattaacctcacaatatgctttctttacttctcctgttatttctcctgtgctatagaatacatgtcctggtcccggagacccagcatggcgtat

SEQ ID NO: 402323 - DNA, 140 bp, Artificial Sequence
  Synthetic
  misc_feature (35)..(35): n is a, c, g, or t
aggccctggctgctgatatgaacaacaatacaagnaaaagtataggattcggtcctggacaaacgttctacgcaacaggtgatataataggagatataagagaagcacattgtaatgtaagaccttttgggacagcggtg

SEQ ID NO: 402324 - DNA, 140 bp, Artificial Sequence
  Synthetic
  misc_feature (106)..(106): n is a, c, g, or t
caccgctgtcccaaaaggtcttacattacaatgtgcttctcttatatctcctattatatcacctgttgcgtagaacgtttgtccaggaccgaatcctatacttttncttgtattgttgttcatatcagcagccagggcct

SEQ ID NO: 402325 - DNA, 140 bp, Artificial Sequence
  Synthetic
  misc_feature (71)..(71): n is a, c, g, or t
  misc_feature (98)..(98): n is a, c, g, or t
atacgccatgctgggtctccaagatctttaacaagactatactctttaactcatccataggaggggacctngaaattacaacacatagttttaattgnagaggagaatttttctattgtacgtacttgggagtcggccat

SEQ ID NO: 402326 - DNA, 140 bp, Artificial Sequence
  Synthetic
  misc_feature (43)..(43): n is a, c, g, or t
  misc_feature (70)..(70): n is a, c, g, or t
atggccgactcccaagtacgtacaatagaaaaattctcctctncaattaaaactatgtgttgtaatttcnaggtcccctcctatggatgagttaaagagtatagtcttgttaaagatcttggagacccagcatggcgtat

SEQ ID NO: 402327 - DNA, 140 bp, Artificial Sequence
  Synthetic
aggccctggctgctgatatgcaagtggtcaaaaagcagtatagttggatggcctgctgtaagagaaagaataagacaaactagaattgagccagcagcagagggagtaggagcagcatctgaccttttgggacagcggtg

SEQ ID NO: 402328 - DNA, 140 bp, Artificial Sequence
  Synthetic
caccgctgtcccaaaaggtcagatgctgctcctactccctctgctgctggctcaattctagtttgtcttattctttctcttacagcaggccatccaactatactgctttttgaccacttgcatatcagcagccagggcct

SEQ ID NO: 402329 - DNA, 140 bp, Artificial Sequence
  Synthetic
atacgccatgctgggtctcctcactttaaatcgtactaatgttaccgaaaatagtactgctggctacaatcatacagaaatgaaaaattgctctttcaacgcaaccacagaaataaaagacgtacttgggagtcggccat

SEQ ID NO: 402330 - DNA, 140 bp, Artificial Sequence
  Synthetic
atggccgactcccaagtacgtcttttatttctgtggttgcgttgaaagagcaatttttcatttctgtatgattgtagccagcagtactattttcggtaacattagtacgatttaaagtgaggagacccagcatggcgtat

SEQ ID NO: 402331 - DNA, 140 bp, Artificial Sequence
  Synthetic
aggccctggctgctgatatgaatagagttaggcagggatactcacctttgtctttccagacccctctccatcagcagagggaacccgacagacccgaaagaatcgaagaagaaggtggcggaccttttgggacagcggtg

SEQ ID NO: 402332 - DNA, 140 bp, Artificial Sequence
  Synthetic
caccgctgtcccaaaaggtccgccaccttcttcttcgattctttcgggtctgtcgggttccctctgctgatggagaggggtctggaaagacaaaggtgagtatccctgcctaactctattcatatcagcagccagggcct

SEQ ID NO: 402333 - DNA, 140 bp, Artificial Sequence
  Synthetic
aggccctggctgctgatatgacaagacccaacaataatacaagaaaaagtataaagataagaccaggacaaacattttttgcaactaacataataagagacataagacaagcacattgtagaccttttgggacagcggtg

SEQ ID NO: 402334 - DNA, 140 bp, Artificial Sequence
  Synthetic
caccgctgtcccaaaaggtctacaatgtgcttgtcttatgtctcttattatgttagttgcaaaaaatgtttgtcctggtcttatctttatactttttcttgtattattgttgggtcttgtcatatcagcagccagggcct

SEQ ID NO: 402335 - DNA, 140 bp, Artificial Sequence
  Synthetic
aggccctggctgctgatatgtagcacgaagagcttggagagccattatccacatacctagaagaatcagacagggcttagaaagggctttgctataacatgggaggcaagtggtcaaaaagaccttttgggacagcggtg

SEQ ID NO: 402336 - DNA, 140 bp, Artificial Sequence
  Synthetic
caccgctgtcccaaaaggtctttttgaccacttgcctcccatgttatagcaaagccctttctaagccctgtctgattcttctaggtatgtggataatggctctccaagctcttcgtgctacatatcagcagccagggcct

SEQ ID NO: 402337 - DNA, 140 bp, Artificial Sequence
  Synthetic
atacgccatgctgggtctccttaaaagaacacttccctaataaaacaataaattttaattcatcctcagaagaggacctagaaattacaacacacagctttaattgtagaagagaattttcgtacttgggagtcggccat

SEQ ID NO: 402338 - DNA, 140 bp, Artificial Sequence
  Synthetic
atggccgactcccaagtacgaaaattctcttctacaattaaagctgtgtgttgtaatttctaggtcctcttctgaggatgaattaaaatttattgttttattagggaagtgttcttttaaggagacccagcatggcgtat

SEQ ID NO: 402339 - DNA, 140 bp, Artificial Sequence
  Synthetic
aggccctggctgctgatatgctggacagatagggttatagaagtagcacaaagagcttgtagagctattatcaacatacctagaaggataagacaaggctttgaaagagctttgctataagaccttttgggacagcggtg

SEQ ID NO: 402340 - DNA, 140 bp, Artificial Sequence
  Synthetic
caccgctgtcccaaaaggtcttatagcaaagctctttcaaagccttgtcttatccttctaggtatgttgataatagctctacaagctctttgtgctacttctataaccctatctgtccagcatatcagcagccagggcct

SEQ ID NO: 402341 - DNA, 140 bp, Artificial Sequence
  Synthetic
atacgccatgctgggtctcctcaacatacctagaaggataagacaaggctttgaaagagctttgctataaaatgggaggcaaatggtcaaaaaggagcatgggtggatggtccgagataacgtacttgggagtcggccat

SEQ ID NO: 402342 - DNA, 140 bp, Artificial Sequence
  Synthetic
atggccgactcccaagtacgttatctcggaccatccacccatgctcctttttgaccatttgcctcccattttatagcaaagctctttcaaagccttgtcttatccttctaggtatgttgaggagacccagcatggcgtat

SEQ ID NO: 402343 - DNA, 140 bp, Artificial Sequence
  Synthetic
atacgccatgctgggtctccgcagcagaaggagtaggagcagcatctcaagatttagccagacatggagcaatcacaagcagtaatacaccacaaaccaatgctgattgtgcctggctggcgtacttgggagtcggccat

SEQ ID NO: 402344 - DNA, 140 bp, Artificial Sequence
  Synthetic
atggccgactcccaagtacgccagccaggcacaatcagcattggtttgtggtgtattactgcttgtgattgctccatgtctggctaaatcttgagatgctgctcctactccttctgctgcggagacccagcatggcgtat

SEQ ID NO: 402345 - DNA, 140 bp, Artificial Sequence
  Synthetic
aggccctggctgctgatatgaaagatacctacaagatcaacagctcctaggaatttaaggctgctctggaaaactcatctgcaccactaatgtgccttggaactccagctagagtaataagaccttttgggacagcggtg

SEQ ID NO: 402346 - DNA, 140 bp, Artificial Sequence
  Synthetic
caccgctgtcccaaaaggtcttattactctagctggagttccaaggcacattagtggtgcagatgagttttccagagcagccttaaattcctaggagctgttgatcttgtaggtatctttcatatcagcagccagggcct

SEQ ID NO: 402347 - DNA, 140 bp, Artificial Sequence
  Synthetic
aggccctggctgctgatatgaggaacagaggagattaaatcattatttaatacagtagcaaccctctattgtgtacatcaaaggatagaggtaaaagacaccaaagaagctctagaggaagaccttttgggacagcggtg

SEQ ID NO: 402348 - DNA, 140 bp, Artificial Sequence
  Synthetic
caccgctgtcccaaaaggtcttcctctagagcttctttggtgtcttttacctctatcctttgatgtacacaatagagggttgctactgtattaaataatgatttaatctcctctgttcctcatatcagcagccagggcct

SEQ ID NO: 402349 - DNA, 140 bp, Artificial Sequence
  Synthetic
aggccctggctgctgatatgaagcattgggaccagcagctacactagaagaaatgatgacagcatgtcagggagtggggggacccggccataaagcaagagttttggctgaagcaatgaggaccttttgggacagcggtg

SEQ ID NO: 402350 - DNA, 140 bp, Artificial Sequence
  Synthetic
caccgctgtcccaaaaggtcctcattgcttcagccaaaactcttgctttatggccgggtccccccactccctgacatgctgtcatcatttcttctagtgtagctgctggtcccaatgcttcatatcagcagccagggcct

SEQ ID NO: 402351 - DNA, 140 bp, Artificial Sequence
  Synthetic
atacgccatgctgggtctcctcttagagccctttaggaaagcaaatccagaaatagttatctgtcaatatgtggatgacttgtatgtagcatctgatctagaaatagggcaacatagagccgtacttgggagtcggccat

SEQ ID NO: 402352 - DNA, 140 bp, Artificial Sequence
  Synthetic
atggccgactcccaagtacggctctatgttgccctatttctagatcagatgctacatacaagtcatccacatattgacagataactatttctggatttgctttcctaaagggctctaagaggagacccagcatggcgtat

SEQ ID NO: 402353 - DNA, 140 bp, Artificial Sequence
  Synthetic
atacgccatgctgggtctccagacaggctaattttttagggaaaatctggccttccaacaaagggaggccaggaaactttccccagaacaggatagagccaacagccccaccagcagagacgtacttgggagtcggccat

SEQ ID NO: 402354 - DNA, 140 bp, Artificial Sequence
  Synthetic
atggccgactcccaagtacgtctctgctggtggggctgttggctctatcctgttctggggaaagtttcctggcctccctttgttggaaggccagattttccctaaaaaattagcctgtctggagacccagcatggcgtat

SEQ ID NO: 402355 - DNA, 140 bp, Artificial Sequence
  Synthetic
aggccctggctgctgatatgcctccctcaaatcactctttggcaacgacccctagtcacagtaagaatagggggacagctaatagaagctctattagacacaggagcagatgatacagtagaccttttgggacagcggtg

SEQ ID NO: 402356 - DNA, 140 bp, Artificial Sequence
  Synthetic
caccgctgtcccaaaaggtctactgtatcatctgctcctgtgtctaatagagcttctattagctgtccccctattcttactgtgactaggggtcgttgccaaagagtgatttgagggaggcatatcagcagccagggcct

SEQ ID NO: 402357 - DNA, 140 bp, Artificial Sequence
  Synthetic
atacgccatgctgggtctccgatcatcaaaattctgtacaaaagcagtaagtattagtaattagtatatgtaatgttgcctttgcacatctgtgcaatagtaggactgatagtagcgctacgtacttgggagtcggccat

SEQ ID NO: 402358 - DNA, 140 bp, Artificial Sequence
  Synthetic
atggccgactcccaagtacgtagcgctactatcagtcctactattgcacagatgtgcaaaggcaacattacatatactaattactaatacttactgcttttgtacagaattttgatgatcggagacccagcatggcgtat

SEQ ID NO: 402359 - DNA, 140 bp, Artificial Sequence
  Synthetic
atacgccatgctgggtctccaggagaaatgagaaacagtaataagacagtagaaggagaaatgagaaactgctctttcaatatcaccacaagcataggaactaaggtaaaggactatgcacgtacttgggagtcggccat

SEQ ID NO: 402360 - DNA, 140 bp, Artificial Sequence
  Synthetic
atggccgactcccaagtacgtgcatagtcctttaccttagttcctatgcttgtggtgatattgaaagagcagtttctcatttctccttctactgtcttattactgtttctcatttctcctggagacccagcatggcgtat

SEQ ID NO: 402361 - DNA, 140 bp, Artificial Sequence
  Synthetic
atacgccatgctgggtctcctaatgctacctatgataatgagataaaaaattgctctttcaatacaaccacagaaataagggataagaacaagaaagggtatgcacttttttatagacctcgtacttgggagtcggccat

SEQ ID NO: 402362 - DNA, 140 bp, Artificial Sequence
  Synthetic
atggccgactcccaagtacgaggtctataaaaaagtgcataccctttcttgttcttatcccttatttctgtggttgtattgaaagagcaattttttatctcattatcataggtagcattaggagacccagcatggcgtat

SEQ ID NO: 402363 - DNA, 140 bp, Artificial Sequence
  Synthetic
aggccctggctgctgatatgtctttaatcaatcctcaggaggggacctagagattgtaatgcacagttttaattgtggaggggaatttttctattgtaatacaacacaactgtttaataggaccttttgggacagcggtg

SEQ ID NO: 402364 - DNA, 140 bp, Artificial Sequence
  Synthetic
caccgctgtcccaaaaggtcctattaaacagttgtgttgtattacaatagaaaaattcccctccacaattaaaactgtgcattacaatctctaggtcccctcctgaggattgattaaagacatatcagcagccagggcct

SEQ ID NO: 402365 - DNA, 140 bp, Artificial Sequence
  Synthetic
aggccctggctgctgatatgagtagcacccaccagggcaaagagaagagtggtgcagagagaaaaaagagcagtgggaatgatgggagctatgttccttgggttcttgggaacagcaggagaccttttgggacagcggtg

SEQ ID NO: 402366 - DNA, 140 bp, Artificial Sequence
  Synthetic
caccgctgtcccaaaaggtctcctgctgttcccaagaacccaaggaacatagctcccatcattcccactgctcttttttctctctgcaccactcttctctttgccctggtgggtgctactcatatcagcagccagggcct

SEQ ID NO: 402367 - DNA, 140 bp, Artificial Sequence
  Synthetic
atacgccatgctgggtctccaagggaaaaattaaaagaacactacaagaataaaacaataatatttgaccaaccctcaggaggggatatagaaattacaacacatagctttaattgtagacgtacttgggagtcggccat

SEQ ID NO: 402368 - DNA, 140 bp, Artificial Sequence
  Synthetic
atggccgactcccaagtacgtctacaattaaagctatgtgttgtaatttctatatcccctcctgagggttggtcaaatattattgttttattcttgtagtgttcttttaatttttcccttggagacccagcatggcgtat

SEQ ID NO: 402369 - DNA, 140 bp, Artificial Sequence
  Synthetic
aggccctggctgctgatatgaagacagcagtacaaatggcagtattcattcacaattttaaaagaaaaggggggattggggggtacagtgcaggggaaagaataatagacataatagcaagaccttttgggacagcggtg

SEQ ID NO: 402370 - DNA, 140 bp, Artificial Sequence
  Synthetic
caccgctgtcccaaaaggtcttgctattatgtctattattctttcccctgcactgtaccccccaatccccccttttcttttaaaattgtgaatgaatactgccatttgtactgctgtcttcatatcagcagccagggcct

SEQ ID NO: 402371 - DNA, 140 bp, Artificial Sequence
  Synthetic
aggccctggctgctgatatgtgtgggtcacagtatattatggggtacctgtgtggagagaagcaaacaccactctattttgtgcatcagatgctaaagcatatgatacagaagtacataagaccttttgggacagcggtg

SEQ ID NO: 402372 - DNA, 140 bp, Artificial Sequence
  Synthetic
caccgctgtcccaaaaggtcttatgtacttctgtatcatatgctttagcatctgatgcacaaaatagagtggtgtttgcttctctccacacaggtaccccataatatactgtgacccacacatatcagcagccagggcct

SEQ ID NO: 402373 - DNA, 140 bp, Artificial Sequence
  Synthetic
aggccctggctgctgatatgaagaaaacatctattaaggtgaagattcaccacaccagataagaaacatcagaaagaacccccatttctttagatgaggtatgaactccatcctgacaaagaccttttgggacagcggtg

SEQ ID NO: 402374 - DNA, 140 bp, Artificial Sequence
  Synthetic
caccgctgtcccaaaaggtctttgtcaggatggagttcatacctcatctaaagaaatgggggttctttctgatgtttcttatctggtgtggtgaatcttcaccttaatagatgttttcttcatatcagcagccagggcct

SEQ ID NO: 402375 - DNA, 140 bp, Artificial Sequence
  Synthetic
atacgccatgctgggtctccattggaataccactagtagcgggaatgctactaataccaccttggaacagatggcaaaagaagaaataaaaaactgttctttcaacattaccacaagcatcgtacttgggagtcggccat

SEQ ID NO: 402376 - DNA, 140 bp, Artificial Sequence
  Synthetic
atggccgactcccaagtacgatgcttgtggtaatgttgaaagaacagttttttatttcttcttttgccatctgttccaaggtggtattagtagcattcccgctactagtggtattccaatggagacccagcatggcgtat

SEQ ID NO: 402377 - DNA, 140 bp, Artificial Sequence
  Synthetic
aggccctggctgctgatatggaggaagtgggttttccagtcagacctcaggtacctttaagaccaatgacttacaagggagctgtagatcttagccactttttaaaagaaaaggggggacgaccttttgggacagcggtg

SEQ ID NO: 402378 - DNA, 140 bp, Artificial Sequence
  Synthetic
caccgctgtcccaaaaggtcgtccccccttttcttttaaaaagtggctaagatctacagctcccttgtaagtcattggtcttaaaggtacctgaggtctgactggaaaacccacttcctccatatcagcagccagggcct

SEQ ID NO: 402379 - DNA, 140 bp, Artificial Sequence
  Synthetic
aggccctggctgctgatatgttggcaagccacctagattcctgagtaagagtttgttaatacccctcccctagtaaaattatagtaccagctggagaaagaacccatggcaggagtagaagaccttttgggacagcggtg

SEQ ID NO: 402380 - DNA, 140 bp, Artificial Sequence
  Synthetic
caccgctgtcccaaaaggtcttctactcctgccatgggttctttctccagctggtactataattttactaggggaggggtattaacaaactcttactcaggaatctaggtggcttgccaacatatcagcagccagggcct

SEQ ID NO: 402381 - DNA, 140 bp, Artificial Sequence
  Synthetic
atacgccatgctgggtctccttagtaaaacaaattgggaaaaagctttaaaacagatagtaggaaaattaagaaaacaatttcagaatacaactaacataacctttactcgatcctcaggcgtacttgggagtcggccat

SEQ ID NO: 402382 - DNA, 140 bp, Artificial Sequence
  Synthetic
atggccgactcccaagtacgcctgaggatcgagtaaaggttatgttagttgtattctgaaattgttttcttaattttcctactatctgttttaaagctttttcccaatttgttttactaaggagacccagcatggcgtat

SEQ ID NO: 402383 - DNA, 140 bp, Artificial Sequence
  Synthetic
atacgccatgctgggtctccaggggatccagaaattgtgatgcacagttttaactgtggaggagaatttttctactgtaatacaacaaaactttttaatagtacttggatgtggaatactcgtacttgggagtcggccat

SEQ ID NO: 402384 - DNA, 140 bp, Artificial Sequence
  Synthetic
atggccgactcccaagtacgagtattccacatccaagtactattaaaaagttttgttgtattacagtagaaaaattctcctccacagttaaaactgtgcatcacaatttctggatcccctggagacccagcatggcgtat

SEQ ID NO: 402385 - DNA, 140 bp, Artificial Sequence
  Synthetic
atacgccatgctgggtctccgtaagcagtttatgggatcaaagtttaaagccatgtgtaacgttaactcctcttcccgttactgttatttgtagtagaagtattgttaattttagtagagcgtacttgggagtcggccat

SEQ ID NO: 402386 - DNA, 140 bp, Artificial Sequence
  Synthetic
atggccgactcccaagtacgctctactaaaattaacaatacttctactacaaataacagtaacgggaagaggagttaacgttacacatggctttaaactttgatcccataaactgcttacggagacccagcatggcgtat

SEQ ID NO: 402387 - DNA, 140 bp, Artificial Sequence
  Synthetic
atacgccatgctgggtctccatctgtagcaattaattgtacaagaccccacaataataccagaaaaagtataaggataggaccagggccaagcattctatgcaccaggagacataataggcgtacttgggagtcggccat

SEQ ID NO: 402388 - DNA, 140 bp, Artificial Sequence
  Synthetic
atggccgactcccaagtacgcctattatgtctcctggtgcatagaatgcttggccctggtcctatccttatactttttctggtattattgtggggtcttgtacaattaattgctacagatggagacccagcatggcgtat

SEQ ID NO: 402389 - DNA, 140 bp, Artificial Sequence
  Synthetic
atacgccatgctgggtctcctaataggagatataagaagagcattttgtgaggttaatggaacaacatggagtaaagttctaaaacaagtagctggaaaactaaaagagcactttaagaacgtacttgggagtcggccat

SEQ ID NO: 402390 - DNA, 140 bp, Artificial Sequence
  Synthetic
atggccgactcccaagtacgttcttaaagtgctcttttagttttccagctacttgttttagaactttactccatgttgttccattaacctcacaaaatgctcttcttatatctcctattaggagacccagcatggcgtat

SEQ ID NO: 402391 - DNA, 140 bp, Artificial Sequence
  Synthetic
aggccctggctgctgatatgatggtagaacagatgcatgaggatataatcagtttatgggatgaaagcctaaagccatgtgtaaagctaacccctctctgtgttaccttaaactgtactagaccttttgggacagcggtg

SEQ ID NO: 402392 - DNA, 140 bp, Artificial Sequence
  Synthetic
caccgctgtcccaaaaggtctagtacagtttaaggtaacacagagaggggttagctttacacatggctttaggctttcatcccataaactgattatatcctcatgcatctgttctaccatcatatcagcagccagggcct

SEQ ID NO: 402393 - DNA, 140 bp, Artificial Sequence
  Synthetic
atacgccatgctgggtctccaacgctacgtgtaacatagaagaagcaaacaacttaaaaaactgctctttcaatataaccacagaaataagagataagaaaaagacagaatatgcgctttcgtacttgggagtcggccat

SEQ ID NO: 402394 - DNA, 140 bp, Artificial Sequence
  Synthetic
atggccgactcccaagtacgaaagcgcatattctgtctttttcttatctcttatttctgtggttatattgaaagagcagttttttaagttgtttgcttcttctatgttacacgtagcgttggagacccagcatggcgtat

SEQ ID NO: 402395 - DNA, 140 bp, Artificial Sequence
  Synthetic
aggccctggctgctgatatgatagggttatagaagtagtacaaaggatttttaggggtatcctccatatacctagaagaataagacagggctttgaaagggctttgctataagatgggtagaccttttgggacagcggtg

SEQ ID NO: 402396 - DNA, 140 bp, Artificial Sequence
  Synthetic
caccgctgtcccaaaaggtctacccatcttatagcaaagccctttcaaagccctgtcttattcttctaggtatatggaggatacccctaaaaatcctttgtactacttctataaccctatcatatcagcagccagggcct

SEQ ID NO: 402397 - DNA, 140 bp, Artificial Sequence
  Synthetic
atacgccatgctgggtctcccagactggaataacactttacaacaggtagctgaacaattacataataactttaacaaaacaatagtatttaatgagcattcaggaggggatttagaagtcgtacttgggagtcggccat

SEQ ID NO: 402398 - DNA, 140 bp, Artificial Sequence
  Synthetic
atggccgactcccaagtacgacttctaaatcccctcctgaatgctcattaaatactattgttttgttaaagttattatgtaattgttcagctacctgttgtaaagtgttattccagtctgggagacccagcatggcgtat

SEQ ID NO: 402399 - DNA, 140 bp, Artificial Sequence
  Synthetic
aggccctggctgctgatatggtcgaagctataataagaatactgcaacaactactgtttattcatttcagaattaggtgccagcatagcaggataggcatcgtgcgacagagaagagcaagaccttttgggacagcggtg

SEQ ID NO: 402400 - DNA, 140 bp, Artificial Sequence
  Synthetic
caccgctgtcccaaaaggtcttgctcttctctgtcgcacgatgcctatcctgctatgctggcacctaattctgaaatgaataaacagtagttgttgcagtattcttattatagcttcgaccatatcagcagccagggcct

SEQ ID NO: 402401 - DNA, 140 bp, Artificial Sequence
  Synthetic
aggccctggctgctgatatggagcctgtgtctcttcagctaccaccacttgagagacttactcttgattgcagcgaggattgtggaacttctgggacgcagggggtgggaagtcctcaaagaccttttgggacagcggtg

SEQ ID NO: 402402 - DNA, 140 bp, Artificial Sequence
  Synthetic
caccgctgtcccaaaaggtctttgaggacttcccaccccctgcgtcccagaagttccacaatcctcgctgcaatcaagagtaagtctctcaagtggtggtagctgaagagacacaggctccatatcagcagccagggcct

SEQ ID NO: 402403 - DNA, 140 bp, Artificial Sequence
  Synthetic
aggccctggctgctgatatgccatgtaagataaaacaaattgtgagaatgtggcagagagtgggacaagcaatgtatgcccctcccatcgcaggagatattacatgtagatcaaacattagaccttttgggacagcggtg

SEQ ID NO: 402404 - DNA, 140 bp, Artificial Sequence
  Synthetic
caccgctgtcccaaaaggtctaatgtttgatctacatgtaatatctcctgcgatgggaggggcatacattgcttgtcccactctctgccacattctcacaatttgttttatcttacatggcatatcagcagccagggcct

SEQ ID NO: 402405 - DNA, 140 bp, Artificial Sequence
  Synthetic
aggccctggctgctgatatggacactctctaaagaaaaaataaggattatgggaaaaaatatttcagacagtgcaaaaaatatcatagtgaccctgaattctactgtaaacatgacctgtgaccttttgggacagcggtg

SEQ ID NO: 402406 - DNA, 140 bp, Artificial Sequence
  Synthetic
caccgctgtcccaaaaggtcacaggtcatgtttacagtagaattcagggtcactatgatattttttgcactgtctgaaatattttttcccataatccttattttttctttagagagtgtccatatcagcagccagggcct

SEQ ID NO: 402407 - DNA, 140 bp, Artificial Sequence
  Synthetic
aggccctggctgctgatatgtccgtgcgattagtgaacggattcttagcacttgcctgggacgatctgcggagcctgtgcctcttcagctaccaccgcttgagagacttactcttgattggaccttttgggacagcggtg

SEQ ID NO: 402408 - DNA, 140 bp, Artificial Sequence
  Synthetic
caccgctgtcccaaaaggtccaatcaagagtaagtctctcaagcggtggtagctgaagaggcacaggctccgcagatcgtcccaggcaagtgctaagaatccgttcactaatcgcacggacatatcagcagccagggcct

SEQ ID NO: 402409 - DNA, 140 bp, Artificial Sequence
  Synthetic
aggccctggctgctgatatgcagcgaggactgtggaacttctgggacacagcagtctcaagggactgagacgggggtgggaaggcctcaaatatctggggaatcttctgatatattgggtgaccttttgggacagcggtg

SEQ ID NO: 402410 - DNA, 140 bp, Artificial Sequence
  Synthetic
caccgctgtcccaaaaggtcacccaatatatcagaagattccccagatatttgaggccttcccacccccgtctcagtcccttgagactgctgtgtcccagaagttccacagtcctcgctgcatatcagcagccagggcct

SEQ ID NO: 402411 - DNA, 140 bp, Artificial Sequence
  Synthetic
aggccctggctgctgatatgatacaagaaaaagtatacatatgggatgggggagagcattttatgcaacaggacaaataataggagatataagacaagcacattgtaatgttagcagcaggaccttttgggacagcggtg

SEQ ID NO: 402412 - DNA, 140 bp, Artificial Sequence
  Synthetic
caccgctgtcccaaaaggtcctgctgctaacattacaatgtgcttgtcttatatctcctattatttgtcctgttgcataaaatgctctcccccatcccatatgtatactttttcttgtatcatatcagcagccagggcct

SEQ ID NO: 402413 - DNA, 140 bp, Artificial Sequence
  Synthetic
atacgccatgctgggtctccaaatcttatgaggagatttgggataacatgacctggatacaatgggaaagggaagtcagcaattacacacaacaaatatacagcctaattgaagaatcgccgtacttgggagtcggccat

SEQ ID NO: 402414 - DNA, 140 bp, Artificial Sequence
  Synthetic
atggccgactcccaagtacggcgattcttcaattaggctgtatatttgttgtgtgtaattgctgacttccctttcccattgtatccaggtcatgttatcccaaatctcctcataagatttggagacccagcatggcgtat

SEQ ID NO: 402415 - DNA, 140 bp, Artificial Sequence
  Synthetic
atacgccatgctgggtctccacctgcaataataccatatgtacagaaatgagaaattgctctttcagtgcaaccacagaactaagagataagaggcgcaatgagtatgcacttttttatacgtacttgggagtcggccat

SEQ ID NO: 402416 - DNA, 140 bp, Artificial Sequence
  Synthetic
atggccgactcccaagtacgtataaaaaagtgcatactcattgcgcctcttatctcttagttctgtggttgcactgaaagagcaatttctcatttctgtacatatggtattattgcaggtggagacccagcatggcgtat

SEQ ID NO: 402417 - DNA, 140 bp, Artificial Sequence
  Synthetic
aggccctggctgctgatatgcgaaagttccagagaagttctctcgacgcaggactcggcttgctgaggtgcacacagcaagaggcgagagcggcgactggtgagtacgccaaaaattttggaccttttgggacagcggtg

SEQ ID NO: 402418 - DNA, 140 bp, Artificial Sequence
  Synthetic
caccgctgtcccaaaaggtccaaaatttttggcgtactcaccagtcgccgctctcgcctcttgctgtgtgcacctcagcaagccgagtcctgcgtcgagagaacttctctggaactttcgcatatcagcagccagggcct

SEQ ID NO: 402419 - DNA, 140 bp, Artificial Sequence
  Synthetic
aggccctggctgctgatatgcgaagaaggaggtggagagcaagacagagacagatcagtgcgcttagtgagcggattcttagcacttgcctgggacgacctgcggaacctgtgcctcttcgaccttttgggacagcggtg

SEQ ID NO: 402420 - DNA, 140 bp, Artificial Sequence
  Synthetic
caccgctgtcccaaaaggtcgaagaggcacaggttccgcaggtcgtcccaggcaagtgctaagaatccgctcactaagcgcactgatctgtctctgtcttgctctccacctccttcttcgcatatcagcagccagggcct

SEQ ID NO: 402421 - DNA, 140 bp, Artificial Sequence
  Synthetic
aggccctggctgctgatatgtcaaatatctgtggaatctcctgttgtattggggtcgggaactaaagaatagtgctattaatttgattgatacaatagcaatagcagtagctaactggacgaccttttgggacagcggtg

SEQ ID NO: 402422 - DNA, 140 bp, Artificial Sequence
  Synthetic
caccgctgtcccaaaaggtcgtccagttagctactgctattgctattgtatcaatcaaattaatagcactattctttagttcccgaccccaatacaacaggagattccacagatatttgacatatcagcagccagggcct

SEQ ID NO: 402423 - DNA, 140 bp, Artificial Sequence
  Synthetic
aggccctggctgctgatatgggttagcctattgcaagtataatatcactgactgggaaaaagccttaaaacaagtagctgaaaggtacttagaacttgtaaattatacagatgggaatgcgaccttttgggacagcggtg

SEQ ID NO: 402424 - DNA, 140 bp, Artificial Sequence
  Synthetic
caccgctgtcccaaaaggtcgcattcccatctgtataatttacaagttctaagtacctttcagctacttgttttaaggctttttcccagtcagtgatattatacttgcaataggctaacccatatcagcagccagggcct

SEQ ID NO: 402425 - DNA, 140 bp, Artificial Sequence
  Synthetic
aggccctggctgctgatatgatgcagaataaaacaaattataaacatgtggcagaaagtaggacgagcaatgtatgcccctcccattgaaggaaacataacatgtaactcaagtatcacagaccttttgggacagcggtg

SEQ ID NO: 402426 - DNA, 140 bp, Artificial Sequence
  Synthetic
caccgctgtcccaaaaggtctgtgatacttgagttacatgttatgtttccttcaatgggaggggcatacattgctcgtcctactttctgccacatgtttataatttgttttattctgcatcatatcagcagccagggcct

SEQ ID NO: 402427 - DNA, 140 bp, Artificial Sequence
  Synthetic
atacgccatgctgggtctccgtggcgcccgaacagggacttgaaaacgaaagttaacagggacttgtaagcggaagttaacggggactcgaaagcgaaagttccagagaagttctctcgacgtacttgggagtcggccat

SEQ ID NO: 402428 - DNA, 140 bp, Artificial Sequence
  Synthetic
atggccgactcccaagtacgtcgagagaacttctctggaactttcgctttcgagtccccgttaacttccgcttacaagtccctgttaactttcgttttcaagtccctgttcgggcgccacggagacccagcatggcgtat

SEQ ID NO: 402429 - DNA, 140 bp, Artificial Sequence
  Synthetic
aggccctggctgctgatatgatctgcaccactaatgtgccttggaactccagttagagtaataaatctcaacaagaaatttaagataacatgacctagatgcagtgagagaaagaaattagaccttttgggacagcggtg

SEQ ID NO: 402430 - DNA, 140 bp, Artificial Sequence
  Synthetic
caccgctgtcccaaaaggtctaatttctttctctcactgcatctaggtcatgttatcttaaatttcttgttgagatttattactctaactggagttccaaggcacattagtggtgcagatcatatcagcagccagggcct

SEQ ID NO: 402431 - DNA, 140 bp, Artificial Sequence
  Synthetic
aggccctggctgctgatatgatgatgcagaaaggcaattttaagggccagagaaaaattaagtgtttcaactgtggcaaagaaggacacctagccagaaattgcagggcccctagaaaaagaccttttgggacagcggtg

SEQ ID NO: 402432 - DNA, 140 bp, Artificial Sequence
  Synthetic
caccgctgtcccaaaaggtctttttctaggggccctgcaatttctggctaggtgtccttctttgccacagttgaaacacttaatttttctctggcccttaaaattgcctttctgcatcatcatatcagcagccagggcct

SEQ ID NO: 402433 - DNA, 140 bp, Artificial Sequence
  Synthetic
atacgccatgctgggtctcccaggaacaaaatgaacaagatttattagcattggacaagtggcaaaatctgtagaattagtttaacataacacattggctttagtatataaaaatattcacgtacttgggagtcggccat

SEQ ID NO: 402434 - DNA, 140 bp, Artificial Sequence
  Synthetic
atggccgactcccaagtacgtgaatatttttatatactaaagccaatgtgttatgttaaactaattctacagattttgccacttgtccaatgctaataaatcttgttcattttgttcctgggagacccagcatggcgtat

SEQ ID NO: 402435 - DNA, 140 bp, Artificial Sequence
  Synthetic
atacgccatgctgggtctccatctgtagcaattaattgtacaagaccccaccataactacagaaaattctatgcaacaggagaccataataggaagactgacaagccacattgtaaccttcgtacttgggagtcggccat

SEQ ID NO: 402436 - DNA, 140 bp, Artificial Sequence
  Synthetic
atggccgactcccaagtacgaaggttacaatgtggcttgtcagtcttcctattatggtctcctgttgcatagaattttctgtagttatggtggggtcttgtacaattaattgctacagatggagacccagcatggcgtat

SEQ ID NO: 402437 - DNA, 140 bp, Artificial Sequence
  Synthetic
atacgccatgctgggtctcctagtctgcttgacgccttagcaatagtagtagctgaaagaacagataagattataaaattcttacaaaggctttgtagagctatccgcaacttacctagacgtacttgggagtcggccat

SEQ ID NO: 402438 - DNA, 140 bp, Artificial Sequence
  Synthetic
atggccgactcccaagtacgtctaggtaagttgcggatagctctacaaagcctttgtaagaattttataatcttatctgttctttcagctactactattgctaaggcgtcaagcagactaggagacccagcatggcgtat

SEQ ID NO: 402439 - DNA, 140 bp, Artificial Sequence
  Synthetic
aggccctggctgctgatatgttataaaattcttacaaaggctttgtagagctatccgcaacttacctagaagaataagacagagttttgaagcagctttgctataaaatgaagagcaaatgaccttttgggacagcggtg

SEQ ID NO: 402440 - DNA, 140 bp, Artificial Sequence
  Synthetic
caccgctgtcccaaaaggtcatttgctcttcattttatagcaaagctgcttcaaaactctgtcttattcttctaggtaagttgcggatagctctacaaagcctttgtaagaattttataacatatcagcagccagggcct

SEQ ID NO: 402441 - DNA, 140 bp, Artificial Sequence
  Synthetic
aggccctggctgctgatatgagtagatttcagagagctcaataaaagaactcaggacttttgggaagttcaattaggaataccacatccagcaggtctaaaaaagaaaaaatcagtaacagaccttttgggacagcggtg

SEQ ID NO: 402442 - DNA, 140 bp, Artificial Sequence
  Synthetic
caccgctgtcccaaaaggtctgttactgattttttcttttttagacctgctggatgtggtattcctaattgaacttcccaaaagtcctgagttcttttattgagctctctgaaatctactcatatcagcagccagggcct

SEQ ID NO: 402443 - DNA, 140 bp, Artificial Sequence
  Synthetic
atacgccatgctgggtctccgtaccagtaataagaccagtaatatgacagagggaggagaaatgaaaaactgctctttcgatatcaccacaagcatgggtactaaggtgaaagactatgccgtacttgggagtcggccat

SEQ ID NO: 402444 - DNA, 140 bp, Artificial Sequence
  Synthetic
atggccgactcccaagtacggcatagtctttcaccttagtacccatgcttgtggtgatatcgaaagagcagtttttcatttctcctccctctgtcatattactggtcttattactggtacggagacccagcatggcgtat

SEQ ID NO: 402445 - DNA, 140 bp, Artificial Sequence
  Synthetic
aggccctggctgctgatatgtttatcaagagccatttaaaaatctaaaaacaggaaaatatgcaagaaaaaggtctgctcacactaatgatgtaagacaattagcagaagtggtgcaaaagaccttttgggacagcggtg

SEQ ID NO: 402446 - DNA, 140 bp, Artificial Sequence
  Synthetic
caccgctgtcccaaaaggtcttttgcaccacttctgctaattgtcttacatcattagtgtgagcagacctttttcttgcatattttcctgtttttagatttttaaatggctcttgataaacatatcagcagccagggcct

SEQ ID NO: 402447 - DNA, 140 bp, Artificial Sequence
  Synthetic
atacgccatgctgggtctccccgtcatgataataccacctatacccataatactagcatgatgggactaaaaaatcgctctttcaatacaaccacagaactaagggataagaaacagaaacgtacttgggagtcggccat

SEQ ID NO: 402448 - DNA, 140 bp, Artificial Sequence
  Synthetic
atggccgactcccaagtacgtttctgtttcttatcccttagttctgtggttgtattgaaagagcgattttttagtcccatcatgctagtattatgggtataggtggtattatcatgacggggagacccagcatggcgtat

SEQ ID NO: 402449 - DNA, 140 bp, Artificial Sequence
  Synthetic
atacgccatgctgggtctcctccctaggaccagggcaagcatggtttacaacaggacaaataataggagatataagacaagcacattgtaaccttagtagatcaaaatgggagaaaacttcgtacttgggagtcggccat

SEQ ID NO: 402450 - DNA, 140 bp, Artificial Sequence
  Synthetic
atggccgactcccaagtacgaagttttctcccattttgatctactaaggttacaatgtgcttgtcttatatctcctattatttgtcctgttgtaaaccatgcttgccctggtcctagggaggagacccagcatggcgtat

SEQ ID NO: 402451 - DNA, 140 bp, Artificial Sequence
  Synthetic
atacgccatgctgggtctccactatcacgctcccttgcagaataaaacaaattgtaaacatgtggcagggaatatggaaagcaatgtatgcccctcccattgcaggacaaattagatgttcgtacttgggagtcggccat

SEQ ID NO: 402452 - DNA, 140 bp, Artificial Sequence
  Synthetic
atggccgactcccaagtacgaacatctaatttgtcctgcaatgggaggggcatacattgctttccatattccctgccacatgtttacaatttgttttattctgcaagggagcgtgatagtggagacccagcatggcgtat

SEQ ID NO: 402453 - DNA, 140 bp, Artificial Sequence
  Synthetic
atacgccatgctgggtctccctgaaactaatactagtagtgaggaaataatggaaatgaaaaattgttctttcaatgtcacctcaaatataaaaggcaagatgcagaaagaatatgcactcgtacttgggagtcggccat

SEQ ID NO: 402454 - DNA, 140 bp, Artificial Sequence
  Synthetic
atggccgactcccaagtacgagtgcatattctttctgcatcttgccttttatatttgaggtgacattgaaagaacaatttttcatttccattatttcctcactactagtattagtttcagggagacccagcatggcgtat

SEQ ID NO: 402455 - DNA, 140 bp, Artificial Sequence
  Synthetic
aggccctggctgctgatatggcttggaaagggctttactataaaatgggtggcaaatggtcaaaaagtagtatagttaggtggcctgctataaaggaaagaataagaagaactgatccaagaccttttgggacagcggtg

SEQ ID NO: 402456 - DNA, 140 bp, Artificial Sequence
  Synthetic
caccgctgtcccaaaaggtcttggatcagttcttcttattctttcctttatagcaggccacctaactatactactttttgaccatttgccacccattttatagtaaagccctttccaagccatatcagcagccagggcct

SEQ ID NO: 402457 - DNA, 140 bp, Artificial Sequence
  Synthetic
atacgccatgctgggtctccctggggattacagaaagggtgggaagccctcaagtatctgggaaatcttgtgctgtatgggagtctggagctgaaaaagagtgctcttagtctgtttgatcgtacttgggagtcggccat

SEQ ID NO: 402458 - DNA, 140 bp, Artificial Sequence
  Synthetic
atggccgactcccaagtacgatcaaacagactaagagcactctttttcagctccagactcccatacagcacaagatttcccagatacttgagggcttcccaccctttctgtaatccccagggagacccagcatggcgtat

SEQ ID NO: 402459 - DNA, 140 bp, Artificial Sequence
  Synthetic
atacgccatgctgggtctcctcatcaaaattctataccaaagcagtaagtattaagtatatataaggttgcctttgcatatctgtgcaatagtaggactgatagtagcgctaatcatagccgtacttgggagtcggccat

SEQ ID NO: 402460 - DNA, 140 bp, Artificial Sequence
  Synthetic
atggccgactcccaagtacggctatgattagcgctactatcagtcctactattgcacagatatgcaaaggcaaccttatatatacttaatacttactgctttggtatagaattttgatgaggagacccagcatggcgtat

SEQ ID NO: 402461 - DNA, 140 bp, Artificial Sequence
  Synthetic
aggccctggctgctgatatgtgagagacttcatattgattgcagtgagagcagtggaacttctgggacgcagcagcctcaagggactacagagggggtgggaagcccttaagtatctagggaccttttgggacagcggtg

SEQ ID NO: 402462 - DNA, 140 bp, Artificial Sequence
  Synthetic
caccgctgtcccaaaaggtccctagatacttaagggcttcccaccccctctgtagtcccttgaggctgctgcgtcccagaagttccactgctctcactgcaatcaatatgaagtctctcacatatcagcagccagggcct

SEQ ID NO: 402463 - DNA, 140 bp, Artificial Sequence
  Synthetic
atacgccatgctgggtctccatccttcaagcacaaccagataagagtaaatcagagttagttagccagataataaaaaagttaataaaaaaaaaaggtttacctgtcataagtaccagcacgtacttgggagtcggccat

SEQ ID NO: 402464 - DNA, 140 bp, Artificial Sequence
  Synthetic
atggccgactcccaagtacgtgctggtacttatgacaggtaaaccttttttttttattaacttttttattatctggctaactaactctgatttactcttatctggttgtgcttgaaggatggagacccagcatggcgtat

SEQ ID NO: 402465 - DNA, 140 bp, Artificial Sequence
  Synthetic
atacgccatgctgggtctccaatcaggaaagtactgtttctaaataaaatagataaagctcaagaaaagcatgaaaagtatcatagcaattaaagagcaatggctagtaattttaacctacgtacttgggagtcggccat

SEQ ID NO: 402466 - DNA, 140 bp, Artificial Sequence
  Synthetic
atggccgactcccaagtacgtaggttaaaattactagccattgctctttaattgctatgatacttttcatgcttttcttgagctttatctattttatttagaaacagtactttcctgattggagacccagcatggcgtat

SEQ ID NO: 402467 - DNA, 140 bp, Artificial Sequence
  Synthetic
atacgccatgctgggtctccagtaagaaactgttcttttaatatgaccacagaactacaagataaaaagcaggaggtccatgcacttttttatacgtctgatgtagtacaaattagtagtcgtacttgggagtcggccat

SEQ ID NO: 402468 - DNA, 140 bp, Artificial Sequence
  Synthetic
atggccgactcccaagtacgactactaatttgtactacatcagacgtataaaaaagtgcatggacctcctgctttttatcttgtagttctgtggtcatattaaaagaacagtttcttactggagacccagcatggcgtat

SEQ ID NO: 402469 - DNA, 140 bp, Artificial Sequence
  Synthetic
aggccctggctgctgatatgcttgtaacaaatgctattgtaaagtgtgttgttggcattgccaagtttgctttctgaacaaaggcttaggcatctcctatggcaggaagaagcggaagcagaccttttgggacagcggtg

SEQ ID NO: 402470 - DNA, 140 bp, Artificial Sequence
  Synthetic
caccgctgtcccaaaaggtctgcttccgcttcttcctgccataggagatgcctaagcctttgttcagaaagcaaacttggcaatgccaacaacacactttacaatagcatttgttacaagcatatcagcagccagggcct

SEQ ID NO: 402471 - DNA, 140 bp, Artificial Sequence
  Synthetic
atacgccatgctgggtctcccaaagggggaaataaaaaattgctctttcaatgcaaccacattattagcagataggaagcagaaagtgtatgcacttttctatagacttgatatagtacccgtacttgggagtcggccat

SEQ ID NO: 402472 - DNA, 140 bp, Artificial Sequence
  Synthetic
atggccgactcccaagtacgggtactatatcaagtctatagaaaagtgcatacactttctgcttcctatctgctaataatgtggttgcattgaaagagcaattttttatttccccctttgggagacccagcatggcgtat

SEQ ID NO: 402473 - DNA, 140 bp, Artificial Sequence
  Synthetic
aggccctggctgctgatatgtaaatctatagaaatcaattgtaccagacccttcaagaaagtaagaataagtgcaaggataggaccaggacgagtattccatacaacaggaaacataaatgaccttttgggacagcggtg

SEQ ID NO: 402474 - DNA, 140 bp, Artificial Sequence
  Synthetic
caccgctgtcccaaaaggtcatttatgtttcctgttgtatggaatactcgtcctggtcctatccttgcacttattcttactttcttgaagggtctggtacaattgatttctatagatttacatatcagcagccagggcct

SEQ ID NO: 402475 - DNA, 140 bp, Artificial Sequence
  Synthetic
atacgccatgctgggtctccaaaaagaagcaaggttgaatggcctactgtaagggaaagaatgcgccgaactgagccagcagcagaaggggtgggagcagcatctcgagacttggaagaacgtacttgggagtcggccat

SEQ ID NO: 402476 - DNA, 140 bp, Artificial Sequence
  Synthetic
atggccgactcccaagtacgttcttccaagtctcgagatgctgctcccaccccttctgctgctggctcagttcggcgcattctttcccttacagtaggccattcaaccttgcttctttttggagacccagcatggcgtat

SEQ ID NO: 402477 - DNA, 140 bp, Artificial Sequence
  Synthetic
atacgccatgctgggtctcctaaaacaccatatgtatatctcaaagaaggctaatagataagtctacagacatcattatgaaagccatcatccaaaagtaagttcagaagtacacatccccgtacttgggagtcggccat

SEQ ID NO: 402478 - DNA, 140 bp, Artificial Sequence
  Synthetic
atggccgactcccaagtacggggatgtgtacttctgaacttacttttggatgatggctttcataatgatgtctgtagacttatctattagccttctttgagatatacatatggtgttttaggagacccagcatggcgtat

SEQ ID NO: 402479 - DNA, 140 bp, Artificial Sequence
  Synthetic
atacgccatgctgggtctccataggaactgtactgacatggaagtagaaaacttaagaaactgctctttcaatataaccacagaactaagagataagaggaagcaagaatatgcgcttttcgtacttgggagtcggccat

SEQ ID NO: 402480 - DNA, 140 bp, Artificial Sequence
  Synthetic
atggccgactcccaagtacgaaaagcgcatattcttgcttcctcttatctcttagttctgtggttatattgaaagagcagtttcttaagttttctacttccatgtcagtacagttcctatggagacccagcatggcgtat

SEQ ID NO: 402481 - DNA, 140 bp, Artificial Sequence
  Synthetic
atacgccatgctgggtctcccaataaaagtagggggccagataaaggaggctctcttagacacaggagcagatgacacagtattagaagaaataaatttgccaggaaaatggaaaccaaacgtacttgggagtcggccat

SEQ ID NO: 402482 - DNA, 140 bp, Artificial Sequence
  Synthetic
atggccgactcccaagtacgtttggtttccattttcctggcaaatttatttcttctaatactgtgtcatctgctcctgtgtctaagagagcctcctttatctggccccctacttttattgggagacccagcatggcgtat

SEQ ID NO: 402483 - DNA, 140 bp, Artificial Sequence
  Synthetic
atacgccatgctgggtctccggctaataaattgtaatgtctcaaccattaaacaggcttgtccaaaggtgtcttttgacccaattcccatacattattgtgctccagctgggtttgcgatcgtacttgggagtcggccat

SEQ ID NO: 402484 - DNA, 140 bp, Artificial Sequence
  Synthetic
atggccgactcccaagtacgatcgcaaacccagctggagcacaataatgtatgggaattgggtcaaaagacacctttggacaagcctgtttaatggttgagacattacaatttattagccggagacccagcatggcgtat

SEQ ID NO: 402485 - DNA, 140 bp, Artificial Sequence
  Synthetic
atacgccatgctgggtctccgtggcgcccgaacagggacccgaaagtgaaagtaggtgaaccagaggagatctctcgacgcaaggactcggcttgctgcagcgcgcacggcaagaggcgacgtacttgggagtcggccat

SEQ ID NO: 402486 - DNA, 140 bp, Artificial Sequence
  Synthetic
atggccgactcccaagtacgtcgcctcttgccgtgcgcgctgcagcaagccgagtccttgcgtcgagagatctcctctggttcacctactttcactttcgggtccctgttcgggcgccacggagacccagcatggcgtat

SEQ ID NO: 402487 - DNA, 140 bp, Artificial Sequence
  Synthetic
atacgccatgctgggtctccacaatccccagaggaccaaagaccgcagagaggaccatacaatgaataggcactacagattctagaagaactcaagcaggaagctgttagacactttcctcgtacttgggagtcggccat

SEQ ID NO: 402488 - DNA, 140 bp, Artificial Sequence
  Synthetic
atggccgactcccaagtacgaggaaagtgtctaacagcttcctgcttgagttcttctagaatctgtagtgcctattcattgtatggtcctctctgcggtctttggtcctctggggattgtggagacccagcatggcgtat

SEQ ID NO: 402489 - DNA, 140 bp, Artificial Sequence
  Synthetic
aggccctggctgctgatatgaaacctcacaaacaatgccaaggtcataatagtacagcttaatgaaacaatagaaattaattgtaccagacccaacaacaatacaagaaagagtataagagaccttttgggacagcggtg

SEQ ID NO: 402490 - DNA, 140 bp, Artificial Sequence
  Synthetic
caccgctgtcccaaaaggtctcttatactctttcttgtattgttgttgggtctggtacaattaatttctattgtttcattaagctgtactattatgaccttggcattgtttgtgaggtttcatatcagcagccagggcct

SEQ ID NO: 402491 - DNA, 140 bp, Artificial Sequence
  Synthetic
atacgccatgctgggtctcctagaaattaattgtaccagacccaacaacaatacaagaaagagtataagaatcggacctggacaaacgttctatgcaacagatataataggagatataagcgtacttgggagtcggccat

SEQ ID NO: 402492 - DNA, 140 bp, Artificial Sequence
  Synthetic
atggccgactcccaagtacgcttatatctcctattatatctgttgcatagaacgtttgtccaggtccgattcttatactctttcttgtattgttgttgggtctggtacaattaatttctaggagacccagcatggcgtat

SEQ ID NO: 402493 - DNA, 140 bp, Artificial Sequence
  Synthetic
  misc_feature (52)..(52): n is a, c, g, or t
atacgccatgctgggtctccaagtagaagcaaaactaaaagaggtctttganaaaaatataacctttaactcaacctcaggaggggacctagaagttacaacacatagttttaattgtagcgtacttgggagtcggccat

SEQ ID NO: 402494 - DNA, 140 bp, Artificial Sequence
  Synthetic
  misc_feature (89)..(89): n is a, c, g, or t
atggccgactcccaagtacgctacaattaaaactatgtgttgtaacttctaggtcccctcctgaggttgagttaaaggttatatttttntcaaagacctcttttagttttgcttctacttggagacccagcatggcgtat

SEQ ID NO: 402495 - DNA, 140 bp, Artificial Sequence
  Synthetic
aggccctggctgctgatatgccaaatatatgagctacttacagaatcgcaggaccagcaggaaaggaatgaaaaggatttgttagcattggacaagtgggcaagtctgtggaattggtttgaccttttgggacagcggtg

SEQ ID NO: 402496 - DNA, 140 bp, Artificial Sequence
  Synthetic
caccgctgtcccaaaaggtcaaaccaattccacagacttgcccacttgtccaatgctaacaaatccttttcattcctttcctgctggtcctgcgattctgtaagtagctcatatatttggcatatcagcagccagggcct

SEQ ID NO: 402497 - DNA, 140 bp, Artificial Sequence
  Synthetic
atacgccatgctgggtctccagcactactcttagcaataattgtgtagatcctagcatatctaaaatatagaaaattagtaaaacaaaaaaaattagactagttaattaaaagaattaaacgtacttgggagtcggccat

SEQ ID NO: 402498 - DNA, 140 bp, Artificial Sequence
  Synthetic
atggccgactcccaagtacgtttaattcttttaattaactagtctaattttttttgttttactaattttctatattttagatatgctaggatctacacaattattgctaagagtagtgctggagacccagcatggcgtat

SEQ ID NO: 402499 - DNA, 140 bp, Artificial Sequence
  Synthetic
aggccctggctgctgatatggaaaattagtaaaacaaaaaaaattagactagttaattaaaagaattaaagaaagagcagaagacagtggcaatgaaggtaatgaagatacagaagaattgaccttttgggacagcggtg

SEQ ID NO: 402500 - DNA, 140 bp, Artificial Sequence
  Synthetic
caccgctgtcccaaaaggtcaattcttctgtatcttcattaccttcattgccactgtcttctgctctttctttaattcttttaattaactagtctaattttttttgttttactaattttccatatcagcagccagggcct

SEQ ID NO: 402501 - DNA, 140 bp, Artificial Sequence
  Synthetic
atacgccatgctgggtctcctgctaatgatgctaatactaatgttaccatagacagcattgtaaaaagagaaataaaaaattgctctttcaatatgaccacagaaataatagataaaaaacgtacttgggagtcggccat

SEQ ID NO: 402502 - DNA, 140 bp, Artificial Sequence
  Synthetic
atggccgactcccaagtacgttttttatctattatttctgtggtcatattgaaagagcaattttttatttctctttttacaatgctgtctatggtaacattagtattagcatcattagcaggagacccagcatggcgtat

SEQ ID NO: 402503 - DNA, 140 bp, Artificial Sequence
  Synthetic
aggccctggctgctgatatggcgaaagttccagagaagttctctcgacgcaggactcggcttgctgaggtgcacacagcaagaggcgagagcggcgactggtgagtacgccaaatttttggaccttttgggacagcggtg

SEQ ID NO: 402504 - DNA, 140 bp, Artificial Sequence
  Synthetic
caccgctgtcccaaaaggtccaaaaatttggcgtactcaccagtcgccgctctcgcctcttgctgtgtgcacctcagcaagccgagtcctgcgtcgagagaacttctctggaactttcgccatatcagcagccagggcct

SEQ ID NO: 402505 - DNA, 140 bp, Artificial Sequence
  Synthetic
aggccctggctgctgatatggtacaagacccaacaataataccagaacaagtgtaaagataagaccaagacaaacattctatgcaacagaagacataataagagacataagacgagcacagaccttttgggacagcggtg

SEQ ID NO: 402506 - DNA, 140 bp, Artificial Sequence
  Synthetic
caccgctgtcccaaaaggtctgtgctcgtcttatgtctcttattatgtcttctgttgcatagaatgtttgtcttggtcttatctttacacttgttctggtattattgttgggtcttgtaccatatcagcagccagggcct

SEQ ID NO: 402507 - DNA, 140 bp, Artificial Sequence
  Synthetic
atacgccatgctgggtctccgacaaggcttggaaagattgttgctataaaatgggaggcaagtggtcaaaaaggagaacagcagctcaatggcccgaggtaagggagagaataagacagacgtacttgggagtcggccat

SEQ ID NO: 402508 - DNA, 140 bp, Artificial Sequence
  Synthetic
atggccgactcccaagtacgtctgtcttattctctcccttacctcgggccattgagctgctgttctcctttttgaccacttgcctcccattttatagcaacaatctttccaagccttgtcggagacccagcatggcgtat

SEQ ID NO: 402509 - DNA, 140 bp, Artificial Sequence
  Synthetic
aggccctggctgctgatatgaccatagtatatatagaatataggaaattggtaagacaaagaaaaatagactggttaattaaaagaattagggaaagagcagaagacagtggcaatgagagaccttttgggacagcggtg

SEQ ID NO: 402510 - DNA, 140 bp, Artificial Sequence
  Synthetic
caccgctgtcccaaaaggtctctcattgccactgtcttctgctctttccctaattcttttaattaaccagtctatttttctttgtcttaccaatttcctatattctatatatactatggtcatatcagcagccagggcct

SEQ ID NO: 402511 - DNA, 140 bp, Artificial Sequence
  Synthetic
atacgccatgctgggtctcccatggagcaatcacaagcagcaatacagcacagaataatcccgcttgtgcctggctagaagcacaacaggaagattcagaggtaggctttccagtcagaccgtacttgggagtcggccat

SEQ ID NO: 402512 - DNA, 140 bp, Artificial Sequence
  Synthetic
atggccgactcccaagtacggtctgactggaaagcctacctctgaatcttcctgttgtgcttctagccaggcacaagcgggattattctgtgctgtattgctgcttgtgattgctccatgggagacccagcatggcgtat

SEQ ID NO: 402513 - DNA, 140 bp, Artificial Sequence
  Synthetic
atacgccatgctgggtctcccctggaggaagagatatgaaggacaattagaaaagtaaattatataaatataaagtagtagagattaagccattagaagtaacacccactgaggcaaaaacgtacttgggagtcggccat

SEQ ID NO: 402514 - DNA, 140 bp, Artificial Sequence
  Synthetic
atggccgactcccaagtacgtttttgcctcagtgggtgttacttctaatggcttaatctctactactttatatttatataatttacttttctaattgtccttcatatctcttcctccaggggagacccagcatggcgtat

SEQ ID NO: 402515 - DNA, 140 bp, Artificial Sequence
  Synthetic
atacgccatgctgggtctccccaggaatggtaatgataccgagaacatgaaggaagaaatgagaaattgcactttcaatacaaccacagaaataagagataaggaaaagcagatgtatgccgtacttgggagtcggccat

SEQ ID NO: 402516 - DNA, 140 bp, Artificial Sequence
  Synthetic
atggccgactcccaagtacggcatacatctgcttttccttatctcttatttctgtggttgtattgaaagtgcaatttctcatttcttccttcatgttctcggtatcattaccattcctggggagacccagcatggcgtat

SEQ ID NO: 402517 - DNA, 140 bp, Artificial Sequence
  Synthetic
aggccctggctgctgatatgcttaaatcattatataatacagtagcaaccctctattgcgtacatcaaaggatagatgtaaaagataccaaggaagctttagataaaatagaggaactacgaccttttgggacagcggtg

SEQ ID NO: 402518 - DNA, 140 bp, Artificial Sequence
  Synthetic
caccgctgtcccaaaaggtcgtagttcctctattttatctaaagcttccttggtatcttttacatctatcctttgatgtacgcaatagagggttgctactgtattatataatgatttaagcatatcagcagccagggcct

SEQ ID NO: 402519 - DNA, 140 bp, Artificial Sequence
  Synthetic
atacgccatgctgggtctcccaattacacaaacataatatacaagctgcttaaaaaatcgcaaatccagcaagaacagaataaaaaagatttattagcattagacagttagaacaatctgcgtacttgggagtcggccat

SEQ ID NO: 402520 - DNA, 140 bp, Artificial Sequence
  Synthetic
atggccgactcccaagtacgcagattgttctaactgtctaatgctaataaatcttttttattctgttcttgctggatttgcgattttttaagcagcttgtatattatgtttgtgtaattgggagacccagcatggcgtat

SEQ ID NO: 402521 - DNA, 140 bp, Artificial Sequence
  Synthetic
atacgccatgctgggtctcctaagaattctgcaacaactgctgtttattcatttcagaattgggtgtcaacatagcagaataggcattattcgacagaggagagcaagaaatggagccagcgtacttgggagtcggccat

SEQ ID NO: 402522 - DNA, 140 bp, Artificial Sequence
  Synthetic
atggccgactcccaagtacgctggctccatttcttgctctcctctgtcgaataatgcctattctgctatgttgacacccaattctgaaatgaataaacagcagttgttgcagaattcttaggagacccagcatggcgtat

SEQ ID NO: 402523 - DNA, 140 bp, Artificial Sequence
  Synthetic
aggccctggctgctgatatgctttaataaatagagctaggcaaagatactcacctttgtcgcttcagacccttaccccaaacccgaggggacccgacaggctcagaaaaatcgaaaaagagaccttttgggacagcggtg

SEQ ID NO: 402524 - DNA, 140 bp, Artificial Sequence
  Synthetic
caccgctgtcccaaaaggtctctttttcgatttttctgagcctgtcgggtcccctcgggtttggggtaagggtctgaagcgacaaaggtgagtatctttgcctagctctatttattaaagcatatcagcagccagggcct

SEQ ID NO: 402525 - DNA, 140 bp, Artificial Sequence
  Synthetic
atacgccatgctgggtctccaagcagtaagtagtaaatgtaatgcaagctttaatcatttcagcaatagtagccttagtagtagtagcaataatagcaatagttgtgtggaccatagtatcgtacttgggagtcggccat

SEQ ID NO: 402526 - DNA, 140 bp, Artificial Sequence
  Synthetic
atggccgactcccaagtacgatactatggtccacacaactattgctattattgctactactactaaggctactattgctgaaatgattaaagcttgcattacatttactacttactgcttggagacccagcatggcgtat

SEQ ID NO: 402527 - DNA, 140 bp, Artificial Sequence
  Synthetic
aggccctggctgctgatatgcgattaaaagacttcatattaattgcagcgagagtagtagaacttctaagacgcagcagtctcaagagactacagaaaaggtaggagacccttaagtatcgaccttttgggacagcggtg

SEQ ID NO: 402528 - DNA, 140 bp, Artificial Sequence
  Synthetic
caccgctgtcccaaaaggtcgatacttaagggtctcctaccttttctgtagtctcttgagactgctgcgtcttagaagttctactactctcgctgcaattaatatgaagtcttttaatcgcatatcagcagccagggcct

SEQ ID NO: 402529 - DNA, 140 bp, Artificial Sequence
  Synthetic
atacgccatgctgggtctccctaaccacaatacgcctgtagataatagtactgctaactacaatgaaagtaatccagaagtgaaaaattgctccttcgagacaaccacagaaataagagacgtacttgggagtcggccat

SEQ ID NO: 402530 - DNA, 140 bp, Artificial Sequence
  Synthetic
atggccgactcccaagtacgtctcttatttctgtggttgtctcgaaggagcaatttttcacttctggattactttcattgtagttagcagtactattatctacaggcgtattgtggttagggagacccagcatggcgtat

SEQ ID NO: 402531 - DNA, 140 bp, Artificial Sequence
  Synthetic
aggccctggctgctgatatggcctagctagaagcacaaaaagaggcagatgaagtaagctttccagtcagacctcaagtgcctttaaggccaatgacttataaaagtgcattcgatctcagaccttttgggacagcggtg

SEQ ID NO: 402532 - DNA, 140 bp, Artificial Sequence
  Synthetic
caccgctgtcccaaaaggtctgagatcgaatgcacttttataagtcattggccttaaaggcacttgaggtctgactggaaagcttacttcatctgcctctttttgtgcttctagctaggccatatcagcagccagggcct

SEQ ID NO: 402533 - DNA, 140 bp, Artificial Sequence
  Synthetic
atacgccatgctgggtctccaacttcccctgagcctgaaccatgtgcacctggagtaggacaagtctccagggacttagcagctagaggagggataccaagttcccatactcctcaaaaccgtacttgggagtcggccat

SEQ ID NO: 402534 - DNA, 140 bp, Artificial Sequence
  Synthetic
atggccgactcccaagtacggttttgaggagtatgggaacttggtatccctcctctagctgctaagtccctggagacttgtcctactccaggtgcacatggttcaggctcaggggaagttggagacccagcatggcgtat

SEQ ID NO: 402535 - DNA, 140 bp, Artificial Sequence
  Synthetic
atacgccatgctgggtctcctaataccactggtgccagtagtcctagtcctagtcctagtactagtagggagatgagaaactgctctttcaatatcaccacaagcataaaaactaaggtgcgtacttgggagtcggccat

SEQ ID NO: 402536 - DNA, 140 bp, Artificial Sequence
  Synthetic
atggccgactcccaagtacgcaccttagtttttatgcttgtggtgatattgaaagagcagtttctcatctccctactagtactaggactaggactaggactactggcaccagtggtattaggagacccagcatggcgtat

SEQ ID NO: 402537 - DNA, 140 bp, Artificial Sequence
  Synthetic
atacgccatgctgggtctccgacaaggagctatatcctttagcttccctcaaatcactctttggcagcgacccctagtcacagtaagaatagggggacagctaatagaagctctattagacgtacttgggagtcggccat

SEQ ID NO: 402538 - DNA, 140 bp, Artificial Sequence
  Synthetic
atggccgactcccaagtacgtctaatagagcttctattagctgtccccctattcttactgtgactaggggtcgctgccaaagagtgatttgagggaagctaaaggatatagctccttgtcggagacccagcatggcgtat

SEQ ID NO: 402539 - DNA, 140 bp, Artificial Sequence
  Synthetic
aggccctggctgctgatatgtgggaagtccttaagtatctgggaaatcttgtgcagtattggggtctggagctaaaaaagagtgctattagtctgcttgataccatagcaatagcagtaggaccttttgggacagcggtg

SEQ ID NO: 402540 - DNA, 140 bp, Artificial Sequence
  Synthetic
caccgctgtcccaaaaggtcctactgctattgctatggtatcaagcagactaatagcactcttttttagctccagaccccaatactgcacaagatttcccagatacttaaggacttcccacatatcagcagccagggcct

SEQ ID NO: 402541 - DNA, 140 bp, Artificial Sequence
  Synthetic
aggccctggctgctgatatgagtcagtcaaaattatcctatagtgcagaatctccaagggcaaatggtacatcagcccatatcacctagaaccttgaatgcatgggtaaaagtaatagaggaccttttgggacagcggtg

SEQ ID NO: 402542 - DNA, 140 bp, Artificial Sequence
  Synthetic
caccgctgtcccaaaaggtcctctattacttttacccatgcattcaaggttctaggtgatatgggctgatgtaccatttgcccttggagattctgcactataggataattttgactgactcatatcagcagccagggcct

SEQ ID NO: 402543 - DNA, 140 bp, Artificial Sequence
  Synthetic
atacgccatgctgggtctcctggattcctgaatgggagtttaataccccccctctagtaaaattatggtaccagttagataaaggacccatagtaggagcagaaactttctatgtagatgcgtacttgggagtcggccat

SEQ ID NO: 402544 - DNA, 140 bp, Artificial Sequence
  Synthetic
atggccgactcccaagtacgcatctacatagaaagtttctgctcctactatgggtcctttatctaactggtaccataattttactagagggggggtattaaactcccattcaggaatccaggagacccagcatggcgtat

SEQ ID NO: 402545 - DNA, 140 bp, Artificial Sequence
  Synthetic
aggccctggctgctgatatgacatgcagggatagaggtacgagacaccaaggaagccttagacaagatagaggaagaacaaaacaaaagtcagcaaaaaatacagcaggcaaaagaggctgaccttttgggacagcggtg

SEQ ID NO: 402546 - DNA, 140 bp, Artificial Sequence
  Synthetic
caccgctgtcccaaaaggtcagcctcttttgcctgctgtattttttgctgacttttgttttgttcttcctctatcttgtctaaggcttccttggtgtctcgtacctctatccctgcatgtcatatcagcagccagggcct

SEQ ID NO: 402547 - DNA, 140 bp, Artificial Sequence
  Synthetic
atacgccatgctgggtctccatccaaaagtaagttcagaagtacatattccaataaatgaggctagattaataataagaacatattggggtctacagacaggagaaaaagattggcatttcgtacttgggagtcggccat

SEQ ID NO: 402548 - DNA, 140 bp, Artificial Sequence
  Synthetic
atggccgactcccaagtacgaaatgccaatctttttctcctgtctgtagaccccaatatgttcttattattaatctagcctcatttattggaatatgtacttctgaacttacttttggatggagacccagcatggcgtat

SEQ ID NO: 402549 - DNA, 140 bp, Artificial Sequence
  Synthetic
aggccctggctgctgatatgccaggccagatgagagaaccaaggggaagtgatatagcaggaactactagtacccttcaggaacaaatagcatggatgacaggtaacccacctattccaggaccttttgggacagcggtg

SEQ ID NO: 402550 - DNA, 140 bp, Artificial Sequence
  Synthetic
caccgctgtcccaaaaggtcctggaataggtgggttacctgtcatccatgctatttgttcctgaagggtactagtagttcctgctatatcacttccccttggttctctcatctggcctggcatatcagcagccagggcct

SEQ ID NO: 402551 - DNA, 140 bp, Artificial Sequence
  Synthetic
aggccctggctgctgatatgaaggcaggctaattttttagggaaaatttggccttccaacaaggggaggccagggaatttccttcagaacaggccagagccaacagccccaccagcagaggaccttttgggacagcggtg

SEQ ID NO: 402552 - DNA, 140 bp, Artificial Sequence
  Synthetic
caccgctgtcccaaaaggtcctctgctggtggggctgttggctctggcctgttctgaaggaaattccctggcctccccttgttggaaggccaaattttccctaaaaaattagcctgccttcatatcagcagccagggcct

SEQ ID NO: 402553 - DNA, 140 bp, Artificial Sequence
  Synthetic
aggccctggctgctgatatgagcttcaagttcgaggagacaacccccgctccgaagcaggagccgaaagacagggaacccttaacttccctcaaatcactctttggcagcgaccccttgtgaccttttgggacagcggtg

SEQ ID NO: 402554 - DNA, 140 bp, Artificial Sequence
  Synthetic
caccgctgtcccaaaaggtcacaaggggtcgctgccaaagagtgatttgagggaagttaagggttccctgtctttcggctcctgcttcggagcgggggttgtctcctcgaacttgaagctcatatcagcagccagggcct

SEQ ID NO: 402555 - DNA, 140 bp, Artificial Sequence
  Synthetic
aggccctggctgctgatatgacaccagggattagatatcaatataatgtgcttccacagggatggaaaggatcaccagcaatattccagagtagcatgacaaaaatcttagagccctttagaccttttgggacagcggtg

SEQ ID NO: 402556 - DNA, 140 bp, Artificial Sequence
  Synthetic
caccgctgtcccaaaaggtctaaagggctctaagatttttgtcatgctactctggaatattgctggtgatcctttccatccctgtggaagcacattatattgatatctaatccctggtgtcatatcagcagccagggcct

SEQ ID NO: 402557 - DNA, 140 bp, Artificial Sequence
  Synthetic
atacgccatgctgggtctccgactaacaccactaacaccactattggtcaggtggaacagatgaaggaaggagaaataaaaaactgctctttcaatatcaccacaaacatggataagaagcgtacttgggagtcggccat

SEQ ID NO: 402558 - DNA, 140 bp, Artificial Sequence
  Synthetic
atggccgactcccaagtacgcttcttatccatgtttgtggtgatattgaaagagcagttttttatttctccttccttcatctgttccacctgaccaatagtggtgttagtggtgttagtcggagacccagcatggcgtat

SEQ ID NO: 402559 - DNA, 140 bp, Artificial Sequence
  Synthetic
aggccctggctgctgatatgtatggggatacttgggaaggggttcaagctataataagaattttgcaacaactactgtttgttcatttcagaattgggtgtcaacatagcagaataggcagaccttttgggacagcggtg

SEQ ID NO: 402560 - DNA, 140 bp, Artificial Sequence
  Synthetic
caccgctgtcccaaaaggtctgcctattctgctatgttgacacccaattctgaaatgaacaaacagtagttgttgcaaaattcttattatagcttgaaccccttcccaagtatccccatacatatcagcagccagggcct

SEQ ID NO: 402561 - DNA, 140 bp, Artificial Sequence
  Synthetic
atacgccatgctgggtctccaaattgtactaatttgaatgctactaggtacaatagtagtaaagagggaataggagaaatgaaaaactgctctttcaatatcaccacaaatatcagagatcgtacttgggagtcggccat

SEQ ID NO: 402562 - DNA, 140 bp, Artificial Sequence
  Synthetic
atggccgactcccaagtacgatctctgatatttgtggtgatattgaaagagcagtttttcatttctcctattccctctttactactattgtacctagtagcattcaaattagtacaatttggagacccagcatggcgtat

SEQ ID NO: 402563 - DNA, 140 bp, Artificial Sequence
  Synthetic
aggccctggctgctgatatgtgctttctgaaaaagggcttaggcatctcctatggcaggaagaagcggagacgccgacgaggaactcctcagagccgtcaggatcatcaaaatcctgtacgaccttttgggacagcggtg

SEQ ID NO: 402564 - DNA, 140 bp, Artificial Sequence
  Synthetic
caccgctgtcccaaaaggtcgtacaggattttgatgatcctgacggctctgaggagttcctcgtcggcgtctccgcttcttcctgccataggagatgcctaagccctttttcagaaagcacatatcagcagccagggcct

SEQ ID NO: 402565 - DNA, 140 bp, Artificial Sequence
  Synthetic
aggccctggctgctgatatgcctagtgttaagaaactagtagaggatagatggaacaagccccagaagaccaagggccacagagagagccaaacaatgaatggacattagagcttttggagaccttttgggacagcggtg

SEQ ID NO: 402566 - DNA, 140 bp, Artificial Sequence
  Synthetic
caccgctgtcccaaaaggtctccaaaagctctaatgtccattcattgtttggctctctctgtggcccttggtcttctggggcttgttccatctatcctctactagtttcttaacactaggcatatcagcagccagggcct

SEQ ID NO: 402567 - DNA, 140 bp, Artificial Sequence
  Synthetic
aggccctggctgctgatatgatgacagaaaccttgttggtccaaaatgcgaacccagattgtaagactattttaaaagcattgggaccagcagctacactagaagaaatgatgacagcatgaccttttgggacagcggtg

SEQ ID NO: 402568 - DNA, 140 bp, Artificial Sequence
  Synthetic
caccgctgtcccaaaaggtcatgctgtcatcatttcttctagtgtagctgctggtcccaatgcttttaaaatagtcttacaatctgggttcgcattttggaccaacaaggtttctgtcatcatatcagcagccagggcct

SEQ ID NO: 402569 - DNA, 140 bp, Artificial Sequence
  Synthetic
atacgccatgctgggtctccattgaccaatgtcactataggaaatctaacagatgaagtaaaaaactgctcttttaatatgaccacagaaataaaagataagaagcagaaaacctatgcacgtacttgggagtcggccat

SEQ ID NO: 402570 - DNA, 140 bp, Artificial Sequence
  Synthetic
atggccgactcccaagtacgtgcataggttttctgcttcttatcttttatttctgtggtcatattaaaagagcagttttttacttcatctgttagatttcctatagtgacattggtcaatggagacccagcatggcgtat

SEQ ID NO: 402571 - DNA, 140 bp, Artificial Sequence
  Synthetic
aggccctggctgctgatatgaaagaatgaacaagaattattggaattagataagtgggcaagtttgtggaattggtttaccataacaaattggctgtggtatataaaaatattcataatggaccttttgggacagcggtg

SEQ ID NO: 402572 - DNA, 140 bp, Artificial Sequence
  Synthetic
caccgctgtcccaaaaggtccattatgaatatttttatataccacagccaatttgttatggtaaaccaattccacaaacttgcccacttatctaattccaataattcttgttcattctttcatatcagcagccagggcct

SEQ ID NO: 402573 - DNA, 140 bp, Artificial Sequence
  Synthetic
atacgccatgctgggtctcctagttgtgtgggacatagtactcatagtatatagaaaataagaaaaccaaagaagaatagataggttaattgttagaataagagaaagagcagaagacagcgtacttgggagtcggccat

SEQ ID NO: 402574 - DNA, 140 bp, Artificial Sequence
  Synthetic
atggccgactcccaagtacgctgtcttctgctctttctcttattctaacaattaacctatctattcttctttggttttcttattttctatatactatgagtactatgtcccacacaactaggagacccagcatggcgtat

SEQ ID NO: 402575 - DNA, 140 bp, Artificial Sequence
  Synthetic
aggccctggctgctgatatgtgaagatataatcagtgtatgggatgaaagtttaaagccatgtgtaaagatgacccctctctgtgtcactttaaattgtagtcacaacatcagtaccaatgaccttttgggacagcggtg

SEQ ID NO: 402576 - DNA, 140 bp, Artificial Sequence
  Synthetic
caccgctgtcccaaaaggtcattggtactgatgttgtgactacaatttaaagtgacacagagaggggtcatctttacacatggctttaaactttcatcccatacactgattatatcttcacatatcagcagccagggcct

SEQ ID NO: 402577 - DNA, 140 bp, Artificial Sequence
  Synthetic
aggccctggctgctgatatgtggtagagcagatgcatacagatataatcagtctatgggaccaaagcctaaaaccatgtgtaaagttaacccctctctgcgtcactttaaattgtaaaaagaccttttgggacagcggtg

SEQ ID NO: 402578 - DNA, 140 bp, Artificial Sequence
  Synthetic
caccgctgtcccaaaaggtctttttacaatttaaagtgacgcagagaggggttaactttacacatggttttaggctttggtcccatagactgattatatctgtatgcatctgctctaccacatatcagcagccagggcct

SEQ ID NO: 402579 - DNA, 140 bp, Artificial Sequence
  Synthetic
atacgccatgctgggtctcctgagaggagaaatgaaaaactgctcttacaatatgaccacagaaatgagagataaaaaacagaaagtatattcacttttttatagactggatgtagtacacgtacttgggagtcggccat

SEQ ID NO: 402580 - DNA, 140 bp, Artificial Sequence
  Synthetic
atggccgactcccaagtacgtgtactacatccagtctataaaaaagtgaatatactttctgttttttatctctcatttctgtggtcatattgtaagagcagtttttcatttctcctctcaggagacccagcatggcgtat

SEQ ID NO: 402581 - DNA, 140 bp, Artificial Sequence
  Synthetic
aggccctggctgctgatatggcacaagaggaagaggaagaggtgggttttccagtcagacctcaggtacctttaagaccaatgactcctagagcagctagggatcttagccactttttaagaccttttgggacagcggtg

SEQ ID NO: 402582 - DNA, 140 bp, Artificial Sequence
  Synthetic
caccgctgtcccaaaaggtcttaaaaagtggctaagatccctagctgctctaggagtcattggtcttaaaggtacctgaggtctgactggaaaacccacctcttcctcttcctcttgtgccatatcagcagccagggcct

SEQ ID NO: 402583 - DNA, 140 bp, Artificial Sequence
  Synthetic
atacgccatgctgggtctccttgtaatgtttcaggagcaacatggaacaacactctaaaaagggtagttgcaaaactaagagaacagtttgggaacaaaacaataatctttaattcatctcgtacttgggagtcggccat

SEQ ID NO: 402584 - DNA, 140 bp, Artificial Sequence
  Synthetic
atggccgactcccaagtacgagatgaattaaagattattgttttgttcccaaactgttctcttagttttgcaactaccctttttagagtgttgttccatgttgctcctgaaacattacaaggagacccagcatggcgtat

SEQ ID NO: 402585 - DNA, 140 bp, Artificial Sequence
  Synthetic
atacgccatgctgggtctccggaatttttctactgtaatacatcaggcctgtttaacagcacttggaggccaaacgacatgcagtggtcaaatgacacgggcaatataacgcattataaccgtacttgggagtcggccat

SEQ ID NO: 402586 - DNA, 140 bp, Artificial Sequence
  Synthetic
atggccgactcccaagtacggttataatgcgttatattgcccgtgtcatttgaccactgcatgtcgtttggcctccaagtgctgttaaacaggcctgatgtattacagtagaaaaattccggagacccagcatggcgtat

SEQ ID NO: 402587 - DNA, 140 bp, Artificial Sequence
  Synthetic
atacgccatgctgggtctcctcttccatgcagaataagcaaattataaatatgtggcagagagtaggacaagcaatgtatgcccctcccatccaaggagaaataaagtgtaattcaaccacgtacttgggagtcggccat

SEQ ID NO: 402588 - DNA, 140 bp, Artificial Sequence
  Synthetic
atggccgactcccaagtacgtggttgaattacactttatttctccttggatgggaggggcatacattgcttgtcctactctctgccacatatttataatttgcttattctgcatggaagaggagacccagcatggcgtat

SEQ ID NO: 402589 - DNA, 140 bp, Artificial Sequence
  Synthetic
atacgccatgctgggtctccagtaataaatctcaagaactaacatatgggaaaaacatgacctggctagaatgggataaagaaattagtaattacacgcaacaaatatatgaactaattgcgtacttgggagtcggccat

SEQ ID NO: 402590 - DNA, 140 bp, Artificial Sequence
  Synthetic
atggccgactcccaagtacgcaattagttcatatatttgttgcgtgtaattactaatttctttatcccattctagccaggtcatgtttttcccatatgttagttcttgagatttattactggagacccagcatggcgtat

SEQ ID NO: 402591 - DNA, 140 bp, Artificial Sequence
  Synthetic
atacgccatgctgggtctcccttagatgatggcatgaagggagaaatacaaaattgctctttcaatgcaaccacagaaataagagataaggagcgccaagagtatgcacttttttataggcgtacttgggagtcggccat

SEQ ID NO: 402592 - DNA, 140 bp, Artificial Sequence
  Synthetic
atggccgactcccaagtacgcctataaaaaagtgcatactcttggcgctccttatctcttatttctgtggttgcattgaaagagcaattttgtatttctcccttcatgccatcatctaagggagacccagcatggcgtat

SEQ ID NO: 402593 - DNA, 140 bp, Artificial Sequence
  Synthetic
  misc_feature (58)..(58): n is a, c, g, or t
atacgccatgctgggtctccgactgtggaaattctggggacacaggggggtggcagancctcaaatatctgggggaacctttctgttatatgggttcaggaactgcagaagagtgctactcgtacttgggagtcggccat

SEQ ID NO: 402594 - DNA, 140 bp, Artificial Sequence
  Synthetic
  misc_feature (83)..(83): n is a, c, g, or t
atggccgactcccaagtacgagtagcactcttctgcagttcctgaacccatataacagaaaggttcccccagatatttgaggntctgccacccccctgtgtccccagaatttccacagtcggagacccagcatggcgtat

SEQ ID NO: 402595 - DNA, 140 bp, Artificial Sequence
  Synthetic
aggccctggctgctgatatgtggagccagtagatcctaacctagagccctggaaccatccaggaagtcagcctaaaactgcttgtaatacatgctattgtaaacactgtagctaccattggaccttttgggacagcggtg

SEQ ID NO: 402596 - DNA, 140 bp, Artificial Sequence
  Synthetic
caccgctgtcccaaaaggtccaatggtagctacagtgtttacaatagcatgtattacaagcagttttaggctgacttcctggatggttccagggctctaggttaggatctactggctccacatatcagcagccagggcct

SEQ ID NO: 402597 - DNA, 140 bp, Artificial Sequence
  Synthetic
aggccctggctgctgatatggtcaaaaagtagtatagtgggatggcctgaaattagggaaagaataagacgaactcctccaaaggatagacaacctctcccagcagcagaaggagtaggagaccttttgggacagcggtg

SEQ ID NO: 402598 - DNA, 140 bp, Artificial Sequence
  Synthetic
caccgctgtcccaaaaggtctcctactccttctgctgctgggagaggttgtctatcctttggaggagttcgtcttattctttccctaatttcaggccatcccactatactactttttgaccatatcagcagccagggcct

SEQ ID NO: 402599 - DNA, 140 bp, Artificial Sequence
  Synthetic
aggccctggctgctgatatggaggggacctagaaattacaacacatagctttaattgtagaggagaatttttctattgcaatacatcagcactgtttaatagtacatacaatggtacatagaccttttgggacagcggtg

SEQ ID NO: 402600 - DNA, 140 bp, Artificial Sequence
  Synthetic
caccgctgtcccaaaaggtctatgtaccattgtatgtactattaaacagtgctgatgtattgcaatagaaaaattctcctctacaattaaagctatgtgttgtaatttctaggtcccctccatatcagcagccagggcct

SEQ ID NO: 402601 - DNA, 140 bp, Artificial Sequence
  Synthetic
atacgccatgctgggtctccaagggctaataatgctaatctcgcctggctggaagcgcaagaggaggaggaggaggcttttccagtcagaccgcagttacctctaagaccaatgacttatcgtacttgggagtcggccat

SEQ ID NO: 402602 - DNA, 140 bp, Artificial Sequence
  Synthetic
atggccgactcccaagtacgataagtcattggtcttagaggtaactgcggtctgactggaaaagcctcctcctcctcctcttgcgcttccagccaggcgagattagcattattagcccttggagacccagcatggcgtat

SEQ ID NO: 402603 - DNA, 140 bp, Artificial Sequence
  Synthetic
aggccctggctgctgatatggaggaggaggcttttccagtcagaccgcagttacctctaagaccaatgacttataaggaagcattagatctcagccactttttaaaagaaaaggggggacgaccttttgggacagcggtg

SEQ ID NO: 402604 - DNA, 140 bp, Artificial Sequence
  Synthetic
caccgctgtcccaaaaggtcgtccccccttttcttttaaaaagtggctgagatctaatgcttccttataagtcattggtcttagaggtaactgcggtctgactggaaaagcctcctcctccatatcagcagccagggcct

SEQ ID NO: 402605 - DNA, 140 bp, Artificial Sequence
  Synthetic
atacgccatgctgggtctccggttaccaataatgctacttacaataatactgatgatataaaaaattgctcttttaatgcaaccacagaaataagagacaagaaacgcaaagagtatgcacgtacttgggagtcggccat

SEQ ID NO: 402606 - DNA, 140 bp, Artificial Sequence
  Synthetic
atggccgactcccaagtacgtgcatactctttgcgtttcttgtctcttatttctgtggttgcattaaaagagcaattttttatatcatcagtattattgtaagtagcattattggtaaccggagacccagcatggcgtat

SEQ ID NO: 402607 - DNA, 140 bp, Artificial Sequence
  Synthetic
atacgccatgctgggtctccctccactgctgtgccttggaactctagttggagtaataaatcttataatgaaatttgggataacatgacctggatggaatgggatagagaagttagcaatcgtacttgggagtcggccat

SEQ ID NO: 402608 - DNA, 140 bp, Artificial Sequence
  Synthetic
atggccgactcccaagtacgattgctaacttctctatcccattccatccaggtcatgttatcccaaatttcattataagatttattactccaactagagttccaaggcacagcagtggagggagacccagcatggcgtat

SEQ ID NO: 402609 - DNA, 140 bp, Artificial Sequence
  Synthetic
aggccctggctgctgatatggacaccaggcagctatgcaaatgttaaaagataccatcaatgaggaagctgcagattgggataggacacatccagtacatgcagggcctattccaccagggaccttttgggacagcggtg

SEQ ID NO: 402610 - DNA, 140 bp, Artificial Sequence
  Synthetic
caccgctgtcccaaaaggtccctggtggaataggccctgcatgtactggatgtgtcctatcccaatctgcagcttcctcattgatggtatcttttaacatttgcatagctgcctggtgtccatatcagcagccagggcct

SEQ ID NO: 402611 - DNA, 140 bp, Artificial Sequence
  Synthetic
  misc_feature (28)..(28): n is a, c, g, or t
aggccctggctgctgatatgcagctacnttagaggaaatgatgacagcatgtcagggagtgggaggaccaggccataagcaagagttttagcggaagcaatgagccaagtaacaagtcaagaccttttgggacagcggtg

SEQ ID NO: 402612 - DNA, 140 bp, Artificial Sequence
  Synthetic
  misc_feature (113)..(113): n is a, c, g, or t
caccgctgtcccaaaaggtcttgacttgttacttggctcattgcttccgctaaaactcttgcttatggcctggtcctcccactccctgacatgctgtcatcatttcctctaangtagctgcatatcagcagccagggcct

SEQ ID NO: 402613 - DNA, 140 bp, Artificial Sequence
  Synthetic
aggccctggctgctgatatgacacaagaaaaagtataaggatagggccaggacaagcattctatgcaacaaacggcataataggagacataagacaagcacattgtaacattagtgaatcgaccttttgggacagcggtg

SEQ ID NO: 402614 - DNA, 140 bp, Artificial Sequence
  Synthetic
caccgctgtcccaaaaggtcgattcactaatgttacaatgtgcttgtcttatgtctcctattatgccgtttgttgcatagaatgcttgtcctggccctatccttatactttttcttgtgtcatatcagcagccagggcct

SEQ ID NO: 402615 - DNA, 140 bp, Artificial Sequence
  Synthetic
atacgccatgctgggtctcctccctaataaaacaataagtttcaaccaatcctcaggaggggacctagaaattgtaacacatagctttaattgtggaggagaattcttttattgtaataccgtacttgggagtcggccat

SEQ ID NO: 402616 - DNA, 140 bp, Artificial Sequence
  Synthetic
atggccgactcccaagtacggtattacaataaaagaattctcctccacaattaaagctatgtgttacaatttctaggtcccctcctgaggattggttgaaacttattgttttattagggaggagacccagcatggcgtat

SEQ ID NO: 402617 - DNA, 140 bp, Artificial Sequence
  Synthetic
aggccctggctgctgatatgattgtaacacatagctttaattgtggaggagaattcttttattgtaatacatcaagactgtttaacggtacatacaatggtacagacatgcctacatacagaccttttgggacagcggtg

SEQ ID NO: 402618 - DNA, 140 bp, Artificial Sequence
  Synthetic
caccgctgtcccaaaaggtctgtatgtaggcatgtctgtaccattgtatgtaccgttaaacagtcttgatgtattacaataaaagaattctcctccacaattaaagctatgtgttacaatcatatcagcagccagggcct

SEQ ID NO: 402619 - DNA, 140 bp, Artificial Sequence
  Synthetic
aggccctggctgctgatatggcattcacactaggaattgttagagctatccgcaacctacctagaagaataagacaaggttttgaagcagctttgctataaaatggggggcaaatggtcagaccttttgggacagcggtg

SEQ ID NO: 402620 - DNA, 140 bp, Artificial Sequence
  Synthetic
caccgctgtcccaaaaggtctgaccatttgccccccattttatagcaaagctgcttcaaaaccttgtcttattcttctaggtaggttgcggatagctctaacaattcctagtgtgaatgccatatcagcagccagggcct

SEQ ID NO: 402621 - DNA, 140 bp, Artificial Sequence
  Synthetic
aggccctggctgctgatatgctggaagcacaagaggaagaggaagaagtaggctttccagttagacctcaggtgcctttaagaccaatgacttataaggcagcgtttgatctcagcttctgaccttttgggacagcggtg

SEQ ID NO: 402622 - DNA, 140 bp, Artificial Sequence
  Synthetic
caccgctgtcccaaaaggtcagaagctgagatcaaacgctgccttataagtcattggtcttaaaggcacctgaggtctaactggaaagcctacttcttcctcttcctcttgtgcttccagcatatcagcagccagggcct

SEQ ID NO: 402623 - DNA, 140 bp, Artificial Sequence
  Synthetic
aggccctggctgctgatatgaggggaggccagggaattttcttcagaacaggccagagccaacagcccggacagagccaacagccccaccagcagagatctttgggttcggagaggggacgaccttttgggacagcggtg

SEQ ID NO: 402624 - DNA, 140 bp, Artificial Sequence
  Synthetic
caccgctgtcccaaaaggtcgtcccctctccgaacccaaagatctctgctggtggggctgttggctctgtccgggctgttggctctggcctgttctgaagaaaattccctggcctcccctcatatcagcagccagggcct

SEQ ID NO: 402625 - DNA, 140 bp, Artificial Sequence
  Synthetic
aggccctggctgctgatatgcagtctcaggggactacagagggggtgggaagcccttaaatatctgggaagtcttgtgcagtattggggtctggaactaaaaaagagtgctattagtctggaccttttgggacagcggtg

SEQ ID NO: 402626 - DNA, 140 bp, Artificial Sequence
  Synthetic
caccgctgtcccaaaaggtccagactaatagcactcttttttagttccagaccccaatactgcacaagacttcccagatatttaagggcttcccaccccctctgtagtcccctgagactgcatatcagcagccagggcct

SEQ ID NO: 402627 - DNA, 140 bp, Artificial Sequence
  Synthetic
  misc_feature (71)..(71): n is a, c, g, or t
aggccctggctgctgatatgcagattaattgtacaagacccaacaactatacaagaaaaagtatatatttnggaccaggacgagcatttcatacagcaggaaaaataataggagacatcagaccttttgggacagcggtg

SEQ ID NO: 402628 - DNA, 140 bp, Artificial Sequence
  Synthetic
  misc_feature (70)..(70): n is a, c, g, or t
caccgctgtcccaaaaggtctgatgtctcctattatttttcctgctgtatgaaatgctcgtcctggtccnaaatatatactttttcttgtatagttgttgggtcttgtacaattaatctgcatatcagcagccagggcct

SEQ ID NO: 402629 - DNA, 140 bp, Artificial Sequence
  Synthetic
atacgccatgctgggtctccttatagaagtagcacaaagagcttatagggctattatccacatacctagaagagtcagacagggcctcgaaagggctttgctgtaagatgggtggcaagtcgtacttgggagtcggccat

SEQ ID NO: 402630 - DNA, 140 bp, Artificial Sequence
  Synthetic
atggccgactcccaagtacgacttgccacccatcttacagcaaagccctttcgaggccctgtctgactcttctaggtatgtggataatagccctataagctctttgtgctacttctataaggagacccagcatggcgtat

SEQ ID NO: 402631 - DNA, 140 bp, Artificial Sequence
  Synthetic
atacgccatgctgggtctccctctgtattactttaaattgtactgatttaaagaatgttaatagtaccactaatagtagcgggagaatgatagagggaggcgaaataaaaaactgctcttcgtacttgggagtcggccat

SEQ ID NO: 402632 - DNA, 140 bp, Artificial Sequence
  Synthetic
atggccgactcccaagtacgaagagcagttttttatttcgcctccctctatcattctcccgctactattagtggtactattaacattctttaaatcagtacaatttaaagtaatacagagggagacccagcatggcgtat

SEQ ID NO: 402633 - DNA, 140 bp, Artificial Sequence
  Synthetic
aggccctggctgctgatatggttcagaagtacatatcccactaggagatgctaaattagtaataagaacatattggggtctgcagacaggagaaaaagactggcacttgggtcatggagtgaccttttgggacagcggtg

SEQ ID NO: 402634 - DNA, 140 bp, Artificial Sequence
  Synthetic
caccgctgtcccaaaaggtcactccatgacccaagtgccagtctttttctcctgtctgcagaccccaatatgttcttattactaatttagcatctcctagtgggatatgtacttctgaaccatatcagcagccagggcct

SEQ ID NO: 402635 - DNA, 140 bp, Artificial Sequence
  Synthetic
aggccctggctgctgatatgcatgtggcaggaagtaggacgagcaatgtatgccgctcccattgaaggaaacattacctgtaactcaaatattacaggtctactattgacaagagatggtgaccttttgggacagcggtg

SEQ ID NO: 402636 - DNA, 140 bp, Artificial Sequence
  Synthetic
caccgctgtcccaaaaggtcaccatctcttgtcaatagtagacctgtaatatttgagttacaggtaatgtttccttcaatgggagcggcatacattgctcgtcctacttcctgccacatgcatatcagcagccagggcct

SEQ ID NO: 402637 - DNA, 140 bp, Artificial Sequence
  Synthetic
aggccctggctgctgatatgtgaagaatcgcagaaccagcaagaaaagaatgaacaagaattattggaattagataaatgggcaaatttgtggaattggtttagcataacacaatggctggaccttttgggacagcggtg

SEQ ID NO: 402638 - DNA, 140 bp, Artificial Sequence
  Synthetic
caccgctgtcccaaaaggtccagccattgtgttatgctaaaccaattccacaaatttgcccatttatctaattccaataattcttgttcattcttttcttgctggttctgcgattcttcacatatcagcagccagggcct

SEQ ID NO: 402639 - DNA, 140 bp, Artificial Sequence
  Synthetic
atacgccatgctgggtctccctatcattgccagatgtgctttttaaacaaaggcttaggcatttcctatggcaggaagaagcggagacagcgacgcacagctcctcctggcagtaagagccgtacttgggagtcggccat

SEQ ID NO: 402640 - DNA, 140 bp, Artificial Sequence
  Synthetic
atggccgactcccaagtacggctcttactgccaggaggagctgtgcgtcgctgtctccgcttcttcctgccataggaaatgcctaagcctttgtttaaaaagcacatctggcaatgatagggagacccagcatggcgtat

SEQ ID NO: 402641 - DNA, 140 bp, Artificial Sequence
  Synthetic
atacgccatgctgggtctcctgcaggcattagagatatctgcaatagtaggattagtagtagcattcatagcagccataattgtgtggactatagtgtatatacaatatagggaaataagcgtacttgggagtcggccat

SEQ ID NO: 402642 - DNA, 140 bp, Artificial Sequence
  Synthetic
atggccgactcccaagtacgcttatttccctatattgtatatacactatagtccacacaattatggctgctatgaatgctactactaatcctactattgcagatatctctaatgcctgcaggagacccagcatggcgtat

SEQ ID NO: 402643 - DNA, 140 bp, Artificial Sequence
  Synthetic
aggccctggctgctgatatggcagccataattgtgtggactatagtgtatatacaatatagggaaataagaaaacagagaaaaatagaaaagttatatgagagaataatagaaagagcaggaccttttgggacagcggtg

SEQ ID NO: 402644 - DNA, 140 bp, Artificial Sequence
  Synthetic
caccgctgtcccaaaaggtcctgctctttctattattctctcatataacttttctatttttctctgttttcttatttccctatattgtatatacactatagtccacacaattatggctgccatatcagcagccagggcct

SEQ ID NO: 402645 - DNA, 140 bp, Artificial Sequence
  Synthetic
atacgccatgctgggtctcctacaagaaaaagtacaagtataggacaaggacaagtatggtatagaacagatgacataataggagatataagaaaagcatattgtgagattaatggaacacgtacttgggagtcggccat

SEQ ID NO: 402646 - DNA, 140 bp, Artificial Sequence
  Synthetic
atggccgactcccaagtacgtgttccattaatctcacaatatgcttttcttatatctcctattatgtcatctgttctataccatacttgtccttgtcctatacttgtactttttcttgtaggagacccagcatggcgtat

SEQ ID NO: 402647 - DNA, 140 bp, Artificial Sequence
  Synthetic
atacgccatgctgggtctccttagaaatattacaaagaattggtagaggtatcctccatatacctacaagaatcagacagggcttagaaaggcttttgctataagatgggtggcaagtggcgtacttgggagtcggccat

SEQ ID NO: 402648 - DNA, 140 bp, Artificial Sequence
  Synthetic
atggccgactcccaagtacgccacttgccacccatcttatagcaaaagcctttctaagccctgtctgattcttgtaggtatatggaggatacctctaccaattctttgtaatatttctaaggagacccagcatggcgtat

SEQ ID NO: 402649 - DNA, 140 bp, Artificial Sequence
  Synthetic
aggccctggctgctgatatgtgagaataagaatataaccttccaaccaccctcaggaggagatccagaaattacaatgcatcattttaattgcagaggggaatttttctattgcaatacagaccttttgggacagcggtg

SEQ ID NO: 402650 - DNA, 140 bp, Artificial Sequence
  Synthetic
caccgctgtcccaaaaggtctgtattgcaatagaaaaattcccctctgcaattaaaatgatgcattgtaatttctggatctcctcctgagggtggttggaaggttatattcttattctcacatatcagcagccagggcct

SEQ ID NO: 402651 - DNA, 140 bp, Artificial Sequence
  Synthetic
atacgccatgctgggtctccacaaacagcagtactaacgtaactaaaactaacaatatcactgtaaaagaggtagaagacatgagaaactgttctttcaatgtaaccacagaaataagagcgtacttgggagtcggccat

SEQ ID NO: 402652 - DNA, 140 bp, Artificial Sequence
  Synthetic
atggccgactcccaagtacgctcttatttctgtggttacattgaaagaacagtttctcatgtcttctacctcttttacagtgatattgttagttttagttacgttagtactgctgtttgtggagacccagcatggcgtat

SEQ ID NO: 402653 - DNA, 140 bp, Artificial Sequence
  Synthetic
aggccctggctgctgatatgggtagaagacatgagaaactgttctttcaatgtaaccacagaaataagagataagacaaagcaggaatacgcgcttttctataaaactgatgtagtacaagaccttttgggacagcggtg

SEQ ID NO: 402654 - DNA, 140 bp, Artificial Sequence
  Synthetic
caccgctgtcccaaaaggtcttgtactacatcagttttatagaaaagcgcgtattcctgctttgtcttatctcttatttctgtggttacattgaaagaacagtttctcatgtcttctacccatatcagcagccagggcct

SEQ ID NO: 402655 - DNA, 140 bp, Artificial Sequence
  Synthetic
atacgccatgctgggtctcccccgaacagggacttgaaagtgaaagagaaacattttaaaaagaaaggggggatgggggggcttgttgaagggcgagcggcaaagggcgaggggcggcggcgtacttgggagtcggccat

SEQ ID NO: 402656 - DNA, 140 bp, Artificial Sequence
  Synthetic
atggccgactcccaagtacgccgccgcccctcgccctttgccgctcgcccttcaacaagcccccccatcccccctttctttttaaaatgtttctctttcactttcaagtccctgttcgggggagacccagcatggcgtat

SEQ ID NO: 402657 - DNA, 140 bp, Artificial Sequence
  Synthetic
atacgccatgctgggtctccacccaataacaatacaagaagaggtatacaccttggaccagggcaagtgttctttgcaacaggtgacataataggagatataagacaagctcattgtaatcgtacttgggagtcggccat

SEQ ID NO: 402658 - DNA, 140 bp, Artificial Sequence
  Synthetic
atggccgactcccaagtacgattacaatgagcttgtcttatatctcctattatgtcacctgttgcaaagaacacttgccctggtccaaggtgtatacctcttcttgtattgttattgggtggagacccagcatggcgtat

SEQ ID NO: 402659 - DNA, 140 bp, Artificial Sequence
  Synthetic
atacgccatgctgggtctccttactgtttactcatttcagaattgggtgccagcatagcagaatgggcatcctacaacagagaagatcaagaaatggagtcagtagatcctagcctagagcgtacttgggagtcggccat

SEQ ID NO: 402660 - DNA, 140 bp, Artificial Sequence
  Synthetic
atggccgactcccaagtacgctctaggctaggatctactgactccatttcttgatcttctctgttgtaggatgcccattctgctatgctggcacccaattctgaaatgagtaaacagtaaggagacccagcatggcgtat

SEQ ID NO: 402661 - DNA, 140 bp, Artificial Sequence
  Synthetic
atacgccatgctgggtctccacctagaaatcacaacacatagttttaattgtagaggagaatttttctattgtaatacatcaaaactatttaatagtactttttctaatgataattccaccgtacttgggagtcggccat

SEQ ID NO: 402662 - DNA, 140 bp, Artificial Sequence
  Synthetic
atggccgactcccaagtacggtggaattatcattagaaaaagtactattaaatagttttgatgtattacaatagaaaaattctcctctacaattaaaactatgtgttgtgatttctaggtggagacccagcatggcgtat

SEQ ID NO: 402663 - DNA, 140 bp, Artificial Sequence
  Synthetic
aggccctggctgctgatatgttagggaaagagcagaagacagtggcaatgagagtgaaggggatacagaggaattggccacaatggtggatatggggcatcttaggcttttggatgataagaccttttgggacagcggtg

SEQ ID NO: 402664 - DNA, 140 bp, Artificial Sequence
  Synthetic
caccgctgtcccaaaaggtcttatcatccaaaagcctaagatgccccatatccaccattgtggccaattcctctgtatccccttcactctcattgccactgtcttctgctctttccctaacatatcagcagccagggcct

SEQ ID NO: 402665 - DNA, 140 bp, Artificial Sequence
  Synthetic
atacgccatgctgggtctcccaggtcagggaaagaatgaggcaaactcctgcaccagctcctgcagcagcagaaggagtaggagcagtatctcaagatctagataaacatggagcagtaacgtacttgggagtcggccat

SEQ ID NO: 402666 - DNA, 140 bp, Artificial Sequence
  Synthetic
atggccgactcccaagtacgttactgctccatgtttatctagatcttgagatactgctcctactccttctgctgctgcaggagctggtgcaggagtttgcctcattctttccctgacctgggagacccagcatggcgtat

SEQ ID NO: 402667 - DNA, 140 bp, Artificial Sequence
  Synthetic
atacgccatgctgggtctccaggaaatgaaaaattgctctttcaatgtatccacagaaataaaagataaaaaacataaagagtatgccactttttatagacttgatatggtaccacttaacgtacttgggagtcggccat

SEQ ID NO: 402668 - DNA, 140 bp, Artificial Sequence
  Synthetic
atggccgactcccaagtacgttaagtggtaccatatcaagtctataaaaagtggcatactctttatgttttttatcttttatttctgtggatacattgaaagagcaatttttcatttcctggagacccagcatggcgtat

SEQ ID NO: 402669 - DNA, 140 bp, Artificial Sequence
  Synthetic
atacgccatgctgggtctccgaaattagcaattacacagacctaatatacagcctaattgaagaatcgcaaactcagcaggaaaagaatgaacaagatttattggcattggacaaatgggcgtacttgggagtcggccat

SEQ ID NO: 402670 - DNA, 140 bp, Artificial Sequence
  Synthetic
atggccgactcccaagtacgcccatttgtccaatgccaataaatcttgttcattcttttcctgctgagtttgcgattcttcaattaggctgtatattaggtctgtgtaattgctaatttcggagacccagcatggcgtat

SEQ ID NO: 402671 - DNA, 140 bp, Artificial Sequence
  Synthetic
aggccctggctgctgatatggcacacagcaagaggcgagagcggcgactggtgagtacgccaatttttgactagcggaggctagaaggagagagatgggtgcgagagcgtcagtattaaggaccttttgggacagcggtg

SEQ ID NO: 402672 - DNA, 140 bp, Artificial Sequence
  Synthetic
caccgctgtcccaaaaggtccttaatactgacgctctcgcacccatctctctccttctagcctccgctagtcaaaaattggcgtactcaccagtcgccgctctcgcctcttgctgtgtgccatatcagcagccagggcct

SEQ ID NO: 402673 - DNA, 140 bp, Artificial Sequence
  Synthetic
aggccctggctgctgatatgtgccataataggagacataagacaagcatattgtaacattagtcaagaagactggaacacaaccttagaagaggtaaagaaaaaattagcaaaacactacgaccttttgggacagcggtg

SEQ ID NO: 402674 - DNA, 140 bp, Artificial Sequence
  Synthetic
caccgctgtcccaaaaggtcgtagtgttttgctaattttttctttacctcttctaaggttgtgttccagtcttcttgactaatgttacaatatgcttgtcttatgtctcctattatggcacatatcagcagccagggcct

SEQ ID NO: 402675 - DNA, 140 bp, Artificial Sequence
  Synthetic
atacgccatgctgggtctcctacaacacataactttaattgtagaggagaatttttctattgcaatacaacagacctgttttctaatattaataaaagtaatataatactcccatgtaaacgtacttgggagtcggccat

SEQ ID NO: 402676 - DNA, 140 bp, Artificial Sequence
  Synthetic
atggccgactcccaagtacgtttacatgggagtattatattacttttattaatattagaaaacaggtctgttgtattgcaatagaaaaattctcctctacaattaaagttatgtgttgtaggagacccagcatggcgtat

SEQ ID NO: 402677 - DNA, 140 bp, Artificial Sequence
  Synthetic
atacgccatgctgggtctccataaaacaaattataaacatgtggcagggggtaggacgagcaatgtatgcccctcccattgaaggaatataacatgtaactcagagatcacaggactactcgtacttgggagtcggccat

SEQ ID NO: 402678 - DNA, 140 bp, Artificial Sequence
  Synthetic
atggccgactcccaagtacgagtagtcctgtgatctctgagttacatgttatattccttcaatgggaggggcatacattgctcgtcctaccccctgccacatgtttataatttgttttatggagacccagcatggcgtat

SEQ ID NO: 402679 - DNA, 140 bp, Artificial Sequence
  Synthetic
aggccctggctgctgatatgtcacttcagacaggatcagaagaacttagatcattattcaatgcaatagcagtcctctattgtgtacatcaaaggatagacataaaagacaccaaggaaggaccttttgggacagcggtg

SEQ ID NO: 402680 - DNA, 140 bp, Artificial Sequence
  Synthetic
caccgctgtcccaaaaggtccttccttggtgtcttttatgtctatcctttgatgtacacaatagaggactgctattgcattgaataatgatctaagttcttctgatcctgtctgaagtgacatatcagcagccagggcct

SEQ ID NO: 402681 - DNA, 140 bp, Artificial Sequence
  Synthetic
aggccctggctgctgatatgagaaagagcaacagaaagagcagcagagggagtaggagcagtgtctcaagatttggatagacatggggcaatcacaagcagcaatacagcagcttcaaatgaccttttgggacagcggtg

SEQ ID NO: 402682 - DNA, 140 bp, Artificial Sequence
  Synthetic
caccgctgtcccaaaaggtcatttgaagctgctgtattgctgcttgtgattgccccatgtctatccaaatcttgagacactgctcctactccctctgctgctctttctgttgctctttctcatatcagcagccagggcct

SEQ ID NO: 402683 - DNA, 140 bp, Artificial Sequence
  Synthetic
atacgccatgctgggtctccccagacaaatgacacgaatgaaaacataacactcccatgcaggataaaacaaattgtaaacatatggcaggaagtaggacaagcaatgtatgcccctccacgtacttgggagtcggccat

SEQ ID NO: 402684 - DNA, 140 bp, Artificial Sequence
  Synthetic
atggccgactcccaagtacgtggaggggcatacattgcttgtcctacttcctgccatatgtttacaatttgttttatcctgcatgggagtgttatgttttcattcgtgtcatttgtctggggagacccagcatggcgtat

SEQ ID NO: 402685 - DNA, 140 bp, Artificial Sequence
  Synthetic
aggccctggctgctgatatgtgtcactttaaaatgtggaaatgctacctataataatacaagggaagaaataaaaaattgcactttcaatataaccacagaaataagaaataggaaaaaggaccttttgggacagcggtg

SEQ ID NO: 402686 - DNA, 140 bp, Artificial Sequence
  Synthetic
caccgctgtcccaaaaggtcctttttcctatttcttatttctgtggttatattgaaagtgcaattttttatttcttcccttgtattattataggtagcatttccacattttaaagtgacacatatcagcagccagggcct

SEQ ID NO: 402687 - DNA, 140 bp, Artificial Sequence
  Synthetic
atacgccatgctgggtctcctaaatcttatgcagaaatttgggaaaacatgacatggatgcagtgggatagagaaattaataattatacagaaacaatatatagattgcttgaagtctcgcgtacttgggagtcggccat

SEQ ID NO: 402688 - DNA, 140 bp, Artificial Sequence
  Synthetic
atggccgactcccaagtacgcgagacttcaagcaatctatatattgtttctgtataattattaatttctctatcccactgcatccatgtcatgttttcccaaatttctgcataagatttaggagacccagcatggcgtat

SEQ ID NO: 402689 - DNA, 140 bp, Artificial Sequence
  Synthetic
aggccctggctgctgatatggaattattggcattggacaaatgggcaagtctgtggaattggtttgacatatcaaattggctgtggtatataaaaatattcataatgatagtaggaggctgaccttttgggacagcggtg

SEQ ID NO: 402690 - DNA, 140 bp, Artificial Sequence
  Synthetic
caccgctgtcccaaaaggtcagcctcctactatcattatgaatatttttatataccacagccaatttgatatgtcaaaccaattccacagacttgcccatttgtccaatgccaataattccatatcagcagccagggcct

SEQ ID NO: 402691 - DNA, 140 bp, Artificial Sequence
  Synthetic
aggccctggctgctgatatgagcacaaccagataaaagtgaatcagagttagtcaatcaaataatagagcagttaataaaaaaggaaaaggtctacctggcatgggtaccagcacacaaagaccttttgggacagcggtg

SEQ ID NO: 402692 - DNA, 140 bp, Artificial Sequence
  Synthetic
caccgctgtcccaaaaggtctttgtgtgctggtacccatgccaggtagaccttttccttttttattaactgctctattatttgattgactaactctgattcacttttatctggttgtgctcatatcagcagccagggcct

SEQ ID NO: 402693 - DNA, 140 bp, Artificial Sequence
  Synthetic
aggccctggctgctgatatgaaagtagcagacaccaaggaagctctagataaaatagaggaaatacaaaataagagcaagcaaaaggcacagcaggcagcaactgccacaggaaacagcagaccttttgggacagcggtg

SEQ ID NO: 402694 - DNA, 140 bp, Artificial Sequence
  Synthetic
caccgctgtcccaaaaggtctgctgtttcctgtggcagttgctgcctgctgtgccttttgcttgctcttattttgtatttcctctattttatctagagcttccttggtgtctgctactttcatatcagcagccagggcct

SEQ ID NO: 402695 - DNA, 140 bp, Artificial Sequence
  Synthetic
aggccctggctgctgatatgcctccatttctttggatgggatatgaactccatcctgacaaatggacagtccagcctatagaactgccagaaaaagacagctggactgtcaatgatatacgaccttttgggacagcggtg

SEQ ID NO: 402696 - DNA, 140 bp, Artificial Sequence
  Synthetic
caccgctgtcccaaaaggtcgtatatcattgacagtccagctgtctttttctggcagttctataggctggactgtccatttgtcaggatggagttcatatcccatccaaagaaatggaggcatatcagcagccagggcct

SEQ ID NO: 402697 - DNA, 140 bp, Artificial Sequence
  Synthetic
aggccctggctgctgatatggaagccctagacaagatagaggaagaacaaaacaaaagtcagcaaaaaagtcagcaaaaaacacagcaagcaaaagcggctgacgggaaagtcagtcaaagaccttttgggacagcggtg

SEQ ID NO: 402698 - DNA, 140 bp, Artificial Sequence
  Synthetic
caccgctgtcccaaaaggtctttgactgactttcccgtcagccgcttttgcttgctgtgttttttgctgacttttttgctgacttttgttttgttcttcctctatcttgtctagggcttccatatcagcagccagggcct

SEQ ID NO: 402699 - DNA, 140 bp, Artificial Sequence
  Synthetic
aggccctggctgctgatatgactatcctatagtacagaatctccaagggcaaatggtacaccagtccctatcacctagaactttgaatgcatgggtaaaagtagtagaggagaagggtttgaccttttgggacagcggtg

SEQ ID NO: 402700 - DNA, 140 bp, Artificial Sequence
  Synthetic
caccgctgtcccaaaaggtcaaacccttctcctctactacttttacccatgcattcaaagttctaggtgatagggactggtgtaccatttgcccttggagattctgtactataggatagtcatatcagcagccagggcct

SEQ ID NO: 402701 - DNA, 140 bp, Artificial Sequence
  Synthetic
aggccctggctgctgatatgtgccttcattgccaagtttgtttcatgaaaaaaggcttaggcatctcctatggcaggaagaagcggagacagcgacgaagagctcctcaagacagtcagagaccttttgggacagcggtg

SEQ ID NO: 402702 - DNA, 140 bp, Artificial Sequence
  Synthetic
caccgctgtcccaaaaggtctctgactgtcttgaggagctcttcgtcgctgtctccgcttcttcctgccataggagatgcctaagccttttttcatgaaacaaacttggcaatgaaggcacatatcagcagccagggcct

SEQ ID NO: 402703 - DNA, 140 bp, Artificial Sequence
  Synthetic
atacgccatgctgggtctccggagacaacccctgctccgaaacaggagtcgaaagacagggagtcgaaagacagggaacccttaacttccctcaaatcactctttggcagcgaccccttgcgtacttgggagtcggccat

SEQ ID NO: 402704 - DNA, 140 bp, Artificial Sequence
  Synthetic
atggccgactcccaagtacgcaaggggtcgctgccaaagagtgatttgagggaagttaagggttccctgtctttcgactccctgtctttcgactcctgtttcggagcaggggttgtctccggagacccagcatggcgtat

SEQ ID NO: 402705 - DNA, 140 bp, Artificial Sequence
  Synthetic
  misc_feature (31)..(31): n is a, c, g, or t
  misc_feature (40)..(40): n is a, c, g, or t
  misc_feature (57)..(57): n is a, c, g, or t
  misc_feature (59)..(59): n is a, c, g, or t
  misc_feature (99)..(99): n is a, c, g, or t
aggccctggctgctgatatggtagggaatgntactaatancaacaatagtagtgagnanatgatggggaaaggagaaatgaaaaattgctctttcaatntcaccacaagtctaagagatagaccttttgggacagcggtg

SEQ ID NO: 402706 - DNA, 140 bp, Artificial Sequence
  Synthetic
  misc_feature (42)..(42): n is a, c, g, or t
  misc_feature (82)..(82): n is a, c, g, or t
  misc_feature (84)..(84): n is a, c, g, or t
  misc_feature (101)..(101): n is a, c, g, or t
  misc_feature (110)..(110): n is a, c, g, or t
caccgctgtcccaaaaggtctatctcttagacttgtggtganattgaaagagcaatttttcatttctcctttccccatcatntnctcactactattgttgntattagtancattccctaccatatcagcagccagggcct

SEQ ID NO: 402707 - DNA, 140 bp, Artificial Sequence
  Synthetic
atacgccatgctgggtctccttgcccctgaagaaataatgaaaaattgctctttcaatacaaccacagaaataagagataagaaaaaacaggtgtatgctcttttttatagatctgatatcgtacttgggagtcggccat

SEQ ID NO: 402708 - DNA, 140 bp, Artificial Sequence
  Synthetic
atggccgactcccaagtacgatatcagatctataaaaaagagcatacacctgttttttcttatctcttatttctgtggttgtattgaaagagcaatttttcattatttcttcaggggcaaggagacccagcatggcgtat

SEQ ID NO: 402709 - DNA, 140 bp, Artificial Sequence
  Synthetic
atacgccatgctgggtctccccatccaaaaataagttcagaagtacacatcccactaggaagtgctgaattagtaataacaacatattggggtctaaatacaggagaaagagaatggcaccgtacttgggagtcggccat

SEQ ID NO: 402710 - DNA, 140 bp, Artificial Sequence
  Synthetic
atggccgactcccaagtacggtgccattctctttctcctgtatttagaccccaatatgttgttattactaattcagcacttcctagtgggatgtgtacttctgaacttatttttggatggggagacccagcatggcgtat

SEQ ID NO: 402711 - DNA, 140 bp, Artificial Sequence
  Synthetic
  misc_feature (86)..(86): n is a, c, g, or t
aggccctggctgctgatatgcagtagctgaggggactgataggattatagaagtattacaaagagcttatagagctgttatccacntacctgtacgaataagacagggcttggaaagggcgaccttttgggacagcggtg

SEQ ID NO: 402712 - DNA, 140 bp, Artificial Sequence
  Synthetic
  misc_feature (55)..(55): n is a, c, g, or t
caccgctgtcccaaaaggtcgccctttccaagccctgtcttattcgtacaggtangtggataacagctctataagctctttgtaatacttctataatcctatcagtcccctcagctactgcatatcagcagccagggcct

SEQ ID NO: 402713 - DNA, 140 bp, Artificial Sequence
  Synthetic
aggccctggctgctgatatgactgtttattcatttcagaattgggtgccagcatagcagaataggaattttgcaacagagaagagcaagaaatggagccagtagatcctaatctagagccgaccttttgggacagcggtg

SEQ ID NO: 402714 - DNA, 140 bp, Artificial Sequence
  Synthetic
caccgctgtcccaaaaggtcggctctagattaggatctactggctccatttcttgctcttctctgttgcaaaattcctattctgctatgctggcacccaattctgaaatgaataaacagtcatatcagcagccagggcct

SEQ ID NO: 402715 - DNA, 140 bp, Artificial Sequence
  Synthetic
atacgccatgctgggtctccagaaatcaattgtaccagaccctctgaaaagaaaagaatgcgtatgactacgggaccaggacacgtattctataaaacaaacgaaataacaggagatatacgtacttgggagtcggccat

SEQ ID NO: 402716 - DNA, 140 bp, Artificial Sequence
  Synthetic
atggccgactcccaagtacgtatatctcctgttatttcgtttgttttatagaatacgtgtcctggtcccgtagtcatacgcattcttttcttttcagagggtctggtacaattgatttctggagacccagcatggcgtat

SEQ ID NO: 402717 - DNA, 140 bp, Artificial Sequence
  Synthetic
atacgccatgctgggtctcccctgaatcaaagcagtaagtaacaatagttattgtgtgtaatgcaggcattagaaatatctgcaatagtaggactaataatagcttcattagcagccatacgtacttgggagtcggccat

SEQ ID NO: 402718 - DNA, 140 bp, Artificial Sequence
  Synthetic
atggccgactcccaagtacgtatggctgctaatgaagctattattagtcctactattgcagatatttctaatgcctgcattacacacaataactattgttacttactgctttgattcaggggagacccagcatggcgtat

SEQ ID NO: 402719 - DNA, 140 bp, Artificial Sequence
  Synthetic
aggccctggctgctgatatggaaatgagagtgagggggacacagatgaattggtcacacttatggaaatggggaactttgatccttgggttggtgataatttgtaatgcctcaaaggaccgaccttttgggacagcggtg

SEQ ID NO: 402720 - DNA, 140 bp, Artificial Sequence
  Synthetic
caccgctgtcccaaaaggtcggtcctttgaggcattacaaattatcaccaacccaaggatcaaagttccccatttccataagtgtgaccaattcatctgtgtccccctcactctcatttccatatcagcagccagggcct

SEQ ID NO: 402721 - DNA, 140 bp, Artificial Sequence
  Synthetic
atacgccatgctgggtctccagcataaatggggaaataaaaaattgctctttcaatacaaccacagaaataagagacaagaaacagaaggggtatgcacttttttatagatctgatatagcgtacttgggagtcggccat

SEQ ID NO: 402722 - DNA, 140 bp, Artificial Sequence
  Synthetic
atggccgactcccaagtacgctatatcagatctataaaaaagtgcataccccttctgtttcttgtctcttatttctgtggttgtattgaaagagcaattttttatttccccatttatgctggagacccagcatggcgtat

SEQ ID NO: 402723 - DNA, 140 bp, Artificial Sequence
  Synthetic
aggccctggctgctgatatgaatagttgtgtggaccatagtatatttagaatatagaaaattggtaaaacaaagaaaaatagactggttaattaaaagaattagggaaagagcagaagacgaccttttgggacagcggtg

SEQ ID NO: 402724 - DNA, 140 bp, Artificial Sequence
  Synthetic
caccgctgtcccaaaaggtcgtcttctgctctttccctaattcttttaattaaccagtctatttttctttgttttaccaattttctatattctaaatatactatggtccacacaactattcatatcagcagccagggcct

SEQ ID NO: 402725 - DNA, 140 bp, Artificial Sequence
  Synthetic
aggccctggctgctgatatgacacattggaccagggcaagcgttttttgcaacaggtgacataataggagatataagacaagctcattgtaacattagtggagcaaaatggaatgagatggaccttttgggacagcggtg

SEQ ID NO: 402726 - DNA, 140 bp, Artificial Sequence
  Synthetic
caccgctgtcccaaaaggtccatctcattccattttgctccactaatgttacaatgagcttgtcttatatctcctattatgtcacctgttgcaaaaaacgcttgccctggtccaatgtgtcatatcagcagccagggcct

SEQ ID NO: 402727 - DNA, 140 bp, Artificial Sequence
  Synthetic
aggccctggctgctgatatggcagggggtaggacgagcaatgtatgcccctcctattgcaggaaacataacatgtaaatcaaatatcacaggactactattgacacgtgatggaggaaacgaccttttgggacagcggtg

SEQ ID NO: 402728 - DNA, 140 bp, Artificial Sequence
  Synthetic
caccgctgtcccaaaaggtcgtttcctccatcacgtgtcaatagtagtcctgtgatatttgatttacatgttatgtttcctgcaataggaggggcatacattgctcgtcctaccccctgccatatcagcagccagggcct

SEQ ID NO: 402729 - DNA, 140 bp, Artificial Sequence
  Synthetic
atacgccatgctgggtctccgacctatgaggataatggcaggaaggagataaagaattgctctttcaatgcaaccgcagaaataagagataagaagaacaaagagtatgcacttttttatcgtacttgggagtcggccat

SEQ ID NO: 402730 - DNA, 140 bp, Artificial Sequence
  Synthetic
atggccgactcccaagtacgataaaaaagtgcatactctttgttcttcttatctcttatttctgcggttgcattgaaagagcaattctttatctccttcctgccattatcctcataggtcggagacccagcatggcgtat

SEQ ID NO: 402731 - DNA, 140 bp, Artificial Sequence
  Synthetic
aggccctggctgctgatatgaattgtaagaatgtggcaaaaagtagcacgagctatgtatgcccctcccattgcaggaaacattacatgtacatcaaacattacaggactactattaacagaccttttgggacagcggtg

SEQ ID NO: 402732 - DNA, 140 bp, Artificial Sequence
  Synthetic
caccgctgtcccaaaaggtctgttaatagtagtcctgtaatgtttgatgtacatgtaatgtttcctgcaatgggaggggcatacatagctcgtgctactttttgccacattcttacaattcatatcagcagccagggcct

SEQ ID NO: 402733 - DNA, 140 bp, Artificial Sequence
  Synthetic
atacgccatgctgggtctccacaacagggatagggttagaaatgaaaaactgctctttcaatatcaccacaagcataaatactaaggtaaaagactatgcacttttttataaacctgatacgtacttgggagtcggccat

SEQ ID NO: 402734 - DNA, 140 bp, Artificial Sequence
  Synthetic
atggccgactcccaagtacgtatcaggtttataaaaaagtgcatagtcttttaccttagtatttatgcttgtggtgatattgaaagagcagtttttcatttctaaccctatccctgttgtggagacccagcatggcgtat

SEQ ID NO: 402735 - DNA, 140 bp, Artificial Sequence
  Synthetic
aggccctggctgctgatatgattgtctagtttgctttcagacaaaaggcttaggcatttcctatggcaggaagaagcggagacagcgacgaagcgctcctccaagcagtgaggatcatcagaccttttgggacagcggtg

SEQ ID NO: 402736 - DNA, 140 bp, Artificial Sequence
  Synthetic
caccgctgtcccaaaaggtctgatgatcctcactgcttggaggagcgcttcgtcgctgtctccgcttcttcctgccataggaaatgcctaagccttttgtctgaaagcaaactagacaatcatatcagcagccagggcct

SEQ ID NO: 402737 - DNA, 140 bp, Artificial Sequence
  Synthetic
aggccctggctgctgatatgataataattagatctgaaaatctgacagacaatgctaaaacaataatagtacagcttaatcaatccatagacattgtgtgcacaagacccaacaataatagaccttttgggacagcggtg

SEQ ID NO: 402738 - DNA, 140 bp, Artificial Sequence
  Synthetic
caccgctgtcccaaaaggtctattattgttgggtcttgtgcacacaatgtctatggattgattaagctgtactattattgttttagcattgtctgtcagattttcagatctaattattatcatatcagcagccagggcct

SEQ ID NO: 402739 - DNA, 140 bp, Artificial Sequence
  Synthetic
atacgccatgctgggtctccctaatataactacaatagaatttaagccaccctcaggaggggacctagaaattacaatgcatagtttcaattgtagaggagaatttttctattgcaataccgtacttgggagtcggccat

SEQ ID NO: 402740 - DNA, 140 bp, Artificial Sequence
  Synthetic
atggccgactcccaagtacggtattgcaatagaaaaattctcctctacaattgaaactatgcattgtaatttctaggtcccctcctgagggtggcttaaattctattgtagttatattagggagacccagcatggcgtat

SEQ ID NO: 402741 - DNA, 140 bp, Artificial Sequence
  Synthetic
atacgccatgctgggtctccactaatgtgccctggaatgatagttggagtaataaaacttttgaagaaatttggaataacatgacctggatagaatgggaaagagaaattaacaattacacgtacttgggagtcggccat

SEQ ID NO: 402742 - DNA, 140 bp, Artificial Sequence
  Synthetic
atggccgactcccaagtacgtgtaattgttaatttctctttcccattctatccaggtcatgttattccaaatttcttcaaaagttttattactccaactatcattccagggcacattagtggagacccagcatggcgtat

SEQ ID NO: 402743 - DNA, 140 bp, Artificial Sequence
  Synthetic
aggccctggctgctgatatgggaaatatgaaggacaattggagaagtgaattatataaatataaagtggtagaaattaagccattaggaatagcacccactgaagcaaaaaggagagtgggaccttttgggacagcggtg

SEQ ID NO: 402744 - DNA, 140 bp, Artificial Sequence
  Synthetic
caccgctgtcccaaaaggtcccactctcctttttgcttcagtgggtgctattcctaatggcttaatttctaccactttatatttatataattcacttctccaattgtccttcatatttcccatatcagcagccagggcct

SEQ ID NO: 402745 - DNA, 140 bp, Artificial Sequence
  Synthetic
atacgccatgctgggtctcccacagagataaaagataagaaacgtaaagtgcaggcacttttttataaacttgatatagtaccacttaactctacggggagtaataccagctctatggggcgtacttgggagtcggccat

SEQ ID NO: 402746 - DNA, 140 bp, Artificial Sequence
  Synthetic
atggccgactcccaagtacgccccatagagctggtattactccccgtagagttaagtggtactatatcaagtttataaaaaagtgcctgcactttacgtttcttatcttttatctctgtgggagacccagcatggcgtat

SEQ ID NO: 402747 - DNA, 140 bp, Artificial Sequence
  Synthetic
atacgccatgctgggtctccagctgactggacagatagagttatagaagtaggacaaagagtttttagagcttttcttaatatacctagaagaataagacaaggattagaaatagctttgcgtacttgggagtcggccat

SEQ ID NO: 402748 - DNA, 140 bp, Artificial Sequence
  Synthetic
atggccgactcccaagtacgcaaagctatttctaatccttgtcttattcttctaggtatattaagaaaagctctaaaaactctttgtcctacttctataactctatctgtccagtcagctggagacccagcatggcgtat

SEQ ID NO: 402749 - DNA, 140 bp, Artificial Sequence
  Synthetic
aggccctggctgctgatatgcttttcttaatatacctagaagaataagacaaggattagaaatagctttgctataaaatgggaggcaagtggtcaaaaagtagcatagtaggttggcctggaccttttgggacagcggtg

SEQ ID NO: 402750 - DNA, 140 bp, Artificial Sequence
  Synthetic
caccgctgtcccaaaaggtccaggccaacctactatgctactttttgaccacttgcctcccattttatagcaaagctatttctaatccttgtcttattcttctaggtatattaagaaaagcatatcagcagccagggcct

SEQ ID NO: 402751 - DNA, 140 bp, Artificial Sequence
  Synthetic
aggccctggctgctgatatgtgggataacatgacctggatgcagtgggataaagaaattagtaattacacaaacatcatataccagttgcttgaagaatcgcacatccagcaggaacaaagaccttttgggacagcggtg

SEQ ID NO: 402752 - DNA, 140 bp, Artificial Sequence
  Synthetic
caccgctgtcccaaaaggtctttgttcctgctggatgtgcgattcttcaagcaactggtatatgatgtttgtgtaattactaatttctttatcccactgcatccaggtcatgttatcccacatatcagcagccagggcct

SEQ ID NO: 402753 - DNA, 140 bp, Artificial Sequence
  Synthetic
atacgccatgctgggtctcccttcaataaaacaataaaattcgaacaatcctcaggaggggacctagaaattaccatgcatagctttaattgtagaggggaatttttctattgcaatacacgtacttgggagtcggccat

SEQ ID NO: 402754 - DNA, 140 bp, Artificial Sequence
  Synthetic
atggccgactcccaagtacgtgtattgcaatagaaaaattcccctctacaattaaagctatgcatggtaatttctaggtcccctcctgaggattgttcgaattttattgttttattgaagggagacccagcatggcgtat

SEQ ID NO: 402755 - DNA, 140 bp, Artificial Sequence
  Synthetic
aggccctggctgctgatatgtccatatacctacaagaatcagacagggactcgaaagggctttgctataatgggtggcaagtggtcaaaatgtggtatgggtggatggcctagtgtaagggaccttttgggacagcggtg

SEQ ID NO: 402756 - DNA, 140 bp, Artificial Sequence
  Synthetic
caccgctgtcccaaaaggtcccttacactaggccatccacccataccacattttgaccacttgccacccattatagcaaagccctttcgagtccctgtctgattcttgtaggtatatggacatatcagcagccagggcct

SEQ ID NO: 402757 - DNA, 140 bp, Artificial Sequence
  Synthetic
atacgccatgctgggtctccgtggcgcccgaacagggacttgaaagcgaaagtaaaagggactcgaaagcggaagttccagagaaggttctctcgacgcaggactcggcttgctgagtgccgtacttgggagtcggccat

SEQ ID NO: 402758 - DNA, 140 bp, Artificial Sequence
  Synthetic
atggccgactcccaagtacggcactcagcaagccgagtcctgcgtcgagagaaccttctctggaacttccgctttcgagtcccttttactttcgctttcaagtccctgttcgggcgccacggagacccagcatggcgtat

SEQ ID NO: 402759 - DNA, 140 bp, Artificial Sequence
  Synthetic
aggccctggctgctgatatgaagactgcacagaaagacaggctaattttttagggaaaatctggccttccaacaaggggaggccagggaactttcttcagaacaggccagagccaacagcgaccttttgggacagcggtg

SEQ ID NO: 402760 - DNA, 140 bp, Artificial Sequence
  Synthetic
caccgctgtcccaaaaggtcgctgttggctctggcctgttctgaagaaagttccctggcctccccttgttggaaggccagattttccctaaaaaattagcctgtctttctgtgcagtcttcatatcagcagccagggcct

SEQ ID NO: 402761 - DNA, 140 bp, Artificial Sequence
  Synthetic
aggccctggctgctgatatggtcgaaggacagggaacccttaacttccctcaaatcactctttggcagcgaccccttgtctcaataaaggtagggggccaaataaaggaggctctattaggaccttttgggacagcggtg

SEQ ID NO: 402762 - DNA, 140 bp, Artificial Sequence
  Synthetic
caccgctgtcccaaaaggtcctaatagagcctcctttatttggccccctacctttattgagacaaggggtcgctgccaaagagtgatttgagggaagttaagggttccctgtccttcgaccatatcagcagccagggcct

SEQ ID NO: 402763 - DNA, 140 bp, Artificial Sequence
  Synthetic
atacgccatgctgggtctcccaatggtactagtaccaataatagtagcatgggaacaatggagggaggagaagtaaaaaactgctctttcaatatcaccacagacagagaagataggatgcgtacttgggagtcggccat

SEQ ID NO: 402764 - DNA, 140 bp, Artificial Sequence
  Synthetic
atggccgactcccaagtacgcatcctatcttctctgtctgtggtgatattgaaagagcagttttttacttctcctccctccattgttcccatgctactattattggtactagtaccattgggagacccagcatggcgtat

SEQ ID NO: 402765 - DNA, 140 bp, Artificial Sequence
  Synthetic
aggccctggctgctgatatgggaaaatttggccttcccagaacaaggggaggccagggaatttccttcagaacaggccagagccatcagccccaccagcagaaagcttcaggttcgaggagaccttttgggacagcggtg

SEQ ID NO: 402766 - DNA, 140 bp, Artificial Sequence
  Synthetic
caccgctgtcccaaaaggtctcctcgaacctgaagctttctgctggtggggctgatggctctggcctgttctgaaggaaattccctggcctccccttgttctgggaaggccaaattttcccatatcagcagccagggcct

SEQ ID NO: 402767 - DNA, 140 bp, Artificial Sequence
  Synthetic
atacgccatgctgggtctcccctgaaggaagagctaggggaaataaaaaactgttctttcaagatgaccacagaagtaagagataagcagaaggaagtacaggcacttttttataaatctcgtacttgggagtcggccat

SEQ ID NO: 402768 - DNA, 140 bp, Artificial Sequence
  Synthetic
atggccgactcccaagtacgagatttataaaaaagtgcctgtacttccttctgcttatctcttacttctgtggtcatcttgaaagaacagttttttatttcccctagctcttccttcaggggagacccagcatggcgtat

SEQ ID NO: 402769 - DNA, 140 bp, Artificial Sequence
  Synthetic
atacgccatgctgggtctccccaggaaaagtataaatataggaccagggagagcatggtataccacaggacaaataataggagatataagacaagcacattgtaaccttagtaaaacagacgtacttgggagtcggccat

SEQ ID NO: 402770 - DNA, 140 bp, Artificial Sequence
  Synthetic
atggccgactcccaagtacgtctgttttactaaggttacaatgtgcttgtcttatatctcctattatttgtcctgtggtataccatgctctccctggtcctatatttatacttttcctggggagacccagcatggcgtat

SEQ ID NO: 402771 - DNA, 140 bp, Artificial Sequence
  Synthetic
aggccctggctgctgatatgggaataaaacaataaactttactcaatcctcaggaggggacccagaaattgtaacacacagttttaattgtggaggggaatttttctactgtaacacaacgaccttttgggacagcggtg

SEQ ID NO: 402772 - DNA, 140 bp, Artificial Sequence
  Synthetic
caccgctgtcccaaaaggtcgttgtgttacagtagaaaaattcccctccacaattaaaactgtgtgttacaatttctgggtcccctcctgaggattgagtaaagtttattgttttattcccatatcagcagccagggcct

SEQ ID NO: 402773 - DNA, 140 bp, Artificial Sequence
  Synthetic
aggccctggctgctgatatgaatcactcctcaggaggggacccagagattgtaatgcacagttttaattgtggaggggaatttttctactgtaatacatcacgactgtttaatagtacttgaccttttgggacagcggtg

SEQ ID NO: 402774 - DNA, 140 bp, Artificial Sequence
  Synthetic
caccgctgtcccaaaaggtcaagtactattaaacagtcgtgatgtattacagtagaaaaattcccctccacaattaaaactgtgcattacaatctctgggtcccctcctgaggagtgattcatatcagcagccagggcct

SEQ ID NO: 402775 - DNA, 140 bp, Artificial Sequence
  Synthetic
aggccctggctgctgatatgtctttgcaacaggtgacataataggagatataagacaagctcattgtaatattagtggaataaaatggggagaagtggtacgcaatgtgagtgcaaaactgaccttttgggacagcggtg

SEQ ID NO: 402776 - DNA, 140 bp, Artificial Sequence
  Synthetic
caccgctgtcccaaaaggtcagttttgcactcacattgcgtaccacttctccccattttattccactaatattacaatgagcttgtcttatatctcctattatgtcacctgttgcaaagacatatcagcagccagggcct

SEQ ID NO: 402777 - DNA, 140 bp, Artificial Sequence
  Synthetic
aggccctggctgctgatatgaacccccagaagatcaggggccgcagagggaaccatacaatgaatggacactagagattctagaggaactcaagcaggaagctgtcagacactttcctaggaccttttgggacagcggtg

SEQ ID NO: 402778 - DNA, 140 bp, Artificial Sequence
  Synthetic
caccgctgtcccaaaaggtcctaggaaagtgtctgacagcttcctgcttgagttcctctagaatctctagtgtccattcattgtatggttccctctgcggcccctgatcttctgggggttcatatcagcagccagggcct

SEQ ID NO: 402779 - DNA, 140 bp, Artificial Sequence
  Synthetic
aggccctggctgctgatatgtattcttcacatacctacaagaataagacagggcttggaaaggcttttgctataagatgggtggcaaatggtcaaaaagtagtataattggatggcctgcgaccttttgggacagcggtg

SEQ ID NO: 402780 - DNA, 140 bp, Artificial Sequence
  Synthetic
caccgctgtcccaaaaggtcgcaggccatccaattatactactttttgaccatttgccacccatcttatagcaaaagcctttccaagccctgtcttattcttgtaggtatgtgaagaatacatatcagcagccagggcct

SEQ ID NO: 402781 - DNA, 140 bp, Artificial Sequence
  Synthetic
aggccctggctgctgatatggtccaattaggaataccacaccctgcaggactagcaaaaaggaaaagaattacagtactggatataggtgatgcatatttctccatacctctagatgaaggaccttttgggacagcggtg

SEQ ID NO: 402782 - DNA, 140 bp, Artificial Sequence
  Synthetic
caccgctgtcccaaaaggtccttcatctagaggtatggagaaatatgcatcacctatatccagtactgtaattcttttcctttttgctagtcctgcagggtgtggtattcctaattggaccatatcagcagccagggcct

SEQ ID NO: 402783 - DNA, 140 bp, Artificial Sequence
  Synthetic
atacgccatgctgggtctccgccccgaacagggacctgaaagcgaaagagaaaccagagggctctcgacgcaggactcggcttgctgaagcgcgcacggcaagaggcgaggggcggcggccgtacttgggagtcggccat

SEQ ID NO: 402784 - DNA, 140 bp, Artificial Sequence
  Synthetic
atggccgactcccaagtacggccgccgcccctcgcctcttgccgtgcgcgcttcagcaagccgagtcctgcgtcgagagccctctggtttctctttcgctttcaggtccctgttcggggcggagacccagcatggcgtat

SEQ ID NO: 402785 - DNA, 140 bp, Artificial Sequence
  Synthetic
aggccctggctgctgatatgctcgacgcaggactcggcttgctgaagcgcgcacagcaagaggcgagagcggcgactggtgagtacgccaatttgactagcggaggctagaaggagagaggaccttttgggacagcggtg

SEQ ID NO: 402786 - DNA, 140 bp, Artificial Sequence
  Synthetic
caccgctgtcccaaaaggtcctctctccttctagcctccgctagtcaaattggcgtactcaccagtcgccgctctcgcctcttgctgtgcgcgcttcagcaagccgagtcctgcgtcgagcatatcagcagccagggcct

SEQ ID NO: 402787 - DNA, 140 bp, Artificial Sequence
  Synthetic
atacgccatgctgggtctcctaaaaagtgttgctatcattgccccatgtgcttcttaaacaagggcttaggcatttcctatggcaggaagaagcggagacaacgacgaacagctcctcctcgtacttgggagtcggccat

SEQ ID NO: 402788 - DNA, 140 bp, Artificial Sequence
  Synthetic
atggccgactcccaagtacgaggaggagctgttcgtcgttgtctccgcttcttcctgccataggaaatgcctaagcccttgtttaagaagcacatggggcaatgatagcaacactttttaggagacccagcatggcgtat

SEQ ID NO: 402789 - DNA, 140 bp, Artificial Sequence
  Synthetic
atacgccatgctgggtctcctttaaattgtgaaaatgcaagggttaagcctgactacaatgatagcacgaatggagaagtacaaaattgcactttcaatgcaaccacagaactaaaagatcgtacttgggagtcggccat

SEQ ID NO: 402790 - DNA, 140 bp, Artificial Sequence
  Synthetic
atggccgactcccaagtacgatcttttagttctgtggttgcattgaaagtgcaattttgtacttctccattcgtgctatcattgtagtcaggcttaacccttgcattttcacaatttaaaggagacccagcatggcgtat

SEQ ID NO: 402791 - DNA, 140 bp, Artificial Sequence
  Synthetic
atacgccatgctgggtctccgaggggataataattaggtctgaaaatctgacagacaatggtaaaataataatagtgcaccttaatgagtctgtagaaattgtgtgtacaagacccaatacgtacttgggagtcggccat

SEQ ID NO: 402792 - DNA, 140 bp, Artificial Sequence
  Synthetic
atggccgactcccaagtacgtattgggtcttgtacacacaatttctacagactcattaaggtgcactattattattttaccattgtctgtcagattttcagacctaattattatcccctcggagacccagcatggcgtat

SEQ ID NO: 402793 - DNA, 140 bp, Artificial Sequence
  Synthetic
atacgccatgctgggtctcctataatgacataataggaaatataagagaagcatattgtatcattaatgaaacaagatggaatttaactttagaaagggtaagggagaaattaaaagaaccgtacttgggagtcggccat

SEQ ID NO: 402794 - DNA, 140 bp, Artificial Sequence
  Synthetic
atggccgactcccaagtacggttcttttaatttctcccttaccctttctaaagttaaattccatcttgtttcattaatgatacaatatgcttctcttatatttcctattatgtcattataggagacccagcatggcgtat

SEQ ID NO: 402795 - DNA, 140 bp, Artificial Sequence
  Synthetic
atacgccatgctgggtctccgcttctctgataaaataataaagtttgaaatgcccgcaggaggggacctagaagttacaacacatagttttaattgtagaggagaatttttctattgcaacgtacttgggagtcggccat

SEQ ID NO: 402796 - DNA, 140 bp, Artificial Sequence
  Synthetic
atggccgactcccaagtacgttgcaatagaaaaattctcctctacaattaaaactatgtgttgtaacttctaggtcccctcctgcgggcatttcaaactttattattttatcagagaagcggagacccagcatggcgtat

SEQ ID NO: 402797 - DNA, 140 bp, Artificial Sequence
  Synthetic
aggccctggctgctgatatgtatacactttggaccagggcaagcgctttttgcaacaggtgaaataataggagatataagacaagctcattgtaacattagtagaaaaaattggaatgaggaccttttgggacagcggtg

SEQ ID NO: 402798 - DNA, 140 bp, Artificial Sequence
  Synthetic
caccgctgtcccaaaaggtcctcattccaattttttctactaatgttacaatgagcttgtcttatatctcctattatttcacctgttgcaaaaagcgcttgccctggtccaaagtgtatacatatcagcagccagggcct

SEQ ID NO: 402799 - DNA, 140 bp, Artificial Sequence
  Synthetic
atacgccatgctgggtctccgggggaaataaaaaatgtaataaggaattgctctttcaatgtaaccacagaactaagagataagaagcacaaagagtattcacttttttatagacttgatcgtacttgggagtcggccat

SEQ ID NO: 402800 - DNA, 140 bp, Artificial Sequence
  Synthetic
atggccgactcccaagtacgatcaagtctataaaaaagtgaatactctttgtgcttcttatctcttagttctgtggttacattgaaagagcaattccttattacattttttatttcccccggagacccagcatggcgtat

SEQ ID NO: 402801 - DNA, 140 bp, Artificial Sequence
  Synthetic
atacgccatgctgggtctccatacagaaatgaaaaattgctctttcaatataaccacagaaatgaaagataaacagaagaaagaatacgcgcttttctatagagttgatatagtaccactcgtacttgggagtcggccat

SEQ ID NO: 402802 - DNA, 140 bp, Artificial Sequence
  Synthetic
atggccgactcccaagtacgagtggtactatatcaactctatagaaaagcgcgtattctttcttctgtttatctttcatttctgtggttatattgaaagagcaatttttcatttctgtatggagacccagcatggcgtat

SEQ ID NO: 402803 - DNA, 140 bp, Artificial Sequence
  Synthetic
aggccctggctgctgatatggaacaataagttttatgccatcctcaggaggggacctagaaattacaacacatagctttaattgtcaaggagaatttttctattgcaatacatcacaactgaccttttgggacagcggtg

SEQ ID NO: 402804 - DNA, 140 bp, Artificial Sequence
  Synthetic
caccgctgtcccaaaaggtcagttgtgatgtattgcaatagaaaaattctccttgacaattaaagctatgtgttgtaatttctaggtcccctcctgaggatggcataaaacttattgttccatatcagcagccagggcct

SEQ ID NO: 402805 - DNA, 140 bp, Artificial Sequence
  Synthetic
aggccctggctgctgatatgtggcaggaagaagcggagacagcgacgaagagctcctcaagacagtcagattcatcaagtttctctatcaaagcagtaagtagtacatgtaatgcaacctgaccttttgggacagcggtg

SEQ ID NO: 402806 - DNA, 140 bp, Artificial Sequence
  Synthetic
caccgctgtcccaaaaggtcaggttgcattacatgtactacttactgctttgatagagaaacttgatgaatctgactgtcttgaggagctcttcgtcgctgtctccgcttcttcctgccacatatcagcagccagggcct

SEQ ID NO: 402807 - DNA, 140 bp, Artificial Sequence
  Synthetic
aggccctggctgctgatatgcacaataatgctgattgtgcctggctgcaagcacaagaagaggaaggaggagtaggctttccagtcagacctcaggtgcctttaagaccaatgacttatagaccttttgggacagcggtg

SEQ ID NO: 402808 - DNA, 140 bp, Artificial Sequence
  Synthetic
caccgctgtcccaaaaggtctataagtcattggtcttaaaggcacctgaggtctgactggaaagcctactcctccttcctcttcttgtgcttgcagccaggcacaatcagcattattgtgcatatcagcagccagggcct

SEQ ID NO: 402809 - DNA, 140 bp, Artificial Sequence
  Synthetic
atacgccatgctgggtctccaacatgacctggatgcagtgggataaagaaattagtaattacacaacaacaatataccagctgcttgaaaaatcgcaaagccagcaggaacaaaatgaaacgtacttgggagtcggccat

SEQ ID NO: 402810 - DNA, 140 bp, Artificial Sequence
  Synthetic
atggccgactcccaagtacgtttcattttgttcctgctggctttgcgatttttcaagcagctggtatattgttgttgtgtaattactaatttctttatcccactgcatccaggtcatgttggagacccagcatggcgtat

SEQ ID NO: 402811 - DNA, 140 bp, Artificial Sequence
  Synthetic
aggccctggctgctgatatgaaagatacctaaaggatcaacagctcctagggatttggggctgctctggaaaactcatctgcaccactactgtgccttggaactccagttggagtaataagaccttttgggacagcggtg

SEQ ID NO: 402812 - DNA, 140 bp, Artificial Sequence
  Synthetic
caccgctgtcccaaaaggtcttattactccaactggagttccaaggcacagtagtggtgcagatgagttttccagagcagccccaaatccctaggagctgttgatcctttaggtatctttcatatcagcagccagggcct

SEQ ID NO: 402813 - DNA, 140 bp, Artificial Sequence
  Synthetic
aggccctggctgctgatatgagcccttaagtatctaggaagtcttgtgcagtattggggtctggaattaaaaaagagtgctattagtctgcttgataccatagcaatagcagtagctgaggaccttttgggacagcggtg

SEQ ID NO: 402814 - DNA, 140 bp, Artificial Sequence
  Synthetic
caccgctgtcccaaaaggtcctcagctactgctattgctatggtatcaagcagactaatagcactcttttttaattccagaccccaatactgcacaagacttcctagatacttaagggctcatatcagcagccagggcct

SEQ ID NO: 402815 - DNA, 140 bp, Artificial Sequence
  Synthetic
aggccctggctgctgatatggttggtgataatttgtagtgcctcaaataacttgtgggtcacagtctattatggggtacctgtgtgggaagatgcatatacccctctattttgtgcatctgaccttttgggacagcggtg

SEQ ID NO: 402816 - DNA, 140 bp, Artificial Sequence
  Synthetic
caccgctgtcccaaaaggtcagatgcacaaaatagaggggtatatgcatcttcccacacaggtaccccataatagactgtgacccacaagttatttgaggcactacaaattatcaccaaccatatcagcagccagggcct

SEQ ID NO: 402817 - DNA, 140 bp, Artificial Sequence
  Synthetic
atacgccatgctgggtctccagaaagactaaggaaaactgagccagcagcagagggagtaggagccgtgtctcaagacttagctagacatggagcaattacaagtagcaacacagccgcccgtacttgggagtcggccat

SEQ ID NO: 402818 - DNA, 140 bp, Artificial Sequence
  Synthetic
atggccgactcccaagtacgggcggctgtgttgctacttgtaattgctccatgtctagctaagtcttgagacacggctcctactccctctgctgctggctcagttttccttagtctttctggagacccagcatggcgtat

SEQ ID NO: 402819 - DNA, 140 bp, Artificial Sequence
  Synthetic
atacgccatgctgggtctccggttgttggaaatgtgggaaggaaggacatcaaatgaaagactgcactaatgagagacaggctaattttttagggaaaatttggccttccaacaagggaacgtacttgggagtcggccat

SEQ ID NO: 402820 - DNA, 140 bp, Artificial Sequence
  Synthetic
atggccgactcccaagtacgttcccttgttggaaggccaaattttccctaaaaaattagcctgtctctcattagtgcagtctttcatttgatgtccttccttcccacatttccaacaaccggagacccagcatggcgtat

SEQ ID NO: 402821 - DNA, 140 bp, Artificial Sequence
  Synthetic
aggccctggctgctgatatgcagtattggagtcaggaactaaagaatagtgctattagcttgcttaataccacagcaatagtagtagctgaggggacagatagaattatagaagctttgcgaccttttgggacagcggtg

SEQ ID NO: 402822 - DNA, 140 bp, Artificial Sequence
  Synthetic
caccgctgtcccaaaaggtcgcaaagcttctataattctatctgtcccctcagctactactattgctgtggtattaagcaagctaatagcactattctttagttcctgactccaatactgcatatcagcagccagggcct

SEQ ID NO: 402823 - DNA, 140 bp, Artificial Sequence
  Synthetic
aggccctggctgctgatatgtggcatttgggccagggagtctccatagaatggaggaaaaagagatatagcacacaagtagaccctggcctagcagaccaactaattcatctgtattattgaccttttgggacagcggtg

SEQ ID NO: 402824 - DNA, 140 bp, Artificial Sequence
  Synthetic
caccgctgtcccaaaaggtcaataatacagatgaattagttggtctgctaggccagggtctacttgtgtgctatatctctttttcctccattctatggagactccctggcccaaatgccacatatcagcagccagggcct

SEQ ID NO: 402825 - DNA, 140 bp, Artificial Sequence
  Synthetic
atacgccatgctgggtctccgggaagttcaattaggaatcccacatcctgctgggttgaagaagaaaaaatcagtaacaatattggatgtgggggatgcatatttttcagtccctttagacgtacttgggagtcggccat

SEQ ID NO: 402826 - DNA, 140 bp, Artificial Sequence
  Synthetic
atggccgactcccaagtacgtctaaagggactgaaaaatatgcatcccccacatccaatattgttactgattttttcttcttcaacccagcaggatgtgggattcctaattgaacttcccggagacccagcatggcgtat

SEQ ID NO: 402827 - DNA, 140 bp, Artificial Sequence
  Synthetic
aggccctggctgctgatatgaaaatatgcacttttttataaacttgatatagtaccaatagaaggaaagaataccaataccagctataggttgataaattgtaacacctcagtcattacagaccttttgggacagcggtg

SEQ ID NO: 402828 - DNA, 140 bp, Artificial Sequence
  Synthetic
caccgctgtcccaaaaggtctgtaatgactgaggtgttacaatttatcaacctatagctggtattggtattctttccttctattggtactatatcaagtttataaaaaagtgcatattttcatatcagcagccagggcct

SEQ ID NO: 402829 - DNA, 140 bp, Artificial Sequence
  Synthetic
atacgccatgctgggtctcccataataatcagatctgaaaatttcacaaacaatggtaaaaacataatagtacagctgaaggaacctgtaaaaatcaattgtacaagacccggcaacaatcgtacttgggagtcggccat

SEQ ID NO: 402830 - DNA, 140 bp, Artificial Sequence
  Synthetic
atggccgactcccaagtacgattgttgccgggtcttgtacaattgatttttacaggttccttcagctgtactattatgtttttaccattgtttgtgaaattttcagatctgattattatgggagacccagcatggcgtat

SEQ ID NO: 402831 - DNA, 140 bp, Artificial Sequence
  Synthetic
aggccctggctgctgatatgatctaggaccagggaaagcatggtatacaacaggacaaataataggagatataagacaagcacattgtaaccttagtagcacaaaatggaataacactttgaccttttgggacagcggtg

SEQ ID NO: 402832 - DNA, 140 bp, Artificial Sequence
  Synthetic
caccgctgtcccaaaaggtcaaagtgttattccattttgtgctactaaggttacaatgtgcttgtcttatatctcctattatttgtcctgttgtataccatgctttccctggtcctagatcatatcagcagccagggcct

SEQ ID NO: 402833 - DNA, 140 bp, Artificial Sequence
  Synthetic
aggccctggctgctgatatgataagacaagcacattgtaaccttagtagcacaaaatggaataacactttaaaacagataactaaaaaattaagagaacaatttgggaacaaaacaataggaccttttgggacagcggtg

SEQ ID NO: 402834 - DNA, 140 bp, Artificial Sequence
  Synthetic
caccgctgtcccaaaaggtcctattgttttgttcccaaattgttctcttaattttttagttatctgttttaaagtgttattccattttgtgctactaaggttacaatgtgcttgtcttatcatatcagcagccagggcct

SEQ ID NO: 402835 - DNA, 140 bp, Artificial Sequence
  Synthetic
aggccctggctgctgatatgattcaggatcagaagtaaacatagtaacagactcacagtatgcattaggaatcattcaagcacaaccagataaaagtgaatcagaattagtcaatcaaatgaccttttgggacagcggtg

SEQ ID NO: 402836 - DNA, 140 bp, Artificial Sequence
  Synthetic
caccgctgtcccaaaaggtcatttgattgactaattctgattcacttttatctggttgtgcttgaatgattcctaatgcatactgtgagtctgttactatgtttacttctgatcctgaatcatatcagcagccagggcct

SEQ ID NO: 402837 - DNA, 140 bp, Artificial Sequence
  Synthetic
aggccctggctgctgatatgactcaccattgtcattacagacccgcttcccagcccagaggggacccggcaggcccgaaggaatcgaagaagaaggtggagagcgagacagagacagatcgaccttttgggacagcggtg

SEQ ID NO: 402838 - DNA, 140 bp, Artificial Sequence
  Synthetic
caccgctgtcccaaaaggtcgatctgtctctgtctcgctctccaccttcttcttcgattccttcgggcctgccgggtcccctctgggctgggaagcgggtctgtaatgacaatggtgagtcatatcagcagccagggcct

SEQ ID NO: 402839 - DNA, 140 bp, Artificial Sequence
  Synthetic
aggccctggctgctgatatgcaatagcaatagcagtaggtaactggacagatagggttatagaagtaggacaaagagctgttagagctgtgcttaacatacctagaagaataagacaagggaccttttgggacagcggtg

SEQ ID NO: 402840 - DNA, 140 bp, Artificial Sequence
  Synthetic
caccgctgtcccaaaaggtcccttgtcttattcttctaggtatgttaagcacagctctaacagctctttgtcctacttctataaccctatctgtccagttacctactgctattgctattgcatatcagcagccagggcct

SEQ ID NO: 402841 - DNA, 140 bp, Artificial Sequence
  Synthetic
atacgccatgctgggtctccaaagaatgagaagagctgagcctgagccagcagcagttggggtgggagcagtatctcgagacctagaaagacatggagcagtcacaagtagcaatacagccgtacttgggagtcggccat

SEQ ID NO: 402842 - DNA, 140 bp, Artificial Sequence
  Synthetic
atggccgactcccaagtacggctgtattgctacttgtgactgctccatgtctttctaggtctcgagatactgctcccaccccaactgctgctggctcaggctcagctcttctcattctttggagacccagcatggcgtat

SEQ ID NO: 402843 - DNA, 140 bp, Artificial Sequence
  Synthetic
aggccctggctgctgatatgaaaaacatggagcaatcacaagtagcaatacagcagctactaatgctgcttgtgcctggctagaagcacaagaggaggaggaggtgggttttccagtcaggaccttttgggacagcggtg

SEQ ID NO: 402844 - DNA, 140 bp, Artificial Sequence
  Synthetic
caccgctgtcccaaaaggtcctgactggaaaacccacctcctcctcctcttgtgcttctagccaggcacaagcagcattagtagctgctgtattgctacttgtgattgctccatgtttttcatatcagcagccagggcct

SEQ ID NO: 402845 - DNA, 140 bp, Artificial Sequence
  Synthetic
aggccctggctgctgatatggaggaggtgggttttccagtcagacctcaggtacctttaagaccaatgacttacaagggagctctagatcttagccactttttaagagaaaaggggggacgaccttttgggacagcggtg

SEQ ID NO: 402846 - DNA, 140 bp, Artificial Sequence
  Synthetic
caccgctgtcccaaaaggtcgtccccccttttctcttaaaaagtggctaagatctagagctcccttgtaagtcattggtcttaaaggtacctgaggtctgactggaaaacccacctcctccatatcagcagccagggcct

SEQ ID NO: 402847 - DNA, 140 bp, Artificial Sequence
  Synthetic
aggccctggctgctgatatgaaattagcagaacacttccctaataaaacaataagctttgcaaatccctcaggaggggacctagaagttacaacacatagttttaattgtagaggagaatgaccttttgggacagcggtg

SEQ ID NO: 402848 - DNA, 140 bp, Artificial Sequence
  Synthetic
caccgctgtcccaaaaggtcattctcctctacaattaaaactatgtgttgtaacttctaggtcccctcctgagggatttgcaaagcttattgttttattagggaagtgttctgctaatttcatatcagcagccagggcct

SEQ ID NO: 402849 - DNA, 140 bp, Artificial Sequence
  Synthetic
atacgccatgctgggtctccctggggggatggactcaggtaagggaaagaatgagaagaaccccagtaacagaaagagcaacagaaagagcagcagagggagtaggagcagtgtctcaagcgtacttgggagtcggccat

SEQ ID NO: 402850 - DNA, 140 bp, Artificial Sequence
  Synthetic
atggccgactcccaagtacgcttgagacactgctcctactccctctgctgctctttctgttgctctttctgttactggggttcttctcattctttcccttacctgagtccatccccccagggagacccagcatggcgtat

SEQ ID NO: 402851 - DNA, 140 bp, Artificial Sequence
  Synthetic
atacgccatgctgggtctcctcaagtacctgggaagtcttgcacagtattggagccaggaaataaagaagagtgccattagtttgcttaatgccacagcaatagtggtagctgagggaaccgtacttgggagtcggccat

SEQ ID NO: 402852 - DNA, 140 bp, Artificial Sequence
  Synthetic
atggccgactcccaagtacggttccctcagctaccactattgctgtggcattaagcaaactaatggcactcttctttatttcctggctccaatactgtgcaagacttcccaggtacttgaggagacccagcatggcgtat

SEQ ID NO: 402853 - DNA, 140 bp, Artificial Sequence
  Synthetic
atacgccatgctgggtctccataaaataaaaaattgttctttcaatgcaaccacagaaataaaagataagaagcgcaaacagtctgcacttttttatagacttgatatagtaccacttaacgtacttgggagtcggccat

SEQ ID NO: 402854 - DNA, 140 bp, Artificial Sequence
  Synthetic
atggccgactcccaagtacgttaagtggtactatatcaagtctataaaaaagtgcagactgtttgcgcttcttatcttttatttctgtggttgcattgaaagaacaattttttattttatggagacccagcatggcgtat

SEQ ID NO: 402855 - DNA, 140 bp, Artificial Sequence
  Synthetic
aggccctggctgctgatatgtaaattgtaatacctcaaccgtaacacaagcctgtccaaaggtctcttttgacccaattcccatacattattgtgctccagctggttatgcgattctaaagaccttttgggacagcggtg

SEQ ID NO: 402856 - DNA, 140 bp, Artificial Sequence
  Synthetic
caccgctgtcccaaaaggtctttagaatcgcataaccagctggagcacaataatgtatgggaattgggtcaaaagagacctttggacaggcttgtgttacggttgaggtattacaatttacatatcagcagccagggcct

SEQ ID NO: 402857 - DNA, 140 bp, Artificial Sequence
  Synthetic
atacgccatgctgggtctcctaaacatgtggcagggagtgggacaagcaatgtatgctcctaatgtatgctcctcccatcggggaataattaattgtgtatcaaacattacaggaatactcgtacttgggagtcggccat

SEQ ID NO: 402858 - DNA, 140 bp, Artificial Sequence
  Synthetic
atggccgactcccaagtacgagtattcctgtaatgtttgatacacaattaattattccccgatgggaggagcatacattaggagcatacattgcttgtcccactccctgccacatgtttaggagacccagcatggcgtat

SEQ ID NO: 402859 - DNA, 140 bp, Artificial Sequence
  Synthetic
atacgccatgctgggtctccattacatgtaccagacccaataataatacaagaaaaggtatacactttggaccagggcaagtgttttttgcaacaggtgacataataggagatataagaccgtacttgggagtcggccat

SEQ ID NO: 402860 - DNA, 140 bp, Artificial Sequence
  Synthetic
atggccgactcccaagtacggtcttatatctcctattatgtcacctgttgcaaaaaacacttgccctggtccaaagtgtataccttttcttgtattattattgggtctggtacatgtaatggagacccagcatggcgtat

SEQ ID NO: 402861 - DNA, 140 bp, Artificial Sequence
  Synthetic
aggccctggctgctgatatgttgtagagctatccgcaacatacctacaagaataagacagggctttgaagcagctttgctataaaatggggggcaagtggtcaaaaagtagcatagttgggaccttttgggacagcggtg

SEQ ID NO: 402862 - DNA, 140 bp, Artificial Sequence
  Synthetic
caccgctgtcccaaaaggtcccaactatgctactttttgaccacttgccccccattttatagcaaagctgcttcaaagccctgtcttattcttgtaggtatgttgcggatagctctacaacatatcagcagccagggcct

SEQ ID NO: 402863 - DNA, 140 bp, Artificial Sequence
  Synthetic
atacgccatgctgggtctccaatatgaccacagaaataagagataagaaaaagcaagtgtatgcacttttttatagacttgatgtagtaccacttaatggggaggagagcaactctagtgcgtacttgggagtcggccat

SEQ ID NO: 402864 - DNA, 140 bp, Artificial Sequence
  Synthetic
atggccgactcccaagtacgcactagagttgctctcctccccattaagtggtactacatcaagtctataaaaaagtgcatacacttgctttttcttatctcttatttctgtggtcatattggagacccagcatggcgtat

SEQ ID NO: 402865 - DNA, 140 bp, Artificial Sequence
  Synthetic
atacgccatgctgggtctccggataagacaaacccctgtagcagcaccaggagtaggagcagtctctcaagatttagctagacatggagcaatcaccagcagcaacacagcagctactaacgtacttgggagtcggccat

SEQ ID NO: 402866 - DNA, 140 bp, Artificial Sequence
  Synthetic
atggccgactcccaagtacgttagtagctgctgtgttgctgctggtgattgctccatgtctagctaaatcttgagagactgctcctactcctggtgctgctacaggggtttgtcttatccggagacccagcatggcgtat

SEQ ID NO: 402867 - DNA, 140 bp, Artificial Sequence
  Synthetic
aggccctggctgctgatatgcaagcctgtccaaaggtatcctttgaaccaattcccatacattattgtgccccggctggttttgcgattctaaagtgtaataataagacattcaatggaagaccttttgggacagcggtg

SEQ ID NO: 402868 - DNA, 140 bp, Artificial Sequence
  Synthetic
caccgctgtcccaaaaggtcttccattgaatgtcttattattacactttagaatcgcaaaaccagccggggcacaataatgtatgggaattggttcaaaggatacctttggacaggcttgcatatcagcagccagggcct

SEQ ID NO: 402869 - DNA, 140 bp, Artificial Sequence
  Synthetic
aggccctggctgctgatatgtaataggtttaagaatagtttttgctgtgctttctatagtcaatagagttaggcagggatactcacctgtgtcattgcagacccgtatcccaaacccaacgaccttttgggacagcggtg

SEQ ID NO: 402870 - DNA, 140 bp, Artificial Sequence
  Synthetic
caccgctgtcccaaaaggtcgttgggtttgggatacgggtctgcaatgacacaggtgagtatccctgcctaactctattgactatagaaagcacagcaaaaactattcttaaacctattacatatcagcagccagggcct

SEQ ID NO: 402871 - DNA, 140 bp, Artificial Sequence
  Synthetic
aggccctggctgctgatatgaggtggagagcaagacaaagacagatccattcgattagtgagcggattcttgccaattgtctgggacgatctacggagcctgtgcctcttcagctaccacgaccttttgggacagcggtg

SEQ ID NO: 402872 - DNA, 140 bp, Artificial Sequence
  Synthetic
caccgctgtcccaaaaggtcgtggtagctgaagaggcacaggctccgtagatcgtcccagacaattggcaagaatccgctcactaatcgaatggatctgtctttgtcttgctctccacctcatatcagcagccagggcct

SEQ ID NO: 402873 - DNA, 140 bp, Artificial Sequence
  Synthetic
atacgccatgctgggtctcctctcaagatttagctaggcatggagcaatcacaagcagccatacaccaactacaaatgctgcttgtgcctggctggaagcacaagaggatgaggaggtagcgtacttgggagtcggccat

SEQ ID NO: 402874 - DNA, 140 bp, Artificial Sequence
  Synthetic
atggccgactcccaagtacgctacctcctcatcctcttgtgcttccagccaggcacaagcagcatttgtagttggtgtatggctgcttgtgattgctccatgcctagctaaatcttgagaggagacccagcatggcgtat

SEQ ID NO: 402875 - DNA, 140 bp, Artificial Sequence
  Synthetic
aggccctggctgctgatatggaagaagtaggctttccagtccgacctcaggtgcctacaagaccaatgacttataaggcagcattcgatctcagcttctttttaaaagaaaaggggggacgaccttttgggacagcggtg

SEQ ID NO: 402876 - DNA, 140 bp, Artificial Sequence
  Synthetic
caccgctgtcccaaaaggtcgtccccccttttcttttaaaaagaagctgagatcgaatgctgccttataagtcattggtcttgtaggcacctgaggtcggactggaaagcctacttcttccatatcagcagccagggcct

SEQ ID NO: 402877 - DNA, 140 bp, Artificial Sequence
  Synthetic
aggccctggctgctgatatgaaattataggacaggtaagagatcaagctgaacatcttaagacagcagtacaaatggcagtattcatccacaattttaaaagaaaaggggggattggggggaccttttgggacagcggtg

SEQ ID NO: 402878 - DNA, 140 bp, Artificial Sequence
  Synthetic
caccgctgtcccaaaaggtccccccaatccccccttttcttttaaaattgtggatgaatactgccatttgtactgctgtcttaagatgttcagcttgatctcttacctgtcctataatttcatatcagcagccagggcct

SEQ ID NO: 402879 - DNA, 140 bp, Artificial Sequence
  Synthetic
atacgccatgctgggtctccattagatctgaaaatttcacaaacaatgctaaaaccataatagtacagtttaacagttctgtaggaattaattgtaccagacctagcaacaatacaagaacgtacttgggagtcggccat

SEQ ID NO: 402880 - DNA, 140 bp, Artificial Sequence
  Synthetic
atggccgactcccaagtacgttcttgtattgttgctaggtctggtacaattaattcctacagaactgttaaactgtactattatggttttagcattgtttgtgaaattttcagatctaatggagacccagcatggcgtat

SEQ ID NO: 402881 - DNA, 140 bp, Artificial Sequence
  Synthetic
atacgccatgctgggtctccggggggcaagtggtcaaaatggcctgctgtaagagaaagaatgagacgaactagagtaggagcagggtatcaagacttagataaagatagagcacttacacgtacttgggagtcggccat

SEQ ID NO: 402882 - DNA, 140 bp, Artificial Sequence
  Synthetic
atggccgactcccaagtacgtgtaagtgctctatctttatctaagtcttgataccctgctcctactctagttcgtctcattctttctcttacagcaggccattttgaccacttgccccccggagacccagcatggcgtat

SEQ ID NO: 402883 - DNA, 140 bp, Artificial Sequence
  Synthetic
aggccctggctgctgatatgtggggatacttgggcaggagtggaagccataataagaattctgcaacaactgctgtttattcatttcagaattgggtgtcaacatagcagaataggcattgaccttttgggacagcggtg

SEQ ID NO: 402884 - DNA, 140 bp, Artificial Sequence
  Synthetic
caccgctgtcccaaaaggtcaatgcctattctgctatgttgacacccaattctgaaatgaataaacagcagttgttgcagaattcttattatggcttccactcctgcccaagtatccccacatatcagcagccagggcct

SEQ ID NO: 402885 - DNA, 140 bp, Artificial Sequence
  Synthetic
aggccctggctgctgatatggacatatcaaatttaccaagaaccattcaaaaatctgaaaacagggaagtatgcaaaaatgaggactgcccacactaatgatgtaaaacagttaacagaggaccttttgggacagcggtg

SEQ ID NO: 402886 - DNA, 140 bp, Artificial Sequence
  Synthetic
caccgctgtcccaaaaggtcctctgttaactgttttacatcattagtgtgggcagtcctcatttttgcatacttccctgttttcagatttttgaatggttcttggtaaatttgatatgtccatatcagcagccagggcct

SEQ ID NO: 402887 - DNA, 140 bp, Artificial Sequence
  Synthetic
aggccctggctgctgatatggtaatgcaagccttaatcattttagcaatagtagccttagtagtagcagcaataatagcaatagttgtgtggaccatagtattcatagaatataggaaaagaccttttgggacagcggtg

SEQ ID NO: 402888 - DNA, 140 bp, Artificial Sequence
  Synthetic
caccgctgtcccaaaaggtcttttcctatattctatgaatactatggtccacacaactattgctattattgctgctactactaaggctactattgctaaaatgattaaggcttgcattaccatatcagcagccagggcct

SEQ ID NO: 402889 - DNA, 140 bp, Artificial Sequence
  Synthetic
aggccctggctgctgatatggctgcagaaaacttgtgggtcacagtctattatggggtacctgtatggaaagaagcaactaccactctattttgtgcatcagatgctaaagcatatgaaagaccttttgggacagcggtg

SEQ ID NO: 402890 - DNA, 140 bp, Artificial Sequence
  Synthetic
caccgctgtcccaaaaggtctttcatatgctttagcatctgatgcacaaaatagagtggtagttgcttctttccatacaggtaccccataatagactgtgacccacaagttttctgcagccatatcagcagccagggcct

SEQ ID NO: 402891 - DNA, 140 bp, Artificial Sequence
  Synthetic
aggccctggctgctgatatgggagagagatgggtgcgagagcgtcagtattaagcggcggaaaattagatacttgggagaaaattcggttgaggccaggggggaagaaacgttataggctgaccttttgggacagcggtg

SEQ ID NO: 402892 - DNA, 140 bp, Artificial Sequence
  Synthetic
caccgctgtcccaaaaggtcagcctataacgtttcttcccccctggcctcaaccgaattttctcccaagtatctaattttccgccgcttaatactgacgctctcgcacccatctctctcccatatcagcagccagggcct

SEQ ID NO: 402893 - DNA, 140 bp, Artificial Sequence
  Synthetic
aggccctggctgctgatatgatcaaagcctaaagccatgtgtaaaattaaccccactctgtgttcctttaaattgcactaatttgaataatactactaataccagtaataataccagtaggaccttttgggacagcggtg

SEQ ID NO: 402894 - DNA, 140 bp, Artificial Sequence
  Synthetic
caccgctgtcccaaaaggtcctactggtattattactggtattagtagtattattcaaattagtgcaatttaaaggaacacagagtggggttaattttacacatggctttaggctttgatcatatcagcagccagggcct

SEQ ID NO: 402895 - DNA, 140 bp, Artificial Sequence
  Synthetic
aggccctggctgctgatatgtggacatatcaaatttatcaagagccatttaaaaatctgaaaacaggaaaatatgcaaaaaaaaggtctgctcacactaatgatgtaagacaattagcaggaccttttgggacagcggtg

SEQ ID NO: 402896 - DNA, 140 bp, Artificial Sequence
  Synthetic
caccgctgtcccaaaaggtcctgctaattgtcttacatcattagtgtgagcagaccttttttttgcatattttcctgttttcagatttttaaatggctcttgataaatttgatatgtccacatatcagcagccagggcct

SEQ ID NO: 402897 - DNA, 140 bp, Artificial Sequence
  Synthetic
aggccctggctgctgatatgctaaatttagactacccatacaaaaggaaacatgggagacatggtggacagactattggcaagccacctggattcctgagtgggagtttgttaataccccgaccttttgggacagcggtg

SEQ ID NO: 402898 - DNA, 140 bp, Artificial Sequence
  Synthetic
caccgctgtcccaaaaggtcggggtattaacaaactcccactcaggaatccaggtggcttgccaatagtctgtccaccatgtctcccatgtttccttttgtatgggtagtctaaatttagcatatcagcagccagggcct

SEQ ID NO: 402899 - DNA, 140 bp, Artificial Sequence
  Synthetic
aggccctggctgctgatatgggtatcaactcaactgctgttaaacggcagtctagcaaaaggtgaggtaaagattaggtctgaaaatctcacagacaatgtcaaaaacataatagtacaggaccttttgggacagcggtg

SEQ ID NO: 402900 - DNA, 140 bp, Artificial Sequence
  Synthetic
caccgctgtcccaaaaggtcctgtactattatgtttttgacattgtctgtgagattttcagacctaatctttacctcaccttttgctagactgccgtttaacagcagttgagttgatacccatatcagcagccagggcct

SEQ ID NO: 402901 - DNA, 140 bp, Artificial Sequence
  Synthetic
aggccctggctgctgatatgtagctgaggggacagataggattatagaagtagcacaaagagcttatagggctattctcaacatacctacaagaatcagacaggccctcgaaagggctttgaccttttgggacagcggtg

SEQ ID NO: 402902 - DNA, 140 bp, Artificial Sequence
  Synthetic
caccgctgtcccaaaaggtcaaagccctttcgagggcctgtctgattcttgtaggtatgttgagaatagccctataagctctttgtgctacttctataatcctatctgtcccctcagctacatatcagcagccagggcct

SEQ ID NO: 402903 - DNA, 140 bp, Artificial Sequence
  Synthetic
aggccctggctgctgatatggctattctcaacatacctacaagaatcagacaggccctcgaaagggctttgctataagatgggtggcaagtggtcaaaaagtagtatggttggatggcctgaccttttgggacagcggtg

SEQ ID NO: 402904 - DNA, 140 bp, Artificial Sequence
  Synthetic
caccgctgtcccaaaaggtcaggccatccaaccatactactttttgaccacttgccacccatcttatagcaaagccctttcgagggcctgtctgattcttgtaggtatgttgagaatagccatatcagcagccagggcct

SEQ ID NO: 402905 - DNA, 140 bp, Artificial Sequence
  Synthetic
aggccctggctgctgatatgaatgtaagggaaagaatgagacgagctgagccagcagcagatggggtgggagcagtatctcgagacctggaaaaacatggagcaatcacaagtagcaatagaccttttgggacagcggtg

SEQ ID NO: 402906 - DNA, 140 bp, Artificial Sequence
  Synthetic
caccgctgtcccaaaaggtctattgctacttgtgattgctccatgtttttccaggtctcgagatactgctcccaccccatctgctgctggctcagctcgtctcattctttcccttacattcatatcagcagccagggcct

SEQ ID NO: 402907 - DNA, 140 bp, Artificial Sequence
  Synthetic
atacgccatgctgggtctccaaaccacctttgcctagtgttcaaaagctagtagaggatagatggaacaagccccagaagaccaggggccacagagagagccatacaatgaatggacactcgtacttgggagtcggccat

SEQ ID NO: 402908 - DNA, 140 bp, Artificial Sequence
  Synthetic
atggccgactcccaagtacgagtgtccattcattgtatggctctctctgtggcccctggtcttctggggcttgttccatctatcctctactagcttttgaacactaggcaaaggtggtttggagacccagcatggcgtat

SEQ ID NO: 402909 - DNA, 140 bp, Artificial Sequence
  Synthetic
aggccctggctgctgatatgtagcgctaatcttagcaatagtagtgtggactatagtagctttagaatataagaaaatacaaaaagaaagaaaaatagaaaagttaattaatagaataaggaccttttgggacagcggtg

SEQ ID NO: 402910 - DNA, 140 bp, Artificial Sequence
  Synthetic
caccgctgtcccaaaaggtccttattctattaattaacttttctatttttctttctttttgtattttcttatattctaaagctactatagtccacactactattgctaagattagcgctacatatcagcagccagggcct

SEQ ID NO: 402911 - DNA, 140 bp, Artificial Sequence
  Synthetic
atacgccatgctgggtctccttgtgcatcagatgccaaggcacatgaaacagaagtgcacaatgcctgggccacaccatgcctgtggtacccacagaccccaacccacaaagaaatggtacgtacttgggagtcggccat

SEQ ID NO: 402912 - DNA, 140 bp, Artificial Sequence
  Synthetic
atggccgactcccaagtacgtaccatttctttgtgggttggggtctgtgggtaccacaggcatggtgtggcccaggcattgtgcacttctgtttcatgtgccttggcatctgatgcacaaggagacccagcatggcgtat

SEQ ID NO: 402913 - DNA, 140 bp, Artificial Sequence
  Synthetic
atacgccatgctgggtctccttcttagcagccatagttgtgtggactatagtatttatacaatatagggaaataagaaaacagaaaaaaatagaaaagttacttgatagaataagagaaacgtacttgggagtcggccat

SEQ ID NO: 402914 - DNA, 140 bp, Artificial Sequence
  Synthetic
atggccgactcccaagtacgtttctcttattctatcaagtaacttttctatttttttctgttttcttatttccctatattgtataaatactatagtccacacaactatggctgctaagaaggagacccagcatggcgtat

SEQ ID NO: 402915 - DNA, 140 bp, Artificial Sequence
  Synthetic
atacgccatgctgggtctccaattggaccaatgtcactgaaagcagcaataacaatacagatttaagaaatataacagatgaagtaagaaactgttcttttaatacaaccacagaaataacgtacttgggagtcggccat

SEQ ID NO: 402916 - DNA, 140 bp, Artificial Sequence
  Synthetic
atggccgactcccaagtacgttatttctgtggttgtattaaaagaacagtttcttacttcatctgttatatttcttaaatctgtattgttattgctgctttcagtgacattggtccaattggagacccagcatggcgtat

SEQ ID NO: 402917 - DNA, 140 bp, Artificial Sequence
  Synthetic
atacgccatgctgggtctcccagcagcagagccagctgcagaaggagtaggagcagcgtctcgagacctagataaacatggagcaattacaagcagcaatacagctgccactaatgctgacgtacttgggagtcggccat

SEQ ID NO: 402918 - DNA, 140 bp, Artificial Sequence
  Synthetic
atggccgactcccaagtacgtcagcattagtggcagctgtattgctgcttgtaattgctccatgtttatctaggtctcgagacgctgctcctactccttctgcagctggctctgctgctgggagacccagcatggcgtat

SEQ ID NO: 402919 - DNA, 140 bp, Artificial Sequence
  Synthetic
atacgccatgctgggtctccactaatagtacattaggtaacaatagtactatagtagatgatatcagcaaggaaataaaaaactgctctttcaatataaccacagaaataagagataagacgtacttgggagtcggccat

SEQ ID NO: 402920 - DNA, 140 bp, Artificial Sequence
  Synthetic
atggccgactcccaagtacgtcttatctcttatttctgtggttatattgaaagagcagttttttatttccttgctgatatcatctactatagtactattgttacctaatgtactattagtggagacccagcatggcgtat

SEQ ID NO: 402921 - DNA, 140 bp, Artificial Sequence
  Synthetic
atacgccatgctgggtctccataagtaatgataccaaggatacaatgagaaattgctctttcaatgcaaccacagtagtacaagataagcatagcaaagagtatgcccttttttataaaccgtacttgggagtcggccat

SEQ ID NO: 402922 - DNA, 140 bp, Artificial Sequence
  Synthetic
atggccgactcccaagtacggtttataaaaaagggcatactctttgctatgcttatcttgtactactgtggttgcattgaaagagcaatttctcattgtatccttggtatcattacttatggagacccagcatggcgtat

SEQ ID NO: 402923 - DNA, 140 bp, Artificial Sequence
  Synthetic
aggccctggctgctgatatgttgtaccaggccttacaccaatttcaagacaaaggtaactatgggaccaggacgagtattctatagaacaggagagataatgggagatataaaacaagcagaccttttgggacagcggtg

SEQ ID NO: 402924 - DNA, 140 bp, Artificial Sequence
  Synthetic
caccgctgtcccaaaaggtctgcttgttttatatctcccattatctctcctgttctatagaatactcgtcctggtcccatagttacctttgtcttgaaattggtgtaaggcctggtacaacatatcagcagccagggcct

SEQ ID NO: 402925 - DNA, 140 bp, Artificial Sequence
  Synthetic
aggccctggctgctgatatgtgcggagcctgtgcctcttcagctaccaccaattgagagacttcatattgattgtggcgagagtagtggaacttctgggacgcagcagtctcaggggactgaccttttgggacagcggtg

SEQ ID NO: 402926 - DNA, 140 bp, Artificial Sequence
  Synthetic
caccgctgtcccaaaaggtcagtcccctgagactgctgcgtcccagaagttccactactctcgccacaatcaatatgaagtctctcaattggtggtagctgaagaggcacaggctccgcacatatcagcagccagggcct

SEQ ID NO: 402927 - DNA, 140 bp, Artificial Sequence
  Synthetic
atacgccatgctgggtctccaatggaacaggaccatgtaaaaatgtcagtacagtacaatgtacacatgggattaagccagtggtatcaactcaattactgctgaatggcagtttagcagcgtacttgggagtcggccat

SEQ ID NO: 402928 - DNA, 140 bp, Artificial Sequence
  Synthetic
atggccgactcccaagtacgctgctaaactgccattcagcagtaattgagttgataccactggcttaatcccatgtgtacattgtactgtactgacatttttacatggtcctgttccattggagacccagcatggcgtat

SEQ ID NO: 402929 - DNA, 140 bp, Artificial Sequence
  Synthetic
aggccctggctgctgatatggattaagccagtggtatcaactcaattactgctgaatggcagtttagcagaaggaaacataacaattaaaactgaaaacatcacagacaataccaaaaatgaccttttgggacagcggtg

SEQ ID NO: 402930 - DNA, 140 bp, Artificial Sequence
  Synthetic
caccgctgtcccaaaaggtcatttttggtattgtctgtgatgttttcagttttaattgttatgtttccttctgctaaactgccattcagcagtaattgagttgataccactggcttaatccatatcagcagccagggcct

SEQ ID NO: 402931 - DNA, 140 bp, Artificial Sequence
  Synthetic
atacgccatgctgggtctccacagaatattaatgacactatcacactcccatgcaggataaagcaaattgtaaacatgtggcagggagtaggacaaacaatgtatgctcctcccatcacgcgtacttgggagtcggccat

SEQ ID NO: 402932 - DNA, 140 bp, Artificial Sequence
  Synthetic
atggccgactcccaagtacgcgtgatgggaggagcatacattgtttgtcctactccctgccacatgtttacaatttgctttatcctgcatgggagtgtgatagtgtcattaatattctgtggagacccagcatggcgtat

SEQ ID NO: 402933 - DNA, 140 bp, Artificial Sequence
  Synthetic
aggccctggctgctgatatgtaacaatacaagaaaaagtatatcctttggaccaggacaagcgttcattgcaacaggtgacataataggagatataagacaagctcattgtaatgttagtgaccttttgggacagcggtg

SEQ ID NO: 402934 - DNA, 140 bp, Artificial Sequence
  Synthetic
caccgctgtcccaaaaggtcactaacattacaatgagcttgtcttatatctcctattatgtcacctgttgcaatgaacgcttgtcctggtccaaaggatatactttttcttgtattgttacatatcagcagccagggcct

SEQ ID NO: 402935 - DNA, 140 bp, Artificial Sequence
  Synthetic
atacgccatgctgggtctcctaggagacataagacaagcacattgtaacattagtgcagataaatggaataggactttgcaatgggtaggtaaaaaattagatgcactctttaataaaaccgtacttgggagtcggccat

SEQ ID NO: 402936 - DNA, 140 bp, Artificial Sequence
  Synthetic
atggccgactcccaagtacggttttattaaagagtgcatctaattttttacctacccattgcaaagtcctattccatttatctgcactaatgttacaatgtgcttgtcttatgtctcctaggagacccagcatggcgtat

SEQ ID NO: 402937 - DNA, 140 bp, Artificial Sequence
  Synthetic
atacgccatgctgggtctcccctttaattgtggaggagaatttttctattgcaatacaacagatctgttcaataatacatacaatcatacatactggcctaatactacaacaagtgcaaccgtacttgggagtcggccat

SEQ ID NO: 402938 - DNA, 140 bp, Artificial Sequence
  Synthetic
atggccgactcccaagtacggttgcacttgttgtagtattaggccagtatgtatgattgtatgtattattgaacagatctgttgtattgcaatagaaaaattctcctccacaattaaaggggagacccagcatggcgtat

SEQ ID NO: 402939 - DNA, 140 bp, Artificial Sequence
  Synthetic
atacgccatgctgggtctcccatcacacttcaatgcggaataaaacaaatcataaacatgtggcagcaggtaggaaaagctatgtatgcccctcccattgcaggaaatataacatgtagacgtacttgggagtcggccat

SEQ ID NO: 402940 - DNA, 140 bp, Artificial Sequence
  Synthetic
atggccgactcccaagtacgtctacatgttatatttcctgcaatgggaggggcatacatagcttttcctacctgctgccacatgtttatgatttgttttattccgcattgaagtgtgatgggagacccagcatggcgtat

SEQ ID NO: 402941 - DNA, 140 bp, Artificial Sequence
  Synthetic
aggccctggctgctgatatgaagagtcctggctatagaaagatacctacaggatcaacagctcctaggaatttggggctgctctggaaaactcatctgcaccactaatgtgccttggaacgaccttttgggacagcggtg

SEQ ID NO: 402942 - DNA, 140 bp, Artificial Sequence
  Synthetic
caccgctgtcccaaaaggtcgttccaaggcacattagtggtgcagatgagttttccagagcagccccaaattcctaggagctgttgatcctgtaggtatctttctatagccaggactcttcatatcagcagccagggcct

SEQ ID NO: 402943 - DNA, 140 bp, Artificial Sequence
  Synthetic
atacgccatgctgggtctcctgagagacttcgtcttgattgtgacgaggactgtggaacttctggggagacgggggtgggaaggcctcaaatatctggggaatcttctggtatattggatcgtacttgggagtcggccat

SEQ ID NO: 402944 - DNA, 140 bp, Artificial Sequence
  Synthetic
atggccgactcccaagtacgatccaatataccagaagattccccagatatttgaggccttcccacccccgtctccccagaagttccacagtcctcgtcacaatcaagacgaagtctctcaggagacccagcatggcgtat

SEQ ID NO: 402945 - DNA, 140 bp, Artificial Sequence
  Synthetic
aggccctggctgctgatatggctaatagggagactaaattaggaaaagcaggatatgttactaacaaaggaagacaaaaagttgtcaccctaactgacacaacaaatcagaagactgagtgaccttttgggacagcggtg

SEQ ID NO: 402946 - DNA, 140 bp, Artificial Sequence
  Synthetic
caccgctgtcccaaaaggtcactcagtcttctgatttgttgtgtcagttagggtgacaactttttgtcttcctttgttagtaacatatcctgcttttcctaatttagtctccctattagccatatcagcagccagggcct

SEQ ID NO: 402947 - DNA, 140 bp, Artificial Sequence
  Synthetic
atacgccatgctgggtctccgaatagtgctattagtttatttgatgcagcagcaatagcagtagctaactggacagatagggttgcagaagtagtacaaagaatttttagagcttttcttcgtacttgggagtcggccat

SEQ ID NO: 402948 - DNA, 140 bp, Artificial Sequence
  Synthetic
atggccgactcccaagtacgaagaaaagctctaaaaattctttgtactacttctgcaaccctatctgtccagttagctactgctattgctgctgcatcaaataaactaatagcactattcggagacccagcatggcgtat

SEQ ID NO: 402949 - DNA, 140 bp, Artificial Sequence
  Synthetic
aggccctggctgctgatatgctataagatgggtggcaagtggtcaaagagtagtggggttggatggtctactataagggagaaaatgagacgagctgagccagcagcagaaggggcagcagaccttttgggacagcggtg

SEQ ID NO: 402950 - DNA, 140 bp, Artificial Sequence
  Synthetic
caccgctgtcccaaaaggtctgctgccccttctgctgctggctcagctcgtctcattttctcccttatagtagaccatccaaccccactactctttgaccacttgccacccatcttatagcatatcagcagccagggcct

SEQ ID NO: 402951 - DNA, 140 bp, Artificial Sequence
  Synthetic
aggccctggctgctgatatgatggtcaaaaggctggcctgctgtaagagaaagaatgagaagaactgaaccagcagcagaaccagcagcagagggagtaggagcagcatctcaagacttagaccttttgggacagcggtg

SEQ ID NO: 402952 - DNA, 140 bp, Artificial Sequence
  Synthetic
caccgctgtcccaaaaggtctaagtcttgagatgctgctcctactccctctgctgctggttctgctgctggttcagttcttctcattctttctcttacagcaggccagccttttgaccatcatatcagcagccagggcct

SEQ ID NO: 402953 - DNA, 140 bp, Artificial Sequence
  Synthetic
aggccctggctgctgatatggggttgctctggaaaactcatttgcaccactgctgtgccttggaataatagttggagtaataaatctctgaatgagatttgggataacatgacctggatggaccttttgggacagcggtg

SEQ ID NO: 402954 - DNA, 140 bp, Artificial Sequence
  Synthetic
caccgctgtcccaaaaggtccatccaggtcatgttatcccaaatctcattcagagatttattactccaactattattccaaggcacagcagtggtgcaaatgagttttccagagcaaccccatatcagcagccagggcct

SEQ ID NO: 402955 - DNA, 140 bp, Artificial Sequence
  Synthetic
aggccctggctgctgatatgaagtgtttcaactgtggcaaggaaggacatctagccagaaattgcagggcccctaggaaaaagggctgttggaaatgtggaaaggaaggacatcaaatgagaccttttgggacagcggtg

SEQ ID NO: 402956 - DNA, 140 bp, Artificial Sequence
  Synthetic
caccgctgtcccaaaaggtctcatttgatgtccttcctttccacatttccaacagccctttttcctaggggccctgcaatttctggctagatgtccttccttgccacagttgaaacacttcatatcagcagccagggcct

SEQ ID NO: 402957 - DNA, 140 bp, Artificial Sequence
  Synthetic
atacgccatgctgggtctccagtaataccagtagtacgacagagggaggaggaatgaaaaactgctctttcaatatcaccacaagcataagaactaaggtgaaagactatgcacttttttcgtacttgggagtcggccat

SEQ ID NO: 402958 - DNA, 140 bp, Artificial Sequence
  Synthetic
atggccgactcccaagtacgaaaaaagtgcatagtctttcaccttagttcttatgcttgtggtgatattgaaagagcagtttttcattcctcctccctctgtcgtactactggtattactggagacccagcatggcgtat

SEQ ID NO: 402959 - DNA, 140 bp, Artificial Sequence
  Synthetic
aggccctggctgctgatatggtagaaattaattgtacaagacccaacaacaatacaagaaaaagtataaatctaggacaagggcgagcatggtatacaacaggacaaataataggagatagaccttttgggacagcggtg

SEQ ID NO: 402960 - DNA, 140 bp, Artificial Sequence
  Synthetic
caccgctgtcccaaaaggtctatctcctattatttgtcctgttgtataccatgctcgcccttgtcctagatttatactttttcttgtattgttgttgggtcttgtacaattaatttctaccatatcagcagccagggcct

SEQ ID NO: 402961 - DNA, 140 bp, Artificial Sequence
  Synthetic
aggccctggctgctgatatgaagtcagtcaaaattatcctatagtgcagaatgcacaagggcaaatggtacatcaggccatatcacctagaactttaaatgcatgggtaaaagtagtagagaccttttgggacagcggtg

SEQ ID NO: 402962 - DNA, 140 bp, Artificial Sequence
  Synthetic
caccgctgtcccaaaaggtctctactacttttacccatgcatttaaagttctaggtgatatggcctgatgtaccatttgcccttgtgcattctgcactataggataattttgactgacttcatatcagcagccagggcct

SEQ ID NO: 402963 - DNA, 140 bp, Artificial Sequence
  Synthetic
aggccctggctgctgatatgctagggatttggggttgctctggaaaactcatttgcaccactgctgtgccttggaatgctagttggagtaataaatctctgagtgagatttgggataacagaccttttgggacagcggtg

SEQ ID NO: 402964 - DNA, 140 bp, Artificial Sequence
  Synthetic
caccgctgtcccaaaaggtctgttatcccaaatctcactcagagatttattactccaactagcattccaaggcacagcagtggtgcaaatgagttttccagagcaaccccaaatccctagcatatcagcagccagggcct

SEQ ID NO: 402965 - DNA, 140 bp, Artificial Sequence
  Synthetic
aggccctggctgctgatatgagtccatgtagccagtggctatatagaagcagaagttatcccagcagaaacaggacaggagacagcatactttatactaaaattagcaggaagatggccagaccttttgggacagcggtg

SEQ ID NO: 402966 - DNA, 140 bp, Artificial Sequence
  Synthetic
caccgctgtcccaaaaggtctggccatcttcctgctaattttagtataaagtatgctgtctcctgtcctgtttctgctgggataacttctgcttctatatagccactggctacatggactcatatcagcagccagggcct

SEQ ID NO: 402967 - DNA, 140 bp, Artificial Sequence
  Synthetic
atacgccatgctgggtctccctactagcagtaaaagtaatgtgacaaatagtcccatgatgaaaaattgctctttcaatacaaccacagaactaagagataagatgaagaaggaatatgccgtacttgggagtcggccat

SEQ ID NO: 402968 - DNA, 140 bp, Artificial Sequence
  Synthetic
atggccgactcccaagtacggcatattccttcttcatcttatctcttagttctgtggttgtattgaaagagcaatttttcatcatgggactatttgtcacattacttttactgctagtagggagacccagcatggcgtat

SEQ ID NO: 402969 - DNA, 140 bp, Artificial Sequence
  Synthetic
aggccctggctgctgatatggaggaggtgggttttccagtcagacctcaggtacctttaagaccaatgacttacaagggagctttagatcttagccactttttaaaagaaaaggggggacgaccttttgggacagcggtg

SEQ ID NO: 402970 - DNA, 140 bp, Artificial Sequence
  Synthetic
caccgctgtcccaaaaggtcgtccccccttttcttttaaaaagtggctaagatctaaagctcccttgtaagtcattggtcttaaaggtacctgaggtctgactggaaaacccacctcctccatatcagcagccagggcct

SEQ ID NO: 402971 - DNA, 140 bp, Artificial Sequence
  Synthetic
aggccctggctgctgatatgtacctgtgtggaaagaagcaaaaactactctattttgtgcatcagatgctaaagcatatgacaaagaagtacataatgtctgggctacacatgcctgtgtgaccttttgggacagcggtg

SEQ ID NO: 402972 - DNA, 140 bp, Artificial Sequence
  Synthetic
caccgctgtcccaaaaggtcacacaggcatgtgtagcccagacattatgtacttctttgtcatatgctttagcatctgatgcacaaaatagagtagtttttgcttctttccacacaggtacatatcagcagccagggcct

SEQ ID NO: 402973 - DNA, 140 bp, Artificial Sequence
  Synthetic
aggccctggctgctgatatgaaacatatagtatgggcaagcagggaactagaacgattcgcagttaatcctggcctgttagaaacagcagaaggctgtagacaaatactggaacagctacgaccttttgggacagcggtg

SEQ ID NO: 402974 - DNA, 140 bp, Artificial Sequence
  Synthetic
caccgctgtcccaaaaggtcgtagctgttccagtatttgtctacagccttctgctgtttctaacaggccaggattaactgcgaatcgttctagttccctgcttgcccatactatatgtttcatatcagcagccagggcct

SEQ ID NO: 402975 - DNA, 140 bp, Artificial Sequence
  Synthetic
aggccctggctgctgatatggggaaggggttgaagctataataagaatattgcaacaactactgtttgttcatttcagaattgggtgtcaacatagcagaataggcattataccagggaggaccttttgggacagcggtg

SEQ ID NO: 402976 - DNA, 140 bp, Artificial Sequence
  Synthetic
caccgctgtcccaaaaggtcctccctggtataatgcctattctgctatgttgacacccaattctgaaatgaacaaacagtagttgttgcaatattcttattatagcttcaaccccttccccatatcagcagccagggcct

SEQ ID NO: 402977 - DNA, 140 bp, Artificial Sequence
  Synthetic
aggccctggctgctgatatgagatggaacaagccccagaagaccagggaccacagagagtgccatacaatgaatggacactagaacttttggaagagcttaaaagtgaagctgttagacagaccttttgggacagcggtg

SEQ ID NO: 402978 - DNA, 140 bp, Artificial Sequence
  Synthetic
caccgctgtcccaaaaggtctgtctaacagcttcacttttaagctcttccaaaagttctagtgtccattcattgtatggcactctctgtggtccctggtcttctggggcttgttccatctcatatcagcagccagggcct

SEQ ID NO: 402979 - DNA, 140 bp, Artificial Sequence
  Synthetic
aggccctggctgctgatatgtaggcatttcctatggcaggaagaagcggagacaacgacgaacagctcctcctggcagtaagaaccatcaagatcctgtaccaaagcagtaagtaataatgaccttttgggacagcggtg

SEQ ID NO: 402980 - DNA, 140 bp, Artificial Sequence
  Synthetic
caccgctgtcccaaaaggtcattattacttactgctttggtacaggatcttgatggttcttactgccaggaggagctgttcgtcgttgtctccgcttcttcctgccataggaaatgcctacatatcagcagccagggcct

SEQ ID NO: 402981 - DNA, 140 bp, Artificial Sequence
  Synthetic
aggccctggctgctgatatgtttggatcatagtatatatagaatatagaaaattggtaaaacaaagaagaataaactggttagttgaaagaattagggaaagagcagaagacagtggcaagaccttttgggacagcggtg

SEQ ID NO: 402982 - DNA, 140 bp, Artificial Sequence
  Synthetic
caccgctgtcccaaaaggtcttgccactgtcttctgctctttccctaattctttcaactaaccagtttattcttctttgttttaccaattttctatattctatatatactatgatccaaacatatcagcagccagggcct

SEQ ID NO: 402983 - DNA, 140 bp, Artificial Sequence
  Synthetic
atacgccatgctgggtctccggaaatatcacagatgaagtaggaaacttaggaaatatatcagaggaagtaagaaactgttcttttaatataaccacaatactaactgataagaagcagacgtacttgggagtcggccat

SEQ ID NO: 402984 - DNA, 140 bp, Artificial Sequence
  Synthetic
atggccgactcccaagtacgtctgcttcttatcagttagtattgtggttatattaaaagaacagtttcttacttcctctgatatatttcctaagtttcctacttcatctgtgatatttccggagacccagcatggcgtat

SEQ ID NO: 402985 - DNA, 140 bp, Artificial Sequence
  Synthetic
atacgccatgctgggtctccaacactgtagagggtaaagaagaaataaaaaactgctcttttaatgtaaccacagaaataaaagataagaaaaagaaagaacgtgcgcttttctatacaccgtacttgggagtcggccat

SEQ ID NO: 402986 - DNA, 140 bp, Artificial Sequence
  Synthetic
atggccgactcccaagtacggtgtatagaaaagcgcacgttctttctttttcttatcttttatttctgtggttacattaaaagagcagttttttatttcttctttaccctctacagtgttggagacccagcatggcgtat

SEQ ID NO: 402987 - DNA, 140 bp, Artificial Sequence
  Synthetic
atacgccatgctgggtctccgtctgaagaaatgaaaattgctctttcaaagtaaccacagaattaagagataagaagcgcaaagagtatgcacttttttatagacttgatgtagtaccaccgtacttgggagtcggccat

SEQ ID NO: 402988 - DNA, 140 bp, Artificial Sequence
  Synthetic
atggccgactcccaagtacggtggtactacatcaagtctataaaaaagtgcatactctttgcgcttcttatctcttaattctgtggttactttgaaagagcaattttcatttcttcagacggagacccagcatggcgtat

SEQ ID NO: 402989 - DNA, 140 bp, Artificial Sequence
  Synthetic
atacgccatgctgggtctccattaggtgtaccagacccagtaacaatacaaggaaaagtataccccttggaccagggcaagcgttctatgcaacaggtgacataataggagatataagaccgtacttgggagtcggccat

SEQ ID NO: 402990 - DNA, 140 bp, Artificial Sequence
  Synthetic
atggccgactcccaagtacggtcttatatctcctattatgtcacctgttgcatagaacgcttgccctggtccaaggggtatacttttccttgtattgttactgggtctggtacacctaatggagacccagcatggcgtat

SEQ ID NO: 402991 - DNA, 140 bp, Artificial Sequence
  Synthetic
atacgccatgctgggtctccctttaaaccatcctcaggaggggacccagagattacaacacatagttttaattgtggaggagaattcttctattgcgacacatcacaactatttaataagcgtacttgggagtcggccat

SEQ ID NO: 402992 - DNA, 140 bp, Artificial Sequence
  Synthetic
atggccgactcccaagtacgcttattaaatagttgtgatgtgtcgcaatagaagaattctcctccacaattaaaactatgtgttgtaatctctgggtcccctcctgaggatggtttaaagggagacccagcatggcgtat

SEQ ID NO: 402993 - DNA, 140 bp, Artificial Sequence
  Synthetic
aggccctggctgctgatatgtggggatttaccacaccagacaaaaaacatcagaaagaacctccattcctttggatggggtatgaactccatcctgataaatggacagtacagcctataggaccttttgggacagcggtg

SEQ ID NO: 402994 - DNA, 140 bp, Artificial Sequence
  Synthetic
caccgctgtcccaaaaggtcctataggctgtactgtccatttatcaggatggagttcataccccatccaaaggaatggaggttctttctgatgttttttgtctggtgtggtaaatccccacatatcagcagccagggcct

SEQ ID NO: 402995 - DNA, 140 bp, Artificial Sequence
  Synthetic
aggccctggctgctgatatggacgatctgcggagcctgtgcctcttcagctaccaccgattgagagacttcgtcttgattgcagcgaggactgtggaaactctgggacgcagggggtggggaccttttgggacagcggtg

SEQ ID NO: 402996 - DNA, 140 bp, Artificial Sequence
  Synthetic
caccgctgtcccaaaaggtccccaccccctgcgtcccagagtttccacagtcctcgctgcaatcaagacgaagtctctcaatcggtggtagctgaagaggcacaggctccgcagatcgtccatatcagcagccagggcct

SEQ ID NO: 402997 - DNA, 140 bp, Artificial Sequence
  Synthetic
aggccctggctgctgatatgcgtcttgattgcagcgaggactgtggaaactctgggacgcagggggtgggagatcctcaaatacctgtggaacctggtgtgttattggggacaggaactagaccttttgggacagcggtg

SEQ ID NO: 402998 - DNA, 140 bp, Artificial Sequence
  Synthetic
caccgctgtcccaaaaggtctagttcctgtccccaataacacaccaggttccacaggtatttgaggatctcccaccccctgcgtcccagagtttccacagtcctcgctgcaatcaagacgcatatcagcagccagggcct

SEQ ID NO: 402999 - DNA, 140 bp, Artificial Sequence
  Synthetic
atacgccatgctgggtctcctaatacaaacgtaatgatgcagaaaggcaactttaagggccccagaagagttattaaatgtttcaactgtggcaaggaaggacacctagccagaaattgccgtacttgggagtcggccat

SEQ ID NO: 403000 - DNA, 140 bp, Artificial Sequence
  Synthetic
atggccgactcccaagtacggcaatttctggctaggtgtccttccttgccacagttgaaacatttaataactcttctggggcccttaaagttgcctttctgcatcattacgtttgtattaggagacccagcatggcgtat

SEQ ID NO: 403001 - DNA, 140 bp, Artificial Sequence
  Synthetic
atacgccatgctgggtctccaatgggaggcaagtggtcaaaaagtagcctagttggatggcctcaggtaagggaaagaataagacaaaccccgccaacagaaggagcagcagaaggagtacgtacttgggagtcggccat

SEQ ID NO: 403002 - DNA, 140 bp, Artificial Sequence
  Synthetic
atggccgactcccaagtacgtactccttctgctgctccttctgttggcggggtttgtcttattctttcccttacctgaggccatccaactaggctactttttgaccacttgcctcccattggagacccagcatggcgtat

SEQ ID NO: 403003 - DNA, 140 bp, Artificial Sequence
  Synthetic
aggccctggctgctgatatggtggcgcccgaacagggacttgaaagcgaaagtaagaccagagaagatctctcgacgcaggactcggcttgctgaagtgcactcggcaagaggcgagagcgaccttttgggacagcggtg

SEQ ID NO: 403004 - DNA, 140 bp, Artificial Sequence
  Synthetic
caccgctgtcccaaaaggtcgctctcgcctcttgccgagtgcacttcagcaagccgagtcctgcgtcgagagatcttctctggtcttactttcgctttcaagtccctgttcgggcgccaccatatcagcagccagggcct

SEQ ID NO: 403005 - DNA, 140 bp, Artificial Sequence
  Synthetic
atacgccatgctgggtctccgtggcgcccgaacagggacttgaaagtgaaagtaagaccagagaagaagaactctcgacgcagggctcggcttgctgaagtgcactcggcaagaggcgagcgtacttgggagtcggccat

SEQ ID NO: 403006 - DNA, 140 bp, Artificial Sequence
  Synthetic
atggccgactcccaagtacgctcgcctcttgccgagtgcacttcagcaagccgagccctgcgtcgagagttcttcttctctggtcttactttcactttcaagtccctgttcgggcgccacggagacccagcatggcgtat

SEQ ID NO: 403007 - DNA, 140 bp, Artificial Sequence
  Synthetic
atacgccatgctgggtctccataccagtagtaataccagtactacgacagagggaggagaaataaaaaactgctctttcaatgtcaccacaaacataagagctaaggtaaaagaatatgccgtacttgggagtcggccat

SEQ ID NO: 403008 - DNA, 140 bp, Artificial Sequence
  Synthetic
atggccgactcccaagtacggcatattcttttaccttagctcttatgtttgtggtgacattgaaagagcagttttttatttctcctccctctgtcgtagtactggtattactactggtatggagacccagcatggcgtat

SEQ ID NO: 403009 - DNA, 140 bp, Artificial Sequence
  Synthetic
aggccctggctgctgatatgataggttgataaattgtaacacctcagtcattacacaagcttgtccaaaggtatcctttgagccaattcccatacattattgtaccccggctggttttgcgaccttttgggacagcggtg

SEQ ID NO: 403010 - DNA, 140 bp, Artificial Sequence
  Synthetic
caccgctgtcccaaaaggtcgcaaaaccagccggggtacaataatgtatgggaattggctcaaaggatacctttggacaagcttgtgtaatgactgaggtgttacaatttatcaacctatcatatcagcagccagggcct

SEQ ID NO: 403011 - DNA, 140 bp, Artificial Sequence
  Synthetic
atacgccatgctgggtctccttcatttcagaattgggtgccaacatagcagaataggcattattccacaaagaagagcaaggaatggatcccgtagatcctaaactagagccctggaatccgtacttgggagtcggccat

SEQ ID NO: 403012 - DNA, 140 bp, Artificial Sequence
  Synthetic
atggccgactcccaagtacggattccagggctctagtttaggatctacgggatccattccttgctcttctttgtggaataatgcctattctgctatgttggcacccaattctgaaatgaaggagacccagcatggcgtat

SEQ ID NO: 403013 - DNA, 140 bp, Artificial Sequence
  Synthetic
atacgccatgctgggtctcccaagcagtgaagatcatcaagatcttatatcaaagcagtaagtaacggtaatgttaaaattagcaacaatagtagattatattttagcagcaaaagtagacgtacttgggagtcggccat

SEQ ID NO: 403014 - DNA, 140 bp, Artificial Sequence
  Synthetic
atggccgactcccaagtacgtctacttttgctgctaaaatataatctactattgttgctaattttaacattaccgttacttactgctttgatataagatcttgatgatcttcactgcttgggagacccagcatggcgtat

SEQ ID NO: 403015 - DNA, 140 bp, Artificial Sequence
  Synthetic
atacgccatgctgggtctccttgtgtggatcatagtatatagagaatataggaaattgttaagacaaaagaaaatagacagggtgcttgaaaaaattagggaaagagcagaagacagtggcgtacttgggagtcggccat

SEQ ID NO: 403016 - DNA, 140 bp, Artificial Sequence
  Synthetic
atggccgactcccaagtacgccactgtcttctgctctttccctaattttttcaagcaccctgtctattttcttttgtcttaacaatttcctatattctctatatactatgatccacacaaggagacccagcatggcgtat

SEQ ID NO: 403017 - DNA, 140 bp, Artificial Sequence
  Synthetic
aggccctggctgctgatatgtggaaatggtaaagaagaaattaggagaacacttccctaataaaacaataatctttagatcaccatccccaggaggggacctagaaattacaacacataggaccttttgggacagcggtg

SEQ ID NO: 403018 - DNA, 140 bp, Artificial Sequence
  Synthetic
caccgctgtcccaaaaggtcctatgtgttgtaatttctaggtcccctcctggggatggtgatctaaagattattgttttattagggaagtgttctcctaatttcttctttaccatttccacatatcagcagccagggcct

SEQ ID NO: 403019 - DNA, 140 bp, Artificial Sequence
  Synthetic
aggccctggctgctgatatggtgggtcacagtctattatggggtacctgtgtggaaagaagcaaaaactactctattctgtgcatcagatgctaaagcatatgagaaagaagtgcataatgaccttttgggacagcggtg

SEQ ID NO: 403020 - DNA, 140 bp, Artificial Sequence
  Synthetic
caccgctgtcccaaaaggtcattatgcacttctttctcatatgctttagcatctgatgcacagaatagagtagtttttgcttctttccacacaggtaccccataatagactgtgacccaccatatcagcagccagggcct

SEQ ID NO: 403021 - DNA, 140 bp, Artificial Sequence
  Synthetic
atacgccatgctgggtctccgtacaaatgtgactaaaagggtgattacttacaataataacatgactgaagaaatgaaaaattgctctttcaataccaccacagaattaagagataaaaacgtacttgggagtcggccat

SEQ ID NO: 403022 - DNA, 140 bp, Artificial Sequence
  Synthetic
atggccgactcccaagtacgtttttatctcttaattctgtggtggtattgaaagagcaatttttcatttcttcagtcatgttattattgtaagtaatcacccttttagtcacatttgtacggagacccagcatggcgtat

SEQ ID NO: 403023 - DNA, 140 bp, Artificial Sequence
  Synthetic
aggccctggctgctgatatggatggggtgggagcagtatctcgagacctggaaaaacatggagcaatcacaagtagcaatatagcaaatgctgattgtgtctggctagaagcacaagagggaccttttgggacagcggtg

SEQ ID NO: 403024 - DNA, 140 bp, Artificial Sequence
  Synthetic
caccgctgtcccaaaaggtccctcttgtgcttctagccagacacaatcagcatttgctatattgctacttgtgattgctccatgtttttccaggtctcgagatactgctcccaccccatccatatcagcagccagggcct

SEQ ID NO: 403025 - DNA, 140 bp, Artificial Sequence
  Synthetic
aggccctggctgctgatatgacaagacccggcaataatacaaggaaaagtgtgaggataggaccaggacaaacattctatgcaacaggagacataataggagatataagacaagcacattgaccttttgggacagcggtg

SEQ ID NO: 403026 - DNA, 140 bp, Artificial Sequence
  Synthetic
caccgctgtcccaaaaggtcaatgtgcttgtcttatatctcctattatgtctcctgttgcatagaatgtttgtcctggtcctatcctcacacttttccttgtattattgccgggtcttgtcatatcagcagccagggcct

SEQ ID NO: 403027 - DNA, 140 bp, Artificial Sequence
  Synthetic
atacgccatgctgggtctccaaattgctcttttaatactaccacagtcataagagataagatacagaaagaatatgcacttttttataaacttgatatagtaccaatagaaggaaagaatcgtacttgggagtcggccat

SEQ ID NO: 403028 - DNA, 140 bp, Artificial Sequence
  Synthetic
atggccgactcccaagtacgattctttccttctattggtactatatcaagtttataaaaaagtgcatattctttctgtatcttatctcttatgactgtggtagtattaaaagagcaatttggagacccagcatggcgtat

SEQ ID NO: 403029 - DNA, 140 bp, Artificial Sequence
  Synthetic
aggccctggctgctgatatgtcacactcccatgcagaataaaacaaattataaacatgtggcagaaggtaggacgagcaatgtatgcccctcccattgcaggaaacataacatgtaaatcgaccttttgggacagcggtg

SEQ ID NO: 403030 - DNA, 140 bp, Artificial Sequence
  Synthetic
caccgctgtcccaaaaggtcgatttacatgttatgtttcctgcaatgggaggggcatacattgctcgtcctaccttctgccacatgtttataatttgttttattctgcatgggagtgtgacatatcagcagccagggcct

SEQ ID NO: 403031 - DNA, 140 bp, Artificial Sequence
  Synthetic
aggccctggctgctgatatggctgttagacattttcctagaccatggctccataacttaggacagtatatctataacacttatggggatacttgggaaggagttgaagctataataagaagaccttttgggacagcggtg

SEQ ID NO: 403032 - DNA, 140 bp, Artificial Sequence
  Synthetic
caccgctgtcccaaaaggtcttcttattatagcttcaactccttcccaagtatccccataagtgttatagatatactgtcctaagttatggagccatggtctaggaaaatgtctaacagccatatcagcagccagggcct

SEQ ID NO: 403033 - DNA, 140 bp, Artificial Sequence
  Synthetic
aggccctggctgctgatatggaagctttagataaaatagaggaagagcaaaacaaaagtaagaaaaaggcacagcaagcagcagcagcagctgacacaggaagtaacaaccaggtcagccgaccttttgggacagcggtg

SEQ ID NO: 403034 - DNA, 140 bp, Artificial Sequence
  Synthetic
caccgctgtcccaaaaggtcggctgacctggttgttacttcctgtgtcagctgctgctgctgcttgctgtgcctttttcttacttttgttttgctcttcctctattttatctaaagcttccatatcagcagccagggcct

SEQ ID NO: 403035 - DNA, 140 bp, Artificial Sequence
  Synthetic
aggccctggctgctgatatgagaataggcattataagacagagaagagggaggaatggagccagtagatcctaacatagagccctggaagcagccaggaagtcggcctaagactgcttgtgaccttttgggacagcggtg

SEQ ID NO: 403036 - DNA, 140 bp, Artificial Sequence
  Synthetic
caccgctgtcccaaaaggtcacaagcagtcttaggccgacttcctggctgcttccagggctctatgttaggatctactggctccattcctccctcttctctgtcttataatgcctattctcatatcagcagccagggcct

SEQ ID NO: 403037 - DNA, 140 bp, Artificial Sequence
  Synthetic
atacgccatgctgggtctccaaattaacaattacacaaaaataatatacaatttgcttgaaaagtcgcaaaaacagcaggagaaaaatgaacaggagttattggcattggacagttgggacgtacttgggagtcggccat

SEQ ID NO: 403038 - DNA, 140 bp, Artificial Sequence
  Synthetic
atggccgactcccaagtacgtcccaactgtccaatgccaataactcctgttcatttttctcctgctgtttttgcgacttttcaagcaaattgtatattatttttgtgtaattgttaatttggagacccagcatggcgtat

SEQ ID NO: 403039 - DNA, 140 bp, Artificial Sequence
  Synthetic
aggccctggctgctgatatgatgacagcatgccaaggagtgggagggcccggccataaagcaagaattttggcagaagcaatgagccaagtaacaacttcaaatgttataatgatgcagagaccttttgggacagcggtg

SEQ ID NO: 403040 - DNA, 140 bp, Artificial Sequence
  Synthetic
caccgctgtcccaaaaggtctctgcatcattataacatttgaagttgttacttggctcattgcttctgccaaaattcttgctttatggccgggccctcccactccttggcatgctgtcatcatatcagcagccagggcct

SEQ ID NO: 403041 - DNA, 140 bp, Artificial Sequence
  Synthetic
atacgccatgctgggtctccatagtactgggaataacaatgctggtactgggaataacaatgctagcattgtggatggtaatgaaataagaaactgctctttcaatataaccacagaattcgtacttgggagtcggccat

SEQ ID NO: 403042 - DNA, 140 bp, Artificial Sequence
  Synthetic
atggccgactcccaagtacgaattctgtggttatattgaaagagcagtttcttatttcattaccatccacaatgctagcattgttattcccagtaccagcattgttattcccagtactatggagacccagcatggcgtat

SEQ ID NO: 403043 - DNA, 140 bp, Artificial Sequence
  Synthetic
aggccctggctgctgatatgaggctaattttttagggaaaatttggccttccaacaaggggaggccagggaactttctccagaacaggccagagccaacagccccgccagcagagagcttgaccttttgggacagcggtg

SEQ ID NO: 403044 - DNA, 140 bp, Artificial Sequence
  Synthetic
caccgctgtcccaaaaggtcaagctctctgctggcggggctgttggctctggcctgttctggagaaagttccctggcctccccttgttggaaggccaaattttccctaaaaaattagcctcatatcagcagccagggcct

SEQ ID NO: 403045 - DNA, 140 bp, Artificial Sequence
  Synthetic
atacgccatgctgggtctccgatgctaatactaatgctaccatagacaatgatggaaagggggaaataaaaaattgctctttcaatatgaccacggaaataagagataagaaaaagaaagcgtacttgggagtcggccat

SEQ ID NO: 403046 - DNA, 140 bp, Artificial Sequence
  Synthetic
atggccgactcccaagtacgctttctttttcttatctcttatttccgtggtcatattgaaagagcaattttttatttccccctttccatcattgtctatggtagcattagtattagcatcggagacccagcatggcgtat

SEQ ID NO: 403047 - DNA, 140 bp, Artificial Sequence
  Synthetic
aggccctggctgctgatatgataacaacacaagaaaaagtatacgtattggaccagggcaatcattctatgcaacaggtgacataataggagacataagacaagctcattgcaacattaggaccttttgggacagcggtg

SEQ ID NO: 403048 - DNA, 140 bp, Artificial Sequence
  Synthetic
caccgctgtcccaaaaggtcctaatgttgcaatgagcttgtcttatgtctcctattatgtcacctgttgcatagaatgattgccctggtccaatacgtatactttttcttgtgttgttatcatatcagcagccagggcct

SEQ ID NO: 403049 - DNA, 140 bp, Artificial Sequence
  Synthetic
atacgccatgctgggtctcccccaataacaatacaagaaaagggatacacattggaccagggcaaacgttctatgcaacaggtgagataataggtgatataagacaagctcattgtaatgcgtacttgggagtcggccat

SEQ ID NO: 403050 - DNA, 140 bp, Artificial Sequence
  Synthetic
atggccgactcccaagtacgcattacaatgagcttgtcttatatcacctattatctcacctgttgcatagaacgtttgccctggtccaatgtgtatcccttttcttgtattgttattgggggagacccagcatggcgtat

SEQ ID NO: 403051 - DNA, 140 bp, Artificial Sequence
  Synthetic
aggccctggctgctgatatgccgctaataatgctgattgtgccaggctgcaagcacaagaggaggacaatgaagtaggtttcccagtcagacctcaggtgcctttaagaccaatgacttagaccttttgggacagcggtg

SEQ ID NO: 403052 - DNA, 140 bp, Artificial Sequence
  Synthetic
caccgctgtcccaaaaggtctaagtcattggtcttaaaggcacctgaggtctgactgggaaacctacttcattgtcctcctcttgtgcttgcagcctggcacaatcagcattattagcggcatatcagcagccagggcct

SEQ ID NO: 403053 - DNA, 140 bp, Artificial Sequence
  Synthetic
aggccctggctgctgatatgattgccaagtttgtttcataacaaaaggcttaggcatctcctatggcaggaagaagcggagacagcgacgaagacctcctcaagacagtgaggctcatcagaccttttgggacagcggtg

SEQ ID NO: 403054 - DNA, 140 bp, Artificial Sequence
  Synthetic
caccgctgtcccaaaaggtctgatgagcctcactgtcttgaggaggtcttcgtcgctgtctccgcttcttcctgccataggagatgcctaagccttttgttatgaaacaaacttggcaatcatatcagcagccagggcct

SEQ ID NO: 403055 - DNA, 140 bp, Artificial Sequence
  Synthetic
aggccctggctgctgatatgaattgtaagaatgtggcagagagtgggacaagcaatgtatgcccctcccattgcaggaaacattacatgtaaatcaaacattacaggactactattaacagaccttttgggacagcggtg

SEQ ID NO: 403056 - DNA, 140 bp, Artificial Sequence
  Synthetic
caccgctgtcccaaaaggtctgttaatagtagtcctgtaatgtttgatttacatgtaatgtttcctgcaatgggaggggcatacattgcttgtcccactctctgccacattcttacaattcatatcagcagccagggcct

SEQ ID NO: 403057 - DNA, 140 bp, Artificial Sequence
  Synthetic
aggccctggctgctgatatgctcgacgcaggactcggcttgctgaggtgcacacagcaagaggcgagaggcggcgactggtgagtacgccaattttgactagcggaggctagaaggagaggaccttttgggacagcggtg

SEQ ID NO: 403058 - DNA, 140 bp, Artificial Sequence
  Synthetic
caccgctgtcccaaaaggtcctctccttctagcctccgctagtcaaaattggcgtactcaccagtcgccgcctctcgcctcttgctgtgtgcacctcagcaagccgagtcctgcgtcgagcatatcagcagccagggcct

SEQ ID NO: 403059 - DNA, 140 bp, Artificial Sequence
  Synthetic
aggccctggctgctgatatgcaggaactaaagaatagtgctattagtttaattgatacagcagcaatagcagtagctaactggacagataggattatagaaatagtacaaagagcttttagaccttttgggacagcggtg

SEQ ID NO: 403060 - DNA, 140 bp, Artificial Sequence
  Synthetic
caccgctgtcccaaaaggtctaaaagctctttgtactatttctataatcctatctgtccagttagctactgctattgctgctgtatcaattaaactaatagcactattctttagttcctgcatatcagcagccagggcct

SEQ ID NO: 403061 - DNA, 140 bp, Artificial Sequence
  Synthetic
aggccctggctgctgatatgctcaggtaagggaaagaataagacaaaccccgccaacagaaggagcagcagaaggagtaggagcagtgtctcaagatttagataagcatggggcaatcacgaccttttgggacagcggtg

SEQ ID NO: 403062 - DNA, 140 bp, Artificial Sequence
  Synthetic
caccgctgtcccaaaaggtcgtgattgccccatgcttatctaaatcttgagacactgctcctactccttctgctgctccttctgttggcggggtttgtcttattctttcccttacctgagcatatcagcagccagggcct

SEQ ID NO: 403063 - DNA, 140 bp, Artificial Sequence
  Synthetic
atacgccatgctgggtctccaaacagaggatgatagcgaagtaggctttccagtcagacctcaggtacctttgagaccaatgacttttaaagctgcttttgatctaggcttctttttaaacgtacttgggagtcggccat

SEQ ID NO: 403064 - DNA, 140 bp, Artificial Sequence
  Synthetic
atggccgactcccaagtacgtttaaaaagaagcctagatcaaaagcagctttaaaagtcattggtctcaaaggtacctgaggtctgactggaaagcctacttcgctatcatcctctgtttggagacccagcatggcgtat

SEQ ID NO: 403065 - DNA, 140 bp, Artificial Sequence
  Synthetic
  misc_feature (32)..(32): n is a, c, g, or t
  misc_feature (38)..(38): n is a, c, g, or t
  misc_feature (42)..(42): n is a, c, g, or t
  misc_feature (50)..(50): n is a, c, g, or t
  misc_feature (60)..(60): n is a, c, g, or t
  misc_feature (101)..(101): n is a, c, g, or t
  misc_feature (108)..(108): n is a, c, g, or t
aggccctggctgctgatatgagctcagtagtntacatnccantaggagangctgaattantaataacaacatattggggtctgcagacaggagaaagagantggcatntgggtcagggaggaccttttgggacagcggtg

SEQ ID NO: 403066 - DNA, 140 bp, Artificial Sequence
  Synthetic
  misc_feature (33)..(33): n is a, c, g, or t
  misc_feature (40)..(40): n is a, c, g, or t
  misc_feature (81)..(81): n is a, c, g, or t
  misc_feature (91)..(91): n is a, c, g, or t
  misc_feature (99)..(99): n is a, c, g, or t
  misc_feature (103)..(103): n is a, c, g, or t
  misc_feature (109)..(109): n is a, c, g, or t
caccgctgtcccaaaaggtcctccctgacccanatgccantctctttctcctgtctgcagaccccaatatgttgttattantaattcagcntctcctantggnatgtanactactgagctcatatcagcagccagggcct

SEQ ID NO: 403067 - DNA, 140 bp, Artificial Sequence
  Synthetic
aggccctggctgctgatatgaagttaattagaggtaccaagtcattaacagaagtagtacctctaagcaaagaggcagaactagaattagaagaaaacagagaaaagctaaaagaaccaggaccttttgggacagcggtg

SEQ ID NO: 403068 - DNA, 140 bp, Artificial Sequence
  Synthetic
caccgctgtcccaaaaggtcctggttcttttagcttttctctgttttcttctaattctagttctgcctctttgcttagaggtactacttctgttaatgacttggtacctctaattaacttcatatcagcagccagggcct

SEQ ID NO: 403069 - DNA, 140 bp, Artificial Sequence
  Synthetic
aggccctggctgctgatatgccacactaatgatgtaaaacagttaacagaggcagtgcaaaaaatagcccaggaaagcatagtaatatggggaaagactcctaaatttagactacccatcgaccttttgggacagcggtg

SEQ ID NO: 403070 - DNA, 140 bp, Artificial Sequence
  Synthetic
caccgctgtcccaaaaggtcgatgggtagtctaaatttaggagtctttccccatattactatgctttcctgggctattttttgcactgcctctgttaactgttttacatcattagtgtggcatatcagcagccagggcct

SEQ ID NO: 403071 - DNA, 140 bp, Artificial Sequence
  Synthetic
aggccctggctgctgatatgtctcctatggcaggaagaagcggagacagcgacgaagacctcctcaaggcagtcagactcatcaagaccctctaccaaagcagtgagtagcatatgtaatgaccttttgggacagcggtg

SEQ ID NO: 403072 - DNA, 140 bp, Artificial Sequence
  Synthetic
caccgctgtcccaaaaggtcattacatatgctactcactgctttggtagagggtcttgatgagtctgactgccttgaggaggtcttcgtcgctgtctccgcttcttcctgccataggagacatatcagcagccagggcct

SEQ ID NO: 403073 - DNA, 140 bp, Artificial Sequence
  Synthetic
atacgccatgctgggtctcctagcaataattgtgtggtctatagtattaatagaatataggaaaatattaagacaaagaaaaatagataatttacttgctagaataatagaaagagcagacgtacttgggagtcggccat

SEQ ID NO: 403074 - DNA, 140 bp, Artificial Sequence
  Synthetic
atggccgactcccaagtacgtctgctctttctattattctagcaagtaaattatctatttttctttgtcttaatattttcctatattctattaatactatagaccacacaattattgctaggagacccagcatggcgtat

SEQ ID NO: 403075 - DNA, 140 bp, Artificial Sequence
  Synthetic
aggccctggctgctgatatgagacaaagaaaaatagataatttacttgctagaataatagaaagagcagaagacagtggcaatgagagcgagggagatcaagaagaattatcagcactgggaccttttgggacagcggtg

SEQ ID NO: 403076 - DNA, 140 bp, Artificial Sequence
  Synthetic
caccgctgtcccaaaaggtcccagtgctgataattcttcttgatctccctcgctctcattgccactgtcttctgctctttctattattctagcaagtaaattatctatttttctttgtctcatatcagcagccagggcct

SEQ ID NO: 403077 - DNA, 140 bp, Artificial Sequence
  Synthetic
atacgccatgctgggtctccacaatagcagcagtaatagtagtgggaagggaacaatagaaggaggagagatgaaaaattgttctttcaatatcaccacccaaacggaggagagaaggaacgtacttgggagtcggccat

SEQ ID NO: 403078 - DNA, 140 bp, Artificial Sequence
  Synthetic
atggccgactcccaagtacgttccttctctcctccgtttgggtggtgatattgaaagaacaatttttcatctctcctccttctattgttcccttcccactactattactgctgctattgtggagacccagcatggcgtat

SEQ ID NO: 403079 - DNA, 140 bp, Artificial Sequence
  Synthetic
aggccctggctgctgatatgaacaatgagacaccaggaatcaggtatcagtacaatgtgcttccacaaggatggaaaggatcaccagcaatattccagagtagcatgacaaaaatcttaggaccttttgggacagcggtg

SEQ ID NO: 403080 - DNA, 140 bp, Artificial Sequence
  Synthetic
caccgctgtcccaaaaggtcctaagatttttgtcatgctactctggaatattgctggtgatcctttccatccttgtggaagcacattgtactgatacctgattcctggtgtctcattgttcatatcagcagccagggcct

SEQ ID NO: 403081 - DNA, 140 bp, Artificial Sequence
  Synthetic
aggccctggctgctgatatgcatctagctttgcaggattcaggattagaagtaaacatagtaacagactcacaatatgcattaggaatcattcaagcacaaccagataaaagtgaatcaggaccttttgggacagcggtg

SEQ ID NO: 403082 - DNA, 140 bp, Artificial Sequence
  Synthetic
caccgctgtcccaaaaggtcctgattcacttttatctggttgtgcttgaatgattcctaatgcatattgtgagtctgttactatgtttacttctaatcctgaatcctgcaaagctagatgcatatcagcagccagggcct

SEQ ID NO: 403083 - DNA, 140 bp, Artificial Sequence
  Synthetic
atacgccatgctgggtctccagaggtatacatatgggaccaggtcgggtattatatgcaacaggagaaataataggaaatataagacaagcacattgtaacattagtaaaacaaaatggacgtacttgggagtcggccat

SEQ ID NO: 403084 - DNA, 140 bp, Artificial Sequence
  Synthetic
atggccgactcccaagtacgtccattttgttttactaatgttacaatgtgcttgtcttatatttcctattatttctcctgttgcatataatacccgacctggtcccatatgtatacctctggagacccagcatggcgtat

SEQ ID NO: 403085 - DNA, 140 bp, Artificial Sequence
  Synthetic
aggccctggctgctgatatgaatacaagaacaagtataactataggaccaggacaagtattctatagaacaggagacataataggagatataagaaaagcatattgtgagattaatggaagaccttttgggacagcggtg

SEQ ID NO: 403086 - DNA, 140 bp, Artificial Sequence
  Synthetic
caccgctgtcccaaaaggtcttccattaatctcacaatatgcttttcttatatctcctattatgtctcctgttctatagaatacttgtcctggtcctatagttatacttgttcttgtattcatatcagcagccagggcct

SEQ ID NO: 403087 - DNA, 140 bp, Artificial Sequence
  Synthetic
aggccctggctgctgatatgaggcaccagtttatttgtggaggggagtttttctactgtgattcagtaaagctgtttaatagcacttggaatagtactgggaataatactatagcaaatggaccttttgggacagcggtg

SEQ ID NO: 403088 - DNA, 140 bp, Artificial Sequence
  Synthetic
caccgctgtcccaaaaggtccatttgctatagtattattcccagtactattccaagtgctattaaacagctttactgaatcacagtagaaaaactcccctccacaaataaactggtgcctcatatcagcagccagggcct

SEQ ID NO: 403089 - DNA, 140 bp, Artificial Sequence
  Synthetic
atacgccatgctgggtctccaatgttaatgctaccaacaatattaatagcatgattgataacagtaataagggagaaatgaaaaattgctctttcaatgtaaccacagaactaagagatacgtacttgggagtcggccat

SEQ ID NO: 403090 - DNA, 140 bp, Artificial Sequence
  Synthetic
atggccgactcccaagtacgtatctcttagttctgtggttacattgaaagagcaatttttcatttctcccttattactgttatcaatcatgctattaatattgttggtagcattaacattggagacccagcatggcgtat

SEQ ID NO: 403091 - DNA, 140 bp, Artificial Sequence
  Synthetic
atacgccatgctgggtctcctgaccagtagcatgattggagaaatgaaaaattgctctttcaatataaccacagaattaagagataaaaggaaaaaagaaagtgcacttttttatagactcgtacttgggagtcggccat

SEQ ID NO: 403092 - DNA, 140 bp, Artificial Sequence
  Synthetic
atggccgactcccaagtacgagtctataaaaaagtgcactttcttttttccttttatctcttaattctgtggttatattgaaagagcaatttttcatttctccaatcatgctactggtcaggagacccagcatggcgtat

SEQ ID NO: 403093 - DNA, 140 bp, Artificial Sequence
  Synthetic
atacgccatgctgggtctcctaagacgaacccctccagtagaaaccccagtagcagaaggggtgggagcagtctctcgagacctaggaaggcatggagcaatcacaagtagcaacacagccgtacttgggagtcggccat

SEQ ID NO: 403094 - DNA, 140 bp, Artificial Sequence
  Synthetic
atggccgactcccaagtacggctgtgttgctacttgtgattgctccatgccttcctaggtctcgagagactgctcccaccccttctgctactggggtttctactggaggggttcgtcttaggagacccagcatggcgtat

SEQ ID NO: 403095 - DNA, 140 bp, Artificial Sequence
  Synthetic
aggccctggctgctgatatggaggaagtaggcttcccagtcagacctcaagtgcccttaagaccaatgacttacaagggagccttcgatcttggcttctttttaaaagaaaaggggggacgaccttttgggacagcggtg

SEQ ID NO: 403096 - DNA, 140 bp, Artificial Sequence
  Synthetic
caccgctgtcccaaaaggtcgtccccccttttcttttaaaaagaagccaagatcgaaggctcccttgtaagtcattggtcttaagggcacttgaggtctgactgggaagcctacttcctccatatcagcagccagggcct

SEQ ID NO: 403097 - DNA, 140 bp, Artificial Sequence
  Synthetic
atacgccatgctgggtctccacgaggatagggataggacgaggacagacattctatgcaatgggacgaataataggagatacaagacaagcacattgtaacattagtggttggaacaacacgtacttgggagtcggccat

SEQ ID NO: 403098 - DNA, 140 bp, Artificial Sequence
  Synthetic
atggccgactcccaagtacgtgttgttccaaccactaatgttacaatgtgcttgtcttgtatctcctattattcgtcccattgcatagaatgtctgtcctcgtcctatccctatcctcgtggagacccagcatggcgtat

SEQ ID NO: 403099 - DNA, 140 bp, Artificial Sequence
  Synthetic
aggccctggctgctgatatgtagagccctggaaccatccgggaagtcagcctacaactgcttgtaacaagtgttactgtaaaaagtgttgctatcattgtcaagtttgctttttgaacaagaccttttgggacagcggtg

SEQ ID NO: 403100 - DNA, 140 bp, Artificial Sequence
  Synthetic
caccgctgtcccaaaaggtcttgttcaaaaagcaaacttgacaatgatagcaacactttttacagtaacacttgttacaagcagttgtaggctgacttcccggatggttccagggctctacatatcagcagccagggcct

SEQ ID NO: 403101 - DNA, 140 bp, Artificial Sequence
  Synthetic
atacgccatgctgggtctccctttcaatatcgacacagacatgggtgccaaggcgcagaaacactctgcagtttttaataaacttgatgtagtatcaatagataatgataataaaactaccgtacttgggagtcggccat

SEQ ID NO: 403102 - DNA, 140 bp, Artificial Sequence
  Synthetic
atggccgactcccaagtacggtagttttattatcattatctattgatactacatcaagtttattaaaaactgcagagtgtttctgcgccttggcacccatgtctgtgtcgatattgaaagggagacccagcatggcgtat

SEQ ID NO: 403103 - DNA, 140 bp, Artificial Sequence
  Synthetic
aggccctggctgctgatatgaggcttaggcatctcctatggcaggaagaagcggagacagcgacgagcagcttctcacagcagtaagagtcatcaagatcctataccagagcagtaagtagaccttttgggacagcggtg

SEQ ID NO: 403104 - DNA, 140 bp, Artificial Sequence
  Synthetic
caccgctgtcccaaaaggtctacttactgctctggtataggatcttgatgactcttactgctgtgagaagctgctcgtcgctgtctccgcttcttcctgccataggagatgcctaagcctcatatcagcagccagggcct

SEQ ID NO: 403105 - DNA, 140 bp, Artificial Sequence
  Synthetic
aggccctggctgctgatatgcttctcacagcagtaagagtcatcaagatcctataccagagcagtaagtataattaactaagttttgtaatggtacctttgcaaatagctagcatagtaggaccttttgggacagcggtg

SEQ ID NO: 403106 - DNA, 140 bp, Artificial Sequence
  Synthetic
caccgctgtcccaaaaggtcctactatgctagctatttgcaaaggtaccattacaaaacttagttaattatacttactgctctggtataggatcttgatgactcttactgctgtgagaagcatatcagcagccagggcct

SEQ ID NO: 403107 - DNA, 140 bp, Artificial Sequence
  Synthetic
aggccctggctgctgatatgtttgggataacatgacctggatgcagtgggatagagaaattaataattacacagacacaatatacaggttgcttgaagaatcacaaaaccagcaggagaagaccttttgggacagcggtg

SEQ ID NO: 403108 - DNA, 140 bp, Artificial Sequence
  Synthetic
caccgctgtcccaaaaggtcttctcctgctggttttgtgattcttcaagcaacctgtatattgtgtctgtgtaattattaatttctctatcccactgcatccaggtcatgttatcccaaacatatcagcagccagggcct

SEQ ID NO: 403109 - DNA, 140 bp, Artificial Sequence
  Synthetic
atacgccatgctgggtctccatagaatataggaaaataagaaaacaaaaaagaatagatagactaattaatagaataagagagagaacagaagatagtggcaatgagagtgaaggggacacgtacttgggagtcggccat

SEQ ID NO: 403110 - DNA, 140 bp, Artificial Sequence
  Synthetic
atggccgactcccaagtacgtgtccccttcactctcattgccactatcttctgttctctctcttattctattaattagtctatctattcttttttgttttcttattttcctatattctatggagacccagcatggcgtat

SEQ ID NO: 403111 - DNA, 140 bp, Artificial Sequence
  Synthetic
aggccctggctgctgatatgggtttagcataacaaattggctgtggtatataaaaatattcataatgatagtaggaggcttgataggtttaagaataatttttgctgtgctttctatagtgaccttttgggacagcggtg

SEQ ID NO: 403112 - DNA, 140 bp, Artificial Sequence
  Synthetic
caccgctgtcccaaaaggtcactatagaaagcacagcaaaaattattcttaaacctatcaagcctcctactatcattatgaatatttttatataccacagccaatttgttatgctaaacccatatcagcagccagggcct

SEQ ID NO: 403113 - DNA, 140 bp, Artificial Sequence
  Synthetic
aggccctggctgctgatatgtaattttttagggaaaatctggccttcccacaaggggaggccagggaacttccttcagagcagaccagagcccaggccagagccaacagccccaccagaagaccttttgggacagcggtg

SEQ ID NO: 403114 - DNA, 140 bp, Artificial Sequence
  Synthetic
caccgctgtcccaaaaggtcttctggtggggctgttggctctggcctgggctctggtctgctctgaaggaagttccctggcctccccttgtgggaaggccagattttccctaaaaaattacatatcagcagccagggcct

SEQ ID NO: 403115 - DNA, 140 bp, Artificial Sequence
  Synthetic
atacgccatgctgggtctcctaaaaattagttgtataagacccaacaacaatacaagaaaaagtatgactctaggaccaggaaaggtattctatacaacaggaataacaggagatataagcgtacttgggagtcggccat

SEQ ID NO: 403116 - DNA, 140 bp, Artificial Sequence
  Synthetic
atggccgactcccaagtacgcttatatctcctgttattcctgttgtatagaatacctttcctggtcctagagtcatactttttcttgtattgttgttgggtcttatacaactaatttttaggagacccagcatggcgtat

SEQ ID NO: 403117 - DNA, 140 bp, Artificial Sequence
  Synthetic
aggccctggctgctgatatggggtgggaagcccttaaatatctgggaagccttgtgcagtattggggtctagagctaaaaaagagtgctattagtctgcttgataccatagcaatagcaggaccttttgggacagcggtg

SEQ ID NO: 403118 - DNA, 140 bp, Artificial Sequence
  Synthetic
caccgctgtcccaaaaggtcctgctattgctatggtatcaagcagactaatagcactcttttttagctctagaccccaatactgcacaaggcttcccagatatttaagggcttcccaccccatatcagcagccagggcct

SEQ ID NO: 403119 - DNA, 140 bp, Artificial Sequence
  Synthetic
atacgccatgctgggtctccaacccctctctgtgtcactttaaattgtattaacgccaacaacactaacagcaccatcacgggagaaatggaaggagaagtaaaaaactgctctttcaatcgtacttgggagtcggccat

SEQ ID NO: 403120 - DNA, 140 bp, Artificial Sequence
  Synthetic
atggccgactcccaagtacgattgaaagagcagttttttacttctccttccatttctcccgtgatggtgctgttagtgttgttggcgttaatacaatttaaagtgacacagagaggggttggagacccagcatggcgtat

SEQ ID NO: 403121 - DNA, 140 bp, Artificial Sequence
  Synthetic
aggccctggctgctgatatgtagctgaaggaacagataggattatagaattcatacaaagaatttgtagagctattcgcaacatacctagaagaataagacagggctttgaagcagctttgaccttttgggacagcggtg

SEQ ID NO: 403122 - DNA, 140 bp, Artificial Sequence
  Synthetic
caccgctgtcccaaaaggtcaaagctgcttcaaagccctgtcttattcttctaggtatgttgcgaatagctctacaaattctttgtatgaattctataatcctatctgttccttcagctacatatcagcagccagggcct

SEQ ID NO: 403123 - DNA, 140 bp, Artificial Sequence
  Synthetic
atacgccatgctgggtctccacccagggaggcggaaatgaaaaattgctctttcaatataaccacagaaataagagataagagtcgcaaagagtatgcacttttttatcgccttgatatacgtacttgggagtcggccat

SEQ ID NO: 403124 - DNA, 140 bp, Artificial Sequence
  Synthetic
atggccgactcccaagtacgtatatcaaggcgataaaaaagtgcatactctttgcgactcttatctcttatttctgtggttatattgaaagagcaatttttcatttccgcctccctgggtggagacccagcatggcgtat

SEQ ID NO: 403125 - DNA, 140 bp, Artificial Sequence
  Synthetic
aggccctggctgctgatatgatagtggtgaatataggctaataaattgtaatgtcgcttctattaaagaggcttgccctccggtgacttttgagccttttcccctaccctattgtgttccgaccttttgggacagcggtg

SEQ ID NO: 403126 - DNA, 140 bp, Artificial Sequence
  Synthetic
caccgctgtcccaaaaggtcggaacacaatagggtaggggaaaaggctcaaaagtcaccggagggcaagcctctttaatagaagcgacattacaatttattagcctatattcaccactatcatatcagcagccagggcct

SEQ ID NO: 403127 - DNA, 140 bp, Artificial Sequence
  Synthetic
atacgccatgctgggtctccgaacatgtaaacatggcactcctgtactttgtacgcatggaattaacccattgctgtcgaccgaattactgctgaatgacagtttatcagaagaagaaatcgtacttgggagtcggccat

SEQ ID NO: 403128 - DNA, 140 bp, Artificial Sequence
  Synthetic
atggccgactcccaagtacgatttcttcttctgataaactgtcattcagcagtaattcggtcgacagcaatgggttaattccatgcgtacaaagtacaggagtgccatgtttacatgttcggagacccagcatggcgtat

SEQ ID NO: 403129 - DNA, 140 bp, Artificial Sequence
  Synthetic
aggccctggctgctgatatgtggagaagtgaattatataaatataaagtagtagaaattgaaccactaggaatagcacccaccaaggcaaagagaagagtggtggagagagaaaaaagaggaccttttgggacagcggtg

SEQ ID NO: 403130 - DNA, 140 bp, Artificial Sequence
  Synthetic
caccgctgtcccaaaaggtcctcttttttctctctccaccactcttctctttgccttggtgggtgctattcctagtggttcaatttctactactttatatttatataattcacttctccacatatcagcagccagggcct

SEQ ID NO: 403131 - DNA, 140 bp, Artificial Sequence
  Synthetic
atacgccatgctgggtctcctttgcaataaaatgggggcaaatggtcaaagaggagtatagttggatggcctaatgtaagagaaagaataagaagaactaatccactaacagagagagaacgtacttgggagtcggccat

SEQ ID NO: 403132 - DNA, 140 bp, Artificial Sequence
  Synthetic
atggccgactcccaagtacgttctctctctgttagtggattagttcttcttattctttctcttacattaggccatccaactatactcctctttgaccatttgcccccattttattgcaaaggagacccagcatggcgtat

SEQ ID NO: 403133 - DNA, 140 bp, Artificial Sequence
  Synthetic
atacgccatgctgggtctccataaaaaacatacgtataggaccaggacaaatgttccatgcaacaggtacaataatagaaaatatacgacaagcatgttgtataattaatggaacaaaatcgtacttgggagtcggccat

SEQ ID NO: 403134 - DNA, 140 bp, Artificial Sequence
  Synthetic
atggccgactcccaagtacgattttgttccattaattatacaacatgcttgtcgtatattttctattattgtacctgttgcatggaacatttgtcctggtcctatacgtatgttttttatggagacccagcatggcgtat

SEQ ID NO: 403135 - DNA, 140 bp, Artificial Sequence
  Synthetic
aggccctggctgctgatatgaataatagaaaatatacgacaagcatgttgtataattaatggaacaaaatggaatgaaaccctacaaaaggtagataacaaattaagaaaatactttggtgaccttttgggacagcggtg

SEQ ID NO: 403136 - DNA, 140 bp, Artificial Sequence
  Synthetic
caccgctgtcccaaaaggtcaccaaagtattttcttaatttgttatctaccttttgtagggtttcattccattttgttccattaattatacaacatgcttgtcgtatattttctattattcatatcagcagccagggcct

SEQ ID NO: 403137 - DNA, 140 bp, Artificial Sequence
  Synthetic
atacgccatgctgggtctccagctggagtaatagtagtaagatacattctctagaagagatttgggggaacatgacctggatgcagtgggaaaaagaaattcgcaatcacacaaaatacacgtacttgggagtcggccat

SEQ ID NO: 403138 - DNA, 140 bp, Artificial Sequence
  Synthetic
atggccgactcccaagtacgtgtattttgtgtgattgcgaatttctttttcccactgcatccaggtcatgttcccccaaatctcttctagagaatgtatcttactactattactccagctggagacccagcatggcgtat

SEQ ID NO: 403139 - DNA, 140 bp, Artificial Sequence
  Synthetic
atacgccatgctgggtctccaacacatagttttaattgtggaggagaatttttatactgcaatacatccaacctgttcaatagcaatgggttgataaaaggcacaaatgccaacattacccgtacttgggagtcggccat

SEQ ID NO: 403140 - DNA, 140 bp, Artificial Sequence
  Synthetic
atggccgactcccaagtacgggtaatgttggcatttgtgccttttatcaacccattgctattgaacaggttggatgtattgcagtataaaaattctcctccacaattaaaactatgtgttggagacccagcatggcgtat

SEQ ID NO: 403141 - DNA, 140 bp, Artificial Sequence
  Synthetic
aggccctggctgctgatatgccacttggagtaatagatcttatgaagagatttggaacaacatgacatggacagaatgggagagagaaattagcaattacacaaaccaaatatatgagatgaccttttgggacagcggtg

SEQ ID NO: 403142 - DNA, 140 bp, Artificial Sequence
  Synthetic
caccgctgtcccaaaaggtcatctcatatatttggtttgtgtaattgctaatttctctctcccattctgtccatgtcatgttgttccaaatctcttcataagatctattactccaagtggcatatcagcagccagggcct

SEQ ID NO: 403143 - DNA, 140 bp, Artificial Sequence
  Synthetic
atacgccatgctgggtctccaacatgactatcccatgcaaaataaagcaaattgtacgtatgtggcagagagtaggacaagcaatgtatgcccctcccctcagcgtagtaataatttgtacgtacttgggagtcggccat

SEQ ID NO: 403144 - DNA, 140 bp, Artificial Sequence
  Synthetic
atggccgactcccaagtacgtacaaattattactacgctgaggggaggggcatacattgcttgtcctactctctgccacatacgtacaatttgctttattttgcatgggatagtcatgttggagacccagcatggcgtat

SEQ ID NO: 403145 - DNA, 140 bp, Artificial Sequence
  Synthetic
atacgccatgctgggtctccaggcaagtcagatttatccagagattaaaataaagcaattatgtaaactcattaaaagaaccaaagcactaacagaagtagtaccactaacagtagaagccgtacttgggagtcggccat

SEQ ID NO: 403146 - DNA, 140 bp, Artificial Sequence
  Synthetic
atggccgactcccaagtacggcttctactgttagtggtactacttctgttagtgctttggttcttttaatgagtttacataattgctttattttaatctctggataaatctgacttgcctggagacccagcatggcgtat

SEQ ID NO: 403147 - DNA, 140 bp, Artificial Sequence
  Synthetic
atacgccatgctgggtctccccctcaaatattggtggaacctcctaaagtattggagccaggaactgcagaagagtgctgttagcttgttcaatgccaccgccatagcagtagctgagggcgtacttgggagtcggccat

SEQ ID NO: 403148 - DNA, 140 bp, Artificial Sequence
  Synthetic
atggccgactcccaagtacgccctcagctactgctatggcggtggcattgaacaagctaacagcactcttctgcagttcctggctccaatactttaggaggttccaccaatatttgagggggagacccagcatggcgtat

SEQ ID NO: 403149 - DNA, 140 bp, Artificial Sequence
  Synthetic
atacgccatgctgggtctccacatacctagaaggataagacagggcctagaaatggctttgctataaatgggtggcaagtgagcaaaaggtagtgtagttagatagcatgcagcagaaggcgtacttgggagtcggccat

SEQ ID NO: 403150 - DNA, 140 bp, Artificial Sequence
  Synthetic
atggccgactcccaagtacgccttctgctgcatgctatctaactacactaccttttgctcacttgccacccatttatagcaaagccatttctaggccctgtcttatccttctaggtatgtggagacccagcatggcgtat

SEQ ID NO: 403151 - DNA, 140 bp, Artificial Sequence
  Synthetic
atacgccatgctgggtctccggtggatgctgattgtgcctggctaaaagcacaaaagaaggaagaagcgggctttccaatcaaacctcaggtagttgtagatcttagccacttttaaaagcgtacttgggagtcggccat

SEQ ID NO: 403152 - DNA, 140 bp, Artificial Sequence
  Synthetic
atggccgactcccaagtacgcttttaaaagtggctaagatctacaactacctgaggtttgattggaaagcccgcttcttccttcttttgtgcttttagccaggcacaatcagcatccaccggagacccagcatggcgtat

SEQ ID NO: 403153 - DNA, 140 bp, Artificial Sequence
  Synthetic
atacgccatgctgggtctccagcatagtagatagagtattggcaagccacctagattcctgaataagagtttgtcaatacccctcccttagtaaagttgtagtaccagttagaaaaagaacgtacttgggagtcggccat

SEQ ID NO: 403154 - DNA, 140 bp, Artificial Sequence
  Synthetic
atggccgactcccaagtacgttctttttctaactggtactacaactttactaagggaggggtattgacaaactcttattcaggaatctaggtggcttgccaatactctatctactatgctggagacccagcatggcgtat

SEQ ID NO: 403155 - DNA, 140 bp, Artificial Sequence
  Synthetic
aggccctggctgctgatatgtataggtacagtattagtaggacctacacctgtcaacataattggaagaaacatgttgactcagcttggctgtactctaaattttccaattagtcctattgaccttttgggacagcggtg

SEQ ID NO: 403156 - DNA, 140 bp, Artificial Sequence
  Synthetic
caccgctgtcccaaaaggtcaataggactaattggaaaatttagagtacagccaagctgagtcaacatgtttcttccaattatgttgacaggtgtaggtcctactaatactgtacctatacatatcagcagccagggcct

SEQ ID NO: 403157 - DNA, 140 bp, Artificial Sequence
  Synthetic
aggccctggctgctgatatggcggcgactggtgagtacgccaattttgactagcggaggctagaaggagagagatgggtgcgagagcgtcagtattaagcgggggagaattggatagatggaccttttgggacagcggtg

SEQ ID NO: 403158 - DNA, 140 bp, Artificial Sequence
  Synthetic
caccgctgtcccaaaaggtccatctatccaattctcccccgcttaatactgacgctctcgcacccatctctctccttctagcctccgctagtcaaaattggcgtactcaccagtcgccgccatatcagcagccagggcct

SEQ ID NO: 403159 - DNA, 140 bp, Artificial Sequence
  Synthetic
atacgccatgctgggtctcccggaacctgtgcctcttcagctaccaccgcttgagagacttagtcttgattgtggcgaggactgtgcaaattctgggacaaagggggtggcagggcctcacgtacttgggagtcggccat

SEQ ID NO: 403160 - DNA, 140 bp, Artificial Sequence
  Synthetic
atggccgactcccaagtacgtgaggccctgccaccccctttgtcccagaatttgcacagtcctcgccacaatcaagactaagtctctcaagcggtggtagctgaagaggcacaggttccgggagacccagcatggcgtat

SEQ ID NO: 403161 - DNA, 140 bp, Artificial Sequence
  Synthetic
atacgccatgctgggtctccctgacataggtaccagcacacaaaagaattgaaggaaatgaacaagtagataaattagtcagtaataaaatcaggaaaatactatttttagataaaataacgtacttgggagtcggccat

SEQ ID NO: 403162 - DNA, 140 bp, Artificial Sequence
  Synthetic
atggccgactcccaagtacgttattttatctaaaaatagtattttcctgattttattactgactaatttatctacttgttcatttccttcaattcttttgtgtgctggtacctatgtcagggagacccagcatggcgtat

SEQ ID NO: 403163 - DNA, 140 bp, Artificial Sequence
  Synthetic
atacgccatgctgggtctccgctattagcctgcttgacaccacagcaatagtagtagccgaggggacagataggatcatagaaattttgcaaagggctggtagagctatcctgaacataccgtacttgggagtcggccat

SEQ ID NO: 403164 - DNA, 140 bp, Artificial Sequence
  Synthetic
atggccgactcccaagtacggtatgttcaggatagctctaccagccctttgcaaaatttctatgatcctatctgtcccctcggctactactattgctgtggtgtcaagcaggctaatagcggagacccagcatggcgtat

SEQ ID NO: 403165 - DNA, 140 bp, Artificial Sequence
  Synthetic
aggccctggctgctgatatgtaggatcatagaaattttgcaaagggctggtagagctatcctgaacatacctgtaagaataagacaaggtttagaaagggctttgctataaaatgggtgggaccttttgggacagcggtg

SEQ ID NO: 403166 - DNA, 140 bp, Artificial Sequence
  Synthetic
caccgctgtcccaaaaggtcccacccattttatagcaaagccctttctaaaccttgtcttattcttacaggtatgttcaggatagctctaccagccctttgcaaaatttctatgatcctacatatcagcagccagggcct

SEQ ID NO: 403167 - DNA, 140 bp, Artificial Sequence
  Synthetic
atacgccatgctgggtctcctaagaagaactcctccaagagaaagacaaaatccaccagcagcagcagcagtaggagtaggagcagtatctcaagatttagctagacatggagcaatcaccgtacttgggagtcggccat

SEQ ID NO: 403168 - DNA, 140 bp, Artificial Sequence
  Synthetic
atggccgactcccaagtacggtgattgctccatgtctagctaaatcttgagatactgctcctactcctactgctgctgctgctggtggattttgtctttctcttggaggagttcttcttaggagacccagcatggcgtat

SEQ ID NO: 403169 - DNA, 140 bp, Artificial Sequence
  Synthetic
atacgccatgctgggtctcccagctttgccataaaatgggaaacaaatggtcaaaaggatggcctgctgtaagggaaagaataagaagagctgagccagcagcagagggagtaggagcagcgtacttgggagtcggccat

SEQ ID NO: 403170 - DNA, 140 bp, Artificial Sequence
  Synthetic
atggccgactcccaagtacgctgctcctactccctctgctgctggctcagctcttcttattctttcccttacagcaggccatccttttgaccatttgtttcccattttatggcaaagctgggagacccagcatggcgtat

SEQ ID NO: 403171 - DNA, 140 bp, Artificial Sequence
  Synthetic
atacgccatgctgggtctcctgagaagggctaggccagccagggaaagaatgagaagtagttcagcagcagaaggagtgggagcagcgtctaaagatttagaaaaatatggggcactcaccgtacttgggagtcggccat

SEQ ID NO: 403172 - DNA, 140 bp, Artificial Sequence
  Synthetic
atggccgactcccaagtacggtgagtgccccatatttttctaaatctttagacgctgctcccactccttctgctgctgaactacttctcattctttccctggctggcctagcccttctcaggagacccagcatggcgtat

SEQ ID NO: 403173 - DNA, 140 bp, Artificial Sequence
  Synthetic
aggccctggctgctgatatgcagtaaaagtaggaggacagctgagagaagctctattagatacaggagcagatgatacagtattagaagatatagatttgccaggaaaatggaaaccaaagaccttttgggacagcggtg

SEQ ID NO: 403174 - DNA, 140 bp, Artificial Sequence
  Synthetic
caccgctgtcccaaaaggtctttggtttccattttcctggcaaatctatatcttctaatactgtatcatctgctcctgtatctaatagagcttctctcagctgtcctcctacttttactgcatatcagcagccagggcct

SEQ ID NO: 403175 - DNA, 140 bp, Artificial Sequence
  Synthetic
atacgccatgctgggtctccataagagaaagagcagaagatagtggcaataagagcgatggagatcaggaagaattctcagcacttgtggtggaaatagggcacgatgctccttagaatgcgtacttgggagtcggccat

SEQ ID NO: 403176 - DNA, 140 bp, Artificial Sequence
  Synthetic
atggccgactcccaagtacgcattctaaggagcatcgtgccctatttccaccacaagtgctgagaattcttcctgatctccatcgctcttattgccactatcttctgctctttctcttatggagacccagcatggcgtat

SEQ ID NO: 403177 - DNA, 140 bp, Artificial Sequence
  Synthetic
aggccctggctgctgatatgaggaagaagcggagacagcgacacagacacagaactcctcaagacagtaaggtgcatcaaaatcctgtaccagagcagtaagtattgttaagtagcatctgaccttttgggacagcggtg

SEQ ID NO: 403178 - DNA, 140 bp, Artificial Sequence
  Synthetic
caccgctgtcccaaaaggtcagatgctacttaacaatacttactgctctggtacaggattttgatgcaccttactgtcttgaggagttctgtgtctgtgtcgctgtctccgcttcttcctcatatcagcagccagggcct

SEQ ID NO: 403179 - DNA, 140 bp, Artificial Sequence
  Synthetic
atacgccatgctgggtctcctgctactaataatagtagttaggaagaggtaaggacagaaataaaaaactgctctttcaatatcacagaaaacataaaaaataaagtgcgaaaaaaatatcgtacttgggagtcggccat

SEQ ID NO: 403180 - DNA, 140 bp, Artificial Sequence
  Synthetic
atggccgactcccaagtacgatatttttttcgcactttattttttatgttttctgtgatattgaaagagcagttttttatttctgtccttacctcttcctaactactattattagtagcaggagacccagcatggcgtat

SEQ ID NO: 403181 - DNA, 140 bp, Artificial Sequence
  Synthetic
atacgccatgctgggtctccatgtacacatggaattaagccagtggtatcaactcaactactgctaaatggcagcaaatcagaaggagatataataattagatctgaaaatatcacaaaccgtacttgggagtcggccat

SEQ ID NO: 403182 - DNA, 140 bp, Artificial Sequence
  Synthetic
atggccgactcccaagtacggtttgtgatattttcagatctaattattatatctccttctgatttgctgccatttagcagtagttgagttgataccactggcttaattccatgtgtacatggagacccagcatggcgtat

SEQ ID NO: 403183 - DNA, 140 bp, Artificial Sequence
  Synthetic
atacgccatgctgggtctccatctgtagtaattaattgtacaagacccaacaacaatacaagaaaaggcatacatataggatgaagaagaacattatatgcaacaggagacataataggacgtacttgggagtcggccat

SEQ ID NO: 403184 - DNA, 140 bp, Artificial Sequence
  Synthetic
atggccgactcccaagtacgtcctattatgtctcctgttgcatataatgttcttcttcatcctatatgtatgccttttcttgtattgttgttgggtcttgtacaattaattactacagatggagacccagcatggcgtat

SEQ ID NO: 403185 - DNA, 140 bp, Artificial Sequence
  Synthetic
atacgccatgctgggtctcctttagaacagatagaaaaaaaattagaggaacaatttaataaaacaatatattttaagcaacaagcccaggaggagacccagaaatcacaatgcacagttcgtacttgggagtcggccat

SEQ ID NO: 403186 - DNA, 140 bp, Artificial Sequence
  Synthetic
atggccgactcccaagtacgaactgtgcattgtgatttctgggtctcctcctgggcttgttgcttaaaatatattgttttattaaattgttcctctaattttttttctatctgttctaaaggagacccagcatggcgtat

SEQ ID NO: 403187 - DNA, 140 bp, Artificial Sequence
  Synthetic
aggccctggctgctgatatgattttaagcaacaagcccaggaggagacccagaaatcacaatgcacagttttaattgtagaggaaaatttttctactgtaatacatcaaagctgtttaatgaccttttgggacagcggtg

SEQ ID NO: 403188 - DNA, 140 bp, Artificial Sequence
  Synthetic
caccgctgtcccaaaaggtcattaaacagctttgatgtattacagtagaaaaattttcctctacaattaaaactgtgcattgtgatttctgggtctcctcctgggcttgttgcttaaaatcatatcagcagccagggcct

SEQ ID NO: 403189 - DNA, 140 bp, Artificial Sequence
  Synthetic
atacgccatgctgggtctccatgtaaaataaaacaaattataaacagatggcaagaagtaagaaaagcaatgtacgcccctcccatcccaagatacattagctgttcatcaaatattacacgtacttgggagtcggccat

SEQ ID NO: 403190 - DNA, 140 bp, Artificial Sequence
  Synthetic
atggccgactcccaagtacgtgtaatatttgatgaacagctaatgtatcttgggatgggaggggcgtacattgcttttcttacttcttgccatctgtttataatttgttttattttacatggagacccagcatggcgtat

SEQ ID NO: 403191 - DNA, 140 bp, Artificial Sequence
  Synthetic
aggccctggctgctgatatgaaagagcagaagacagtggcaatgagagtgatggggatattgaggaattgtcaacaatggtggatatggggcatcttaggcttttggatgttaatgatttgaccttttgggacagcggtg

SEQ ID NO: 403192 - DNA, 140 bp, Artificial Sequence
  Synthetic
caccgctgtcccaaaaggtcaaatcattaacatccaaaagcctaagatgccccatatccaccattgttgacaattcctcaatatccccatcactctcattgccactgtcttctgctctttcatatcagcagccagggcct

SEQ ID NO: 403193 - DNA, 140 bp, Artificial Sequence
  Synthetic
aggccctggctgctgatatgaaagaaaaaatataggataaaacatttagtatgggcaagcagggagctggaaagatttgcacttaaccctggccttttagaaacaggggaaggatgtcaagaccttttgggacagcggtg

SEQ ID NO: 403194 - DNA, 140 bp, Artificial Sequence
  Synthetic
caccgctgtcccaaaaggtcttgacatccttcccctgtttctaaaaggccagggttaagtgcaaatctttccagctccctgcttgcccatactaaatgttttatcctatattttttctttcatatcagcagccagggcct

SEQ ID NO: 403195 - DNA, 140 bp, Artificial Sequence
  Synthetic
atacgccatgctgggtctccaatttcaccagcgctgcagttaaagcagcctgttggtgggccaatgtccaacaggaatttgggatcccctacaatccccaaagtcaaggagtagtagaatcgtacttgggagtcggccat

SEQ ID NO: 403196 - DNA, 140 bp, Artificial Sequence
  Synthetic
atggccgactcccaagtacgattctactactccttgactttggggattgtaggggatcccaaattcctgttggacattggcccaccaacaggctgctttaactgcagcgctggtgaaattggagacccagcatggcgtat

SEQ ID NO: 403197 - DNA, 140 bp, Artificial Sequence
  Synthetic
aggccctggctgctgatatggagtatagattaataaattgtaatacctcaaccataacacaagcctgtccaaaggtctcttttgacccaattcctatacattattgtgctccagctggttgaccttttgggacagcggtg

SEQ ID NO: 403198 - DNA, 140 bp, Artificial Sequence
  Synthetic
caccgctgtcccaaaaggtcaaccagctggagcacaataatgtataggaattgggtcaaaagagacctttggacaggcttgtgttatggttgaggtattacaatttattaatctatactccatatcagcagccagggcct

SEQ ID NO: 403199 - DNA, 140 bp, Artificial Sequence
  Synthetic
aggccctggctgctgatatgaagtgctctttgcaacagagagagtagtaggggatataagaagagcatactgtaatgttagtagcaactggaacagagttttaggtacagtagctgcaaagaccttttgggacagcggtg

SEQ ID NO: 403200 - DNA, 140 bp, Artificial Sequence
  Synthetic
caccgctgtcccaaaaggtctttgcagctactgtacctaaaactctgttccagttgctactaacattacagtatgctcttcttatatcccctactactctctctgttgcaaagagcacttcatatcagcagccagggcct

SEQ ID NO: 403201 - DNA, 140 bp, Artificial Sequence
  Synthetic
atacgccatgctgggtctccttagcactcatctaggacgatctgcggagcctgtgcctcttcagctaccaccgattgagagacttactctcgattgtagcgaaggttgtagaacttctagcgtacttgggagtcggccat

SEQ ID NO: 403202 - DNA, 140 bp, Artificial Sequence
  Synthetic
atggccgactcccaagtacgctagaagttctacaaccttcgctacaatcgagagtaagtctctcaatcggtggtagctgaagaggcacaggctccgcagatcgtcctagatgagtgctaaggagacccagcatggcgtat

SEQ ID NO: 403203 - DNA, 140 bp, Artificial Sequence
  Synthetic
aggccctggctgctgatatgccgattgagagacttactctcgattgtagcgaaggttgtagaacttctaggacgcagaaggtaggaagctctcaaatatctgtagaatctcctacagtatgaccttttgggacagcggtg

SEQ ID NO: 403204 - DNA, 140 bp, Artificial Sequence
  Synthetic
caccgctgtcccaaaaggtcatactgtaggagattctacagatatttgagagcttcctaccttctgcgtcctagaagttctacaaccttcgctacaatcgagagtaagtctctcaatcggcatatcagcagccagggcct

SEQ ID NO: 403205 - DNA, 140 bp, Artificial Sequence
  Synthetic
aggccctggctgctgatatgctgaaagcattagtaacaccaacaagggcaaagccacctttgcctagtgttaggaaattagcagaggatagatggaacaagccccagaagaccaggggccgaccttttgggacagcggtg

SEQ ID NO: 403206 - DNA, 140 bp, Artificial Sequence
  Synthetic
caccgctgtcccaaaaggtcggcccctggtcttctggggcttgttccatctatcctctgctaatttcctaacactaggcaaaggtggctttgcccttgttggtgttactaatgctttcagcatatcagcagccagggcct

SEQ ID NO: 403207 - DNA, 140 bp, Artificial Sequence
  Synthetic
atacgccatgctgggtctcctatagcagtagctaaaggaacagataggattatagaagtagcacagagatttagtagagctattctccacatacctacaagaataagacagggcttagaacgtacttgggagtcggccat

SEQ ID NO: 403208 - DNA, 140 bp, Artificial Sequence
  Synthetic
atggccgactcccaagtacgttctaagccctgtcttattcttgtaggtatgtggagaatagctctactaaatctctgtgctacttctataatcctatctgttcctttagctactgctataggagacccagcatggcgtat

SEQ ID NO: 403209 - DNA, 140 bp, Artificial Sequence
  Synthetic
atacgccatgctgggtctccaaggctttgcaataaaataagtggcaagtggtcaaaacgtagtgtaaataaaaaataggatactataaaaaaaagaataagacgaactaggcctgagccacgtacttgggagtcggccat

SEQ ID NO: 403210 - DNA, 140 bp, Artificial Sequence
  Synthetic
atggccgactcccaagtacgtggctcaggcctagttcgtcttattcttttttttatagtatcctattttttatttacactacgttttgaccacttgccacttattttattgcaaagccttggagacccagcatggcgtat

SEQ ID NO: 403211 - DNA, 140 bp, Artificial Sequence
  Synthetic
aggccctggctgctgatatgattctatgcaacaggagaaataataggaaacataagacaagcacattgtaacattagtaaagataaatggaatgaaactttacaaagggtaggtgaaaaagaccttttgggacagcggtg

SEQ ID NO: 403212 - DNA, 140 bp, Artificial Sequence
  Synthetic
caccgctgtcccaaaaggtctttttcacctaccctttgtaaagtttcattccatttatctttactaatgttacaatgtgcttgtcttatgtttcctattatttctcctgttgcatagaatcatatcagcagccagggcct

SEQ ID NO: 403213 - DNA, 140 bp, Artificial Sequence
  Synthetic
aggccctggctgctgatatgtgtgaataccctgcaggacatagtcaggtagggacactgcaactactagctctaagagtagtagtaggagcaaaaagaagtaagcctcccctacccagtggaccttttgggacagcggtg

SEQ ID NO: 403214 - DNA, 140 bp, Artificial Sequence
  Synthetic
caccgctgtcccaaaaggtccactgggtaggggaggcttacttctttttgctcctactactactcttagagctagtagttgcagtgtccctacctgactatgtcctgcagggtattcacacatatcagcagccagggcct

SEQ ID NO: 403215 - DNA, 140 bp, Artificial Sequence
  Synthetic
aggccctggctgctgatatgtatagtacagaaccttcaggggcaaatggtacatcagtccctatcacctagaactttaaatgcatgggtaaaagtagtagaagagaaggctttcagcccagaccttttgggacagcggtg

SEQ ID NO: 403216 - DNA, 140 bp, Artificial Sequence
  Synthetic
caccgctgtcccaaaaggtctgggctgaaagccttctcttctactacttttacccatgcatttaaagttctaggtgatagggactgatgtaccatttgcccctgaaggttctgtactatacatatcagcagccagggcct

SEQ ID NO: 403217 - DNA, 140 bp, Artificial Sequence
  Synthetic
atacgccatgctgggtctcctactgtaaatgctactggtggggggaatcgtactgaaatggagaaaggagaaataaaaaactgctcttttaatatcaccacaggaataagagataaggtgcgtacttgggagtcggccat

SEQ ID NO: 403218 - DNA, 140 bp, Artificial Sequence
  Synthetic
atggccgactcccaagtacgcaccttatctcttattcctgtggtgatattaaaagagcagttttttatttctcctttctccatttcagtacgattccccccaccagtagcatttacagtaggagacccagcatggcgtat

SEQ ID NO: 403219 - DNA, 140 bp, Artificial Sequence
  Synthetic
atacgccatgctgggtctccgatgaagtaagaaactgttcttttagtatgaccacagaactacaggataggaagcagaagatccaggcacttttttataagcttgatatagtacaaatgacgtacttgggagtcggccat

SEQ ID NO: 403220 - DNA, 140 bp, Artificial Sequence
  Synthetic
atggccgactcccaagtacgtcatttgtactatatcaagcttataaaaaagtgcctggatcttctgcttcctatcctgtagttctgtggtcatactaaaagaacagtttcttacttcatcggagacccagcatggcgtat

SEQ ID NO: 403221 - DNA, 140 bp, Artificial Sequence
  Synthetic
atacgccatgctgggtctcctagtgatattatgaatactaccagtaatgatggagaaatgaaaaattgctctttcaatataaccacagaactaaaagataagaggcagaaggtgtctgcacgtacttgggagtcggccat

SEQ ID NO: 403222 - DNA, 140 bp, Artificial Sequence
  Synthetic
atggccgactcccaagtacgtgcagacaccttctgcctcttatcttttagttctgtggttatattgaaagagcaatttttcatttctccatcattactggtagtattcataatatcactaggagacccagcatggcgtat

SEQ ID NO: 403223 - DNA, 140 bp, Artificial Sequence
  Synthetic
aggccctggctgctgatatggacccagcaacaatacaagaaaaagtatacatatgggacccgggggagcattttatgcaacaggagccatcataggagatataagacaagcacattgtaagaccttttgggacagcggtg

SEQ ID NO: 403224 - DNA, 140 bp, Artificial Sequence
  Synthetic
caccgctgtcccaaaaggtcttacaatgtgcttgtcttatatctcctatgatggctcctgttgcataaaatgctcccccgggtcccatatgtatactttttcttgtattgttgctgggtccatatcagcagccagggcct

SEQ ID NO: 403225 - DNA, 140 bp, Artificial Sequence
  Synthetic
aggccctggctgctgatatgctttcaaccaccctcaggaggagatctagaaattacaacacatcattttaattgtagaggggaatttttctattgcaatacaacactactgtttaataatgaccttttgggacagcggtg

SEQ ID NO: 403226 - DNA, 140 bp, Artificial Sequence
  Synthetic
caccgctgtcccaaaaggtcattattaaacagtagtgttgtattgcaatagaaaaattcccctctacaattaaaatgatgtgttgtaatttctagatctcctcctgagggtggttgaaagcatatcagcagccagggcct

SEQ ID NO: 403227 - DNA, 140 bp, Artificial Sequence
  Synthetic
aggccctggctgctgatatgacaatacatctatgagacttatggagacacttgggaaggagttatggcaattataagaatcttacaacaactactgtttacccattatagaattggatgcgaccttttgggacagcggtg

SEQ ID NO: 403228 - DNA, 140 bp, Artificial Sequence
  Synthetic
caccgctgtcccaaaaggtcgcatccaattctataatgggtaaacagtagttgttgtaagattcttataattgccataactccttcccaagtgtctccataagtctcatagatgtattgtcatatcagcagccagggcct

SEQ ID NO: 403229 - DNA, 140 bp, Artificial Sequence
  Synthetic
atacgccatgctgggtctccatataaaaaactgctctttcaatatcaccccaacagtgagagataaaatgaagaaagaatatgcattttttaataaccttgatatagtaccaataaatgacgtacttgggagtcggccat

SEQ ID NO: 403230 - DNA, 140 bp, Artificial Sequence
  Synthetic
atggccgactcccaagtacgtcatttattggtactatatcaaggttattaaaaaatgcatattctttcttcattttatctctcactgttggggtgatattgaaagagcagttttttatatggagacccagcatggcgtat

SEQ ID NO: 403231 - DNA, 140 bp, Artificial Sequence
  Synthetic
atacgccatgctgggtctccgaaaaattgctctttcaatgtaaccacagaattaagagataagaagcacaaccagtatgcacttttttatagacttgatataataccacttaatgaggatcgtacttgggagtcggccat

SEQ ID NO: 403232 - DNA, 140 bp, Artificial Sequence
  Synthetic
atggccgactcccaagtacgatcctcattaagtggtattatatcaagtctataaaaaagtgcatactggttgtgcttcttatctcttaattctgtggttacattgaaagagcaatttttcggagacccagcatggcgtat

SEQ ID NO: 403233 - DNA, 140 bp, Artificial Sequence
  Synthetic
atacgccatgctgggtctccatacaagaaaaagcatacatctcgggccaggacaaacattctatgcaacaggtgacataataggggatataagacaagcacattgtaatgtcagtagaaacgtacttgggagtcggccat

SEQ ID NO: 403234 - DNA, 140 bp, Artificial Sequence
  Synthetic
atggccgactcccaagtacgtttctactgacattacaatgtgcttgtcttatatcccctattatgtcacctgttgcatagaatgtttgtcctggcccgagatgtatgctttttcttgtatggagacccagcatggcgtat

SEQ ID NO: 403235 - DNA, 140 bp, Artificial Sequence
  Synthetic
aggccctggctgctgatatgggtgacataataggggatataagacaagcacattgtaatgtcagtagaaaccaatggatgacaactttacaaagggtagctcgacaattaaggaagcactgaccttttgggacagcggtg

SEQ ID NO: 403236 - DNA, 140 bp, Artificial Sequence
  Synthetic
caccgctgtcccaaaaggtcagtgcttccttaattgtcgagctaccctttgtaaagttgtcatccattggtttctactgacattacaatgtgcttgtcttatatcccctattatgtcacccatatcagcagccagggcct

SEQ ID NO: 403237 - DNA, 140 bp, Artificial Sequence
  Synthetic
atacgccatgctgggtctcccaagtgtaaggataggaccaggacaagcgttctatgcaacaaatgatataataggagacataagacaagcacattgtaacattagcgcaaaggactggaacgtacttgggagtcggccat

SEQ ID NO: 403238 - DNA, 140 bp, Artificial Sequence
  Synthetic
atggccgactcccaagtacgttccagtcctttgcgctaatgttacaatgtgcttgtcttatgtctcctattatatcatttgttgcatagaacgcttgtcctggtcctatccttacacttgggagacccagcatggcgtat

SEQ ID NO: 403239 - DNA, 140 bp, Artificial Sequence
  Synthetic
aggccctggctgctgatatggaaattacaacacatagctttaattgtgcaggagaatttttctattgcaatacatcaggactgtttaatagtacttggaatgacactagtacttggaatggaccttttgggacagcggtg

SEQ ID NO: 403240 - DNA, 140 bp, Artificial Sequence
  Synthetic
caccgctgtcccaaaaggtccattccaagtactagtgtcattccaagtactattaaacagtcctgatgtattgcaatagaaaaattctcctgcacaattaaagctatgtgttgtaatttccatatcagcagccagggcct

SEQ ID NO: 403241 - DNA, 140 bp, Artificial Sequence
  Synthetic
atacgccatgctgggtctcccaaattataaatatgtggcagagagtagagcgagcaatgtatgcccctcccatccgaggagacataaaatgtgcatcaaacattactggactactactaacgtacttgggagtcggccat

SEQ ID NO: 403242 - DNA, 140 bp, Artificial Sequence
  Synthetic
atggccgactcccaagtacgttagtagtagtccagtaatgtttgatgcacattttatgtctcctcggatgggaggggcatacattgctcgctctactctctgccacatatttataatttgggagacccagcatggcgtat

SEQ ID NO: 403243 - DNA, 140 bp, Artificial Sequence
  Synthetic
aggccctggctgctgatatgtgcaaatgttaaaagataccatcaatgaggaagctgcagaatgggacagattacatccagtgcatgcagggcctattgcaccaggccagatgagagaaccgaccttttgggacagcggtg

SEQ ID NO: 403244 - DNA, 140 bp, Artificial Sequence
  Synthetic
caccgctgtcccaaaaggtcggttctctcatctggcctggtgcaataggccctgcatgcactggatgtaatctgtcccattctgcagcttcctcattgatggtatcttttaacatttgcacatatcagcagccagggcct

SEQ ID NO: 403245 - DNA, 140 bp, Artificial Sequence
  Synthetic
aggccctggctgctgatatgtattctccacatacccacaagaataagacaaggcttcgaaaggcttttactataaaatgggtggcaagtggtcaaaaagtagtatgattggatggcctaagaccttttgggacagcggtg

SEQ ID NO: 403246 - DNA, 140 bp, Artificial Sequence
  Synthetic
caccgctgtcccaaaaggtcttaggccatccaatcatactactttttgaccacttgccacccattttatagtaaaagcctttcgaagccttgtcttattcttgtgggtatgtggagaatacatatcagcagccagggcct

SEQ ID NO: 403247 - DNA, 140 bp, Artificial Sequence
  Synthetic
aggccctggctgctgatatggatggggtgggagcagcatctcgagacctggaaagacatggagcaatcacaagtagcaatacagcagctactaatgctgattgtgcctggctagaagcacgaccttttgggacagcggtg

SEQ ID NO: 403248 - DNA, 140 bp, Artificial Sequence
  Synthetic
caccgctgtcccaaaaggtcgtgcttctagccaggcacaatcagcattagtagctgctgtattgctacttgtgattgctccatgtctttccaggtctcgagatgctgctcccaccccatccatatcagcagccagggcct

SEQ ID NO: 403249 - DNA, 140 bp, Artificial Sequence
  Synthetic
aggccctggctgctgatatgatatgggataacatgacctggctgcaatgggataaagaaattagcaactacacagacataatatattctctaattgaagaatcgcaaaaccagcaggaaagaccttttgggacagcggtg

SEQ ID NO: 403250 - DNA, 140 bp, Artificial Sequence
  Synthetic
caccgctgtcccaaaaggtctttcctgctggttttgcgattcttcaattagagaatatattatgtctgtgtagttgctaatttctttatcccattgcagccaggtcatgttatcccatatcatatcagcagccagggcct

SEQ ID NO: 403251 - DNA, 140 bp, Artificial Sequence
  Synthetic
  misc_feature (24)..(24): n is a, c, g, or t
  misc_feature (82)..(82): n is a, c, g, or t
  misc_feature (85)..(85): n is a, c, g, or t
atacgccatgctgggtctccacancagtcaagtcagtcaaaattatcctatagtgcagaacatgcaagggcaaccagtacancangccctatcacctagaactttaaatgcatgggtaaacgtacttgggagtcggccat

SEQ ID NO: 403252 - DNA, 140 bp, Artificial Sequence
  Synthetic
  misc_feature (56)..(56): n is a, c, g, or t
  misc_feature (59)..(59): n is a, c, g, or t
  misc_feature (117)..(117): n is a, c, g, or t
atggccgactcccaagtacgtttacccatgcatttaaagttctaggtgatagggcntgntgtactggttgcccttgcatgttctgcactataggataattttgactgacttgactgntgtggagacccagcatggcgtat

SEQ ID NO: 403253 - DNA, 140 bp, Artificial Sequence
  Synthetic
atacgccatgctgggtctccgtctcctatcctactggggtcaggaactaaagaagagtgctattagtttgcttgatacaattgcaatagcagtagctaactggacagatagagttatagacgtacttgggagtcggccat

SEQ ID NO: 403254 - DNA, 140 bp, Artificial Sequence
  Synthetic
atggccgactcccaagtacgtctataactctatctgtccagttagctactgctattgcaattgtatcaagcaaactaatagcactcttctttagttcctgaccccagtaggataggagacggagacccagcatggcgtat

SEQ ID NO: 403255 - DNA, 140 bp, Artificial Sequence
  Synthetic
  misc_feature (105)..(105): n is a, c, g, or t
aggccctggctgctgatatgcttgatacaattgcaatagcagtagctaactggacagatagagttatagaactagggcaagcagctggtagagctgtcctccacntacctagaagaataagaccttttgggacagcggtg

SEQ ID NO: 403256 - DNA, 140 bp, Artificial Sequence
  Synthetic
  misc_feature (36)..(36): n is a, c, g, or t
caccgctgtcccaaaaggtcttattcttctaggtangtggaggacagctctaccagctgcttgccctagttctataactctatctgtccagttagctactgctattgcaattgtatcaagcatatcagcagccagggcct

SEQ ID NO: 403257 - DNA, 140 bp, Artificial Sequence
  Synthetic
aggccctggctgctgatatgatggggagcaaatggtcaaaaagcagcatagttggatggcctgctgtaagggaaagaatgagaagaactagagctgaaccagcagcagaaggagtaggaggaccttttgggacagcggtg

SEQ ID NO: 403258 - DNA, 140 bp, Artificial Sequence
  Synthetic
caccgctgtcccaaaaggtcctcctactccttctgctgctggttcagctctagttcttctcattctttcccttacagcaggccatccaactatgctgctttttgaccatttgctccccatcatatcagcagccagggcct

SEQ ID NO: 403259 - DNA, 140 bp, Artificial Sequence
  Synthetic
atacgccatgctgggtctccaaaactcatctgcaccactactgtgccttggaacactacttggagtaatagatctcatgatgacatttggggaaacatgacctggatacaatgggagaggcgtacttgggagtcggccat

SEQ ID NO: 403260 - DNA, 140 bp, Artificial Sequence
  Synthetic
atggccgactcccaagtacgcctctcccattgtatccaggtcatgtttccccaaatgtcatcatgagatctattactccaagtagtgttccaaggcacagtagtggtgcagatgagttttggagacccagcatggcgtat

SEQ ID NO: 403261 - DNA, 140 bp, Artificial Sequence
  Synthetic
atacgccatgctgggtctccaataagaatgttgcaacaactatagtgtatatagaatatagaaaaatattacaacaaaggagaatagacagattaattgatagaataagagaaagagcagcgtacttgggagtcggccat

SEQ ID NO: 403262 - DNA, 140 bp, Artificial Sequence
  Synthetic
atggccgactcccaagtacgctgctctttctcttattctatcaattaatctgtctattctcctttgttgtaatatttttctatattctatatacactatagttgttgcaacattcttattggagacccagcatggcgtat

SEQ ID NO: 403263 - DNA, 140 bp, Artificial Sequence
  Synthetic
atacgccatgctgggtctcctcgactgctacccctagtaccagtagggaggaggtaggagtgaaaaactgctctttctataaccccacaagtacaaaaaaagaggagaagaaagaatatgcgtacttgggagtcggccat

SEQ ID NO: 403264 - DNA, 140 bp, Artificial Sequence
  Synthetic
atggccgactcccaagtacgcatattctttcttctcctctttttttgtacttgtggggttatagaaagagcagtttttcactcctacctcctccctactggtactaggggtagcagtcgaggagacccagcatggcgtat

SEQ ID NO: 403265 - DNA, 140 bp, Artificial Sequence
  Synthetic
aggccctggctgctgatatgaacctttaattcatcggcaggaggggacctagaaattacaacacatagttttaattgtggaggagaatttttctattgtaatacatcaaaactgtttaatgaccttttgggacagcggtg

SEQ ID NO: 403266 - DNA, 140 bp, Artificial Sequence
  Synthetic
caccgctgtcccaaaaggtcattaaacagttttgatgtattacaatagaaaaattctcctccacaattaaaactatgtgttgtaatttctaggtcccctcctgccgatgaattaaaggttcatatcagcagccagggcct

SEQ ID NO: 403267 - DNA, 140 bp, Artificial Sequence
  Synthetic
atacgccatgctgggtctccaatacattagaaaaggtaaatggcaaagttagggtcttatttcaaaataatacaacaataaattttaccttatctgcaggaggggacccagaaattacaacgtacttgggagtcggccat

SEQ ID NO: 403268 - DNA, 140 bp, Artificial Sequence
  Synthetic
atggccgactcccaagtacgttgtaatttctgggtcccctcctgcagataaggtaaaatttattgttgtattattttgaaataagaccctaactttgccatttaccttttctaatgtattggagacccagcatggcgtat

SEQ ID NO: 403269 - DNA, 140 bp, Artificial Sequence
  Synthetic
aggccctggctgctgatatgtacaacaataaattttaccttatctgcaggaggggacccagaaattacaatgcacagttttaattgtggaggggaatttttctactgcaatacaacaaaggaccttttgggacagcggtg

SEQ ID NO: 403270 - DNA, 140 bp, Artificial Sequence
  Synthetic
caccgctgtcccaaaaggtcctttgttgtattgcagtagaaaaattcccctccacaattaaaactgtgcattgtaatttctgggtcccctcctgcagataaggtaaaatttattgttgtacatatcagcagccagggcct

SEQ ID NO: 403271 - DNA, 140 bp, Artificial Sequence
  Synthetic
  misc_feature (53)..(53): n is a, c, g, or t
aggccctggctgctgatatggaagaaggaggtggagagcaaggcagaaccagntcgattcgattagtgaacggattctttgcacttgcctgggaagatctgcggaacctgtgcctcttcagaccttttgggacagcggtg

SEQ ID NO: 403272 - DNA, 140 bp, Artificial Sequence
  Synthetic
  misc_feature (88)..(88): n is a, c, g, or t
caccgctgtcccaaaaggtctgaagaggcacaggttccgcagatcttcccaggcaagtgcaaagaatccgttcactaatcgaatcganctggttctgccttgctctccacctccttcttccatatcagcagccagggcct

SEQ ID NO: 403273 - DNA, 140 bp, Artificial Sequence
  Synthetic
aggccctggctgctgatatgataagacagggcttagaaagggctttgctataaaatgggtggcaaatggtcaaaatgcagtagggggggatggaatgttataagggaacgaatgagacgagaccttttgggacagcggtg

SEQ ID NO: 403274 - DNA, 140 bp, Artificial Sequence
  Synthetic
caccgctgtcccaaaaggtctcgtctcattcgttcccttataacattccatccccccctactgcattttgaccatttgccacccattttatagcaaagccctttctaagccctgtcttatcatatcagcagccagggcct

SEQ ID NO: 403275 - DNA, 140 bp, Artificial Sequence
  Synthetic
  misc_feature (114)..(114): n is a, c, g, or t
atacgccatgctgggtctccgggaaagagacgagataagggaagacatctagtatgggcaagcagggagctagagcgattcgcagttaatcctggcctcttagaaacagcaganggctgtcgtacttgggagtcggccat

SEQ ID NO: 403276 - DNA, 140 bp, Artificial Sequence
  Synthetic
  misc_feature (27)..(27): n is a, c, g, or t
atggccgactcccaagtacgacagccntctgctgtttctaagaggccaggattaactgcgaatcgctctagctccctgcttgcccatactagatgtcttcccttatctcgtctctttcccggagacccagcatggcgtat

SEQ ID NO: 403277 - DNA, 140 bp, Artificial Sequence
  Synthetic
aggccctggctgctgatatgagcattggacagttggaaaaatttgtggaattggtttgacataacaaattggctgtggtatataaaaatattcataatgatagtaggaggcttgataggtgaccttttgggacagcggtg

SEQ ID NO: 403278 - DNA, 140 bp, Artificial Sequence
  Synthetic
caccgctgtcccaaaaggtcacctatcaagcctcctactatcattatgaatatttttatataccacagccaatttgttatgtcaaaccaattccacaaatttttccaactgtccaatgctcatatcagcagccagggcct

SEQ ID NO: 403279 - DNA, 140 bp, Artificial Sequence
  Synthetic
  misc_feature (105)..(105): n is a, c, g, or t
  misc_feature (107)..(107): n is a, c, g, or t
  misc_feature (109)..(109): n is a, c, g, or t
  misc_feature (113)..(113): n is a, c, g, or t
aggccctggctgctgatatgatataatagtacaccttaatgtatctgtacagattaattgtacaagaccctacaacaatacaagaaaaagtatacatataaaacntntnggancagggaggaccttttgggacagcggtg

SEQ ID NO: 403280 - DNA, 140 bp, Artificial Sequence
  Synthetic
  misc_feature (28)..(28): n is a, c, g, or t
  misc_feature (32)..(32): n is a, c, g, or t
  misc_feature (34)..(34): n is a, c, g, or t
  misc_feature (36)..(36): n is a, c, g, or t
caccgctgtcccaaaaggtcctccctgntccnanangttttatatgtatactttttcttgtattgttgtagggtcttgtacaattaatctgtacagatacattaaggtgtactattatatcatatcagcagccagggcct

SEQ ID NO: 403281 - DNA, 140 bp, Artificial Sequence
  Synthetic
aggccctggctgctgatatgtgggaaaaaattcggttaaggccagggggaaagaaaaaatataaattaaaacatatagtatgggcaagcagggagctagaacgatttgcagttaatcctggaccttttgggacagcggtg

SEQ ID NO: 403282 - DNA, 140 bp, Artificial Sequence
  Synthetic
caccgctgtcccaaaaggtccaggattaactgcaaatcgttctagctccctgcttgcccatactatatgttttaatttatattttttctttccccctggccttaaccgaattttttcccacatatcagcagccagggcct

SEQ ID NO: 403283 - DNA, 140 bp, Artificial Sequence
  Synthetic
atacgccatgctgggtctcctaagtagtcaatgggggatgtaatgatagatttactaacaaaagtagattatagattaggagtaggagcattcatagtagcactaatcatagcaatagttcgtacttgggagtcggccat

SEQ ID NO: 403284 - DNA, 140 bp, Artificial Sequence
  Synthetic
atggccgactcccaagtacgaactattgctatgattagtgctactatgaatgctcctactcctaatctataatctacttttgttagtaaatctatcattacatcccccattgactacttaggagacccagcatggcgtat

SEQ ID NO: 403285 - DNA, 140 bp, Artificial Sequence
  Synthetic
atacgccatgctgggtctcctaaccccactctgtgttactttaaattgcactgataagttggagactataaattgcactaattgtaataaagccaatggtagtagcgggagagagaagaacgtacttgggagtcggccat

SEQ ID NO: 403286 - DNA, 140 bp, Artificial Sequence
  Synthetic
atggccgactcccaagtacgttcttctctctcccgctactaccattggctttattacaattagtgcaatttatagtctccaacttatcagtgcaatttaaagtaacacagagtggggttaggagacccagcatggcgtat

SEQ ID NO: 403287 - DNA, 140 bp, Artificial Sequence
  Synthetic
atacgccatgctgggtctccgataagaatgtcactagtatcactgggggtaacgaaacaaaattagaaatgaaagaagaaataaaaaactgctctttcaatatcaccacaaacataagagcgtacttgggagtcggccat

SEQ ID NO: 403288 - DNA, 140 bp, Artificial Sequence
  Synthetic
atggccgactcccaagtacgctcttatgtttgtggtgatattgaaagagcagttttttatttcttctttcatttctaattttgtttcgttacccccagtgatactagtgacattcttatcggagacccagcatggcgtat

SEQ ID NO: 403289 - DNA, 140 bp, Artificial Sequence
  Synthetic
atacgccatgctgggtctcccatataataatggtacgaatagtactgatactatgaaaatttgttctttcaatgcaaccacagaactaagagataagaaaaagaaggagtatgcacttttcgtacttgggagtcggccat

SEQ ID NO: 403290 - DNA, 140 bp, Artificial Sequence
  Synthetic
atggccgactcccaagtacgaaaagtgcatactccttctttttcttatctcttagttctgtggttgcattgaaagaacaaattttcatagtatcagtactattcgtaccattattatatgggagacccagcatggcgtat

SEQ ID NO: 403291 - DNA, 140 bp, Artificial Sequence
  Synthetic
atacgccatgctgggtctccatttaatggaacaggcacatgcagcaacataacagtagttacttgtacacatggtatcagaccaacaataagtactcagctactattaaatgggacactccgtacttgggagtcggccat

SEQ ID NO: 403292 - DNA, 140 bp, Artificial Sequence
  Synthetic
atggccgactcccaagtacggagtgtcccatttaatagtagctgagtacttattgttggtctgataccatgtgtacaagtaactactgttatgttgctgcatgtgcctgttccattaaatggagacccagcatggcgtat

SEQ ID NO: 403293 - DNA, 140 bp, Artificial Sequence
  Synthetic
atacgccatgctgggtctccaagagaaagagcagaagacagtggaaatgagagtgagggggataaagaggagttggccacacttatggacatggtggactttgattcttgggttggtgatcgtacttgggagtcggccat

SEQ ID NO: 403294 - DNA, 140 bp, Artificial Sequence
  Synthetic
atggccgactcccaagtacgatcaccaacccaagaatcaaagtccaccatgtccataagtgtggccaactcctctttatccccctcactctcatttccactgtcttctgctctttctcttggagacccagcatggcgtat

SEQ ID NO: 403295 - DNA, 140 bp, Artificial Sequence
  Synthetic
atacgccatgctgggtctccattggagatgaagtaagaaactgttcttttaatgtgaccacagaactaagggataagaagcaggaggtccatgcacttttttatgtgcctgatatagtaccgtacttgggagtcggccat

SEQ ID NO: 403296 - DNA, 140 bp, Artificial Sequence
  Synthetic
atggccgactcccaagtacggtactatatcaggcacataaaaaagtgcatggacctcctgcttcttatcccttagttctgtggtcacattaaaagaacagtttcttacttcatctccaatggagacccagcatggcgtat

SEQ ID NO: 403297 - DNA, 140 bp, Artificial Sequence
  Synthetic
aggccctggctgctgatatgaaaaactactctattctgtgcatcagatgctaaagcatatgagagagaagtgcataatgtctgggctacacatgcctgtgtacccacagaccccaacccagaccttttgggacagcggtg

SEQ ID NO: 403298 - DNA, 140 bp, Artificial Sequence
  Synthetic
caccgctgtcccaaaaggtctgggttggggtctgtgggtacacaggcatgtgtagcccagacattatgcacttctctctcatatgctttagcatctgatgcacagaatagagtagtttttcatatcagcagccagggcct

SEQ ID NO: 403299 - DNA, 140 bp, Artificial Sequence
  Synthetic
aggccctggctgctgatatgctgtatggaaagatgcagagaccaccctattttgcgcatcagatgctagagcatatgatacagaggtacataatgtctgggccacacatgcctgtgtaccgaccttttgggacagcggtg

SEQ ID NO: 403300 - DNA, 140 bp, Artificial Sequence
  Synthetic
caccgctgtcccaaaaggtcggtacacaggcatgtgtggcccagacattatgtacctctgtatcatatgctctagcatctgatgcgcaaaatagggtggtctctgcatctttccatacagcatatcagcagccagggcct

SEQ ID NO: 403301 - DNA, 140 bp, Artificial Sequence
  Synthetic
atacgccatgctgggtctccacctaacaataatacaagaagaggtatacatatgggaccagggaaattttatgcaacaggagacataataggagatataaggcaagcacattgtaaccttcgtacttgggagtcggccat

SEQ ID NO: 403302 - DNA, 140 bp, Artificial Sequence
  Synthetic
atggccgactcccaagtacgaaggttacaatgtgcttgccttatatctcctattatgtctcctgttgcataaaatttccctggtcccatatgtatacctcttcttgtattattgttaggtggagacccagcatggcgtat

SEQ ID NO: 403303 - DNA, 140 bp, Artificial Sequence
  Synthetic
aggccctggctgctgatatgaaaaatgagaccctaaatgggatgagaaattgctctttcaatgcaaccacagtagtaaaagataggaaacagaaagtggatgcacttttttatagacttggaccttttgggacagcggtg

SEQ ID NO: 403304 - DNA, 140 bp, Artificial Sequence
  Synthetic
caccgctgtcccaaaaggtccaagtctataaaaaagtgcatccactttctgtttcctatcttttactactgtggttgcattgaaagagcaatttctcatcccatttagggtctcatttttcatatcagcagccagggcct

SEQ ID NO: 403305 - DNA, 140 bp, Artificial Sequence
  Synthetic
aggccctggctgctgatatgtcctcaggaggggaccctgaaattgtaactcacagttttatttgtggaggggagtttttctactgtaatacaacacagctgtttaatagtacttggtattgaccttttgggacagcggtg

SEQ ID NO: 403306 - DNA, 140 bp, Artificial Sequence
  Synthetic
caccgctgtcccaaaaggtcaataccaagtactattaaacagctgtgttgtattacagtagaaaaactcccctccacaaataaaactgtgagttacaatttcagggtcccctcctgaggacatatcagcagccagggcct

SEQ ID NO: 403307 - DNA, 140 bp, Artificial Sequence
  Synthetic
atacgccatgctgggtctcctctaaaggaaaattaaggattatgggaaaaaatatttcggacagtgcacaaactatcatagtgaccctaaattcttccataagcatgacctgtaaaagaccgtacttgggagtcggccat

SEQ ID NO: 403308 - DNA, 140 bp, Artificial Sequence
  Synthetic
atggccgactcccaagtacggtcttttacaggtcatgcttatggaagaatttagggtcactatgatagtttgtgcactgtccgaaatattttttcccataatccttaattttcctttagaggagacccagcatggcgtat

SEQ ID NO: 403309 - DNA, 140 bp, Artificial Sequence
  Synthetic
aggccctggctgctgatatgaggaccaggacaagtattctataaaacaggaagcataacaggagacataagaaaagcatattgtgagattaatggaacaaaatggaatgaaactttaaaagaccttttgggacagcggtg

SEQ ID NO: 403310 - DNA, 140 bp, Artificial Sequence
  Synthetic
caccgctgtcccaaaaggtcttttaaagtttcattccattttgttccattaatctcacaatatgcttttcttatgtctcctgttatgcttcctgttttatagaatacttgtcctggtcctcatatcagcagccagggcct

SEQ ID NO: 403311 - DNA, 140 bp, Artificial Sequence
  Synthetic
atacgccatgctgggtctccatttgtaatgtggtgggaaacttgtgggtcacagtctattatggggtacctgtgtggaaagaagcaaaaactactctattctgtgcatcagatgctaaagcgtacttgggagtcggccat

SEQ ID NO: 403312 - DNA, 140 bp, Artificial Sequence
  Synthetic
atggccgactcccaagtacgctttagcatctgatgcacagaatagagtagtttttgcttctttccacacaggtaccccataatagactgtgacccacaagtttcccaccacattacaaatggagacccagcatggcgtat

SEQ ID NO: 403313 - DNA, 140 bp, Artificial Sequence
  Synthetic
aggccctggctgctgatatggtatgtataagacccaacaataatacaaggaaaagtataaggataggaccaggacaaacattctatgcacatggacaaataataggaaacataagagaaggaccttttgggacagcggtg

SEQ ID NO: 403314 - DNA, 140 bp, Artificial Sequence
  Synthetic
caccgctgtcccaaaaggtccttctcttatgtttcctattatttgtccatgtgcatagaatgtttgtcctggtcctatccttatacttttccttgtattattgttgggtcttatacataccatatcagcagccagggcct

SEQ ID NO: 403315 - DNA, 140 bp, Artificial Sequence
  Synthetic
atacgccatgctgggtctcctatcacacttccatgcaggataaagcaagttgtaaacatgtggcaggaagtaggaaaagcaatgtatgctcctcccatcagtgaagcagttaattgtgtacgtacttgggagtcggccat

SEQ ID NO: 403316 - DNA, 140 bp, Artificial Sequence
  Synthetic
atggccgactcccaagtacgtacacaattaactgcttcactgatgggaggagcatacattgcttttcctacttcctgccacatgtttacaacttgctttatcctgcatggaagtgtgataggagacccagcatggcgtat

SEQ ID NO: 403317 - DNA, 140 bp, Artificial Sequence
  Synthetic
atacgccatgctgggtctccgtcactttaaattgtactaatgttgacattaagggtaatgttaccttcaataacacagatataaaaatgaaaaattgctctttcagtgtaaccacagaaccgtacttgggagtcggccat

SEQ ID NO: 403318 - DNA, 140 bp, Artificial Sequence
  Synthetic
atggccgactcccaagtacggttctgtggttacactgaaagagcaatttttcatttttatatctgtgttattgaaggtaacattacccttaatgtcaacattagtacaatttaaagtgacggagacccagcatggcgtat

SEQ ID NO: 403319 - DNA, 140 bp, Artificial Sequence
  Synthetic
atacgccatgctgggtctcctgagaccttcagacctggaggaggaaatatgaaggacaattggagaagtgaattatataaatataaagtagtacaaattgaaccactaggaatagcaccccgtacttgggagtcggccat

SEQ ID NO: 403320 - DNA, 140 bp, Artificial Sequence
  Synthetic
atggccgactcccaagtacggggtgctattcctagtggttcaatttgtactactttatatttatataattcacttctccaattgtccttcatatttcctcctccaggtctgaaggtctcaggagacccagcatggcgtat

SEQ ID NO: 403321 - DNA, 140 bp, Artificial Sequence
  Synthetic
aggccctggctgctgatatggacaaaaatcttagaaccctttagaacaaaaaatccagacatagttatctaccagtacatggatgatttgtatgtagggtctgacttagaaatagggcaggaccttttgggacagcggtg

SEQ ID NO: 403322 - DNA, 140 bp, Artificial Sequence
  Synthetic
caccgctgtcccaaaaggtcctgccctatttctaagtcagaccctacatacaaatcatccatgtactggtagataactatgtctggattttttgttctaaagggttctaagatttttgtccatatcagcagccagggcct

SEQ ID NO: 403323 - DNA, 140 bp, Artificial Sequence
  Synthetic
atacgccatgctgggtctcccataacttctgaaccatacccaggaggggacgtagaagttacaacacatatttttaattgtagaggagaatttttctattgtaatacatcagggctgtttcgtacttgggagtcggccat

SEQ ID NO: 403324 - DNA, 140 bp, Artificial Sequence
  Synthetic
atggccgactcccaagtacgaaacagccctgatgtattacaatagaaaaattctcctctacaattaaaaatatgtgttgtaacttctacgtcccctcctgggtatggttcagaagttatgggagacccagcatggcgtat

SEQ ID NO: 403325 - DNA, 140 bp, Artificial Sequence
  Synthetic
atacgccatgctgggtctccaaaattagaagaacacttccctaacaaaacaatacaatttgagccatcttcaggaggagatctagaagttacaacacatagctttaattgtagaggagaacgtacttgggagtcggccat

SEQ ID NO: 403326 - DNA, 140 bp, Artificial Sequence
  Synthetic
atggccgactcccaagtacgttctcctctacaattaaagctatgtgttgtaacttctagatctcctcctgaagatggctcaaattgtattgttttgttagggaagtgttcttctaattttggagacccagcatggcgtat

SEQ ID NO: 403327 - DNA, 140 bp, Artificial Sequence
  Synthetic
aggccctggctgctgatatgtttgctgtgctttctatagtaaatagagttaggcagggatactcacctttgtcattccagacccttacccaccaccagagggaacccgacaggcccgaaagaccttttgggacagcggtg

SEQ ID NO: 403328 - DNA, 140 bp, Artificial Sequence
  Synthetic
caccgctgtcccaaaaggtctttcgggcctgtcgggttccctctggtggtgggtaagggtctggaatgacaaaggtgagtatccctgcctaactctatttactatagaaagcacagcaaacatatcagcagccagggcct

SEQ ID NO: 403329 - DNA, 140 bp, Artificial Sequence
  Synthetic
aggccctggctgctgatatgtggaacttctgggacacagcagtctcaagggactgagacgggggtgggagggcctcaaatatctggggaatcttctgtcatattggggtcaggaactaaagaccttttgggacagcggtg

SEQ ID NO: 403330 - DNA, 140 bp, Artificial Sequence
  Synthetic
caccgctgtcccaaaaggtctttagttcctgaccccaatatgacagaagattccccagatatttgaggccctcccacccccgtctcagtcccttgagactgctgtgtcccagaagttccacatatcagcagccagggcct

SEQ ID NO: 403331 - DNA, 140 bp, Artificial Sequence
  Synthetic
aggccctggctgctgatatgtggggagcaaatggtcaaaatgcagtccagtgggatggcctgctgtaatagaaagaatgaggagaactgagccagcagcagagggagtaggagcagcgtcgaccttttgggacagcggtg

SEQ ID NO: 403332 - DNA, 140 bp, Artificial Sequence
  Synthetic
caccgctgtcccaaaaggtcgacgctgctcctactccctctgctgctggctcagttctcctcattctttctattacagcaggccatcccactggactgcattttgaccatttgctccccacatatcagcagccagggcct

SEQ ID NO: 403333 - DNA, 140 bp, Artificial Sequence
  Synthetic
aggccctggctgctgatatggcctattagaaacatcagaaggctgtcgaaaaataataggacagctacaaccatcccttcagacaggatcagaagagcttagatcattatataatacaatgaccttttgggacagcggtg

SEQ ID NO: 403334 - DNA, 140 bp, Artificial Sequence
  Synthetic
caccgctgtcccaaaaggtcattgtattatataatgatctaagctcttctgatcctgtctgaagggatggttgtagctgtcctattatttttcgacagccttctgatgtttctaataggccatatcagcagccagggcct

SEQ ID NO: 403335 - DNA, 140 bp, Artificial Sequence
  Synthetic
aggccctggctgctgatatgggcgcaacagcatatgttgcaactcacagtctggggcattaagcagctccagacaagagtcttggctatagaaagatacctaaaggatcaacagctcctagaccttttgggacagcggtg

SEQ ID NO: 403336 - DNA, 140 bp, Artificial Sequence
  Synthetic
caccgctgtcccaaaaggtctaggagctgttgatcctttaggtatctttctatagccaagactcttgtctggagctgcttaatgccccagactgtgagttgcaacatatgctgttgcgcccatatcagcagccagggcct

SEQ ID NO: 403337 - DNA, 140 bp, Artificial Sequence
  Synthetic
aggccctggctgctgatatgcctggatgcagtgggatagagaaattagtaattacacagacacaatatacaggttgcttgaagactcgcaaaaccagcaggagaaaaatgaaaaagatttgaccttttgggacagcggtg

SEQ ID NO: 403338 - DNA, 140 bp, Artificial Sequence
  Synthetic
caccgctgtcccaaaaggtcaaatctttttcatttttctcctgctggttttgcgagtcttcaagcaacctgtatattgtgtctgtgtaattactaatttctctatcccactgcatccaggcatatcagcagccagggcct

SEQ ID NO: 403339 - DNA, 140 bp, Artificial Sequence
  Synthetic
aggccctggctgctgatatgaatagagttaggcagggatactcacctgtgtcattgcagacccgtatcccaaacccaacgggagccgacaggcccggagaaatagaagaaggaggtggaggaccttttgggacagcggtg

SEQ ID NO: 403340 - DNA, 140 bp, Artificial Sequence
  Synthetic
caccgctgtcccaaaaggtcctccacctccttcttctatttctccgggcctgtcggctcccgttgggtttgggatacgggtctgcaatgacacaggtgagtatccctgcctaactctattcatatcagcagccagggcct

SEQ ID NO: 403341 - DNA, 140 bp, Artificial Sequence
  Synthetic
atacgccatgctgggtctcccaagtggtcaaaacgcatagtgggatggcctcaagttagggaaagaataagacaaactactccagagccagcagcagtaggagtaggagcagcatctcgacgtacttgggagtcggccat

SEQ ID NO: 403342 - DNA, 140 bp, Artificial Sequence
  Synthetic
atggccgactcccaagtacgtcgagatgctgctcctactcctactgctgctggctctggagtagtttgtcttattctttccctaacttgaggccatcccactatgcgttttgaccacttgggagacccagcatggcgtat

SEQ ID NO: 403343 - DNA, 140 bp, Artificial Sequence
  Synthetic
aggccctggctgctgatatgaagaaaaaatatagactgaaacacttagtatgggcaagcagggagctagaaagattcgcacttaaccctggccttttagaaacagcagaaggatgtcaacgaccttttgggacagcggtg

SEQ ID NO: 403344 - DNA, 140 bp, Artificial Sequence
  Synthetic
caccgctgtcccaaaaggtcgttgacatccttctgctgtttctaaaaggccagggttaagtgcgaatctttctagctccctgcttgcccatactaagtgtttcagtctatattttttcttcatatcagcagccagggcct

SEQ ID NO: 403345 - DNA, 140 bp, Artificial Sequence
  Synthetic
aggccctggctgctgatatgatgggaaaaaattactttgaagccagggggaaagaaaacatacatgctaaaacacctagtatgggcaagcagggaactagaaagatttgcacttaaccctgaccttttgggacagcggtg

SEQ ID NO: 403346 - DNA, 140 bp, Artificial Sequence
  Synthetic
caccgctgtcccaaaaggtcagggttaagtgcaaatctttctagttccctgcttgcccatactaggtgttttagcatgtatgttttctttccccctggcttcaaagtaattttttcccatcatatcagcagccagggcct

SEQ ID NO: 403347 - DNA, 140 bp, Artificial Sequence
  Synthetic
aggccctggctgctgatatgagtaggagcagcgtctcgagacttagataaatatggagcacttacaagcagcaacacagccaccaataatgctgattgtgcctggctggaagcacaagaggaccttttgggacagcggtg

SEQ ID NO: 403348 - DNA, 140 bp, Artificial Sequence
  Synthetic
caccgctgtcccaaaaggtcctcttgtgcttccagccaggcacaatcagcattattggtggctgtgttgctgcttgtaagtgctccatatttatctaagtctcgagacgctgctcctactcatatcagcagccagggcct

SEQ ID NO: 403349 - DNA, 140 bp, Artificial Sequence
  Synthetic
aggccctggctgctgatatgcatagctataagaatcaaagtataataccttgcaaattgaagcaggtggtaaggtcatggatacagggagggtcgggactctatgcacctcccatcaaaggaccttttgggacagcggtg

SEQ ID NO: 403350 - DNA, 140 bp, Artificial Sequence
  Synthetic
caccgctgtcccaaaaggtcctttgatgggaggtgcatagagtcccgaccctccctgtatccatgaccttaccacctgcttcaatttgcaaggtattatactttgattcttatagctatgcatatcagcagccagggcct

SEQ ID NO: 403351 - DNA, 140 bp, Artificial Sequence
  Synthetic
aggccctggctgctgatatggagaaatctataaaaggtggataatcctgggattaaataaaatagtaagaatgtatagccctgttagcattttggatataagacaagggccaaaagaaccgaccttttgggacagcggtg

SEQ ID NO: 403352 - DNA, 140 bp, Artificial Sequence
  Synthetic
caccgctgtcccaaaaggtcggttcttttggcccttgtcttatatccaaaatgctaacagggctatacattcttactattttatttaatcccaggattatccaccttttatagatttctccatatcagcagccagggcct

SEQ ID NO: 403353 - DNA, 140 bp, Artificial Sequence
  Synthetic
aggccctggctgctgatatgtgttgctttcattgccaagtttgtttcataaaaaaaggcttaggcatctcctatggcaggaagaagcggagacagcgacgaagaactcctcaagacagtcgaccttttgggacagcggtg

SEQ ID NO: 403354 - DNA, 140 bp, Artificial Sequence
  Synthetic
caccgctgtcccaaaaggtcgactgtcttgaggagttcttcgtcgctgtctccgcttcttcctgccataggagatgcctaagcctttttttatgaaacaaacttggcaatgaaagcaacacatatcagcagccagggcct

SEQ ID NO: 403355 - DNA, 140 bp, Artificial Sequence
  Synthetic
aggccctggctgctgatatgctatggcaggaagaagcggagacagcgacgaagaactcctcaagacagtccgactcatcaagtttctctatcaaagcagtaagtagtacatgtaatgcaagaccttttgggacagcggtg

SEQ ID NO: 403356 - DNA, 140 bp, Artificial Sequence
  Synthetic
caccgctgtcccaaaaggtcttgcattacatgtactacttactgctttgatagagaaacttgatgagtcggactgtcttgaggagttcttcgtcgctgtctccgcttcttcctgccatagcatatcagcagccagggcct

SEQ ID NO: 403357 - DNA, 140 bp, Artificial Sequence
  Synthetic
  misc_feature (31)..(31): n is a, c, g, or t
aggccctggctgctgatatggatggggcatnatgctccttgggatgttaatgdtttgtagtgctacagaacaattgtgggtcacaatctactatggggtgcctgtgtggaagaaggcaaagaccttttgggacagcggtg

SEQ ID NO: 403358 - DNA, 140 bp, Artificial Sequence
  Synthetic
  misc_feature (110)..(110): n is a, c, g, or t
caccgctgtcccaaaaggtctttgccttcttccacacaggcaccccatagtagattgtgacccacaattgttctgtagcactacaaadcattaacatcccaaggagcatnatgccccatccatatcagcagccagggcct

SEQ ID NO: 403359 - DNA, 140 bp, Artificial Sequence
  Synthetic
atacgccatgctgggtctccatttggccttcccagaaggggaggccagggaacttccttcagaacaggccagagcccacacacccacggccagagccgacagccccaccagcagagagctcgtacttgggagtcggccat

SEQ ID NO: 403360 - DNA, 140 bp, Artificial Sequence
  Synthetic
atggccgactcccaagtacgagctctctgctggtggggctgtcggctctggccgtgggtgtgtgggctctggcctgttctgaaggaagttccctggcctccccttctgggaaggccaaatggagacccagcatggcgtat

SEQ ID NO: 403361 - DNA, 140 bp, Artificial Sequence
  Synthetic
atacgccatgctgggtctcctgctacaaccaccactactactccaaccactacccctactaatacaaccaccaatagtagtagtgaggagaaagacatgaaaaactgctctttctatgtccgtacttgggagtcggccat

SEQ ID NO: 403362 - DNA, 140 bp, Artificial Sequence
  Synthetic
atggccgactcccaagtacggacatagaaagagcagtttttcatgtctttctcctcactactactattggtggttgtattagtaggggtagtggttggagtagtagtggtggttgtagcaggagacccagcatggcgtat

SEQ ID NO: 403363 - DNA, 140 bp, Artificial Sequence
  Synthetic
  misc_feature (87)..(87): n is a, c, g, or t
aggccctggctgctgatatgccaatagtagtagtgaggagaaagacatgaaaaactgctctttctatgtcacctcaggcatacaagntaagtttcagaaagaatatgcacttttttataagaccttttgggacagcggtg

SEQ ID NO: 403364 - DNA, 140 bp, Artificial Sequence
  Synthetic
  misc_feature (54)..(54): n is a, c, g, or t
caccgctgtcccaaaaggtcttataaaaaagtgcatattctttctgaaacttancttgtatgcctgaggtgacatagaaagagcagtttttcatgtctttctcctcactactactattggcatatcagcagccagggcct

SEQ ID NO: 403365 - DNA, 140 bp, Artificial Sequence
  Synthetic
aggccctggctgctgatatgaccactgactgaagaagcagaattagaattggcagagaacagggaaattctaaaagaaccagtacatggagcatattatgacccatcgaaagacttaatagaccttttgggacagcggtg

SEQ ID NO: 403366 - DNA, 140 bp, Artificial Sequence
  Synthetic
caccgctgtcccaaaaggtctattaagtctttcgatgggtcataatatgctccatgtactggttcttttagaatttccctgttctctgccaattctaattctgcttcttcagtcagtggtcatatcagcagccagggcct

SEQ ID NO: 403367 - DNA, 140 bp, Artificial Sequence
  Synthetic
aggccctggctgctgatatgtaattaattgtataagacctaacaacaatacaagaaaaagtatacgcataggaccagggggagtattttatgcagcaggagacataataggagatataaggaccttttgggacagcggtg

SEQ ID NO: 403368 - DNA, 140 bp, Artificial Sequence
  Synthetic
caccgctgtcccaaaaggtccttatatctcctattatgtctcctgctgcataaaatactccccctggtcctatgcgtatactttttcttgtattgttgttaggtcttatacaattaattacatatcagcagccagggcct

SEQ ID NO: 403369 - DNA, 140 bp, Artificial Sequence
  Synthetic
atacgccatgctgggtctccaggtagttgtaaaattaagagaacagttagttacaaaagtaggaggaaataatgaaacgaacgcaaatataacctttaatcactcctcaggagagggccccgtacttgggagtcggccat

SEQ ID NO: 403370 - DNA, 140 bp, Artificial Sequence
  Synthetic
atggccgactcccaagtacggggccctctcctgaggagtgattaaaggttatatttgcgttcgtttcattatttcctcctacttttgtaactaactgttctcttaattttacaactacctggagacccagcatggcgtat

SEQ ID NO: 403371 - DNA, 140 bp, Artificial Sequence
  Synthetic
aggccctggctgctgatatgaatgaaacgaacgcaaatataacctttaatcactcctcaggagagggccctagaaattgtaacaccacttttaattgtggaggggaatttttctcttgtagaccttttgggacagcggtg

SEQ ID NO: 403372 - DNA, 140 bp, Artificial Sequence
  Synthetic
caccgctgtcccaaaaggtctacaagagaaaaattcccctccacaattaaaagtggtgttacaatttctagggccctctcctgaggagtgattaaaggttatatttgcgttcgtttcattcatatcagcagccagggcct

SEQ ID NO: 403373 - DNA, 140 bp, Artificial Sequence
  Synthetic
aggccctggctgctgatatgttatggtaccaattagaaaaagaccccatagcaggagcagagactttctatgtagatggggcagctagtagggagactaagctaggaaaagcagggtatggaccttttgggacagcggtg

SEQ ID NO: 403374 - DNA, 140 bp, Artificial Sequence
  Synthetic
caccgctgtcccaaaaggtccataccctgcttttcctagcttagtctccctactagctgccccatctacatagaaagtctctgctcctgctatggggtctttttctaattggtaccataacatatcagcagccagggcct

SEQ ID NO: 403375 - DNA, 140 bp, Artificial Sequence
  Synthetic
aggccctggctgctgatatgcacactaatgatgtaaaacagttaacagaggcagtgcaaaaaatagccatggaaagcatagtaatatggggaaagactcctaaatttagactacccatccgaccttttgggacagcggtg

SEQ ID NO: 403376 - DNA, 140 bp, Artificial Sequence
  Synthetic
caccgctgtcccaaaaggtcggatgggtagtctaaatttaggagtctttccccatattactatgctttccatggctattttttgcactgcctctgttaactgttttacatcattagtgtgcatatcagcagccagggcct

SEQ ID NO: 403377 - DNA, 140 bp, Artificial Sequence
  Synthetic
atacgccatgctgggtctccagaatcagcaactcctaagcctatgggggtgtaaaggaagactaatctgctacacaacagtagaatggaacaccaccgcatggccagatggtgaaaaaatcgtacttgggagtcggccat

SEQ ID NO: 403378 - DNA, 140 bp, Artificial Sequence
  Synthetic
atggccgactcccaagtacgattttttcaccatctggccatgcggtggtgttccattctactgttgtgtagcagattagtcttcctttacacccccataggcttaggagttgctgattctggagacccagcatggcgtat

SEQ ID NO: 403379 - DNA, 140 bp, Artificial Sequence
  Synthetic
aggccctggctgctgatatgctttggaaattagtgcaatagtaggactgatagtagcgctaatcttagcaataatagtgtggactatagtagttatagaatttcagaaaataaaaaagcagaccttttgggacagcggtg

SEQ ID NO: 403380 - DNA, 140 bp, Artificial Sequence
  Synthetic
caccgctgtcccaaaaggtctgcttttttattttctgaaattctataactactatagtccacactattattgctaagattagcgctactatcagtcctactattgcactaatttccaaagcatatcagcagccagggcct

SEQ ID NO: 403381 - DNA, 140 bp, Artificial Sequence
  Synthetic
  misc_feature (35)..(35): n is a, c, g, or t
  misc_feature (107)..(107): n is a, c, g, or t
aggccctggctgctgatatgaaggtggagagaganacagaggcagatccgaaagtttagtgagcggattcttacctcttatctgggacgacctgaggagcctgtgcnttttctgctaccagaccttttgggacagcggtg

SEQ ID NO: 403382 - DNA, 140 bp, Artificial Sequence
  Synthetic
  misc_feature (34)..(34): n is a, c, g, or t
  misc_feature (106)..(106): n is a, c, g, or t
caccgctgtcccaaaaggtctggtagcagaaaangcacaggctcctcaggtcgtcccagataagaggtaagaatccgctcactaaactttcggatctgcctctgtntctctctccaccttcatatcagcagccagggcct

SEQ ID NO: 403383 - DNA, 140 bp, Artificial Sequence
  Synthetic
aggccctggctgctgatatgagggctttgctataagatgggtggcaaatggtcaaaacgtagtgtgggtggatggtctgctataagggaaagaatgagacgaactgagccagcaactgaggaccttttgggacagcggtg

SEQ ID NO: 403384 - DNA, 140 bp, Artificial Sequence
  Synthetic
caccgctgtcccaaaaggtcctcagttgctggctcagttcgtctcattctttcccttatagcagaccatccacccacactacgttttgaccatttgccacccatcttatagcaaagccctcatatcagcagccagggcct

SEQ ID NO: 403385 - DNA, 140 bp, Artificial Sequence
  Synthetic
atacgccatgctgggtctcccaaatcagacagtcacactcccatgcagaatacgacaaattatatacatgtggcagaaagttggaaaagcaatgtatgcccctcccatacaaggaacactcgtacttgggagtcggccat

SEQ ID NO: 403386 - DNA, 140 bp, Artificial Sequence
  Synthetic
atggccgactcccaagtacgagtgttccttgtatgggaggggcatacattgcttttccaactttctgccacatgtatataatttgtcgtattctgcatgggagtgtgactgtctgatttgggagacccagcatggcgtat

SEQ ID NO: 403387 - DNA, 140 bp, Artificial Sequence
  Synthetic
atacgccatgctgggtctcctcaagatcctatttcaaagcagtaagtataaagtataggtaatgttacctttgcaaatcagtgcaatagtacgactgatagtagcgctaatcttagcaatcgtacttgggagtcggccat

SEQ ID NO: 403388 - DNA, 140 bp, Artificial Sequence
  Synthetic
atggccgactcccaagtacgattgctaagattagcgctactatcagtcgtactattgcactgatttgcaaaggtaacattacctatactttatacttactgctttgaaataggatcttgaggagacccagcatggcgtat

SEQ ID NO: 403389 - DNA, 140 bp, Artificial Sequence
  Synthetic
aggccctggctgctgatatgtggggggacatcaagcagccatgcaaatgttaaaagacaccatcaatgaggaagctgcagaatgggacagattacatccagtgcatgcaggacctatcgcgaccttttgggacagcggtg

SEQ ID NO: 403390 - DNA, 140 bp, Artificial Sequence
  Synthetic
caccgctgtcccaaaaggtcgcgataggtcctgcatgcactggatgtaatctgtcccattctgcagcttcctcattgatggtgtcttttaacatttgcatggctgcttgatgtccccccacatatcagcagccagggcct

SEQ ID NO: 403391 - DNA, 140 bp, Artificial Sequence
  Synthetic
atacgccatgctgggtctccgaatactactattaaaaatggtaccctcgatgatggaatgaagggagaaataaaaaattgctctttcaatgcaaccacagaaataaaagataaaaaacggcgtacttgggagtcggccat

SEQ ID NO: 403392 - DNA, 140 bp, Artificial Sequence
  Synthetic
atggccgactcccaagtacgccgttttttatcttttatttctgtggttgcattgaaagagcaattttttatttctcccttcattccatcatcgagggtaccatttttaatagtagtattcggagacccagcatggcgtat

SEQ ID NO: 403393 - DNA, 140 bp, Artificial Sequence
  Synthetic
  misc_feature (100)..(100): n is a, c, g, or t
atacgccatgctgggtctcctctaggaccagggagagtatattatacaacaggacaaataataggagatataagacaagcacattgtaccattagtgggncaaaatggaataacactctacgtacttgggagtcggccat

SEQ ID NO: 403394 - DNA, 140 bp, Artificial Sequence
  Synthetic
  misc_feature (41)..(41): n is a, c, g, or t
atggccgactcccaagtacgtagagtgttattccattttgncccactaatggtacaatgtgcttgtcttatatctcctattatttgtcctgttgtataatatactctccctggtcctagaggagacccagcatggcgtat

SEQ ID NO: 403395 - DNA, 140 bp, Artificial Sequence
  Synthetic
atacgccatgctgggtctcctatcagaaatgcaaaaagaagtaagcaactgtccttttaatataaccacagaactaagagataaggagcaggaggtctatgcacttttttataggtctgacgtacttgggagtcggccat

SEQ ID NO: 403396 - DNA, 140 bp, Artificial Sequence
  Synthetic
atggccgactcccaagtacgtcagacctataaaaaagtgcatagacctcctgctccttatctcttagttctgtggttatattaaaaggacagttgcttacttctttttgcatttctgataggagacccagcatggcgtat

SEQ ID NO: 403397 - DNA, 140 bp, Artificial Sequence
  Synthetic
aggccctggctgctgatatgacaagggaaggccagggaatttccttcagaacaggccagagccaacagccccgccagcagagagctttgggttcggagaggagataaccccctctccgaagaccttttgggacagcggtg

SEQ ID NO: 403398 - DNA, 140 bp, Artificial Sequence
  Synthetic
caccgctgtcccaaaaggtcttcggagagggggttatctcctctccgaacccaaagctctctgctggcggggctgttggctctggcctgttctgaaggaaattccctggccttcccttgtcatatcagcagccagggcct

SEQ ID NO: 403399 - DNA, 140 bp, Artificial Sequence
  Synthetic
aggccctggctgctgatatgaacagataattagaaaattagaagagcactttaataataagacaatacaatttaaaccaccatactcaggaggagatctagaaattacaatgcaccatttgaccttttgggacagcggtg

SEQ ID NO: 403400 - DNA, 140 bp, Artificial Sequence
  Synthetic
caccgctgtcccaaaaggtcaaatggtgcattgtaatttctagatctcctcctgagtatggtggtttaaattgtattgtcttattattaaagtgctcttctaattttctaattatctgttcatatcagcagccagggcct

SEQ ID NO: 403401 - DNA, 140 bp, Artificial Sequence
  Synthetic
aggccctggctgctgatatgtgcagaataaaacaaattataaacatgtggcaggaggtaggacgagcaatgtatgcccctcccattgcaggaaacataacatgtaaatcaaatatcacaggaccttttgggacagcggtg

SEQ ID NO: 403402 - DNA, 140 bp, Artificial Sequence
  Synthetic
caccgctgtcccaaaaggtcctgtgatatttgatttacatgttatgtttcctgcaatgggaggggcatacattgctcgtcctacctcctgccacatgtttataatttgttttattctgcacatatcagcagccagggcct

SEQ ID NO: 403403 - DNA, 140 bp, Artificial Sequence
  Synthetic
aggccctggctgctgatatgttggagtaataaatctctgaatgagatttggaataatatgacctggatggagtgggaaagagaaattgacaattacacaggcttaatatacagcttaattgaccttttgggacagcggtg

SEQ ID NO: 403404 - DNA, 140 bp, Artificial Sequence
  Synthetic
caccgctgtcccaaaaggtcaattaagctgtatattaagcctgtgtaattgtcaatttctctttcccactccatccaggtcatattattccaaatctcattcagagatttattactccaacatatcagcagccagggcct

SEQ ID NO: 403405 - DNA, 140 bp, Artificial Sequence
  Synthetic
atacgccatgctgggtctccatctgcaataaaaccatagagacagaaatgagaaattgctctttcaatgcaaccacagaactaaaagataagaagaacaaagagtatgcacttttttatacgtacttgggagtcggccat

SEQ ID NO: 403406 - DNA, 140 bp, Artificial Sequence
  Synthetic
atggccgactcccaagtacgtataaaaaagtgcatactctttgttcttcttatcttttagttctgtggttgcattgaaagagcaatttctcatttctgtctctatggttttattgcagatggagacccagcatggcgtat

SEQ ID NO: 403407 - DNA, 140 bp, Artificial Sequence
  Synthetic
aggccctggctgctgatatgaaccacagaactaaaagataagaagaacaaagagtatgcacttttttataaacttgatatagtaccacttgatgggaaaagagataacaacagtaatggggaccttttgggacagcggtg

SEQ ID NO: 403408 - DNA, 140 bp, Artificial Sequence
  Synthetic
caccgctgtcccaaaaggtccccattactgttgttatctcttttcccatcaagtggtactatatcaagtttataaaaaagtgcatactctttgttcttcttatcttttagttctgtggttcatatcagcagccagggcct

SEQ ID NO: 403409 - DNA, 140 bp, Artificial Sequence
  Synthetic
aggccctggctgctgatatggcgagagcggtggaccttctgggacgcagcagcctcaggggactacagagggggtgggaaatccttaagtatttgggaaaccttgtgcagtattggggtcgaccttttgggacagcggtg

SEQ ID NO: 403410 - DNA, 140 bp, Artificial Sequence
  Synthetic
caccgctgtcccaaaaggtcgaccccaatactgcacaaggtttcccaaatacttaaggatttcccaccccctctgtagtcccctgaggctgctgcgtcccagaaggtccaccgctctcgccatatcagcagccagggcct

SEQ ID NO: 403411 - DNA, 140 bp, Artificial Sequence
  Synthetic
aggccctggctgctgatatgtggagcaatcacaagtagcaatactaacaatgctgcttgtgcctggctagaagcacaagaggaggaggaggtgggttttccagtcagacctcaggtacctgaccttttgggacagcggtg

SEQ ID NO: 403412 - DNA, 140 bp, Artificial Sequence
  Synthetic
caccgctgtcccaaaaggtcaggtacctgaggtctgactggaaaacccacctcctcctcctcttgtgcttctagccaggcacaagcagcattgttagtattgctacttgtgattgctccacatatcagcagccagggcct

SEQ ID NO: 403413 - DNA, 140 bp, Artificial Sequence
  Synthetic
aggccctggctgctgatatgaagcacaagaggaggaggaggtgggttttccagtcagacctcaggtacctttaagaccaatgacttacaaaggagctttagatcttagccattttttaaagaccttttgggacagcggtg

SEQ ID NO: 403414 - DNA, 140 bp, Artificial Sequence
  Synthetic
caccgctgtcccaaaaggtctttaaaaaatggctaagatctaaagctcctttgtaagtcattggtcttaaaggtacctgaggtctgactggaaaacccacctcctcctcctcttgtgcttcatatcagcagccagggcct

SEQ ID NO: 403415 - DNA, 140 bp, Artificial Sequence
  Synthetic
atacgccatgctgggtctccgctttgccataaaatggggaacaaatggtcaaaatgtagtccagtgggatggtctgatataagagaaagaatgagacgagctgctccagcagcggagggacgtacttgggagtcggccat

SEQ ID NO: 403416 - DNA, 140 bp, Artificial Sequence
  Synthetic
atggccgactcccaagtacgtccctccgctgctggagcagctcgtctcattctttctcttatatcagaccatcccactggactacattttgaccatttgttccccattttatggcaaagcggagacccagcatggcgtat

SEQ ID NO: 403417 - DNA, 140 bp, Artificial Sequence
  Synthetic
aggccctggctgctgatatgagattagcgagcggattcttagcacttgcctgggacgatctacggagcctgtgcatcttcctctaccaccgattgagagactttgtcttaattgcaacgagaccttttgggacagcggtg

SEQ ID NO: 403418 - DNA, 140 bp, Artificial Sequence
  Synthetic
caccgctgtcccaaaaggtctcgttgcaattaagacaaagtctctcaatcggtggtagaggaagatgcacaggctccgtagatcgtcccaggcaagtgctaagaatccgctcgctaatctcatatcagcagccagggcct

SEQ ID NO: 403419 - DNA, 140 bp, Artificial Sequence
  Synthetic
aggccctggctgctgatatgcttaaatatctaggaagtcttgtgcagtattggggtctggaactaaaaaagagtgctattagtctgcttgataccatagcaatagcagtagctgaaggaagaccttttgggacagcggtg

SEQ ID NO: 403420 - DNA, 140 bp, Artificial Sequence
  Synthetic
caccgctgtcccaaaaggtcttccttcagctactgctattgctatggtatcaagcagactaatagcactcttttttagttccagaccccaatactgcacaagacttcctagatatttaagcatatcagcagccagggcct

SEQ ID NO: 403421 - DNA, 140 bp, Artificial Sequence
  Synthetic
atacgccatgctgggtctcctcaagacaggaacagaagactttagatcattatataatttaatagcagtcctctattgtgtacatcaaaagatagatgtaaaagacaccaaggaagctttcgtacttgggagtcggccat

SEQ ID NO: 403422 - DNA, 140 bp, Artificial Sequence
  Synthetic
atggccgactcccaagtacgaaagcttccttggtgtcttttacatctatcttttgatgtacacaatagaggactgctattaaattatataatgatctaaagtcttctgttcctgtcttgaggagacccagcatggcgtat

SEQ ID NO: 403423 - DNA, 140 bp, Artificial Sequence
  Synthetic
aggccctggctgctgatatgttaggaccaggggctacattagaagaaatgatgacagcatgccagggagtaggaggacccggccataaagcaagggttttggctgaggcaatgagtcaaggaccttttgggacagcggtg

SEQ ID NO: 403424 - DNA, 140 bp, Artificial Sequence
  Synthetic
caccgctgtcccaaaaggtccttgactcattgcctcagccaaaacccttgctttatggccgggtcctcctactccctggcatgctgtcatcatttcttctaatgtagcccctggtcctaacatatcagcagccagggcct

SEQ ID NO: 403425 - DNA, 140 bp, Artificial Sequence
  Synthetic
aggccctggctgctgatatgtcactctttggcaacgaccagttgtcacagtaaaaatagcagggcagctaaaggaagctctattagatacaggagcagatgatacagtattagaagaaatgaccttttgggacagcggtg

SEQ ID NO: 403426 - DNA, 140 bp, Artificial Sequence
  Synthetic
caccgctgtcccaaaaggtcatttcttctaatactgtatcatctgctcctgtatctaatagagcttcctttagctgccctgctatttttactgtgacaactggtcgttgccaaagagtgacatatcagcagccagggcct

SEQ ID NO: 403427 - DNA, 140 bp, Artificial Sequence
  Synthetic
aggccctggctgctgatatggccataataggagatataagacaagcacattgtaacattagtgaagaaaaatggaataacaatctagaacaggtagttacaaaattaagagaaaaatttagaccttttgggacagcggtg

SEQ ID NO: 403428 - DNA, 140 bp, Artificial Sequence
  Synthetic
caccgctgtcccaaaaggtctaaatttttctcttaattttgtaactacctgttctagattgttattccatttttcttcactaatgttacaatgtgcttgtcttatatctcctattatggccatatcagcagccagggcct

SEQ ID NO: 403429 - DNA, 140 bp, Artificial Sequence
  Synthetic
aggccctggctgctgatatgctctggaaaactcatctgcaccactagtgtgccctggaactctagttggagtaataaatcactgaatgacatttgggacaacatgacttggatgcagtgggaccttttgggacagcggtg

SEQ ID NO: 403430 - DNA, 140 bp, Artificial Sequence
  Synthetic
caccgctgtcccaaaaggtcccactgcatccaagtcatgttgtcccaaatgtcattcagtgatttattactccaactagagttccagggcacactagtggtgcagatgagttttccagagcatatcagcagccagggcct

SEQ ID NO: 403431 - DNA, 140 bp, Artificial Sequence
  Synthetic
aggccctggctgctgatatgctttgaagcagctttgctataaaatggggagcaagtggtcaaaatgcagcgggtggccagatgtaagagaaagaatgagacgagctacgccagcagcagagaccttttgggacagcggtg

SEQ ID NO: 403432 - DNA, 140 bp, Artificial Sequence
  Synthetic
caccgctgtcccaaaaggtctctgctgctggcgtagctcgtctcattctttctcttacatctggccacccgctgcattttgaccacttgctccccattttatagcaaagctgcttcaaagcatatcagcagccagggcct

SEQ ID NO: 403433 - DNA, 140 bp, Artificial Sequence
  Synthetic
aggccctggctgctgatatgccagctataagggaaagaatgagacgaacccctccagcagcagatggagtgggatcagcctctcgagacctagaaagacatggagcactcacaactagcagaccttttgggacagcggtg

SEQ ID NO: 403434 - DNA, 140 bp, Artificial Sequence
  Synthetic
caccgctgtcccaaaaggtctgctagttgtgagtgctccatgtctttctaggtctcgagaggctgatcccactccatctgctgctggaggggttcgtctcattctttcccttatagctggcatatcagcagccagggcct

SEQ ID NO: 403435 - DNA, 140 bp, Artificial Sequence
  Synthetic
atacgccatgctgggtctcccagcagggtaaatgttaccagtgttaggaaagaagtaaaaaattgcacttttaatgcaaccacagaactgagagataagaagcagtcagtgtatgcacttcgtacttgggagtcggccat

SEQ ID NO: 403436 - DNA, 140 bp, Artificial Sequence
  Synthetic
atggccgactcccaagtacgaagtgcatacactgactgcttcttatctctcagttctgtggttgcattaaaagtgcaattttttacttctttcctaacactggtaacatttaccctgctgggagacccagcatggcgtat

SEQ ID NO: 403437 - DNA, 140 bp, Artificial Sequence
  Synthetic
aggccctggctgctgatatgtcctatggcaggaagaagcggagacagcgacgaagcgctcctccaagcagtgaggatcatcaaaatcctatatcaaagcagtaagtattcactattagatgaccttttgggacagcggtg

SEQ ID NO: 403438 - DNA, 140 bp, Artificial Sequence
  Synthetic
caccgctgtcccaaaaggtcatctaatagtgaatacttactgctttgatataggattttgatgatcctcactgcttggaggagcgcttcgtcgctgtctccgcttcttcctgccataggacatatcagcagccagggcct

SEQ ID NO: 403439 - DNA, 140 bp, Artificial Sequence
  Synthetic
aggccctggctgctgatatgaggactaataatagcaataattgtgtggatcatagtttatatagaatataagaaattggtaagacaaagaagaatagactggttagttaaaagaattagggaccttttgggacagcggtg

SEQ ID NO: 403440 - DNA, 140 bp, Artificial Sequence
  Synthetic
caccgctgtcccaaaaggtccctaattcttttaactaaccagtctattcttctttgtcttaccaatttcttatattctatataaactatgatccacacaattattgctattattagtcctcatatcagcagccagggcct

SEQ ID NO: 403441 - DNA, 140 bp, Artificial Sequence
  Synthetic
atacgccatgctgggtctccgaaagagcagaagacagtggcaatgagagtgaagaggatacagaggaattggaaaccatggtggggcatcttaggcttttggatgttaatgatgtataatcgtacttgggagtcggccat

SEQ ID NO: 403442 - DNA, 140 bp, Artificial Sequence
  Synthetic
atggccgactcccaagtacgattatacatcattaacatccaaaagcctaagatgccccaccatggtttccaattcctctgtatcctcttcactctcattgccactgtcttctgctctttcggagacccagcatggcgtat

SEQ ID NO: 403443 - DNA, 140 bp, Artificial Sequence
  Synthetic
aggccctggctgctgatatgtggaacaagccccagaagaccaagggccacagagggagccatacaatgaatggatgttagaactgttagaggatcttaagcatgaagctgttagacatttgaccttttgggacagcggtg

SEQ ID NO: 403444 - DNA, 140 bp, Artificial Sequence
  Synthetic
caccgctgtcccaaaaggtcaaatgtctaacagcttcatgcttaagatcctctaacagttctaacatccattcattgtatggctccctctgtggcccttggtcttctggggcttgttccacatatcagcagccagggcct

SEQ ID NO: 403445 - DNA, 140 bp, Artificial Sequence
  Synthetic
atacgccatgctgggtctcctagtatgcagggagaaataaaaaattgctctttcaatatgaccactgaactaagagataagaaaaagaaggtacatgcacttttttatagacttgatgtacgtacttgggagtcggccat

SEQ ID NO: 403446 - DNA, 140 bp, Artificial Sequence
  Synthetic
atggccgactcccaagtacgtacatcaagtctataaaaaagtgcatgtaccttctttttcttatctcttagttcagtggtcatattgaaagagcaattttttatttctccctgcatactaggagacccagcatggcgtat

SEQ ID NO: 403447 - DNA, 140 bp, Artificial Sequence
  Synthetic
atacgccatgctgggtctccttgtacaagacccgccaacaatacaagagaaagtatacacataggaccagggagagcattttatgcaaccgacataataggagatataagacaagcacatcgtacttgggagtcggccat

SEQ ID NO: 403448 - DNA, 140 bp, Artificial Sequence
  Synthetic
atggccgactcccaagtacgatgtgcttgtcttatatctcctattatgtcggttgcataaaatgctctccctggtcctatgtgtatactttctcttgtattgttggcgggtcttgtacaaggagacccagcatggcgtat

SEQ ID NO: 403449 - DNA, 140 bp, Artificial Sequence
  Synthetic
atacgccatgctgggtctccttcctatggcaggaagaagcggagacgaagcgctcctccaagccgtgaggatcatcagaatcttataccaaagcagtaagtatatgtaatgctggatttacgtacttgggagtcggccat

SEQ ID NO: 403450 - DNA, 140 bp, Artificial Sequence
  Synthetic
atggccgactcccaagtacgtaaatccagcattacatatacttactgctttggtataagattctgatgatcctcacggcttggaggagcgcttcgtctccgcttcttcctgccataggaaggagacccagcatggcgtat

SEQ ID NO: 403451 - DNA, 140 bp, Artificial Sequence
  Synthetic
atacgccatgctgggtctcccaatagtatttagaaaccactcaggaggggacttagaaattacaacacatagctttaattgtagaggagaatttttctattgcagtacatcaggcctgttcgtacttgggagtcggccat

SEQ ID NO: 403452 - DNA, 140 bp, Artificial Sequence
  Synthetic
atggccgactcccaagtacgaacaggcctgatgtactgcaatagaaaaattctcctctacaattaaagctatgtgttgtaatttctaagtcccctcctgagtggtttctaaatactattgggagacccagcatggcgtat

SEQ ID NO: 403453 - DNA, 140 bp, Artificial Sequence
  Synthetic
atacgccatgctgggtctccaacagcaatatatctagcagcagcaatatatctaaagaatggcaagaaataaaaaactgctcttttaatatgaccacagagttaagagataggaaacagacgtacttgggagtcggccat

SEQ ID NO: 403454 - DNA, 140 bp, Artificial Sequence
  Synthetic
atggccgactcccaagtacgtctgtttcctatctcttaactctgtggtcatattaaaagagcagttttttatttcttgccattctttagatatattgctgctgctagatatattgctgttggagacccagcatggcgtat

SEQ ID NO: 403455 - DNA, 140 bp, Artificial Sequence
  Synthetic
aggccctggctgctgatatgaaaaaactgctcttttaatatgaccacagagttaagagataggaaacagaaagtatatgcacttttttacaaacttgatatagtacaaattgatggaaatgaccttttgggacagcggtg

SEQ ID NO: 403456 - DNA, 140 bp, Artificial Sequence
  Synthetic
caccgctgtcccaaaaggtcatttccatcaatttgtactatatcaagtttgtaaaaaagtgcatatactttctgtttcctatctcttaactctgtggtcatattaaaagagcagttttttcatatcagcagccagggcct

SEQ ID NO: 403457 - DNA, 140 bp, Artificial Sequence
  Synthetic
atacgccatgctgggtctccagtagtactaatgctactgatatggaggcggtggaacaaatgagaaattgctctttcaatgtcaccaaaggcataggagataagatgcagaaagaatatgcgtacttgggagtcggccat

SEQ ID NO: 403458 - DNA, 140 bp, Artificial Sequence
  Synthetic
atggccgactcccaagtacgcatattctttctgcatcttatctcctatgcctttggtgacattgaaagagcaatttctcatttgttccaccgcctccatatcagtagcattagtactactggagacccagcatggcgtat

SEQ ID NO: 403459 - DNA, 140 bp, Artificial Sequence
  Synthetic
atacgccatgctgggtctcctgtcagtaccaccacagaaatacaaaattgctctttcaatgcaactacagaactaaaagataagaagaacaaggagtatgcacttttctatagacttgatcgtacttgggagtcggccat

SEQ ID NO: 403460 - DNA, 140 bp, Artificial Sequence
  Synthetic
atggccgactcccaagtacgatcaagtctatagaaaagtgcatactccttgttcttcttatcttttagttctgtagttgcattgaaagagcaattttgtatttctgtggtggtactgacaggagacccagcatggcgtat

SEQ ID NO: 403461 - DNA, 140 bp, Artificial Sequence
  Synthetic
atacgccatgctgggtctccctttgcaataaaatgggggccaagtggtcacgaagcagtgcagttggatggcctgctgtaagggagagaataagacgagctcagccagcagcagaaggagcgtacttgggagtcggccat

SEQ ID NO: 403462 - DNA, 140 bp, Artificial Sequence
  Synthetic
atggccgactcccaagtacgctccttctgctgctggctgagctcgtcttattctctcccttacagcaggccatccaactgcactgcttcgtgaccacttggcccccattttattgcaaagggagacccagcatggcgtat

SEQ ID NO: 403463 - DNA, 140 bp, Artificial Sequence
  Synthetic
atacgccatgctgggtctccgaatctcctacaatattggagtcaggaactcaagaagagtgctattagcttgtacaatgccaccgccacagcagtagctgaggggacagatagagttatacgtacttgggagtcggccat

SEQ ID NO: 403464 - DNA, 140 bp, Artificial Sequence
  Synthetic
atggccgactcccaagtacgtataactctatctgtcccctcagctactgctgtggcggtggcattgtacaagctaatagcactcttcttgagttcctgactccaatattgtaggagattcggagacccagcatggcgtat

SEQ ID NO: 403465 - DNA, 140 bp, Artificial Sequence
  Synthetic
aggccctggctgctgatatgtgtgcctcttcagctaccaccgattgagagacttaatattaattgcagcgagagcggtggaacttctgggacgcagcagcctcaggggactgcagagggggaccttttgggacagcggtg

SEQ ID NO: 403466 - DNA, 140 bp, Artificial Sequence
  Synthetic
caccgctgtcccaaaaggtccccctctgcagtcccctgaggctgctgcgtcccagaagttccaccgctctcgctgcaattaatattaagtctctcaatcggtggtagctgaagaggcacacatatcagcagccagggcct

SEQ ID NO: 403467 - DNA, 140 bp, Artificial Sequence
  Synthetic
aggccctggctgctgatatggaaagtagtatggatagatgctcctctgtaagggaaaaaatcacacaagctgacgcccggcagcagaagggtggagcagtatctcgagatctcgaacaacgaccttttgggacagcggtg

SEQ ID NO: 403468 - DNA, 140 bp, Artificial Sequence
  Synthetic
caccgctgtcccaaaaggtcgttgttcgagatctcgagatactgctccacccttctgctgccgggcgtcagcttgtgtgattttttcccttacagaggagcatctatccatactactttccatatcagcagccagggcct

SEQ ID NO: 403469 - DNA, 140 bp, Artificial Sequence
  Synthetic
aggccctggctgctgatatgaaacaagggccaaaggaaccctttagagactatgtagatcggttctttaaaactttaagagctgaacaagctacacaagatgtaaaaaattggatgacaggaccttttgggacagcggtg

SEQ ID NO: 403470 - DNA, 140 bp, Artificial Sequence
  Synthetic
caccgctgtcccaaaaggtcctgtcatccaattttttacatcttgtgtagcttgttcagctcttaaagttttaaagaaccgatctacatagtctctaaagggttcctttggcccttgtttcatatcagcagccagggcct

SEQ ID NO: 403471 - DNA, 140 bp, Artificial Sequence
  Synthetic
atacgccatgctgggtctccggattatagaataggacaagagctggtagagctattctcaacatacctagaagaatcagacagggcttagaaagagctttgctataacatgggtggcaagcgtacttgggagtcggccat

SEQ ID NO: 403472 - DNA, 140 bp, Artificial Sequence
  Synthetic
atggccgactcccaagtacgcttgccacccatgttatagcaaagctctttctaagccctgtctgattcttctaggtatgttgagaatagctctaccagctcttgtcctattctataatccggagacccagcatggcgtat

SEQ ID NO: 403473 - DNA, 140 bp, Artificial Sequence
  Synthetic
atacgccatgctgggtctcctcctccaacaccaacaacagcagaagcagcagcagaaggagtaggagcagtatctcgagatttagctagacatggagcaatcacaagcagtaatacagcccgtacttgggagtcggccat

SEQ ID NO: 403474 - DNA, 140 bp, Artificial Sequence
  Synthetic
atggccgactcccaagtacgggctgtattactgcttgtgattgctccatgtctagctaaatctcgagatactgctcctactccttctgctgctgcttctgctgttgttggtgttggaggaggagacccagcatggcgtat

SEQ ID NO: 403475 - DNA, 140 bp, Artificial Sequence
  Synthetic
aggccctggctgctgatatgccgaagcaggagcagaaagacagggaacctttaacttccctcaaatcactctttggcagcgacccgttgtcacaataaaagtagggggacagctaaaggagaccttttgggacagcggtg

SEQ ID NO: 403476 - DNA, 140 bp, Artificial Sequence
  Synthetic
caccgctgtcccaaaaggtctcctttagctgtccccctacttttattgtgacaacgggtcgctgccaaagagtgatttgagggaagttaaaggttccctgtctttctgctcctgcttcggcatatcagcagccagggcct

SEQ ID NO: 403477 - DNA, 140 bp, Artificial Sequence
  Synthetic
aggccctggctgctgatatgatgtgcttccacagggatggaaaggatcaccagcaatattccaaagtagcatgacaaaaattttagagccttttagaaaacaaaatccagacatagtcatgaccttttgggacagcggtg

SEQ ID NO: 403478 - DNA, 140 bp, Artificial Sequence
  Synthetic
caccgctgtcccaaaaggtcatgactatgtctggattttgttttctaaaaggctctaaaatttttgtcatgctactttggaatattgctggtgatcctttccatccctgtggaagcacatcatatcagcagccagggcct

SEQ ID NO: 403479 - DNA, 140 bp, Artificial Sequence
  Synthetic
aggccctggctgctgatatgtcactctttggcagcgacccctagtcacagtaaagataggggaacagctaatagaagctctattagatacaggagcagatgatacagtattaaaagaaatgaccttttgggacagcggtg

SEQ ID NO: 403480 - DNA, 140 bp, Artificial Sequence
  Synthetic
caccgctgtcccaaaaggtcatttcttttaatactgtatcatctgctcctgtatctaatagagcttctattagctgttcccctatctttactgtgactaggggtcgctgccaaagagtgacatatcagcagccagggcct

SEQ ID NO: 403481 - DNA, 140 bp, Artificial Sequence
  Synthetic
atacgccatgctgggtctccgttcaatgggacagggccatgcaagaatgtcagcacagtacaatgtacacatggaattaaaccagtggtatcaactcaattgttgctaaatggcagcctacgtacttgggagtcggccat

SEQ ID NO: 403482 - DNA, 140 bp, Artificial Sequence
  Synthetic
atggccgactcccaagtacgtaggctgccatttagcaacaattgagttgataccactggtttaattccatgtgtacattgtactgtgctgacattcttgcatggccctgtcccattgaacggagacccagcatggcgtat

SEQ ID NO: 403483 - DNA, 140 bp, Artificial Sequence
  Synthetic
atacgccatgctgggtctccgcggaagaagatataataatcagatctcaaaatatctcagataatacaaaaaccataatagtacaccttaatgaatctgtacagattaattgtacaagaccgtacttgggagtcggccat

SEQ ID NO: 403484 - DNA, 140 bp, Artificial Sequence
  Synthetic
atggccgactcccaagtacggtcttgtacaattaatctgtacagattcattaaggtgtactattatggtttttgtattatctgagatattttgagatctgattattatatcttcttccgcggagacccagcatggcgtat

SEQ ID NO: 403485 - DNA, 140 bp, Artificial Sequence
  Synthetic
aggccctggctgctgatatgagaccttcagacctgggggaggaaatatgaaagacaattggagaagtgaattatataaatataaagtagtagaaattgaaccactaggagtagcacccacgaccttttgggacagcggtg

SEQ ID NO: 403486 - DNA, 140 bp, Artificial Sequence
  Synthetic
caccgctgtcccaaaaggtcgtgggtgctactcctagtggttcaatttctactactttatatttatataattcacttctccaattgtctttcatatttcctcccccaggtctgaaggtctcatatcagcagccagggcct

SEQ ID NO: 403487 - DNA, 140 bp, Artificial Sequence
  Synthetic
atacgccatgctgggtctccaagaataatagacataatagcaacagacatacaaactaaagaattacaaaaacaaattacaaaaattcaaaattttcgggtttattacagggacagcagacgtacttgggagtcggccat

SEQ ID NO: 403488 - DNA, 140 bp, Artificial Sequence
  Synthetic
atggccgactcccaagtacgtctgctgtccctgtaataaacccgaaaattttgaatttttgtaatttgtttttgtaattctttagtttgtatgtctgttgctattatgtctattattcttggagacccagcatggcgtat

SEQ ID NO: 403489 - DNA, 140 bp, Artificial Sequence
  Synthetic
atacgccatgctgggtctcctgtccatttcagagtggggggtcagcatagccgaataggcattataagacagaatagggcgagaaatggagcctctagaaactaacctagagccctggaacgtacttgggagtcggccat

SEQ ID NO: 403490 - DNA, 140 bp, Artificial Sequence
  Synthetic
atggccgactcccaagtacgttccagggctctaggttagtttctagaggctccatttctcgccctattctgtcttataatgcctattcggctatgctgaccccccactctgaaatggacaggagacccagcatggcgtat

SEQ ID NO: 403491 - DNA, 140 bp, Artificial Sequence
  Synthetic
aggccctggctgctgatatgaaagcagtaagtagtgcatgtaatgaacgctttacaaatatcagcaatagtagcattagtaatagtagcaataatagcaatagttgtgtggaccatagtagaccttttgggacagcggtg

SEQ ID NO: 403492 - DNA, 140 bp, Artificial Sequence
  Synthetic
caccgctgtcccaaaaggtctactatggtccacacaactattgctattattgctactattactaatgctactattgctgatatttgtaaagcgttcattacatgcactacttactgctttcatatcagcagccagggcct

SEQ ID NO: 403493 - DNA, 140 bp, Artificial Sequence
  Synthetic
aggccctggctgctgatatgtgatagaataatagacagagcagaagacagtggcaatgaaagtgaaggagaccaggaggaactatcagcacttatggagatggggcaccatgctccttgggaccttttgggacagcggtg

SEQ ID NO: 403494 - DNA, 140 bp, Artificial Sequence
  Synthetic
caccgctgtcccaaaaggtcccaaggagcatggtgccccatctccataagtgctgatagttcctcctggtctccttcactttcattgccactgtcttctgctctgtctattattctatcacatatcagcagccagggcct

SEQ ID NO: 403495 - DNA, 140 bp, Artificial Sequence
  Synthetic
aggccctggctgctgatatgagtagtatagttggctggcctgctgtaagggaaagaatgaaacgcaccccctccagtagcagaaggagggaaaacgcaccctccaggagcagcaaggtgtgaccttttgggacagcggtg

SEQ ID NO: 403496 - DNA, 140 bp, Artificial Sequence
  Synthetic
caccgctgtcccaaaaggtcacaccttgctgctcctggagggtgcgttttccctccttctgctactggagggggtgcgtttcattctttcccttacagcaggccagccaactatactactcatatcagcagccagggcct

SEQ ID NO: 403497 - DNA, 140 bp, Artificial Sequence
  Synthetic
atacgccatgctgggtctccggtactaatgatgcggcttgtgtttggctagaggcacaagaggatggccaggaggtgggttttccagtcaggcctcaggtacctttaagaccaatgactccgtacttgggagtcggccat

SEQ ID NO: 403498 - DNA, 140 bp, Artificial Sequence
  Synthetic
atggccgactcccaagtacggagtcattggtcttaaaggtacctgaggcctgactggaaaacccacctcctggccatcctcttgtgcctctagccaaacacaagccgcatcattagtaccggagacccagcatggcgtat

SEQ ID NO: 403499 - DNA, 140 bp, Artificial Sequence
  Synthetic
aggccctggctgctgatatgcaggaggtgggttttccagtcaggcctcaggtacctttaagaccaatgactcgcagggcagctcatgatcttagcttctttttgaaagaaaaggggggacgaccttttgggacagcggtg

SEQ ID NO: 403500 - DNA, 140 bp, Artificial Sequence
  Synthetic
caccgctgtcccaaaaggtcgtccccccttttctttcaaaaagaagctaagatcatgagctgccctgcgagtcattggtcttaaaggtacctgaggcctgactggaaaacccacctcctgcatatcagcagccagggcct

SEQ ID NO: 403501 - DNA, 140 bp, Artificial Sequence
  Synthetic
atacgccatgctgggtctccactaataataagggggaattaaaaaactgctctttccaggtcaccacaggcataggagatagaacaaagaaagaatatgcacttttttataagcatgatgcgtacttgggagtcggccat

SEQ ID NO: 403502 - DNA, 140 bp, Artificial Sequence
  Synthetic
atggccgactcccaagtacgcatcatgcttataaaaaagtgcatattctttctttgttctatctcctatgcctgtggtgacctggaaagagcagttttttaattcccccttattattagtggagacccagcatggcgtat

SEQ ID NO: 403503 - DNA, 140 bp, Artificial Sequence
  Synthetic
aggccctggctgctgatatgatgcaggataaaacaaattataaacatgtggcagcaggtaggacgagcaatgtatgctcctcccattgaaggaaacataacatgtaaatcaactatcacagaccttttgggacagcggtg

SEQ ID NO: 403504 - DNA, 140 bp, Artificial Sequence
  Synthetic
caccgctgtcccaaaaggtctgtgatagttgatttacatgttatgtttccttcaatgggaggagcatacattgctcgtcctacctgctgccacatgtttataatttgttttatcctgcatcatatcagcagccagggcct

SEQ ID NO: 403505 - DNA, 140 bp, Artificial Sequence
  Synthetic
aggccctggctgctgatatgaagatcctataccaaagcagtgagtataattaaataagctctgtaatgcaaactttgaatatagtaagcatagcaggattaatagtagcattcatagcaggaccttttgggacagcggtg

SEQ ID NO: 403506 - DNA, 140 bp, Artificial Sequence
  Synthetic
caccgctgtcccaaaaggtcctgctatgaatgctactattaatcctgctatgcttactatattcaaagtttgcattacagagcttatttaattatactcactgctttggtataggatcttcatatcagcagccagggcct

SEQ ID NO: 403507 - DNA, 140 bp, Artificial Sequence
  Synthetic
atacgccatgctgggtctcccaataatatttagaaaccactcaggaggggacttagaagttacaacacacgctttaattgtagaggagaatttttctattgcaatacatcaggcctgtttcgtacttgggagtcggccat

SEQ ID NO: 403508 - DNA, 140 bp, Artificial Sequence
  Synthetic
atggccgactcccaagtacgaaacaggcctgatgtattgcaatagaaaaattctcctctacaattaaagcgtgtgttgtaacttctaagtcccctcctgagtggtttctaaatattattgggagacccagcatggcgtat

SEQ ID NO: 403509 - DNA, 140 bp, Artificial Sequence
  Synthetic
atacgccatgctgggtctcctgctacttttaccgaaaacgataactacactaaaatcgagggactagagggaaatataacagatgaaataaggaactgttcttttaatatgaccacagagcgtacttgggagtcggccat

SEQ ID NO: 403510 - DNA, 140 bp, Artificial Sequence
  Synthetic
atggccgactcccaagtacgctctgtggtcatattaaaagaacagttccttatttcatctgttatatttccctctagtccctcgattttagtgtagttatcgttttcggtaaaagtagcaggagacccagcatggcgtat

SEQ ID NO: 403511 - DNA, 140 bp, Artificial Sequence
  Synthetic
aggccctggctgctgatatgtggtagagcagatgcatgaagatataattagtctatgggatcaaagcctaaagccatgtgtaaagttaacccctctctgtgttactttagattgtcataagaccttttgggacagcggtg

SEQ ID NO: 403512 - DNA, 140 bp, Artificial Sequence
  Synthetic
caccgctgtcccaaaaggtcttatgacaatctaaagtaacacagagaggggttaactttacacatggctttaggctttgatcccatagactaattatatcttcatgcatctgctctaccacatatcagcagccagggcct

SEQ ID NO: 403513 - DNA, 140 bp, Artificial Sequence
  Synthetic
atacgccatgctgggtctccgacccttcaacaatacaagaacaagtttcaggataggaccaggacgagcattccatagaacaggaaccataacaggagatataaagacagcatattgtgacgtacttgggagtcggccat

SEQ ID NO: 403514 - DNA, 140 bp, Artificial Sequence
  Synthetic
atggccgactcccaagtacgtcacaatatgctgtctttatatctcctgttatggttcctgttctatggaatgctcgtcctggtcctatcctgaaacttgttcttgtattgttgaagggtcggagacccagcatggcgtat

SEQ ID NO: 403515 - DNA, 140 bp, Artificial Sequence
  Synthetic
atacgccatgctgggtctccttctgggacgcagggggtgggaagcccttaagtatctgggaagtcttgtgcagtattggggtctggagctaaaaaagagtgctattagtctgcttgataccgtacttgggagtcggccat

SEQ ID NO: 403516 - DNA, 140 bp, Artificial Sequence
  Synthetic
atggccgactcccaagtacggtatcaagcagactaatagcactcttttttagctccagaccccaatactgcacaagacttcccagatacttaagggcttcccaccccctgcgtcccagaaggagacccagcatggcgtat

SEQ ID NO: 403517 - DNA, 140 bp, Artificial Sequence
  Synthetic
aggccctggctgctgatatgcagtattggggtctggagctaaaaaagagtgctattagtctgcttgataccatagcaatagcagtagctgaaggaacagataggattatagaagtagtacgaccttttgggacagcggtg

SEQ ID NO: 403518 - DNA, 140 bp, Artificial Sequence
  Synthetic
caccgctgtcccaaaaggtcgtactacttctataatcctatctgttccttcagctactgctattgctatggtatcaagcagactaatagcactcttttttagctccagaccccaatactgcatatcagcagccagggcct

SEQ ID NO: 403519 - DNA, 140 bp, Artificial Sequence
  Synthetic
atacgccatgctgggtctccaccaataatggtaacaataatgatagtaagattatcaatgatgagatgaaaaattgctctttcaatgcaaccacagaaataagagataagactcgcaaagcgtacttgggagtcggccat

SEQ ID NO: 403520 - DNA, 140 bp, Artificial Sequence
  Synthetic
atggccgactcccaagtacgctttgcgagtcttatctcttatttctgtggttgcattgaaagagcaatttttcatctcatcattgataatcttactatcattattgttaccattattggtggagacccagcatggcgtat

SEQ ID NO: 403521 - DNA, 140 bp, Artificial Sequence
  Synthetic
aggccctggctgctgatatgtttgctaactcctcaggaggggatttagaaattacaacacatagttttaattgtagaggagaatttttctattgcaatacaacaaaactgtttaatagcagaccttttgggacagcggtg

SEQ ID NO: 403522 - DNA, 140 bp, Artificial Sequence
  Synthetic
caccgctgtcccaaaaggtctgctattaaacagttttgttgtattgcaatagaaaaattctcctctacaattaaaactatgtgttgtaatttctaaatcccctcctgaggagttagcaaacatatcagcagccagggcct

SEQ ID NO: 403523 - DNA, 140 bp, Artificial Sequence
  Synthetic
aggccctggctgctgatatgtataaatatgtggcagagagtaggacaagcaatgtatgcccctcccatcccaggagaaataaagtgtgtatcaaacattactggactaatattaacaagagaccttttgggacagcggtg

SEQ ID NO: 403524 - DNA, 140 bp, Artificial Sequence
  Synthetic
caccgctgtcccaaaaggtctcttgttaatattagtccagtaatgtttgatacacactttatttctcctgggatgggaggggcatacattgcttgtcctactctctgccacatatttatacatatcagcagccagggcct

SEQ ID NO: 403525 - DNA, 140 bp, Artificial Sequence
  Synthetic
aggccctggctgctgatatgggacagatagggttatagaagtagtgctaagagcttatagagctattctccacatacctagaagaataagacagggcttggaaaggcttttgctataagagaccttttgggacagcggtg

SEQ ID NO: 403526 - DNA, 140 bp, Artificial Sequence
  Synthetic
caccgctgtcccaaaaggtctcttatagcaaaagcctttccaagccctgtcttattcttctaggtatgtggagaatagctctataagctcttagcactacttctataaccctatctgtcccatatcagcagccagggcct

SEQ ID NO: 403527 - DNA, 140 bp, Artificial Sequence
  Synthetic
atacgccatgctgggtctcctgggataacatgacctggatgcagtgggaaaaagaaattgataattacacaagcgaaatatacaccttaattgaagagtcacagaaccaacaagaaaagacgtacttgggagtcggccat

SEQ ID NO: 403528 - DNA, 140 bp, Artificial Sequence
  Synthetic
atggccgactcccaagtacgtcttttcttgttggttctgtgactcttcaattaaggtgtatatttcgcttgtgtaattatcaatttctttttcccactgcatccaggtcatgttatcccaggagacccagcatggcgtat

SEQ ID NO: 403529 - DNA, 140 bp, Artificial Sequence
  Synthetic
aggccctggctgctgatatgcaactcaactgctgttaaatggcagcctatcagaaggagatataatgatcaggtctcaaaatttcacaaacaatgctaaaactataatagtacagctgaagaccttttgggacagcggtg

SEQ ID NO: 403530 - DNA, 140 bp, Artificial Sequence
  Synthetic
caccgctgtcccaaaaggtcttcagctgtactattatagttttagcattgtttgtgaaattttgagacctgatcattatatctccttctgataggctgccatttaacagcagttgagttgcatatcagcagccagggcct

SEQ ID NO: 403531 - DNA, 140 bp, Artificial Sequence
  Synthetic
atacgccatgctgggtctccggctcaccagctatattccaaagttcaatgacaaaaattctagatccatttaggaaagacaacccagaattagaaatttgtcagtacatggatgacctatcgtacttgggagtcggccat

SEQ ID NO: 403532 - DNA, 140 bp, Artificial Sequence
  Synthetic
atggccgactcccaagtacgataggtcatccatgtactgacaaatttctaattctgggttgtctttcctaaatggatctagaatttttgtcattgaactttggaatatagctggtgagccggagacccagcatggcgtat

SEQ ID NO: 403533 - DNA, 140 bp, Artificial Sequence
  Synthetic
atacgccatgctgggtctcctcaagggattgagactggggtgggaagccctcaaatatctggggaatcttctgttatactggggtcaggaattaagaattagtgctattaacttgcttaacgtacttgggagtcggccat

SEQ ID NO: 403534 - DNA, 140 bp, Artificial Sequence
  Synthetic
atggccgactcccaagtacgttaagcaagttaatagcactaattcttaattcctgaccccagtataacagaagattccccagatatttgagggcttcccaccccagtctcaatcccttgaggagacccagcatggcgtat

SEQ ID NO: 403535 - DNA, 140 bp, Artificial Sequence
  Synthetic
aggccctggctgctgatatgcaagggactacagagggggtgggaagcccttaaatatctaggaaatcttgtgcagtattggggtctggaactaaaaaagagtgctattagtctgtttgatgaccttttgggacagcggtg

SEQ ID NO: 403536 - DNA, 140 bp, Artificial Sequence
  Synthetic
caccgctgtcccaaaaggtcatcaaacagactaatagcactcttttttagttccagaccccaatactgcacaagatttcctagatatttaagggcttcccaccccctctgtagtcccttgcatatcagcagccagggcct

SEQ ID NO: 403537 - DNA, 140 bp, Artificial Sequence
  Synthetic
aggccctggctgctgatatgaccatagcaatagcagtagctgagggaacagataggattatagaattcatacaaagattttgtagagctatccgcaacctacctagaagaataagacagggaccttttgggacagcggtg

SEQ ID NO: 403538 - DNA, 140 bp, Artificial Sequence
  Synthetic
caccgctgtcccaaaaggtccctgtcttattcttctaggtaggttgcggatagctctacaaaatctttgtatgaattctataatcctatctgttccctcagctactgctattgctatggtcatatcagcagccagggcct

SEQ ID NO: 403539 - DNA, 140 bp, Artificial Sequence
  Synthetic
atacgccatgctgggtctccgtatacatgtaggatgggggagagcattatatacaacaggacaaataataggagatataagaaaggcacattgtaacattagtctaacaaagtggaacaacgtacttgggagtcggccat

SEQ ID NO: 403540 - DNA, 140 bp, Artificial Sequence
  Synthetic
atggccgactcccaagtacgttgttccactttgttagactaatgttacaatgtgcctttcttatatctcctattatttgtcctgttgtatataatgctctcccccatcctacatgtatacggagacccagcatggcgtat

SEQ ID NO: 403541 - DNA, 140 bp, Artificial Sequence
  Synthetic
aggccctggctgctgatatgcagcagagggagtaggagcagcgtctcgagacttagataaacatggagcacttacaagcagcaatacacccaccaataatgctgcttgtgcctggctggagaccttttgggacagcggtg

SEQ ID NO: 403542 - DNA, 140 bp, Artificial Sequence
  Synthetic
caccgctgtcccaaaaggtctccagccaggcacaagcagcattattggtgggtgtattgctgcttgtaagtgctccatgtttatctaagtctcgagacgctgctcctactccctctgctgcatatcagcagccagggcct

SEQ ID NO: 403543 - DNA, 140 bp, Artificial Sequence
  Synthetic
atacgccatgctgggtctccggcgactggtgagtacgccaaaattttatttgactagcggaggctaggaggagagagatgggtgcgagagcgtcaatattaagaggtggaaaattagatacgtacttgggagtcggccat

SEQ ID NO: 403544 - DNA, 140 bp, Artificial Sequence
  Synthetic
atggccgactcccaagtacgtatctaattttccacctcttaatattgacgctctcgcacccatctctctcctcctagcctccgctagtcaaataaaattttggcgtactcaccagtcgccggagacccagcatggcgtat

SEQ ID NO: 403545 - DNA, 140 bp, Artificial Sequence
  Synthetic
  misc_feature (80)..(80): n is a, c, g, or t
aggccctggctgctgatatgtataatacagtagcaaccctctggtgcgtacatcgacagatagatgtaaaagataccaangaagctttagataaaatagaggaaatacaaaagaagagcagaccttttgggacagcggtg

SEQ ID NO: 403546 - DNA, 140 bp, Artificial Sequence
  Synthetic
  misc_feature (61)..(61): n is a, c, g, or t
caccgctgtcccaaaaggtctgctcttcttttgtatttcctctattttatctaaagcttcnttggtatcttttacatctatctgtcgatgtacgcaccagagggttgctactgtattatacatatcagcagccagggcct

SEQ ID NO: 403547 - DNA, 140 bp, Artificial Sequence
  Synthetic
aggccctggctgctgatatgagttttaattgtgcaggggaattcttctactgtaatacatcaaagctgtttaatagtacgttgtttagtaataatacttggttcaatagtactatgaatggaccttttgggacagcggtg

SEQ ID NO: 403548 - DNA, 140 bp, Artificial Sequence
  Synthetic
caccgctgtcccaaaaggtccattcatagtactattgaaccaagtattattactaaacaacgtactattaaacagctttgatgtattacagtagaagaattcccctgcacaattaaaactcatatcagcagccagggcct

SEQ ID NO: 403549 - DNA, 140 bp, Artificial Sequence
  Synthetic
atacgccatgctgggtctccaggacaaggaacagccccctcctttagtttccctcaaatcactctttggcaacgacccattgtcacagtaaaaataggaggacagctaaaggaagctctgcgtacttgggagtcggccat

SEQ ID NO: 403550 - DNA, 140 bp, Artificial Sequence
  Synthetic
atggccgactcccaagtacgcagagcttcctttagctgtcctcctatttttactgtgacaatgggtcgttgccaaagagtgatttgagggaaactaaaggagggggctgttccttgtcctggagacccagcatggcgtat

SEQ ID NO: 403551 - DNA, 140 bp, Artificial Sequence
  Synthetic
atacgccatgctgggtctccacaatacaggagaataaaaagacaaagacaaatagacaggttaattgatagaataatagaaagagcagaagatagtggcaatgaaagcgaaggggatcagcgtacttgggagtcggccat

SEQ ID NO: 403552 - DNA, 140 bp, Artificial Sequence
  Synthetic
atggccgactcccaagtacgctgatccccttcgctttcattgccactatcttctgctctttctattattctatcaattaacctgtctatttgtctttgtctttttattctcctgtattgtggagacccagcatggcgtat

SEQ ID NO: 403553 - DNA, 140 bp, Artificial Sequence
  Synthetic
atacgccatgctgggtctcctgatgatctgtagtgctacaaatttgtgggtcacagtctattatggggtacctgtgtggaaagaagcaaccaccactctattctgtgcatcagatgcgaacgtacttgggagtcggccat

SEQ ID NO: 403554 - DNA, 140 bp, Artificial Sequence
  Synthetic
atggccgactcccaagtacgttcgcatctgatgcacagaatagagtggtggttgcttctttccacacaggtaccccataatagactgtgacccacaaatttgtagcactacagatcatcaggagacccagcatggcgtat

SEQ ID NO: 403555 - DNA, 140 bp, Artificial Sequence
  Synthetic
aggccctggctgctgatatgaatccagaaatagttatataccaatacatggatgatttgtatgtagggtctgacttagaaatagggcaacatagagcaaaaatagaggaactaagagaacgaccttttgggacagcggtg

SEQ ID NO: 403556 - DNA, 140 bp, Artificial Sequence
  Synthetic
caccgctgtcccaaaaggtcgttctcttagttcctctatttttgctctatgttgccctatttctaagtcagaccctacatacaaatcatccatgtattggtatataactatttctggattcatatcagcagccagggcct

SEQ ID NO: 403557 - DNA, 140 bp, Artificial Sequence
  Synthetic
atacgccatgctgggtctccatcctttaagagtgcctcaggaggggacccagaaattgtaacacacagttttaattgtggaggggaatttttctattgtaatacaacacagctgtttaatcgtacttgggagtcggccat

SEQ ID NO: 403558 - DNA, 140 bp, Artificial Sequence
  Synthetic
atggccgactcccaagtacgattaaacagctgtgttgtattacaatagaaaaattcccctccacaattaaaactgtgtgttacaatttctgggtcccctcctgaggcactcttaaaggatggagacccagcatggcgtat

SEQ ID NO: 403559 - DNA, 140 bp, Artificial Sequence
  Synthetic
aggccctggctgctgatatgcaagtctgtggacttggtttgacataacaaagtggctgtggtatataaaaatattcataatgatagtaggaggcttgataggcttaagaatagtttttacgaccttttgggacagcggtg

SEQ ID NO: 403560 - DNA, 140 bp, Artificial Sequence
  Synthetic
caccgctgtcccaaaaggtcgtaaaaactattcttaagcctatcaagcctcctactatcattatgaatatttttatataccacagccactttgttatgtcaaaccaagtccacagacttgcatatcagcagccagggcct

SEQ ID NO: 403561 - DNA, 140 bp, Artificial Sequence
  Synthetic
aggccctggctgctgatatgcacaaccagacaagagtgaatcagagttagtcaatcagataatagagaagctaatagaaaaagaaaaggtctatctgtcatgggtgccagcacacaaagggaccttttgggacagcggtg

SEQ ID NO: 403562 - DNA, 140 bp, Artificial Sequence
  Synthetic
caccgctgtcccaaaaggtccctttgtgtgctggcacccatgacagatagaccttttctttttctattagcttctctattatctgattgactaactctgattcactcttgtctggttgtgcatatcagcagccagggcct

SEQ ID NO: 403563 - DNA, 140 bp, Artificial Sequence
  Synthetic
aggccctggctgctgatatggagaaattgacaattacacaggcttaatatacaacttacttgaagaatcgcagaaccaacaagaaaagaatgaacaagaattattggaattggataagtggaccttttgggacagcggtg

SEQ ID NO: 403564 - DNA, 140 bp, Artificial Sequence
  Synthetic
caccgctgtcccaaaaggtccacttatccaattccaataattcttgttcattcttttcttgttggttctgcgattcttcaagtaagttgtatattaagcctgtgtaattgtcaatttctccatatcagcagccagggcct

SEQ ID NO: 403565 - DNA, 140 bp, Artificial Sequence
  Synthetic
atacgccatgctgggtctcctaatagtaccagtagtaatgttaatagtaccagtaatggtaatgataccacccaggagggcatagaagagataaaaaattgctctttcaatgcaaccacacgtacttgggagtcggccat

SEQ ID NO: 403566 - DNA, 140 bp, Artificial Sequence
  Synthetic
atggccgactcccaagtacgtgtggttgcattgaaagagcaattttttatctcttctatgccctcctgggtggtatcattaccattactggtactattaacattactactggtactattaggagacccagcatggcgtat

SEQ ID NO: 403567 - DNA, 140 bp, Artificial Sequence
  Synthetic
aggccctggctgctgatatgtgcaaagagctggtagagctatccgcaacgtacctgtaagaataagacagggcttggaaagggctttgctataaaatgggtggcaagtggtcaaaatgtagaccttttgggacagcggtg

SEQ ID NO: 403568 - DNA, 140 bp, Artificial Sequence
  Synthetic
caccgctgtcccaaaaggtctacattttgaccacttgccacccattttatagcaaagccctttccaagccctgtcttattcttacaggtacgttgcggatagctctaccagctctttgcacatatcagcagccagggcct

SEQ ID NO: 403569 - DNA, 140 bp, Artificial Sequence
  Synthetic
atacgccatgctgggtctccttaaatcattatttaatacaatagcaaccctctactgtgtacatcaaaagatagatgtaaaagacaccaaggaagctgtggagaaagttgaggaactacacgtacttgggagtcggccat

SEQ ID NO: 403570 - DNA, 140 bp, Artificial Sequence
  Synthetic
atggccgactcccaagtacgtgtagttcctcaactttctccacagcttccttggtgtcttttacatctatcttttgatgtacacagtagagggttgctattgtattaaataatgatttaaggagacccagcatggcgtat

SEQ ID NO: 403571 - DNA, 140 bp, Artificial Sequence
  Synthetic
atacgccatgctgggtctccgaaacatcacgctcccatgcagaataaagcaaattataaacatgtggcaggaggtaggacgagcaatgtatgcccctcccattaaaggaaaaataacatgcgtacttgggagtcggccat

SEQ ID NO: 403572 - DNA, 140 bp, Artificial Sequence
  Synthetic
atggccgactcccaagtacgcatgttatttttcctttaatgggaggggcatacattgctcgtcctacctcctgccacatgtttataatttgctttattctgcatgggagcgtgatgtttcggagacccagcatggcgtat

SEQ ID NO: 403573 - DNA, 140 bp, Artificial Sequence
  Synthetic
aggccctggctgctgatatggcaatgctgattgtgcttggctagaagcacaagaggaagaggaagtgggttttccagtcagaccccaggtacctttaagaccaatgactcccagggcagcgaccttttgggacagcggtg

SEQ ID NO: 403574 - DNA, 140 bp, Artificial Sequence
  Synthetic
caccgctgtcccaaaaggtcgctgccctgggagtcattggtcttaaaggtacctggggtctgactggaaaacccacttcctcttcctcttgtgcttctagccaagcacaatcagcattgccatatcagcagccagggcct

SEQ ID NO: 403575 - DNA, 140 bp, Artificial Sequence
  Synthetic
aggccctggctgctgatatgacgcaggactcggcttgctgaagcgcgcacggcaagaggcgaggggcggcgactggtgagtacgccaaaaactttttgactagcggaggctagaaggagagaccttttgggacagcggtg

SEQ ID NO: 403576 - DNA, 140 bp, Artificial Sequence
  Synthetic
caccgctgtcccaaaaggtctctccttctagcctccgctagtcaaaaagtttttggcgtactcaccagtcgccgcccctcgcctcttgccgtgcgcgcttcagcaagccgagtcctgcgtcatatcagcagccagggcct

SEQ ID NO: 403577 - DNA, 140 bp, Artificial Sequence
  Synthetic
aggccctggctgctgatatgcagaggaccaggggccacagagggaaccaaacaacgaatggacactagagcttttggaggagcttaaaaatgaagctgttagacattttcctagaccctggaccttttgggacagcggtg

SEQ ID NO: 403578 - DNA, 140 bp, Artificial Sequence
  Synthetic
caccgctgtcccaaaaggtccagggtctaggaaaatgtctaacagcttcatttttaagctcctccaaaagctctagtgtccattcgttgtttggttccctctgtggcccctggtcctctgcatatcagcagccagggcct

SEQ ID NO: 403579 - DNA, 140 bp, Artificial Sequence
  Synthetic
atacgccatgctgggtctccaatagtacagctgaatgaaactgtaaaaattaattgtacaagacccaacaacaatacaagaaaagctatacgtataggacgagggagagcaatttatgcacgtacttgggagtcggccat

SEQ ID NO: 403580 - DNA, 140 bp, Artificial Sequence
  Synthetic
atggccgactcccaagtacgtgcataaattgctctccctcgtcctatacgtatagcttttcttgtattgttgttgggtcttgtacaattaatttttacagtttcattcagctgtactattggagacccagcatggcgtat

SEQ ID NO: 403581 - DNA, 140 bp, Artificial Sequence
  Synthetic
aggccctggctgctgatatgggaaatccttaagtatttgggaagcattgtgcagtattggagtcaggaaccaaagaatagtgctattagcttgctcaatactacagctatagcagtggctgaccttttgggacagcggtg

SEQ ID NO: 403582 - DNA, 140 bp, Artificial Sequence
  Synthetic
caccgctgtcccaaaaggtcagccactgctatagctgtagtattgagcaagctaatagcactattctttggttcctgactccaatactgcacaatgcttcccaaatacttaaggatttcccatatcagcagccagggcct

SEQ ID NO: 403583 - DNA, 140 bp, Artificial Sequence
  Synthetic
atacgccatgctgggtctcccaaagaatagtgctattagcttgctcaatactacagctatagcagtggctgaggggacagataggcttatagaaatagttcaaataatttggagggctatcgtacttgggagtcggccat

SEQ ID NO: 403584 - DNA, 140 bp, Artificial Sequence
  Synthetic
atggccgactcccaagtacgatagccctccaaattatttgaactatttctataagcctatctgtcccctcagccactgctatagctgtagtattgagcaagctaatagcactattctttgggagacccagcatggcgtat

SEQ ID NO: 403585 - DNA, 140 bp, Artificial Sequence
  Synthetic
aggccctggctgctgatatgttcagacctggaggaggaaatatgaaggacaattggagaagtgaattatataaatataaagtagtagaaattgaaccattaggagtagcacccaccaagggaccttttgggacagcggtg

SEQ ID NO: 403586 - DNA, 140 bp, Artificial Sequence
  Synthetic
caccgctgtcccaaaaggtcccttggtgggtgctactcctaatggttcaatttctactactttatatttatataattcacttctccaattgtccttcatatttcctcctccaggtctgaacatatcagcagccagggcct

SEQ ID NO: 403587 - DNA, 140 bp, Artificial Sequence
  Synthetic
aggccctggctgctgatatgatagtagtagctgaaggaacagataggattatagaattagtacaaagattttgtagagctatctgcaacatacctagaagaataagacagggctttgaaggaccttttgggacagcggtg

SEQ ID NO: 403588 - DNA, 140 bp, Artificial Sequence
  Synthetic
caccgctgtcccaaaaggtccttcaaagccctgtcttattcttctaggtatgttgcagatagctctacaaaatctttgtactaattctataatcctatctgttccttcagctactactatcatatcagcagccagggcct

SEQ ID NO: 403589 - DNA, 140 bp, Artificial Sequence
  Synthetic
aggccctggctgctgatatgaatgtcagaacgtcaccaacagcagcagaaccatatctagtgacatggaaggggaaataaaaaactgctctttcaatatgaccacaatattaagggataagaccttttgggacagcggtg

SEQ ID NO: 403590 - DNA, 140 bp, Artificial Sequence
  Synthetic
caccgctgtcccaaaaggtcttatcccttaatattgtggtcatattgaaagagcagttttttatttccccttccatgtcactagatatggttctgctgctgttggtgacgttctgacattcatatcagcagccagggcct

SEQ ID NO: 403591 - DNA, 140 bp, Artificial Sequence
  Synthetic
atacgccatgctgggtctccccaacaatacaagaacaagtatacctatgggaccaggaagagcactctttagaacaggagaaataataggaaatccaagacaagcattttgtaaggttaacgtacttgggagtcggccat

SEQ ID NO: 403592 - DNA, 140 bp, Artificial Sequence
  Synthetic
atggccgactcccaagtacgttaaccttacaaaatgcttgtcttggatttcctattatttctcctgttctaaagagtgctcttcctggtcccataggtatacttgttcttgtattgttggggagacccagcatggcgtat

SEQ ID NO: 403593 - DNA, 140 bp, Artificial Sequence
  Synthetic
atacgccatgctgggtctccctaatgctatcagtaatggtaatgccacttacaataatacagggaatggggaaatgaaaaattgctctttcaatacaaccacagaaataagaaataagaacgtacttgggagtcggccat

SEQ ID NO: 403594 - DNA, 140 bp, Artificial Sequence
  Synthetic
atggccgactcccaagtacgttcttatttcttatttctgtggttgtattgaaagagcaatttttcatttccccattccctgtattattgtaagtggcattaccattactgatagcattagggagacccagcatggcgtat

SEQ ID NO: 403595 - DNA, 140 bp, Artificial Sequence
  Synthetic
aggccctggctgctgatatgaccatcccttcagacaggatcagaagagcttaaatcattatttaatacagtagcagtcctctattgtgtacatcaaaagatagatgtaaaagacaccaaggaccttttgggacagcggtg

SEQ ID NO: 403596 - DNA, 140 bp, Artificial Sequence
  Synthetic
caccgctgtcccaaaaggtccttggtgtcttttacatctatcttttgatgtacacaatagaggactgctactgtattaaataatgatttaagctcttctgatcctgtctgaagggatggtcatatcagcagccagggcct

SEQ ID NO: 403597 - DNA, 140 bp, Artificial Sequence
  Synthetic
aggccctggctgctgatatgtggcaggaagaagcggagacaacgacgaagcgctccttcaagcagtaaggatcatcaaaatcttatatcaaagcagtaagtactaagtagtatatgtaatgaccttttgggacagcggtg

SEQ ID NO: 403598 - DNA, 140 bp, Artificial Sequence
  Synthetic
caccgctgtcccaaaaggtcattacatatactacttagtacttactgctttgatataagattttgatgatccttactgcttgaaggagcgcttcgtcgttgtctccgcttcttcctgccacatatcagcagccagggcct

SEQ ID NO: 403599 - DNA, 140 bp, Artificial Sequence
  Synthetic
aggccctggctgctgatatgtccaacttaatgaatctgtagcaattaattgtacaagacccaacaataatacaagaaaaagtataaggataggaccaggacaaacattctatgcaacagggaccttttgggacagcggtg

SEQ ID NO: 403600 - DNA, 140 bp, Artificial Sequence
  Synthetic
caccgctgtcccaaaaggtccctgttgcatagaatgtttgtcctggtcctatccttatactttttcttgtattattgttgggtcttgtacaattaattgctacagattcattaagttggacatatcagcagccagggcct

SEQ ID NO: 403601 - DNA, 140 bp, Artificial Sequence
  Synthetic
atacgccatgctgggtctcccctaatgacacaatagaatttaaaccacacgcaggaggggatctagaaattacaacacatagctttaattgtagaggagaatttttctattgcaatacaacgtacttgggagtcggccat

SEQ ID NO: 403602 - DNA, 140 bp, Artificial Sequence
  Synthetic
atggccgactcccaagtacgttgtattgcaatagaaaaattctcctctacaattaaagctatgtgttgtaatttctagatcccctcctgcgtgtggtttaaattctattgtgtcattaggggagacccagcatggcgtat

SEQ ID NO: 403603 - DNA, 140 bp, Artificial Sequence
  Synthetic
atacgccatgctgggtctcctgcaaagggctggtagagctattcttcacatacctagaagaatcagacagggcttcgaaagggctttgctataacatgggtggcaagtggtcaaaaagtacgtacttgggagtcggccat

SEQ ID NO: 403604 - DNA, 140 bp, Artificial Sequence
  Synthetic
atggccgactcccaagtacgtactttttgaccacttgccacccatgttatagcaaagccctttcgaagccctgtctgattcttctaggtatgtgaagaatagctctaccagccctttgcaggagacccagcatggcgtat

SEQ ID NO: 403605 - DNA, 140 bp, Artificial Sequence
  Synthetic
atacgccatgctgggtctccgattacaagcagcaacactgccgctactaatcctaccttggcctggctggaagcacaagaagaaggggaagtagggtttccagtaagaccccaagtacctcgtacttgggagtcggccat

SEQ ID NO: 403606 - DNA, 140 bp, Artificial Sequence
  Synthetic
atggccgactcccaagtacgaggtacttggggtcttactggaaaccctacttccccttcttcttgtgcttccagccaggccaaggtaggattagtagcggcagtgttgctgcttgtaatcggagacccagcatggcgtat

SEQ ID NO: 403607 - DNA, 140 bp, Artificial Sequence
  Synthetic
aggccctggctgctgatatgaacatttagtatgggcaagcagagagttggaaagattcgcacttaaccctggccttttagaaacagcagaaggatgtcaacaattaatagaacagttacagaccttttgggacagcggtg

SEQ ID NO: 403608 - DNA, 140 bp, Artificial Sequence
  Synthetic
caccgctgtcccaaaaggtctgtaactgttctattaattgttgacatccttctgctgtttctaaaaggccagggttaagtgcgaatctttccaactctctgcttgcccatactaaatgttcatatcagcagccagggcct

SEQ ID NO: 403609 - DNA, 140 bp, Artificial Sequence
  Synthetic
atacgccatgctgggtctcccaagcaaacagtaacataatgatgcagagaagtaattttaaaagatctaaaagaattgttaaatgcttcaactgtggcaaggacgggcacatagccagaacgtacttgggagtcggccat

SEQ ID NO: 403610 - DNA, 140 bp, Artificial Sequence
  Synthetic
atggccgactcccaagtacgttctggctatgtgcccgtccttgccacagttgaagcatttaacaattcttttagatcttttaaaattacttctctgcatcattatgttactgtttgcttgggagacccagcatggcgtat

SEQ ID NO: 403611 - DNA, 140 bp, Artificial Sequence
  Synthetic
atacgccatgctgggtctccgcaagggggaggagggagaaatgagaaactgctctttcaatatcaccacgcaaataaaacaaaaggtgcgaacagagtacgcccttttttataagcatgacgtacttgggagtcggccat

SEQ ID NO: 403612 - DNA, 140 bp, Artificial Sequence
  Synthetic
atggccgactcccaagtacgtcatgcttataaaaaagggcgtactctgttcgcaccttttgttttatttgcgtggtgatattgaaagagcagtttctcatttctccctcctcccccttgcggagacccagcatggcgtat

SEQ ID NO: 403613 - DNA, 140 bp, Artificial Sequence
  Synthetic
aggccctggctgctgatatgttatatttgcaccacattcaggaggggacctagaaattacaacacatagctttaattgtagaggagaatttttctattgcaatacatcaaaactgtttaagaccttttgggacagcggtg

SEQ ID NO: 403614 - DNA, 140 bp, Artificial Sequence
  Synthetic
caccgctgtcccaaaaggtcttaaacagttttgatgtattgcaatagaaaaattctcctctacaattaaagctatgtgttgtaatttctaggtcccctcctgaatgtggtgcaaatataacatatcagcagccagggcct

SEQ ID NO: 403615 - DNA, 140 bp, Artificial Sequence
  Synthetic
aggccctggctgctgatatgctgctctggaaaactcatctgcaccactgctgtgccttggaactctagttggagtaataaatctctagaggctatttggaagaacatgacctggatgcaggaccttttgggacagcggtg

SEQ ID NO: 403616 - DNA, 140 bp, Artificial Sequence
  Synthetic
caccgctgtcccaaaaggtcctgcatccaggtcatgttcttccaaatagcctctagagatttattactccaactagagttccaaggcacagcagtggtgcagatgagttttccagagcagcatatcagcagccagggcct

SEQ ID NO: 403617 - DNA, 140 bp, Artificial Sequence
  Synthetic
atacgccatgctgggtctccacaataggaagcataacaagagatataagacaagcacattgtaacattagtagagcaaaatgggataacactttaaaacagatagttaaaaaattaagtgcgtacttgggagtcggccat

SEQ ID NO: 403618 - DNA, 140 bp, Artificial Sequence
  Synthetic
atggccgactcccaagtacgcacttaattttttaactatctgttttaaagtgttatcccattttgctctactaatgttacaatgtgcttgtcttatatctcttgttatgcttcctattgtggagacccagcatggcgtat

SEQ ID NO: 403619 - DNA, 140 bp, Artificial Sequence
  Synthetic
atacgccatgctgggtctccaacaatttgagaatacaacaacaatattctttaagcaagcctcaggaggggacccagaagttgtaacgcacacttttaattgtggaggggaatttttctacgtacttgggagtcggccat

SEQ ID NO: 403620 - DNA, 140 bp, Artificial Sequence
  Synthetic
atggccgactcccaagtacgtagaaaaattcccctccacaattaaaagtgtgcgttacaacttctgggtcccctcctgaggcttgcttaaagaatattgttgttgtattctcaaattgttggagacccagcatggcgtat

SEQ ID NO: 403621 - DNA, 140 bp, Artificial Sequence
  Synthetic
atacgccatgctgggtctccattggagaaataaaaaattgctctttcaatatgaccacagaactgagagataagaaaaagaatgtgtatgcacttttttataaacttgatatagtaccaccgtacttgggagtcggccat

SEQ ID NO: 403622 - DNA, 140 bp, Artificial Sequence
  Synthetic
atggccgactcccaagtacggtggtactatatcaagtttataaaaaagtgcatacacattctttttcttatctctcagttctgtggtcatattgaaagagcaattttttatttctccaatggagacccagcatggcgtat

SEQ ID NO: 403623 - DNA, 140 bp, Artificial Sequence
  Synthetic
atacgccatgctgggtctcctaaggtaggatctctacaatatctggcactaacagcattaataaacccaaaaaagacaaagccacctttgcctagtgtgcaaaaattagtagaggatagacgtacttgggagtcggccat

SEQ ID NO: 403624 - DNA, 140 bp, Artificial Sequence
  Synthetic
atggccgactcccaagtacgtctatcctctactaatttttgcacactaggcaaaggtggctttgtcttttttgggtttattaatgctgttagtgccagatattgtagagatcctaccttaggagacccagcatggcgtat

SEQ ID NO: 403625 - DNA, 140 bp, Artificial Sequence
  Synthetic
aggccctggctgctgatatgaggtagacaggatgaggattaatacatggaaaagtttagtaaaataccatatgcatatttcaaagaaagctaaaaattggttttatagacatcactatgagaccttttgggacagcggtg

SEQ ID NO: 403626 - DNA, 140 bp, Artificial Sequence
  Synthetic
caccgctgtcccaaaaggtctcatagtgatgtctataaaaccaatttttagctttctttgaaatatgcatatggtattttactaaacttttccatgtattaatcctcatcctgtctacctcatatcagcagccagggcct

SEQ ID NO: 403627 - DNA, 140 bp, Artificial Sequence
  Synthetic
atacgccatgctgggtctcctgtaatgacacctttggaaattagtgcaatagcaggactggtagtagcgctaatcttagcaatagtagtgtggactatagtagctatagaatataggaaacgtacttgggagtcggccat

SEQ ID NO: 403628 - DNA, 140 bp, Artificial Sequence
  Synthetic
atggccgactcccaagtacgtttcctatattctatagctactatagtccacactactattgctaagattagcgctactaccagtcctgctattgcactaatttccaaaggtgtcattacaggagacccagcatggcgtat

SEQ ID NO: 403629 - DNA, 140 bp, Artificial Sequence
  Synthetic
atacgccatgctgggtctccccataattgtgtggagcatagtatttatagaatataggaaaataagaaaacaaaagagaatagataagttaattgataggataagagatagagcagaagacgtacttgggagtcggccat

SEQ ID NO: 403630 - DNA, 140 bp, Artificial Sequence
  Synthetic
atggccgactcccaagtacgtcttctgctctatctcttatcctatcaattaacttatctattctcttttgttttcttattttcctatattctataaatactatgctccacacaattatggggagacccagcatggcgtat

SEQ ID NO: 403631 - DNA, 140 bp, Artificial Sequence
  Synthetic
atacgccatgctgggtctcccagtggcaatgaaagtgaaggggacacagacgaactggcaaaacttgtggagatggggcctcctcatgacctttggaactttaatgatttgtagtgctaccgtacttgggagtcggccat

SEQ ID NO: 403632 - DNA, 140 bp, Artificial Sequence
  Synthetic
atggccgactcccaagtacggtagcactacaaatcattaaagttccaaaggtcatgaggaggccccatctccacaagttttgccagttcgtctgtgtccccttcactttcattgccactgggagacccagcatggcgtat

SEQ ID NO: 403633 - DNA, 140 bp, Artificial Sequence
  Synthetic
atacgccatgctgggtctccccaatgcctctgacatactaggaaatgtaacagaggaagtaagaaactgcacttttaatatgaccacagtactacaagataagaagcagagagtccatgccgtacttgggagtcggccat

SEQ ID NO: 403634 - DNA, 140 bp, Artificial Sequence
  Synthetic
atggccgactcccaagtacggcatggactctctgcttcttatcttgtagtactgtggtcatattaaaagtgcagtttcttacttcctctgttacatttcctagtatgtcagaggcattggggagacccagcatggcgtat

SEQ ID NO: 403635 - DNA, 140 bp, Artificial Sequence
  Synthetic
aggccctggctgctgatatgaaaatccagacatagttatctatcaatacatggatgacttgtatgtaggatctgacttagaaatagggcagcatagagcaaaaatagaggagttaagagagaccttttgggacagcggtg

SEQ ID NO: 403636 - DNA, 140 bp, Artificial Sequence
  Synthetic
caccgctgtcccaaaaggtctctcttaactcctctatttttgctctatgctgccctatttctaagtcagatcctacatacaagtcatccatgtattgatagataactatgtctggattttcatatcagcagccagggcct

SEQ ID NO: 403637 - DNA, 140 bp, Artificial Sequence
  Synthetic
atacgccatgctgggtctccattccaacagcaacagcaccaggaaggaaatgctagaacaaatgaaaaactgctcttacaatgcgaccacagaactgagagataaacacaagaaaatgtacgtacttgggagtcggccat

SEQ ID NO: 403638 - DNA, 140 bp, Artificial Sequence
  Synthetic
atggccgactcccaagtacgtacattttcttgtgtttatctctcagttctgtggtcgcattgtaagagcagtttttcatttgttctagcatttccttcctggtgctgttgctgttggaatggagacccagcatggcgtat

SEQ ID NO: 403639 - DNA, 140 bp, Artificial Sequence
  Synthetic
aggccctggctgctgatatgcactttagaatgtgctaatgttaaggataatgttactgttagtgttaatgataccatggaaatgaaaaattgctctttcaatgtaaccacagtagtaacagaccttttgggacagcggtg

SEQ ID NO: 403640 - DNA, 140 bp, Artificial Sequence
  Synthetic
caccgctgtcccaaaaggtctgttactactgtggttacattgaaagagcaatttttcatttccatggtatcattaacactaacagtaacattatccttaacattagcacattctaaagtgcatatcagcagccagggcct

SEQ ID NO: 403641 - DNA, 140 bp, Artificial Sequence
  Synthetic
aggccctggctgctgatatgcccagctggttttgcgattctaaagtgtagggataaaaatttcactggaataggaacatgtaaaaatgtcagttcagtacaatgcacacatgggattaaggaccttttgggacagcggtg

SEQ ID NO: 403642 - DNA, 140 bp, Artificial Sequence
  Synthetic
caccgctgtcccaaaaggtccttaatcccatgtgtgcattgtactgaactgacatttttacatgttcctattccagtgaaatttttatccctacactttagaatcgcaaaaccagctgggcatatcagcagccagggcct

SEQ ID NO: 403643 - DNA, 140 bp, Artificial Sequence
  Synthetic
atacgccatgctgggtctcctataatgattagatctgagaatatcacagacaatgccaaagacataatagtacaattgaaggagcctgtaaatattacttgtatcagacctagcaacaatcgtacttgggagtcggccat

SEQ ID NO: 403644 - DNA, 140 bp, Artificial Sequence
  Synthetic
atggccgactcccaagtacgattgttgctaggtctgatacaagtaatatttacaggctccttcaattgtactattatgtctttggcattgtctgtgatattctcagatctaatcattataggagacccagcatggcgtat

SEQ ID NO: 403645 - DNA, 140 bp, Artificial Sequence
  Synthetic
atacgccatgctgggtctccacaagggaaagtgtacgtataggaccaggacaaactttctttgcaacaggtgatataataggagacataaggaaagcacattgtctgattaatgaaacaccgtacttgggagtcggccat

SEQ ID NO: 403646 - DNA, 140 bp, Artificial Sequence
  Synthetic
atggccgactcccaagtacggtgtttcattaatcagacaatgtgctttccttatgtctcctattatatcacctgttgcaaagaaagtttgtcctggtcctatacgtacactttcccttgtggagacccagcatggcgtat

SEQ ID NO: 403647 - DNA, 140 bp, Artificial Sequence
  Synthetic
atacgccatgctgggtctcccaacacaagaagaagtgtgtctataggaccaggacaagcattctatgcaatgggtgacgtaataggggatataagaaaagcatattgtcaggtcaataaacgtacttgggagtcggccat

SEQ ID NO: 403648 - DNA, 140 bp, Artificial Sequence
  Synthetic
atggccgactcccaagtacgtttattgacctgacaatatgcttttcttatatcccctattacgtcacccattgcatagaatgcttgtcctggtcctatagacacacttcttcttgtgttgggagacccagcatggcgtat

SEQ ID NO: 403649 - DNA, 140 bp, Artificial Sequence
  Synthetic
atacgccatgctgggtctcctgtgagaatgtggcagagagtaggacaagcaatgtatgctcctcccatcccaggagtaataagctgtacatccaatattacaggactaataataacaagacgtacttgggagtcggccat

SEQ ID NO: 403650 - DNA, 140 bp, Artificial Sequence
  Synthetic
atggccgactcccaagtacgtcttgttattattagtcctgtaatattggatgtacagcttattactcctgggatgggaggagcatacattgcttgtcctactctctgccacattctcacaggagacccagcatggcgtat

SEQ ID NO: 403651 - DNA, 140 bp, Artificial Sequence
  Synthetic
aggccctggctgctgatatgaactcatctgcaccactgctgtgccttggaactccagttggagtaataaatctcaaaatgatatttgggataacatgacctggatgcagtgggatagagagaccttttgggacagcggtg

SEQ ID NO: 403652 - DNA, 140 bp, Artificial Sequence
  Synthetic
caccgctgtcccaaaaggtctctctatcccactgcatccaggtcatgttatcccaaatatcattttgagatttattactccaactggagttccaaggcacagcagtggtgcagatgagttcatatcagcagccagggcct

SEQ ID NO: 403653 - DNA, 140 bp, Artificial Sequence
  Synthetic
aggccctggctgctgatatgtacagcaatagcagtagcggggtggacagatagggttatagaagtagcacaaagagcttggagagcccttctccacatacctagaagaatcagacagggcgaccttttgggacagcggtg

SEQ ID NO: 403654 - DNA, 140 bp, Artificial Sequence
  Synthetic
caccgctgtcccaaaaggtcgccctgtctgattcttctaggtatgtggagaagggctctccaagctctttgtgctacttctataaccctatctgtccaccccgctactgctattgctgtacatatcagcagccagggcct

SEQ ID NO: 403655 - DNA, 140 bp, Artificial Sequence
  Synthetic
aggccctggctgctgatatgcttcatcttgattgcagcgaggactgtggagactctgggacgcagggtgtggcagagcctcaaatatctgtggggtcttgtgcaatactggggtcaggaagaccttttgggacagcggtg

SEQ ID NO: 403656 - DNA, 140 bp, Artificial Sequence
  Synthetic
caccgctgtcccaaaaggtcttcctgaccccagtattgcacaagaccccacagatatttgaggctctgccacaccctgcgtcccagagtctccacagtcctcgctgcaatcaagatgaagcatatcagcagccagggcct

SEQ ID NO: 403657 - DNA, 140 bp, Artificial Sequence
  Synthetic
atacgccatgctgggtctcctatagcacacaagtagaccctgacctggcagaccaactaattcatatgcattattttgattgttttgcagactctgccataaggaaagccatattaggaccgtacttgggagtcggccat

SEQ ID NO: 403658 - DNA, 140 bp, Artificial Sequence
  Synthetic
atggccgactcccaagtacggtcctaatatggctttccttatggcagagtctgcaaaacaatcaaaataatgcatatgaattagttggtctgccaggtcagggtctacttgtgtgctataggagacccagcatggcgtat

SEQ ID NO: 403659 - DNA, 140 bp, Artificial Sequence
  Synthetic
aggccctggctgctgatatgtaacatgggtggcaagtggtcaaaatgtaaagtaccaggatggcctgagattagggaaagactaagacgagcctccccaacagaagcagcagaaggggtggaccttttgggacagcggtg

SEQ ID NO: 403660 - DNA, 140 bp, Artificial Sequence
  Synthetic
caccgctgtcccaaaaggtccaccccttctgctgcttctgttggggaggctcgtcttagtctttccctaatctcaggccatcctggtactttacattttgaccacttgccacccatgttacatatcagcagccagggcct

SEQ ID NO: 403661 - DNA, 140 bp, Artificial Sequence
  Synthetic
aggccctggctgctgatatgcaagtggtcaaaaagcagcatagttggatggcctgctgtaagagacagaatgagacgagctgagccagcagcagaaggagtaggaccagcatctaaagatgaccttttgggacagcggtg

SEQ ID NO: 403662 - DNA, 140 bp, Artificial Sequence
  Synthetic
caccgctgtcccaaaaggtcatctttagatgctggtcctactccttctgctgctggctcagctcgtctcattctgtctcttacagcaggccatccaactatgctgctttttgaccacttgcatatcagcagccagggcct

SEQ ID NO: 403663 - DNA, 140 bp, Artificial Sequence
  Synthetic
atacgccatgctgggtctccaaatcactatataatctactagcaaccctctggtgcgtacatcaaaggatagaggtaaaagacaccaaggaagctgtagataaaattgaggaaatgcaaacgtacttgggagtcggccat

SEQ ID NO: 403664 - DNA, 140 bp, Artificial Sequence
  Synthetic
atggccgactcccaagtacgtttgcatttcctcaattttatctacagcttccttggtgtcttttacctctatcctttgatgtacgcaccagagggttgctagtagattatatagtgatttggagacccagcatggcgtat

SEQ ID NO: 403665 - DNA, 140 bp, Artificial Sequence
  Synthetic
aggccctggctgctgatatgagctaccattgtctagtttgctttcagaaaaaaggcttaggcatttcctatggcaggaagaagcggagacagcgacgaagcgctcctccaagcagtgagagaccttttgggacagcggtg

SEQ ID NO: 403666 - DNA, 140 bp, Artificial Sequence
  Synthetic
caccgctgtcccaaaaggtctctcactgcttggaggagcgcttcgtcgctgtctccgcttcttcctgccataggaaatgcctaagccttttttctgaaagcaaactagacaatggtagctcatatcagcagccagggcct

SEQ ID NO: 403667 - DNA, 140 bp, Artificial Sequence
  Synthetic
aggccctggctgctgatatgtagtgcaaaatgcacaagggcaaatggtacatcaggccatatcacctagaactttaaatgcatgggtgaaagtaatagaagaaaaggctttcagcccagagaccttttgggacagcggtg

SEQ ID NO: 403668 - DNA, 140 bp, Artificial Sequence
  Synthetic
caccgctgtcccaaaaggtctctgggctgaaagccttttcttctattactttcacccatgcatttaaagttctaggtgatatggcctgatgtaccatttgcccttgtgcattttgcactacatatcagcagccagggcct

SEQ ID NO: 403669 - DNA, 140 bp, Artificial Sequence
  Synthetic
aggccctggctgctgatatgaaaacgtagtagggatgggtggtctaccataagggaaagaatgagaagagcgccagcagcagatagaagagatgagccagcagcagctggggtgggagcagaccttttgggacagcggtg

SEQ ID NO: 403670 - DNA, 140 bp, Artificial Sequence
  Synthetic
caccgctgtcccaaaaggtctgctcccaccccagctgctgctggctcatctcttctatctgctgctggcgctcttctcattctttcccttatggtagaccacccatccctactacgttttcatatcagcagccagggcct

SEQ ID NO: 403671 - DNA, 140 bp, Artificial Sequence
  Synthetic
atacgccatgctgggtctccaatgattaatttactagaaaaagtagattataaaataacagtagcagcatttataatagcaataatcttagcaataattgtatggaccatagcctatctacgtacttgggagtcggccat

SEQ ID NO: 403672 - DNA, 140 bp, Artificial Sequence
  Synthetic
atggccgactcccaagtacgtagataggctatggtccatacaattattgctaagattattgctattataaatgctgctactgttattttataatctactttttctagtaaattaatcattggagacccagcatggcgtat

SEQ ID NO: 403673 - DNA, 140 bp, Artificial Sequence
  Synthetic
atacgccatgctgggtctccgtaccttagataagaacatgaggggagaaataaaaaattgctctttcaatatgaccacagaactaaaagataagaaaaggaaggtgcatgcatttttttacgtacttgggagtcggccat

SEQ ID NO: 403674 - DNA, 140 bp, Artificial Sequence
  Synthetic
atggccgactcccaagtacgtaaaaaaatgcatgcaccttccttttcttatcttttagttctgtggtcatattgaaagagcaattttttatttctcccctcatgttcttatctaaggtacggagacccagcatggcgtat

SEQ ID NO: 403675 - DNA, 140 bp, Artificial Sequence
  Synthetic
atacgccatgctgggtctcccctaataaaacaataaaatttaatcaatcctcaggaggggacccagaaattgtaatgcacacttttaattgtggaggagaatttttctattgcaatacatcgtacttgggagtcggccat

SEQ ID NO: 403676 - DNA, 140 bp, Artificial Sequence
  Synthetic
atggccgactcccaagtacgatgtattgcaatagaaaaattctcctccacaattaaaagtgtgcattacaatttctgggtcccctcctgaggattgattaaattttattgttttattaggggagacccagcatggcgtat

SEQ ID NO: 403677 - DNA, 140 bp, Artificial Sequence
  Synthetic
aggccctggctgctgatatgacaatgagacaccaggaatcagatatcagtacaatgtgctgccacagggatggaaaggatcaccagcaatattccagtgtagcatgacaaaaatcttagagaccttttgggacagcggtg

SEQ ID NO: 403678 - DNA, 140 bp, Artificial Sequence
  Synthetic
caccgctgtcccaaaaggtctctaagatttttgtcatgctacactggaatattgctggtgatcctttccatccctgtggcagcacattgtactgatatctgattcctggtgtctcattgtcatatcagcagccagggcct

SEQ ID NO: 403679 - DNA, 140 bp, Artificial Sequence
  Synthetic
atacgccatgctgggtctcccacacaacccgctgcaggaggggacttagaaattacaacacatagctttaattgtagaggagaatttttctattgcaatacatcaaaactgtttaacaggcgtacttgggagtcggccat

SEQ ID NO: 403680 - DNA, 140 bp, Artificial Sequence
  Synthetic
atggccgactcccaagtacgcctgttaaacagttttgatgtattgcaatagaaaaattctcctctacaattaaagctatgtgttgtaatttctaagtcccctcctgcagcgggttgtgtgggagacccagcatggcgtat

SEQ ID NO: 403681 - DNA, 140 bp, Artificial Sequence
  Synthetic
atacgccatgctgggtctccattgttgttaaatggcagcttagcagaagaagatacaataatcagatctcaaaatttctcaaataatgcaaaaagcatattagtacagctgaatgaatctcgtacttgggagtcggccat

SEQ ID NO: 403682 - DNA, 140 bp, Artificial Sequence
  Synthetic
atggccgactcccaagtacgagattcattcagctgtactaatatgctttttgcattatttgagaaattttgagatctgattattgtatcttcttctgctaagctgccatttaacaacaatggagacccagcatggcgtat

SEQ ID NO: 403683 - DNA, 140 bp, Artificial Sequence
  Synthetic
aggccctggctgctgatatgaaaatttctcaaataatgcaaaaagcatattagtacagctgaatgaatctgtggtaattaattgtacaagacccaacaacaatacaagaaaaagtatacggaccttttgggacagcggtg

SEQ ID NO: 403684 - DNA, 140 bp, Artificial Sequence
  Synthetic
caccgctgtcccaaaaggtccgtatactttttcttgtattgttgttgggtcttgtacaattaattaccacagattcattcagctgtactaatatgctttttgcattatttgagaaattttcatatcagcagccagggcct

SEQ ID NO: 403685 - DNA, 140 bp, Artificial Sequence
  Synthetic
aggccctggctgctgatatgagcaagacagaggcagatccattcgcttagtgagcggattcttagcacttgcctgggacgacctgcggagcctgtgccttttcagctaccaccgattgaggaccttttgggacagcggtg

SEQ ID NO: 403686 - DNA, 140 bp, Artificial Sequence
  Synthetic
caccgctgtcccaaaaggtcctcaatcggtggtagctgaaaaggcacaggctccgcaggtcgtcccaggcaagtgctaagaatccgctcactaagcgaatggatctgcctctgtcttgctcatatcagcagccagggcct

SEQ ID NO: 403687 - DNA, 140 bp, Artificial Sequence
  Synthetic
aggccctggctgctgatatgactcccatgcagaataaaacaaattataaacatgtggcaggaagtaggaaaagcaatgtatgcccctcccatcaaaggacaaattagatgttcatcaaatgaccttttgggacagcggtg

SEQ ID NO: 403688 - DNA, 140 bp, Artificial Sequence
  Synthetic
caccgctgtcccaaaaggtcatttgatgaacatctaatttgtcctttgatgggaggggcatacattgcttttcctacttcctgccacatgtttataatttgttttattctgcatgggagtcatatcagcagccagggcct

SEQ ID NO: 403689 - DNA, 140 bp, Artificial Sequence
  Synthetic
aggccctggctgctgatatgcaataaaatggggaacaaatggtcaaagggatggcctgctataagggaaagaatgagacgagctcgtgctcgtccagcacagaaccagcagcagagggaggaccttttgggacagcggtg

SEQ ID NO: 403690 - DNA, 140 bp, Artificial Sequence
  Synthetic
caccgctgtcccaaaaggtcctccctctgctgctggttctgtgctggacgagcacgagctcgtctcattctttcccttatagcaggccatccctttgaccatttgttccccattttattgcatatcagcagccagggcct

SEQ ID NO: 403691 - DNA, 140 bp, Artificial Sequence
  Synthetic
aggccctggctgctgatatgagcagcagagggagtaggagcagcatcccaagacttagacaaacatggagcaattacaagcagcaacacagccaccactaatgctgattgtgcctggctggaccttttgggacagcggtg

SEQ ID NO: 403692 - DNA, 140 bp, Artificial Sequence
  Synthetic
caccgctgtcccaaaaggtccagccaggcacaatcagcattagtggtggctgtgttgctgcttgtaattgctccatgtttgtctaagtcttgggatgctgctcctactccctctgctgctcatatcagcagccagggcct

SEQ ID NO: 403693 - DNA, 140 bp, Artificial Sequence
  Synthetic
atacgccatgctgggtctccgctgagccagcagcagagggggtgggaccagcatctcgagacctggaaaaacatggggcactcacaagcagcaatacagcaactaataatgctgattgtgcgtacttgggagtcggccat

SEQ ID NO: 403694 - DNA, 140 bp, Artificial Sequence
  Synthetic
atggccgactcccaagtacgcacaatcagcattattagttgctgtattgctgcttgtgagtgccccatgtttttccaggtctcgagatgctggtcccaccccctctgctgctggctcagcggagacccagcatggcgtat

SEQ ID NO: 403695 - DNA, 140 bp, Artificial Sequence
  Synthetic
atacgccatgctgggtctccctctagctggagtaataaatccttggataacatttgggacaatctgacctggatggagtgggatagagaaattagcaattacacacaagtaatatatgggcgtacttgggagtcggccat

SEQ ID NO: 403696 - DNA, 140 bp, Artificial Sequence
  Synthetic
atggccgactcccaagtacgcccatatattacttgtgtgtaattgctaatttctctatcccactccatccaggtcagattgtcccaaatgttatccaaggatttattactccagctagagggagacccagcatggcgtat

SEQ ID NO: 403697 - DNA, 140 bp, Artificial Sequence
  Synthetic
aggccctggctgctgatatgtatggggatacttgggaaggggttgaagctataataagaactttgcaacaactactgtttgttcatttcagaattgggtgtcaacatagcagaataggcagaccttttgggacagcggtg

SEQ ID NO: 403698 - DNA, 140 bp, Artificial Sequence
  Synthetic
caccgctgtcccaaaaggtctgcctattctgctatgttgacacccaattctgaaatgaacaaacagtagttgttgcaaagttcttattatagcttcaaccccttcccaagtatccccatacatatcagcagccagggcct

SEQ ID NO: 403699 - DNA, 140 bp, Artificial Sequence
  Synthetic
aggccctggctgctgatatgagaagaataagacagggcttggaaagggctttgctatagcatgggtggcaagtggtccaaacgtagtgtagttgggtggcctgctataagggaaagaatggaccttttgggacagcggtg

SEQ ID NO: 403700 - DNA, 140 bp, Artificial Sequence
  Synthetic
caccgctgtcccaaaaggtccattctttcccttatagcaggccacccaactacactacgtttggaccacttgccacccatgctatagcaaagccctttccaagccctgtcttattcttctcatatcagcagccagggcct

SEQ ID NO: 403701 - DNA, 140 bp, Artificial Sequence
  Synthetic
aggccctggctgctgatatgcaacatatctatgaaacatatggggatacttggacaggagtcgaagctataataagaatactgcaacaactactgtttattcatttcagaattgggtgccgaccttttgggacagcggtg

SEQ ID NO: 403702 - DNA, 140 bp, Artificial Sequence
  Synthetic
caccgctgtcccaaaaggtcggcacccaattctgaaatgaataaacagtagttgttgcagtattcttattatagcttcgactcctgtccaagtatccccatatgtttcatagatatgttgcatatcagcagccagggcct

SEQ ID NO: 403703 - DNA, 140 bp, Artificial Sequence
  Synthetic
atacgccatgctgggtctcctggaatgttgctgatttgtaatgctgcagacaacttgtgggtcacagtatattatggggtacctgtgtggaaagatgcagagaccaccctattttgcgcacgtacttgggagtcggccat

SEQ ID NO: 403704 - DNA, 140 bp, Artificial Sequence
  Synthetic
atggccgactcccaagtacgtgcgcaaaatagggtggtctctgcatctttccacacaggtaccccataatatactgtgacccacaagttgtctgcagcattacaaatcagcaacattccaggagacccagcatggcgtat

SEQ ID NO: 403705 - DNA, 140 bp, Artificial Sequence
  Synthetic
atacgccatgctgggtctcctaataaaagaaataaagaaagaaatgagtaattgctctttcaatgtaaccacagaactaagagataagaaaaagcaggaatatgcacttttttatagactcgtacttgggagtcggccat

SEQ ID NO: 403706 - DNA, 140 bp, Artificial Sequence
  Synthetic
atggccgactcccaagtacgagtctataaaaaagtgcatattcctgctttttcttatctcttagttctgtggttacattgaaagagcaattactcatttctttctttatttcttttattaggagacccagcatggcgtat

SEQ ID NO: 403707 - DNA, 140 bp, Artificial Sequence
  Synthetic
atacgccatgctgggtctccccaataacagcagcatatttagcaacattacggaggacgggcgaggagaaatggcaaactgctctttcaatatgaccacagaattaagagataaaaaacacgtacttgggagtcggccat

SEQ ID NO: 403708 - DNA, 140 bp, Artificial Sequence
  Synthetic
atggccgactcccaagtacgtgttttttatctcttaattctgtggtcatattgaaagagcagtttgccatttctcctcgcccgtcctccgtaatgttgctaaatatgctgctgttattggggagacccagcatggcgtat

SEQ ID NO: 403709 - DNA, 140 bp, Artificial Sequence
  Synthetic
aggccctggctgctgatatggggattaagccagtggtatcaactcaattactgctgaatggcagtttagcagaagaagatataataattagatttgagaatatcacaagcaatgccaaaggaccttttgggacagcggtg

SEQ ID NO: 403710 - DNA, 140 bp, Artificial Sequence
  Synthetic
caccgctgtcccaaaaggtcctttggcattgcttgtgatattctcaaatctaattattatatcttcttctgctaaactgccattcagcagtaattgagttgataccactggcttaatccccatatcagcagccagggcct

SEQ ID NO: 403711 - DNA, 140 bp, Artificial Sequence
  Synthetic
atacgccatgctgggtctccattgtgtggcaagtagacaggatgaggattagaacatggaaaagtctagtaaaacaccatatgtatatttcagggaaagctaggaaatggttttatagaccgtacttgggagtcggccat

SEQ ID NO: 403712 - DNA, 140 bp, Artificial Sequence
  Synthetic
atggccgactcccaagtacggtctataaaaccatttcctagctttccctgaaatatacatatggtgttttactagacttttccatgttctaatcctcatcctgtctacttgccacacaatggagacccagcatggcgtat

SEQ ID NO: 403713 - DNA, 140 bp, Artificial Sequence
  Synthetic
atacgccatgctgggtctccaacaacaatacaagaaaaggtgtacatataggaccaggacaagcgttctatgcaacagatgacatagtaggagacataagaaaagcattttgtgaggttacgtacttgggagtcggccat

SEQ ID NO: 403714 - DNA, 140 bp, Artificial Sequence
  Synthetic
atggccgactcccaagtacgtaacctcacaaaatgcttttcttatgtctcctactatgtcatctgttgcatagaacgcttgtcctggtcctatatgtacaccttttcttgtattgttgttggagacccagcatggcgtat

SEQ ID NO: 403715 - DNA, 140 bp, Artificial Sequence
  Synthetic
atacgccatgctgggtctccgaacactttaaaaataagacaataagctttcaaccatcctcaggaggggatttagaaattacaacacatagttttaattgtggaggagaatttttctattcgtacttgggagtcggccat

SEQ ID NO: 403716 - DNA, 140 bp, Artificial Sequence
  Synthetic
atggccgactcccaagtacgaatagaaaaattctcctccacaattaaaactatgtgttgtaatttctaaatcccctcctgaggatggttgaaagcttattgtcttatttttaaagtgttcggagacccagcatggcgtat

SEQ ID NO: 403717 - DNA, 140 bp, Artificial Sequence
  Synthetic
atacgccatgctgggtctccaataagctttaaatcatcctcaggaggagacccagaaattacagcacatagctttaattgtatgggagaatttttctattgtaatacatcagaactgtttcgtacttgggagtcggccat

SEQ ID NO: 403718 - DNA, 140 bp, Artificial Sequence
  Synthetic
atggccgactcccaagtacgaaacagttctgatgtattacaatagaaaaattctcccatacaattaaagctatgtgctgtaatttctgggtctcctcctgaggatgatttaaagcttattggagacccagcatggcgtat

SEQ ID NO: 403719 - DNA, 140 bp, Artificial Sequence
  Synthetic
aggccctggctgctgatatgggaattaggtaccagtacaatgtgcttccacaaggatggaaaggatcaccagcaatattccaatgtagcatgacaaaaatcttagagccctttagagcaagaccttttgggacagcggtg

SEQ ID NO: 403720 - DNA, 140 bp, Artificial Sequence
  Synthetic
caccgctgtcccaaaaggtcttgctctaaagggctctaagatttttgtcatgctacattggaatattgctggtgatcctttccatccttgtggaagcacattgtactggtacctaattcccatatcagcagccagggcct

SEQ ID NO: 403721 - DNA, 140 bp, Artificial Sequence
  Synthetic
aggccctggctgctgatatgaatcatcacaattccatgcagaataaaacaaattataaacatgtggcagggggtaggaagagcaatgtatgcccctcccattgcaggaaacataacatgtgaccttttgggacagcggtg

SEQ ID NO: 403722 - DNA, 140 bp, Artificial Sequence
  Synthetic
caccgctgtcccaaaaggtcacatgttatgtttcctgcaatgggaggggcatacattgctcttcctaccccctgccacatgtttataatttgttttattctgcatggaattgtgatgattcatatcagcagccagggcct

SEQ ID NO: 403723 - DNA, 140 bp, Artificial Sequence
  Synthetic
atacgccatgctgggtctccaaatgaacaattgctctttcaatgcaacctcagaaataagagataagaaaaagaaagtgtatgcacttttttataaacttgatatagtaccacttgaggacgtacttgggagtcggccat

SEQ ID NO: 403724 - DNA, 140 bp, Artificial Sequence
  Synthetic
atggccgactcccaagtacgtcctcaagtggtactatatcaagtttataaaaaagtgcatacactttctttttcttatctcttatttctgaggttgcattgaaagagcaattgttcatttggagacccagcatggcgtat

SEQ ID NO: 403725 - DNA, 140 bp, Artificial Sequence
  Synthetic
aggccctggctgctgatatgctcaccattgtcattgcagaccctcctcccaacccagaggggacccgacaggcccgaaggaatcgaagaagaaggtggagagagagacagagacagatccgaccttttgggacagcggtg

SEQ ID NO: 403726 - DNA, 140 bp, Artificial Sequence
  Synthetic
caccgctgtcccaaaaggtcggatctgtctctgtctctctctccaccttcttcttcgattccttcgggcctgtcgggtcccctctgggttgggaggagggtctgcaatgacaatggtgagcatatcagcagccagggcct

SEQ ID NO: 403727 - DNA, 140 bp, Artificial Sequence
  Synthetic
aggccctggctgctgatatggaggaggtaggctttccagtcaggccacaggtacctctaagaccaatgacttataagggagcttttgatcttagcttctttttaaaagaaaaggggggacgaccttttgggacagcggtg

SEQ ID NO: 403728 - DNA, 140 bp, Artificial Sequence
  Synthetic
caccgctgtcccaaaaggtcgtccccccttttcttttaaaaagaagctaagatcaaaagctcccttataagtcattggtcttagaggtacctgtggcctgactggaaagcctacctcctccatatcagcagccagggcct

SEQ ID NO: 403729 - DNA, 140 bp, Artificial Sequence
  Synthetic
aggccctggctgctgatatgatataggctaattgaagaatcgcagaaccagcaggaaaagaatgaacaagagttattggcattggacaagtgggcaagtctgtggaattggtttgacatagaccttttgggacagcggtg

SEQ ID NO: 403730 - DNA, 140 bp, Artificial Sequence
  Synthetic
caccgctgtcccaaaaggtctatgtcaaaccaattccacagacttgcccacttgtccaatgccaataactcttgttcattcttttcctgctggttctgcgattcttcaattagcctatatcatatcagcagccagggcct

SEQ ID NO: 403731 - DNA, 140 bp, Artificial Sequence
  Synthetic
aggccctggctgctgatatgaaacagctgaaaagtatttagaacttgtcaacaatacaagaaatattaccgtgatattcaagaacagcagtaataacggaggagatctagagacaacccggaccttttgggacagcggtg

SEQ ID NO: 403732 - DNA, 140 bp, Artificial Sequence
  Synthetic
caccgctgtcccaaaaggtccgggttgtctctagatctcctccgttattactgctgttcttgaatatcacggtaatatttcttgtattgttgacaagttctaaatacttttcagctgtttcatatcagcagccagggcct

SEQ ID NO: 403733 - DNA, 140 bp, Artificial Sequence
  Synthetic
aggccctggctgctgatatgcaaagtcagccaaaattaccctatagtgcaaaatgcacaagggcaaatggtacatcagcctgtatcacctagaactttgaatgcatgggtgaaagtagtagaccttttgggacagcggtg

SEQ ID NO: 403734 - DNA, 140 bp, Artificial Sequence
  Synthetic
caccgctgtcccaaaaggtctactactttcacccatgcattcaaagttctaggtgatacaggctgatgtaccatttgcccttgtgcattttgcactatagggtaattttggctgactttgcatatcagcagccagggcct

SEQ ID NO: 403735 - DNA, 140 bp, Artificial Sequence
  Synthetic
atacgccatgctgggtctcctgtttaattataccctggaatgtaacggaaccatctgtgagaatatcagtagtgagagtaatagcagtagtgagagtaagaataaaacgcggataccttgcgtacttgggagtcggccat

SEQ ID NO: 403736 - DNA, 140 bp, Artificial Sequence
  Synthetic
atggccgactcccaagtacgcaaggtatccgcgttttattcttactctcactactgctattactctcactactgatattctcacagatggttccgttacattccagggtataattaaacaggagacccagcatggcgtat

SEQ ID NO: 403737 - DNA, 140 bp, Artificial Sequence
  Synthetic
atacgccatgctgggtctcccaggctgaaacagatggtaaggtcatgggcaacaggagggtcaggaatctatgcacctcccatccaaggcaatctcacatgtacatcaaacataactgggcgtacttgggagtcggccat

SEQ ID NO: 403738 - DNA, 140 bp, Artificial Sequence
  Synthetic
atggccgactcccaagtacgcccagttatgtttgatgtacatgtgagattgccttggatgggaggtgcatagattcctgaccctcctgttgcccatgaccttaccatctgtttcagcctgggagacccagcatggcgtat

SEQ ID NO: 403739 - DNA, 140 bp, Artificial Sequence
  Synthetic
aggccctggctgctgatatgagcttttagaggagcttaagaatgaagctgtcagacattttcctaggccatggcttcatggcttaggacaacatatctatgaaacttatggggatacttggaccttttgggacagcggtg

SEQ ID NO: 403740 - DNA, 140 bp, Artificial Sequence
  Synthetic
caccgctgtcccaaaaggtccaagtatccccataagtttcatagatatgttgtcctaagccatgaagccatggcctaggaaaatgtctgacagcttcattcttaagctcctctaaaagctcatatcagcagccagggcct

SEQ ID NO: 403741 - DNA, 140 bp, Artificial Sequence
  Synthetic
aggccctggctgctgatatggtagatcctagactagagccctggaagcatccaggaagtcagcctaagactgcttgtaacaattgctattgtaaaaagtgttgctttcattgccaagtttgaccttttgggacagcggtg

SEQ ID NO: 403742 - DNA, 140 bp, Artificial Sequence
  Synthetic
caccgctgtcccaaaaggtcaaacttggcaatgaaagcaacactttttacaatagcaattgttacaagcagtcttaggctgacttcctggatgcttccagggctctagtctaggatctaccatatcagcagccagggcct

SEQ ID NO: 403743 - DNA, 140 bp, Artificial Sequence
  Synthetic
atacgccatgctgggtctccatcacactcccatgcagaataaaacaagttataaacatgtggcaagaagtaggaaaagcaatgtatgcccctcccattgcaggagtaataaaatgtagatcgtacttgggagtcggccat

SEQ ID NO: 403744 - DNA, 140 bp, Artificial Sequence
  Synthetic
atggccgactcccaagtacgatctacattttattactcctgcaatgggaggggcatacattgcttttcctacttcttgccacatgtttataacttgttttattctgcatgggagtgtgatggagacccagcatggcgtat

SEQ ID NO: 403745 - DNA, 140 bp, Artificial Sequence
  Synthetic
atacgccatgctgggtctcccatgtgtaaaattaagtccactatgtgttactttaaattgcagtaatgctaatttcagtaatgctaattcgaatgttactaatgctactacttctactaacgtacttgggagtcggccat

SEQ ID NO: 403746 - DNA, 140 bp, Artificial Sequence
  Synthetic
atggccgactcccaagtacgttagtagaagtagtagcattagtaacattcgaattagcattactgaaattagcattactgcaatttaaagtaacacatagtggacttaattttacacatgggagacccagcatggcgtat

SEQ ID NO: 403747 - DNA, 140 bp, Artificial Sequence
  Synthetic
aggccctggctgctgatatgaatttcagtaatgctaattcgaatgttactaatgctactacttctactaatactagttgggaaaggatggaggtagaaataaaaaactgctctttcaatggaccttttgggacagcggtg

SEQ ID NO: 403748 - DNA, 140 bp, Artificial Sequence
  Synthetic
caccgctgtcccaaaaggtccattgaaagagcagttttttatttctacctccatcctttcccaactagtattagtagaagtagtagcattagtaacattcgaattagcattactgaaattcatatcagcagccagggcct

SEQ ID NO: 403749 - DNA, 140 bp, Artificial Sequence
  Synthetic
aggccctggctgctgatatgaagtggcaaaatctgtggagttggtttgacataacaaattggctgtggtatataaaaatatttataatgatagtaggaggcttgataggtttaagaataagaccttttgggacagcggtg

SEQ ID NO: 403750 - DNA, 140 bp, Artificial Sequence
  Synthetic
caccgctgtcccaaaaggtcttattcttaaacctatcaagcctcctactatcattataaatatttttatataccacagccaatttgttatgtcaaaccaactccacagattttgccacttcatatcagcagccagggcct

SEQ ID NO: 403751 - DNA, 140 bp, Artificial Sequence
  Synthetic
aggccctggctgctgatatgaacttaattgaaaaatcgcaaaaccaacaagaaaagaatgaacaagaattattggaattagataaatgggcaaatttgtggacttggtttgacataacaagaccttttgggacagcggtg

SEQ ID NO: 403752 - DNA, 140 bp, Artificial Sequence
  Synthetic
caccgctgtcccaaaaggtcttgttatgtcaaaccaagtccacaaatttgcccatttatctaattccaataattcttgttcattcttttcttgttggttttgcgatttttcaattaagttcatatcagcagccagggcct

SEQ ID NO: 403753 - DNA, 140 bp, Artificial Sequence
  Synthetic
atacgccatgctgggtctcctaaacaattatacatgtggcagaagtaggaaaagcatgtttgcccctcccatcagcggacaaatcagatgctcatcaaatattacaggtatactattgaccgtacttgggagtcggccat

SEQ ID NO: 403754 - DNA, 140 bp, Artificial Sequence
  Synthetic
atggccgactcccaagtacggtcaatagtatacctgtaatatttgatgagcatctgatttgtccgctgatgggaggggcaaacatgcttttcctacttctgccacatgtataattgtttaggagacccagcatggcgtat

SEQ ID NO: 403755 - DNA, 140 bp, Artificial Sequence
  Synthetic
atacgccatgctgggtctccaaaaagagtgctattagtctgcttgatactttagcaatagcagtaggtgaaggaacagatagaattataggagtaatacaaagaatttgtagaggtatctcgtacttgggagtcggccat

SEQ ID NO: 403756 - DNA, 140 bp, Artificial Sequence
  Synthetic
atggccgactcccaagtacgagatacctctacaaattctttgtattactcctataattctatctgttccttcacctactgctattgctaaagtatcaagcagactaatagcactctttttggagacccagcatggcgtat

SEQ ID NO: 403757 - DNA, 140 bp, Artificial Sequence
  Synthetic
aggccctggctgctgatatggggatggcctaaggttagggaaagaatgagacaaactcctacagcagcaccaggagtaggagcagtatctcaagatttagagaaatatggagcaatcacagaccttttgggacagcggtg

SEQ ID NO: 403758 - DNA, 140 bp, Artificial Sequence
  Synthetic
caccgctgtcccaaaaggtctgtgattgctccatatttctctaaatcttgagatactgctcctactcctggtgctgctgtaggagtttgtctcattctttccctaaccttaggccatccccatatcagcagccagggcct

SEQ ID NO: 403759 - DNA, 140 bp, Artificial Sequence
  Synthetic
aggccctggctgctgatatgttgcaccactactgtgccttggaataatagttggagtaataggtctctgaaaagcatatgggataacatgacctggatggaatgggaaagagagattgaggaccttttgggacagcggtg

SEQ ID NO: 403760 - DNA, 140 bp, Artificial Sequence
  Synthetic
caccgctgtcccaaaaggtcctcaatctctctttcccattccatccaggtcatgttatcccatatgcttttcagagacctattactccaactattattccaaggcacagtagtggtgcaacatatcagcagccagggcct

SEQ ID NO: 403761 - DNA, 140 bp, Artificial Sequence
  Synthetic
aggccctggctgctgatatggcagcatgttggtgggcaaatatcacccaagaatttggaattccctacaatccccaaagccaaggagtagtggaatctatgaataaagaattaaagaaaagaccttttgggacagcggtg

SEQ ID NO: 403762 - DNA, 140 bp, Artificial Sequence
  Synthetic
caccgctgtcccaaaaggtcttttctttaattctttattcatagattccactactccttggctttggggattgtagggaattccaaattcttgggtgatatttgcccaccaacatgctgccatatcagcagccagggcct

SEQ ID NO: 403763 - DNA, 140 bp, Artificial Sequence
  Synthetic
atacgccatgctgggtctcccagcaggcagaagcggctgacaaaggaaaggtcagtcaaaattatcctatagtgcagaatctccaagggcaaatggtacaccagcccatatcacctagaacgtacttgggagtcggccat

SEQ ID NO: 403764 - DNA, 140 bp, Artificial Sequence
  Synthetic
atggccgactcccaagtacgttctaggtgatatgggctggtgtaccatttgcccttggagattctgcactataggataattttgactgacctttcctttgtcagccgcttctgcctgctgggagacccagcatggcgtat

SEQ ID NO: 403765 - DNA, 140 bp, Artificial Sequence
  Synthetic
aggccctggctgctgatatgggatacttgggaaggagttgaagctataataagaattttgcaacaactactgtttgttcatttcagaattgggtgccatcatagcagaataggcattattgaccttttgggacagcggtg

SEQ ID NO: 403766 - DNA, 140 bp, Artificial Sequence
  Synthetic
caccgctgtcccaaaaggtcaataatgcctattctgctatgatggcacccaattctgaaatgaacaaacagtagttgttgcaaaattcttattatagcttcaactccttcccaagtatcccatatcagcagccagggcct

SEQ ID NO: 403767 - DNA, 140 bp, Artificial Sequence
  Synthetic
aggccctggctgctgatatgggagatgtgggttttccagtcagacctcaggtacccttacggccaatgacttacaaggcagcttttgatctcagccactttttaaaagaagaggggggacgaccttttgggacagcggtg

SEQ ID NO: 403768 - DNA, 140 bp, Artificial Sequence
  Synthetic
caccgctgtcccaaaaggtcgtcccccctcttcttttaaaaagtggctgagatcaaaagctgccttgtaagtcattggccgtaagggtacctgaggtctgactggaaaacccacatctcccatatcagcagccagggcct

SEQ ID NO: 403769 - DNA, 140 bp, Artificial Sequence
  Synthetic
aggccctggctgctgatatggcggcagtaaaagtaatcaagatactataccaaagcagtaagtataattaagtaagctctgtaatgcaacctttgcaaatagcaagcatagtaggactaagaccttttgggacagcggtg

SEQ ID NO: 403770 - DNA, 140 bp, Artificial Sequence
  Synthetic
caccgctgtcccaaaaggtcttagtcctactatgcttgctatttgcaaaggttgcattacagagcttacttaattatacttactgctttggtatagtatcttgattacttttactgccgccatatcagcagccagggcct

SEQ ID NO: 403771 - DNA, 140 bp, Artificial Sequence
  Synthetic
atacgccatgctgggtctcccgtcacgttaaattgtaccaacaccacgagtgacaacaaccccaacgtcacgagtggcgagagtgaaatgaaaaactgctctttcaatatgaccacagaacgtacttgggagtcggccat

SEQ ID NO: 403772 - DNA, 140 bp, Artificial Sequence
  Synthetic
atggccgactcccaagtacgttctgtggtcatattgaaagagcagtttttcatttcactctcgccactcgtgacgttggggttgttgtcactcgtggtgttggtacaatttaacgtgacgggagacccagcatggcgtat

SEQ ID NO: 403773 - DNA, 140 bp, Artificial Sequence
  Synthetic
aggccctggctgctgatatgtgtaacagaaaattttaacatgtggaaaaatgacatggtggatcagatgcatgaggatataatcagtttatgggatcaaagcctaaagccatgtgtaaaggaccttttgggacagcggtg

SEQ ID NO: 403774 - DNA, 140 bp, Artificial Sequence
  Synthetic
caccgctgtcccaaaaggtcctttacacatggctttaggctttgatcccataaactgattatatcctcatgcatctgatccaccatgtcatttttccacatgttaaaattttctgttacacatatcagcagccagggcct

SEQ ID NO: 403775 - DNA, 140 bp, Artificial Sequence
  Synthetic
atacgccatgctgggtctccgtaccagacccaacaacaatacaagaaaaagtatacgtataggaccaggacaaacgttctatgcaacagacatagtaggaaatataagaaaagcatcttgcgtacttgggagtcggccat

SEQ ID NO: 403776 - DNA, 140 bp, Artificial Sequence
  Synthetic
atggccgactcccaagtacgcaagatgcttttcttatatttcctactatgtctgttgcatagaacgtttgtcctggtcctatacgtatactttttcttgtattgttgttgggtctggtacggagacccagcatggcgtat

SEQ ID NO: 403777 - DNA, 140 bp, Artificial Sequence
  Synthetic
aggccctggctgctgatatgggaggggatatagaaattacaacacatagctttaattgtggaggagaatttttctattgcgatacatcaggcctgtttaatagcacgtggaaaaatggcagaccttttgggacagcggtg

SEQ ID NO: 403778 - DNA, 140 bp, Artificial Sequence
  Synthetic
caccgctgtcccaaaaggtctgccatttttccacgtgctattaaacaggcctgatgtatcgcaatagaaaaattctcctccacaattaaagctatgtgttgtaatttctatatcccctcccatatcagcagccagggcct

SEQ ID NO: 403779 - DNA, 140 bp, Artificial Sequence
  Synthetic
atacgccatgctgggtctcctgcaaaataaagcaaattgtgagaatgtggcagagagtaggacaagcaatgtatgcccctcccatcccaggagtaatagggtgtatatcaaacattacagcgtacttgggagtcggccat

SEQ ID NO: 403780 - DNA, 140 bp, Artificial Sequence
  Synthetic
atggccgactcccaagtacgctgtaatgtttgatatacaccctattactcctgggatgggaggggcatacattgcttgtcctactctctgccacattctcacaatttgctttattttgcaggagacccagcatggcgtat

SEQ ID NO: 403781 - DNA, 140 bp, Artificial Sequence
  Synthetic
atacgccatgctgggtctcccttggaactccagttggagcaataaaactctagactatatttggaaaaacatgacctggatgcagtgggagaaagaaatcgataattacacactcacaatcgtacttgggagtcggccat

SEQ ID NO: 403782 - DNA, 140 bp, Artificial Sequence
  Synthetic
atggccgactcccaagtacgattgtgagtgtgtaattatcgatttctttctcccactgcatccaggtcatgtttttccaaatatagtctagagttttattgctccaactggagttccaagggagacccagcatggcgtat

SEQ ID NO: 403783 - DNA, 140 bp, Artificial Sequence
  Synthetic
atacgccatgctgggtctcctctgggacacagggtgtggcagatcctcaaatatctggggaatcttgcgcaatattggggtcaggaactaaagaatagtgctgttagtttgcttaatacccgtacttgggagtcggccat

SEQ ID NO: 403784 - DNA, 140 bp, Artificial Sequence
  Synthetic
atggccgactcccaagtacgggtattaagcaaactaacagcactattctttagttcctgaccccaatattgcgcaagattccccagatatttgaggatctgccacaccctgtgtcccagaggagacccagcatggcgtat

SEQ ID NO: 403785 - DNA, 140 bp, Artificial Sequence
  Synthetic
aggccctggctgctgatatgagacagatccattcgattagtgagcggattcttgacacttgtctgggacgatctgcggagcctgtgcctcttcagctaccaccgattgagagacttcatagaccttttgggacagcggtg

SEQ ID NO: 403786 - DNA, 140 bp, Artificial Sequence
  Synthetic
caccgctgtcccaaaaggtctatgaagtctctcaatcggtggtagctgaagaggcacaggctccgcagatcgtcccagacaagtgtcaagaatccgctcactaatcgaatggatctgtctcatatcagcagccagggcct

SEQ ID NO: 403787 - DNA, 140 bp, Artificial Sequence
  Synthetic
aggccctggctgctgatatggggagcaaattgtcaaaaagaagcatagtaggatggcctgaggtgagagaaagactaaggagaactcagccagcagcagaggaagtaagagcagcagagggaccttttgggacagcggtg

SEQ ID NO: 403788 - DNA, 140 bp, Artificial Sequence
  Synthetic
caccgctgtcccaaaaggtccctctgctgctcttacttcctctgctgctggctgagttctccttagtctttctctcacctcaggccatcctactatgcttctttttgacaatttgctccccatatcagcagccagggcct

SEQ ID NO: 403789 - DNA, 140 bp, Artificial Sequence
  Synthetic
aggccctggctgctgatatgaaagaattagggaaagagcagaagacagtggcaatgagagtgaaggggatactgaggaattggcaacaatggtggatatggggcatcttaggcttttggagaccttttgggacagcggtg

SEQ ID NO: 403790 - DNA, 140 bp, Artificial Sequence
  Synthetic
caccgctgtcccaaaaggtctccaaaagcctaagatgccccatatccaccattgttgccaattcctcagtatccccttcactctcattgccactgtcttctgctctttccctaattctttcatatcagcagccagggcct

SEQ ID NO: 403791 - DNA, 140 bp, Artificial Sequence
  Synthetic
  misc_feature (112)..(112): n is a, c, g, or t
aggccctggctgctgatatgtaagagcattaggaccaggggctacattagaagagatgatgacagcatgtcagggagtgggaggacctggccataaagcaagagttttggcngaagcaatgaccttttgggacagcggtg

SEQ ID NO: 403792 - DNA, 140 bp, Artificial Sequence
  Synthetic
  misc_feature (29)..(29): n is a, c, g, or t
caccgctgtcccaaaaggtcattgcttcngccaaaactcttgctttatggccaggtcctcccactccctgacatgctgtcatcatctcttctaatgtagcccctggtcctaatgctcttacatatcagcagccagggcct

SEQ ID NO: 403793 - DNA, 140 bp, Artificial Sequence
  Synthetic
atacgccatgctgggtctccgctacctacagtaataggacgatgactgaggaaataaaaaattgctctttcaatataaccatggaactaagagataggaaacagaaggtgaatgcactttcgtacttgggagtcggccat

SEQ ID NO: 403794 - DNA, 140 bp, Artificial Sequence
  Synthetic
atggccgactcccaagtacgaaagtgcattcaccttctgtttcctatctcttagttccatggttatattgaaagagcaattttttatttcctcagtcatcgtcctattactgtaggtagcggagacccagcatggcgtat

SEQ ID NO: 403795 - DNA, 140 bp, Artificial Sequence
  Synthetic
atacgccatgctgggtctccatggtgccatggaagaaataaaaaattgctctttcaatatgaccacagtactacaagataagagacagaaggtacatgcacttttttataaaattgatgtcgtacttgggagtcggccat

SEQ ID NO: 403796 - DNA, 140 bp, Artificial Sequence
  Synthetic
atggccgactcccaagtacgacatcaattttataaaaaagtgcatgtaccttctgtctcttatcttgtagtactgtggtcatattgaaagagcaattttttatttcttccatggcaccatggagacccagcatggcgtat

SEQ ID NO: 403797 - DNA, 140 bp, Artificial Sequence
  Synthetic
aggccctggctgctgatatgggcttaggcatctcctatggcaggaagaagcggagacagcgacgaagaactcctcaagacagtcagactcatcaagtttctctatcaaagcagtaagtaggaccttttgggacagcggtg

SEQ ID NO: 403798 - DNA, 140 bp, Artificial Sequence
  Synthetic
caccgctgtcccaaaaggtcctacttactgctttgatagagaaacttgatgagtctgactgtcttgaggagttcttcgtcgctgtctccgcttcttcctgccataggagatgcctaagcccatatcagcagccagggcct

SEQ ID NO: 403799 - DNA, 140 bp, Artificial Sequence
  Synthetic
aggccctggctgctgatatgtaaaacaataaaatttaactcatcctcaggaggggacctagaaattacaacacatagctttaattgtagaggagaattcttttattgcaatacatcaaaagaccttttgggacagcggtg

SEQ ID NO: 403800 - DNA, 140 bp, Artificial Sequence
  Synthetic
caccgctgtcccaaaaggtcttttgatgtattgcaataaaagaattctcctctacaattaaagctatgtgttgtaatttctaggtcccctcctgaggatgagttaaattttattgttttacatatcagcagccagggcct

SEQ ID NO: 403801 - DNA, 140 bp, Artificial Sequence
  Synthetic
atacgccatgctgggtctccaagaaaagcatattgtaacattaatagaacagcatggaataacactttacaaagggtaaaggataaattaaaagaacacttccctaataaaactataacccgtacttgggagtcggccat

SEQ ID NO: 403802 - DNA, 140 bp, Artificial Sequence
  Synthetic
atggccgactcccaagtacgggttatagttttattagggaagtgttcttttaatttatcctttaccctttgtaaagtgttattccatgctgttctattaatgttacaatatgcttttcttggagacccagcatggcgtat

SEQ ID NO: 403803 - DNA, 140 bp, Artificial Sequence
  Synthetic
atacgccatgctgggtctccttgtagaggagaatttttctattgcaatacatcaggactgtttacagaaaacattactacaaaagcaaaccaaagcatcacactcccatgcagaataaaacgtacttgggagtcggccat

SEQ ID NO: 403804 - DNA, 140 bp, Artificial Sequence
  Synthetic
atggccgactcccaagtacgttttattctgcatgggagtgtgatgctttggtttgcttttgtagtaatgttttctgtaaacagtcctgatgtattgcaatagaaaaattctcctctacaaggagacccagcatggcgtat

SEQ ID NO: 403805 - DNA, 140 bp, Artificial Sequence
  Synthetic
atacgccatgctgggtctcccaaatcataaatatgtggcaggaggtaggacgagcaatgtatgcccctccaattccgggacaaataacatgtatatcaaatatcacaggattactactgacgtacttgggagtcggccat

SEQ ID NO: 403806 - DNA, 140 bp, Artificial Sequence
  Synthetic
atggccgactcccaagtacgtcagtagtaatcctgtgatatttgatatacatgttatttgtcccggaattggaggggcatacattgctcgtcctacctcctgccacatatttatgatttgggagacccagcatggcgtat

SEQ ID NO: 403807 - DNA, 140 bp, Artificial Sequence
  Synthetic
atacgccatgctgggtctccaatgaaagaagaaatgagaaattgctctttcaatatcaccacaaacataagagataaggtaaagacagaatatgcacttttgtataaacttgatctagtacgtacttgggagtcggccat

SEQ ID NO: 403808 - DNA, 140 bp, Artificial Sequence
  Synthetic
atggccgactcccaagtacgtactagatcaagtttatacaaaagtgcatattctgtctttaccttatctcttatgtttgtggtgatattgaaagagcaatttctcatttcttctttcattggagacccagcatggcgtat

SEQ ID NO: 403809 - DNA, 140 bp, Artificial Sequence
  Synthetic
aggccctggctgctgatatgaactgctattaaatggcagtctagcagaagaagatgtagtaattagatccagcaatttcacagacaatactaaaaccataatagtacagctgaaagaatcgaccttttgggacagcggtg

SEQ ID NO: 403810 - DNA, 140 bp, Artificial Sequence
  Synthetic
caccgctgtcccaaaaggtcgattctttcagctgtactattatggttttagtattgtctgtgaaattgctggatctaattactacatcttcttctgctagactgccatttaatagcagttcatatcagcagccagggcct

SEQ ID NO: 403811 - DNA, 140 bp, Artificial Sequence
  Synthetic
atacgccatgctgggtctccatatgggaccaggcaaagcattctatacaacaggacagatagtaggagatattagaaaagcatactgtaacattagtagaacagcatggaataacactttcgtacttgggagtcggccat

SEQ ID NO: 403812 - DNA, 140 bp, Artificial Sequence
  Synthetic
atggccgactcccaagtacgaaagtgttattccatgctgttctactaatgttacagtatgcttttctaatatctcctactatctgtcctgttgtatagaatgctttgcctggtcccatatggagacccagcatggcgtat

SEQ ID NO: 403813 - DNA, 140 bp, Artificial Sequence
  Synthetic
atacgccatgctgggtctcctctttaggcaacattcaggaggggacccagaaattgcaatgcacagttttaattgtggaggagagttcttctactgtaacacaacacaactatttaatagcgtacttgggagtcggccat

SEQ ID NO: 403814 - DNA, 140 bp, Artificial Sequence
  Synthetic
atggccgactcccaagtacgctattaaatagttgtgttgtgttacagtagaagaactctcctccacaattaaaactgtgcattgcaatttctgggtcccctcctgaatgttgcctaaagaggagacccagcatggcgtat

SEQ ID NO: 403815 - DNA, 140 bp, Artificial Sequence
  Synthetic
aggccctggctgctgatatgccactaatgctgattgtgcctggctggaagcgcaagaggaggcagacgaagtaggctttccagtcagacctcaggaccaatgacttataaagcagcattcgaccttttgggacagcggtg

SEQ ID NO: 403816 - DNA, 140 bp, Artificial Sequence
  Synthetic
caccgctgtcccaaaaggtcgaatgctgctttataagtcattggtcctgaggtctgactggaaagcctacttcgtctgcctcctcttgcgcttccagccaggcacaatcagcattagtggcatatcagcagccagggcct

SEQ ID NO: 403817 - DNA, 140 bp, Artificial Sequence
  Synthetic
aggccctggctgctgatatgagaagtaatacaaagaatttggagagctatctgcaacatacctagaagaataagacagggcttggaagcagctttgcagtaaaatgggaaacaaatggtcgaccttttgggacagcggtg

SEQ ID NO: 403818 - DNA, 140 bp, Artificial Sequence
  Synthetic
caccgctgtcccaaaaggtcgaccatttgtttcccattttactgcaaagctgcttccaagccctgtcttattcttctaggtatgttgcagatagctctccaaattctttgtattacttctcatatcagcagccagggcct

SEQ ID NO: 403819 - DNA, 140 bp, Artificial Sequence
  Synthetic
atacgccatgctgggtctccccagctcttcagacaggaacaaaggaacttatatcattacataatacagttgcaactctctattgtgtacatgaaaagatagaggtacgagacaccaaggcgtacttgggagtcggccat

SEQ ID NO: 403820 - DNA, 140 bp, Artificial Sequence
  Synthetic
atggccgactcccaagtacgccttggtgtctcgtacctctatcttttcatgtacacaatagagagttgcaactgtattatgtaatgatataagttcctttgttcctgtctgaagagctggggagacccagcatggcgtat

SEQ ID NO: 403821 - DNA, 140 bp, Artificial Sequence
  Synthetic
aggccctggctgctgatatgtagaggatagatggaacaagccccagaggaccaggggccacagagagaaccaaacaatgaatggacactagagcttttggaggagcttaagaatgaagctgaccttttgggacagcggtg

SEQ ID NO: 403822 - DNA, 140 bp, Artificial Sequence
  Synthetic
caccgctgtcccaaaaggtcagcttcattcttaagctcctccaaaagctctagtgtccattcattgtttggttctctctgtggcccctggtcctctggggcttgttccatctatcctctacatatcagcagccagggcct

SEQ ID NO: 403823 - DNA, 140 bp, Artificial Sequence
  Synthetic
aggccctggctgctgatatgggggttgaagctataataagaattttgcaacaactactgtttattcatttcagaattgggtgtcaacatagcagaataggcattacaccagggagaagaggaccttttgggacagcggtg

SEQ ID NO: 403824 - DNA, 140 bp, Artificial Sequence
  Synthetic
caccgctgtcccaaaaggtcctcttctccctggtgtaatgcctattctgctatgttgacacccaattctgaaatgaataaacagtagttgttgcaaaattcttattatagcttcaacccccatatcagcagccagggcct

SEQ ID NO: 403825 - DNA, 140 bp, Artificial Sequence
  Synthetic
atacgccatgctgggtctcctgctataaaatgggtagcaagttgtcaaaaagtagtatagtaggatggcctaaaataagggaaagaatgagacgaacccctccaacagcagagggggcagcgtacttgggagtcggccat

SEQ ID NO: 403826 - DNA, 140 bp, Artificial Sequence
  Synthetic
atggccgactcccaagtacgctgccccctctgctgttggaggggttcgtctcattctttcccttattttaggccatcctactatactactttttgacaacttgctacccattttatagcaggagacccagcatggcgtat

SEQ ID NO: 403827 - DNA, 140 bp, Artificial Sequence
  Synthetic
atacgccatgctgggtctccgaacaaaggcttaggcatctcctatggcaggaagaagcggagacaacgacgagcagcttcttgcggcagtaagagtaatcaagatcctataccaaagcagcgtacttgggagtcggccat

SEQ ID NO: 403828 - DNA, 140 bp, Artificial Sequence
  Synthetic
atggccgactcccaagtacgctgctttggtataggatcttgattactcttactgccgcaagaagctgctcgtcgttgtctccgcttcttcctgccataggagatgcctaagcctttgttcggagacccagcatggcgtat

SEQ ID NO: 403829 - DNA, 140 bp, Artificial Sequence
  Synthetic
atacgccatgctgggtctccgaggaagtgggcttcccagtcagacctcaggtacctttaagaccaatgactcccagagcagctagggatcttagcttctttttaaaagaagaggggggaccgtacttgggagtcggccat

SEQ ID NO: 403830 - DNA, 140 bp, Artificial Sequence
  Synthetic
atggccgactcccaagtacggtcccccctcttcttttaaaaagaagctaagatccctagctgctctgggagtcattggtcttaaaggtacctgaggtctgactgggaagcccacttcctcggagacccagcatggcgtat

SEQ ID NO: 403831 - DNA, 140 bp, Artificial Sequence
  Synthetic
atacgccatgctgggtctccagggagtgggaggacctggccacaaagcaagagtgttggctgaggcaatgagccaagtaaacaatacaaacataatgatgcagagaagcaattttaaaggcgtacttgggagtcggccat

SEQ ID NO: 403832 - DNA, 140 bp, Artificial Sequence
  Synthetic
atggccgactcccaagtacgcctttaaaattgcttctctgcatcattatgtttgtattgtttacttggctcattgcctcagccaacactcttgctttgtggccaggtcctcccactccctggagacccagcatggcgtat

SEQ ID NO: 403833 - DNA, 140 bp, Artificial Sequence
  Synthetic
atacgccatgctgggtctccccaacaccacgagtgacgggagtgaagtaagaatgcaaaactgctctttcaatataaccacagaattaagagataaacaccagaaagtatattcacttttcgtacttgggagtcggccat

SEQ ID NO: 403834 - DNA, 140 bp, Artificial Sequence
  Synthetic
atggccgactcccaagtacgaaaagtgaatatactttctggtgtttatctcttaattctgtggttatattgaaagagcagttttgcattcttacttcactcccgtcactcgtggtgttggggagacccagcatggcgtat

SEQ ID NO: 403835 - DNA, 140 bp, Artificial Sequence
  Synthetic
aggccctggctgctgatatgcagtagtatcaactcaattgctattaaatggcagcctatcggaagaaggggtagtaattaggtctgaaaatctcacaaacaatgctaaaaccataatagtgaccttttgggacagcggtg

SEQ ID NO: 403836 - DNA, 140 bp, Artificial Sequence
  Synthetic
caccgctgtcccaaaaggtcactattatggttttagcattgtttgtgagattttcagacctaattactaccccttcttccgataggctgccatttaatagcaattgagttgatactactgcatatcagcagccagggcct

SEQ ID NO: 403837 - DNA, 140 bp, Artificial Sequence
  Synthetic
aggccctggctgctgatatgtaataaattgtaatacctcagccattacacaggcttgtccaaaggtaacctttgagccaattcccatacattattgtgccccagctggttttgcgattctgaccttttgggacagcggtg

SEQ ID NO: 403838 - DNA, 140 bp, Artificial Sequence
  Synthetic
caccgctgtcccaaaaggtcagaatcgcaaaaccagctggggcacaataatgtatgggaattggctcaaaggttacctttggacaagcctgtgtaatggctgaggtattacaatttattacatatcagcagccagggcct

SEQ ID NO: 403839 - DNA, 140 bp, Artificial Sequence
  Synthetic
atacgccatgctgggtctcccagtgaggatcatcaaaatcttatatcaaagcagtaagtatatgtaatgctggatttattagaaagagtagattatagaataggagtaggagcattcatacgtacttgggagtcggccat

SEQ ID NO: 403840 - DNA, 140 bp, Artificial Sequence
  Synthetic
atggccgactcccaagtacgtatgaatgctcctactcctattctataatctactctttctaataaatccagcattacatatacttactgctttgatataagattttgatgatcctcactgggagacccagcatggcgtat

SEQ ID NO: 403841 - DNA, 140 bp, Artificial Sequence
  Synthetic
atacgccatgctgggtctcccagaccctccaacaataaaagaacacgtatgtctatgggaccaggacacgtgttctataaaacaggagaaataacaggagatataagacaagcatattgtcgtacttgggagtcggccat

SEQ ID NO: 403842 - DNA, 140 bp, Artificial Sequence
  Synthetic
atggccgactcccaagtacgacaatatgcttgtcttatatctcctgttatttctcctgttttatagaacacgtgtcctggtcccatagacatacgtgttcttttattgttggagggtctgggagacccagcatggcgtat

SEQ ID NO: 403843 - DNA, 140 bp, Artificial Sequence
  Synthetic
aggccctggctgctgatatgtaaatggagaaaattagtagatttcagagaacttaataagagaactcaagacttctgggaagttcaattaggaataccacatcccgcagggttaaaaaaggaccttttgggacagcggtg

SEQ ID NO: 403844 - DNA, 140 bp, Artificial Sequence
  Synthetic
caccgctgtcccaaaaggtccttttttaaccctgcgggatgtggtattcctaattgaacttcccagaagtcttgagttctcttattaagttctctgaaatctactaattttctccatttacatatcagcagccagggcct

SEQ ID NO: 403845 - DNA, 140 bp, Artificial Sequence
  Synthetic
atacgccatgctgggtctcccgattgattgtgtcagaactggcaacaatacaagaacaagtgtacgtataggaccaggacaaacgttctatgcaacaggtgacataataggagatataagcgtacttgggagtcggccat

SEQ ID NO: 403846 - DNA, 140 bp, Artificial Sequence
  Synthetic
atggccgactcccaagtacgcttatatctcctattatgtcacctgttgcatagaacgtttgtcctggtcctatacgtacacttgttcttgtattgttgccagttctgacacaatcaatcgggagacccagcatggcgtat

SEQ ID NO: 403847 - DNA, 140 bp, Artificial Sequence
  Synthetic
aggccctggctgctgatatgcgaccatcctcaggaggggatgtagaaattacaacacatagttttaattgtggaggagaatttttctattgcgatacatcaggcctatttaataacacttgaccttttgggacagcggtg

SEQ ID NO: 403848 - DNA, 140 bp, Artificial Sequence
  Synthetic
caccgctgtcccaaaaggtcaagtgttattaaataggcctgatgtatcgcaatagaaaaattctcctccacaattaaaactatgtgttgtaatttctacatcccctcctgaggatggtcgcatatcagcagccagggcct

SEQ ID NO: 403849 - DNA, 140 bp, Artificial Sequence
  Synthetic
aggccctggctgctgatatgctaaagccatgtgtaaaattaaccccactttgtgttactttaaattgtactaatttgaaaaatactactaataccactatcatagataaagaagaaataagaccttttgggacagcggtg

SEQ ID NO: 403850 - DNA, 140 bp, Artificial Sequence
  Synthetic
caccgctgtcccaaaaggtcttatttcttctttatctatgatagtggtattagtagtatttttcaaattagtacaatttaaagtaacacaaagtggggttaattttacacatggctttagcatatcagcagccagggcct

SEQ ID NO: 403851 - DNA, 140 bp, Artificial Sequence
  Synthetic
atacgccatgctgggtctccacaacaatgagtcctaataatattagcagtaatgttaaagaaatgaaaaactgcactttcaatacaaccacagaattaagagataagaagcacaaacagtcgtacttgggagtcggccat

SEQ ID NO: 403852 - DNA, 140 bp, Artificial Sequence
  Synthetic
atggccgactcccaagtacgactgtttgtgcttcttatctcttaattctgtggttgtattgaaagtgcagtttttcatttctttaacattactgctaatattattaggactcattgttgtggagacccagcatggcgtat

SEQ ID NO: 403853 - DNA, 140 bp, Artificial Sequence
  Synthetic
atacgccatgctgggtctccacaaaaacacttccctggtaggacaataagatttaaaccatcctcaggaggggacctagaaattacaacacatagctttacctgtagaggagaatttttccgtacttgggagtcggccat

SEQ ID NO: 403854 - DNA, 140 bp, Artificial Sequence
  Synthetic
atggccgactcccaagtacggaaaaattctcctctacaggtaaagctatgtgttgtaatttctaggtcccctcctgaggatggtttaaatcttattgtcctaccagggaagtgtttttgtggagacccagcatggcgtat

SEQ ID NO: 403855 - DNA, 140 bp, Artificial Sequence
  Synthetic
aggccctggctgctgatatggaagagcgttttatgcaacaggagatgtaataggagatataagaaaagcatattgtactgttaatagaaccaactggaacagaactttacaactggtagcgaccttttgggacagcggtg

SEQ ID NO: 403856 - DNA, 140 bp, Artificial Sequence
  Synthetic
caccgctgtcccaaaaggtcgctaccagttgtaaagttctgttccagttggttctattaacagtacaatatgcttttcttatatctcctattacatctcctgttgcataaaacgctcttccatatcagcagccagggcct

SEQ ID NO: 403857 - DNA, 140 bp, Artificial Sequence
  Synthetic
aggccctggctgctgatatgacaagcagcaacactgcctctactaatcatgactgtgcctggctggaggcacaggaagatgaggacgtagggttcccagtcagaccccaggtacctttaagaccttttgggacagcggtg

SEQ ID NO: 403858 - DNA, 140 bp, Artificial Sequence
  Synthetic
caccgctgtcccaaaaggtcttaaaggtacctggggtctgactgggaaccctacgtcctcatcttcctgtgcctccagccaggcacagtcatgattagtagaggcagtgttgctgcttgtcatatcagcagccagggcct

SEQ ID NO: 403859 - DNA, 140 bp, Artificial Sequence
  Synthetic
atacgccatgctgggtctcccgcaacagcaagaggcgagagcagcggctggtgagtacgccaatttttgactagcggaggctagaaggagaggatgggtgcgagagcgtcggtattaagtcgtacttgggagtcggccat

SEQ ID NO: 403860 - DNA, 140 bp, Artificial Sequence
  Synthetic
atggccgactcccaagtacgacttaataccgacgctctcgcacccatcctctccttctagcctccgctagtcaaaaattggcgtactcaccagccgctgctctcgcctcttgctgttgcgggagacccagcatggcgtat

SEQ ID NO: 403861 - DNA, 140 bp, Artificial Sequence
  Synthetic
aggccctggctgctgatatgtacaaaaagagacatgggatacatggtggacagagtattggcaagccacctggattcctgaatgggagtttgtcaataccccccctctagtaaaactatggaccttttgggacagcggtg

SEQ ID NO: 403862 - DNA, 140 bp, Artificial Sequence
  Synthetic
caccgctgtcccaaaaggtccatagttttactagagggggggtattgacaaactcccattcaggaatccaggtggcttgccaatactctgtccaccatgtatcccatgtctctttttgtacatatcagcagccagggcct

SEQ ID NO: 403863 - DNA, 140 bp, Artificial Sequence
  Synthetic
atacgccatgctgggtctccgtggcgcccgaacagggacttgaaagtaatagggactcgaaagcgaaagttccagagaagttctctcgacgcagggactcggcttgctgagtgcacacggcgtacttgggagtcggccat

SEQ ID NO: 403864 - DNA, 140 bp, Artificial Sequence
  Synthetic
atggccgactcccaagtacgccgtgtgcactcagcaagccgagtccctgcgtcgagagaacttctctggaactttcgctttcgagtccctattactttcaagtccctgttcgggcgccacggagacccagcatggcgtat

SEQ ID NO: 403865 - DNA, 140 bp, Artificial Sequence
  Synthetic
aggccctggctgctgatatgtaatagtagcactaatcatagccataattgtgtggaccatagcatctctagaatataggaaattgaaaagacaaagaaaaatagactggttaattaaaaggaccttttgggacagcggtg

SEQ ID NO: 403866 - DNA, 140 bp, Artificial Sequence
  Synthetic
caccgctgtcccaaaaggtccttttaattaaccagtctatttttctttgtcttttcaatttcctatattctagagatgctatggtccacacaattatggctatgattagtgctactattacatatcagcagccagggcct

SEQ ID NO: 403867 - DNA, 140 bp, Artificial Sequence
  Synthetic
aggccctggctgctgatatgcgcaacctacctagaagaataagacagggttttgaagcagctttgctataaaatggggagcaaatggtcaaaaagctggcctgaggtaagagaaagaatggaccttttgggacagcggtg

SEQ ID NO: 403868 - DNA, 140 bp, Artificial Sequence
  Synthetic
caccgctgtcccaaaaggtccattctttctcttacctcaggccagctttttgaccatttgctccccattttatagcaaagctgcttcaaaaccctgtcttattcttctaggtaggttgcgcatatcagcagccagggcct

SEQ ID NO: 403869 - DNA, 140 bp, Artificial Sequence
  Synthetic
aggccctggctgctgatatggccagcagcagagggagtaggggcagcgtctcaagacttagctaaatatggagcacttacaagcagcaacacagccaccactaatgctgattgtgcctgggaccttttgggacagcggtg

SEQ ID NO: 403870 - DNA, 140 bp, Artificial Sequence
  Synthetic
caccgctgtcccaaaaggtcccaggcacaatcagcattagtggtggctgtgttgctgcttgtaagtgctccatatttagctaagtcttgagacgctgcccctactccctctgctgctggccatatcagcagccagggcct

SEQ ID NO: 403871 - DNA, 140 bp, Artificial Sequence
  Synthetic
atacgccatgctgggtctccatgggtgcgagagcgtcaacattaagcgggggagaattggatagatgggagaaaattcggttaaggccaggaggaaggaaaaatataagttcaaacatttcgtacttgggagtcggccat

SEQ ID NO: 403872 - DNA, 140 bp, Artificial Sequence
  Synthetic
atggccgactcccaagtacgaaatgtttgaacttatatttttccttcctcctggccttaaccgaattttctcccatctatccaattctcccccgcttaatgttgacgctctcgcacccatggagacccagcatggcgtat

SEQ ID NO: 403873 - DNA, 140 bp, Artificial Sequence
  Synthetic
atacgccatgctgggtctccataatagtacaattggagaaataaaaaattgctctttcaatacaaccacggaattaagagataggaaaaagaatgtgtatgcacttttttataaaattgacgtacttgggagtcggccat

SEQ ID NO: 403874 - DNA, 140 bp, Artificial Sequence
  Synthetic
atggccgactcccaagtacgtcaattttataaaaaagtgcatacacattctttttcctatctcttaattccgtggttgtattgaaagagcaattttttatttctccaattgtactattatggagacccagcatggcgtat

SEQ ID NO: 403875 - DNA, 140 bp, Artificial Sequence
  Synthetic
aggccctggctgctgatatggtagacatgatgaggattaacacatggaaaagtttaaaataccatatgcatgtttcaaagaaagccaaaagatggttttatagacatcactatgaaagcagaccttttgggacagcggtg

SEQ ID NO: 403876 - DNA, 140 bp, Artificial Sequence
  Synthetic
caccgctgtcccaaaaggtctgctttcatagtgatgtctataaaaccatcttttggctttctttgaaacatgcatatggtattttaaacttttccatgtgttaatcctcatcatgtctaccatatcagcagccagggcct

SEQ ID NO: 403877 - DNA, 140 bp, Artificial Sequence
  Synthetic
aggccctggctgctgatatgacacctagccagaaattgcagggcccctaggaaaaagggctgttggaaatgtgggaaggaaggacaccaaatgaaagactgcactgagagacaggctaatgaccttttgggacagcggtg

SEQ ID NO: 403878 - DNA, 140 bp, Artificial Sequence
  Synthetic
caccgctgtcccaaaaggtcattagcctgtctctcagtgcagtctttcatttggtgtccttccttcccacatttccaacagccctttttcctaggggccctgcaatttctggctaggtgtcatatcagcagccagggcct

SEQ ID NO: 403879 - DNA, 140 bp, Artificial Sequence
  Synthetic
  misc_feature (50)..(50): n is a, c, g, or t
atacgccatgctgggtctccacactaatagtagcatgggaaccatggagngaggagaaataaaaaattgctctttcaatgtcaccacaagaataagagataaggtgcagaaagaatatgccgtacttgggagtcggccat

SEQ ID NO: 403880 - DNA, 140 bp, Artificial Sequence
  Synthetic
  misc_feature (91)..(91): n is a, c, g, or t
atggccgactcccaagtacggcatattctttctgcaccttatctcttattcttgtggtgacattgaaagagcaattttttatttctcctcnctccatggttcccatgctactattagtgtggagacccagcatggcgtat

SEQ ID NO: 403881 - DNA, 140 bp, Artificial Sequence
  Synthetic
aggccctggctgctgatatgttttttagggaaaatctggccttcccacaagggaaggccagggaattttcttcagagcagaccagagccaacagccccaccagccccaccagaagagagcgaccttttgggacagcggtg

SEQ ID NO: 403882 - DNA, 140 bp, Artificial Sequence
  Synthetic
caccgctgtcccaaaaggtcgctctcttctggtggggctggtggggctgttggctctggtctgctctgaagaaaattccctggccttcccttgtgggaaggccagattttccctaaaaaacatatcagcagccagggcct

SEQ ID NO: 403883 - DNA, 140 bp, Artificial Sequence
  Synthetic
aggccctggctgctgatatggcaatacaaaactgttctttcaacatgaccacagaagtaagagataagcagctgaaagtacatgcacttttttatagacttgatatagtaccaatcagcagaccttttgggacagcggtg

SEQ ID NO: 403884 - DNA, 140 bp, Artificial Sequence
  Synthetic
caccgctgtcccaaaaggtctgctgattggtactatatcaagtctataaaaaagtgcatgtactttcagctgcttatctcttacttctgtggtcatgttgaaagaacagttttgtattgccatatcagcagccagggcct

SEQ ID NO: 403885 - DNA, 140 bp, Artificial Sequence
  Synthetic
  misc_feature (74)..(74): n is a, c, g, or t
atacgccatgctgggtctccatcactctcccatgcaaaataaaacaaattataaatatgtggcaggaagtaggnagagcaatgtatgccaatcccatagcaggaaacatttcctgtaactcgtacttgggagtcggccat

SEQ ID NO: 403886 - DNA, 140 bp, Artificial Sequence
  Synthetic
  misc_feature (67)..(67): n is a, c, g, or t
atggccgactcccaagtacgagttacaggaaatgtttcctgctatgggattggcatacattgctctncctacttcctgccacatatttataatttgttttattttgcatgggagagtgatggagacccagcatggcgtat

SEQ ID NO: 403887 - DNA, 140 bp, Artificial Sequence
  Synthetic
aggccctggctgctgatatgcttgtgcagtattggggtctagagctaaaaaagagtgctattagtctgcttgatactacagcaatagcagtagctgaaggaacagataggattatagaaggaccttttgggacagcggtg

SEQ ID NO: 403888 - DNA, 140 bp, Artificial Sequence
  Synthetic
caccgctgtcccaaaaggtccttctataatcctatctgttccttcagctactgctattgctgtagtatcaagcagactaatagcactcttttttagctctagaccccaatactgcacaagcatatcagcagccagggcct

SEQ ID NO: 403889 - DNA, 140 bp, Artificial Sequence
  Synthetic
aggccctggctgctgatatgaagcagggtatgttactgacagaggaaggcagaaagttgttactctaactgaaacaacaaatcagaagactgaattacaagcaattcagctagctttgcagaccttttgggacagcggtg

SEQ ID NO: 403890 - DNA, 140 bp, Artificial Sequence
  Synthetic
caccgctgtcccaaaaggtctgcaaagctagctgaattgcttgtaattcagtcttctgatttgttgtttcagttagagtaacaactttctgccttcctctgtcagtaacataccctgcttcatatcagcagccagggcct

SEQ ID NO: 403891 - DNA, 140 bp, Artificial Sequence
  Synthetic
aggccctggctgctgatatggaaacaacaaatcagaagactgaattacaagcaattcagctagctttgcaggattcaggatcagaagtaaacatagtaacagactcacagtatgcattaggaccttttgggacagcggtg

SEQ ID NO: 403892 - DNA, 140 bp, Artificial Sequence
  Synthetic
caccgctgtcccaaaaggtcctaatgcatactgtgagtctgttactatgtttacttctgatcctgaatcctgcaaagctagctgaattgcttgtaattcagtcttctgatttgttgtttccatatcagcagccagggcct

SEQ ID NO: 403893 - DNA, 140 bp, Artificial Sequence
  Synthetic
aggccctggctgctgatatgtttgggaaaacatgacctggatgcagtgggatagagaaattgataattacacatacacaatatatcagttgcttgaagaatcgcaaacccagcaggaacggaccttttgggacagcggtg

SEQ ID NO: 403894 - DNA, 140 bp, Artificial Sequence
  Synthetic
caccgctgtcccaaaaggtccgttcctgctgggtttgcgattcttcaagcaactgatatattgtgtatgtgtaattatcaatttctctatcccactgcatccaggtcatgttttcccaaacatatcagcagccagggcct

SEQ ID NO: 403895 - DNA, 140 bp, Artificial Sequence
  Synthetic
aggccctggctgctgatatgatcctgacctagcagaccaactaattcatctgcattattttgactgtttttcagaatctgccataaggaaagccatattaggacaagtagttagacctaggaccttttgggacagcggtg

SEQ ID NO: 403896 - DNA, 140 bp, Artificial Sequence
  Synthetic
caccgctgtcccaaaaggtcctaggtctaactacttgtcctaatatggctttccttatggcagattctgaaaaacagtcaaaataatgcagatgaattagttggtctgctaggtcaggatcatatcagcagccagggcct

SEQ ID NO: 403897 - DNA, 140 bp, Artificial Sequence
  Synthetic
atacgccatgctgggtctccaccaaagcagtaagtagtagtaagcagtatatgtaatgactcctttgactcctttgcaactctctgcaatagtaggactagtagtagcattcatagcagccgtacttgggagtcggccat

SEQ ID NO: 403898 - DNA, 140 bp, Artificial Sequence
  Synthetic
atggccgactcccaagtacggctgctatgaatgctactactagtcctactattgcagagagttgcaaaggagtcaaaggagtcattacatatactgcttactactacttactgctttggtggagacccagcatggcgtat

SEQ ID NO: 403899 - DNA, 140 bp, Artificial Sequence
  Synthetic
aggccctggctgctgatatgagaagaacttaaatcattatataatacagtagcaaccctctattgtgtacatcaaagaatagatgtaaaagacaccaaggaagctttagataagatagaggaccttttgggacagcggtg

SEQ ID NO: 403900 - DNA, 140 bp, Artificial Sequence
  Synthetic
caccgctgtcccaaaaggtcctctatcttatctaaagcttccttggtgtcttttacatctattctttgatgtacacaatagagggttgctactgtattatataatgatttaagttcttctcatatcagcagccagggcct

SEQ ID NO: 403901 - DNA, 140 bp, Artificial Sequence
  Synthetic
atacgccatgctgggtctccaacatcaccaacaacagcaccatatccaatatcacgggggaggacatgagagaggaactaaaaaactgctcattcaatatgaccacagaactaagagatacgtacttgggagtcggccat

SEQ ID NO: 403902 - DNA, 140 bp, Artificial Sequence
  Synthetic
atggccgactcccaagtacgtatctcttagttctgtggtcatattgaatgagcagttttttagttcctctctcatgtcctcccccgtgatattggatatggtgctgttgttggtgatgttggagacccagcatggcgtat

SEQ ID NO: 403903 - DNA, 140 bp, Artificial Sequence
  Synthetic
atacgccatgctgggtctcctggaccaggacaagtattctatagaacaggagacataataggggatataagacaagcatattgtaagattgatggaacaaaatggaataaaactttacaacgtacttgggagtcggccat

SEQ ID NO: 403904 - DNA, 140 bp, Artificial Sequence
  Synthetic
atggccgactcccaagtacgttgtaaagttttattccattttgttccatcaatcttacaatatgcttgtcttatatcccctattatgtctcctgttctatagaatacttgtcctggtccaggagacccagcatggcgtat

SEQ ID NO: 403905 - DNA, 140 bp, Artificial Sequence
  Synthetic
aggccctggctgctgatatgtggaatcaaaccagtagtatcaactcaactgctgttgaatggcagtctagcagaaggagatgtaatgattagatctgaaaatctcacaaacaatgccaaagaccttttgggacagcggtg

SEQ ID NO: 403906 - DNA, 140 bp, Artificial Sequence
  Synthetic
caccgctgtcccaaaaggtctttggcattgtttgtgagattttcagatctaatcattacatctccttctgctagactgccattcaacagcagttgagttgatactactggtttgattccacatatcagcagccagggcct

SEQ ID NO: 403907 - DNA, 140 bp, Artificial Sequence
  Synthetic
atacgccatgctgggtctcccaacaacaatacaagaaaaagtatacgtatagggccaggacaaacattctatgcaacaaatgccataataggggatataagacaggcacattgtactgtccgtacttgggagtcggccat

SEQ ID NO: 403908 - DNA, 140 bp, Artificial Sequence
  Synthetic
atggccgactcccaagtacggacagtacaatgtgcctgtcttatatcccctattatggcatttgttgcatagaatgtttgtcctggccctatacgtatactttttcttgtattgttgttgggagacccagcatggcgtat

SEQ ID NO: 403909 - DNA, 140 bp, Artificial Sequence
  Synthetic
atacgccatgctgggtctccctagtgctacctacaatgatagctcggagacaggactaaaaaattgctctttcaatacaaccacagaactaaaagataagaagcaccaagagtttgcactcgtacttgggagtcggccat

SEQ ID NO: 403910 - DNA, 140 bp, Artificial Sequence
  Synthetic
atggccgactcccaagtacgagtgcaaactcttggtgcttcttatcttttagttctgtggttgtattgaaagagcaattttttagtcctgtctccgagctatcattgtaggtagcactagggagacccagcatggcgtat

SEQ ID NO: 403911 - DNA, 140 bp, Artificial Sequence
  Synthetic
atacgccatgctgggtctcccatgcagaataagacaaattgtacatatgtggcagagagtaggacaagcaatgtatgcccctcccattaaaggaataataaaatgtacatcaaacattaccgtacttgggagtcggccat

SEQ ID NO: 403912 - DNA, 140 bp, Artificial Sequence
  Synthetic
atggccgactcccaagtacggtaatgtttgatgtacattttattattcctttaatgggaggggcatacattgcttgtcctactctctgccacatatgtacaatttgtcttattctgcatgggagacccagcatggcgtat

SEQ ID NO: 403913 - DNA, 140 bp, Artificial Sequence
  Synthetic
atacgccatgctgggtctccagacccaataataacacaagaagaagcataagaataggaccaggacaagcgttctatgcaacaaatggcataataggagacataagacaagcacattgtacgtacttgggagtcggccat

SEQ ID NO: 403914 - DNA, 140 bp, Artificial Sequence
  Synthetic
atggccgactcccaagtacgtacaatgtgcttgtcttatgtctcctattatgccatttgttgcatagaacgcttgtcctggtcctattcttatgcttcttcttgtgttattattgggtctggagacccagcatggcgtat

SEQ ID NO: 403915 - DNA, 140 bp, Artificial Sequence
  Synthetic
atacgccatgctgggtctccttaagagaacacttccctaataaaacaatagtctttaactcatcctcaggaggggacctagaaattacaacacatagctttaattgtagaggagaattttcgtacttgggagtcggccat

SEQ ID NO: 403916 - DNA, 140 bp, Artificial Sequence
  Synthetic
atggccgactcccaagtacgaaaattctcctctacaattaaagctatgtgttgtaatttctaggtcccctcctgaggatgagttaaagactattgttttattagggaagtgttctcttaaggagacccagcatggcgtat

SEQ ID NO: 403917 - DNA, 140 bp, Artificial Sequence
  Synthetic
aggccctggctgctgatatgtggaaaactcatctgcaccactaatgtgccctggaactctagttggagtaataaatctcaggatgaaatatgggagaatatgacctggctgcaatgggatgaccttttgggacagcggtg

SEQ ID NO: 403918 - DNA, 140 bp, Artificial Sequence
  Synthetic
caccgctgtcccaaaaggtcatcccattgcagccaggtcatattctcccatatttcatcctgagatttattactccaactagagttccagggcacattagtggtgcagatgagttttccacatatcagcagccagggcct

SEQ ID NO: 403919 - DNA, 140 bp, Artificial Sequence
  Synthetic
aggccctggctgctgatatgatacctaagggatcaacagctcctgggaatttggggttgctctggaaaactcatctgcaccactgctgtgccttggaatgctagttggagtaataaatctgaccttttgggacagcggtg

SEQ ID NO: 403920 - DNA, 140 bp, Artificial Sequence
  Synthetic
caccgctgtcccaaaaggtcagatttattactccaactagcattccaaggcacagcagtggtgcagatgagttttccagagcaaccccaaattcccaggagctgttgatcccttaggtatcatatcagcagccagggcct

SEQ ID NO: 403921 - DNA, 140 bp, Artificial Sequence
  Synthetic
aggccctggctgctgatatgtatacctagaagaatcagacagggcttcgaaagggctttgctataacatgggtggcaagtggtcaaaaagcagcatagtgggatggcctgaggttagggagaccttttgggacagcggtg

SEQ ID NO: 403922 - DNA, 140 bp, Artificial Sequence
  Synthetic
caccgctgtcccaaaaggtctccctaacctcaggccatcccactatgctgctttttgaccacttgccacccatgttatagcaaagccctttcgaagccctgtctgattcttctaggtatacatatcagcagccagggcct

SEQ ID NO: 403923 - DNA, 140 bp, Artificial Sequence
  Synthetic
aggccctggctgctgatatgtgatagtaggaggcttgataggcttgagaataatttttgctgtgctatctatagtaaatagagttaggcagggatactcacctttgtcgtttcagaccctgaccttttgggacagcggtg

SEQ ID NO: 403924 - DNA, 140 bp, Artificial Sequence
  Synthetic
caccgctgtcccaaaaggtcagggtctgaaacgacaaaggtgagtatccctgcctaactctatttactatagatagcacagcaaaaattattctcaagcctatcaagcctcctactatcacatatcagcagccagggcct

SEQ ID NO: 403925 - DNA, 140 bp, Artificial Sequence
  Synthetic
atacgccatgctgggtctccatgttagaattagtagcaaaggtagattatagattaggagtaggggcattgatagtagcactaagcatagcaatagttgtgtggatcatagcatatatagcgtacttgggagtcggccat

SEQ ID NO: 403926 - DNA, 140 bp, Artificial Sequence
  Synthetic
atggccgactcccaagtacgctatatatgctatgatccacacaactattgctatgcttagtgctactatcaatgcccctactcctaatctataatctacctttgctactaattctaacatggagacccagcatggcgtat

SEQ ID NO: 403927 - DNA, 140 bp, Artificial Sequence
  Synthetic
aggccctggctgctgatatgctgacttagaaataggacagcatagagaaaaggtagaggaactgagaaagcatctattgaaatggggatttaccacaccagataaaaaacatcagaaagagaccttttgggacagcggtg

SEQ ID NO: 403928 - DNA, 140 bp, Artificial Sequence
  Synthetic
caccgctgtcccaaaaggtctctttctgatgttttttatctggtgtggtaaatccccatttcaatagatgctttctcagttcctctaccttttctctatgctgtcctatttctaagtcagcatatcagcagccagggcct

SEQ ID NO: 403929 - DNA, 140 bp, Artificial Sequence
  Synthetic
aggccctggctgctgatatgttttaacatgtggaaaaatgacatggtggatcaaatgcatgaggatataatcagtttatgggatcaaagcctaaagccatgtgtaaagttgaccccactcgaccttttgggacagcggtg

SEQ ID NO: 403930 - DNA, 140 bp, Artificial Sequence
  Synthetic
caccgctgtcccaaaaggtcgagtggggtcaactttacacatggctttaggctttgatcccataaactgattatatcctcatgcatttgatccaccatgtcatttttccacatgttaaaacatatcagcagccagggcct

SEQ ID NO: 403931 - DNA, 140 bp, Artificial Sequence
  Synthetic
aggccctggctgctgatatgtgtgtcactttaaaatgttctacctacaatggtacttacactgataactaccaggaaaagataaaaaattgttctttcaatacaaccacagaaataagaggaccttttgggacagcggtg

SEQ ID NO: 403932 - DNA, 140 bp, Artificial Sequence
  Synthetic
caccgctgtcccaaaaggtcctcttatttctgtggttgtattgaaagaacaattttttatcttttcctggtagttatcagtgtaagtaccattgtaggtagaacattttaaagtgacacacatatcagcagccagggcct

SEQ ID NO: 403933 - DNA, 140 bp, Artificial Sequence
  Synthetic
atacgccatgctgggtctcctacccaataatgaaactatcactctcccatgtagaataaaacaaattataaacatgtggcagggagtaggacaagcaatgtatgccgctcccattgcaggcgtacttgggagtcggccat

SEQ ID NO: 403934 - DNA, 140 bp, Artificial Sequence
  Synthetic
atggccgactcccaagtacgcctgcaatgggagcggcatacattgcttgtcctactccctgccacatgtttataatttgttttattctacatgggagagtgatagtttcattattgggtaggagacccagcatggcgtat

SEQ ID NO: 403935 - DNA, 140 bp, Artificial Sequence
  Synthetic
aggccctggctgctgatatggccgcctgttggtgggcggggatcaagcaggaatttggcattccctacaatccccaaagtcaaggagtagtagaatctatgaataaagaattaaagaaaagaccttttgggacagcggtg

SEQ ID NO: 403936 - DNA, 140 bp, Artificial Sequence
  Synthetic
caccgctgtcccaaaaggtcttttctttaattctttattcatagattctactactccttgactttggggattgtagggaatgccaaattcctgcttgatccccgcccaccaacaggcggccatatcagcagccagggcct

SEQ ID NO: 403937 - DNA, 140 bp, Artificial Sequence
  Synthetic
atacgccatgctgggtctcctaagtgttcatagtagatgtaatgttaaaattaatagaaagaatagattataaattagcagtaggagcattgatagtagcactaatcataacaataattgcgtacttgggagtcggccat

SEQ ID NO: 403938 - DNA, 140 bp, Artificial Sequence
  Synthetic
atggccgactcccaagtacgcaattattgttatgattagtgctactatcaatgctcctactgctaatttataatctattctttctattaattttaacattacatctactatgaacacttaggagacccagcatggcgtat

SEQ ID NO: 403939 - DNA, 140 bp, Artificial Sequence
  Synthetic
atacgccatgctgggtctcccattctatgcagcaggagaaataataggaaaaataagactggcatattgtaatattagtgaagaagtctggaagaaaactttacaaagggtaggtagaaacgtacttgggagtcggccat

SEQ ID NO: 403940 - DNA, 140 bp, Artificial Sequence
  Synthetic
atggccgactcccaagtacgtttctacctaccctttgtaaagttttcttccagacttcttcactaatattacaatatgccagtcttatttttcctattatttctcctgctgcatagaatgggagacccagcatggcgtat

SEQ ID NO: 403941 - DNA, 140 bp, Artificial Sequence
  Synthetic
atacgccatgctgggtctcctaaaacaaattataaacatgtggcagggggtgggacgagcaatgtatgcccctcccattaaaggaagtataacatgtagatcaaatattacagggttactcgtacttgggagtcggccat

SEQ ID NO: 403942 - DNA, 140 bp, Artificial Sequence
  Synthetic
atggccgactcccaagtacgagtaaccctgtaatatttgatctacatgttatacttcctttaatgggaggggcatacattgctcgtcccaccccctgccacatgtttataatttgttttaggagacccagcatggcgtat

SEQ ID NO: 403943 - DNA, 140 bp, Artificial Sequence
  Synthetic
atacgccatgctgggtctcccagaactagttactacaatagcagcactatggtgggagaaataaaaaactgttctttcaatacgaccacagaaatgaaggataagagaaggaaggttcatcgtacttgggagtcggccat

SEQ ID NO: 403944 - DNA, 140 bp, Artificial Sequence
  Synthetic
atggccgactcccaagtacgatgaaccttccttctcttatccttcatttctgtggtcgtattgaaagaacagttttttatttctcccaccatagtgctgctattgtagtaactagttctgggagacccagcatggcgtat

SEQ ID NO: 403945 - DNA, 140 bp, Artificial Sequence
  Synthetic
atacgccatgctgggtctccaaacttcaaacattacaatcccatgcagaataaaacaaattataaatatgtggcagagggtaggaggagcaatgtatgcccctcccattgcaggactaatcgtacttgggagtcggccat

SEQ ID NO: 403946 - DNA, 140 bp, Artificial Sequence
  Synthetic
atggccgactcccaagtacgattagtcctgcaatgggaggggcatacattgctcctcctaccctctgccacatatttataatttgttttattctgcatgggattgtaatgtttgaagtttggagacccagcatggcgtat

SEQ ID NO: 403947 - DNA, 140 bp, Artificial Sequence
  Synthetic
aggccctggctgctgatatgtgcactgatttaaggaatgttactaacaccactagtagtagtgagggaatgatggagaaaggagaaatgaagaattgctctttcaatatgaccacaagcagaccttttgggacagcggtg

SEQ ID NO: 403948 - DNA, 140 bp, Artificial Sequence
  Synthetic
caccgctgtcccaaaaggtctgcttgtggtcatattgaaagagcaattcttcatttctcctttctccatcattccctcactactactagtggtgttagtaacattccttaaatcagtgcacatatcagcagccagggcct

SEQ ID NO: 403949 - DNA, 140 bp, Artificial Sequence
  Synthetic
aggccctggctgctgatatgtgccttggaattctagttggagtaataaatctcaagaggatatttggaataacatgacctggatgcagtgggatagagaaattagtaattacacagacacgaccttttgggacagcggtg

SEQ ID NO: 403950 - DNA, 140 bp, Artificial Sequence
  Synthetic
caccgctgtcccaaaaggtcgtgtctgtgtaattactaatttctctatcccactgcatccaggtcatgttattccaaatatcctcttgagatttattactccaactagaattccaaggcacatatcagcagccagggcct

SEQ ID NO: 403951 - DNA, 140 bp, Artificial Sequence
  Synthetic
aggccctggctgctgatatgaacatgacctggatgcagtgggatagagaaattagtaattacacagacacaatatacaggttgcttgaagactcgcaaaaccagcaggagaaaaatgaacgaccttttgggacagcggtg

SEQ ID NO: 403952 - DNA, 140 bp, Artificial Sequence
  Synthetic
caccgctgtcccaaaaggtcgttcatttttctcctgctggttttgcgagtcttcaagcaacctgtatattgtgtctgtgtaattactaatttctctatcccactgcatccaggtcatgttcatatcagcagccagggcct

SEQ ID NO: 403953 - DNA, 140 bp, Artificial Sequence
  Synthetic
aggccctggctgctgatatgaatgctaaaatcataatagtacagctgaaagaacctgtagaaattaattgtacaagacccagcaacaatacaagaaaaagtatacatatgggaccaggcagaccttttgggacagcggtg

SEQ ID NO: 403954 - DNA, 140 bp, Artificial Sequence
  Synthetic
caccgctgtcccaaaaggtctgcctggtcccatatgtatactttttcttgtattgttgctgggtcttgtacaattaatttctacaggttctttcagctgtactattatgattttagcattcatatcagcagccagggcct

SEQ ID NO: 403955 - DNA, 140 bp, Artificial Sequence
  Synthetic
atacgccatgctgggtctcccagaacttctccaggcagccagagccatctcgatcctttatcagagcagtaagtagtacatgtaatgccatctctagaaatagtaggagcatcagtagcacgtacttgggagtcggccat

SEQ ID NO: 403956 - DNA, 140 bp, Artificial Sequence
  Synthetic
atggccgactcccaagtacgtgctactgatgctcctactatttctagagatggcattacatgtactacttactgctctgataaaggatcgagatggctctggctgcctggagaagttctgggagacccagcatggcgtat

SEQ ID NO: 403957 - DNA, 140 bp, Artificial Sequence
  Synthetic
aggccctggctgctgatatggcagtgcaaaaaatagccatggaaagcatagtaatatggggaaagactcctaaatttagactacccatccaaaaggaaacatgggagacatggtggacaggaccttttgggacagcggtg

SEQ ID NO: 403958 - DNA, 140 bp, Artificial Sequence
  Synthetic
caccgctgtcccaaaaggtcctgtccaccatgtctcccatgtttccttttggatgggtagtctaaatttaggagtctttccccatattactatgctttccatggctattttttgcactgccatatcagcagccagggcct

SEQ ID NO: 403959 - DNA, 140 bp, Artificial Sequence
  Synthetic
aggccctggctgctgatatgtgctgattgtgtggcaggtagacaggatgaggatcagaacatggaatagtctagtaaagcaccatatgtatgtttcaaaaagagctacaggatggttttagaccttttgggacagcggtg

SEQ ID NO: 403960 - DNA, 140 bp, Artificial Sequence
  Synthetic
caccgctgtcccaaaaggtctaaaaccatcctgtagctctttttgaaacatacatatggtgctttactagactattccatgttctgatcctcatcctgtctacctgccacacaatcagcacatatcagcagccagggcct

SEQ ID NO: 403961 - DNA, 140 bp, Artificial Sequence
  Synthetic
aggccctggctgctgatatgattttgactgtttttcagactctgccataaggaaagccatattaggagaaatagttagacctaggtgtgaatatcaagcaggacataataaggtaggatcgaccttttgggacagcggtg

SEQ ID NO: 403962 - DNA, 140 bp, Artificial Sequence
  Synthetic
caccgctgtcccaaaaggtcgatcctaccttattatgtcctgcttgatattcacacctaggtctaactatttctcctaatatggctttccttatggcagagtctgaaaaacagtcaaaatcatatcagcagccagggcct

SEQ ID NO: 403963 - DNA, 140 bp, Artificial Sequence
  Synthetic
aggccctggctgctgatatggatcagaagtaaacatagtaacagactcacagtatgcattaggaatcattcaagcacaaccagataagagtgaatcagagttagtcaatcaaataatagagaccttttgggacagcggtg

SEQ ID NO: 403964 - DNA, 140 bp, Artificial Sequence
  Synthetic
caccgctgtcccaaaaggtctctattatttgattgactaactctgattcactcttatctggttgtgcttgaatgattcctaatgcatactgtgagtctgttactatgtttacttctgatccatatcagcagccagggcct

SEQ ID NO: 403965 - DNA, 140 bp, Artificial Sequence
  Synthetic
atacgccatgctgggtctccgactggtgagtacgcctaaagatttttgactaacggaggctagaaggagagagatgggtgcgagagcgtcagtattaagcgggggaaaattagatgcatgcgtacttgggagtcggccat

SEQ ID NO: 403966 - DNA, 140 bp, Artificial Sequence
  Synthetic
atggccgactcccaagtacgcatgcatctaattttcccccgcttaatactgacgctctcgcacccatctctctccttctagcctccgttagtcaaaaatctttaggcgtactcaccagtcggagacccagcatggcgtat

SEQ ID NO: 403967 - DNA, 140 bp, Artificial Sequence
  Synthetic
atacgccatgctgggtctcctgcagccattagacatatttgcaatagtaggactaataatagcattcttagcagccatagttgtgtgggctatagtatttaaactatatagggaaataagcgtacttgggagtcggccat

SEQ ID NO: 403968 - DNA, 140 bp, Artificial Sequence
  Synthetic
atggccgactcccaagtacgcttatttccctatatagtttaaatactatagcccacacaactatggctgctaagaatgctattattagtcctactattgcaaatatgtctaatggctgcaggagacccagcatggcgtat

SEQ ID NO: 403969 - DNA, 140 bp, Artificial Sequence
  Synthetic
atacgccatgctgggtctccactatcaacaatactactactgcatcccctaatagcctccaagaaatgagaaattgctctttcaatataaccacagaaataagggataagaaaaagacagcgtacttgggagtcggccat

SEQ ID NO: 403970 - DNA, 140 bp, Artificial Sequence
  Synthetic
atggccgactcccaagtacgctgtctttttcttatcccttatttctgtggttatattgaaagagcaatttctcatttcttggaggctattaggggatgcagtagtagtattgttgatagtggagacccagcatggcgtat

SEQ ID NO: 403971 - DNA, 140 bp, Artificial Sequence
  Synthetic
atacgccatgctgggtctccttcaatgcaaccacagaagtaagagataagaagaacaaagagtatgcacttttttatagacttgatatagtaccacttgaaaataaggacaactctagtgcgtacttgggagtcggccat

SEQ ID NO: 403972 - DNA, 140 bp, Artificial Sequence
  Synthetic
atggccgactcccaagtacgcactagagttgtccttattttcaagtggtactatatcaagtctataaaaaagtgcatactctttgttcttcttatctcttacttctgtggttgcattgaaggagacccagcatggcgtat

SEQ ID NO: 403973 - DNA, 140 bp, Artificial Sequence
  Synthetic
aggccctggctgctgatatgaagtatacccattggaccagggcaagcgttctatgcaacaggtgaaataataggaaatataagacaagctcattgtaatgttagtaagaaagagtggcatgaccttttgggacagcggtg

SEQ ID NO: 403974 - DNA, 140 bp, Artificial Sequence
  Synthetic
caccgctgtcccaaaaggtcatgccactctttcttactaacattacaatgagcttgtcttatatttcctattatttcacctgttgcatagaacgcttgccctggtccaatgggtatacttcatatcagcagccagggcct

SEQ ID NO: 403975 - DNA, 140 bp, Artificial Sequence
  Synthetic
atacgccatgctgggtctcccataacttttaattcatcttcaggaggggacctagaaattacaacacatagttttaattgtagaggagaatttttctattgtaatacatcaggactgtttcgtacttgggagtcggccat

SEQ ID NO: 403976 - DNA, 140 bp, Artificial Sequence
  Synthetic
atggccgactcccaagtacgaaacagtcctgatgtattacaatagaaaaattctcctctacaattaaaactatgtgttgtaatttctaggtcccctcctgaagatgaattaaaagttatgggagacccagcatggcgtat

SEQ ID NO: 403977 - DNA, 140 bp, Artificial Sequence
  Synthetic
atacgccatgctgggtctccaatccatagatattgtgtgcacaagacccaacaataacacaagaaaaagtgtaaggatagggccaggacaagtattctatgcaacaaatgctataataggcgtacttgggagtcggccat

SEQ ID NO: 403978 - DNA, 140 bp, Artificial Sequence
  Synthetic
atggccgactcccaagtacgcctattatagcatttgttgcatagaatacttgtcctggccctatccttacactttttcttgtgttattgttgggtcttgtgcacacaatatctatggattggagacccagcatggcgtat

SEQ ID NO: 403979 - DNA, 140 bp, Artificial Sequence
  Synthetic
atacgccatgctgggtctccagcaccctggaagaaaagccaggggcaatacaaaactgttctttcaatatgaccacagaagtaagggataagcagaagaaagtacaagcacttttttatacgtacttgggagtcggccat

SEQ ID NO: 403980 - DNA, 140 bp, Artificial Sequence
  Synthetic
atggccgactcccaagtacgtataaaaaagtgcttgtactttcttctgcttatcccttacttctgtggtcatattgaaagaacagttttgtattgcccctggcttttcttccagggtgctggagacccagcatggcgtat

SEQ ID NO: 403981 - DNA, 140 bp, Artificial Sequence
  Synthetic
atacgccatgctgggtctccacaaacatcacaattccatgcagaataaaacaaatcataaacatgtggcaaaaggtagggcgagcaatgtatgccaatcccattgcaggaaacataatatcgtacttgggagtcggccat

SEQ ID NO: 403982 - DNA, 140 bp, Artificial Sequence
  Synthetic
atggccgactcccaagtacgatattatgtttcctgcaatgggattggcatacattgctcgccctaccttttgccacatgtttatgatttgttttattctgcatggaattgtgatgtttgtggagacccagcatggcgtat

SEQ ID NO: 403983 - DNA, 140 bp, Artificial Sequence
  Synthetic
atacgccatgctgggtctccaattaaaagaacacttccctaataaaacaatacagtttcaaccaccctcaggaggggacctagaagttacaacacatagctttaattgtagaggagaattcgtacttgggagtcggccat

SEQ ID NO: 403984 - DNA, 140 bp, Artificial Sequence
  Synthetic
atggccgactcccaagtacgaattctcctctacaattaaagctatgtgttgtaacttctaggtcccctcctgagggtggttgaaactgtattgttttattagggaagtgttcttttaattggagacccagcatggcgtat

SEQ ID NO: 403985 - DNA, 140 bp, Artificial Sequence
  Synthetic
aggccctggctgctgatatggggatactcacctctgtcgttgcagaccctcatcccactcccaacggaagcagacagacccggaggaatcgaagaaggaggtggagagcaaggcaaaaccgaccttttgggacagcggtg

SEQ ID NO: 403986 - DNA, 140 bp, Artificial Sequence
  Synthetic
caccgctgtcccaaaaggtcggttttgccttgctctccacctccttcttcgattcctccgggtctgtctgcttccgttgggagtgggatgagggtctgcaacgacagaggtgagtatccccatatcagcagccagggcct

SEQ ID NO: 403987 - DNA, 140 bp, Artificial Sequence
  Synthetic
atacgccatgctgggtctccatagggttatagaagtaatacaaagagctattagagcttttcttaacatacctagaagaataagacaaggattagaaagagctttgctataaaatgggggcgtacttgggagtcggccat

SEQ ID NO: 403988 - DNA, 140 bp, Artificial Sequence
  Synthetic
atggccgactcccaagtacgcccccattttatagcaaagctctttctaatccttgtcttattcttctaggtatgttaagaaaagctctaatagctctttgtattacttctataaccctatggagacccagcatggcgtat

SEQ ID NO: 403989 - DNA, 140 bp, Artificial Sequence
  Synthetic
aggccctggctgctgatatgcctagaagaataagacaaggattagaaagagctttgctataaaatggggggcaagtggtcaaaaaggagggagggtgaatggtttgctgtaagaagaaaagaccttttgggacagcggtg

SEQ ID NO: 403990 - DNA, 140 bp, Artificial Sequence
  Synthetic
caccgctgtcccaaaaggtcttttcttcttacagcaaaccattcaccctccctcctttttgaccacttgccccccattttatagcaaagctctttctaatccttgtcttattcttctaggcatatcagcagccagggcct

SEQ ID NO: 403991 - DNA, 140 bp, Artificial Sequence
  Synthetic
atacgccatgctgggtctcctcgcaggactcggcttgctgaagcgcgcacagcaagaggcgaggggcggcgacgactggtgagtacgccaatttttgactagcggaggctagaaggagagcgtacttgggagtcggccat

SEQ ID NO: 403992 - DNA, 140 bp, Artificial Sequence
  Synthetic
atggccgactcccaagtacgctctccttctagcctccgctagtcaaaaattggcgtactcaccagtcgtcgccgcccctcgcctcttgctgtgcgcgcttcagcaagccgagtcctgcgaggagacccagcatggcgtat

SEQ ID NO: 403993 - DNA, 140 bp, Artificial Sequence
  Synthetic
aggccctggctgctgatatgagagacaggctaattttttagggaaaatttggccttccagcaaggggaggccaggaaattttcctcagagcagaccggaaccaacagccccaccagcagagaccttttgggacagcggtg

SEQ ID NO: 403994 - DNA, 140 bp, Artificial Sequence
  Synthetic
caccgctgtcccaaaaggtctctgctggtggggctgttggttccggtctgctctgaggaaaatttcctggcctccccttgctggaaggccaaattttccctaaaaaattagcctgtctctcatatcagcagccagggcct

SEQ ID NO: 403995 - DNA, 140 bp, Artificial Sequence
  Synthetic
aggccctggctgctgatatgccaggaaattttcctcagagcagaccggaaccaacagccccaccagcagagagccttgggatgggggaagagataaccccctctccgaagcaggaaccgggaccttttgggacagcggtg

SEQ ID NO: 403996 - DNA, 140 bp, Artificial Sequence
  Synthetic
caccgctgtcccaaaaggtcccggttcctgcttcggagagggggttatctcttcccccatcccaaggctctctgctggtggggctgttggttccggtctgctctgaggaaaatttcctggcatatcagcagccagggcct

SEQ ID NO: 403997 - DNA, 140 bp, Artificial Sequence
  Synthetic
aggccctggctgctgatatgaaaaatttcaaaaattgggcctgaaaatccatacaatactccaatatttgccataaagaaaaaagacagtactaaatggagaaaattagtagatttcagagaccttttgggacagcggtg

SEQ ID NO: 403998 - DNA, 140 bp, Artificial Sequence
  Synthetic
caccgctgtcccaaaaggtctctgaaatctactaattttctccatttagtactgtcttttttctttatggcaaatattggagtattgtatggattttcaggcccaatttttgaaatttttcatatcagcagccagggcct

SEQ ID NO: 403999 - DNA, 140 bp, Artificial Sequence
  Synthetic
aggccctggctgctgatatgggaaaaggaaggaaaaatttcaaaaattgggcctgaaaatccatacaatactccagtatttgccataaagaaaaaagatagtactaaatggagaaaattagaccttttgggacagcggtg

SEQ ID NO: 404000 - DNA, 140 bp, Artificial Sequence
  Synthetic
caccgctgtcccaaaaggtctaattttctccatttagtactatcttttttctttatggcaaatactggagtattgtatggattttcaggcccaatttttgaaatttttccttccttttcccatatcagcagccagggcct

SEQ ID NO: 404001 - DNA, 140 bp, Artificial Sequence
  Synthetic
aggccctggctgctgatatgattatggggtacctgtgtggagagaagcaaaaactactctattttgtgcatcagatgctaaagcatatgatacagaggtgcataatgtctgggctacacagaccttttgggacagcggtg

SEQ ID NO: 404002 - DNA, 140 bp, Artificial Sequence
  Synthetic
caccgctgtcccaaaaggtctgtgtagcccagacattatgcacctctgtatcatatgctttagcatctgatgcacaaaatagagtagtttttgcttctctccacacaggtaccccataatcatatcagcagccagggcct

SEQ ID NO: 404003 - DNA, 140 bp, Artificial Sequence
  Synthetic
aggccctggctgctgatatggtagatttcagagaactcaataagagaactcaagacttctgggaggtccaattaggaatacctcatcccgcgggattaaaaaagaaaaaatcagtaacaggaccttttgggacagcggtg

SEQ ID NO: 404004 - DNA, 140 bp, Artificial Sequence
  Synthetic
caccgctgtcccaaaaggtcctgttactgattttttcttttttaatcccgcgggatgaggtattcctaattggacctcccagaagtcttgagttctcttattgagttctctgaaatctaccatatcagcagccagggcct

SEQ ID NO: 404005 - DNA, 140 bp, Artificial Sequence
  Synthetic
aggccctggctgctgatatgatgacacctttggaaattagtgcaatagtaggactgatagtagcgctaatcttagcaatagtagtgtggactatagtagctatagaatttaagaaaatacgaccttttgggacagcggtg

SEQ ID NO: 404006 - DNA, 140 bp, Artificial Sequence
  Synthetic
caccgctgtcccaaaaggtcgtattttcttaaattctatagctactatagtccacactactattgctaagattagcgctactatcagtcctactattgcactaatttccaaaggtgtcatcatatcagcagccagggcct

SEQ ID NO: 404007 - DNA, 140 bp, Artificial Sequence
  Synthetic
atacgccatgctgggtctccagcactattgatatgaagggagaaataaaaaactgttctttcaatatgaccacagaactaagagataaaataaggaaggtacatgcacttttttatagaccgtacttgggagtcggccat

SEQ ID NO: 404008 - DNA, 140 bp, Artificial Sequence
  Synthetic
atggccgactcccaagtacggtctataaaaaagtgcatgtaccttccttattttatctcttagttctgtggtcatattgaaagaacagttttttatttctcccttcatatcaatagtgctggagacccagcatggcgtat

SEQ ID NO: 404009 - DNA, 140 bp, Artificial Sequence
  Synthetic
aggccctggctgctgatatgagcattaagaacaccaaaaaagataaagccacctttgcctagtgttacgaaactgacagaggatagatggaacaagccccagaggaccaaggaccacagagaccttttgggacagcggtg

SEQ ID NO: 404010 - DNA, 140 bp, Artificial Sequence
  Synthetic
caccgctgtcccaaaaggtctctgtggtccttggtcctctggggcttgttccatctatcctctgtcagtttcgtaacactaggcaaaggtggctttatcttttttggtgttcttaatgctcatatcagcagccagggcct

SEQ ID NO: 404011 - DNA, 140 bp, Artificial Sequence
  Synthetic
aggccctggctgctgatatgggaatttttctactgtaacacttcacaactgtttaatagtacttggtatagcacttggaatagtacttggtatagcaataggaatagtactggagggtcagaccttttgggacagcggtg

SEQ ID NO: 404012 - DNA, 140 bp, Artificial Sequence
  Synthetic
caccgctgtcccaaaaggtctgaccctccagtactattcctattgctataccaagtactattccaagtgctataccaagtactattaaacagttgtgaagtgttacagtagaaaaattcccatatcagcagccagggcct

SEQ ID NO: 404013 - DNA, 140 bp, Artificial Sequence
  Synthetic
atacgccatgctgggtctcctaaggcaaagaaaaatagacaggttaattaaaagaataagagaaagagcagaagacagtggaaatgagagtgaaggagacacagatgaattggccaaactcgtacttgggagtcggccat

SEQ ID NO: 404014 - DNA, 140 bp, Artificial Sequence
  Synthetic
atggccgactcccaagtacgagtttggccaattcatctgtgtctccttcactctcatttccactgtcttctgctctttctcttattcttttaattaacctgtctatttttctttgccttaggagacccagcatggcgtat

SEQ ID NO: 404015 - DNA, 140 bp, Artificial Sequence
  Synthetic
  misc_feature (27)..(27): n is a, c, g, or t
atacgccatgctgggtctcctgaaacntcaaccatcatggtaatcccatgcggaataaaacaaattataaatatgtggcaggaggtaggacgagccatgtatgcccctcccgttaaaggacgtacttgggagtcggccat

SEQ ID NO: 404016 - DNA, 140 bp, Artificial Sequence
  Synthetic
  misc_feature (114)..(114): n is a, c, g, or t
atggccgactcccaagtacgtcctttaacgggaggggcatacatggctcgtcctacctcctgccacatatttataatttgttttattccgcatgggattaccatgatggttgangtttcaggagacccagcatggcgtat

SEQ ID NO: 404017 - DNA, 140 bp, Artificial Sequence
  Synthetic
atacgccatgctgggtctccgcctgagagataaagtaaaaaaagaatatgcactcttttatgaacttgatgtagtacaaataaataatgatagctataggttgataagttgtaatacctccgtacttgggagtcggccat

SEQ ID NO: 404018 - DNA, 140 bp, Artificial Sequence
  Synthetic
atggccgactcccaagtacggaggtattacaacttatcaacctatagctatcattatttatttgtactacatcaagttcataaaagagtgcatattctttttttactttatctctcaggcggagacccagcatggcgtat

SEQ ID NO: 404019 - DNA, 140 bp, Artificial Sequence
  Synthetic
aggccctggctgctgatatgaagacaccaaggaagccttagataaagtagaggaaatgcaaaataaaagcaagcaaaagacacagcagtcagcacagcagtcagcagctgctgccacagggaccttttgggacagcggtg

SEQ ID NO: 404020 - DNA, 140 bp, Artificial Sequence
  Synthetic
caccgctgtcccaaaaggtccctgtggcagcagctgctgactgctgtgctgactgctgtgtcttttgcttgcttttattttgcatttcctctactttatctaaggcttccttggtgtcttcatatcagcagccagggcct

SEQ ID NO: 404021 - DNA, 140 bp, Artificial Sequence
  Synthetic
aggccctggctgctgatatggaacagataggattatagaagtagtacaaagaattgcagagctatctataacatacctagaagataagacaggctttgaagcagcattgcaataaacatggaccttttgggacagcggtg

SEQ ID NO: 404022 - DNA, 140 bp, Artificial Sequence
  Synthetic
caccgctgtcccaaaaggtccatgtttattgcaatgctgcttcaaagcctgtcttatcttctaggtatgttatagatagctctgcaattctttgtactacttctataatcctatctgttccatatcagcagccagggcct

SEQ ID NO: 404023 - DNA, 140 bp, Artificial Sequence
  Synthetic
aggccctggctgctgatatgacttagatagatatggggcactgacaagcagcaacacacctgccactaatgctgcttgtgcctggctggaagcacaacaggaggaagatgaggaggttccgaccttttgggacagcggtg

SEQ ID NO: 404024 - DNA, 140 bp, Artificial Sequence
  Synthetic
caccgctgtcccaaaaggtcggaacctcctcatcttcctcctgttgtgcttccagccaggcacaagcagcattagtggcaggtgtgttgctgcttgtcagtgccccatatctatctaagtcatatcagcagccagggcct

SEQ ID NO: 404025 - DNA, 140 bp, Artificial Sequence
  Synthetic
aggccctggctgctgatatgaagacgaactgagccagcagcagagggagtaggagcagcttctcaagacttagataaatatggagcacttacaaccagcaacacagaccccaataatgctgaccttttgggacagcggtg

SEQ ID NO: 404026 - DNA, 140 bp, Artificial Sequence
  Synthetic
caccgctgtcccaaaaggtcagcattattggggtctgtgttgctggttgtaagtgctccatatttatctaagtcttgagaagctgctcctactccctctgctgctggctcagttcgtcttcatatcagcagccagggcct

SEQ ID NO: 404027 - DNA, 140 bp, Artificial Sequence
  Synthetic
atacgccatgctgggtctccgttagggaaagaataagacgagctcctgctccagcagcaagaggagtaggaccagtatctcaagatttggataagtatggagcagtcacaagcagtaatacgtacttgggagtcggccat

SEQ ID NO: 404028 - DNA, 140 bp, Artificial Sequence
  Synthetic
atggccgactcccaagtacgtattactgcttgtgactgctccatacttatccaaatcttgagatactggtcctactcctcttgctgctggagcaggagctcgtcttattctttccctaacggagacccagcatggcgtat

SEQ ID NO: 404029 - DNA, 140 bp, Artificial Sequence
  Synthetic
aggccctggctgctgatatgacagtccagcctataaagctgccagaaaaagacagctggactgtcaatgatatacagaaattagtgggaaagctaaattgggcaagtcagatttatccaggaccttttgggacagcggtg

SEQ ID NO: 404030 - DNA, 140 bp, Artificial Sequence
  Synthetic
caccgctgtcccaaaaggtcctggataaatctgacttgcccaatttagctttcccactaatttctgtatatcattgacagtccagctgtctttttctggcagctttataggctggactgtcatatcagcagccagggcct

SEQ ID NO: 404031 - DNA, 140 bp, Artificial Sequence
  Synthetic
atacgccatgctgggtctccatactagaaaatgtaacagaggaaataagcaactgttcttttaatacaaccacagaactaagagataagaagcagaaggtctatgcacttttttataagccgtacttgggagtcggccat

SEQ ID NO: 404032 - DNA, 140 bp, Artificial Sequence
  Synthetic
atggccgactcccaagtacggcttataaaaaagtgcatagaccttctgcttcttatctcttagttctgtggttgtattaaaagaacagttgcttatttcctctgttacattttctagtatggagacccagcatggcgtat

SEQ ID NO: 404033 - DNA, 140 bp, Artificial Sequence
  Synthetic
atacgccatgctgggtctccaggatgtggtgtaaatgatacaatggggacagtaatgaaaaattgctctttcaatgcaactacagagataaaagacaagaagcgccaagagtatgcacttcgtacttgggagtcggccat

SEQ ID NO: 404034 - DNA, 140 bp, Artificial Sequence
  Synthetic
atggccgactcccaagtacgaagtgcatactcttggcgcttcttgtcttttatctctgtagttgcattgaaagagcaatttttcattactgtccccattgtatcatttacaccacatcctggagacccagcatggcgtat

SEQ ID NO: 404035 - DNA, 140 bp, Artificial Sequence
  Synthetic
atacgccatgctgggtctcctgtgtggcaggtagacaggatgaggattagaacatggaacagtttagtaaaacatcatatgtatgtctcaaagaaagctaaaaattggttttatagacatcgtacttgggagtcggccat

SEQ ID NO: 404036 - DNA, 140 bp, Artificial Sequence
  Synthetic
atggccgactcccaagtacgatgtctataaaaccaatttttagctttctttgagacatacatatgatgttttactaaactgttccatgttctaatcctcatcctgtctacctgccacacaggagacccagcatggcgtat

SEQ ID NO: 404037 - DNA, 140 bp, Artificial Sequence
  Synthetic
aggccctggctgctgatatggcaataacacaaggagaagtgtaaggataggaccaggacaaacattctatgcaacaggagatataataggagacataagacaagcacattgtaacattaggaccttttgggacagcggtg

SEQ ID NO: 404038 - DNA, 140 bp, Artificial Sequence
  Synthetic
caccgctgtcccaaaaggtcctaatgttacaatgtgcttgtcttatgtctcctattatatctcctgttgcatagaatgtttgtcctggtcctatccttacacttctccttgtgttattgccatatcagcagccagggcct

SEQ ID NO: 404039 - DNA, 140 bp, Artificial Sequence
  Synthetic
atacgccatgctgggtctccagcactgtgagtaacaaagaagaaataacaaactgctctttcaatataaccacagaaataagagataagaaaaagacagaatacgcgcttttctataaaccgtacttgggagtcggccat

SEQ ID NO: 404040 - DNA, 140 bp, Artificial Sequence
  Synthetic
atggccgactcccaagtacggtttatagaaaagcgcgtattctgtctttttcttatctcttatttctgtggttatattgaaagagcagtttgttatttcttctttgttactcacagtgctggagacccagcatggcgtat

SEQ ID NO: 404041 - DNA, 140 bp, Artificial Sequence
  Synthetic
aggccctggctgctgatatgaattgcaaggccaactataggaactagcactcatagagagaaaagagcagcaggtttggcaatgctattcttggggattctaagtgcagcaggaagcactgaccttttgggacagcggtg

SEQ ID NO: 404042 - DNA, 140 bp, Artificial Sequence
  Synthetic
caccgctgtcccaaaaggtcagtgcttcctgctgcacttagaatccccaagaatagcattgccaaacctgctgctcttttctctctatgagtgctagttcctatagttggccttgcaattcatatcagcagccagggcct

SEQ ID NO: 404043 - DNA, 140 bp, Artificial Sequence
  Synthetic
aggccctggctgctgatatgataaggaaacagaagaaaatagacaggttacttgatagaataagagaaagagcagaagatagtggcaatgagagtgatggagacacagaggaattatccagaccttttgggacagcggtg

SEQ ID NO: 404044 - DNA, 140 bp, Artificial Sequence
  Synthetic
caccgctgtcccaaaaggtctggataattcctctgtgtctccatcactctcattgccactatcttctgctctttctcttattctatcaagtaacctgtctattttcttctgtttccttatcatatcagcagccagggcct

SEQ ID NO: 404045 - DNA, 140 bp, Artificial Sequence
  Synthetic
atacgccatgctgggtctccagcagaagatagtggcaatgagagtgatggagacacagaggaattatccactcttatggagatggggtatgataatattttggataatgataatttgtaacgtacttgggagtcggccat

SEQ ID NO: 404046 - DNA, 140 bp, Artificial Sequence
  Synthetic
atggccgactcccaagtacgttacaaattatcattatccaaaatattatcataccccatctccataagagtggataattcctctgtgtctccatcactctcattgccactatcttctgctggagacccagcatggcgtat

SEQ ID NO: 404047 - DNA, 140 bp, Artificial Sequence
  Synthetic
atacgccatgctgggtctccctgtagccacaacatcaccatcaccctcgccaacaacactaggatcataggtaacatgacagaagaaatgagaaactgctcgtacaatacaaccacagaacgtacttgggagtcggccat

SEQ ID NO: 404048 - DNA, 140 bp, Artificial Sequence
  Synthetic
atggccgactcccaagtacgttctgtggttgtattgtacgagcagtttctcatttcttctgtcatgttacctatgatcctagtgttgttggcgagggtgatggtgatgttgtggctacagggagacccagcatggcgtat

SEQ ID NO: 404049 - DNA, 140 bp, Artificial Sequence
  Synthetic
aggccctggctgctgatatgaagcagcatagtagggtggccggaaataagagaaagaataagaagagctgagccagcagcagagggaagaagaactgagccagcagcagagggagtaggagaccttttgggacagcggtg

SEQ ID NO: 404050 - DNA, 140 bp, Artificial Sequence
  Synthetic
caccgctgtcccaaaaggtctcctactccctctgctgctggctcagttcttcttccctctgctgctggctcagctcttcttattctttctcttatttccggccaccctactatgctgcttcatatcagcagccagggcct

SEQ ID NO: 404051 - DNA, 140 bp, Artificial Sequence
  Synthetic
aggccctggctgctgatatgccagacccaacaacaatacgagaagaagtgtacatataggaccaggacaagcattctatgcaacaggtgacataataggggatataagaaaagcacattggaccttttgggacagcggtg

SEQ ID NO: 404052 - DNA, 140 bp, Artificial Sequence
  Synthetic
caccgctgtcccaaaaggtccaatgtgcttttcttatatcccctattatgtcacctgttgcatagaatgcttgtcctggtcctatatgtacacttcttctcgtattgttgttgggtctggcatatcagcagccagggcct

SEQ ID NO: 404053 - DNA, 140 bp, Artificial Sequence
  Synthetic
atacgccatgctgggtctccggggatttagaagttacaacacatagctttaattgtggaggagaatttttttattgcaatacatcaagcctgtttaatagtacttggtacggtaatggcacgtacttgggagtcggccat

SEQ ID NO: 404054 - DNA, 140 bp, Artificial Sequence
  Synthetic
atggccgactcccaagtacgtgccattaccgtaccaagtactattaaacaggcttgatgtattgcaataaaaaaattctcctccacaattaaagctatgtgttgtaacttctaaatccccggagacccagcatggcgtat

SEQ ID NO: 404055 - DNA, 140 bp, Artificial Sequence
  Synthetic
aggccctggctgctgatatgcattgtctagtttgctttcagacaaaaggcttaggcatttcctatggcaggaagaagcggagacagcgacgaagcgctcctccaagcagtgaagatcatcgaccttttgggacagcggtg

SEQ ID NO: 404056 - DNA, 140 bp, Artificial Sequence
  Synthetic
caccgctgtcccaaaaggtcgatgatcttcactgcttggaggagcgcttcgtcgctgtctccgcttcttcctgccataggaaatgcctaagccttttgtctgaaagcaaactagacaatgcatatcagcagccagggcct

SEQ ID NO: 404057 - DNA, 140 bp, Artificial Sequence
  Synthetic
aggccctggctgctgatatgtagaatataggaaaatattaagacaaagaaaaatagacaggttaattgatagaataagagaaagagcagaagacagtggcaatgagagtgaaggagatcagaccttttgggacagcggtg

SEQ ID NO: 404058 - DNA, 140 bp, Artificial Sequence
  Synthetic
caccgctgtcccaaaaggtctgatctccttcactctcattgccactgtcttctgctctttctcttattctatcaattaacctgtctatttttctttgtcttaatattttcctatattctacatatcagcagccagggcct

SEQ ID NO: 404059 - DNA, 140 bp, Artificial Sequence
  Synthetic
aggccctggctgctgatatggccttttagaaacatcagaaggctgtaaacaaataatgaaacagctacatccatctcttcagacagggtcagaagaacttaaatcattatacaacacagtgaccttttgggacagcggtg

SEQ ID NO: 404060 - DNA, 140 bp, Artificial Sequence
  Synthetic
caccgctgtcccaaaaggtcactgtgttgtataatgatttaagttcttctgaccctgtctgaagagatggatgtagctgtttcattatttgtttacagccttctgatgtttctaaaaggccatatcagcagccagggcct

SEQ ID NO: 404061 - DNA, 140 bp, Artificial Sequence
  Synthetic
atacgccatgctgggtctccgaatataggaaattgttaagacagaaaaagatagataggttaattgaaagaattagggaaagagcagaagacagtggcaatgatagtgagggggatattgcgtacttgggagtcggccat

SEQ ID NO: 404062 - DNA, 140 bp, Artificial Sequence
  Synthetic
atggccgactcccaagtacgcaatatccccctcactatcattgccactgtcttctgctctttccctaattctttcaattaacctatctatctttttctgtcttaacaatttcctatattcggagacccagcatggcgtat

SEQ ID NO: 404063 - DNA, 140 bp, Artificial Sequence
  Synthetic
atacgccatgctgggtctcctttcagacccataccccaaacccagggggactcgacaggcccggaagaatcgaagaagaaggtggagagcaagacagaaccagatcgattcgattagtgacgtacttgggagtcggccat

SEQ ID NO: 404064 - DNA, 140 bp, Artificial Sequence
  Synthetic
atggccgactcccaagtacgtcactaatcgaatcgatctggttctgtcttgctctccaccttcttcttcgattcttccgggcctgtcgagtccccctgggtttggggtatgggtctgaaaggagacccagcatggcgtat

SEQ ID NO: 404065 - DNA, 140 bp, Artificial Sequence
  Synthetic
aggccctggctgctgatatgatttaggaataaaacaatagtctttaatcaatcctcaggaggggacccagaaattgtaatgcacagttttaattgtggaggggaatttttctactgtaatgaccttttgggacagcggtg

SEQ ID NO: 404066 - DNA, 140 bp, Artificial Sequence
  Synthetic
caccgctgtcccaaaaggtcattacagtagaaaaattcccctccacaattaaaactgtgcattacaatttctgggtcccctcctgaggattgattaaagactattgttttattcctaaatcatatcagcagccagggcct

SEQ ID NO: 404067 - DNA, 140 bp, Artificial Sequence
  Synthetic
atacgccatgctgggtctccttaaatatctgtggaatctcctgttatattgggggagggaactaagaaacagtgctattactttgcttaatgctatagcaataacagtagctgagggaaccgtacttgggagtcggccat

SEQ ID NO: 404068 - DNA, 140 bp, Artificial Sequence
  Synthetic
atggccgactcccaagtacggttccctcagctactgttattgctatagcattaagcaaagtaatagcactgtttcttagttccctcccccaatataacaggagattccacagatatttaaggagacccagcatggcgtat

SEQ ID NO: 404069 - DNA, 140 bp, Artificial Sequence
  Synthetic
atacgccatgctgggtctcctacctagaagaatcagacagggcctagaaaggcttctgctataacatgggtggcaagtggtccaagagcctcgggggatggcctaaggttagggaaagaacgtacttgggagtcggccat

SEQ ID NO: 404070 - DNA, 140 bp, Artificial Sequence
  Synthetic
atggccgactcccaagtacgttctttccctaaccttaggccatcccccgaggctcttggaccacttgccacccatgttatagcagaagcctttctaggccctgtctgattcttctaggtaggagacccagcatggcgtat

SEQ ID NO: 404071 - DNA, 140 bp, Artificial Sequence
  Synthetic
aggccctggctgctgatatgtggcaagtggtccaagagcctcgggggatggcctaaggttagggaaagaatgagaaaaactcctccaacaccagcagcagaaggagtaggagcagtatctgaccttttgggacagcggtg

SEQ ID NO: 404072 - DNA, 140 bp, Artificial Sequence
  Synthetic
caccgctgtcccaaaaggtcagatactgctcctactccttctgctgctggtgttggaggagtttttctcattctttccctaaccttaggccatcccccgaggctcttggaccacttgccacatatcagcagccagggcct

SEQ ID NO: 404073 - DNA, 140 bp, Artificial Sequence
  Synthetic
atacgccatgctgggtctcccactttagattgtacaaatgtaactggtaatgttagtactgaggataaagaagaaataaaaaattgctctttcaatacaaccacagtaataagagacaagcgtacttgggagtcggccat

SEQ ID NO: 404074 - DNA, 140 bp, Artificial Sequence
  Synthetic
atggccgactcccaagtacgcttgtctcttattactgtggttgtattgaaagagcaattttttatttcttctttatcctcagtactaacattaccagttacatttgtacaatctaaagtgggagacccagcatggcgtat

SEQ ID NO: 404075 - DNA, 140 bp, Artificial Sequence
  Synthetic
aggccctggctgctgatatgtataaatatgtggcaggaggtaagacgagcaatgtatgcccctcccattaaaggaataataacatgtagatcaaatatcacaggattactactgacacgggaccttttgggacagcggtg

SEQ ID NO: 404076 - DNA, 140 bp, Artificial Sequence
  Synthetic
caccgctgtcccaaaaggtcccgtgtcagtagtaatcctgtgatatttgatctacatgttattattcctttaatgggaggggcatacattgctcgtcttacctcctgccacatatttatacatatcagcagccagggcct

SEQ ID NO: 404077 - DNA, 140 bp, Artificial Sequence
  Synthetic
atacgccatgctgggtctccggacagatagggttatagaaataggacaaagattttgtagagctattcgtaacatacctaggagaatcagacagggcgcagaaaaggctttgcaataacacgtacttgggagtcggccat

SEQ ID NO: 404078 - DNA, 140 bp, Artificial Sequence
  Synthetic
atggccgactcccaagtacgtgttattgcaaagccttttctgcgccctgtctgattctcctaggtatgttacgaatagctctacaaaatctttgtcctatttctataaccctatctgtccggagacccagcatggcgtat

SEQ ID NO: 404079 - DNA, 140 bp, Artificial Sequence
  Synthetic
aggccctggctgctgatatggcctccctcaaatcactctttggcaacgacccattgtcacaataaagatagggggacagctaaaggaagctctattagatacaggagcagatgatacagtgaccttttgggacagcggtg

SEQ ID NO: 404080 - DNA, 140 bp, Artificial Sequence
  Synthetic
caccgctgtcccaaaaggtcactgtatcatctgctcctgtatctaatagagcttcctttagctgtccccctatctttattgtgacaatgggtcgttgccaaagagtgatttgagggaggccatatcagcagccagggcct

SEQ ID NO: 404081 - DNA, 140 bp, Artificial Sequence
  Synthetic
aggccctggctgctgatatggaggaggtaggctttccagtcaggccgcaggtacctttgagaccgatgacatataagggagctttcgatctcagccactttttaaaagaaaaggggggacgaccttttgggacagcggtg

SEQ ID NO: 404082 - DNA, 140 bp, Artificial Sequence
  Synthetic
caccgctgtcccaaaaggtcgtccccccttttcttttaaaaagtggctgagatcgaaagctcccttatatgtcatcggtctcaaaggtacctgcggcctgactggaaagcctacctcctccatatcagcagccagggcct

SEQ ID NO: 404083 - DNA, 140 bp, Artificial Sequence
  Synthetic
aggccctggctgctgatatggcagagggagtaggaccagcgtctcaagacttagataaacatggggcactgacaagcagcaacacacctggcaataatgctgattgtgcctggctggaaggaccttttgggacagcggtg

SEQ ID NO: 404084 - DNA, 140 bp, Artificial Sequence
  Synthetic
caccgctgtcccaaaaggtccttccagccaggcacaatcagcattattgccaggtgtgttgctgcttgtcagtgccccatgtttatctaagtcttgagacgctggtcctactccctctgccatatcagcagccagggcct

SEQ ID NO: 404085 - DNA, 140 bp, Artificial Sequence
  Synthetic
atacgccatgctgggtctccgcagcaaagactatgcagatttaagaaatataacagatgaagtaaaaaactgttcttttaatatgaccgcagaaataagagataagcagcggaaggtctacgtacttgggagtcggccat

SEQ ID NO: 404086 - DNA, 140 bp, Artificial Sequence
  Synthetic
atggccgactcccaagtacgtagaccttccgctgcttatctcttatttctgcggtcatattaaaagaacagttttttacttcatctgttatatttcttaaatctgcatagtctttgctgcggagacccagcatggcgtat

SEQ ID NO: 404087 - DNA, 140 bp, Artificial Sequence
  Synthetic
atacgccatgctgggtctccatatatcaggagccatataaaaatctgaaaacagggaagtatgcaagaataaagtctgcccacactaatgatgtaaaacaattaacagaagcagtgcaaacgtacttgggagtcggccat

SEQ ID NO: 404088 - DNA, 140 bp, Artificial Sequence
  Synthetic
atggccgactcccaagtacgtttgcactgcttctgttaattgttttacatcattagtgtgggcagactttattcttgcatacttccctgttttcagatttttatatggctcctgatatatggagacccagcatggcgtat

SEQ ID NO: 404089 - DNA, 140 bp, Artificial Sequence
  Synthetic
aggccctggctgctgatatgtatgtagatggggcagctaatagggagactaagctaggaaaagcagggtatgtcactgacagaggaagacaaaaggttgtttccctaactgagacaacaagaccttttgggacagcggtg

SEQ ID NO: 404090 - DNA, 140 bp, Artificial Sequence
  Synthetic
caccgctgtcccaaaaggtcttgttgtctcagttagggaaacaaccttttgtcttcctctgtcagtgacataccctgcttttcctagcttagtctccctattagctgccccatctacatacatatcagcagccagggcct

SEQ ID NO: 404091 - DNA, 140 bp, Artificial Sequence
  Synthetic
atacgccatgctgggtctccaacaatatgaggacacgtatgacttttggaccaggacacgtattctatagaacaggagagataataggagatataagacaggcatattgtaatattagtacgtacttgggagtcggccat

SEQ ID NO: 404092 - DNA, 140 bp, Artificial Sequence
  Synthetic
atggccgactcccaagtacgtactaatattacaatatgcctgtcttatatctcctattatctctcctgttctatagaatacgtgtcctggtccaaaagtcatacgtgtcctcatattgttggagacccagcatggcgtat

SEQ ID NO: 404093 - DNA, 140 bp, Artificial Sequence
  Synthetic
atacgccatgctgggtctccgagacaagtcttacagaaatgaaaaattgctctttcaatacaaccacagtaataaaagataagaagcaccaagagtatgcacttttttataaacttgatacgtacttgggagtcggccat

SEQ ID NO: 404094 - DNA, 140 bp, Artificial Sequence
  Synthetic
atggccgactcccaagtacgtatcaagtttataaaaaagtgcatactcttggtgcttcttatcttttattactgtggttgtattgaaagagcaatttttcatttctgtaagacttgtctcggagacccagcatggcgtat

SEQ ID NO: 404095 - DNA, 140 bp, Artificial Sequence
  Synthetic
atacgccatgctgggtctccaggctaattttttagggaaaatttggcctttcaacaacaaagggaggccagggaactttcctcagagcagaacagaaccatcagccccaccagcagagagcgtacttgggagtcggccat

SEQ ID NO: 404096 - DNA, 140 bp, Artificial Sequence
  Synthetic
atggccgactcccaagtacgctctctgctggtggggctgatggttctgttctgctctgaggaaagttccctggcctccctttgttgttgaaaggccaaattttccctaaaaaattagcctggagacccagcatggcgtat

SEQ ID NO: 404097 - DNA, 140 bp, Artificial Sequence
  Synthetic
aggccctggctgctgatatgggctgctctggaaaactcatctgcaccactgatgtaccttggaactccagttggagtaataaaactgaaggtgatatttggaataaaatgacctggatgcgaccttttgggacagcggtg

SEQ ID NO: 404098 - DNA, 140 bp, Artificial Sequence
  Synthetic
caccgctgtcccaaaaggtcgcatccaggtcattttattccaaatatcaccttcagttttattactccaactggagttccaaggtacatcagtggtgcagatgagttttccagagcagcccatatcagcagccagggcct

SEQ ID NO: 404099 - DNA, 140 bp, Artificial Sequence
  Synthetic
atacgccatgctgggtctccaggaaataaaaaactgcactttcaatatgaccacagaattaagagataggaaacagaaagtgtctgcacttttctatagacttgatgtggtactaattaacgtacttgggagtcggccat

SEQ ID NO: 404100 - DNA, 140 bp, Artificial Sequence
  Synthetic
atggccgactcccaagtacgttaattagtaccacatcaagtctatagaaaagtgcagacactttctgtttcctatctcttaattctgtggtcatattgaaagtgcagttttttatttcctggagacccagcatggcgtat

SEQ ID NO: 404101 - DNA, 140 bp, Artificial Sequence
  Synthetic
aggccctggctgctgatatgcaacaggtaatcgcaggtccaatggccttgaacagcatggccctaacaacggatgcaataagaaatagctcaagggcagcttattgcacgtataataccagaccttttgggacagcggtg

SEQ ID NO: 404102 - DNA, 140 bp, Artificial Sequence
  Synthetic
caccgctgtcccaaaaggtctggtattatacgtgcaataagctgcccttgagctatttcttattgcatccgttgttagggccatgctgttcaaggccattggacctgcgattacctgttgcatatcagcagccagggcct

SEQ ID NO: 404103 - DNA, 140 bp, Artificial Sequence
  Synthetic
atacgccatgctgggtctccagtactttaagaacagcacagccataatctttactaaccactcaggaggagatttagaaattacaacacatagctttaattgtggaggagaatttttctacgtacttgggagtcggccat

SEQ ID NO: 404104 - DNA, 140 bp, Artificial Sequence
  Synthetic
atggccgactcccaagtacgtagaaaaattctcctccacaattaaagctatgtgttgtaatttctaaatctcctcctgagtggttagtaaagattatggctgtgctgttcttaaagtactggagacccagcatggcgtat

SEQ ID NO: 404105 - DNA, 140 bp, Artificial Sequence
  Synthetic
aggccctggctgctgatatggatttagaaattacaacacatagctttaattgtggaggagaatttttctattgcaatacatcacaactgtttaacagtacttggagtaacaatggcactggaccttttgggacagcggtg

SEQ ID NO: 404106 - DNA, 140 bp, Artificial Sequence
  Synthetic
caccgctgtcccaaaaggtccagtgccattgttactccaagtactgttaaacagttgtgatgtattgcaatagaaaaattctcctccacaattaaagctatgtgttgtaatttctaaatccatatcagcagccagggcct

SEQ ID NO: 404107 - DNA, 140 bp, Artificial Sequence
  Synthetic
aggccctggctgctgatatgcagagaagagcaagaaatggagccagtagatcctaacctagagccctggaaccatccaggaagtcagcctaaaactgcttgtaataactgttattgtaaagaccttttgggacagcggtg

SEQ ID NO: 404108 - DNA, 140 bp, Artificial Sequence
  Synthetic
caccgctgtcccaaaaggtctttacaataacagttattacaagcagttttaggctgacttcctggatggttccagggctctaggttaggatctactggctccatttcttgctcttctctgcatatcagcagccagggcct

SEQ ID NO: 404109 - DNA, 140 bp, Artificial Sequence
  Synthetic
aggccctggctgctgatatggataagttgtaatacctcagtcgttacacaagcctgtccaaagatatcctttgagccaattcccatacattattgtgccccagctggttttgcgattctagaccttttgggacagcggtg

SEQ ID NO: 404110 - DNA, 140 bp, Artificial Sequence
  Synthetic
caccgctgtcccaaaaggtctagaatcgcaaaaccagctggggcacaataatgtatgggaattggctcaaaggatatctttggacaggcttgtgtaacgactgaggtattacaacttatccatatcagcagccagggcct

SEQ ID NO: 404111 - DNA, 140 bp, Artificial Sequence
  Synthetic
atacgccatgctgggtctccgaactgataacatggggggagaaataaaaaattgttctttcaatatgaccacagaagtaagagataagagagagaaggtacatgcacttttttatagactcgtacttgggagtcggccat

SEQ ID NO: 404112 - DNA, 140 bp, Artificial Sequence
  Synthetic
atggccgactcccaagtacgagtctataaaaaagtgcatgtaccttctctctcttatctcttacttctgtggtcatattgaaagaacaattttttatttctccccccatgttatcagttcggagacccagcatggcgtat

SEQ ID NO: 404113 - DNA, 140 bp, Artificial Sequence
  Synthetic
aggccctggctgctgatatgatcaatcctcaggaggggacccagaaattgtaatgcacagttttaattgtggaggggaatttttctactgtaatacaacaaaactgtttaatagcacttggaccttttgggacagcggtg

SEQ ID NO: 404114 - DNA, 140 bp, Artificial Sequence
  Synthetic
caccgctgtcccaaaaggtccaagtgctattaaacagttttgttgtattacagtagaaaaattcccctccacaattaaaactgtgcattacaatttctgggtcccctcctgaggattgatcatatcagcagccagggcct

SEQ ID NO: 404115 - DNA, 140 bp, Artificial Sequence
  Synthetic
aggccctggctgctgatatgataggaccaggacaagcattctatgcaacaggagaaataataggagatataagacaagcacattgtaacattagtagaacagcatggaacaaaactttacgaccttttgggacagcggtg

SEQ ID NO: 404116 - DNA, 140 bp, Artificial Sequence
  Synthetic
caccgctgtcccaaaaggtcgtaaagttttgttccatgctgttctactaatgttacaatgtgcttgtcttatatctcctattatttctcctgttgcatagaatgcttgtcctggtcctatcatatcagcagccagggcct

SEQ ID NO: 404117 - DNA, 140 bp, Artificial Sequence
  Synthetic
atacgccatgctgggtctcccaacggtaggaccctcgatgagaatgtaagaaattgctctttcaatacaaccacactagtaaaagataagaagcagaaagagtatgcacttttttatagacgtacttgggagtcggccat

SEQ ID NO: 404118 - DNA, 140 bp, Artificial Sequence
  Synthetic
atggccgactcccaagtacgtctataaaaaagtgcatactctttctgcttcttatcttttactagtgtggttgtattgaaagagcaatttcttacattctcatcgagggtcctaccgttgggagacccagcatggcgtat

SEQ ID NO: 404119 - DNA, 140 bp, Artificial Sequence
  Synthetic
aggccctggctgctgatatgacacagcagtctcaagggactgagactggggtgggaagccatcaaatatctgtggaatcttctagcatactggggtcaggaactaaagaatagtgctattgaccttttgggacagcggtg

SEQ ID NO: 404120 - DNA, 140 bp, Artificial Sequence
  Synthetic
caccgctgtcccaaaaggtcaatagcactattctttagttcctgaccccagtatgctagaagattccacagatatttgatggcttcccaccccagtctcagtcccttgagactgctgtgtcatatcagcagccagggcct

SEQ ID NO: 404121 - DNA, 140 bp, Artificial Sequence
  Synthetic
aggccctggctgctgatatgatcacaatcccatgcagaataaaacaaattataaatatgtggcagggggtcggacgagcaatgtatgcccctcccattgaaggaatattaacatgtagatgaccttttgggacagcggtg

SEQ ID NO: 404122 - DNA, 140 bp, Artificial Sequence
  Synthetic
caccgctgtcccaaaaggtcatctacatgttaatattccttcaatgggaggggcatacattgctcgtccgaccccctgccacatatttataatttgttttattctgcatgggattgtgatcatatcagcagccagggcct

SEQ ID NO: 404123 - DNA, 140 bp, Artificial Sequence
  Synthetic
aggccctggctgctgatatgttttatcaaagtaagacagtatgatcagatacttatagaaatttgtggaaaaaaggctataggtacagtattagtaggacctacacctgtcaacataattgaccttttgggacagcggtg

SEQ ID NO: 404124 - DNA, 140 bp, Artificial Sequence
  Synthetic
caccgctgtcccaaaaggtcaattatgttgacaggtgtaggtcctactaatactgtacctatagccttttttccacaaatttctataagtatctgatcatactgtcttactttgataaaacatatcagcagccagggcct

SEQ ID NO: 404125 - DNA, 140 bp, Artificial Sequence
  Synthetic
aggccctggctgctgatatgagaaattgaatgtataagacccagcaataatagaagaaaaagtgtaaggataggaccaggacaagcaatctatgcaacaggagacataataggggacatagaccttttgggacagcggtg

SEQ ID NO: 404126 - DNA, 140 bp, Artificial Sequence
  Synthetic
caccgctgtcccaaaaggtctatgtcccctattatgtctcctgttgcatagattgcttgtcctggtcctatccttacactttttcttctattattgctgggtcttatacattcaatttctcatatcagcagccagggcct

SEQ ID NO: 404127 - DNA, 140 bp, Artificial Sequence
  Synthetic
aggccctggctgctgatatgatgtggcaggaggtaggacgagcaatgtatgcccctcccattgagggaaacataacatgtaaatcaaatatcacaggactactattggtacgtgatggaggaccttttgggacagcggtg

SEQ ID NO: 404128 - DNA, 140 bp, Artificial Sequence
  Synthetic
caccgctgtcccaaaaggtcctccatcacgtaccaatagtagtcctgtgatatttgatttacatgttatgtttccctcaatgggaggggcatacattgctcgtcctacctcctgccacatcatatcagcagccagggcct

SEQ ID NO: 404129 - DNA, 140 bp, Artificial Sequence
  Synthetic
atacgccatgctgggtctccatataatacagtagcagtcctctactgcgtacatcaaagatttgagataagagacaccaaggaagccttagataaaatagaagaaataaaaaataagagccgtacttgggagtcggccat

SEQ ID NO: 404130 - DNA, 140 bp, Artificial Sequence
  Synthetic
atggccgactcccaagtacggctcttattttttatttcttctattttatctaaggcttccttggtgtctcttatctcaaatctttgatgtacgcagtagaggactgctactgtattatatggagacccagcatggcgtat

SEQ ID NO: 404131 - DNA, 140 bp, Artificial Sequence
  Synthetic
aggccctggctgctgatatgcccttgtcgtttcagacccttaccccaaacccgaggggaccagacaggctcggaggaatcgaagaagaaggtggagagcaagacagagacagatccattcgaccttttgggacagcggtg

SEQ ID NO: 404132 - DNA, 140 bp, Artificial Sequence
  Synthetic
caccgctgtcccaaaaggtcgaatggatctgtctctgtcttgctctccaccttcttcttcgattcctccgagcctgtctggtcccctcgggtttggggtaagggtctgaaacgacaagggcatatcagcagccagggcct

SEQ ID NO: 404133 - DNA, 140 bp, Artificial Sequence
  Synthetic
atacgccatgctgggtctccaccaggattggtaatgaaagcatgcagggagaaataaaaaattgctctttcaatataaccacagaaataagagataagagaaagagagtgtttgcactttcgtacttgggagtcggccat

SEQ ID NO: 404134 - DNA, 140 bp, Artificial Sequence
  Synthetic
atggccgactcccaagtacgaaagtgcaaacactctctttctcttatctcttatttctgtggttatattgaaagagcaattttttatttctccctgcatgctttcattaccaatcctggtggagacccagcatggcgtat

SEQ ID NO: 404135 - DNA, 140 bp, Artificial Sequence
  Synthetic
atacgccatgctgggtctccgtggcgcccgaacagggaccttgaaagcgaaagtggaaccagagtagatctctcgacgcaggactcggcttgctgagcgcgcacagcaagaggcgaggggcgtacttgggagtcggccat

SEQ ID NO: 404136 - DNA, 140 bp, Artificial Sequence
  Synthetic
atggccgactcccaagtacgcccctcgcctcttgctgtgcgcgctcagcaagccgagtcctgcgtcgagagatctactctggttccactttcgctttcaaggtccctgttcgggcgccacggagacccagcatggcgtat

SEQ ID NO: 404137 - DNA, 140 bp, Artificial Sequence
  Synthetic
aggccctggctgctgatatgaaaaagatttattagcattggacagttggcaaagtctatggaattggtttaacatatcaaattggctgtggtatataaaaatattcataatgatagtagggaccttttgggacagcggtg

SEQ ID NO: 404138 - DNA, 140 bp, Artificial Sequence
  Synthetic
caccgctgtcccaaaaggtccctactatcattatgaatatttttatataccacagccaatttgatatgttaaaccaattccatagactttgccaactgtccaatgctaataaatctttttcatatcagcagccagggcct

SEQ ID NO: 404139 - DNA, 140 bp, Artificial Sequence
  Synthetic
aggccctggctgctgatatgcatagttggatggcctgctataagagagagaatgagacgaactcagccagcagcagaaggagtaggagcagcatctcaagacttagataaatatggagcagaccttttgggacagcggtg

SEQ ID NO: 404140 - DNA, 140 bp, Artificial Sequence
  Synthetic
caccgctgtcccaaaaggtctgctccatatttatctaagtcttgagatgctgctcctactccttctgctgctggctgagttcgtctcattctctctcttatagcaggccatccaactatgcatatcagcagccagggcct

SEQ ID NO: 404141 - DNA, 140 bp, Artificial Sequence
  Synthetic
aggccctggctgctgatatgctatggagatacttggacaggagttgaagctataataagaatactgcaacaactattgtttattcatttcagaattgggtgccagcatagcagaataggagaccttttgggacagcggtg

SEQ ID NO: 404142 - DNA, 140 bp, Artificial Sequence
  Synthetic
caccgctgtcccaaaaggtctcctattctgctatgctggcacccaattctgaaatgaataaacaatagttgttgcagtattcttattatagcttcaactcctgtccaagtatctccatagcatatcagcagccagggcct

SEQ ID NO: 404143 - DNA, 140 bp, Artificial Sequence
  Synthetic
aggccctggctgctgatatgatcattatataatgcagtagcagtcctctggtgcgtgcaccaaaggatagaagtaaaaggcaccaaagaagccttagataaattagaggaagtacaaaatgaccttttgggacagcggtg

SEQ ID NO: 404144 - DNA, 140 bp, Artificial Sequence
  Synthetic
caccgctgtcccaaaaggtcattttgtacttcctctaatttatctaaggcttctttggtgccttttacttctatcctttggtgcacgcaccagaggactgctactgcattatataatgatcatatcagcagccagggcct

SEQ ID NO: 404145 - DNA, 140 bp, Artificial Sequence
  Synthetic
aggccctggctgctgatatgtactgtttactcatttcagaattgggtgccatcatagcagaataggaattttaagacaaagaagagcaagaaatggagccagtagatcctaacctagaacgaccttttgggacagcggtg

SEQ ID NO: 404146 - DNA, 140 bp, Artificial Sequence
  Synthetic
caccgctgtcccaaaaggtcgttctaggttaggatctactggctccatttcttgctcttctttgtcttaaaattcctattctgctatgatggcacccaattctgaaatgagtaaacagtacatatcagcagccagggcct

SEQ ID NO: 404147 - DNA, 140 bp, Artificial Sequence
  Synthetic
aggccctggctgctgatatgtaatgtgcttccacagggatggaaaggatcaccagcaatattccagagtagcatgacaaaaatcttagagccctttaggacaaaaaacccagacatagttgaccttttgggacagcggtg

SEQ ID NO: 404148 - DNA, 140 bp, Artificial Sequence
  Synthetic
caccgctgtcccaaaaggtcaactatgtctgggttttttgtcctaaagggctctaagatttttgtcatgctactctggaatattgctggtgatcctttccatccctgtggaagcacattacatatcagcagccagggcct

SEQ ID NO: 404149 - DNA, 140 bp, Artificial Sequence
  Synthetic
atacgccatgctgggtctccatgatttataatgtgatggggaacttgtgggtcacagtatattatggggtacctgtgtggaaagaagcaaaagctaccttattctgtgcatcagatgctacgtacttgggagtcggccat

SEQ ID NO: 404150 - DNA, 140 bp, Artificial Sequence
  Synthetic
atggccgactcccaagtacgtagcatctgatgcacagaataaggtagcttttgcttctttccacacaggtaccccataatatactgtgacccacaagttccccatcacattataaatcatggagacccagcatggcgtat

SEQ ID NO: 404151 - DNA, 140 bp, Artificial Sequence
  Synthetic
aggccctggctgctgatatgtgtaaactccttaggggagccaaagcactaacagacatagtaccactaactgaagaagcagaattagaattggcagaaaacagggaaattctaaaagaacgaccttttgggacagcggtg

SEQ ID NO: 404152 - DNA, 140 bp, Artificial Sequence
  Synthetic
caccgctgtcccaaaaggtcgttcttttagaatttccctgttttctgccaattctaattctgcttcttcagttagtggtactatgtctgttagtgctttggctcccctaaggagtttacacatatcagcagccagggcct

SEQ ID NO: 404153 - DNA, 140 bp, Artificial Sequence
  Synthetic
atacgccatgctgggtctcctcagtttatgggatcaaagtctaaaacccatgtgtaaagttacccctctctgtgtcactttaaattgtacagatgctattgttaccaggaatggtactatcgtacttgggagtcggccat

SEQ ID NO: 404154 - DNA, 140 bp, Artificial Sequence
  Synthetic
atggccgactcccaagtacgatagtaccattcctggtaacaatagcatctgtacaatttaaagtgacacagagaggggtaactttacacatgggttttagactttgatcccataaactgaggagacccagcatggcgtat

SEQ ID NO: 404155 - DNA, 140 bp, Artificial Sequence
  Synthetic
aggccctggctgctgatatgatgcaataatgtcagcacagtacaatgtacacatggaattaaaccagtgatatcaactcaactactgttaaacggtagcagagcagaaggagaaataatagaccttttgggacagcggtg

SEQ ID NO: 404156 - DNA, 140 bp, Artificial Sequence
  Synthetic
caccgctgtcccaaaaggtctattatttctccttctgctctgctaccgtttaacagtagttgagttgatatcactggtttaattccatgtgtacattgtactgtgctgacattattgcatcatatcagcagccagggcct

SEQ ID NO: 404157 - DNA, 140 bp, Artificial Sequence
  Synthetic
aggccctggctgctgatatgagacaataatatttaaatcatcctcaggaggggacctagaaattacaacacatagctttaattgtggaggagaatttttttattgcaatacatcaggcctgaccttttgggacagcggtg

SEQ ID NO: 404158 - DNA, 140 bp, Artificial Sequence
  Synthetic
caccgctgtcccaaaaggtcaggcctgatgtattgcaataaaaaaattctcctccacaattaaagctatgtgttgtaatttctaggtcccctcctgaggatgatttaaatattattgtctcatatcagcagccagggcct

SEQ ID NO: 404159 - DNA, 140 bp, Artificial Sequence
  Synthetic
aggccctggctgctgatatgatattaagacaggatcagaagaaatcaaatcattatataatacagtagtaaccctctattgtgtacatcagaggatagaggtaaaagacaccaaggaagcgaccttttgggacagcggtg

SEQ ID NO: 404160 - DNA, 140 bp, Artificial Sequence
  Synthetic
caccgctgtcccaaaaggtcgcttccttggtgtcttttacctctatcctctgatgtacacaatagagggttactactgtattatataatgatttgatttcttctgatcctgtcttaatatcatatcagcagccagggcct

SEQ ID NO: 404161 - DNA, 140 bp, Artificial Sequence
  Synthetic
aggccctggctgctgatatggcaatagtaggattagtagtagcattcatagcagccatagttgtgtggaccatagtatatatagaatataggaaaataagaaaacagaagaaaatagacagaccttttgggacagcggtg

SEQ ID NO: 404162 - DNA, 140 bp, Artificial Sequence
  Synthetic
caccgctgtcccaaaaggtctgtctattttcttctgttttcttattttcctatattctatatatactatggtccacacaactatggctgctatgaatgctactactaatcctactattgccatatcagcagccagggcct

SEQ ID NO: 404163 - DNA, 140 bp, Artificial Sequence
  Synthetic
aggccctggctgctgatatgcatagtatatatagaatataggaaaataagaaaacagaagaaaatagacaagttacttgatagaataagggaaagagcagaagatagtggcaatgagagtgaccttttgggacagcggtg

SEQ ID NO: 404164 - DNA, 140 bp, Artificial Sequence
  Synthetic
caccgctgtcccaaaaggtcactctcattgccactatcttctgctctttcccttattctatcaagtaacttgtctattttcttctgttttcttattttcctatattctatatatactatgcatatcagcagccagggcct

SEQ ID NO: 404165 - DNA, 140 bp, Artificial Sequence
  Synthetic
aggccctggctgctgatatgtactatggggtaccggtgtggagagacgcagagaccactctattttgtgcatcagatgctaaagcatatcatacagaagcacataatgtttgggctacacgaccttttgggacagcggtg

SEQ ID NO: 404166 - DNA, 140 bp, Artificial Sequence
  Synthetic
caccgctgtcccaaaaggtcgtgtagcccaaacattatgtgcttctgtatgatatgctttagcatctgatgcacaaaatagagtggtctctgcgtctctccacaccggtaccccatagtacatatcagcagccagggcct

SEQ ID NO: 404167 - DNA, 140 bp, Artificial Sequence
  Synthetic
atacgccatgctgggtctccataactattgaaggtgacatggggaaggaaataaaaaactgctcttacaaggtgaccacagaactaagagataaggaacagaatatgacttcacttttttcgtacttgggagtcggccat

SEQ ID NO: 404168 - DNA, 140 bp, Artificial Sequence
  Synthetic
atggccgactcccaagtacgaaaaaagtgaagtcatattctgttccttatctcttagttctgtggtcaccttgtaagagcagttttttatttccttccccatgtcaccttcaatagttatggagacccagcatggcgtat

SEQ ID NO: 404169 - DNA, 140 bp, Artificial Sequence
  Synthetic
aggccctggctgctgatatgtgtaagagaaagattaagaagaactgagccagcagcagagggagtaggagcagcgtctcgagacttagataaacatggagcgctgacaagcagcaacacagaccttttgggacagcggtg

SEQ ID NO: 404170 - DNA, 140 bp, Artificial Sequence
  Synthetic
caccgctgtcccaaaaggtctgtgttgctgcttgtcagcgctccatgtttatctaagtctcgagacgctgctcctactccctctgctgctggctcagttcttcttaatctttctcttacacatatcagcagccagggcct

SEQ ID NO: 404171 - DNA, 140 bp, Artificial Sequence
  Synthetic
aggccctggctgctgatatgacagtacaatgcacacatggaatcaaaccagtagtatcaactcaactgctactaaatggcagtctagcaaaggaccagataatgattagatctgaaaatagaccttttgggacagcggtg

SEQ ID NO: 404172 - DNA, 140 bp, Artificial Sequence
  Synthetic
caccgctgtcccaaaaggtctattttcagatctaatcattatctggtcctttgctagactgccatttagtagcagttgagttgatactactggtttgattccatgtgtgcattgtactgtcatatcagcagccagggcct

SEQ ID NO: 404173 - DNA, 140 bp, Artificial Sequence
  Synthetic
atacgccatgctgggtctcctcaaagcagtaagtatatgtaatgtttaatttagcagcaagagtagattatagattaggcgtaggagcattggtaatagcaggaatcatagcaatagttgcgtacttgggagtcggccat

SEQ ID NO: 404174 - DNA, 140 bp, Artificial Sequence
  Synthetic
atggccgactcccaagtacgcaactattgctatgattcctgctattaccaatgctcctacgcctaatctataatctactcttgctgctaaattaaacattacatatacttactgctttgaggagacccagcatggcgtat

SEQ ID NO: 404175 - DNA, 140 bp, Artificial Sequence
  Synthetic
aggccctggctgctgatatgaccaggacaagcattctatgcaagaggtgacataataggggatataagacaagcacattgtgaggtcaataaaacagaatgggtgaaaactttacacaaggaccttttgggacagcggtg

SEQ ID NO: 404176 - DNA, 140 bp, Artificial Sequence
  Synthetic
caccgctgtcccaaaaggtccttgtgtaaagttttcacccattctgttttattgacctcacaatgtgcttgtcttatatcccctattatgtcacctcttgcatagaatgcttgtcctggtcatatcagcagccagggcct

SEQ ID NO: 404177 - DNA, 140 bp, Artificial Sequence
  Synthetic
  misc_feature (31)..(31): n is a, c, g, or t
  misc_feature (51)..(51): n is a, c, g, or t
  misc_feature (91)..(91): n is a, c, g, or t
atacgccatgctgggtctcctaaatcctcangaggggatatagaaattacnacacatagttttaattgtggaggagaattcttctattgcnatacatcaagactatttaatagtacttggcgtacttgggagtcggccat

SEQ ID NO: 404178 - DNA, 140 bp, Artificial Sequence
  Synthetic
  misc_feature (50)..(50): n is a, c, g, or t
  misc_feature (90)..(90): n is a, c, g, or t
  misc_feature (110)..(110): n is a, c, g, or t
atggccgactcccaagtacgccaagtactattaaatagtcttgatgtatngcaatagaagaattctcctccacaattaaaactatgtgtngtaatttctatatcccctcntgaggatttaggagacccagcatggcgtat

SEQ ID NO: 404179 - DNA, 140 bp, Artificial Sequence
  Synthetic
atacgccatgctgggtctccgaaatgaaaagctgctctttcaatgtcaccacaaatataggaggtaaagtaaagaaggaaaatgcacttttttataatcttgatgtagtaaaattacgggcgtacttgggagtcggccat

SEQ ID NO: 404180 - DNA, 140 bp, Artificial Sequence
  Synthetic
atggccgactcccaagtacgcccgtaattttactacatcaagattataaaaaagtgcattttccttctttactttacctcctatatttgtggtgacattgaaagagcagcttttcatttcggagacccagcatggcgtat

SEQ ID NO: 404181 - DNA, 140 bp, Artificial Sequence
  Synthetic
aggccctggctgctgatatgggcaacgaccccttgttacagtaaaaataggaggacagttaaaagaagctctattagatacaggagcagatgatacagtattagaagatataaatttgccgaccttttgggacagcggtg

SEQ ID NO: 404182 - DNA, 140 bp, Artificial Sequence
  Synthetic
caccgctgtcccaaaaggtcggcaaatttatatcttctaatactgtatcatctgctcctgtatctaatagagcttcttttaactgtcctcctatttttactgtaacaaggggtcgttgcccatatcagcagccagggcct

SEQ ID NO: 404183 - DNA, 140 bp, Artificial Sequence
  Synthetic
aggccctggctgctgatatgcttaggcatttcctatggcaggaagaagcggagacgacgaagcgcttctcaaagcagtgaggatcatcaaaatcctatatcaaagcagtaagtatctgtagaccttttgggacagcggtg

SEQ ID NO: 404184 - DNA, 140 bp, Artificial Sequence
  Synthetic
caccgctgtcccaaaaggtctacagatacttactgctttgatataggattttgatgatcctcactgctttgagaagcgcttcgtcgtctccgcttcttcctgccataggaaatgcctaagcatatcagcagccagggcct

SEQ ID NO: 404185 - DNA, 140 bp, Artificial Sequence
  Synthetic
atacgccatgctgggtctccaaatgttaccaagaatgataatgataccctcaataataacatgaaggaagagataaaaaattgttcttttaatataaccacagaactaagagataagaaacgtacttgggagtcggccat

SEQ ID NO: 404186 - DNA, 140 bp, Artificial Sequence
  Synthetic
atggccgactcccaagtacgtttcttatctcttagttctgtggttatattaaaagaacaattttttatctcttccttcatgttattattgagggtatcattatcattcttggtaacatttggagacccagcatggcgtat

SEQ ID NO: 404187 - DNA, 140 bp, Artificial Sequence
  Synthetic
aggccctggctgctgatatggaggaggagatatgagagacaattggagaagtgaattatataagtataaagtagtacaaattgaaccaataggtgtggcacccacccatgcaaaaagaaggaccttttgggacagcggtg

SEQ ID NO: 404188 - DNA, 140 bp, Artificial Sequence
  Synthetic
caccgctgtcccaaaaggtccttctttttgcatgggtgggtgccacacctattggttcaatttgtactactttatacttatataattcacttctccaattgtctctcatatctcctcctccatatcagcagccagggcct

SEQ ID NO: 404189 - DNA, 140 bp, Artificial Sequence
  Synthetic
aggccctggctgctgatatggtagtacaaattgaaccaataggtgtggcacccacccatgcaaaaagaagagtggtggagagagaaaaaagagcagttggactgggagctgtcttccttggaccttttgggacagcggtg

SEQ ID NO: 404190 - DNA, 140 bp, Artificial Sequence
  Synthetic
caccgctgtcccaaaaggtccaaggaagacagctcccagtccaactgctcttttttctctctccaccactcttctttttgcatgggtgggtgccacacctattggttcaatttgtactaccatatcagcagccagggcct

SEQ ID NO: 404191 - DNA, 140 bp, Artificial Sequence
  Synthetic
aggccctggctgctgatatgtatgggaccagggagtgcaatttatgcaacaggagcaataataggagatataagacaagcacattgtaacataagtagggaaaaatggaataacactctagaccttttgggacagcggtg

SEQ ID NO: 404192 - DNA, 140 bp, Artificial Sequence
  Synthetic
caccgctgtcccaaaaggtctagagtgttattccatttttccctacttatgttacaatgtgcttgtcttatatctcctattattgctcctgttgcataaattgcactccctggtcccatacatatcagcagccagggcct

SEQ ID NO: 404193 - DNA, 140 bp, Artificial Sequence
  Synthetic
atacgccatgctgggtctccctttaagcagccaccctcaggaggggatccagaaattacaactcacagctttaattgtggaggggaattcttctactgtaatacaacaccactgtttaatcgtacttgggagtcggccat

SEQ ID NO: 404194 - DNA, 140 bp, Artificial Sequence
  Synthetic
atggccgactcccaagtacgattaaacagtggtgttgtattacagtagaagaattcccctccacaattaaagctgtgagttgtaatttctggatcccctcctgagggtggctgcttaaagggagacccagcatggcgtat

SEQ ID NO: 404195 - DNA, 140 bp, Artificial Sequence
  Synthetic
atacgccatgctgggtctccaacactttcctaataaaacaataatattcgacaaatcttcaggaggggacctagagattacaacacatagctttaattgtggaggagaatttttctattgcgtacttgggagtcggccat

SEQ ID NO: 404196 - DNA, 140 bp, Artificial Sequence
  Synthetic
atggccgactcccaagtacgcaatagaaaaattctcctccacaattaaagctatgtgttgtaatctctaggtcccctcctgaagatttgtcgaatattattgttttattaggaaagtgttggagacccagcatggcgtat

SEQ ID NO: 404197 - DNA, 140 bp, Artificial Sequence
  Synthetic
atacgccatgctgggtctccgtgtgatgcaggaaataaaaaattgctctttcaatgtaaccacagaattaagagataggaagcagaaagtgtatgcacttttttataaacttgatatagtcgtacttgggagtcggccat

SEQ ID NO: 404198 - DNA, 140 bp, Artificial Sequence
  Synthetic
atggccgactcccaagtacgactatatcaagtttataaaaaagtgcatacactttctgcttcctatctcttaattctgtggttacattgaaagagcaattttttatttcctgcatcacacggagacccagcatggcgtat

SEQ ID NO: 404199 - DNA, 140 bp, Artificial Sequence
  Synthetic
aggccctggctgctgatatgaataaatagagttaggcagggatactcacctttgtcattccagacccttacccaccaccagagggaacccgacaggcccgaaagaatcgaagaaggaggtgaccttttgggacagcggtg

SEQ ID NO: 404200 - DNA, 140 bp, Artificial Sequence
  Synthetic
caccgctgtcccaaaaggtcacctccttcttcgattctttcgggcctgtcgggttccctctggtggtgggtaagggtctggaatgacaaaggtgagtatccctgcctaactctatttattcatatcagcagccagggcct

SEQ ID NO: 404201 - DNA, 140 bp, Artificial Sequence
  Synthetic
aggccctggctgctgatatggaatcttctatcatactggggtcgggaactaaagaatagtgctattaatttgcttgatacaatagcaatagcagtagctaactggacagatagggttatagaccttttgggacagcggtg

SEQ ID NO: 404202 - DNA, 140 bp, Artificial Sequence
  Synthetic
caccgctgtcccaaaaggtctataaccctatctgtccagttagctactgctattgctattgtatcaagcaaattaatagcactattctttagttcccgaccccagtatgatagaagattccatatcagcagccagggcct

SEQ ID NO: 404203 - DNA, 140 bp, Artificial Sequence
  Synthetic
atacgccatgctgggtctccatgaagcaagcacaagcaacaatacaacagctactaatgctgcttgtgctggggcggaagcacaagaggaagaggaggtaggcttcccagtcgtgccacacgtacttgggagtcggccat

SEQ ID NO: 404204 - DNA, 140 bp, Artificial Sequence
  Synthetic
atggccgactcccaagtacgtgtggcacgactgggaagcctacctcctcttcctcttgtgcttccgccccagcacaagcagcattagtagctgttgtattgttgcttgtgcttgcttcatggagacccagcatggcgtat

SEQ ID NO: 404205 - DNA, 140 bp, Artificial Sequence
  Synthetic
aggccctggctgctgatatgggggcggaagcacaagaggaagaggaggtaggcttcccagtcgtgccacaagtacccctgagaccaatgacttataaggcagctatagatctcagccactgaccttttgggacagcggtg

SEQ ID NO: 404206 - DNA, 140 bp, Artificial Sequence
  Synthetic
caccgctgtcccaaaaggtcagtggctgagatctatagctgccttataagtcattggtctcaggggtacttgtggcacgactgggaagcctacctcctcttcctcttgtgcttccgcccccatatcagcagccagggcct

SEQ ID NO: 404207 - DNA, 140 bp, Artificial Sequence
  Synthetic
aggccctggctgctgatatgcacttaaccctggccttttagaaacagcagaaggatgtcaacaaataatagaacagttacaatcaactctcaagacaggatcagaagaacttaaatcattgaccttttgggacagcggtg

SEQ ID NO: 404208 - DNA, 140 bp, Artificial Sequence
  Synthetic
caccgctgtcccaaaaggtcaatgatttaagttcttctgatcctgtcttgagagttgattgtaactgttctattatttgttgacatccttctgctgtttctaaaaggccagggttaagtgcatatcagcagccagggcct

SEQ ID NO: 404209 - DNA, 140 bp, Artificial Sequence
  Synthetic
atacgccatgctgggtctccatacctagaaggataagacagggcttggaaaggcttttgctataaaatgggtggcaagtggtcaaaacctaagattggatggcctgctataagggacaggcgtacttgggagtcggccat

SEQ ID NO: 404210 - DNA, 140 bp, Artificial Sequence
  Synthetic
atggccgactcccaagtacgcctgtcccttatagcaggccatccaatcttaggttttgaccacttgccacccattttatagcaaaagcctttccaagccctgtcttatccttctaggtatggagacccagcatggcgtat

SEQ ID NO: 404211 - DNA, 140 bp, Artificial Sequence
  Synthetic
aggccctggctgctgatatggtggcaagtggtcaaaacctaagattggatggcctgctataagggacaggatgcatcgagctgagccagcagcagagggggtgggagcagtatctaaagagaccttttgggacagcggtg

SEQ ID NO: 404212 - DNA, 140 bp, Artificial Sequence
  Synthetic
caccgctgtcccaaaaggtctctttagatactgctcccaccccctctgctgctggctcagctcgatgcatcctgtcccttatagcaggccatccaatcttaggttttgaccacttgccaccatatcagcagccagggcct

SEQ ID NO: 404213 - DNA, 140 bp, Artificial Sequence
  Synthetic
atacgccatgctgggtctcccacaggatgcagccaaaattaccctatagtgcaaaatgcacaagggcaaatgacacaccagaatctgtcacctaggactttaaatgcatgggtgaaggtacgtacttgggagtcggccat

SEQ ID NO: 404214 - DNA, 140 bp, Artificial Sequence
  Synthetic
atggccgactcccaagtacgtaccttcacccatgcatttaaagtcctaggtgacagattctggtgtgtcatttgcccttgtgcattttgcactatagggtaattttggctgcatcctgtgggagacccagcatggcgtat

SEQ ID NO: 404215 - DNA, 140 bp, Artificial Sequence
  Synthetic
atacgccatgctgggtctccaaaaagctggcctgctgtaagagaaagaataagaagaactgagcccgctgtaagagtaaggagaactgagccagcagcagaaggagtaggggcagcatctcgtacttgggagtcggccat

SEQ ID NO: 404216 - DNA, 140 bp, Artificial Sequence
  Synthetic
atggccgactcccaagtacgagatgctgcccctactccttctgctgctggctcagttctccttactcttacagcgggctcagttcttcttattctttctcttacagcaggccagctttttggagacccagcatggcgtat

SEQ ID NO: 404217 - DNA, 140 bp, Artificial Sequence
  Synthetic
aggccctggctgctgatatgagaaagcgaaagtaaaaccagaggagatctctcgacgcaggactcggcttgctgaagcgcgcacagcaagaggcgaggggcggcgactggtgagtacgccgaccttttgggacagcggtg

SEQ ID NO: 404218 - DNA, 140 bp, Artificial Sequence
  Synthetic
caccgctgtcccaaaaggtcggcgtactcaccagtcgccgcccctcgcctcttgctgtgcgcgcttcagcaagccgagtcctgcgtcgagagatctcctctggttttactttcgctttctcatatcagcagccagggcct

SEQ ID NO: 404219 - DNA, 140 bp, Artificial Sequence
  Synthetic
aggccctggctgctgatatgaaagcaaagatcattagggattatggaaaacagatggcaggtgatgattgtgtggcaggtagacaggatgaggattagaacatggaatagtttagtaaaagaccttttgggacagcggtg

SEQ ID NO: 404220 - DNA, 140 bp, Artificial Sequence
  Synthetic
caccgctgtcccaaaaggtcttttactaaactattccatgttctaatcctcatcctgtctacctgccacacaatcatcacctgccatctgttttccataatccctaatgatctttgctttcatatcagcagccagggcct

SEQ ID NO: 404221 - DNA, 140 bp, Artificial Sequence
  Synthetic
atacgccatgctgggtctccaaggtaggatctctacaatacttggcactgacagcattgataaaaccaaaaaagataaagccacctctgcctagtgttaggaaattagtagaggatagatcgtacttgggagtcggccat

SEQ ID NO: 404222 - DNA, 140 bp, Artificial Sequence
  Synthetic
atggccgactcccaagtacgatctatcctctactaatttcctaacactaggcagaggtggctttatcttttttggttttatcaatgctgtcagtgccaagtattgtagagatcctaccttggagacccagcatggcgtat

SEQ ID NO: 404223 - DNA, 140 bp, Artificial Sequence
  Synthetic
  misc_feature (43)..(43): n is a, c, g, or t
  misc_feature (49)..(49): n is a, c, g, or t
  misc_feature (54)..(54): n is a, c, g, or t
  misc_feature (71)..(71): n is a, c, g, or t
  misc_feature (98)..(98): n is a, c, g, or t
  misc_feature (106)..(106): n is a, c, g, or t
atacgccatgctgggtctccaggcaatgagtcaagcaacacangcaggngtaangatgcagaaaagtaacnttaagggcccaagaagaaatgttaaangttttaantgtggcaaagaaggcgtacttgggagtcggccat

SEQ ID NO: 404224 - DNA, 140 bp, Artificial Sequence
  Synthetic
  misc_feature (35)..(35): n is a, c, g, or t
  misc_feature (43)..(43): n is a, c, g, or t
  misc_feature (70)..(70): n is a, c, g, or t
  misc_feature (87)..(87): n is a, c, g, or t
  misc_feature (92)..(92): n is a, c, g, or t
  misc_feature (98)..(98): n is a, c, g, or t
atggccgactcccaagtacgccttctttgccacanttaaaacntttaacatttcttcttgggcccttaangttacttttctgcatcnttacncctgcntgtgttgcttgactcattgcctggagacccagcatggcgtat

SEQ ID NO: 404225 - DNA, 140 bp, Artificial Sequence
  Synthetic
aggccctggctgctgatatgccatcagccccgccagcagagagcttcgggttcgggggggagataaccccttccccgaagcaggagcagaaagacgagggacgggagggactgtaccctcgaccttttgggacagcggtg

SEQ ID NO: 404226 - DNA, 140 bp, Artificial Sequence
  Synthetic
caccgctgtcccaaaaggtcgagggtacagtccctcccgtccctcgtctttctgctcctgcttcggggaaggggttatctcccccccgaacccgaagctctctgctggcggggctgatggcatatcagcagccagggcct

SEQ ID NO: 404227 - DNA, 140 bp, Artificial Sequence
  Synthetic
atacgccatgctgggtctccggcaacagtagcataggaaatgtaacagatgaagtaaaaaactgtacttttaacatgaccacagagataagagataagcagcagaaggtccgtgcattttcgtacttgggagtcggccat

SEQ ID NO: 404228 - DNA, 140 bp, Artificial Sequence
  Synthetic
atggccgactcccaagtacgaaaatgcacggaccttctgctgcttatctcttatctctgtggtcatgttaaaagtacagttttttacttcatctgttacatttcctatgctactgttgccggagacccagcatggcgtat

SEQ ID NO: 404229 - DNA, 140 bp, Artificial Sequence
  Synthetic
aggccctggctgctgatatgaatgtttcaactgtggcaaggaagggcacatagccagaaattgcagggcccctaggaaaaaaggctgttggaaatgtggaagggaaggacaccaaatgaagaccttttgggacagcggtg

SEQ ID NO: 404230 - DNA, 140 bp, Artificial Sequence
  Synthetic
caccgctgtcccaaaaggtcttcatttggtgtccttcccttccacatttccaacagccttttttcctaggggccctgcaatttctggctatgtgcccttccttgccacagttgaaacattcatatcagcagccagggcct

SEQ ID NO: 404231 - DNA, 140 bp, Artificial Sequence
  Synthetic
aggccctggctgctgatatggtaataatcaattgtaccagaccctccaccaatacaagaaaaagtacaagaataggaccaggtcaagtgttctatagaacaggagacataacaggagatagaccttttgggacagcggtg

SEQ ID NO: 404232 - DNA, 140 bp, Artificial Sequence
  Synthetic
caccgctgtcccaaaaggtctatctcctgttatgtctcctgttctatagaacacttgacctggtcctattcttgtactttttcttgtattggtggagggtctggtacaattgattattaccatatcagcagccagggcct

SEQ ID NO: 404233 - DNA, 140 bp, Artificial Sequence
  Synthetic
atacgccatgctgggtctccgataaagcaaattgtaaggatgtggcaggaagtaggacaagcaatgtataatcctcccatcagtggaaacattacttgtatatcaagtattacaggaatacgtacttgggagtcggccat

SEQ ID NO: 404234 - DNA, 140 bp, Artificial Sequence
  Synthetic
atggccgactcccaagtacgtattcctgtaatacttgatatacaagtaatgtttccactgatgggaggattatacattgcttgtcctacttcctgccacatccttacaatttgctttatcggagacccagcatggcgtat

SEQ ID NO: 404235 - DNA, 140 bp, Artificial Sequence
  Synthetic
atacgccatgctgggtctcccaaccgaagatgaaaaattgcaaaattgctctttcaatgtaaccacagtaataagagataagaaacacaaagagtatgcacttttttatagacctgatatcgtacttgggagtcggccat

SEQ ID NO: 404236 - DNA, 140 bp, Artificial Sequence
  Synthetic
atggccgactcccaagtacgatatcaggtctataaaaaagtgcatactctttgtgtttcttatctcttattactgtggttacattgaaagagcaattttgcaatttttcatcttcggttgggagacccagcatggcgtat

SEQ ID NO: 404237 - DNA, 140 bp, Artificial Sequence
  Synthetic
aggccctggctgctgatatgttttatgcaacaaatgacataataggagacataagacaagcacattgtaacattagtgaaaagaaatggtataaagctttacacggggtgagagaaaaatgaccttttgggacagcggtg

SEQ ID NO: 404238 - DNA, 140 bp, Artificial Sequence
  Synthetic
caccgctgtcccaaaaggtcatttttctctcaccccgtgtaaagctttataccatttcttttcactaatgttacaatgtgcttgtcttatgtctcctattatgtcatttgttgcataaaacatatcagcagccagggcct

SEQ ID NO: 404239 - DNA, 140 bp, Artificial Sequence
  Synthetic
atacgccatgctgggtctccgcaggaggggacctagaagttacaacacatagctttaactgtaaaggagagtttttctattgcaatacatcaaagctgtttaatacatcatggctggattcgtacttgggagtcggccat

SEQ ID NO: 404240 - DNA, 140 bp, Artificial Sequence
  Synthetic
atggccgactcccaagtacgaatccagccatgatgtattaaacagctttgatgtattgcaatagaaaaactctcctttacagttaaagctatgtgttgtaacttctaggtcccctcctgcggagacccagcatggcgtat

SEQ ID NO: 404241 - DNA, 140 bp, Artificial Sequence
  Synthetic
aggccctggctgctgatatgaaagagcttggagagctcttctccacatacctagaagaatcagacagggctttgaaagggctttgctataaatgggaggcaagtggtcgaagagtagcaagaccttttgggacagcggtg

SEQ ID NO: 404242 - DNA, 140 bp, Artificial Sequence
  Synthetic
caccgctgtcccaaaaggtcttgctactcttcgaccacttgcctcccatttatagcaaagccctttcaaagccctgtctgattcttctaggtatgtggagaagagctctccaagctctttcatatcagcagccagggcct

SEQ ID NO: 404243 - DNA, 140 bp, Artificial Sequence
  Synthetic
aggccctggctgctgatatgagtattggggtctggaactaaaaaagagtgctattagtctgcttgataccatagcaatagcagtagctgagggaacagataggattatagaattcatacagaccttttgggacagcggtg

SEQ ID NO: 404244 - DNA, 140 bp, Artificial Sequence
  Synthetic
caccgctgtcccaaaaggtctgtatgaattctataatcctatctgttccctcagctactgctattgctatggtatcaagcagactaatagcactcttttttagttccagaccccaatactcatatcagcagccagggcct

SEQ ID NO: 404245 - DNA, 140 bp, Artificial Sequence
  Synthetic
atacgccatgctgggtctcctcaaagcagtaagttctaaataatatatgtaatgttagatttaatagcaagagtagattatagaataggagtaggagcattggcaatagcagtactcttacgtacttgggagtcggccat

SEQ ID NO: 404246 - DNA, 140 bp, Artificial Sequence
  Synthetic
atggccgactcccaagtacgtaagagtactgctattgccaatgctcctactcctattctataatctactcttgctattaaatctaacattacatatattatttagaacttactgctttgaggagacccagcatggcgtat

SEQ ID NO: 404247 - DNA, 140 bp, Artificial Sequence
  Synthetic
atacgccatgctgggtctcctaaaaaactgcactttcaatacgaccacagaaagaatagataaaaaagagaaagcatatgcacttttttataaacttgatataaaagaacttgagggaagcgtacttgggagtcggccat

SEQ ID NO: 404248 - DNA, 140 bp, Artificial Sequence
  Synthetic
atggccgactcccaagtacgcttccctcaagttcttttatatcaagtttataaaaaagtgcatatgctttctcttttttatctattctttctgtggtcgtattgaaagtgcagttttttaggagacccagcatggcgtat

SEQ ID NO: 404249 - DNA, 140 bp, Artificial Sequence
  Synthetic
aggccctggctgctgatatggaagaagtaggctttccagtcagacctcaggtgcctttaagaccaatgacttataagggagcatttgatctcggcttctttttaaaagaaaaggggggacgaccttttgggacagcggtg

SEQ ID NO: 404250 - DNA, 140 bp, Artificial Sequence
  Synthetic
caccgctgtcccaaaaggtcgtccccccttttcttttaaaaagaagccgagatcaaatgctcccttataagtcattggtcttaaaggcacctgaggtctgactggaaagcctacttcttccatatcagcagccagggcct

SEQ ID NO: 404251 - DNA, 140 bp, Artificial Sequence
  Synthetic
atacgccatgctgggtctccgacctggcaatcctataagaaaaagggtaggtataggaccaggacaagcattccatgcaacaggtaatataataggagacataagacgagcacagtgtaacgtacttgggagtcggccat

SEQ ID NO: 404252 - DNA, 140 bp, Artificial Sequence
  Synthetic
atggccgactcccaagtacgttacactgtgctcgtcttatgtctcctattatattacctgttgcatggaatgcttgtcctggtcctatacctaccctttttcttataggattgccaggtcggagacccagcatggcgtat

SEQ ID NO: 404253 - DNA, 140 bp, Artificial Sequence
  Synthetic
aggccctggctgctgatatgttccatgcaacaggtaatataataggagacataagacgagcacagtgtaatgtcagtggaacagaatggaaggaagctttacaaaaggtaactgaacaatgaccttttgggacagcggtg

SEQ ID NO: 404254 - DNA, 140 bp, Artificial Sequence
  Synthetic
caccgctgtcccaaaaggtcattgttcagttaccttttgtaaagcttccttccattctgttccactgacattacactgtgctcgtcttatgtctcctattatattacctgttgcatggaacatatcagcagccagggcct

SEQ ID NO: 404255 - DNA, 140 bp, Artificial Sequence
  Synthetic
atacgccatgctgggtctccgaagaaatgaaaaattgttcttttaatgcaaccacagagctaagagataagaaacagaaaaaatatgcgcttttttataaagttgatatagtaccacttacgtacttgggagtcggccat

SEQ ID NO: 404256 - DNA, 140 bp, Artificial Sequence
  Synthetic
atggccgactcccaagtacgtaagtggtactatatcaactttataaaaaagcgcatattttttctgtttcttatctcttagctctgtggttgcattaaaagaacaatttttcatttcttcggagacccagcatggcgtat

SEQ ID NO: 404257 - DNA, 140 bp, Artificial Sequence
  Synthetic
atacgccatgctgggtctccaaatgaaaaactgctctttcaatgtcaccacaagcaaaagaaataagatgaataaagaatatgcacttttttataaacttgatgtaaaacaaacagaagacgtacttgggagtcggccat

SEQ ID NO: 404258 - DNA, 140 bp, Artificial Sequence
  Synthetic
atggccgactcccaagtacgtcttctgtttgttttacatcaagtttataaaaaagtgcatattctttattcatcttatttcttttgcttgtggtgacattgaaagagcagtttttcatttggagacccagcatggcgtat

SEQ ID NO: 404259 - DNA, 140 bp, Artificial Sequence
  Synthetic
atacgccatgctgggtctccgagggtaggacaagcaatgtatgcccctcccatcccaggagaaattaagtgtaaatcaaacattacaggaatactattgacaagagatggagggacaaaacgtacttgggagtcggccat

SEQ ID NO: 404260 - DNA, 140 bp, Artificial Sequence
  Synthetic
atggccgactcccaagtacgttttgtccctccatctcttgtcaatagtattcctgtaatgtttgatttacacttaatttctcctgggatgggaggggcatacattgcttgtcctaccctcggagacccagcatggcgtat

SEQ ID NO: 404261 - DNA, 140 bp, Artificial Sequence
  Synthetic
atacgccatgctgggtctccataccaggaaaagtatacatctaggatgggggagaacattgtatgcaacaggagatataataggagacccaagacaagcacattgtaaccttagtagagccgtacttgggagtcggccat

SEQ ID NO: 404262 - DNA, 140 bp, Artificial Sequence
  Synthetic
atggccgactcccaagtacggctctactaaggttacaatgtgcttgtcttgggtctcctattatatctcctgttgcatacaatgttctcccccatcctagatgtatacttttcctggtatggagacccagcatggcgtat

SEQ ID NO: 404263 - DNA, 140 bp, Artificial Sequence
  Synthetic
atacgccatgctgggtctcctacactactacaaatggtagcgacattcagccctacaatagtagtgagggtaaggaaataaaaaattgctctttcaatgcaaccacagaattaaaaaacacgtacttgggagtcggccat

SEQ ID NO: 404264 - DNA, 140 bp, Artificial Sequence
  Synthetic
atggccgactcccaagtacgtgttttttaattctgtggttgcattgaaagagcaattttttatttccttaccctcactactattgtagggctgaatgtcgctaccatttgtagtagtgtaggagacccagcatggcgtat

SEQ ID NO: 404265 - DNA, 140 bp, Artificial Sequence
  Synthetic
aggccctggctgctgatatgaggatcaacagctcctaggaatttggggctgctctggaaaactcatctgcaccactaatgtgccctggaactctagttggagtaataaaacttatgataagaccttttgggacagcggtg

SEQ ID NO: 404266 - DNA, 140 bp, Artificial Sequence
  Synthetic
caccgctgtcccaaaaggtcttatcataagttttattactccaactagagttccagggcacattagtggtgcagatgagttttccagagcagccccaaattcctaggagctgttgatcctcatatcagcagccagggcct

SEQ ID NO: 404267 - DNA, 140 bp, Artificial Sequence
  Synthetic
aggccctggctgctgatatgggaggagatatgagggacaattggagaagtgaattatataaatataaagtagtaaaaattgagccattaggagtagcacccaccaaggcaaagagaagaggaccttttgggacagcggtg

SEQ ID NO: 404268 - DNA, 140 bp, Artificial Sequence
  Synthetic
caccgctgtcccaaaaggtcctcttctctttgccttggtgggtgctactcctaatggctcaatttttactactttatatttatataattcacttctccaattgtccctcatatctcctcccatatcagcagccagggcct

SEQ ID NO: 404269 - DNA, 140 bp, Artificial Sequence
  Synthetic
atacgccatgctgggtctccgggacctagaaatcacaatgcatagctttaattgtagaggagaattcttctattgtaacacatcaggcctgtttaatagtacatacatacttaatggtaccgtacttgggagtcggccat

SEQ ID NO: 404270 - DNA, 140 bp, Artificial Sequence
  Synthetic
atggccgactcccaagtacggtaccattaagtatgtatgtactattaaacaggcctgatgtgttacaatagaagaattctcctctacaattaaagctatgcattgtgatttctaggtcccggagacccagcatggcgtat

SEQ ID NO: 404271 - DNA, 140 bp, Artificial Sequence
  Synthetic
atacgccatgctgggtctccagaatgagacaaaaccctccagcagcagcagaaggagtaggagcagcatctcaagatttagctaaacatggagcaatcacaagcagtaacacagcagaaacgtacttgggagtcggccat

SEQ ID NO: 404272 - DNA, 140 bp, Artificial Sequence
  Synthetic
atggccgactcccaagtacgtttctgctgtgttactgcttgtgattgctccatgtttagctaaatcttgagatgctgctcctactccttctgctgctgctggagggttttgtctcattctggagacccagcatggcgtat

SEQ ID NO: 404273 - DNA, 140 bp, Artificial Sequence
  Synthetic
aggccctggctgctgatatggaggaggtaggctttccagtcaggccgcaagtacccttgagaccaatgacttataagggagcttttgatctcagccactttttaaaagaaaaggggggacgaccttttgggacagcggtg

SEQ ID NO: 404274 - DNA, 140 bp, Artificial Sequence
  Synthetic
caccgctgtcccaaaaggtcgtccccccttttcttttaaaaagtggctgagatcaaaagctcccttataagtcattggtctcaagggtacttgcggcctgactggaaagcctacctcctccatatcagcagccagggcct

SEQ ID NO: 404275 - DNA, 140 bp, Artificial Sequence
  Synthetic
aggccctggctgctgatatgaccagctcttcagacaggaacagaggaacttagatcattatataacacagtagcaactctctattgtgtacatagaaagatagaggtacgagacaccaaggaccttttgggacagcggtg

SEQ ID NO: 404276 - DNA, 140 bp, Artificial Sequence
  Synthetic
caccgctgtcccaaaaggtccttggtgtctcgtacctctatctttctatgtacacaatagagagttgctactgtgttatataatgatctaagttcctctgttcctgtctgaagagctggtcatatcagcagccagggcct

SEQ ID NO: 404277 - DNA, 140 bp, Artificial Sequence
  Synthetic
atacgccatgctgggtctccgtggcgcccgaacagggacttgaaaagcgaaagtagacccaaagaagttttttcaccccagaattcggtttgccaaacccccaacggcaaaaggcaagggcgtacttgggagtcggccat

SEQ ID NO: 404278 - DNA, 140 bp, Artificial Sequence
  Synthetic
atggccgactcccaagtacgcccttgccttttgccgttgggggtttggcaaaccgaattctggggtgaaaaaacttctttgggtctactttcgcttttcaagtccctgttcgggcgccacggagacccagcatggcgtat

SEQ ID NO: 404279 - DNA, 140 bp, Artificial Sequence
  Synthetic
aggccctggctgctgatatgtttcaccccagaattcggtttgccaaacccccaacggcaaaaggcaaggggcgccaactggtaattcccccaaatttttaataagggaaggttaaaaggagaccttttgggacagcggtg

SEQ ID NO: 404280 - DNA, 140 bp, Artificial Sequence
  Synthetic
caccgctgtcccaaaaggtctccttttaaccttcccttattaaaaatttgggggaattaccagttggcgccccttgccttttgccgttgggggtttggcaaaccgaattctggggtgaaacatatcagcagccagggcct

SEQ ID NO: 404281 - DNA, 140 bp, Artificial Sequence
  Synthetic
atacgccatgctgggtctcccagcagaaggagtaggagcagcgtctcaagacttagataaacatggagcacttacaagcagcaacacagacaccaataatgctgattgtgcttggctgagcgtacttgggagtcggccat

SEQ ID NO: 404282 - DNA, 140 bp, Artificial Sequence
  Synthetic
atggccgactcccaagtacgctcagccaagcacaatcagcattattggtgtctgtgttgctgcttgtaagtgctccatgtttatctaagtcttgagacgctgctcctactccttctgctgggagacccagcatggcgtat

SEQ ID NO: 404283 - DNA, 140 bp, Artificial Sequence
  Synthetic
aggccctggctgctgatatgcaagtgttactgtaaaaattgttgctggcattgccaactatgctttctgaaaaaaggcttaggcatctcctatggcaggaagaagcggaagcaccgacgagaccttttgggacagcggtg

SEQ ID NO: 404284 - DNA, 140 bp, Artificial Sequence
  Synthetic
caccgctgtcccaaaaggtctcgtcggtgcttccgcttcttcctgccataggagatgcctaagccttttttcagaaagcatagttggcaatgccagcaacaatttttacagtaacacttgcatatcagcagccagggcct

SEQ ID NO: 404285 - DNA, 140 bp, Artificial Sequence
  Synthetic
atacgccatgctgggtctccacaaccaatggcactaccccaaccagtacggtaaatataacaaatgaagtaaaaaactgttcttttaatgtgaccacagaaataagagataagaggcagacgtacttgggagtcggccat

SEQ ID NO: 404286 - DNA, 140 bp, Artificial Sequence
  Synthetic
atggccgactcccaagtacgtctgcctcttatctcttatttctgtggtcacattaaaagaacagttttttacttcatttgttatatttaccgtactggttggggtagtgccattggttgtggagacccagcatggcgtat

SEQ ID NO: 404287 - DNA, 140 bp, Artificial Sequence
  Synthetic
atacgccatgctgggtctccaagaacaagtataaacataggaccaggacaagtattctattatagaccaggagatgtaataggagatataagaaaagcatattgtgaggttaatagaacacgtacttgggagtcggccat

SEQ ID NO: 404288 - DNA, 140 bp, Artificial Sequence
  Synthetic
atggccgactcccaagtacgtgttctattaacctcacaatatgcttttcttatatctcctattacatctcctggtctataatagaatacttgtcctggtcctatgtttatacttgttcttggagacccagcatggcgtat

SEQ ID NO: 404289 - DNA, 140 bp, Artificial Sequence
  Synthetic
aggccctggctgctgatatgaaaaagaaacatgggaaacatggtggacagagtattggcaggctacctggattcctgaatgggagtttgtcaatacccctcctctagtaaaattatggtagaccttttgggacagcggtg

SEQ ID NO: 404290 - DNA, 140 bp, Artificial Sequence
  Synthetic
caccgctgtcccaaaaggtctaccataattttactagaggaggggtattgacaaactcccattcaggaatccaggtagcctgccaatactctgtccaccatgtttcccatgtttctttttcatatcagcagccagggcct

SEQ ID NO: 404291 - DNA, 140 bp, Artificial Sequence
  Synthetic
atacgccatgctgggtctccatcaataatgcaatggaagaaatgaaaaattgctctttcaatgcaaacacagagttaagagataagcggcacaaagcatatgcacttttttatcgccttgcgtacttgggagtcggccat

SEQ ID NO: 404292 - DNA, 140 bp, Artificial Sequence
  Synthetic
atggccgactcccaagtacgcaaggcgataaaaaagtgcatatgctttgtgccgcttatctcttaactctgtgtttgcattgaaagagcaatttttcatttcttccattgcattattgatggagacccagcatggcgtat

SEQ ID NO: 404293 - DNA, 140 bp, Artificial Sequence
  Synthetic
aggccctggctgctgatatgtaaacatgtggcaggaagtagggaaagcaatgtatgcccctcccattgaaggacaaattagatgttcatcaaatattacagggttactattaacaagagagaccttttgggacagcggtg

SEQ ID NO: 404294 - DNA, 140 bp, Artificial Sequence
  Synthetic
caccgctgtcccaaaaggtctctcttgttaatagtaaccctgtaatatttgatgaacatctaatttgtccttcaatgggaggggcatacattgctttccctacttcctgccacatgtttacatatcagcagccagggcct

SEQ ID NO: 404295 - DNA, 140 bp, Artificial Sequence
  Synthetic
aggccctggctgctgatatgctcaagaagaacatgaaaaatatcacagcaattggagagcaatggctagtgattttaatctgccacctatagtagcaaaagaaatagtagccagctgtgagaccttttgggacagcggtg

SEQ ID NO: 404296 - DNA, 140 bp, Artificial Sequence
  Synthetic
caccgctgtcccaaaaggtctcacagctggctactatttcttttgctactataggtggcagattaaaatcactagccattgctctccaattgctgtgatatttttcatgttcttcttgagcatatcagcagccagggcct

SEQ ID NO: 404297 - DNA, 140 bp, Artificial Sequence
  Synthetic
aggccctggctgctgatatgattgtgtgcacaagacccaacaataatacaaggaaaagtgtaaggataggaccaggacaagcattctatacaaatgacgtaataggagacataagaaaaggaccttttgggacagcggtg

SEQ ID NO: 404298 - DNA, 140 bp, Artificial Sequence
  Synthetic
caccgctgtcccaaaaggtccttttcttatgtctcctattacgtcatttgtatagaatgcttgtcctggtcctatccttacacttttccttgtattattgttgggtcttgtgcacacaatcatatcagcagccagggcct

SEQ ID NO: 404299 - DNA, 140 bp, Artificial Sequence
  Synthetic
aggccctggctgctgatatgaaacctgtggcaggaagtagggcgagcaatgtatgcccctcccattgaaggaaacataacatgtaactcaagtatcacaggactactattgacacgtgatgaccttttgggacagcggtg

SEQ ID NO: 404300 - DNA, 140 bp, Artificial Sequence
  Synthetic
caccgctgtcccaaaaggtcatcacgtgtcaatagtagtcctgtgatacttgagttacatgttatgtttccttcaatgggaggggcatacattgctcgccctacttcctgccacaggtttcatatcagcagccagggcct

SEQ ID NO: 404301 - DNA, 140 bp, Artificial Sequence
  Synthetic
aggccctggctgctgatatgtggttttatagacatcattatgaaagccgacatccaaaagtaagttcagaagtacacatcccattaggggaggctaaattagtaataagaacatattggggaccttttgggacagcggtg

SEQ ID NO: 404302 - DNA, 140 bp, Artificial Sequence
  Synthetic
caccgctgtcccaaaaggtccccaatatgttcttattactaatttagcctcccctaatgggatgtgtacttctgaacttacttttggatgtcggctttcataatgatgtctataaaaccacatatcagcagccagggcct

SEQ ID NO: 404303 - DNA, 140 bp, Artificial Sequence
  Synthetic
aggccctggctgctgatatgaatgaaaaggatttattagcattggacaagtggcaaaatctgtggagttggtttaacataacaaattggctatggtatataagaatattcataatgataggaccttttgggacagcggtg

SEQ ID NO: 404304 - DNA, 140 bp, Artificial Sequence
  Synthetic
caccgctgtcccaaaaggtcctatcattatgaatattcttatataccatagccaatttgttatgttaaaccaactccacagattttgccacttgtccaatgctaataaatccttttcattcatatcagcagccagggcct

SEQ ID NO: 404305 - DNA, 140 bp, Artificial Sequence
  Synthetic
aggccctggctgctgatatgcatggtagatcagatgcatgaagatataattagtctatgggaccaaagcctaaagccatgtgtaaagttaacccctctctgcgttactttaaattgttctgaccttttgggacagcggtg

SEQ ID NO: 404306 - DNA, 140 bp, Artificial Sequence
  Synthetic
caccgctgtcccaaaaggtcagaacaatttaaagtaacgcagagaggggttaactttacacatggctttaggctttggtcccatagactaattatatcttcatgcatctgatctaccatgcatatcagcagccagggcct

SEQ ID NO: 404307 - DNA, 140 bp, Artificial Sequence
  Synthetic
atacgccatgctgggtctccgtcaggggaaataaaaaactgctctttcaatatgaccacagaactaagagacaagaaacagaaggtgtatgcacttttttatagacatgatgtagtacaacgtacttgggagtcggccat

SEQ ID NO: 404308 - DNA, 140 bp, Artificial Sequence
  Synthetic
atggccgactcccaagtacgttgtactacatcatgtctataaaaaagtgcatacaccttctgtttcttgtctcttagttctgtggtcatattgaaagagcagttttttatttcccctgacggagacccagcatggcgtat

SEQ ID NO: 404309 - DNA, 140 bp, Artificial Sequence
  Synthetic
aggccctggctgctgatatgtgttaatgatctgtagtgctacagaacaattgtgggtcacagtctattatggggtgcctgtgtggaaagaagcatccaccaccctattttgtgcatcagagaccttttgggacagcggtg

SEQ ID NO: 404310 - DNA, 140 bp, Artificial Sequence
  Synthetic
caccgctgtcccaaaaggtctctgatgcacaaaatagggtggtggatgcttctttccacacaggcaccccataatagactgtgacccacaattgttctgtagcactacagatcattaacacatatcagcagccagggcct

SEQ ID NO: 404311 - DNA, 140 bp, Artificial Sequence
  Synthetic
aggccctggctgctgatatgcactctgtgttaccttaaagtgcactaatttgaatgccactaagttaaacattactactactaccaataatagtagttgggaggaggagttaggaatgacgaccttttgggacagcggtg

SEQ ID NO: 404312 - DNA, 140 bp, Artificial Sequence
  Synthetic
caccgctgtcccaaaaggtcgtcattcctaactcctcctcccaactactattattggtagtagtagtaatgtttaacttagtggcattcaaattagtgcactttaaggtaacacagagtgcatatcagcagccagggcct

SEQ ID NO: 404313 - DNA, 140 bp, Artificial Sequence
  Synthetic
atacgccatgctgggtctccaaaaatgctacaaacaatgtgagtgggccaattgaggctgggaaggaaatacaaaattgctctttcaacgcaaccacagaagtaagagataagaagaatacgtacttgggagtcggccat

SEQ ID NO: 404314 - DNA, 140 bp, Artificial Sequence
  Synthetic
atggccgactcccaagtacgtattcttcttatctcttacttctgtggttgcgttgaaagagcaattttgtatttccttcccagcctcaattggcccactcacattgtttgtagcatttttggagacccagcatggcgtat

SEQ ID NO: 404315 - DNA, 140 bp, Artificial Sequence
  Synthetic
atacgccatgctgggtctccgaccaccctcaggaggggatttagaaattacaacacatagttttaattgcggaggagaatttttctactgcaatacaacacaactgtttaatagcgcttgcgtacttgggagtcggccat

SEQ ID NO: 404316 - DNA, 140 bp, Artificial Sequence
  Synthetic
atggccgactcccaagtacgcaagcgctattaaacagttgtgttgtattgcagtagaaaaattctcctccgcaattaaaactatgtgttgtaatttctaaatcccctcctgagggtggtcggagacccagcatggcgtat

SEQ ID NO: 404317 - DNA, 140 bp, Artificial Sequence
  Synthetic
atacgccatgctgggtctcccaaatataactctcccatgcagcataaagcaaattgtgagaatgtggcagaaagtaggacaagcaatgtatgcccctcccatcccaggaataataaggtgcgtacttgggagtcggccat

SEQ ID NO: 404318 - DNA, 140 bp, Artificial Sequence
  Synthetic
atggccgactcccaagtacgcaccttattattcctgggatgggaggggcatacattgcttgtcctactttctgccacattctcacaatttgctttatgctgcatgggagagttatatttgggagacccagcatggcgtat

SEQ ID NO: 404319 - DNA, 140 bp, Artificial Sequence
  Synthetic
aggccctggctgctgatatgataaaatttgcaccatcctcaggaggggacctagaaattactacacatagctttaattgtagaggggaatttttctattgcaatacatcaggcctgtttagaccttttgggacagcggtg

SEQ ID NO: 404320 - DNA, 140 bp, Artificial Sequence
  Synthetic
caccgctgtcccaaaaggtctaaacaggcctgatgtattgcaatagaaaaattcccctctacaattaaagctatgtgtagtaatttctaggtcccctcctgaggatggtgcaaattttatcatatcagcagccagggcct

SEQ ID NO: 404321 - DNA, 140 bp, Artificial Sequence
  Synthetic
aggccctggctgctgatatgtggagaagtgaattatataagtataaagtagtaaaaattgaaccactaggtgtagcacccacccctgcaaaaagaagagtggtgcagagagaaaaaagaggaccttttgggacagcggtg

SEQ ID NO: 404322 - DNA, 140 bp, Artificial Sequence
  Synthetic
caccgctgtcccaaaaggtcctcttttttctctctgcaccactcttctttttgcaggggtgggtgctacacctagtggttcaatttttactactttatacttatataattcacttctccacatatcagcagccagggcct

SEQ ID NO: 404323 - DNA, 140 bp, Artificial Sequence
  Synthetic
atacgccatgctgggtctcctgcacacttttaattgtggaggggaatttttctactgtaatacaacacagctgtttaatagtacttggagggttaataataatactgggaatggtactaacgtacttgggagtcggccat

SEQ ID NO: 404324 - DNA, 140 bp, Artificial Sequence
  Synthetic
atggccgactcccaagtacgttagtaccattcccagtattattattaaccctccaagtactattaaacagctgtgttgtattacagtagaaaaattcccctccacaattaaaagtgtgcaggagacccagcatggcgtat

SEQ ID NO: 404325 - DNA, 140 bp, Artificial Sequence
  Synthetic
aggccctggctgctgatatgttatactcccatgcagaataaaacaaattataaacagatggcaggaagtaggaaaagcaatgtatgcccctcccatcagaggacagattaaatgttcatcgaccttttgggacagcggtg

SEQ ID NO: 404326 - DNA, 140 bp, Artificial Sequence
  Synthetic
caccgctgtcccaaaaggtcgatgaacatttaatctgtcctctgatgggaggggcatacattgcttttcctacttcctgccatctgtttataatttgttttattctgcatgggagtataacatatcagcagccagggcct

SEQ ID NO: 404327 - DNA, 140 bp, Artificial Sequence
  Synthetic
aggccctggctgctgatatgaatcgcaaagccagcaggaaagaaatgaaaaagatttactagcattggacagttggaacaatctgtggaattggtttagcataacaaaatggctgtggtagaccttttgggacagcggtg

SEQ ID NO: 404328 - DNA, 140 bp, Artificial Sequence
  Synthetic
caccgctgtcccaaaaggtctaccacagccattttgttatgctaaaccaattccacagattgttccaactgtccaatgctagtaaatctttttcatttctttcctgctggctttgcgattcatatcagcagccagggcct

SEQ ID NO: 404329 - DNA, 140 bp, Artificial Sequence
  Synthetic
atacgccatgctgggtctccaagacaaacccctccagcagcagaaggagtgggagcagtatctcaagatccagcagcagaaggagtgggagcagtatctcaagatttagatagacatggacgtacttgggagtcggccat

SEQ ID NO: 404330 - DNA, 140 bp, Artificial Sequence
  Synthetic
atggccgactcccaagtacgtccatgtctatctaaatcttgagatactgctcccactccttctgctgctggatcttgagatactgctcccactccttctgctgctggaggggtttgtcttggagacccagcatggcgtat

SEQ ID NO: 404331 - DNA, 140 bp, Artificial Sequence
  Synthetic
aggccctggctgctgatatgtggcaataatacaagaaaaagtataaggataggaccaggacaaacattctatacaaatgatgtaataggagacataggagaagcacattgtaatattactgaccttttgggacagcggtg

SEQ ID NO: 404332 - DNA, 140 bp, Artificial Sequence
  Synthetic
caccgctgtcccaaaaggtcagtaatattacaatgtgcttctcctatgtctcctattacatcatttgtatagaatgtttgtcctggtcctatccttatactttttcttgtattattgccacatatcagcagccagggcct

SEQ ID NO: 404333 - DNA, 140 bp, Artificial Sequence
  Synthetic
aggccctggctgctgatatgtaacttccctcaaatcactctttggcaacgaccccttgtctcaataaaaatagggggccagataaaggaggctctcttagatacaggagcagatgatacagaccttttgggacagcggtg

SEQ ID NO: 404334 - DNA, 140 bp, Artificial Sequence
  Synthetic
caccgctgtcccaaaaggtctgtatcatctgctcctgtatctaagagagcctcctttatctggccccctatttttattgagacaaggggtcgttgccaaagagtgatttgagggaagttacatatcagcagccagggcct

SEQ ID NO: 404335 - DNA, 140 bp, Artificial Sequence
  Synthetic
atacgccatgctgggtctcccagcagagagtttcgggttcggagaggagataaccccctccccgaagcaggagaagaaagacgaggggaagtaccctcccttagcttccctcaaatcactcgtacttgggagtcggccat

SEQ ID NO: 404336 - DNA, 140 bp, Artificial Sequence
  Synthetic
atggccgactcccaagtacgagtgatttgagggaagctaagggagggtacttcccctcgtctttcttctcctgcttcggggagggggttatctcctctccgaacccgaaactctctgctgggagacccagcatggcgtat

SEQ ID NO: 404337 - DNA, 140 bp, Artificial Sequence
  Synthetic
aggccctggctgctgatatgcaccttagtgaatctgtagaaatcaactgtaccagaccctccaacaatacaagaacaagtgtaaatataggaccaggacaagtattattctatagatcaggaccttttgggacagcggtg

SEQ ID NO: 404338 - DNA, 140 bp, Artificial Sequence
  Synthetic
caccgctgtcccaaaaggtcctgatctatagaataatacttgtcctggtcctatatttacacttgttcttgtattgttggagggtctggtacagttgatttctacagattcactaaggtgcatatcagcagccagggcct

SEQ ID NO: 404339 - DNA, 140 bp, Artificial Sequence
  Synthetic
atacgccatgctgggtctccaaaaagtaatactatcaacaatgttactagggagatgaaaaattgctctttcaatgcaaccacagaattaagagataagaagaaaaaacagtatgcacttcgtacttgggagtcggccat

SEQ ID NO: 404340 - DNA, 140 bp, Artificial Sequence
  Synthetic
atggccgactcccaagtacgaagtgcatactgttttttcttcttatctcttaattctgtggttgcattgaaagagcaatttttcatctccctagtaacattgttgatagtattactttttggagacccagcatggcgtat

SEQ ID NO: 404341 - DNA, 140 bp, Artificial Sequence
  Synthetic
aggccctggctgctgatatgataatacaagaaaaagtataaggataggaccaggacaagcattctatgcaacaggtgacataataggagacataagacaagcacattgtaacattagtgagaccttttgggacagcggtg

SEQ ID NO: 404342 - DNA, 140 bp, Artificial Sequence
  Synthetic
caccgctgtcccaaaaggtctcactaatgttacaatgtgcttgtcttatgtctcctattatgtcacctgttgcatagaatgcttgtcctggtcctatccttatactttttcttgtattatcatatcagcagccagggcct

SEQ ID NO: 404343 - DNA, 140 bp, Artificial Sequence
  Synthetic
aggccctggctgctgatatgcagacatacaaactaaagaattacaaaaacaaattataaaaattcaaaattttcgggtttattacagagacagcagagaccctatttggaaaggaccagcgaccttttgggacagcggtg

SEQ ID NO: 404344 - DNA, 140 bp, Artificial Sequence
  Synthetic
caccgctgtcccaaaaggtcgctggtcctttccaaatagggtctctgctgtctctgtaataaacccgaaaattttgaatttttataatttgtttttgtaattctttagtttgtatgtctgcatatcagcagccagggcct

SEQ ID NO: 404345 - DNA, 140 bp, Artificial Sequence
  Synthetic
aggccctggctgctgatatgacttccctaataaaacaataagctttctaccatcctcaggaggggacctagaagttgcaacacatagctttaattgtagaggagaatttttctattgcaagaccttttgggacagcggtg

SEQ ID NO: 404346 - DNA, 140 bp, Artificial Sequence
  Synthetic
caccgctgtcccaaaaggtcttgcaatagaaaaattctcctctacaattaaagctatgtgttgcaacttctaggtcccctcctgaggatggtagaaagcttattgttttattagggaagtcatatcagcagccagggcct

SEQ ID NO: 404347 - DNA, 140 bp, Artificial Sequence
  Synthetic
atacgccatgctgggtctccaaagtaattcaaccatcacacttccatgcagaataaaacaaattataaacatgtggcaggaggtaggacgagcaatgtatgcccctcccattgaaggaaacgtacttgggagtcggccat

SEQ ID NO: 404348 - DNA, 140 bp, Artificial Sequence
  Synthetic
atggccgactcccaagtacgtttccttcaatgggaggggcatacattgctcgtcctacctcctgccacatgtttataatttgttttattctgcatggaagtgtgatggttgaattactttggagacccagcatggcgtat

SEQ ID NO: 404349 - DNA, 140 bp, Artificial Sequence
  Synthetic
atacgccatgctgggtctcctagacctgatgtattaccaattgataagaataaaattaataataagacttatagtggtgaatataggctaataaattgtaatgtcgcttctattaaagagcgtacttgggagtcggccat

SEQ ID NO: 404350 - DNA, 140 bp, Artificial Sequence
  Synthetic
atggccgactcccaagtacgctctttaatagaagcgacattacaatttattagcctatattcaccactataagtcttattattaattttattcttatcaattggtaatacatcaggtctaggagacccagcatggcgtat

SEQ ID NO: 404351 - DNA, 140 bp, Artificial Sequence
  Synthetic
aggccctggctgctgatatggacaattggagaagtgaattatataaatacaaagtggtagaaattaagccattgggactagcacccactggagcaaaaaggagagtggtggagagagaaagaccttttgggacagcggtg

SEQ ID NO: 404352 - DNA, 140 bp, Artificial Sequence
  Synthetic
caccgctgtcccaaaaggtctttctctctccaccactctcctttttgctccagtgggtgctagtcccaatggcttaatttctaccactttgtatttatataattcacttctccaattgtccatatcagcagccagggcct

SEQ ID NO: 404353 - DNA, 140 bp, Artificial Sequence
  Synthetic
atacgccatgctgggtctcctacatcagcctttatcgcctagaactttgaatgcatgggtgaaagtagtagaagaaaagggttttaacccagaagtaatacccatgttctcagcattatccgtacttgggagtcggccat

SEQ ID NO: 404354 - DNA, 140 bp, Artificial Sequence
  Synthetic
atggccgactcccaagtacggataatgctgagaacatgggtattacttctgggttaaaacccttttcttctactactttcacccatgcattcaaagttctaggcgataaaggctgatgtaggagacccagcatggcgtat

SEQ ID NO: 404355 - DNA, 140 bp, Artificial Sequence
  Synthetic
aggccctggctgctgatatgcacaggaaacagcagccaggtcagccaaaactaccctatagtgcagaacctacaggggcaaatggtacatcagcccatatcacctagaactttaaatgcagaccttttgggacagcggtg

SEQ ID NO: 404356 - DNA, 140 bp, Artificial Sequence
  Synthetic
caccgctgtcccaaaaggtctgcatttaaagttctaggtgatatgggctgatgtaccatttgcccctgtaggttctgcactatagggtagttttggctgacctggctgctgtttcctgtgcatatcagcagccagggcct

SEQ ID NO: 404357 - DNA, 140 bp, Artificial Sequence
  Synthetic
atacgccatgctgggtctcctaaagaaagaaatgagacaatgctctttcaatgtaaccacagtagtaagagataagaaaaggaaagaaaatgcacttttttataaacttgatatagtacccgtacttgggagtcggccat

SEQ ID NO: 404358 - DNA, 140 bp, Artificial Sequence
  Synthetic
atggccgactcccaagtacgggtactatatcaagtttataaaaaagtgcattttctttccttttcttatctcttactactgtggttacattgaaagagcattgtctcatttctttctttaggagacccagcatggcgtat

SEQ ID NO: 404359 - DNA, 140 bp, Artificial Sequence
  Synthetic
atacgccatgctgggtctccaacctatctaaaataagggacaacatgtacgaggaaataaaaaactgctctttcaatacgaccacagtactaagagataagacacggaaagagtatgcaccgtacttgggagtcggccat

SEQ ID NO: 404360 - DNA, 140 bp, Artificial Sequence
  Synthetic
atggccgactcccaagtacggtgcatactctttccgtgtcttatctcttagtactgtggtcgtattgaaagagcagttttttatttcctcgtacatgttgtcccttattttagataggttggagacccagcatggcgtat

SEQ ID NO: 404361 - DNA, 140 bp, Artificial Sequence
  Synthetic
atacgccatgctgggtctccgatctgaaaatttgacaaacaatgccaaaacaataatagtacaccttaatgaatctgtagaaataaattgtacaagacccaatcataataaaaggataagcgtacttgggagtcggccat

SEQ ID NO: 404362 - DNA, 140 bp, Artificial Sequence
  Synthetic
atggccgactcccaagtacgcttatccttttattatgattgggtcttgtacaatttatttctacagattcattaaggtgtactattattgttttggcattgtttgtcaaattttcagatcggagacccagcatggcgtat

SEQ ID NO: 404363 - DNA, 140 bp, Artificial Sequence
  Synthetic
aggccctggctgctgatatgtgtgtcactttaagatgtgaggatgttccgtttaataagagtgagacggaaataagaaattgctctttcaacgcaaccacagaaataagagataggaagcgaccttttgggacagcggtg

SEQ ID NO: 404364 - DNA, 140 bp, Artificial Sequence
  Synthetic
caccgctgtcccaaaaggtcgcttcctatctcttatttctgtggttgcgttgaaagagcaatttcttatttccgtctcactcttattaaacggaacatcctcacatcttaaagtgacacacatatcagcagccagggcct

SEQ ID NO: 404365 - DNA, 140 bp, Artificial Sequence
  Synthetic
aggccctggctgctgatatgtgtaacacctcagtcattacacaggcctgtccaaaggtatcctttgaaccaattcccatacattattgtaccccagctggttttgcgcttctaaagtgtagaccttttgggacagcggtg

SEQ ID NO: 404366 - DNA, 140 bp, Artificial Sequence
  Synthetic
caccgctgtcccaaaaggtctacactttagaagcgcaaaaccagctggggtacaataatgtatgggaattggttcaaaggatacctttggacaggcctgtgtaatgactgaggtgttacacatatcagcagccagggcct

SEQ ID NO: 404367 - DNA, 140 bp, Artificial Sequence
  Synthetic
aggccctggctgctgatatggacggaaaggtcagtcaaaattatcctatagtgcagaatctccaagggcaaatggtacaccaagccatatcacctagaactttgaatgcatgggtaaaaggaccttttgggacagcggtg

SEQ ID NO: 404368 - DNA, 140 bp, Artificial Sequence
  Synthetic
caccgctgtcccaaaaggtccttttacccatgcattcaaagttctaggtgatatggcttggtgtaccatttgcccttggagattctgcactataggataattttgactgacctttccgtccatatcagcagccagggcct

SEQ ID NO: 404369 - DNA, 140 bp, Artificial Sequence
  Synthetic
aggccctggctgctgatatgtgtacaagacccagcaacaataccagaaaaagtatacatctaggatgggggagagcattttatgctacaggagacataataggagatataagacaagcatgaccttttgggacagcggtg

SEQ ID NO: 404370 - DNA, 140 bp, Artificial Sequence
  Synthetic
caccgctgtcccaaaaggtcatgcttgtcttatatctcctattatgtctcctgtagcataaaatgctctcccccatcctagatgtatactttttctggtattgttgctgggtcttgtacacatatcagcagccagggcct

SEQ ID NO: 404371 - DNA, 140 bp, Artificial Sequence
  Synthetic
atacgccatgctgggtctcctgtggcagacagtaggacgagcaatgtatgcccctcccatcccaggaataatacagtgtaactcaaacattacaggattgctattaacaagagatggaggcgtacttgggagtcggccat

SEQ ID NO: 404372 - DNA, 140 bp, Artificial Sequence
  Synthetic
atggccgactcccaagtacgcctccatctcttgttaatagcaatcctgtaatgtttgagttacactgtattattcctgggatgggaggggcatacattgctcgtcctactgtctgccacaggagacccagcatggcgtat

SEQ ID NO: 404373 - DNA, 140 bp, Artificial Sequence
  Synthetic
aggccctggctgctgatatgctcaggaggggacccagaaattgtaatgcacagctttaattgtggaggggaatttttctactgtaacacaacacaactgtttaatagtacttggaataaggaccttttgggacagcggtg

SEQ ID NO: 404374 - DNA, 140 bp, Artificial Sequence
  Synthetic
caccgctgtcccaaaaggtccttattccaagtactattaaacagttgtgttgtgttacagtagaaaaattcccctccacaattaaagctgtgcattacaatttctgggtcccctcctgagcatatcagcagccagggcct

SEQ ID NO: 404375 - DNA, 140 bp, Artificial Sequence
  Synthetic
atacgccatgctgggtctccactcctgtgcagaataaaacaaattataaacaggtggcaagaagtaggaaaagcaatgtatgcccctcccatcagaggaccaattggctgtttatcaaaacgtacttgggagtcggccat

SEQ ID NO: 404376 - DNA, 140 bp, Artificial Sequence
  Synthetic
atggccgactcccaagtacgttttgataaacagccaattggtcctctgatgggaggggcatacattgcttttcctacttcttgccacctgtttataatttgttttattctgcacaggagtggagacccagcatggcgtat

SEQ ID NO: 404377 - DNA, 140 bp, Artificial Sequence
  Synthetic
aggccctggctgctgatatgccatttcagaatcgggtgccaccatagcaggataggcattataccacagagaagagggagaaatggagccagtagatcctaaaatagagccctggaatcagaccttttgggacagcggtg

SEQ ID NO: 404378 - DNA, 140 bp, Artificial Sequence
  Synthetic
caccgctgtcccaaaaggtctgattccagggctctattttaggatctactggctccatttctccctcttctctgtggtataatgcctatcctgctatggtggcacccgattctgaaatggcatatcagcagccagggcct

SEQ ID NO: 404379 - DNA, 140 bp, Artificial Sequence
  Synthetic
atacgccatgctgggtctcccatggggggcaaatggtcaaaaagcagtatagttggatggcctgaggtcagagaaagaataagacgaactaggccagcagcagagggagagaaaacagcacgtacttgggagtcggccat

SEQ ID NO: 404380 - DNA, 140 bp, Artificial Sequence
  Synthetic
atggccgactcccaagtacgtgctgttttctctccctctgctgctggcctagttcgtcttattctttctctgacctcaggccatccaactatactgctttttgaccatttgccccccatgggagacccagcatggcgtat

SEQ ID NO: 404381 - DNA, 140 bp, Artificial Sequence
  Synthetic
aggccctggctgctgatatggagaaagaataagacgaactaggccagcagcagagggagagaaaacagcagcagagggagtaggaacagcgtctcaagacctagataaacatggggcactgaccttttgggacagcggtg

SEQ ID NO: 404382 - DNA, 140 bp, Artificial Sequence
  Synthetic
caccgctgtcccaaaaggtcagtgccccatgtttatctaggtcttgagacgctgttcctactccctctgctgctgttttctctccctctgctgctggcctagttcgtcttattctttctccatatcagcagccagggcct

SEQ ID NO: 404383 - DNA, 140 bp, Artificial Sequence
  Synthetic
aggccctggctgctgatatgaatctcctgcagtattggagtcaggaactaaagaatagtgctgttagtttgcttaatgccacagctatagcagtagctgaggggacagatagagttataggaccttttgggacagcggtg

SEQ ID NO: 404384 - DNA, 140 bp, Artificial Sequence
  Synthetic
caccgctgtcccaaaaggtcctataactctatctgtcccctcagctactgctatagctgtggcattaagcaaactaacagcactattctttagttcctgactccaatactgcaggagattcatatcagcagccagggcct

SEQ ID NO: 404385 - DNA, 140 bp, Artificial Sequence
  Synthetic
aggccctggctgctgatatgaagtattacaaagaattggtagagctattctccacatacctacaagaataagacagggcttagaaagggctttgctataagatgggtggcaagtggtcaagaccttttgggacagcggtg

SEQ ID NO: 404386 - DNA, 140 bp, Artificial Sequence
  Synthetic
caccgctgtcccaaaaggtcttgaccacttgccacccatcttatagcaaagccctttctaagccctgtcttattcttgtaggtatgtggagaatagctctaccaattctttgtaatacttcatatcagcagccagggcct

SEQ ID NO: 404387 - DNA, 140 bp, Artificial Sequence
  Synthetic
aggccctggctgctgatatggctatccgcaacatacctacaagaataagacagggctttgaaatagctttgcaataaaatggggggcaagtggtcaaaaagtagcatagttggatggcctgaccttttgggacagcggtg

SEQ ID NO: 404388 - DNA, 140 bp, Artificial Sequence
  Synthetic
caccgctgtcccaaaaggtcaggccatccaactatgctactttttgaccacttgccccccattttattgcaaagctatttcaaagccctgtcttattcttgtaggtatgttgcggatagccatatcagcagccagggcct

SEQ ID NO: 404389 - DNA, 140 bp, Artificial Sequence
  Synthetic
aggccctggctgctgatatgtttaatacaatagcaaccctttggtgcgtacatcaaaggatagaaataaaagacaccaaggaagccttagataaaatagaggaagtacaaaataagagcagaccttttgggacagcggtg

SEQ ID NO: 404390 - DNA, 140 bp, Artificial Sequence
  Synthetic
caccgctgtcccaaaaggtctgctcttattttgtacttcctctattttatctaaggcttccttggtgtcttttatttctatcctttgatgtacgcaccaaagggttgctattgtattaaacatatcagcagccagggcct

SEQ ID NO: 404391 - DNA, 140 bp, Artificial Sequence
  Synthetic
aggccctggctgctgatatgaatggatgacaagcaacccacctgtcccagtgggagaaatctataaaagatggatcatcctaggattaaataaaatagtaagaatgtatagccctgtcaggaccttttgggacagcggtg

SEQ ID NO: 404392 - DNA, 140 bp, Artificial Sequence
  Synthetic
caccgctgtcccaaaaggtcctgacagggctatacattcttactattttatttaatcctaggatgatccatcttttatagatttctcccactgggacaggtgggttgcttgtcatccattcatatcagcagccagggcct

SEQ ID NO: 404393 - DNA, 140 bp, Artificial Sequence
  Synthetic
atacgccatgctgggtctccttaagagctgaacaagctacacaagatgtaaaaaattggatgacagacaccttgttagtccaaaatgcaaacccagattgtaagaccattttaagagcatcgtacttgggagtcggccat

SEQ ID NO: 404394 - DNA, 140 bp, Artificial Sequence
  Synthetic
atggccgactcccaagtacgatgctcttaaaatggtcttacaatctgggtttgcattttggactaacaaggtgtctgtcatccaattttttacatcttgtgtagcttgttcagctcttaaggagacccagcatggcgtat

SEQ ID NO: 404395 - DNA, 140 bp, Artificial Sequence
  Synthetic
aggccctggctgctgatatggcggaagcaccggcgaagaactcctcagagcagggaggaccatcaaaatcctactccagagcagggagtaataaacaaaagtaatgtttccttttcaaatgaccttttgggacagcggtg

SEQ ID NO: 404396 - DNA, 140 bp, Artificial Sequence
  Synthetic
caccgctgtcccaaaaggtcatttgaaaaggaaacattacttttgtttattactccctgctctggagtaggattttgatggtcctccctgctctgaggagttcttcgccggtgcttccgccatatcagcagccagggcct

SEQ ID NO: 404397 - DNA, 140 bp, Artificial Sequence
  Synthetic
aggccctggctgctgatatgtactgagagacaggctaattttttagggaaaatttggccttcccacaaggggaggccagggaatttccttcagagcagaccagagccaacagccccaccagaccttttgggacagcggtg

SEQ ID NO: 404398 - DNA, 140 bp, Artificial Sequence
  Synthetic
caccgctgtcccaaaaggtctggtggggctgttggctctggtctgctctgaaggaaattccctggcctccccttgtgggaaggccaaattttccctaaaaaattagcctgtctctcagtacatatcagcagccagggcct

SEQ ID NO: 404399 - DNA, 140 bp, Artificial Sequence
  Synthetic
aggccctggctgctgatatgtcaaatcactctttggcaacgaccccttgtcacaataaaagtagggggccagataaaagaggctctcttagacacaggagcagatgatacagtattagaagaccttttgggacagcggtg

SEQ ID NO: 404400 - DNA, 140 bp, Artificial Sequence
  Synthetic
caccgctgtcccaaaaggtcttctaatactgtatcatctgctcctgtgtctaagagagcctcttttatctggccccctacttttattgtgacaaggggtcgttgccaaagagtgatttgacatatcagcagccagggcct

SEQ ID NO: 404401 - DNA, 140 bp, Artificial Sequence
  Synthetic
atacgccatgctgggtctcccccgacaggcccgaaggaatcgaagaaggaggtggagagcaaggcaaagacagatccgtgagattagtgaacggattcttgactcttgtctgggacgacccgtacttgggagtcggccat

SEQ ID NO: 404402 - DNA, 140 bp, Artificial Sequence
  Synthetic
atggccgactcccaagtacgggtcgtcccagacaagagtcaagaatccgttcactaatctcacggatctgtctttgccttgctctccacctccttcttcgattccttcgggcctgtcgggggagacccagcatggcgtat

SEQ ID NO: 404403 - DNA, 140 bp, Artificial Sequence
  Synthetic
aggccctggctgctgatatgtgtaaacgctgtagctaccactgtctagtttgctttcagacaaaaggcttaggcatttcctatggcaggaagaagcggagacagcgacgcagcgctcctcgaccttttgggacagcggtg

SEQ ID NO: 404404 - DNA, 140 bp, Artificial Sequence
  Synthetic
caccgctgtcccaaaaggtcgaggagcgctgcgtcgctgtctccgcttcttcctgccataggaaatgcctaagccttttgtctgaaagcaaactagacagtggtagctacagcgtttacacatatcagcagccagggcct

SEQ ID NO: 404405 - DNA, 140 bp, Artificial Sequence
  Synthetic
aggccctggctgctgatatgcaggacaaacattctatgcaacaggagagataataggagatataagagaagcatattgtcacattaataaaacaaaatggaatagaactttagaaatggtgaccttttgggacagcggtg

SEQ ID NO: 404406 - DNA, 140 bp, Artificial Sequence
  Synthetic
caccgctgtcccaaaaggtcaccatttctaaagttctattccattttgttttattaatgtgacaatatgcttctcttatatctcctattatctctcctgttgcatagaatgtttgtcctgcatatcagcagccagggcct

SEQ ID NO: 404407 - DNA, 140 bp, Artificial Sequence
  Synthetic
atacgccatgctgggtctccgaattatcaacaatggtggatatggggcatcttaggcttttggatgttaatgatttgtaatgtggtggggaacttgtgggtcacagtctattatggggtacgtacttgggagtcggccat

SEQ ID NO: 404408 - DNA, 140 bp, Artificial Sequence
  Synthetic
atggccgactcccaagtacgtaccccataatagactgtgacccacaagttccccaccacattacaaatcattaacatccaaaagcctaagatgccccatatccaccattgttgataattcggagacccagcatggcgtat

SEQ ID NO: 404409 - DNA, 140 bp, Artificial Sequence
  Synthetic
aggccctggctgctgatatgaggactttggggctgctctggaaaaatcatctgcaccactgctgtgccctggaactccacttggagtaataaatcttatgaagagatttgggacaacatggaccttttgggacagcggtg

SEQ ID NO: 404410 - DNA, 140 bp, Artificial Sequence
  Synthetic
caccgctgtcccaaaaggtccatgttgtcccaaatctcttcataagatttattactccaagtggagttccagggcacagcagtggtgcagatgatttttccagagcagccccaaagtcctcatatcagcagccagggcct

SEQ ID NO: 404411 - DNA, 140 bp, Artificial Sequence
  Synthetic
atacgccatgctgggtctccgtgttactttaagatgtagaaatgttaccagtaatggtaatactacccacaataataccatgtatgaagaaatgaggaattgctctttcaatgcaaccaccgtacttgggagtcggccat

SEQ ID NO: 404412 - DNA, 140 bp, Artificial Sequence
  Synthetic
atggccgactcccaagtacggtggttgcattgaaagagcaattcctcatttcttcatacatggtattattgtgggtagtattaccattactggtaacatttctacatcttaaagtaacacggagacccagcatggcgtat

SEQ ID NO: 404413 - DNA, 140 bp, Artificial Sequence
  Synthetic
aggccctggctgctgatatgggacccaacaataatacaagaaaaagtatgaggataggaccaggacaagtattctatgccacaaacggcataataggagacataagacaagcacattgtagaccttttgggacagcggtg

SEQ ID NO: 404414 - DNA, 140 bp, Artificial Sequence
  Synthetic
caccgctgtcccaaaaggtctacaatgtgcttgtcttatgtctcctattatgccgtttgtggcatagaatacttgtcctggtcctatcctcatactttttcttgtattattgttgggtcccatatcagcagccagggcct

SEQ ID NO: 404415 - DNA, 140 bp, Artificial Sequence
  Synthetic
atacgccatgctgggtctccttacaacgcatagttttaattgtaaaaaaaaatttttctactgcaatacatcacaattgtttaataaaacaagagtcaataaaacaaaatccaatggcaccgtacttgggagtcggccat

SEQ ID NO: 404416 - DNA, 140 bp, Artificial Sequence
  Synthetic
atggccgactcccaagtacggtgccattggattttgttttattgactcttgttttattaaacaattgtgatgtattgcagtagaaaaatttttttttacaattaaaactatgcgttgtaaggagacccagcatggcgtat

SEQ ID NO: 404417 - DNA, 140 bp, Artificial Sequence
  Synthetic
aggccctggctgctgatatgcattatgagagcagacatccaaaagtaagttcagaagtacacatcccattaggggatgctagattaataataaaaacatattggggtttgcaaacaggaggaccttttgggacagcggtg

SEQ ID NO: 404418 - DNA, 140 bp, Artificial Sequence
  Synthetic
caccgctgtcccaaaaggtcctcctgtttgcaaaccccaatatgtttttattattaatctagcatcccctaatgggatgtgtacttctgaacttacttttggatgtctgctctcataatgcatatcagcagccagggcct

SEQ ID NO: 404419 - DNA, 140 bp, Artificial Sequence
  Synthetic
aggccctggctgctgatatgaacggcttgtaacaagtgttattgtaaagcatgttgctggcattgtcaagtctgctttctgaacaaaggcttaggcatctcctatggcaggaagaagcgggaccttttgggacagcggtg

SEQ ID NO: 404420 - DNA, 140 bp, Artificial Sequence
  Synthetic
caccgctgtcccaaaaggtcccgcttcttcctgccataggagatgcctaagcctttgttcagaaagcagacttgacaatgccagcaacatgctttacaataacacttgttacaagccgttcatatcagcagccagggcct

SEQ ID NO: 404421 - DNA, 140 bp, Artificial Sequence
  Synthetic
aggccctggctgctgatatgtctgctttctgaacaaaggcttaggcatctcctatggcaggaagaagcggagacaacatcgaggaccttctcagaacaataaggatcatcagaatcctgtgaccttttgggacagcggtg

SEQ ID NO: 404422 - DNA, 140 bp, Artificial Sequence
  Synthetic
caccgctgtcccaaaaggtcacaggattctgatgatccttattgttctgagaaggtcctcgatgttgtctccgcttcttcctgccataggagatgcctaagcctttgttcagaaagcagacatatcagcagccagggcct

SEQ ID NO: 404423 - DNA, 140 bp, Artificial Sequence
  Synthetic
atacgccatgctgggtctccagaaattatccacccttatggaggtgggggattatattccttggaatgataataatttgtaaggctacaacaattttgtgggtcacggtctactatggggcgtacttgggagtcggccat

SEQ ID NO: 404424 - DNA, 140 bp, Artificial Sequence
  Synthetic
atggccgactcccaagtacgccccatagtagaccgtgacccacaaaattgttgtagccttacaaattattatcattccaaggaatataatcccccacctccataagggtggataatttctggagacccagcatggcgtat

SEQ ID NO: 404425 - DNA, 140 bp, Artificial Sequence
  Synthetic
aggccctggctgctgatatgattttaacatgtggaaaaataacatggtagagcagatgcatgaagatataattagtctatgggaccaaagcctacaaccatgtgtaaagttaacccctctgaccttttgggacagcggtg

SEQ ID NO: 404426 - DNA, 140 bp, Artificial Sequence
  Synthetic
caccgctgtcccaaaaggtcagaggggttaactttacacatggttgtaggctttggtcccatagactaattatatcttcatgcatctgctctaccatgttatttttccacatgttaaaatcatatcagcagccagggcct

SEQ ID NO: 404427 - DNA, 140 bp, Artificial Sequence
  Synthetic
aggccctggctgctgatatgctatggcaggaagaagcggagacagcgacgaagcgctcctccaagcagtgaggatcatcaaaatcctgtatcaaagcagtaagtaccacatagtagatgtgaccttttgggacagcggtg

SEQ ID NO: 404428 - DNA, 140 bp, Artificial Sequence
  Synthetic
caccgctgtcccaaaaggtcacatctactatgtggtacttactgctttgatacaggattttgatgatcctcactgcttggaggagcgcttcgtcgctgtctccgcttcttcctgccatagcatatcagcagccagggcct

SEQ ID NO: 404429 - DNA, 140 bp, Artificial Sequence
  Synthetic
atacgccatgctgggtctcctgctctttcaatatgactacagaattaagagataagaaacagaaaatgcatgcgcttttttatagacttgatatagtgccaattgagtcaagtaataatacgtacttgggagtcggccat

SEQ ID NO: 404430 - DNA, 140 bp, Artificial Sequence
  Synthetic
atggccgactcccaagtacgtattattacttgactcaattggcactatatcaagtctataaaaaagcgcatgcattttctgtttcttatctcttaattctgtagtcatattgaaagagcaggagacccagcatggcgtat

SEQ ID NO: 404431 - DNA, 140 bp, Artificial Sequence
  Synthetic
aggccctggctgctgatatgtgcgcttttttatagacttgatatagtgccaattgagtcaagtaataatagtcagttaagtaataatagtcaggtaagtaataatagtcagtcaagtaatgaccttttgggacagcggtg

SEQ ID NO: 404432 - DNA, 140 bp, Artificial Sequence
  Synthetic
caccgctgtcccaaaaggtcattacttgactgactattattacttacctgactattattacttaactgactattattacttgactcaattggcactatatcaagtctataaaaaagcgcacatatcagcagccagggcct

SEQ ID NO: 404433 - DNA, 140 bp, Artificial Sequence
  Synthetic
aggccctggctgctgatatgtgtgtggactatagtgcttatagaatatagaaaattattaagacaaagaaaaataaacaggatacttgacagaataagagatagagcagaagacagtggcgaccttttgggacagcggtg

SEQ ID NO: 404434 - DNA, 140 bp, Artificial Sequence
  Synthetic
caccgctgtcccaaaaggtcgccactgtcttctgctctatctcttattctgtcaagtatcctgtttatttttctttgtcttaataattttctatattctataagcactatagtccacacacatatcagcagccagggcct

SEQ ID NO: 404435 - DNA, 140 bp, Artificial Sequence
  Synthetic
atacgccatgctgggtctccactttaagatgtagagatgttaccaacaatgggagctacaatgggagcgcggaggaaataaaagattgtgctttcaatgtaaccacagtagtaagagatacgtacttgggagtcggccat

SEQ ID NO: 404436 - DNA, 140 bp, Artificial Sequence
  Synthetic
atggccgactcccaagtacgtatctcttactactgtggttacattgaaagcacaatcttttatttcctccgcgctcccattgtagctcccattgttggtaacatctctacatcttaaagtggagacccagcatggcgtat

SEQ ID NO: 404437 - DNA, 140 bp, Artificial Sequence
  Synthetic
atacgccatgctgggtctccgcacgatgctccttgggatgttaatgatctgtaatattgctgctgcagatcaattgtgggtcacagtttactatggggtgcctgtgtggaaagaagcaaccgtacttgggagtcggccat

SEQ ID NO: 404438 - DNA, 140 bp, Artificial Sequence
  Synthetic
atggccgactcccaagtacggttgcttctttccacacaggcaccccatagtaaactgtgacccacaattgatctgcagcagcaatattacagatcattaacatcccaaggagcatcgtgcggagacccagcatggcgtat

SEQ ID NO: 404439 - DNA, 140 bp, Artificial Sequence
  Synthetic
atacgccatgctgggtctccatgataccatgaataaggaagtaaaaaattgctctttcaatataaccacagaaataagagataagaaaaagaatgaatatgcacttttttatagacttgacgtacttgggagtcggccat

SEQ ID NO: 404440 - DNA, 140 bp, Artificial Sequence
  Synthetic
atggccgactcccaagtacgtcaagtctataaaaaagtgcatattcattctttttcttatctcttatttctgtggttatattgaaagagcaattttttacttccttattcatggtatcatggagacccagcatggcgtat

SEQ ID NO: 404441 - DNA, 140 bp, Artificial Sequence
  Synthetic
atacgccatgctgggtctccaatgtcaccacagaaataagagataagacaagaaaagaatatgcacttttttataggcttgatgtagtaccaatagataatgaagataatgctagaaatacgtacttgggagtcggccat

SEQ ID NO: 404442 - DNA, 140 bp, Artificial Sequence
  Synthetic
atggccgactcccaagtacgtatttctagcattatcttcattatctattggtactacatcaagcctataaaaaagtgcatattcttttcttgtcttatctcttatttctgtggtgacattggagacccagcatggcgtat

SEQ ID NO: 404443 - DNA, 140 bp, Artificial Sequence
  Synthetic
aggccctggctgctgatatgcaacacatggttttaattgtggaggagaatttttctattgcaatacatcaacactgtttaatagcacttggattaggaatagctcaaatagcacttggaagaccttttgggacagcggtg

SEQ ID NO: 404444 - DNA, 140 bp, Artificial Sequence
  Synthetic
caccgctgtcccaaaaggtcttccaagtgctatttgagctattcctaatccaagtgctattaaacagtgttgatgtattgcaatagaaaaattctcctccacaattaaaaccatgtgttgcatatcagcagccagggcct

SEQ ID NO: 404445 - DNA, 140 bp, Artificial Sequence
  Synthetic
atacgccatgctgggtctcctttaaaaattagggagggagaaatgaaaaactgctctttcaatgtcaccgcaggcataagaaataagatgtataaagaatatgcactttttcataaacttcgtacttgggagtcggccat

SEQ ID NO: 404446 - DNA, 140 bp, Artificial Sequence
  Synthetic
atggccgactcccaagtacgaagtttatgaaaaagtgcatattctttatacatcttatttcttatgcctgcggtgacattgaaagagcagtttttcatttctccctccctaatttttaaaggagacccagcatggcgtat

SEQ ID NO: 404447 - DNA, 140 bp, Artificial Sequence
  Synthetic
atacgccatgctgggtctccgcagaatcaagcaaattgtaagaatgtggcagagagtaggacaagcaatgtatgcccctccaatcgcaggagacataaggtgtgaatcaaacattactggcgtacttgggagtcggccat

SEQ ID NO: 404448 - DNA, 140 bp, Artificial Sequence
  Synthetic
atggccgactcccaagtacgccagtaatgtttgattcacaccttatgtctcctgcgattggaggggcatacattgcttgtcctactctctgccacattcttacaatttgcttgattctgcggagacccagcatggcgtat

SEQ ID NO: 404449 - DNA, 140 bp, Artificial Sequence
  Synthetic
aggccctggctgctgatatgaccagctcttcagacaggaacagaggaacttaaatcattatttaacacagtagcaactctctattgtgtacatgaaggcatagaggtacgagacaccaaggaccttttgggacagcggtg

SEQ ID NO: 404450 - DNA, 140 bp, Artificial Sequence
  Synthetic
caccgctgtcccaaaaggtccttggtgtctcgtacctctatgccttcatgtacacaatagagagttgctactgtgttaaataatgatttaagttcctctgttcctgtctgaagagctggtcatatcagcagccagggcct

SEQ ID NO: 404451 - DNA, 140 bp, Artificial Sequence
  Synthetic
aggccctggctgctgatatgttcaagacccaacaacaatacaagaaaagctatacgtataggaccagggagaacaatttatgcagcaagaaaaataataggagatataagacaagcacatgaccttttgggacagcggtg

SEQ ID NO: 404452 - DNA, 140 bp, Artificial Sequence
  Synthetic
caccgctgtcccaaaaggtcatgtgcttgtcttatatctcctattatttttcttgctgcataaattgttctccctggtcctatacgtatagcttttcttgtattgttgttgggtcttgaacatatcagcagccagggcct

SEQ ID NO: 404453 - DNA, 140 bp, Artificial Sequence
  Synthetic
aggccctggctgctgatatgatgcctgtgtacccacagatcccagcccacaagagatggtcctggaaaatgtaacagagaattttaatatgtgggaaaataacatggtagaccagatgcagaccttttgggacagcggtg

SEQ ID NO: 404454 - DNA, 140 bp, Artificial Sequence
  Synthetic
caccgctgtcccaaaaggtctgcatctggtctaccatgttattttcccacatattaaaattctctgttacattttccaggaccatctcttgtgggctgggatctgtgggtacacaggcatcatatcagcagccagggcct

SEQ ID NO: 404455 - DNA, 140 bp, Artificial Sequence
  Synthetic
aggccctggctgctgatatggcagtattggatacaagaactgaagaatagtactatcagcttgcttgataccatagcaatagcagtagctgaggggacagacagggttataaacgtagtagaccttttgggacagcggtg

SEQ ID NO: 404456 - DNA, 140 bp, Artificial Sequence
  Synthetic
caccgctgtcccaaaaggtctactacgtttataaccctgtctgtcccctcagctactgctattgctatggtatcaagcaagctgatagtactattcttcagttcttgtatccaatactgccatatcagcagccagggcct

SEQ ID NO: 404457 - DNA, 140 bp, Artificial Sequence
  Synthetic
aggccctggctgctgatatgaatattcataatgatagtaggaggcttgataggtttaagaataatttttgctgtgctttctatagtaaatagagttaggcagggatactcacctttgtcggaccttttgggacagcggtg

SEQ ID NO: 404458 - DNA, 140 bp, Artificial Sequence
  Synthetic
caccgctgtcccaaaaggtccgacaaaggtgagtatccctgcctaactctatttactatagaaagcacagcaaaaattattcttaaacctatcaagcctcctactatcattatgaatattcatatcagcagccagggcct

SEQ ID NO: 404459 - DNA, 140 bp, Artificial Sequence
  Synthetic
aggccctggctgctgatatgtatataaaaatattcataatgatagtaggaggcttaataggtttaagaatagtttttgctgtgctttctatagtgaatagagttaggcagggatactcacgaccttttgggacagcggtg

SEQ ID NO: 404460 - DNA, 140 bp, Artificial Sequence
  Synthetic
caccgctgtcccaaaaggtcgtgagtatccctgcctaactctattcactatagaaagcacagcaaaaactattcttaaacctattaagcctcctactatcattatgaatatttttatatacatatcagcagccagggcct

SEQ ID NO: 404461 - DNA, 140 bp, Artificial Sequence
  Synthetic
aggccctggctgctgatatgtacctagaagaataagacagggctttgaagcagctttgcaataaaatgggaagcacgtggtcaaaatgtagtccagtgggatggcctgctgtaagagaaagaccttttgggacagcggtg

SEQ ID NO: 404462 - DNA, 140 bp, Artificial Sequence
  Synthetic
caccgctgtcccaaaaggtctttctcttacagcaggccatcccactggactacattttgaccacgtgcttcccattttattgcaaagctgcttcaaagccctgtcttattcttctaggtacatatcagcagccagggcct

SEQ ID NO: 404463 - DNA, 140 bp, Artificial Sequence
  Synthetic
aggccctggctgctgatatgaagcacgtggtcaaaatgtagtccagtgggatggcctgctgtaagagaaagaataagacaagctaggccagcagcagaaggagtaggagcagcgtctcaagaccttttgggacagcggtg

SEQ ID NO: 404464 - DNA, 140 bp, Artificial Sequence
  Synthetic
caccgctgtcccaaaaggtcttgagacgctgctcctactccttctgctgctggcctagcttgtcttattctttctcttacagcaggccatcccactggactacattttgaccacgtgcttcatatcagcagccagggcct

SEQ ID NO: 404465 - DNA, 140 bp, Artificial Sequence
  Synthetic
aggccctggctgctgatatgagatataaaagacaccaaggaagccttagataaagtagaggaaatacaaaataagaacaaacaaaagacacagcaggcagcagctgccacaggaagcagcgaccttttgggacagcggtg

SEQ ID NO: 404466 - DNA, 140 bp, Artificial Sequence
  Synthetic
caccgctgtcccaaaaggtcgctgcttcctgtggcagctgctgcctgctgtgtcttttgtttgttcttattttgtatttcctctactttatctaaggcttccttggtgtcttttatatctcatatcagcagccagggcct

SEQ ID NO: 404467 - DNA, 140 bp, Artificial Sequence
  Synthetic
atacgccatgctgggtctcctcatagggacctgctagcaataataattattagtgctttgctgtttataaatgtaattttatgggggtttattcttagaaaatatttagaacaaaaggaacgtacttgggagtcggccat

SEQ ID NO: 404468 - DNA, 140 bp, Artificial Sequence
  Synthetic
atggccgactcccaagtacgttccttttgttctaaatattttctaagaataaacccccataaaattacatttataaacagcaaagcactaataattattattgctagcaggtccctatgaggagacccagcatggcgtat

SEQ ID NO: 404469 - DNA, 140 bp, Artificial Sequence
  Synthetic
aggccctggctgctgatatgagccaaaattaccctatagtgcaaaatgcacaagggcaaatggtacatcagtccatatcacctaggactttgaatgcatgggtaaaagtaatagaagaaagaccttttgggacagcggtg

SEQ ID NO: 404470 - DNA, 140 bp, Artificial Sequence
  Synthetic
caccgctgtcccaaaaggtctttcttctattacttttacccatgcattcaaagtcctaggtgatatggactgatgtaccatttgcccttgtgcattttgcactatagggtaattttggctcatatcagcagccagggcct

SEQ ID NO: 404471 - DNA, 140 bp, Artificial Sequence
  Synthetic
aggccctggctgctgatatggcttaggcatctcctatggcaggaagaagcggaagcaccgacgaggaactcctcagagcagtaaggatcatcaaaatcctgtaccaaagcagtaagtaatgaccttttgggacagcggtg

SEQ ID NO: 404472 - DNA, 140 bp, Artificial Sequence
  Synthetic
caccgctgtcccaaaaggtcattacttactgctttggtacaggattttgatgatccttactgctctgaggagttcctcgtcggtgcttccgcttcttcctgccataggagatgcctaagccatatcagcagccagggcct

SEQ ID NO: 404473 - DNA, 140 bp, Artificial Sequence
  Synthetic
atacgccatgctgggtctccacagtaggaaatataacagatgaagtaggaaatggaagagatgaactaaaaaactgtacctttaatatgaccacagaattaaaagataagaagcagagggcgtacttgggagtcggccat

SEQ ID NO: 404474 - DNA, 140 bp, Artificial Sequence
  Synthetic
atggccgactcccaagtacgccctctgcttcttatcttttaattctgtggtcatattaaaggtacagttttttagttcatctcttccatttcctacttcatctgttatatttcctactgtggagacccagcatggcgtat

SEQ ID NO: 404475 - DNA, 140 bp, Artificial Sequence
  Synthetic
atacgccatgctgggtctccactaataatgatataataggagggatggagagaggagaaataaaaaactgctctttcaatatcagcacagccctaagagataaaataaagaaagaatatgcgtacttgggagtcggccat

SEQ ID NO: 404476 - DNA, 140 bp, Artificial Sequence
  Synthetic
atggccgactcccaagtacgcatattctttctttattttatctcttagggctgtgctgatattgaaagagcagttttttatttctcctctctccatccctcctattatatcattattagtggagacccagcatggcgtat

SEQ ID NO: 404477 - DNA, 140 bp, Artificial Sequence
  Synthetic
atacgccatgctgggtctcccttaatgaatctgtaaaaatcaattgtaccaggcccaacaacaatacaagaacaagtgtatctataggaccaggacaaatgttctatagaacaggagacacgtacttgggagtcggccat

SEQ ID NO: 404478 - DNA, 140 bp, Artificial Sequence
  Synthetic
atggccgactcccaagtacgtgtctcctgttctatagaacatttgtcctggtcctatagatacacttgttcttgtattgttgttgggcctggtacaattgatttttacagattcattaagggagacccagcatggcgtat

SEQ ID NO: 404479 - DNA, 140 bp, Artificial Sequence
  Synthetic
aggccctggctgctgatatgtgagttacatgcaatatatctagccttgcaggattcaggatcagaggtaaatatagtaacagactcacagtatgcattaggaatcattcaggcacaaccagaccttttgggacagcggtg

SEQ ID NO: 404480 - DNA, 140 bp, Artificial Sequence
  Synthetic
caccgctgtcccaaaaggtctggttgtgcctgaatgattcctaatgcatactgtgagtctgttactatatttacctctgatcctgaatcctgcaaggctagatatattgcatgtaactcacatatcagcagccagggcct

SEQ ID NO: 404481 - DNA, 140 bp, Artificial Sequence
  Synthetic
aggccctggctgctgatatgatatagtaacagactcacagtatgcattaggaatcattcaggcacaaccagacaggagtgaatcagagttagtcaatcaaataatagagaagctaatagagaccttttgggacagcggtg

SEQ ID NO: 404482 - DNA, 140 bp, Artificial Sequence
  Synthetic
caccgctgtcccaaaaggtctctattagcttctctattatttgattgactaactctgattcactcctgtctggttgtgcctgaatgattcctaatgcatactgtgagtctgttactatatcatatcagcagccagggcct

SEQ ID NO: 404483 - DNA, 140 bp, Artificial Sequence
  Synthetic
aggccctggctgctgatatgaggcatttcctatggcaggaagaagcggagacagcgacgaagcactcctccaagcagtgaggatcatcaaaatcttgtatcaaagcagtaagtatatgtagaccttttgggacagcggtg

SEQ ID NO: 404484 - DNA, 140 bp, Artificial Sequence
  Synthetic
caccgctgtcccaaaaggtctacatatacttactgctttgatacaagattttgatgatcctcactgcttggaggagtgcttcgtcgctgtctccgcttcttcctgccataggaaatgcctcatatcagcagccagggcct

SEQ ID NO: 404485 - DNA, 140 bp, Artificial Sequence
  Synthetic
atacgccatgctgggtctcctcagcttatgggatcaaagtctaaaaccatgtgtaaagttgaccccactctgtgtcactctaaattgctcaaatgtaccagttaatgctaattgttcaaacgtacttgggagtcggccat

SEQ ID NO: 404486 - DNA, 140 bp, Artificial Sequence
  Synthetic
atggccgactcccaagtacgtttgaacaattagcattaactggtacatttgagcaatttagagtgacacagagtggggtcaactttacacatggttttagactttgatcccataagctgaggagacccagcatggcgtat

SEQ ID NO: 404487 - DNA, 140 bp, Artificial Sequence
  Synthetic
aggccctggctgctgatatgaaatagatcctgacctagcagaccaactgattcacctgcattattttgactgtttttcagactctgccataaggaaagccatattaggacaaatagttaggaccttttgggacagcggtg

SEQ ID NO: 404488 - DNA, 140 bp, Artificial Sequence
  Synthetic
caccgctgtcccaaaaggtcctaactatttgtcctaatatggctttccttatggcagagtctgaaaaacagtcaaaataatgcaggtgaatcagttggtctgctaggtcaggatctatttcatatcagcagccagggcct

SEQ ID NO: 404489 - DNA, 140 bp, Artificial Sequence
  Synthetic
aggccctggctgctgatatgcctggcagaccaactaattcatatgcattattttgattgttttgcagactctgccataaggaaagccatattaggacatatagttagccctaggtgtgacgaccttttgggacagcggtg

SEQ ID NO: 404490 - DNA, 140 bp, Artificial Sequence
  Synthetic
caccgctgtcccaaaaggtcgtcacacctagggctaactatatgtcctaatatggctttccttatggcagagtctgcaaaacaatcaaaataatgcatatgaattagttggtctgccaggcatatcagcagccagggcct

SEQ ID NO: 404491 - DNA, 140 bp, Artificial Sequence
  Synthetic
aggccctggctgctgatatgtgggtgtcaacatagcagaataggcattattcgagggagaagaggcaggaatggatccggtagatcctaacctagagccctggaaccacccgggaagtcagaccttttgggacagcggtg

SEQ ID NO: 404492 - DNA, 140 bp, Artificial Sequence
  Synthetic
caccgctgtcccaaaaggtctgacttcccgggtggttccagggctctaggttaggatctaccggatccattcctgcctcttctccctcgaataatgcctattctgctatgttgacacccacatatcagcagccagggcct

SEQ ID NO: 404493 - DNA, 140 bp, Artificial Sequence
  Synthetic
aggccctggctgctgatatgcatatatagaatataggaaattgaaaaaacaaaggaaaatagactggttaattaaaagaattagggaaagagcagaagacagtggcaatgagagtgaggggaccttttgggacagcggtg

SEQ ID NO: 404494 - DNA, 140 bp, Artificial Sequence
  Synthetic
caccgctgtcccaaaaggtcccctcactctcattgccactgtcttctgctctttccctaattcttttaattaaccagtctattttcctttgttttttcaatttcctatattctatatatgcatatcagcagccagggcct

SEQ ID NO: 404495 - DNA, 140 bp, Artificial Sequence
  Synthetic
atacgccatgctgggtctccaaagaatagataagttaattgatagaataagagatagagcagaagacagtggcaatgagagtgaaggggacacagaggaattggcaaaacttgtggagatcgtacttgggagtcggccat

SEQ ID NO: 404496 - DNA, 140 bp, Artificial Sequence
  Synthetic
atggccgactcccaagtacgatctccacaagttttgccaattcctctgtgtccccttcactctcattgccactgtcttctgctctatctcttattctatcaattaacttatctattctttggagacccagcatggcgtat

SEQ ID NO: 404497 - DNA, 140 bp, Artificial Sequence
  Synthetic
aggccctggctgctgatatgaccccactctgtgtcactctagaatgtgcaaatgtttacaatgtgaccgccaaggggggcgggagggaaataaaaaattgctcgttcaatgcaaccacaggaccttttgggacagcggtg

SEQ ID NO: 404498 - DNA, 140 bp, Artificial Sequence
  Synthetic
caccgctgtcccaaaaggtcctgtggttgcattgaacgagcaattttttatttccctcccgccccccttggcggtcacattgtaaacatttgcacattctagagtgacacagagtggggtcatatcagcagccagggcct

SEQ ID NO: 404499 - DNA, 140 bp, Artificial Sequence
  Synthetic
atacgccatgctgggtctccgaagacagtggcaatgaaagtgatggggacacagaggaactggccacggtggtgggtatggggaatcttaggcttttggatgttgttgatttgtaatgggcgtacttgggagtcggccat

SEQ ID NO: 404500 - DNA, 140 bp, Artificial Sequence
  Synthetic
atggccgactcccaagtacgcccattacaaatcaacaacatccaaaagcctaagattccccatacccaccaccgtggccagttcctctgtgtccccatcactttcattgccactgtcttcggagacccagcatggcgtat

SEQ ID NO: 404501 - DNA, 140 bp, Artificial Sequence
  Synthetic
atacgccatgctgggtctccaacggaacgaacggtaacatatctagggagatgctaggggaaataaagaactgctctttcaatatgaccacagtattaagagataagaaacagaaggtggcgtacttgggagtcggccat

SEQ ID NO: 404502 - DNA, 140 bp, Artificial Sequence
  Synthetic
atggccgactcccaagtacgccaccttctgtttcttatctcttaatactgtggtcatattgaaagagcagttctttatttcccctagcatctccctagatatgttaccgttcgttccgttggagacccagcatggcgtat

SEQ ID NO: 404503 - DNA, 140 bp, Artificial Sequence
  Synthetic
aggccctggctgctgatatgcccaattcctatacattattgtgctccagctggttatgcgattctaaagtgtaataataagacattcaatgggacaggaccatgcaataatgtcagcacagaccttttgggacagcggtg

SEQ ID NO: 404504 - DNA, 140 bp, Artificial Sequence
  Synthetic
caccgctgtcccaaaaggtctgtgctgacattattgcatggtcctgtcccattgaatgtcttattattacactttagaatcgcataaccagctggagcacaataatgtataggaattgggcatatcagcagccagggcct

SEQ ID NO: 404505 - DNA, 140 bp, Artificial Sequence
  Synthetic
aggccctggctgctgatatgtaaagccatgtgtaaagttgaccccactttgtgttactttacactgtagtaatgttcaaagtaatgctacctacgagaatggcacaaaagaagaaatgaagaccttttgggacagcggtg

SEQ ID NO: 404506 - DNA, 140 bp, Artificial Sequence
  Synthetic
caccgctgtcccaaaaggtcttcatttcttcttttgtgccattctcgtaggtagcattactttgaacattactacagtgtaaagtaacacaaagtggggtcaactttacacatggctttacatatcagcagccagggcct

SEQ ID NO: 404507 - DNA, 140 bp, Artificial Sequence
  Synthetic
atacgccatgctgggtctccgaccaggaagaattactggtggagatggggcatgatgctccttgggatgctaatgatctgtagtgctgcagaacaattgtgggttacagtctattatgggcgtacttgggagtcggccat

SEQ ID NO: 404508 - DNA, 140 bp, Artificial Sequence
  Synthetic
atggccgactcccaagtacgcccataatagactgtaacccacaattgttctgcagcactacagatcattagcatcccaaggagcatcatgccccatctccaccagtaattcttcctggtcggagacccagcatggcgtat

SEQ ID NO: 404509 - DNA, 140 bp, Artificial Sequence
  Synthetic
atacgccatgctgggtctcctacaagaaaaggtgtgggtataggaccagggcaaacattctatgcagcagatagaataatagggaatataagacaagcacattgtaatgtcagcagagatcgtacttgggagtcggccat

SEQ ID NO: 404510 - DNA, 140 bp, Artificial Sequence
  Synthetic
atggccgactcccaagtacgatctctgctgacattacaatgtgcttgtcttatattccctattattctatctgctgcatagaatgtttgccctggtcctatacccacaccttttcttgtaggagacccagcatggcgtat

SEQ ID NO: 404511 - DNA, 140 bp, Artificial Sequence
  Synthetic
aggccctggctgctgatatgaattagtttatgggatcaaagtctaaagccatgtgtaaaattaaccccgctctgtgttaccttaaattgcactgattggaatggtaggaatggcactatggaccttttgggacagcggtg

SEQ ID NO: 404512 - DNA, 140 bp, Artificial Sequence
  Synthetic
caccgctgtcccaaaaggtccatagtgccattcctaccattccaatcagtgcaatttaaggtaacacagagcggggttaattttacacatggctttagactttgatcccataaactaattcatatcagcagccagggcct

SEQ ID NO: 404513 - DNA, 140 bp, Artificial Sequence
  Synthetic
atacgccatgctgggtctccaatgcaaaataaagcaaattgtaaatatgtggcagagagtaggacaagcaatatatgcccctcctatccaaggaaaaataagttgtaattcaagcattaccgtacttgggagtcggccat

SEQ ID NO: 404514 - DNA, 140 bp, Artificial Sequence
  Synthetic
atggccgactcccaagtacggtaatgcttgaattacaacttatttttccttggataggaggggcatatattgcttgtcctactctctgccacatatttacaatttgctttattttgcattggagacccagcatggcgtat

SEQ ID NO: 404515 - DNA, 140 bp, Artificial Sequence
  Synthetic
aggccctggctgctgatatgtacaagacccggcaacaatacaagaagaagtatacatataggaccagggagggcattttatgcaacaggagacataataggagatataagacaagcacatgaccttttgggacagcggtg

SEQ ID NO: 404516 - DNA, 140 bp, Artificial Sequence
  Synthetic
caccgctgtcccaaaaggtcatgtgcttgtcttatatctcctattatgtctcctgttgcataaaatgccctccctggtcctatatgtatacttcttcttgtattgttgccgggtcttgtacatatcagcagccagggcct

SEQ ID NO: 404517 - DNA, 140 bp, Artificial Sequence
  Synthetic
aggccctggctgctgatatggtagcaaaggaaatagtagccaactgtgataaatgtcaactaaaaggggaagctatgcatggacaagtagactgtagcccagggatatggcaattagattgaccttttgggacagcggtg

SEQ ID NO: 404518 - DNA, 140 bp, Artificial Sequence
  Synthetic
caccgctgtcccaaaaggtcaatctaattgccatatccctgggctacagtctacttgtccatgcatagcttccccttttagttgacatttatcacagttggctactatttcctttgctaccatatcagcagccagggcct

SEQ ID NO: 404519 - DNA, 140 bp, Artificial Sequence
  Synthetic
aggccctggctgctgatatgggcctgctgtaagagaaagaataaggcaaactgatccagcagcaaggcaaactgattcagcagcaaagggagtaggagcagcgtctcaagacttagacaagaccttttgggacagcggtg

SEQ ID NO: 404520 - DNA, 140 bp, Artificial Sequence
  Synthetic
caccgctgtcccaaaaggtcttgtctaagtcttgagacgctgctcctactccctttgctgctgaatcagtttgccttgctgctggatcagtttgccttattctttctcttacagcaggcccatatcagcagccagggcct

SEQ ID NO: 404521 - DNA, 140 bp, Artificial Sequence
  Synthetic
aggccctggctgctgatatgaaattagatgcatgggagaaaattcggttaaggccagggggaaagaaaaaatatagactaaaacatctagtatgggcaagcagggagctggaaagattcggaccttttgggacagcggtg

SEQ ID NO: 404522 - DNA, 140 bp, Artificial Sequence
  Synthetic
caccgctgtcccaaaaggtccgaatctttccagctccctgcttgcccatactagatgttttagtctatattttttctttccccctggccttaaccgaattttctcccatgcatctaatttcatatcagcagccagggcct

SEQ ID NO: 404523 - DNA, 140 bp, Artificial Sequence
  Synthetic
aggccctggctgctgatatggtggaatctcctgcagtattggagtcaggaactaaagaatagtgctgttagtttgtttaatgctatagctatagcagtagctgaggggacagatagggttgaccttttgggacagcggtg

SEQ ID NO: 404524 - DNA, 140 bp, Artificial Sequence
  Synthetic
caccgctgtcccaaaaggtcaaccctatctgtcccctcagctactgctatagctatagcattaaacaaactaacagcactattctttagttcctgactccaatactgcaggagattccaccatatcagcagccagggcct

SEQ ID NO: 404525 - DNA, 140 bp, Artificial Sequence
  Synthetic
aggccctggctgctgatatgctgggacgatctgcggagcctgtgcctcttcagctaccaccgcttgagagacttactcttgattgtagcgaggattgtggaacttctgggacgcaggggggaccttttgggacagcggtg

SEQ ID NO: 404526 - DNA, 140 bp, Artificial Sequence
  Synthetic
caccgctgtcccaaaaggtcccccctgcgtcccagaagttccacaatcctcgctacaatcaagagtaagtctctcaagcggtggtagctgaagaggcacaggctccgcagatcgtcccagcatatcagcagccagggcct

SEQ ID NO: 404527 - DNA, 140 bp, Artificial Sequence
  Synthetic
atacgccatgctgggtctccaatgatgcagagaggcaattttaggggccagagaacaataaagtgtttcaactgtggcaaagaaggacacctagccagaaattgcaaggcccctaggaaacgtacttgggagtcggccat

SEQ ID NO: 404528 - DNA, 140 bp, Artificial Sequence
  Synthetic
atggccgactcccaagtacgtttcctaggggccttgcaatttctggctaggtgtccttctttgccacagttgaaacactttattgttctctggcccctaaaattgcctctctgcatcattggagacccagcatggcgtat

SEQ ID NO: 404529 - DNA, 140 bp, Artificial Sequence
  Synthetic
atacgccatgctgggtctccgagagctttgggattggggaagagataacctcctctcagaagcaggaaccgaaggagcaggaaccgagggacaagggactatatcctcctttaacttccccgtacttgggagtcggccat

SEQ ID NO: 404530 - DNA, 140 bp, Artificial Sequence
  Synthetic
atggccgactcccaagtacggggaagttaaaggaggatatagtcccttgtccctcggttcctgctccttcggttcctgcttctgagaggaggttatctcttccccaatcccaaagctctcggagacccagcatggcgtat

SEQ ID NO: 404531 - DNA, 140 bp, Artificial Sequence
  Synthetic
aggccctggctgctgatatgtcacactcccatgcagaataaaacaaattataaacatgtggcagggagtaggaaaagcaatgtatgcccctcccattgcaggagtaattagatgttcatcgaccttttgggacagcggtg

SEQ ID NO: 404532 - DNA, 140 bp, Artificial Sequence
  Synthetic
caccgctgtcccaaaaggtcgatgaacatctaattactcctgcaatgggaggggcatacattgcttttcctactccctgccacatgtttataatttgttttattctgcatgggagtgtgacatatcagcagccagggcct

SEQ ID NO: 404533 - DNA, 140 bp, Artificial Sequence
  Synthetic
atacgccatgctgggtctccaagtgaaagtaatagggacttgaaagcgaaagttccagagaagatctctcgacgcaggactcggcttgctgaagcgcacggcaagaggcgaggggcggcgcgtacttgggagtcggccat

SEQ ID NO: 404534 - DNA, 140 bp, Artificial Sequence
  Synthetic
atggccgactcccaagtacgcgccgcccctcgcctcttgccgtgcgcttcagcaagccgagtcctgcgtcgagagatcttctctggaactttcgctttcaagtccctattactttcacttggagacccagcatggcgtat

SEQ ID NO: 404535 - DNA, 140 bp, Artificial Sequence
  Synthetic
aggccctggctgctgatatgataaaacaatagtctttaattcatcctcaggaggggacccagaaattgtaatgcatagttttaattgtggaggggaatttttctactgtaattcaacacagaccttttgggacagcggtg

SEQ ID NO: 404536 - DNA, 140 bp, Artificial Sequence
  Synthetic
caccgctgtcccaaaaggtctgtgttgaattacagtagaaaaattcccctccacaattaaaactatgcattacaatttctgggtcccctcctgaggatgaattaaagactattgttttatcatatcagcagccagggcct

SEQ ID NO: 404537 - DNA, 140 bp, Artificial Sequence
  Synthetic
atacgccatgctgggtctcctcactttaaactgtacaaaggcaaattttacaaatgtaaattataccaatataaatgagacaaatattgaagaaataagaaattgcacttttaatacaaccgtacttgggagtcggccat

SEQ ID NO: 404538 - DNA, 140 bp, Artificial Sequence
  Synthetic
atggccgactcccaagtacggttgtattaaaagtgcaatttcttatttcttcaatatttgtctcatttatattggtataatttacatttgtaaaatttgcctttgtacagtttaaagtgaggagacccagcatggcgtat

SEQ ID NO: 404539 - DNA, 140 bp, Artificial Sequence
  Synthetic
aggccctggctgctgatatgttttatagacatcactatgaaagtaggcatccaaaagtaagttcagaagtacacatcccactaggggatgctagattagtagtaagaacatattggggtcgaccttttgggacagcggtg

SEQ ID NO: 404540 - DNA, 140 bp, Artificial Sequence
  Synthetic
caccgctgtcccaaaaggtcgaccccaatatgttcttactactaatctagcatcccctagtgggatgtgtacttctgaacttacttttggatgcctactttcatagtgatgtctataaaacatatcagcagccagggcct

SEQ ID NO: 404541 - DNA, 140 bp, Artificial Sequence
  Synthetic
aggccctggctgctgatatgacaatgccaaaacaataatagtacagcttaataaatccatagacattgtgtgcacaagacccggcaataatacaagaaaaagtataaggataggaccagggaccttttgggacagcggtg

SEQ ID NO: 404542 - DNA, 140 bp, Artificial Sequence
  Synthetic
caccgctgtcccaaaaggtccctggtcctatccttatactttttcttgtattattgccgggtcttgtgcacacaatgtctatggatttattaagctgtactattattgttttggcattgtcatatcagcagccagggcct

SEQ ID NO: 404543 - DNA, 140 bp, Artificial Sequence
  Synthetic
aggccctggctgctgatatgcataataaggtaggatcgctacaatatttggcactgaaagcattagtaacaccaacaaagacaaagccacctttgcctagtgttaagaagttaacagaaggaccttttgggacagcggtg

SEQ ID NO: 404544 - DNA, 140 bp, Artificial Sequence
  Synthetic
caccgctgtcccaaaaggtccttctgttaacttcttaacactaggcaaaggtggctttgtctttgttggtgttactaatgctttcagtgccaaatattgtagcgatcctaccttattatgcatatcagcagccagggcct

SEQ ID NO: 404545 - DNA, 140 bp, Artificial Sequence
  Synthetic
aggccctggctgctgatatgaagcattctttggaacagaaaaaataacaggggatataagaaaagcacattgtaatgtcagtagatcaagatggaatgacactttgaaacaggtagctaagaccttttgggacagcggtg

SEQ ID NO: 404546 - DNA, 140 bp, Artificial Sequence
  Synthetic
caccgctgtcccaaaaggtcttagctacctgtttcaaagtgtcattccatcttgatctactgacattacaatgtgcttttcttatatcccctgttattttttctgttccaaagaatgcttcatatcagcagccagggcct

SEQ ID NO: 404547 - DNA, 140 bp, Artificial Sequence
  Synthetic
aggccctggctgctgatatgaactactttttgttcatttcagaattgggtgtcaacatagcagaataggcattattccaagagaaagaagaggcagaagaggcagggatggagccagtaagaccttttgggacagcggtg

SEQ ID NO: 404548 - DNA, 140 bp, Artificial Sequence
  Synthetic
caccgctgtcccaaaaggtcttactggctccatccctgcctcttctgcctcttctttctcttggaataatgcctattctgctatgttgacacccaattctgaaatgaacaaaaagtagttcatatcagcagccagggcct

SEQ ID NO: 404549 - DNA, 140 bp, Artificial Sequence
  Synthetic
aggccctggctgctgatatgcttgagagacttcatcttgattgcagcgaggactgtggaacttctgggacgcagcagtctcaagggactgagactggggtgggagagcctcaaatatctggaccttttgggacagcggtg

SEQ ID NO: 404550 - DNA, 140 bp, Artificial Sequence
  Synthetic
caccgctgtcccaaaaggtccagatatttgaggctctcccaccccagtctcagtcccttgagactgctgcgtcccagaagttccacagtcctcgctgcaatcaagatgaagtctctcaagcatatcagcagccagggcct

SEQ ID NO: 404551 - DNA, 140 bp, Artificial Sequence
  Synthetic
aggccctggctgctgatatggaaaaagagcccatagcaggagcagaaactttctatgtagatggggcagctaatagggaaaataaaaaaggaagagcaggatatgtcactgacagaggaagaccttttgggacagcggtg

SEQ ID NO: 404552 - DNA, 140 bp, Artificial Sequence
  Synthetic
caccgctgtcccaaaaggtcttcctctgtcagtgacatatcctgctcttccttttttattttccctattagctgccccatctacatagaaagtttctgctcctgctatgggctctttttccatatcagcagccagggcct

SEQ ID NO: 404553 - DNA, 140 bp, Artificial Sequence
  Synthetic
atacgccatgctgggtctccagagatgttaccaacaatagcagtaatagtaatgttaccaacaatgagaacatgaaaaattgctctttcaatacaaccacagaactgagagataagaagccgtacttgggagtcggccat

SEQ ID NO: 404554 - DNA, 140 bp, Artificial Sequence
  Synthetic
atggccgactcccaagtacggcttcttatctctcagttctgtggttgtattgaaagagcaatttttcatgttctcattgttggtaacattactattactgctattgttggtaacatctctggagacccagcatggcgtat

SEQ ID NO: 404555 - DNA, 140 bp, Artificial Sequence
  Synthetic
atacgccatgctgggtctccgtggcgcccgaacagggactcgaaagcggaagttaatagggactcgaaagcgaagttccagagaagttctctcgacgcaggactcggcttgctgaggtgccgtacttgggagtcggccat

SEQ ID NO: 404556 - DNA, 140 bp, Artificial Sequence
  Synthetic
atggccgactcccaagtacggcacctcagcaagccgagtcctgcgtcgagagaacttctctggaacttcgctttcgagtccctattaacttccgctttcgagtccctgttcgggcgccacggagacccagcatggcgtat

SEQ ID NO: 404557 - DNA, 140 bp, Artificial Sequence
  Synthetic
aggccctggctgctgatatggggacaggaccatgccataatgtcagcacagtacaatgtacacatggaattaaaccagtggtatcaactcaactactgttaaatggtagcctagcagaaagaccttttgggacagcggtg

SEQ ID NO: 404558 - DNA, 140 bp, Artificial Sequence
  Synthetic
caccgctgtcccaaaaggtctttctgctaggctaccatttaacagtagttgagttgataccactggtttaattccatgtgtacattgtactgtgctgacattatggcatggtcctgtccccatatcagcagccagggcct

SEQ ID NO: 404559 - DNA, 140 bp, Artificial Sequence
  Synthetic
aggccctggctgctgatatgggactacagacggggtggacagcccttaaatatttgggaagtcttgtgcagaattggggtctgggactaaaaaagggtattattagtctggttgatacccgaccttttgggacagcggtg

SEQ ID NO: 404560 - DNA, 140 bp, Artificial Sequence
  Synthetic
caccgctgtcccaaaaggtcgggtatcaaccagactaataatacccttttttagtcccagaccccaattctgcacaagacttcccaaatatttaagggctgtccaccccgtctgtagtcccatatcagcagccagggcct

SEQ ID NO: 404561 - DNA, 140 bp, Artificial Sequence
  Synthetic
atacgccatgctgggtctcctaccagtgccagtaatggtactagtttcaataataaggaagaaatgaaaaattgctctttcaatataaccacagaactaagagataagacaaagaaagaacgtacttgggagtcggccat

SEQ ID NO: 404562 - DNA, 140 bp, Artificial Sequence
  Synthetic
atggccgactcccaagtacgttctttctttgtcttatctcttagttctgtggttatattgaaagagcaatttttcatttcttccttattattgaaactagtaccattactggcactggtaggagacccagcatggcgtat

SEQ ID NO: 404563 - DNA, 140 bp, Artificial Sequence
  Synthetic
aggccctggctgctgatatggacaaagagctggtagagctattctccacatacctagaagaatcagacagggcttagaaagggctttgctataacatgggtggcaagtggtcaaaaagcagaccttttgggacagcggtg

SEQ ID NO: 404564 - DNA, 140 bp, Artificial Sequence
  Synthetic
caccgctgtcccaaaaggtctgctttttgaccacttgccacccatgttatagcaaagccctttctaagccctgtctgattcttctaggtatgtggagaatagctctaccagctctttgtccatatcagcagccagggcct

SEQ ID NO: 404565 - DNA, 140 bp, Artificial Sequence
  Synthetic
atacgccatgctgggtctccagatggagggagaaataaaaaactgctctttcaatgtcaccacaagcataagaaataagatgcataaagaatatgcactgttttataaacttgatgtaatcgtacttgggagtcggccat

SEQ ID NO: 404566 - DNA, 140 bp, Artificial Sequence
  Synthetic
atggccgactcccaagtacgattacatcaagtttataaaacagtgcatattctttatgcatcttatttcttatgcttgtggtgacattgaaagagcagttttttatttctccctccatctggagacccagcatggcgtat

SEQ ID NO: 404567 - DNA, 140 bp, Artificial Sequence
  Synthetic
aggccctggctgctgatatgctctgtgttactttaaattgcaaagaggtgaagaatgatactgatgccactaacgggacggtggggggaaaaggaatgacaaactgctctttcaatgtcagaccttttgggacagcggtg

SEQ ID NO: 404568 - DNA, 140 bp, Artificial Sequence
  Synthetic
caccgctgtcccaaaaggtctgacattgaaagagcagtttgtcattccttttccccccaccgtcccgttagtggcatcagtatcattcttcacctctttgcaatttaaagtaacacagagcatatcagcagccagggcct

SEQ ID NO: 404569 - DNA, 140 bp, Artificial Sequence
  Synthetic
atacgccatgctgggtctccataatacaatacaatttaaaccagcctcagggggggacttagaaattataacacatagctttaattgtggaggagagtttttctattgcaatacatcaagcgtacttgggagtcggccat

SEQ ID NO: 404570 - DNA, 140 bp, Artificial Sequence
  Synthetic
atggccgactcccaagtacgcttgatgtattgcaatagaaaaactctcctccacaattaaagctatgtgttataatttctaagtccccccctgaggctggtttaaattgtattgtattatggagacccagcatggcgtat

SEQ ID NO: 404571 - DNA, 140 bp, Artificial Sequence
  Synthetic
  misc_feature (50)..(50): n is a, c, g, or t
aggccctggctgctgatatgctgggtggaagcacaagaggaagaaggggnagtaggctttccagtcagacctcaggtatctttaagaccaatgacttccagggcagctagggatcttagcgaccttttgggacagcggtg

SEQ ID NO: 404572 - DNA, 140 bp, Artificial Sequence
  Synthetic
  misc_feature (91)..(91): n is a, c, g, or t
caccgctgtcccaaaaggtcgctaagatccctagctgccctggaagtcattggtcttaaagatacctgaggtctgactggaaagcctactnccccttcttcctcttgtgcttccacccagcatatcagcagccagggcct

SEQ ID NO: 404573 - DNA, 140 bp, Artificial Sequence
  Synthetic
atacgccatgctgggtctccattagaaaaagaccccatagtaggagcagaaactttctatgtagatggggcggctagtagggagactaagctaggaaaagcaggatatgtcactgacagacgtacttgggagtcggccat

SEQ ID NO: 404574 - DNA, 140 bp, Artificial Sequence
  Synthetic
atggccgactcccaagtacgtctgtcagtgacatatcctgcttttcctagcttagtctccctactagccgccccatctacatagaaagtttctgctcctactatggggtctttttctaatggagacccagcatggcgtat

SEQ ID NO: 404575 - DNA, 140 bp, Artificial Sequence
  Synthetic
aggccctggctgctgatatgtgtagaataaaacaaattataaacatgtggcaggaagtaggaaaagcaatgtatgcccctcccatcaaaggacaaattcaatgttcatcaaatattacaggaccttttgggacagcggtg

SEQ ID NO: 404576 - DNA, 140 bp, Artificial Sequence
  Synthetic
caccgctgtcccaaaaggtcctgtaatatttgatgaacattgaatttgtcctttgatgggaggggcatacattgcttttcctacttcctgccacatgtttataatttgttttattctacacatatcagcagccagggcct

SEQ ID NO: 404577 - DNA, 140 bp, Artificial Sequence
  Synthetic
atacgccatgctgggtctccacatgcagagcgaataaaaaattgctctttcaataccaccacaggaataagaggtaagaaacagcaggtgtatgcacttttttataacactgatgtagtgcgtacttgggagtcggccat

SEQ ID NO: 404578 - DNA, 140 bp, Artificial Sequence
  Synthetic
atggccgactcccaagtacgcactacatcagtgttataaaaaagtgcatacacctgctgtttcttacctcttattcctgtggtggtattgaaagagcaattttttattcgctctgcatgtggagacccagcatggcgtat

SEQ ID NO: 404579 - DNA, 140 bp, Artificial Sequence
  Synthetic
atacgccatgctgggtctcctgttaagaaattaacagaagacagatggaacaagccccagaagaccaggggccacagagggagccgttcaatgaatggacactagaactgttagaagagccgtacttgggagtcggccat

SEQ ID NO: 404580 - DNA, 140 bp, Artificial Sequence
  Synthetic
atggccgactcccaagtacggctcttctaacagttctagtgtccattcattgaacggctccctctgtggcccctggtcttctggggcttgttccatctgtcttctgttaatttcttaacaggagacccagcatggcgtat

SEQ ID NO: 404581 - DNA, 140 bp, Artificial Sequence
  Synthetic
atacgccatgctgggtctccaccccactctgtgtcaccttaaactgtagcaattacaattttagtagcaatgttacctacaatgagaccgatgaagtaaaaaattgcactttcaatgcaacgtacttgggagtcggccat

SEQ ID NO: 404582 - DNA, 140 bp, Artificial Sequence
  Synthetic
atggccgactcccaagtacgttgcattgaaagtgcaattttttacttcatcggtctcattgtaggtaacattgctactaaaattgtaattgctacagtttaaggtgacacagagtggggtggagacccagcatggcgtat

SEQ ID NO: 404583 - DNA, 140 bp, Artificial Sequence
  Synthetic
aggccctggctgctgatatgatagctgcaatagtaggactagtagtagcattcatagcagccatagttgtgtggagcatagtacttatagaatataggaaaataaggaaacagaagaaaagaccttttgggacagcggtg

SEQ ID NO: 404584 - DNA, 140 bp, Artificial Sequence
  Synthetic
caccgctgtcccaaaaggtcttttcttctgtttccttattttcctatattctataagtactatgctccacacaactatggctgctatgaatgctactactagtcctactattgcagctatcatatcagcagccagggcct

SEQ ID NO: 404585 - DNA, 140 bp, Artificial Sequence
  Synthetic
aggccctggctgctgatatgtgggacgatctacggagcctgtgcctcttcagctaccaccgattgagagacttcatcttgattgcagcgaggactgtggaacttctgggacgcagcagtcgaccttttgggacagcggtg

SEQ ID NO: 404586 - DNA, 140 bp, Artificial Sequence
  Synthetic
caccgctgtcccaaaaggtcgactgctgcgtcccagaagttccacagtcctcgctgcaatcaagatgaagtctctcaatcggtggtagctgaagaggcacaggctccgtagatcgtcccacatatcagcagccagggcct

SEQ ID NO: 404587 - DNA, 140 bp, Artificial Sequence
  Synthetic
aggccctggctgctgatatggaaaggggaaataaaaaactgctctttcaatatgaccacagtattaagagataagacacagaaaatgtctgcacttttttataaacttgatgtagtacaagaccttttgggacagcggtg

SEQ ID NO: 404588 - DNA, 140 bp, Artificial Sequence
  Synthetic
caccgctgtcccaaaaggtcttgtactacatcaagtttataaaaaagtgcagacattttctgtgtcttatctcttaatactgtggtcatattgaaagagcagttttttatttcccctttccatatcagcagccagggcct

SEQ ID NO: 404589 - DNA, 140 bp, Artificial Sequence
  Synthetic
atacgccatgctgggtctccaatggaacagggccatgcaagaatgtcagtacagtacaatgcacacatggaatcaagccagtagtatcaactcaactgctgttaaatggcagtctagcagcgtacttgggagtcggccat

SEQ ID NO: 404590 - DNA, 140 bp, Artificial Sequence
  Synthetic
atggccgactcccaagtacgctgctagactgccatttaacagcagttgagttgatactactggcttgattccatgtgtgcattgtactgtactgacattcttgcatggccctgttccattggagacccagcatggcgtat

SEQ ID NO: 404591 - DNA, 140 bp, Artificial Sequence
  Synthetic
atacgccatgctgggtctcccaagaggtgacataataggggatataagacaggcacattgtaatgtcagtaaaaaagaatggaatgccactttacgaaaggtagctgaaaaattaaggcacgtacttgggagtcggccat

SEQ ID NO: 404592 - DNA, 140 bp, Artificial Sequence
  Synthetic
atggccgactcccaagtacgtgccttaatttttcagctacctttcgtaaagtggcattccattcttttttactgacattacaatgtgcctgtcttatatcccctattatgtcacctcttgggagacccagcatggcgtat

SEQ ID NO: 404593 - DNA, 140 bp, Artificial Sequence
  Synthetic
atacgccatgctgggtctccatttagaaattacaacacatacttttaattgtagaggagaatttttctattgctatacatcagacctgtttaatagcacttggcccaataacactgcagacgtacttgggagtcggccat

SEQ ID NO: 404594 - DNA, 140 bp, Artificial Sequence
  Synthetic
atggccgactcccaagtacgtctgcagtgttattgggccaagtgctattaaacaggtctgatgtatagcaatagaaaaattctcctctacaattaaaagtatgtgttgtaatttctaaatggagacccagcatggcgtat

SEQ ID NO: 404595 - DNA, 140 bp, Artificial Sequence
  Synthetic
aggccctggctgctgatatgtagaacagatgcatgaggatataatcagtttatgggatcaaagcctaaagccatgtgtaaaattaaccccactctgtgttactttaaattgtactaatttgaccttttgggacagcggtg

SEQ ID NO: 404596 - DNA, 140 bp, Artificial Sequence
  Synthetic
caccgctgtcccaaaaggtcaaattagtacaatttaaagtaacacagagtggggttaattttacacatggctttaggctttgatcccataaactgattatatcctcatgcatctgttctacatatcagcagccagggcct

SEQ ID NO: 404597 - DNA, 140 bp, Artificial Sequence
  Synthetic
atacgccatgctgggtctcctaaatggtagatgtaatgttaagtttactagcaaaagtagattataaattaggagtaggagcattgataatagcactgatcttagcaatagttgtgtggacgtacttgggagtcggccat

SEQ ID NO: 404598 - DNA, 140 bp, Artificial Sequence
  Synthetic
atggccgactcccaagtacgtccacacaactattgctaagatcagtgctattatcaatgctcctactcctaatttataatctacttttgctagtaaacttaacattacatctaccatttaggagacccagcatggcgtat

SEQ ID NO: 404599 - DNA, 140 bp, Artificial Sequence
  Synthetic
aggccctggctgctgatatggcacttttttataggcttgatgtagtaccaatagataataaagataatgctggaaataatactaataatactagctataggttaataaattgtaactcctgaccttttgggacagcggtg

SEQ ID NO: 404600 - DNA, 140 bp, Artificial Sequence
  Synthetic
caccgctgtcccaaaaggtcaggagttacaatttattaacctatagctagtattattagtattatttccagcattatctttattatctattggtactacatcaagcctataaaaaagtgccatatcagcagccagggcct

SEQ ID NO: 404601 - DNA, 140 bp, Artificial Sequence
  Synthetic
atacgccatgctgggtctccgaatagtacctccagtgagaataatagtacctccagtaccaacagtacaatcttgagtgaaataatgagaaattgtactttcaatgtaaccacagaactacgtacttgggagtcggccat

SEQ ID NO: 404602 - DNA, 140 bp, Artificial Sequence
  Synthetic
atggccgactcccaagtacgtagttctgtggttacattgaaagtacaatttctcattatttcactcaagattgtactgttggtactggaggtactattattctcactggaggtactattcggagacccagcatggcgtat

SEQ ID NO: 404603 - DNA, 140 bp, Artificial Sequence
  Synthetic
aggccctggctgctgatatgtaccagagaagtctctccgacgcagtcgaaagcgaaagttccagagaagctctctcgacgcagggactcggcttgctgaggtgcacacggcaagaggcgagaccttttgggacagcggtg

SEQ ID NO: 404604 - DNA, 140 bp, Artificial Sequence
  Synthetic
caccgctgtcccaaaaggtctcgcctcttgccgtgtgcacctcagcaagccgagtccctgcgtcgagagagcttctctggaactttcgctttcgactgcgtcggagagacttctctggtacatatcagcagccagggcct

SEQ ID NO: 404605 - DNA, 140 bp, Artificial Sequence
  Synthetic
aggccctggctgctgatatgccttttagaaacatcagaaggctgtaaacaaataataaaacagctacaaccagctcttcagacaggaacagaggaacttaaatcattattcaacacagtagaccttttgggacagcggtg

SEQ ID NO: 404606 - DNA, 140 bp, Artificial Sequence
  Synthetic
caccgctgtcccaaaaggtctactgtgttgaataatgatttaagttcctctgttcctgtctgaagagctggttgtagctgttttattatttgtttacagccttctgatgtttctaaaaggcatatcagcagccagggcct

SEQ ID NO: 404607 - DNA, 140 bp, Artificial Sequence
  Synthetic
aggccctggctgctgatatgtattcttgggaatattgataatctgtaatgctgcagacaatttgtgggtcacagtctattatggggtacctgtgtggaaagaagcaaacaccactctattgaccttttgggacagcggtg

SEQ ID NO: 404608 - DNA, 140 bp, Artificial Sequence
  Synthetic
caccgctgtcccaaaaggtcaatagagtggtgtttgcttctttccacacaggtaccccataatagactgtgacccacaaattgtctgcagcattacagattatcaatattcccaagaatacatatcagcagccagggcct

SEQ ID NO: 404609 - DNA, 140 bp, Artificial Sequence
  Synthetic
atacgccatgctgggtctccgtggcgcccgaacagggaccggaagttaatagggacgcgaaagcgaaagttccagagaagtatctcgacgcacggactcggcttgctgaggtgcacacagcgtacttgggagtcggccat

SEQ ID NO: 404610 - DNA, 140 bp, Artificial Sequence
  Synthetic
atggccgactcccaagtacgctgtgtgcacctcagcaagccgagtccgtgcgtcgagatacttctctggaactttcgctttcgcgtccctattaacttccggtccctgttcgggcgccacggagacccagcatggcgtat

SEQ ID NO: 404611 - DNA, 140 bp, Artificial Sequence
  Synthetic
aggccctggctgctgatatgtgtcagcattttggacataaaacaagggccaaaagaaccctttagagactatgtagacaggttctttaaaaccctaagagctgagcaatgtacacaggaagaccttttgggacagcggtg

SEQ ID NO: 404612 - DNA, 140 bp, Artificial Sequence
  Synthetic
caccgctgtcccaaaaggtcttcctgtgtacattgctcagctcttagggttttaaagaacctgtctacatagtctctaaagggttcttttggcccttgttttatgtccaaaatgctgacacatatcagcagccagggcct

SEQ ID NO: 404613 - DNA, 140 bp, Artificial Sequence
  Synthetic
aggccctggctgctgatatgaaggaactgtatcccttagcctccctcaaatcactctttggcaacgacccctcgtcacaataaagataggggggcaactaaaggaagctctattagatacgaccttttgggacagcggtg

SEQ ID NO: 404614 - DNA, 140 bp, Artificial Sequence
  Synthetic
caccgctgtcccaaaaggtcgtatctaatagagcttcctttagttgcccccctatctttattgtgacgaggggtcgttgccaaagagtgatttgagggaggctaagggatacagttccttcatatcagcagccagggcct

SEQ ID NO: 404615 - DNA, 140 bp, Artificial Sequence
  Synthetic
aggccctggctgctgatatgcatgtgtaaagttaaccccactttgtgttactttaaactgtactaatgctactatccccaatggcaataataactccacacaaaatgacagcctgatagagaccttttgggacagcggtg

SEQ ID NO: 404616 - DNA, 140 bp, Artificial Sequence
  Synthetic
caccgctgtcccaaaaggtctctatcaggctgtcattttgtgtggagttattattgccattggggatagtagcattagtacagtttaaagtaacacaaagtggggttaactttacacatgcatatcagcagccagggcct

SEQ ID NO: 404617 - DNA, 140 bp, Artificial Sequence
  Synthetic
aggccctggctgctgatatgaccaaatgaaagattgcagaaatggaaaacaggcaaattttttaggcaaatactggcctccggggggcacgaggccaggcaattatgtgcagaaacaagtgaccttttgggacagcggtg

SEQ ID NO: 404618 - DNA, 140 bp, Artificial Sequence
  Synthetic
caccgctgtcccaaaaggtcacttgtttctgcacataattgcctggcctcgtgccccccggaggccagtatttgcctaaaaaatttgcctgttttccatttctgcaatctttcatttggtcatatcagcagccagggcct

SEQ ID NO: 404619 - DNA, 140 bp, Artificial Sequence
  Synthetic
aggccctggctgctgatatgaccagcaatattccaatgtagcatgacaaaaatcttagagccttttagaaaacaaaatccagacatagttatctatcaatacatggatgatttgtatgtagaccttttgggacagcggtg

SEQ ID NO: 404620 - DNA, 140 bp, Artificial Sequence
  Synthetic
caccgctgtcccaaaaggtctacatacaaatcatccatgtattgatagataactatgtctggattttgttttctaaaaggctctaagatttttgtcatgctacattggaatattgctggtcatatcagcagccagggcct

SEQ ID NO: 404621 - DNA, 140 bp, Artificial Sequence
  Synthetic
aggccctggctgctgatatgtattaggacacatagttattcctaggtgtgactatcaagcaggacataataaggtaggatctctacaatacttggcactgacagcattgataaaaccaaagaccttttgggacagcggtg

SEQ ID NO: 404622 - DNA, 140 bp, Artificial Sequence
  Synthetic
caccgctgtcccaaaaggtctttggttttatcaatgctgtcagtgccaagtattgtagagatcctaccttattatgtcctgcttgatagtcacacctaggaataactatgtgtcctaatacatatcagcagccagggcct

SEQ ID NO: 404623 - DNA, 140 bp, Artificial Sequence
  Synthetic
atacgccatgctgggtctccgggggtgggaagttcttaagtatttaggaagccttgtgcagtattggtgtttagagctaaaagggagtgctattagcctgcttgatactgtagccatagccgtacttgggagtcggccat

SEQ ID NO: 404624 - DNA, 140 bp, Artificial Sequence
  Synthetic
atggccgactcccaagtacggctatggctacagtatcaagcaggctaatagcactcccttttagctctaaacaccaatactgcacaaggcttcctaaatacttaagaacttcccacccccggagacccagcatggcgtat

SEQ ID NO: 404625 - DNA, 140 bp, Artificial Sequence
  Synthetic
atacgccatgctgggtctccaaactgaagtaagaaactgttcttttaatataaccacagaaataaaggataagaagaagaaggtccaggcacttttttataggcttgacatagtaccaatcgtacttgggagtcggccat

SEQ ID NO: 404626 - DNA, 140 bp, Artificial Sequence
  Synthetic
atggccgactcccaagtacgattggtactatgtcaagcctataaaaaagtgcctggaccttcttcttcttatcctttatttctgtggttatattaaaagaacagtttcttacttcagtttggagacccagcatggcgtat

SEQ ID NO: 404627 - DNA, 140 bp, Artificial Sequence
  Synthetic
atacgccatgctgggtctccgtcactttaaattgtacacatgacgttaatgttactaaagtcaaaaatagcataagggaaataaaaaattgctctttcaatacaaccacagaaataagagcgtacttgggagtcggccat

SEQ ID NO: 404628 - DNA, 140 bp, Artificial Sequence
  Synthetic
atggccgactcccaagtacgctcttatttctgtggttgtattgaaagagcaattttttatttcccttatgctatttttgactttagtaacattaacgtcatgtgtacaatttaaagtgacggagacccagcatggcgtat

SEQ ID NO: 404629 - DNA, 140 bp, Artificial Sequence
  Synthetic
  misc_feature (34)..(34): n is a, c, g, or t
  misc_feature (53)..(53): n is a, c, g, or t
  misc_feature (66)..(66): n is a, c, g, or t
  misc_feature (115)..(115): n is a, c, g, or t
aggccctggctgctgatatgcacaggacaatgtncacatgggattaagccagnggtatcaactcanctgctggtaaatggcagcctagcagaaggagatatagtaatcaggcctnaaaatgaccttttgggacagcggtg

SEQ ID NO: 404630 - DNA, 140 bp, Artificial Sequence
  Synthetic
  misc_feature (26)..(26): n is a, c, g, or t
  misc_feature (75)..(75): n is a, c, g, or t
  misc_feature (88)..(88): n is a, c, g, or t
  misc_feature (107)..(107): n is a, c, g, or t
caccgctgtcccaaaaggtcattttnaggcctgattactatatctccttctgctaggctgccatttaccagcagntgagttgataccnctggcttaatcccatgtgnacattgtcctgtgcatatcagcagccagggcct

SEQ ID NO: 404631 - DNA, 140 bp, Artificial Sequence
  Synthetic
atacgccatgctgggtctccccctactaacataagctttagctcatcctcaggaggggacctagaaattacaacacatagctttaattgtagaggagaatttttctattgcaacacatcacgtacttgggagtcggccat

SEQ ID NO: 404632 - DNA, 140 bp, Artificial Sequence
  Synthetic
atggccgactcccaagtacgtgatgtgttgcaatagaaaaattctcctctacaattaaagctatgtgttgtaatttctaggtcccctcctgaggatgagctaaagcttatgttagtagggggagacccagcatggcgtat

SEQ ID NO: 404633 - DNA, 140 bp, Artificial Sequence
  Synthetic
atacgccatgctgggtctccgcgaggagagtatgagggaaataaaaaattgctctttcaacacaaccacagtggtaagagataagacgaaggcagtgcatgcacttttttatagacttgacgtacttgggagtcggccat

SEQ ID NO: 404634 - DNA, 140 bp, Artificial Sequence
  Synthetic
atggccgactcccaagtacgtcaagtctataaaaaagtgcatgcactgccttcgtcttatctcttaccactgtggttgtgttgaaagagcaattttttatttccctcatactctcctcgcggagacccagcatggcgtat

SEQ ID NO: 404635 - DNA, 140 bp, Artificial Sequence
  Synthetic
aggccctggctgctgatatgctatggcaggaagaagcggagacagcgacgaagagctcctcaagacagtaagactcatcaaagctctataccaaagcagtaagtagtacatgtaatgcaagaccttttgggacagcggtg

SEQ ID NO: 404636 - DNA, 140 bp, Artificial Sequence
  Synthetic
caccgctgtcccaaaaggtcttgcattacatgtactacttactgctttggtatagagctttgatgagtcttactgtcttgaggagctcttcgtcgctgtctccgcttcttcctgccatagcatatcagcagccagggcct

SEQ ID NO: 404637 - DNA, 140 bp, Artificial Sequence
  Synthetic
aggccctggctgctgatatggagggggtaggctttccagtcaggccgcaggtacctctaagaccaatgacttttaagggagcttttgatcttagcttctttttaaaagaaaaggggggacgaccttttgggacagcggtg

SEQ ID NO: 404638 - DNA, 140 bp, Artificial Sequence
  Synthetic
caccgctgtcccaaaaggtcgtccccccttttcttttaaaaagaagctaagatcaaaagctcccttaaaagtcattggtcttagaggtacctgcggcctgactggaaagcctaccccctccatatcagcagccagggcct

SEQ ID NO: 404639 - DNA, 140 bp, Artificial Sequence
  Synthetic
atacgccatgctgggtctcctgaaatgcaaggggaaataaaaaactgctctttcaatatgaccacagaactacgagacaagaatcggaaaatgcatgcacttttttatagacaagatatacgtacttgggagtcggccat

SEQ ID NO: 404640 - DNA, 140 bp, Artificial Sequence
  Synthetic
atggccgactcccaagtacgtatatcttgtctataaaaaagtgcatgcattttccgattcttgtctcgtagttctgtggtcatattgaaagagcagttttttatttccccttgcatttcaggagacccagcatggcgtat

SEQ ID NO: 404641 - DNA, 140 bp, Artificial Sequence
  Synthetic
atacgccatgctgggtctccgttttgaatatccgcgacatgaatagcactgctaatggtactctggttgggatggagacagaaatgacaaactgctctttcaatgtcacctcaagcatagcgtacttgggagtcggccat

SEQ ID NO: 404642 - DNA, 140 bp, Artificial Sequence
  Synthetic
atggccgactcccaagtacgctatgcttgaggtgacattgaaagagcagtttgtcatttctgtctccatcccaaccagagtaccattagcagtgctattcatgtcgcggatattcaaaacggagacccagcatggcgtat

SEQ ID NO: 404643 - DNA, 140 bp, Artificial Sequence
  Synthetic
aggccctggctgctgatatggaatagtttttgctgtactttctatagtgaatagagttaggcagggatactcaccattatcgttccagacccgcctcccagttccgaggggacccgacaggaccttttgggacagcggtg

SEQ ID NO: 404644 - DNA, 140 bp, Artificial Sequence
  Synthetic
caccgctgtcccaaaaggtcctgtcgggtcccctcggaactgggaggcgggtctggaacgataatggtgagtatccctgcctaactctattcactatagaaagtacagcaaaaactattccatatcagcagccagggcct

SEQ ID NO: 404645 - DNA, 140 bp, Artificial Sequence
  Synthetic
aggccctggctgctgatatgggaggagtaggctttccagtcagacctcaggtgcctctaagaccaatgacttataagggagcgtttgatcttggcttctttttaaaagaaaaggggggacgaccttttgggacagcggtg

SEQ ID NO: 404646 - DNA, 140 bp, Artificial Sequence
  Synthetic
caccgctgtcccaaaaggtcgtccccccttttcttttaaaaagaagccaagatcaaacgctcccttataagtcattggtcttagaggcacctgaggtctgactggaaagcctactcctcccatatcagcagccagggcct

SEQ ID NO: 404647 - DNA, 140 bp, Artificial Sequence
  Synthetic
aggccctggctgctgatatgcaactcaactgctgttaaatggcagtctagcagaaagagaggtagtgattagatctgaaaatttctcagataatgccaaaaccataatagtacagttagcgaccttttgggacagcggtg

SEQ ID NO: 404648 - DNA, 140 bp, Artificial Sequence
  Synthetic
caccgctgtcccaaaaggtcgctaactgtactattatggttttggcattatctgagaaattttcagatctaatcactacctctctttctgctagactgccatttaacagcagttgagttgcatatcagcagccagggcct

SEQ ID NO: 404649 - DNA, 140 bp, Artificial Sequence
  Synthetic
atacgccatgctgggtctccgtatacatatgggactagggcgaacattctatgcaacaggtgacataataggggatataagacaagcacattgtaatgttagtgcaaaagcttggaatgacgtacttgggagtcggccat

SEQ ID NO: 404650 - DNA, 140 bp, Artificial Sequence
  Synthetic
atggccgactcccaagtacgtcattccaagcttttgcactaacattacaatgtgcttgtcttatatcccctattatgtcacctgttgcatagaatgttcgccctagtcccatatgtatacggagacccagcatggcgtat

SEQ ID NO: 404651 - DNA, 140 bp, Artificial Sequence
  Synthetic
aggccctggctgctgatatgatgcaacaggagacataataggagatataagacaagcacattgtaaccttagtagcacagaatggagagacactttaaaacaggtagctataaaattaaggaccttttgggacagcggtg

SEQ ID NO: 404652 - DNA, 140 bp, Artificial Sequence
  Synthetic
caccgctgtcccaaaaggtccttaattttatagctacctgttttaaagtgtctctccattctgtgctactaaggttacaatgtgcttgtcttatatctcctattatgtctcctgttgcatcatatcagcagccagggcct

SEQ ID NO: 404653 - DNA, 140 bp, Artificial Sequence
  Synthetic
atacgccatgctgggtctccctgtgcatcttcctctaccaccgattgagggacttaatatcactgacagcgaggggactacagagggggtgggaagcccttaaatatctggcaggtcttgcgtacttgggagtcggccat

SEQ ID NO: 404654 - DNA, 140 bp, Artificial Sequence
  Synthetic
atggccgactcccaagtacgcaagacctgccagatatttaagggcttcccaccccctctgtagtcccctcgctgtcagtgatattaagtccctcaatcggtggtagaggaagatgcacagggagacccagcatggcgtat

SEQ ID NO: 404655 - DNA, 140 bp, Artificial Sequence
  Synthetic
aggccctggctgctgatatgggttgttggaaatgtggaaaggaaggacatcaaatgaaagactgcactgagagacaggctaattttttagggaaaatctggccttccaacaagggaaggcgaccttttgggacagcggtg

SEQ ID NO: 404656 - DNA, 140 bp, Artificial Sequence
  Synthetic
caccgctgtcccaaaaggtcgccttcccttgttggaaggccagattttccctaaaaaattagcctgtctctcagtgcagtctttcatttgatgtccttcctttccacatttccaacaacccatatcagcagccagggcct

SEQ ID NO: 404657 - DNA, 140 bp, Artificial Sequence
  Synthetic
atacgccatgctgggtctccggaatcgaaggagaaggtggagagagagacaaaggcagatccattcgattagtagatggattcttagcaatcatctgggacgatctgcggagcctgtgcccgtacttgggagtcggccat

SEQ ID NO: 404658 - DNA, 140 bp, Artificial Sequence
  Synthetic
atggccgactcccaagtacgggcacaggctccgcagatcgtcccagatgattgctaagaatccatctactaatcgaatggatctgcctttgtctctctctccaccttctccttcgattccggagacccagcatggcgtat

SEQ ID NO: 404659 - DNA, 140 bp, Artificial Sequence
  Synthetic
atacgccatgctgggtctccggcagcaagctttcaaaaagccgcatagtgggatgggctagggttagggaaagactaagacgaacccctccaacagcagaaagagtaagacgaccccctccgtacttgggagtcggccat

SEQ ID NO: 404660 - DNA, 140 bp, Artificial Sequence
  Synthetic
atggccgactcccaagtacggagggggtcgtcttactctttctgctgttggaggggttcgtcttagtctttccctaaccctagcccatcccactatgcggctttttgaaagcttgctgccggagacccagcatggcgtat

SEQ ID NO: 404661 - DNA, 140 bp, Artificial Sequence
  Synthetic
atacgccatgctgggtctcccgtagcatgggtgggtggactaatataagggaaagaatgagaagaactccagcaactgagccaccagcagatggggtgggagcagcatctcaagatttggcgtacttgggagtcggccat

SEQ ID NO: 404662 - DNA, 140 bp, Artificial Sequence
  Synthetic
atggccgactcccaagtacgccaaatcttgagatgctgctcccaccccatctgctggtggctcagttgctggagttcttctcattctttcccttatattagtccacccacccatgctacgggagacccagcatggcgtat

SEQ ID NO: 404663 - DNA, 140 bp, Artificial Sequence
  Synthetic
aggccctggctgctgatatggaggaggtaggctttccagtcaggccacaggtacctttgagaccaatgacttataaggcagctgtcgatctcagccactttttaaaagaaaaggggggacgaccttttgggacagcggtg

SEQ ID NO: 404664 - DNA, 140 bp, Artificial Sequence
  Synthetic
caccgctgtcccaaaaggtcgtccccccttttcttttaaaaagtggctgagatcgacagctgccttataagtcattggtctcaaaggtacctgtggcctgactggaaagcctacctcctccatatcagcagccagggcct

SEQ ID NO: 404665 - DNA, 140 bp, Artificial Sequence
  Synthetic
aggccctggctgctgatatgtggagagatacctaagggatcaacagctcctggggatttggggttgctctggaaaactcatctgcaccactgctgtgccttggaatactagttggagtaagaccttttgggacagcggtg

SEQ ID NO: 404666 - DNA, 140 bp, Artificial Sequence
  Synthetic
caccgctgtcccaaaaggtcttactccaactagtattccaaggcacagcagtggtgcagatgagttttccagagcaaccccaaatccccaggagctgttgatcccttaggtatctctccacatatcagcagccagggcct

SEQ ID NO: 404667 - DNA, 140 bp, Artificial Sequence
  Synthetic
aggccctggctgctgatatgatcagatgctaaagcatatgagaaagaagtgcataatgtctgggctacacatgcctgtgtacccacagaccccagcccacaagaaatagttttggaaaatgaccttttgggacagcggtg

SEQ ID NO: 404668 - DNA, 140 bp, Artificial Sequence
  Synthetic
caccgctgtcccaaaaggtcattttccaaaactatttcttgtgggctggggtctgtgggtacacaggcatgtgtagcccagacattatgcacttctttctcatatgctttagcatctgatcatatcagcagccagggcct

SEQ ID NO: 404669 - DNA, 140 bp, Artificial Sequence
  Synthetic
atacgccatgctgggtctccgctgaaatgaagggagaaataaaaaattgctctttccatatatccacagaaatgagagataagagacaaaaggaatttgcactttttaatatacttgatacgtacttgggagtcggccat

SEQ ID NO: 404670 - DNA, 140 bp, Artificial Sequence
  Synthetic
atggccgactcccaagtacgtatcaagtatattaaaaagtgcaaattccttttgtctcttatctctcatttctgtggatatatggaaagagcaattttttatttctcccttcatttcagcggagacccagcatggcgtat

SEQ ID NO: 404671 - DNA, 140 bp, Artificial Sequence
  Synthetic
aggccctggctgctgatatggtcagcacagtacaatgtacacatggaattaagccagtggtatcaactcaactactgttaaatggtagtctagcagaaaaagagatagtaattagatctggaccttttgggacagcggtg

SEQ ID NO: 404672 - DNA, 140 bp, Artificial Sequence
  Synthetic
caccgctgtcccaaaaggtccagatctaattactatctctttttctgctagactaccatttaacagtagttgagttgataccactggcttaattccatgtgtacattgtactgtgctgaccatatcagcagccagggcct

SEQ ID NO: 404673 - DNA, 140 bp, Artificial Sequence
  Synthetic
aggccctggctgctgatatgactctagttggagtaataaaacttatgatgaaatttggaacaacatgacctggatgcagtgggaaaaggagattagcaatcactcagaaacaatatacaggaccttttgggacagcggtg

SEQ ID NO: 404674 - DNA, 140 bp, Artificial Sequence
  Synthetic
caccgctgtcccaaaaggtcctgtatattgtttctgagtgattgctaatctccttttcccactgcatccaggtcatgttgttccaaatttcatcataagttttattactccaactagagtcatatcagcagccagggcct

SEQ ID NO: 404675 - DNA, 140 bp, Artificial Sequence
  Synthetic
atacgccatgctgggtctccgtagaaattgagtgtagaaggcccaacaataacacaggaaaaagtgtgaggataggaccaggacaaacattctttgcaacaggaggcataataggggaaacgtacttgggagtcggccat

SEQ ID NO: 404676 - DNA, 140 bp, Artificial Sequence
  Synthetic
atggccgactcccaagtacgtttcccctattatgcctcctgttgcaaagaatgtttgtcctggtcctatcctcacactttttcctgtgttattgttgggccttctacactcaatttctacggagacccagcatggcgtat

SEQ ID NO: 404677 - DNA, 140 bp, Artificial Sequence
  Synthetic
aggccctggctgctgatatggataggaccaggacaaacattctttgcaacaggaggcataataggggaaataagacgagcacattgtgacatcaatggaacgaaatggaccgaaactttagaccttttgggacagcggtg

SEQ ID NO: 404678 - DNA, 140 bp, Artificial Sequence
  Synthetic
caccgctgtcccaaaaggtctaaagtttcggtccatttcgttccattgatgtcacaatgtgctcgtcttatttcccctattatgcctcctgttgcaaagaatgtttgtcctggtcctatccatatcagcagccagggcct

SEQ ID NO: 404679 - DNA, 140 bp, Artificial Sequence
  Synthetic
aggccctggctgctgatatgtgcaccatcctcaggaggggacccagaaattacaacacatagctttaattgtagaggagaatttttctattgcaatacatcacaactgtttaatagtacagaccttttgggacagcggtg

SEQ ID NO: 404680 - DNA, 140 bp, Artificial Sequence
  Synthetic
caccgctgtcccaaaaggtctgtactattaaacagttgtgatgtattgcaatagaaaaattctcctctacaattaaagctatgtgttgtaatttctgggtcccctcctgaggatggtgcacatatcagcagccagggcct

SEQ ID NO: 404681 - DNA, 140 bp, Artificial Sequence
  Synthetic
atacgccatgctgggtctcccaaccatagtgggaaatataacaaatgaagtgaaaaactgttcttttaatatgaccacagaatttagagataagaagcagaaggtctatgcacttttttacgtacttgggagtcggccat

SEQ ID NO: 404682 - DNA, 140 bp, Artificial Sequence
  Synthetic
atggccgactcccaagtacgtaaaaaagtgcatagaccttctgcttcttatctctaaattctgtggtcatattaaaagaacagtttttcacttcatttgttatatttcccactatggttgggagacccagcatggcgtat

SEQ ID NO: 404683 - DNA, 140 bp, Artificial Sequence
  Synthetic
atacgccatgctgggtctccaattgctctttcaattctaccacagaaataagagataagaaacagaaagtgtatgcacttttttatgggtctgatgtagtaccacttaatgagaatagcccgtacttgggagtcggccat

SEQ ID NO: 404684 - DNA, 140 bp, Artificial Sequence
  Synthetic
atggccgactcccaagtacgggctattctcattaagtggtactacatcagacccataaaaaagtgcatacactttctgtttcttatctcttatttctgtggtagaattgaaagagcaattggagacccagcatggcgtat

SEQ ID NO: 404685 - DNA, 140 bp, Artificial Sequence
  Synthetic
atacgccatgctgggtctcccagacaatggcagcaatttcaccagtgctgcagtaaaggcagcatgttggtgggcaagtatcacacaagaatttggaattccctacaatccccaaagtcacgtacttgggagtcggccat

SEQ ID NO: 404686 - DNA, 140 bp, Artificial Sequence
  Synthetic
atggccgactcccaagtacgtgactttggggattgtagggaattccaaattcttgtgtgatacttgcccaccaacatgctgcctttactgcagcactggtgaaattgctgccattgtctgggagacccagcatggcgtat

SEQ ID NO: 404687 - DNA, 140 bp, Artificial Sequence
  Synthetic
aggccctggctgctgatatgtatctgggaagtcttgtgcagtattggggtctggaactaaaaaagagtgctattagtctgcttgataccatagcaatagcagtagctgaaggaacagatagaccttttgggacagcggtg

SEQ ID NO: 404688 - DNA, 140 bp, Artificial Sequence
  Synthetic
caccgctgtcccaaaaggtctatctgttccttcagctactgctattgctatggtatcaagcagactaatagcactcttttttagttccagaccccaatactgcacaagacttcccagatacatatcagcagccagggcct

SEQ ID NO: 404689 - DNA, 140 bp, Artificial Sequence
  Synthetic
aggccctggctgctgatatgacaagacccaacaataatacaagaaaaagtataaggataggaccaggacaaacattctatgcaaataatgacataataggagacataagacaagcacattgaccttttgggacagcggtg

SEQ ID NO: 404690 - DNA, 140 bp, Artificial Sequence
  Synthetic
caccgctgtcccaaaaggtcaatgtgcttgtcttatgtctcctattatgtcattatttgcatagaatgtttgtcctggtcctatccttatactttttcttgtattattgttgggtcttgtcatatcagcagccagggcct

SEQ ID NO: 404691 - DNA, 140 bp, Artificial Sequence
  Synthetic
atacgccatgctgggtctccgtggcgcccgaacagggacttgaaagcgaaagtaaaaccagaggagatctctcgacgcaggactcggcttgctgaaagtgcactcggcaagaggcgagagcgtacttgggagtcggccat

SEQ ID NO: 404692 - DNA, 140 bp, Artificial Sequence
  Synthetic
atggccgactcccaagtacgctctcgcctcttgccgagtgcactttcagcaagccgagtcctgcgtcgagagatctcctctggttttactttcgctttcaagtccctgttcgggcgccacggagacccagcatggcgtat

SEQ ID NO: 404693 - DNA, 140 bp, Artificial Sequence
  Synthetic
atacgccatgctgggtctcctagttagccctagatgtgagtttcaagcaggacacaataaggtaggatctctgcaatatttggcactgaaagcattagtaaagcagccaaggagaaagcccgtacttgggagtcggccat

SEQ ID NO: 404694 - DNA, 140 bp, Artificial Sequence
  Synthetic
atggccgactcccaagtacgggctttctccttggctgctttactaatgctttcagtgccaaatattgcagagatcctaccttattgtgtcctgcttgaaactcacatctagggctaactaggagacccagcatggcgtat

SEQ ID NO: 404695 - DNA, 140 bp, Artificial Sequence
  Synthetic
aggccctggctgctgatatgaaacatgtggcaggaagtgggacgagcaatgtatgctgctcccattgcaggaagaattacctgtaactcaaatattacaggtctactattgacaagagatgaccttttgggacagcggtg

SEQ ID NO: 404696 - DNA, 140 bp, Artificial Sequence
  Synthetic
caccgctgtcccaaaaggtcatctcttgtcaatagtagacctgtaatatttgagttacaggtaattcttcctgcaatgggagcagcatacattgctcgtcccacttcctgccacatgtttcatatcagcagccagggcct

SEQ ID NO: 404697 - DNA, 140 bp, Artificial Sequence
  Synthetic
aggccctggctgctgatatgaaaatgacatggtggatcagatgcatgaggatataatcagtttatgggatcaaagcctaaagccatgtgtaaagttgaccccactctgtgtcactttaaagaccttttgggacagcggtg

SEQ ID NO: 404698 - DNA, 140 bp, Artificial Sequence
  Synthetic
caccgctgtcccaaaaggtctttaaagtgacacagagtggggtcaactttacacatggctttaggctttgatcccataaactgattatatcctcatgcatctgatccaccatgtcattttcatatcagcagccagggcct

SEQ ID NO: 404699 - DNA, 140 bp, Artificial Sequence
  Synthetic
atacgccatgctgggtctccatcaaaatcctgtatcaaagcagtgagtaataataatcagtatatgtaatgcagttttcagatcctttaacaatagcttcaatagtaggactagtagtagcgtacttgggagtcggccat

SEQ ID NO: 404700 - DNA, 140 bp, Artificial Sequence
  Synthetic
atggccgactcccaagtacgctactactagtcctactattgaagctattgttaaaggatctgaaaactgcattacatatactgattattattactcactgctttgatacaggattttgatggagacccagcatggcgtat

SEQ ID NO: 404701 - DNA, 140 bp, Artificial Sequence
  Synthetic
aggccctggctgctgatatgaataatacaagacaaagtataagaataggaccaggacaaacattctatgcaacaggagacataataggagacataagacaagcacattgtaacattagtagaccttttgggacagcggtg

SEQ ID NO: 404702 - DNA, 140 bp, Artificial Sequence
  Synthetic
caccgctgtcccaaaaggtctactaatgttacaatgtgcttgtcttatgtctcctattatgtctcctgttgcatagaatgtttgtcctggtcctattcttatactttgtcttgtattattcatatcagcagccagggcct

SEQ ID NO: 404703 - DNA, 140 bp, Artificial Sequence
  Synthetic
aggccctggctgctgatatgcacttccctaataaaaacataacatttaaaccatcctcaggaggggacctagaaattacaacacatagctttaattgtagaggagaatttttctattgcagaccttttgggacagcggtg

SEQ ID NO: 404704 - DNA, 140 bp, Artificial Sequence
  Synthetic
caccgctgtcccaaaaggtctgcaatagaaaaattctcctctacaattaaagctatgtgttgtaatttctaggtcccctcctgaggatggtttaaatgttatgtttttattagggaagtgcatatcagcagccagggcct

SEQ ID NO: 404705 - DNA, 140 bp, Artificial Sequence
  Synthetic
aggccctggctgctgatatgtgctctttcaatatgaccacagaattaagagataagaaacagaatgtgtatgcacttttttatagacttgatgtagtaccaattgatgcaaaaagtagtagaccttttgggacagcggtg

SEQ ID NO: 404706 - DNA, 140 bp, Artificial Sequence
  Synthetic
caccgctgtcccaaaaggtctactactttttgcatcaattggtactacatcaagtctataaaaaagtgcatacacattctgtttcttatctcttaattctgtggtcatattgaaagagcacatatcagcagccagggcct

SEQ ID NO: 404707 - DNA, 140 bp, Artificial Sequence
  Synthetic
aggccctggctgctgatatgttaagccattgggaatagcacccactgaggcaaaaaggagagtggtggagagagaaaaaagagcagtgggaataggagctgtgttccttgggttcttggggaccttttgggacagcggtg

SEQ ID NO: 404708 - DNA, 140 bp, Artificial Sequence
  Synthetic
caccgctgtcccaaaaggtccccaagaacccaaggaacacagctcctattcccactgctcttttttctctctccaccactctcctttttgcctcagtgggtgctattcccaatggcttaacatatcagcagccagggcct

SEQ ID NO: 404709 - DNA, 140 bp, Artificial Sequence
  Synthetic
atacgccatgctgggtctcctacaagaaaaggtatacatctaggaggagtagggagagcattctatgtaaaaggacaaataataggagatataagacaagcacattgtaacgttagcagacgtacttgggagtcggccat

SEQ ID NO: 404710 - DNA, 140 bp, Artificial Sequence
  Synthetic
atggccgactcccaagtacgtctgctaacgttacaatgtgcttgtcttatatctcctattatttgtccttttacatagaatgctctccctactcctcctagatgtataccttttcttgtaggagacccagcatggcgtat

SEQ ID NO: 404711 - DNA, 140 bp, Artificial Sequence
  Synthetic
aggccctggctgctgatatgatcaacacaactgctgttgaatggtagtctagcagaaaaagaggtagtgattagatctgaaaatatctcagacaatgccaaaatcataatagtacagttggaccttttgggacagcggtg

SEQ ID NO: 404712 - DNA, 140 bp, Artificial Sequence
  Synthetic
caccgctgtcccaaaaggtccaactgtactattatgattttggcattgtctgagatattttcagatctaatcactacctctttttctgctagactaccattcaacagcagttgtgttgatcatatcagcagccagggcct

SEQ ID NO: 404713 - DNA, 140 bp, Artificial Sequence
  Synthetic
atacgccatgctgggtctccaagtatacatataggaccagggcaagcatgggatgcaacaacaaaaataataggggatataagaaaagcatattgtaatgtcagtaaagcaaaatggaatcgtacttgggagtcggccat

SEQ ID NO: 404714 - DNA, 140 bp, Artificial Sequence
  Synthetic
atggccgactcccaagtacgattccattttgctttactgacattacaatatgcttttcttatatcccctattatttttgttgttgcatcccatgcttgccctggtcctatatgtatacttggagacccagcatggcgtat

SEQ ID NO: 404715 - DNA, 140 bp, Artificial Sequence
  Synthetic
aggccctggctgctgatatggcagaataaaacagattataaacagatggcaggaagtagggaaagcaatgtatgcccctcccattagtggactaattagatgtgtatcaaatattacagggaccttttgggacagcggtg

SEQ ID NO: 404716 - DNA, 140 bp, Artificial Sequence
  Synthetic
caccgctgtcccaaaaggtccctgtaatatttgatacacatctaattagtccactaatgggaggggcatacattgctttccctacttcctgccatctgtttataatctgttttattctgccatatcagcagccagggcct

SEQ ID NO: 404717 - DNA, 140 bp, Artificial Sequence
  Synthetic
atacgccatgctgggtctccatagttttaattgtagaggagaatttttctattgcgatacatcagggctgtttaatagcacttgggataacattaccagtacaaatggcacaaaggtaaacgtacttgggagtcggccat

SEQ ID NO: 404718 - DNA, 140 bp, Artificial Sequence
  Synthetic
atggccgactcccaagtacgtttacctttgtgccatttgtactggtaatgttatcccaagtgctattaaacagccctgatgtatcgcaatagaaaaattctcctctacaattaaaactatggagacccagcatggcgtat

SEQ ID NO: 404719 - DNA, 140 bp, Artificial Sequence
  Synthetic
aggccctggctgctgatatgtgtggcagagagtaggacaagcaatgtatgcccctcctatccaaggagaactacggtgtgaatcaaatattacaggactactattaacaagagatggagggaccttttgggacagcggtg

SEQ ID NO: 404720 - DNA, 140 bp, Artificial Sequence
  Synthetic
caccgctgtcccaaaaggtccctccatctcttgttaatagtagtcctgtaatatttgattcacaccgtagttctccttggataggaggggcatacattgcttgtcctactctctgccacacatatcagcagccagggcct

SEQ ID NO: 404721 - DNA, 140 bp, Artificial Sequence
  Synthetic
aggccctggctgctgatatgagcgcaaaaccaacaggaaaagaatgaacaagagttattgcaattggatatgtgggcaagtttgtggaattggtttagcataacaaaatggctgtggtatgaccttttgggacagcggtg

SEQ ID NO: 404722 - DNA, 140 bp, Artificial Sequence
  Synthetic
caccgctgtcccaaaaggtcataccacagccattttgttatgctaaaccaattccacaaacttgcccacatatccaattgcaataactcttgttcattcttttcctgttggttttgcgctcatatcagcagccagggcct

SEQ ID NO: 404723 - DNA, 140 bp, Artificial Sequence
  Synthetic
aggccctggctgctgatatggagtaataaatctctagaaaaaatttgggataacatgacctggatgcagtgggaaagagaaattgacaattacacaggcataatatatgacctacttgaagaccttttgggacagcggtg

SEQ ID NO: 404724 - DNA, 140 bp, Artificial Sequence
  Synthetic
caccgctgtcccaaaaggtcttcaagtaggtcatatattatgcctgtgtaattgtcaatttctctttcccactgcatccaggtcatgttatcccaaattttttctagagatttattactccatatcagcagccagggcct

SEQ ID NO: 404725 - DNA, 140 bp, Artificial Sequence
  Synthetic
aggccctggctgctgatatgtttgcttgatacaatagcaatagcagtagctaactggacagatagagttatagaaataggacaaggagctattagagctattcgcaacgtacctagaagagaccttttgggacagcggtg

SEQ ID NO: 404726 - DNA, 140 bp, Artificial Sequence
  Synthetic
caccgctgtcccaaaaggtctcttctaggtacgttgcgaatagctctaatagctccttgtcctatttctataactctatctgtccagttagctactgctattgctattgtatcaagcaaacatatcagcagccagggcct

SEQ ID NO: 404727 - DNA, 140 bp, Artificial Sequence
  Synthetic
atacgccatgctgggtctcccaaaaagcagcatagtgggatggcctaaggttagggaaagaataagacaaacccctgtagcagcagacacccctggagcagcaaaaggagtaggagcagccgtacttgggagtcggccat

SEQ ID NO: 404728 - DNA, 140 bp, Artificial Sequence
  Synthetic
atggccgactcccaagtacggctgctcctactccttttgctgctccaggggtgtctgctgctacaggggtttgtcttattctttccctaaccttaggccatcccactatgctgctttttgggagacccagcatggcgtat

SEQ ID NO: 404729 - DNA, 140 bp, Artificial Sequence
  Synthetic
atacgccatgctgggtctccgtggcgcccgaacagggacttgaaaacgaaagtagaaccggaggctgaatctctcgacgcaggactcggctcgttggtgcacacagcgagaggcgaggcgcgtacttgggagtcggccat

SEQ ID NO: 404730 - DNA, 140 bp, Artificial Sequence
  Synthetic
atggccgactcccaagtacgcgcctcgcctctcgctgtgtgcaccaacgagccgagtcctgcgtcgagagattcagcctccggttctactttcgttttcaagtccctgttcgggcgccacggagacccagcatggcgtat

SEQ ID NO: 404731 - DNA, 140 bp, Artificial Sequence
  Synthetic
atacgccatgctgggtctcctttaaaagctttgggcccagggccttcacttgaagaactgacgacccctggtccgggagtgggaggacctagccataaggcaagagttttggctgaggcacgtacttgggagtcggccat

SEQ ID NO: 404732 - DNA, 140 bp, Artificial Sequence
  Synthetic
atggccgactcccaagtacgtgcctcagccaaaactcttgccttatggctaggtcctcccactcccggaccaggggtcgtcagttcttcaagtgaaggccctgggcccaaagcttttaaaggagacccagcatggcgtat

SEQ ID NO: 404733 - DNA, 140 bp, Artificial Sequence
  Synthetic
aggccctggctgctgatatggggccaaagaagaattgttaaatgttttaattgtggcaaagaaggacacatagccaaaaattgcagggcccctagaaaaaagggctgttggaaatgtggagaccttttgggacagcggtg

SEQ ID NO: 404734 - DNA, 140 bp, Artificial Sequence
  Synthetic
caccgctgtcccaaaaggtctccacatttccaacagcccttttttctaggggccctgcaatttttggctatgtgtccttctttgccacaattaaaacatttaacaattcttctttggccccatatcagcagccagggcct

SEQ ID NO: 404735 - DNA, 140 bp, Artificial Sequence
  Synthetic
aggccctggctgctgatatggtattggaccagggcaaacattctatgcaacaggtgacataataggggatataagacaagcacattgtaatgtcagtagagaaaaatggaatagcactttgaccttttgggacagcggtg

SEQ ID NO: 404736 - DNA, 140 bp, Artificial Sequence
  Synthetic
caccgctgtcccaaaaggtcaaagtgctattccatttttctctactgacattacaatgtgcttgtcttatatcccctattatgtcacctgttgcatagaatgtttgccctggtccaataccatatcagcagccagggcct

SEQ ID NO: 404737 - DNA, 140 bp, Artificial Sequence
  Synthetic
aggccctggctgctgatatgaaataaaagcattaacagaaatttgtacagaaatggaaaaggaaggaaaaatttcaaaaattgggcctgaaaatccatacaatactccagtatttgccatgaccttttgggacagcggtg

SEQ ID NO: 404738 - DNA, 140 bp, Artificial Sequence
  Synthetic
caccgctgtcccaaaaggtcatggcaaatactggagtattgtatggattttcaggcccaatttttgaaatttttccttccttttccatttctgtacaaatttctgttaatgcttttatttcatatcagcagccagggcct

SEQ ID NO: 404739 - DNA, 140 bp, Artificial Sequence
  Synthetic
atacgccatgctgggtctcctactctaaactgtagtgatgttatcaatagcactggtactatgaaaaattgttctttcagtgtaaccacagagctaagagataggaaacagaagaaacatcgtacttgggagtcggccat

SEQ ID NO: 404740 - DNA, 140 bp, Artificial Sequence
  Synthetic
atggccgactcccaagtacgatgtttcttctgtttcctatctcttagctctgtggttacactgaaagaacaatttttcatagtaccagtgctattgataacatcactacagtttagagtaggagacccagcatggcgtat

SEQ ID NO: 404741 - DNA, 140 bp, Artificial Sequence
  Synthetic
aggccctggctgctgatatgacaagcagggcctgttgcaccaggccaaatgagagacccaataggaaatgacatagcaggaactactagtacccttcaggaacaaatagcatagataacagaccttttgggacagcggtg

SEQ ID NO: 404742 - DNA, 140 bp, Artificial Sequence
  Synthetic
caccgctgtcccaaaaggtctgttatctatgctatttgttcctgaagggtactagtagttcctgctatgtcatttcctattgggtctctcatttggcctggtgcaacaggccctgcttgtcatatcagcagccagggcct

SEQ ID NO: 404743 - DNA, 140 bp, Artificial Sequence
  Synthetic
atacgccatgctgggtctccagacgtaataggagacataagacaagcacattgtaacattagtaaagctgactggaataaaaccttacaaggggtaagtaaaaaattaatagaactcttccgtacttgggagtcggccat

SEQ ID NO: 404744 - DNA, 140 bp, Artificial Sequence
  Synthetic
atggccgactcccaagtacggaagagttctattaattttttacttaccccttgtaaggttttattccagtcagctttactaatgttacaatgtgcttgtcttatgtctcctattacgtctggagacccagcatggcgtat

SEQ ID NO: 404745 - DNA, 140 bp, Artificial Sequence
  Synthetic
atacgccatgctgggtctcctatttggcagaacatgacctggatggagtgggatagagaaattaacaattacacaaacacaatatacagactgcttgaagaatcacagaaccagcaggagcgtacttgggagtcggccat

SEQ ID NO: 404746 - DNA, 140 bp, Artificial Sequence
  Synthetic
atggccgactcccaagtacgctcctgctggttctgtgattcttcaagcagtctgtatattgtgtttgtgtaattgttaatttctctatcccactccatccaggtcatgttctgccaaataggagacccagcatggcgtat

SEQ ID NO: 404747 - DNA, 140 bp, Artificial Sequence
  Synthetic
aggccctggctgctgatatgtggagaagtgaattatataaatataaagtggtagaaattaaaccattaggagtagcacccactaaggcaaaaaggagagtggtggagagagaaaaaagaggaccttttgggacagcggtg

SEQ ID NO: 404748 - DNA, 140 bp, Artificial Sequence
  Synthetic
caccgctgtcccaaaaggtcctcttttttctctctccaccactctcctttttgccttagtgggtgctactcctaatggtttaatttctaccactttatatttatataattcacttctccacatatcagcagccagggcct

SEQ ID NO: 404749 - DNA, 140 bp, Artificial Sequence
  Synthetic
atacgccatgctgggtctccaatgctaccagtgagaatagcatgcggggagaagtaaaaaattgctctttcaacataaccacagaaataagagataagaaacagaaagcatttgcactttcgtacttgggagtcggccat

SEQ ID NO: 404750 - DNA, 140 bp, Artificial Sequence
  Synthetic
atggccgactcccaagtacgaaagtgcaaatgctttctgtttcttatctcttatttctgtggttatgttgaaagagcaattttttacttctccccgcatgctattctcactggtagcattggagacccagcatggcgtat

SEQ ID NO: 404751 - DNA, 140 bp, Artificial Sequence
  Synthetic
atacgccatgctgggtctcccattgcaataaaatggggggcaaatggtcaaaaagtagtccagtgggatggcctaatataagagaaagaataagaagaactgatccagcagcagagggagcgtacttgggagtcggccat

SEQ ID NO: 404752 - DNA, 140 bp, Artificial Sequence
  Synthetic
atggccgactcccaagtacgctccctctgctgctggatcagttcttcttattctttctcttatattaggccatcccactggactactttttgaccatttgccccccattttattgcaatgggagacccagcatggcgtat

SEQ ID NO: 404753 - DNA, 140 bp, Artificial Sequence
  Synthetic
atacgccatgctgggtctccatctgctataagaaatgccatattaggacgtatagttagacctaggtgtgattatcaagcaggacataacaaggtaggatctctacagtacttggcactacgtacttgggagtcggccat

SEQ ID NO: 404754 - DNA, 140 bp, Artificial Sequence
  Synthetic
atggccgactcccaagtacgtagtgccaagtactgtagagatcctaccttgttatgtcctgcttgataatcacacctaggtctaactatacgtcctaatatggcatttcttatagcagatggagacccagcatggcgtat

SEQ ID NO: 404755 - DNA, 140 bp, Artificial Sequence
  Synthetic
atacgccatgctgggtctccacaatgagagcgtggaggaaataaaaaattgctctttcaatgcaaccacagaattaaaaaataagaagcagaaagtgcgtgcacttttttataaacttgacgtacttgggagtcggccat

SEQ ID NO: 404756 - DNA, 140 bp, Artificial Sequence
  Synthetic
atggccgactcccaagtacgtcaagtttataaaaaagtgcacgcactttctgcttcttattttttaattctgtggttgcattgaaagagcaattttttatttcctccacgctctcattgtggagacccagcatggcgtat

SEQ ID NO: 404757 - DNA, 140 bp, Artificial Sequence
  Synthetic
aggccctggctgctgatatgagcaatagtagcattagtaatagtagcaataatagcaatagttgtgtggaccatagtatttttagaatataggaaaatattaaaacaaagaaaaatagacgaccttttgggacagcggtg

SEQ ID NO: 404758 - DNA, 140 bp, Artificial Sequence
  Synthetic
caccgctgtcccaaaaggtcgtctatttttctttgttttaatattttcctatattctaaaaatactatggtccacacaactattgctattattgctactattactaatgctactattgctcatatcagcagccagggcct

SEQ ID NO: 404759 - DNA, 140 bp, Artificial Sequence
  Synthetic
aggccctggctgctgatatgccatcctcaggaggggacccagaaattgcaacacatagctttaattgtggaggagaatttttctattgtaatacatcaaacctgtttaatagtacatacagaccttttgggacagcggtg

SEQ ID NO: 404760 - DNA, 140 bp, Artificial Sequence
  Synthetic
caccgctgtcccaaaaggtctgtatgtactattaaacaggtttgatgtattacaatagaaaaattctcctccacaattaaagctatgtgttgcaatttctgggtcccctcctgaggatggcatatcagcagccagggcct

SEQ ID NO: 404761 - DNA, 140 bp, Artificial Sequence
  Synthetic
atacgccatgctgggtctccaaactgctctttcaatgtcacctcaagcataggaaataagatgcagaaagaatatgcacttttttataaacttgatgtagtaccaataaataatgatagtcgtacttgggagtcggccat

SEQ ID NO: 404762 - DNA, 140 bp, Artificial Sequence
  Synthetic
atggccgactcccaagtacgactatcattatttattggtactacatcaagtttataaaaaagtgcatattctttctgcatcttatttcctatgcttgaggtgacattgaaagagcagtttggagacccagcatggcgtat

SEQ ID NO: 404763 - DNA, 140 bp, Artificial Sequence
  Synthetic
atacgccatgctgggtctcccactgggacaatagatggcaacatgcatggggaaataaaaaactgctctttcaatatgaccacagaattaagagacaaggaaaagaaaatgcatgcactccgtacttgggagtcggccat

SEQ ID NO: 404764 - DNA, 140 bp, Artificial Sequence
  Synthetic
atggccgactcccaagtacggagtgcatgcattttcttttccttgtctcttaattctgtggtcatattgaaagagcagttttttatttccccatgcatgttgccatctattgtcccagtgggagacccagcatggcgtat

SEQ ID NO: 404765 - DNA, 140 bp, Artificial Sequence
  Synthetic
aggccctggctgctgatatggatttattagcattggacagttggcaaaatctgtggagttggtttagcataacaaattggctgtggtatataaaaatattcataatgatagtaggaggctgaccttttgggacagcggtg

SEQ ID NO: 404766 - DNA, 140 bp, Artificial Sequence
  Synthetic
caccgctgtcccaaaaggtcagcctcctactatcattatgaatatttttatataccacagccaatttgttatgctaaaccaactccacagattttgccaactgtccaatgctaataaatccatatcagcagccagggcct

SEQ ID NO: 404767 - DNA, 140 bp, Artificial Sequence
  Synthetic
atacgccatgctgggtctccaaataaaacaataaccttcgatctctcctcaggaggggacccagaaattatgctgcacagtttcagttgtggaggggaattcttctactgtaatacaacacgtacttgggagtcggccat

SEQ ID NO: 404768 - DNA, 140 bp, Artificial Sequence
  Synthetic
atggccgactcccaagtacgtgttgtattacagtagaagaattcccctccacaactgaaactgtgcagcataatttctgggtcccctcctgaggagagatcgaaggttattgttttatttggagacccagcatggcgtat

SEQ ID NO: 404769 - DNA, 140 bp, Artificial Sequence
  Synthetic
aggccctggctgctgatatgtaggaccagggcaaacattctttgcaacaggtgaaataatagggaatataagacaagcacattgtaatgtcagtagatcaaaatggaatcacactttacagaccttttgggacagcggtg

SEQ ID NO: 404770 - DNA, 140 bp, Artificial Sequence
  Synthetic
caccgctgtcccaaaaggtctgtaaagtgtgattccattttgatctactgacattacaatgtgcttgtcttatattccctattatttcacctgttgcaaagaatgtttgccctggtcctacatatcagcagccagggcct

SEQ ID NO: 404771 - DNA, 140 bp, Artificial Sequence
  Synthetic
aggccctggctgctgatatgttgctaaacactcaggaggggatttagagattacaacacatagttttaattgtagaggagaatttttctattgcaatacatcaggattgtttaataacaagaccttttgggacagcggtg

SEQ ID NO: 404772 - DNA, 140 bp, Artificial Sequence
  Synthetic
caccgctgtcccaaaaggtcttgttattaaacaatcctgatgtattgcaatagaaaaattctcctctacaattaaaactatgtgttgtaatctctaaatcccctcctgagtgtttagcaacatatcagcagccagggcct

SEQ ID NO: 404773 - DNA, 140 bp, Artificial Sequence
  Synthetic
atacgccatgctgggtctccaatgatgcagagaggcaattttaagggccagaaaagaattaagtgcttcaactgtggcaaagaaggacacctagccagaaattgcagggcccctagaaaacgtacttgggagtcggccat

SEQ ID NO: 404774 - DNA, 140 bp, Artificial Sequence
  Synthetic
atggccgactcccaagtacgttttctaggggccctgcaatttctggctaggtgtccttctttgccacagttgaagcacttaattcttttctggcccttaaaattgcctctctgcatcattggagacccagcatggcgtat

SEQ ID NO: 404775 - DNA, 140 bp, Artificial Sequence
  Synthetic
atacgccatgctgggtctccgtgaaaccttcaggccgggaggaggagatatgagggacaattggagaagcgaactatacaagtataaagtagtacaaattgaaccaataggagtagcacccgtacttgggagtcggccat

SEQ ID NO: 404776 - DNA, 140 bp, Artificial Sequence
  Synthetic
atggccgactcccaagtacgggtgctactcctattggttcaatttgtactactttatacttgtatagttcgcttctccaattgtccctcatatctcctcctcccggcctgaaggtttcacggagacccagcatggcgtat

SEQ ID NO: 404777 - DNA, 140 bp, Artificial Sequence
  Synthetic
aggccctggctgctgatatgttgctataaaatggggggcaagtggtcaaaaaatagaatagttggatggcctgctgtaagagaaagaataagaagaactaatacagcaacagaaccagcagaccttttgggacagcggtg

SEQ ID NO: 404778 - DNA, 140 bp, Artificial Sequence
  Synthetic
caccgctgtcccaaaaggtctgctggttctgttgctgtattagttcttcttattctttctcttacagcaggccatccaactattctattttttgaccacttgccccccattttatagcaacatatcagcagccagggcct

SEQ ID NO: 404779 - DNA, 140 bp, Artificial Sequence
  Synthetic
aggccctggctgctgatatgtagtatgggcaagcagggagctggaaagatttgcacttaaccctggccttttagaaacatcagatggctgtaaacaaataataaaacagctacaaccagcgaccttttgggacagcggtg

SEQ ID NO: 404780 - DNA, 140 bp, Artificial Sequence
  Synthetic
caccgctgtcccaaaaggtcgctggttgtagctgttttattatttgtttacagccatctgatgtttctaaaaggccagggttaagtgcaaatctttccagctccctgcttgcccatactacatatcagcagccagggcct

SEQ ID NO: 404781 - DNA, 140 bp, Artificial Sequence
  Synthetic
aggccctggctgctgatatgatcgcagaaccagcaggaaaagaatgaacaagacttattggcattggacaaatgggcaagtctgtggaattggtttgacataacaaagtggttatggtatgaccttttgggacagcggtg

SEQ ID NO: 404782 - DNA, 140 bp, Artificial Sequence
  Synthetic
caccgctgtcccaaaaggtcataccataaccactttgttatgtcaaaccaattccacagacttgcccatttgtccaatgccaataagtcttgttcattcttttcctgctggttctgcgatcatatcagcagccagggcct

SEQ ID NO: 404783 - DNA, 140 bp, Artificial Sequence
  Synthetic
atacgccatgctgggtctccactgctgtaagggaaagaatgagacgaactgagccagcaactgagccagcagcagatggggtgggagcagtatctcgagacttggaaaaacatggagcaacgtacttgggagtcggccat

SEQ ID NO: 404784 - DNA, 140 bp, Artificial Sequence
  Synthetic
atggccgactcccaagtacgttgctccatgtttttccaagtctcgagatactgctcccaccccatctgctgctggctcagttgctggctcagttcgtctcattctttcccttacagcagtggagacccagcatggcgtat

SEQ ID NO: 404785 - DNA, 140 bp, Artificial Sequence
  Synthetic
aggccctggctgctgatatgagcagatggggtgggagcagtatctcgagacttggaaaaacatggagcaattacaagtagcaatacagcagctactaatgctgactgtgcctggctagaagaccttttgggacagcggtg

SEQ ID NO: 404786 - DNA, 140 bp, Artificial Sequence
  Synthetic
caccgctgtcccaaaaggtcttctagccaggcacagtcagcattagtagctgctgtattgctacttgtaattgctccatgtttttccaagtctcgagatactgctcccaccccatctgctcatatcagcagccagggcct

SEQ ID NO: 404787 - DNA, 140 bp, Artificial Sequence
  Synthetic
atacgccatgctgggtctcctaaaacaataaagtttacacaacactcaggaggggacctagagattacaacacatagctttaattgtagaggagaatttttctactgcaatacatcacaacgtacttgggagtcggccat

SEQ ID NO: 404788 - DNA, 140 bp, Artificial Sequence
  Synthetic
atggccgactcccaagtacgttgtgatgtattgcagtagaaaaattctcctctacaattaaagctatgtgttgtaatctctaggtcccctcctgagtgttgtgtaaactttattgttttaggagacccagcatggcgtat

SEQ ID NO: 404789 - DNA, 140 bp, Artificial Sequence
  Synthetic
aggccctggctgctgatatggcactaacagacatagtaccactaactgaagaagcagaattagaattggcagagaacagggaaattctaaaagaaccagtacatggagtatattatgaccgaccttttgggacagcggtg

SEQ ID NO: 404790 - DNA, 140 bp, Artificial Sequence
  Synthetic
caccgctgtcccaaaaggtcggtcataatatactccatgtactggttcttttagaatttccctgttctctgccaattctaattctgcttcttcagttagtggtactatgtctgttagtgccatatcagcagccagggcct

SEQ ID NO: 404791 - DNA, 140 bp, Artificial Sequence
  Synthetic
atacgccatgctgggtctccgcaggaagaagcggagacgccgacgaggaactcctcagagccgtcaggatcatcaaaatcctgtaccaaagcagtaagtagtaataattagtatatgtgacgtacttgggagtcggccat

SEQ ID NO: 404792 - DNA, 140 bp, Artificial Sequence
  Synthetic
atggccgactcccaagtacgtcacatatactaattattactacttactgctttggtacaggattttgatgatcctgacggctctgaggagttcctcgtcggcgtctccgcttcttcctgcggagacccagcatggcgtat

SEQ ID NO: 404793 - DNA, 140 bp, Artificial Sequence
  Synthetic
aggccctggctgctgatatgagacttactcttgattgtgataaggagtgtggaacttctgggacgcagggggtgggaaatcctcaaatactgttggaatctcctacagtattggagtcaggaccttttgggacagcggtg

SEQ ID NO: 404794 - DNA, 140 bp, Artificial Sequence
  Synthetic
caccgctgtcccaaaaggtcctgactccaatactgtaggagattccaacagtatttgaggatttcccaccccctgcgtcccagaagttccacactccttatcacaatcaagagtaagtctcatatcagcagccagggcct

SEQ ID NO: 404795 - DNA, 140 bp, Artificial Sequence
  Synthetic
atacgccatgctgggtctcccctggcaataatacaagaaaaggtatacatctaggaccagggcaaacattctttgcaacaggtgaaataataggggatataagacgagcacactgtaatgcgtacttgggagtcggccat

SEQ ID NO: 404796 - DNA, 140 bp, Artificial Sequence
  Synthetic
atggccgactcccaagtacgcattacagtgtgctcgtcttatatcccctattatttcacctgttgcaaagaatgtttgccctggtcctagatgtataccttttcttgtattattgccaggggagacccagcatggcgtat

SEQ ID NO: 404797 - DNA, 140 bp, Artificial Sequence
  Synthetic
aggccctggctgctgatatgctttgcaacaggtgaaataataggggatataagacgagcacactgtaatgtcagtggaacagactggaataaagccttacaaaaggtggctggaaaattagaccttttgggacagcggtg

SEQ ID NO: 404798 - DNA, 140 bp, Artificial Sequence
  Synthetic
caccgctgtcccaaaaggtctaattttccagccaccttttgtaaggctttattccagtctgttccactgacattacagtgtgctcgtcttatatcccctattatttcacctgttgcaaagcatatcagcagccagggcct

SEQ ID NO: 404799 - DNA, 140 bp, Artificial Sequence
  Synthetic
atacgccatgctgggtctccgcaaattgtaaatatgtggcagagggtagggcaagcgatgtatgcccctcccatcccaggagagctaaggtgtgactcaaacattactggactactattacgtacttgggagtcggccat

SEQ ID NO: 404800 - DNA, 140 bp, Artificial Sequence
  Synthetic
atggccgactcccaagtacgtaatagtagtccagtaatgtttgagtcacaccttagctctcctgggatgggaggggcatacatcgcttgccctaccctctgccacatatttacaatttgcggagacccagcatggcgtat

SEQ ID NO: 404801 - DNA, 140 bp, Artificial Sequence
  Synthetic
atacgccatgctgggtctccttctgggacacagggggtgggagatcctcaaatatctgtggagtctcctgcaatattggagtcaggaactaaagaatagtgctattaatctgtttaataccgtacttgggagtcggccat

SEQ ID NO: 404802 - DNA, 140 bp, Artificial Sequence
  Synthetic
atggccgactcccaagtacggtattaaacagattaatagcactattctttagttcctgactccaatattgcaggagactccacagatatttgaggatctcccaccccctgtgtcccagaaggagacccagcatggcgtat

SEQ ID NO: 404803 - DNA, 140 bp, Artificial Sequence
  Synthetic
atacgccatgctgggtctcccagctcttcagacaggaacagaggaattgagatcattatataacacagtggcaactctctattgtgtacatagcaacatagatgtacaagacaccaaggacgtacttgggagtcggccat

SEQ ID NO: 404804 - DNA, 140 bp, Artificial Sequence
  Synthetic
atggccgactcccaagtacgtccttggtgtcttgtacatctatgttgctatgtacacaatagagagttgccactgtgttatataatgatctcaattcctctgttcctgtctgaagagctgggagacccagcatggcgtat

SEQ ID NO: 404805 - DNA, 140 bp, Artificial Sequence
  Synthetic
aggccctggctgctgatatgactttaataagacaataaaatttcaaccaccctcaggaggagatctagaaattacaatgcatcactttaattgtagaggggaatttttctattgcaatacgaccttttgggacagcggtg

SEQ ID NO: 404806 - DNA, 140 bp, Artificial Sequence
  Synthetic
caccgctgtcccaaaaggtcgtattgcaatagaaaaattcccctctacaattaaagtgatgcattgtaatttctagatctcctcctgagggtggttgaaattttattgtcttattaaagtcatatcagcagccagggcct

SEQ ID NO: 404807 - DNA, 140 bp, Artificial Sequence
  Synthetic
atacgccatgctgggtctccaccctcgatagcagcatgaaggaagaagtaaaaaattgctctttcaacacaaccacagaactaagagataaaaaacagaaagtgtatgcacttttttatacgtacttgggagtcggccat

SEQ ID NO: 404808 - DNA, 140 bp, Artificial Sequence
  Synthetic
atggccgactcccaagtacgtataaaaaagtgcatacactttctgttttttatctcttagttctgtggttgtgttgaaagagcaattttttacttcttccttcatgctgctatcgagggtggagacccagcatggcgtat

SEQ ID NO: 404809 - DNA, 140 bp, Artificial Sequence
  Synthetic
aggccctggctgctgatatgtattttgattgtttttcagaatctgctataagaaatgccatattaggacatagagttagtcctagttgtgaatatcaagcaggacataacaaggtaggatgaccttttgggacagcggtg

SEQ ID NO: 404810 - DNA, 140 bp, Artificial Sequence
  Synthetic
caccgctgtcccaaaaggtcatcctaccttgttatgtcctgcttgatattcacaactaggactaactctatgtcctaatatggcatttcttatagcagattctgaaaaacaatcaaaatacatatcagcagccagggcct

SEQ ID NO: 404811 - DNA, 140 bp, Artificial Sequence
  Synthetic
atacgccatgctgggtctccggtcaaaaagtagcttcgtaggatggcctaaggttatggaaagaataagacaaactccagcaccagcagcagagggagtaggagcagcatctcaagatttcgtacttgggagtcggccat

SEQ ID NO: 404812 - DNA, 140 bp, Artificial Sequence
  Synthetic
atggccgactcccaagtacgaaatcttgagatgctgctcctactccctctgctgctggtgctggagtttgtcttattctttccataaccttaggccatcctacgaagctactttttgaccggagacccagcatggcgtat

SEQ ID NO: 404813 - DNA, 140 bp, Artificial Sequence
  Synthetic
atacgccatgctgggtctccaagttgctctttcaatacaaccacagaagtaagagataagaagcagaaagtgactgcacttttttatagaattgatctagtaccacttaatgataataaccgtacttgggagtcggccat

SEQ ID NO: 404814 - DNA, 140 bp, Artificial Sequence
  Synthetic
atggccgactcccaagtacggttattatcattaagtggtactagatcaattctataaaaaagtgcagtcactttctgcttcttatctcttacttctgtggttgtattgaaagagcaacttggagacccagcatggcgtat

SEQ ID NO: 404815 - DNA, 140 bp, Artificial Sequence
  Synthetic
atacgccatgctgggtctccgagtgtaaggataggaccaggacaaacattctttgcaaatgccataataggagacataagacaagcatattgtaacattaatggaacaaaatggaacgcacgtacttgggagtcggccat

SEQ ID NO: 404816 - DNA, 140 bp, Artificial Sequence
  Synthetic
atggccgactcccaagtacgtgcgttccattttgttccattaatgttacaatatgcttgtcttatgtctcctattatggcatttgcaaagaatgtttgtcctggtcctatccttacactcggagacccagcatggcgtat

SEQ ID NO: 404817 - DNA, 140 bp, Artificial Sequence
  Synthetic
atacgccatgctgggtctccgcgatatgcaaaggtgtgagtttaatgtaaccactgttgtaaaagacaaaaaggagaaaaaacaggctttattctatagatcagatttgatggaattaaacgtacttgggagtcggccat

SEQ ID NO: 404818 - DNA, 140 bp, Artificial Sequence
  Synthetic
atggccgactcccaagtacgtttaattccatcaaatctgatctatagaataaagcctgttttttctcctttttgtcttttacaacagtggttacattaaactcacacctttgcatatcgcggagacccagcatggcgtat

SEQ ID NO: 404819 - DNA, 140 bp, Artificial Sequence
  Synthetic
aggccctggctgctgatatgaaaattaaccccactatgtgttactttaaattgcactgattggaatggtactgccactagtcctaatgataatagcactaatagtagtatagaggaaacagaccttttgggacagcggtg

SEQ ID NO: 404820 - DNA, 140 bp, Artificial Sequence
  Synthetic
caccgctgtcccaaaaggtctgtttcctctatactactattagtgctattatcattaggactagtggcagtaccattccaatcagtgcaatttaaagtaacacatagtggggttaattttcatatcagcagccagggcct

SEQ ID NO: 404821 - DNA, 140 bp, Artificial Sequence
  Synthetic
atacgccatgctgggtctccataagagataagatacagaaagaatatgcacttttttataaacttgatatggtaccaatagatgatgataagactaatagcagccctactacaactactacgtacttgggagtcggccat

SEQ ID NO: 404822 - DNA, 140 bp, Artificial Sequence
  Synthetic
atggccgactcccaagtacgtagtagttgtagtagggctgctattagtcttatcatcatctattggtaccatatcaagtttataaaaaagtgcatattctttctgtatcttatctcttatggagacccagcatggcgtat

SEQ ID NO: 404823 - DNA, 140 bp, Artificial Sequence
  Synthetic
atacgccatgctgggtctcccacctttgtgccctggaactctagttggagtaataggacccaggatgacatttggaacaacatgacctggttgcaatgggagagagaaattgacaattaccgtacttgggagtcggccat

SEQ ID NO: 404824 - DNA, 140 bp, Artificial Sequence
  Synthetic
atggccgactcccaagtacggtaattgtcaatttctctctcccattgcaaccaggtcatgttgttccaaatgtcatcctgggtcctattactccaactagagttccagggcacaaaggtgggagacccagcatggcgtat

SEQ ID NO: 404825 - DNA, 140 bp, Artificial Sequence
  Synthetic
aggccctggctgctgatatgtggggtacctgtgtggaaagaagcaaccaccactctattttgtgcatcagatgctaacgcagttaaaacagaggcacataatatttgggccacacatgccgaccttttgggacagcggtg

SEQ ID NO: 404826 - DNA, 140 bp, Artificial Sequence
  Synthetic
caccgctgtcccaaaaggtcggcatgtgtggcccaaatattatgtgcctctgttttaactgcgttagcatctgatgcacaaaatagagtggtggttgcttctttccacacaggtaccccacatatcagcagccagggcct

SEQ ID NO: 404827 - DNA, 140 bp, Artificial Sequence
  Synthetic
aggccctggctgctgatatgtagagcaaaaaatccagaaatagttatctatcaatatatggatgacttatatgtaggatctgatttagaaataatgcaacatagagcaaaaatagaagaggaccttttgggacagcggtg

SEQ ID NO: 404828 - DNA, 140 bp, Artificial Sequence
  Synthetic
caccgctgtcccaaaaggtcctcttctatttttgctctatgttgcattatttctaaatcagatcctacatataagtcatccatatattgatagataactatttctggattttttgctctacatatcagcagccagggcct

SEQ ID NO: 404829 - DNA, 140 bp, Artificial Sequence
  Synthetic
aggccctggctgctgatatggggcattttatacaacaggagatgtaataggagatataagacaagcacattgtaacattagcggaacaaaatggaataacactttataccaaatagctaagaccttttgggacagcggtg

SEQ ID NO: 404830 - DNA, 140 bp, Artificial Sequence
  Synthetic
caccgctgtcccaaaaggtcttagctatttggtataaagtgttattccattttgttccgctaatgttacaatgtgcttgtcttatatctcctattacatctcctgttgtataaaatgccccatatcagcagccagggcct

SEQ ID NO: 404831 - DNA, 140 bp, Artificial Sequence
  Synthetic
atacgccatgctgggtctccataaaatggggggcaaatggtcaaagagcagcatagttggatggcctgagataagagaaagactaagaagaactgaacctagaactgagccagcagcagacgtacttgggagtcggccat

SEQ ID NO: 404832 - DNA, 140 bp, Artificial Sequence
  Synthetic
atggccgactcccaagtacgtctgctgctggctcagttctaggttcagttcttcttagtctttctcttatctcaggccatccaactatgctgctctttgaccatttgccccccattttatggagacccagcatggcgtat

SEQ ID NO: 404833 - DNA, 140 bp, Artificial Sequence
  Synthetic
atacgccatgctgggtctccgaaacaaacgtatacatctaggacgggggagaataatgtatgtaacagaacgaatacaaggaggtataagacaagcacattgcaacattagtagagaaaacgtacttgggagtcggccat

SEQ ID NO: 404834 - DNA, 140 bp, Artificial Sequence
  Synthetic
atggccgactcccaagtacgttttctctactaatgttgcaatgtgcttgtcttatacctccttgtattcgttctgttacatacattattctcccccgtcctagatgtatacgtttgtttcggagacccagcatggcgtat

SEQ ID NO: 404835 - DNA, 140 bp, Artificial Sequence
  Synthetic
aggccctggctgctgatatgactgtggcaaagaaggacacctagccagaaattgcagggcccctagaaaaaagggttgttggaaatgtgggaaggaaggacatcaaatgaaagactgcacgaccttttgggacagcggtg

SEQ ID NO: 404836 - DNA, 140 bp, Artificial Sequence
  Synthetic
caccgctgtcccaaaaggtcgtgcagtctttcatttgatgtccttccttcccacatttccaacaacccttttttctaggggccctgcaatttctggctaggtgtccttctttgccacagtcatatcagcagccagggcct

SEQ ID NO: 404837 - DNA, 140 bp, Artificial Sequence
  Synthetic
aggccctggctgctgatatgactctcgacgcagggctcggcttgctgaagtgcactcggcaagaggcgagaggggcgactggtgagtacgccaattttatttgactagcggaggctagaagaccttttgggacagcggtg

SEQ ID NO: 404838 - DNA, 140 bp, Artificial Sequence
  Synthetic
caccgctgtcccaaaaggtcttctagcctccgctagtcaaataaaattggcgtactcaccagtcgcccctctcgcctcttgccgagtgcacttcagcaagccgagccctgcgtcgagagtcatatcagcagccagggcct

SEQ ID NO: 404839 - DNA, 140 bp, Artificial Sequence
  Synthetic
aggccctggctgctgatatgtgtgtaaactcctcaggggagccaaagcactaacagatatagtaacactgactgaggaagcagaattagaattggcagagaacagggagattctaaaagagaccttttgggacagcggtg

SEQ ID NO: 404840 - DNA, 140 bp, Artificial Sequence
  Synthetic
caccgctgtcccaaaaggtctcttttagaatctccctgttctctgccaattctaattctgcttcctcagtcagtgttactatatctgttagtgctttggctcccctgaggagtttacacacatatcagcagccagggcct

SEQ ID NO: 404841 - DNA, 140 bp, Artificial Sequence
  Synthetic
aggccctggctgctgatatgagaagtaatacccatgtttacagcattatcagaaggagccaccccacaagatttaaacaccatgttaaatacagtagggggacatcaagcagctatgcaagaccttttgggacagcggtg

SEQ ID NO: 404842 - DNA, 140 bp, Artificial Sequence
  Synthetic
caccgctgtcccaaaaggtcttgcatagctgcttgatgtccccctactgtatttaacatggtgtttaaatcttgtggggtggctccttctgataatgctgtaaacatgggtattacttctcatatcagcagccagggcct

SEQ ID NO: 404843 - DNA, 140 bp, Artificial Sequence
  Synthetic
aggccctggctgctgatatgccaataacaatacaagaaaaagtatacatctaggaccagggaaagcctggtatacaacaggagacataataggaaatataagaaaagcacattgtaccctgaccttttgggacagcggtg

SEQ ID NO: 404844 - DNA, 140 bp, Artificial Sequence
  Synthetic
caccgctgtcccaaaaggtcagggtacaatgtgcttttcttatatttcctattatgtctcctgttgtataccaggctttccctggtcctagatgtatactttttcttgtattgttattggcatatcagcagccagggcct

SEQ ID NO: 404845 - DNA, 140 bp, Artificial Sequence
  Synthetic
aggccctggctgctgatatgaacaaaagcaacgatggtggagatccagagacaacccatttacattttaattgtcatggagaattcttttattgtaacacatctaatttatttaattatagaccttttgggacagcggtg

SEQ ID NO: 404846 - DNA, 140 bp, Artificial Sequence
  Synthetic
caccgctgtcccaaaaggtctataattaaataaattagatgtgttacaataaaagaattctccatgacaattaaaatgtaaatgggttgtctctggatctccaccatcgttgcttttgttcatatcagcagccagggcct

SEQ ID NO: 404847 - DNA, 140 bp, Artificial Sequence
  Synthetic
atacgccatgctgggtctccatgtaatgttaagtttaatagcaagagtagattatagattaggagtaggagcattgatagtagcactaatcatagcaataattgtgtggatcatagcatacgtacttgggagtcggccat

SEQ ID NO: 404848 - DNA, 140 bp, Artificial Sequence
  Synthetic
atggccgactcccaagtacgtatgctatgatccacacaattattgctatgattagtgctactatcaatgctcctactcctaatctataatctactcttgctattaaacttaacattacatggagacccagcatggcgtat

SEQ ID NO: 404849 - DNA, 140 bp, Artificial Sequence
  Synthetic
aggccctggctgctgatatgttaatagctcctcaggaggggatctagaaatcacaacacatagttttaattgtggaggagaatttttttattgtaatacatcaggcctgtttaatagcacgaccttttgggacagcggtg

SEQ ID NO: 404850 - DNA, 140 bp, Artificial Sequence
  Synthetic
caccgctgtcccaaaaggtcgtgctattaaacaggcctgatgtattacaataaaaaaattctcctccacaattaaaactatgtgttgtgatttctagatcccctcctgaggagctattaacatatcagcagccagggcct

SEQ ID NO: 404851 - DNA, 140 bp, Artificial Sequence
  Synthetic
aggccctggctgctgatatgggacaacatatctatgaaacatatggggatacttgggaaggggttgaagctataataagaattttgcaacaactactgtttgttcatttcagaattgggtgaccttttgggacagcggtg

SEQ ID NO: 404852 - DNA, 140 bp, Artificial Sequence
  Synthetic
caccgctgtcccaaaaggtcacccaattctgaaatgaacaaacagtagttgttgcaaaattcttattatagcttcaaccccttcccaagtatccccatatgtttcatagatatgttgtcccatatcagcagccagggcct

SEQ ID NO: 404853 - DNA, 140 bp, Artificial Sequence
  Synthetic
atacgccatgctgggtctccactaataccgtcaataataccatgaatggagaaatgaaaaattgctctttcaatataaccacagaaataagagataagagagagaatcaatatgcactttcgtacttgggagtcggccat

SEQ ID NO: 404854 - DNA, 140 bp, Artificial Sequence
  Synthetic
atggccgactcccaagtacgaaagtgcatattgattctctctcttatctcttatttctgtggttatattgaaagagcaatttttcatttctccattcatggtattattgacggtattagtggagacccagcatggcgtat

SEQ ID NO: 404855 - DNA, 140 bp, Artificial Sequence
  Synthetic
aggccctggctgctgatatgaataagatttaatccatcctcaggaggggacctagaaattactacacatagctttaattgtagaggagaatttttctattgcaatacatcaaaactgtttgaccttttgggacagcggtg

SEQ ID NO: 404856 - DNA, 140 bp, Artificial Sequence
  Synthetic
caccgctgtcccaaaaggtcaaacagttttgatgtattgcaatagaaaaattctcctctacaattaaagctatgtgtagtaatttctaggtcccctcctgaggatggattaaatcttattcatatcagcagccagggcct

SEQ ID NO: 404857 - DNA, 140 bp, Artificial Sequence
  Synthetic
atacgccatgctgggtctccgtaaagttaacccctctctgcgttactctagattgtcagaactttaaaaacatatctgatggcagcaatagtgaaataaaaaactgttcttttaatatgacgtacttgggagtcggccat

SEQ ID NO: 404858 - DNA, 140 bp, Artificial Sequence
  Synthetic
atggccgactcccaagtacgtcatattaaaagaacagttttttatttcactattgctgccatcagatatgtttttaaagttctgacaatctagagtaacgcagagaggggttaactttacggagacccagcatggcgtat

SEQ ID NO: 404859 - DNA, 140 bp, Artificial Sequence
  Synthetic
aggccctggctgctgatatgtacctcagccattacacaggcttgtccaaaggtatcctttgagccaattcccatacattattgtgccccagctggttttgcgattctgaagtgtaaggatgaccttttgggacagcggtg

SEQ ID NO: 404860 - DNA, 140 bp, Artificial Sequence
  Synthetic
caccgctgtcccaaaaggtcatccttacacttcagaatcgcaaaaccagctggggcacaataatgtatgggaattggctcaaaggatacctttggacaagcctgtgtaatggctgaggtacatatcagcagccagggcct

SEQ ID NO: 404861 - DNA, 140 bp, Artificial Sequence
  Synthetic
aggccctggctgctgatatgcagacctaacaacaatacaagaaaaagtgtacgtataggaccagggcaaacattctatgcaacaggtggcataataggggatataagacaagcacattgtgaccttttgggacagcggtg

SEQ ID NO: 404862 - DNA, 140 bp, Artificial Sequence
  Synthetic
caccgctgtcccaaaaggtcacaatgtgcttgtcttatatcccctattatgccacctgttgcatagaatgtttgccctggtcctatacgtacactttttcttgtattgttgttaggtctgcatatcagcagccagggcct

SEQ ID NO: 404863 - DNA, 140 bp, Artificial Sequence
  Synthetic
aggccctggctgctgatatgctgtaataatcaattgtaccagaccctccaacaatacaagaacaagtataactataggaccaggacaagtattctatagaacaggagacataataggagagaccttttgggacagcggtg

SEQ ID NO: 404864 - DNA, 140 bp, Artificial Sequence
  Synthetic
caccgctgtcccaaaaggtctctcctattatgtctcctgttctatagaatacttgtcctggtcctatagttatacttgttcttgtattgttggagggtctggtacaattgattattacagcatatcagcagccagggcct

SEQ ID NO: 404865 - DNA, 140 bp, Artificial Sequence
  Synthetic
atacgccatgctgggtctccatagcactataactctccaatgcaaaataaagcaaattataaatatgtggcagaaagtaggacaagcaatgtatgcccctcccatccaaggagtaataagcgtacttgggagtcggccat

SEQ ID NO: 404866 - DNA, 140 bp, Artificial Sequence
  Synthetic
atggccgactcccaagtacgcttattactccttggatgggaggggcatacattgcttgtcctactttctgccacatatttataatttgctttattttgcattggagagttatagtgctatggagacccagcatggcgtat

SEQ ID NO: 404867 - DNA, 140 bp, Artificial Sequence
  Synthetic
aggccctggctgctgatatggagcagttggactgggagctgtcttccttgggttcttaggagcagcaggaagcactatgggcgcagcgtcaataacgctgacggtacaggccagacaattgaccttttgggacagcggtg

SEQ ID NO: 404868 - DNA, 140 bp, Artificial Sequence
  Synthetic
caccgctgtcccaaaaggtcaattgtctggcctgtaccgtcagcgttattgacgctgcgcccatagtgcttcctgctgctcctaagaacccaaggaagacagctcccagtccaactgctccatatcagcagccagggcct

SEQ ID NO: 404869 - DNA, 140 bp, Artificial Sequence
  Synthetic
atacgccatgctgggtctccaagatacctaaaagatcaaaagttcctaggactttggggctgctctggaaaaatcatctgcaccactgctgtgccctggaactccacttggagtaatagacgtacttgggagtcggccat

SEQ ID NO: 404870 - DNA, 140 bp, Artificial Sequence
  Synthetic
atggccgactcccaagtacgtctattactccaagtggagttccagggcacagcagtggtgcagatgatttttccagagcagccccaaagtcctaggaacttttgatcttttaggtatcttggagacccagcatggcgtat

SEQ ID NO: 404871 - DNA, 140 bp, Artificial Sequence
  Synthetic
atacgccatgctgggtctccgaaataaaaaattgctctttcaatgcaaccacaatattaacagatagaaagcagacagtgtatgcacttttttatagactagatatagaaccacttaatccgtacttgggagtcggccat

SEQ ID NO: 404872 - DNA, 140 bp, Artificial Sequence
  Synthetic
atggccgactcccaagtacggattaagtggttctatatctagtctataaaaaagtgcatacactgtctgctttctatctgttaatattgtggttgcattgaaagagcaattttttatttcggagacccagcatggcgtat

SEQ ID NO: 404873 - DNA, 140 bp, Artificial Sequence
  Synthetic
atacgccatgctgggtctccacggaagaaataaaaaattgcactttcaacacaaccacagaaataagagataagaaacagaacgtgtatgcattgttttatagatctgatgtaataccaccgtacttgggagtcggccat

SEQ ID NO: 404874 - DNA, 140 bp, Artificial Sequence
  Synthetic
atggccgactcccaagtacggtggtattacatcagatctataaaacaatgcatacacgttctgtttcttatctcttatttctgtggttgtgttgaaagtgcaattttttatttcttccgtggagacccagcatggcgtat

SEQ ID NO: 404875 - DNA, 140 bp, Artificial Sequence
  Synthetic
atacgccatgctgggtctccagcctcaggaggggatctagaaattacaatgcatagctttaattgcagaggagaatttttctattgtaatacatcaaaactgtttaatggtacatacagtcgtacttgggagtcggccat

SEQ ID NO: 404876 - DNA, 140 bp, Artificial Sequence
  Synthetic
atggccgactcccaagtacgactgtatgtaccattaaacagttttgatgtattacaatagaaaaattctcctctgcaattaaagctatgcattgtaatttctagatcccctcctgaggctggagacccagcatggcgtat

SEQ ID NO: 404877 - DNA, 140 bp, Artificial Sequence
  Synthetic
aggccctggctgctgatatgtgctattgtaaaaagtgttgctttcattgccaagtttgtttcataacaaaaggcttaggcatctcctatggcaggaagaagcggagacagcgacgaagaggaccttttgggacagcggtg

SEQ ID NO: 404878 - DNA, 140 bp, Artificial Sequence
  Synthetic
caccgctgtcccaaaaggtcctcttcgtcgctgtctccgcttcttcctgccataggagatgcctaagccttttgttatgaaacaaacttggcaatgaaagcaacactttttacaatagcacatatcagcagccagggcct

SEQ ID NO: 404879 - DNA, 140 bp, Artificial Sequence
  Synthetic
aggccctggctgctgatatggcaggagttgaaagacagggaacccttaacttccctcaaatcactctttggcagcgaccccttgtcacaataaaagtagggggccagataagggaggctcgaccttttgggacagcggtg

SEQ ID NO: 404880 - DNA, 140 bp, Artificial Sequence
  Synthetic
caccgctgtcccaaaaggtcgagcctcccttatctggccccctacttttattgtgacaaggggtcgctgccaaagagtgatttgagggaagttaagggttccctgtctttcaactcctgccatatcagcagccagggcct

SEQ ID NO: 404881 - DNA, 140 bp, Artificial Sequence
  Synthetic
atacgccatgctgggtctccaatgggaagagatgaagaaagaaatgacaaactgctctttcaatatcaccacaagcataaaagataagatacagaaagaatatgcacttttacataaactcgtacttgggagtcggccat

SEQ ID NO: 404882 - DNA, 140 bp, Artificial Sequence
  Synthetic
atggccgactcccaagtacgagtttatgtaaaagtgcatattctttctgtatcttatcttttatgcttgtggtgatattgaaagagcagtttgtcatttctttcttcatctcttcccattggagacccagcatggcgtat

SEQ ID NO: 404883 - DNA, 140 bp, Artificial Sequence
  Synthetic
atacgccatgctgggtctccgtacaagacccagcaacaatacaagaaaaagtatacacataggagtggggagagcactttatgcaacaggagatataataggagacataagacaagcacacgtacttgggagtcggccat

SEQ ID NO: 404884 - DNA, 140 bp, Artificial Sequence
  Synthetic
atggccgactcccaagtacgtgtgcttgtcttatgtctcctattatatctcctgttgcataaagtgctctccccactcctatgtgtatactttttcttgtattgttgctgggtcttgtacggagacccagcatggcgtat

SEQ ID NO: 404885 - DNA, 140 bp, Artificial Sequence
  Synthetic
aggccctggctgctgatatgctctttcaatgtcaccaaaggcataggagataagatgcagaaagaatatgcactttttgataaacttgacataatgccaatagataagaataagacaagcgaccttttgggacagcggtg

SEQ ID NO: 404886 - DNA, 140 bp, Artificial Sequence
  Synthetic
caccgctgtcccaaaaggtcgcttgtcttattcttatctattggcattatgtcaagtttatcaaaaagtgcatattctttctgcatcttatctcctatgcctttggtgacattgaaagagcatatcagcagccagggcct

SEQ ID NO: 404887 - DNA, 140 bp, Artificial Sequence
  Synthetic
aggccctggctgctgatatgcaaaaagtagcatagttggatggcctgctgtaagagaaagaataagaagaactgagccagctgcagatggggtaggagcagtatctcgagacctggaaaggaccttttgggacagcggtg

SEQ ID NO: 404888 - DNA, 140 bp, Artificial Sequence
  Synthetic
caccgctgtcccaaaaggtcctttccaggtctcgagatactgctcctaccccatctgcagctggctcagttcttcttattctttctcttacagcaggccatccaactatgctactttttgcatatcagcagccagggcct

SEQ ID NO: 404889 - DNA, 140 bp, Artificial Sequence
  Synthetic
aggccctggctgctgatatgtcaactactgttaaatggcagtctagcagaaaaaggggtagtaattagaagtaaaaacttctcagacaatgctaaaaccataatagtacagctgaacgaagaccttttgggacagcggtg

SEQ ID NO: 404890 - DNA, 140 bp, Artificial Sequence
  Synthetic
caccgctgtcccaaaaggtcttcgttcagctgtactattatggttttagcattgtctgagaagtttttacttctaattactacccctttttctgctagactgccatttaacagtagttgacatatcagcagccagggcct

SEQ ID NO: 404891 - DNA, 140 bp, Artificial Sequence
  Synthetic
atacgccatgctgggtctccacgtacaggatgggggaggacaatttatgcaacagaaagaataacaggagatataagaaaagcatattgtgaagttaatgggacagcttggaaacgcacccgtacttgggagtcggccat

SEQ ID NO: 404892 - DNA, 140 bp, Artificial Sequence
  Synthetic
atggccgactcccaagtacgggtgcgtttccaagctgtcccattaacttcacaatatgcttttcttatatctcctgttattctttctgttgcataaattgtcctcccccatcctgtacgtggagacccagcatggcgtat

SEQ ID NO: 404893 - DNA, 140 bp, Artificial Sequence
  Synthetic
atacgccatgctgggtctccaataatctttaagaactcctcaggaggggacccagaaataacaatgcacaattttaattgtggaggggaatttttctactgtaatacatcactgctgtttcgtacttgggagtcggccat

SEQ ID NO: 404894 - DNA, 140 bp, Artificial Sequence
  Synthetic
atggccgactcccaagtacgaaacagcagtgatgtattacagtagaaaaattcccctccacaattaaaattgtgcattgttatttctgggtcccctcctgaggagttcttaaagattattggagacccagcatggcgtat

SEQ ID NO: 404895 - DNA, 140 bp, Artificial Sequence
  Synthetic
aggccctggctgctgatatgattttaattgtggaggggaatttttctactgtaatacatcactgctgtttaatactacttgggagaagcataataccactcaaccttggataatgaaaaagaccttttgggacagcggtg

SEQ ID NO: 404896 - DNA, 140 bp, Artificial Sequence
  Synthetic
caccgctgtcccaaaaggtctttttcattatccaaggttgagtggtattatgcttctcccaagtagtattaaacagcagtgatgtattacagtagaaaaattcccctccacaattaaaatcatatcagcagccagggcct

SEQ ID NO: 404897 - DNA, 140 bp, Artificial Sequence
  Synthetic
atacgccatgctgggtctccaaggcttggaaagagctttgctataacatggggggcaagtggtcaaaacgttccatagttgggtggcctgagataagggaaagaataagacgaacccctccgtacttgggagtcggccat

SEQ ID NO: 404898 - DNA, 140 bp, Artificial Sequence
  Synthetic
atggccgactcccaagtacggaggggttcgtcttattctttcccttatctcaggccacccaactatggaacgttttgaccacttgccccccatgttatagcaaagctctttccaagccttggagacccagcatggcgtat

SEQ ID NO: 404899 - DNA, 140 bp, Artificial Sequence
  Synthetic
aggccctggctgctgatatgtagtgatatggggaaagacccctaaatttagactacccatacaaaaagaaacatgggaagcatggtggatggagtattggcaggctacctggattcctgagaccttttgggacagcggtg

SEQ ID NO: 404900 - DNA, 140 bp, Artificial Sequence
  Synthetic
caccgctgtcccaaaaggtctcaggaatccaggtagcctgccaatactccatccaccatgcttcccatgtttctttttgtatgggtagtctaaatttaggggtctttccccatatcactacatatcagcagccagggcct

SEQ ID NO: 404901 - DNA, 140 bp, Artificial Sequence
  Synthetic
atacgccatgctgggtctccagagctattatccacacacctagaagaataagacagggcttagaaaggagtttgctataaaatggggggcaagtggtcaaaacgtagtagagatggatggcgtacttgggagtcggccat

SEQ ID NO: 404902 - DNA, 140 bp, Artificial Sequence
  Synthetic
atggccgactcccaagtacgccatccatctctactacgttttgaccacttgccccccattttatagcaaactcctttctaagccctgtcttattcttctaggtgtgtggataatagctctggagacccagcatggcgtat

SEQ ID NO: 404903 - DNA, 140 bp, Artificial Sequence
  Synthetic
atacgccatgctgggtctccggtggcaagtggtcaaaaagtagcatagtgggatggccagctataagggaaagaataaggagaactcctccaacaacacctcctccagcagcaacaggagcgtacttgggagtcggccat

SEQ ID NO: 404904 - DNA, 140 bp, Artificial Sequence
  Synthetic
atggccgactcccaagtacgctcctgttgctgctggaggaggtgttgttggaggagttctccttattctttcccttatagctggccatcccactatgctactttttgaccacttgccaccggagacccagcatggcgtat

SEQ ID NO: 404905 - DNA, 140 bp, Artificial Sequence
  Synthetic
atacgccatgctgggtctccgcacaggaagatgaagaagtgggctttccagtcagaccccaagtacctttaagaccaatgactttcaaggcagctcatgaccttagcttctttttaaaagcgtacttgggagtcggccat

SEQ ID NO: 404906 - DNA, 140 bp, Artificial Sequence
  Synthetic
atggccgactcccaagtacgcttttaaaaagaagctaaggtcatgagctgccttgaaagtcattggtcttaaaggtacttggggtctgactggaaagcccacttcttcatcttcctgtgcggagacccagcatggcgtat

SEQ ID NO: 404907 - DNA, 140 bp, Artificial Sequence
  Synthetic
atacgccatgctgggtctcccactagtgttaataccactagcgggggaatggagggaggagaaataaaaaactgctctttcaatatcaccacaaacataagagataaggtgcagcaacaacgtacttgggagtcggccat

SEQ ID NO: 404908 - DNA, 140 bp, Artificial Sequence
  Synthetic
atggccgactcccaagtacgttgttgctgcaccttatctcttatgtttgtggtgatattgaaagagcagttttttatttctcctccctccattcccccgctagtggtattaacactagtgggagacccagcatggcgtat

SEQ ID NO: 404909 - DNA, 140 bp, Artificial Sequence
  Synthetic
aggccctggctgctgatatgattgtggaggggaattcttctactgtaattcaacaccactgtttagtagtaattggactaggaatactactaccgggtcttggattggcaggtatgagtcgaccttttgggacagcggtg

SEQ ID NO: 404910 - DNA, 140 bp, Artificial Sequence
  Synthetic
caccgctgtcccaaaaggtcgactcatacctgccaatccaagacccggtagtagtattcctagtccaattactactaaacagtggtgttgaattacagtagaagaattcccctccacaatcatatcagcagccagggcct

SEQ ID NO: 404911 - DNA, 140 bp, Artificial Sequence
  Synthetic
aggccctggctgctgatatgtagcagtcctctattgtgtacatcaaaagatagatgtaaaagacaccaaggaagctttagacaagatagaggaagagcaaaacaaaagtaagaaaaaagcgaccttttgggacagcggtg

SEQ ID NO: 404912 - DNA, 140 bp, Artificial Sequence
  Synthetic
caccgctgtcccaaaaggtcgcttttttcttacttttgttttgctcttcctctatcttgtctaaagcttccttggtgtcttttacatctatcttttgatgtacacaatagaggactgctacatatcagcagccagggcct

SEQ ID NO: 404913 - DNA, 140 bp, Artificial Sequence
  Synthetic
aggccctggctgctgatatgagtttatgggatcaaagcctaaagccctgtgtaaagttgactccactctgtgtcacgctaaactgtattaatgtcaatattaccaacaatgctagtagtggaccttttgggacagcggtg

SEQ ID NO: 404914 - DNA, 140 bp, Artificial Sequence
  Synthetic
caccgctgtcccaaaaggtccactactagcattgttggtaatattgacattaatacagtttagcgtgacacagagtggagtcaactttacacagggctttaggctttgatcccataaactcatatcagcagccagggcct

SEQ ID NO: 404915 - DNA, 140 bp, Artificial Sequence
  Synthetic
aggccctggctgctgatatggtacaatgtacacatggaattaagccagtggtatcaactcaattactgttaaatggtagtctagcagaagaagagataataattagatctgaaaatctgagaccttttgggacagcggtg

SEQ ID NO: 404916 - DNA, 140 bp, Artificial Sequence
  Synthetic
caccgctgtcccaaaaggtctcagattttcagatctaattattatctcttcttctgctagactaccatttaacagtaattgagttgataccactggcttaattccatgtgtacattgtaccatatcagcagccagggcct

SEQ ID NO: 404917 - DNA, 140 bp, Artificial Sequence
  Synthetic
atacgccatgctgggtctcccagagaagaacaagaaatggagatagtagatcctaacctagatccctgggaccatccaggaagtcaacctagcaccccttgtaataagtgctattgcaagcgtacttgggagtcggccat

SEQ ID NO: 404918 - DNA, 140 bp, Artificial Sequence
  Synthetic
atggccgactcccaagtacgcttgcaatagcacttattacaaggggtgctaggttgacttcctggatggtcccagggatctaggttaggatctactatctccatttcttgttcttctctgggagacccagcatggcgtat

SEQ ID NO: 404919 - DNA, 140 bp, Artificial Sequence
  Synthetic
aggccctggctgctgatatgaccctcaggaggggacctagaagttacaacacatacctttaattgtatgggggaatttttctattgcaatacatcaaaactgtttaatagtacacacaatgaccttttgggacagcggtg

SEQ ID NO: 404920 - DNA, 140 bp, Artificial Sequence
  Synthetic
caccgctgtcccaaaaggtcattgtgtgtactattaaacagttttgatgtattgcaatagaaaaattcccccatacaattaaaggtatgtgttgtaacttctaggtcccctcctgagggtcatatcagcagccagggcct

SEQ ID NO: 404921 - DNA, 140 bp, Artificial Sequence
  Synthetic
atacgccatgctgggtctccgggcacggcagaagggaaagaagaaataagaaactgctcgtacaatataaccacagaactaagagataagaaacagaaagtgtattcacttttttataaacgtacttgggagtcggccat

SEQ ID NO: 404922 - DNA, 140 bp, Artificial Sequence
  Synthetic
atggccgactcccaagtacgtttataaaaaagtgaatacactttctgtttcttatctcttagttctgtggttatattgtacgagcagtttcttatttcttctttcccttctgccgtgcccggagacccagcatggcgtat

SEQ ID NO: 404923 - DNA, 140 bp, Artificial Sequence
  Synthetic
atacgccatgctgggtctcctgagtatagactaataaattgtaatacctcagccattacacaggcttgtccaaaggtatcctttgagccaattcccatacattattgtgccccagctggtcgtacttgggagtcggccat

SEQ ID NO: 404924 - DNA, 140 bp, Artificial Sequence
  Synthetic
atggccgactcccaagtacgaccagctggggcacaataatgtatgggaattggctcaaaggatacctttggacaagcctgtgtaatggctgaggtattacaatttattagtctatactcaggagacccagcatggcgtat

SEQ ID NO: 404925 - DNA, 140 bp, Artificial Sequence
  Synthetic
aggccctggctgctgatatgcaaaggtatcctttgagccaattcccatacattattgtgccccagctggttttgcgattctaaagtgtaatgataagaaattcaatggaacagggctatggaccttttgggacagcggtg

SEQ ID NO: 404926 - DNA, 140 bp, Artificial Sequence
  Synthetic
caccgctgtcccaaaaggtccatagccctgttccattgaatttcttatcattacactttagaatcgcaaaaccagctggggcacaataatgtatgggaattggctcaaaggatacctttgcatatcagcagccagggcct

SEQ ID NO: 404927 - DNA, 140 bp, Artificial Sequence
  Synthetic
atacgccatgctgggtctcctgcagccaatgtctctaacataataggaaatataacagaggaagtaagaaactgttcttttaatatgaccacaatactaagaggtaagatgcagaaggtccgtacttgggagtcggccat

SEQ ID NO: 404928 - DNA, 140 bp, Artificial Sequence
  Synthetic
atggccgactcccaagtacggaccttctgcatcttacctcttagtattgtggtcatattaaaagaacagtttcttacttcctctgttatatttcctattatgttagagacattggctgcaggagacccagcatggcgtat

SEQ ID NO: 404929 - DNA, 140 bp, Artificial Sequence
  Synthetic
atacgccatgctgggtctcctaagttttaatgaatcctcaggaggggatttagaaattgtaacacatagttttaattgtggaggagaatttttctattgtaagacatcgagactgtttaacgtacttgggagtcggccat

SEQ ID NO: 404930 - DNA, 140 bp, Artificial Sequence
  Synthetic
atggccgactcccaagtacgttaaacagtctcgatgtcttacaatagaaaaattctcctccacaattaaaactatgtgttacaatttctaaatcccctcctgaggattcattaaaacttaggagacccagcatggcgtat

SEQ ID NO: 404931 - DNA, 140 bp, Artificial Sequence
  Synthetic
atacgccatgctgggtctccacaatgacactataactctcccatgcagaataagacaaattgtacatatgtggcagagagtaggacaagcaatgtatgcccctcccattcgaggagtaatcgtacttgggagtcggccat

SEQ ID NO: 404932 - DNA, 140 bp, Artificial Sequence
  Synthetic
atggccgactcccaagtacgattactcctcgaatgggaggggcatacattgcttgtcctactctctgccacatatgtacaatttgtcttattctgcatgggagagttatagtgtcattgtggagacccagcatggcgtat

SEQ ID NO: 404933 - DNA, 140 bp, Artificial Sequence
  Synthetic
aggccctggctgctgatatgaaagacttaatagcagaaatacagaagcaggggctaggccaatggacatatcaaatttatcaagagccatttaagaatctgaaaacaggaaagtatgcaagaccttttgggacagcggtg

SEQ ID NO: 404934 - DNA, 140 bp, Artificial Sequence
  Synthetic
caccgctgtcccaaaaggtcttgcatactttcctgttttcagattcttaaatggctcttgataaatttgatatgtccattggcctagcccctgcttctgtatttctgctattaagtctttcatatcagcagccagggcct

SEQ ID NO: 404935 - DNA, 140 bp, Artificial Sequence
  Synthetic
aggccctggctgctgatatgtataagaatattcatcatgatagtaggaggcttgataggtttgagaataatctttggagtgctctctatagtgagaagagttaggcagggatactcacctgaccttttgggacagcggtg

SEQ ID NO: 404936 - DNA, 140 bp, Artificial Sequence
  Synthetic
caccgctgtcccaaaaggtcaggtgagtatccctgcctaactcttctcactatagagagcactccaaagattattctcaaacctatcaagcctcctactatcatgatgaatattcttatacatatcagcagccagggcct

SEQ ID NO: 404937 - DNA, 140 bp, Artificial Sequence
  Synthetic
atacgccatgctgggtctccagaataaggagagctgatccagcagcagaaggagtaggagcagcatctcaagacttagatagacatggggcactgacaagtagcaacacagctgacaatacgtacttgggagtcggccat

SEQ ID NO: 404938 - DNA, 140 bp, Artificial Sequence
  Synthetic
atggccgactcccaagtacgtattgtcagctgtgttgctacttgtcagtgccccatgtctatctaagtcttgagatgctgctcctactccttctgctgctggatcagctctccttattctggagacccagcatggcgtat

SEQ ID NO: 404939 - DNA, 140 bp, Artificial Sequence
  Synthetic
aggccctggctgctgatatggtacacatggaattaagccagtggtatcaactcaactactgttaaatggtagcctagcagaaaaagaaatagtaatcagatctgaaaatctgacaaacaagaccttttgggacagcggtg

SEQ ID NO: 404940 - DNA, 140 bp, Artificial Sequence
  Synthetic
caccgctgtcccaaaaggtcttgtttgtcagattttcagatctgattactatttctttttctgctaggctaccatttaacagtagttgagttgataccactggcttaattccatgtgtaccatatcagcagccagggcct

SEQ ID NO: 404941 - DNA, 140 bp, Artificial Sequence
  Synthetic
aggccctggctgctgatatggtggcaactctctattgtgtacatagcaacatagagataagagacaccaaggaagccttagacaaaatagaggaggaacaacgcaaatgccagcaaaaaagaccttttgggacagcggtg

SEQ ID NO: 404942 - DNA, 140 bp, Artificial Sequence
  Synthetic
caccgctgtcccaaaaggtcttttttgctggcatttgcgttgttcctcctctattttgtctaaggcttccttggtgtctcttatctctatgttgctatgtacacaatagagagttgccaccatatcagcagccagggcct

SEQ ID NO: 404943 - DNA, 140 bp, Artificial Sequence
  Synthetic
atacgccatgctgggtctccagctggtagagctcttctccacatacctagaagaattagacaaggctttgaaagggctttactgtaacatgggtggcaagtggtccaaaagtagcctagtcgtacttgggagtcggccat

SEQ ID NO: 404944 - DNA, 140 bp, Artificial Sequence
  Synthetic
atggccgactcccaagtacgactaggctacttttggaccacttgccacccatgttacagtaaagccctttcaaagccttgtctaattcttctaggtatgtggagaagagctctaccagctggagacccagcatggcgtat

SEQ ID NO: 404945 - DNA, 140 bp, Artificial Sequence
  Synthetic
atacgccatgctgggtctccaagtgtacaaatgtaagtgctaagaaggttgatagcggcatggaggaagaaatgaaaaattgctctttcaatgcaaccacagaaagaagagataagaaaccgtacttgggagtcggccat

SEQ ID NO: 404946 - DNA, 140 bp, Artificial Sequence
  Synthetic
atggccgactcccaagtacggtttcttatctcttctttctgtggttgcattgaaagagcaatttttcatttcttcctccatgccgctatcaaccttcttagcacttacatttgtacacttggagacccagcatggcgtat

SEQ ID NO: 404947 - DNA, 140 bp, Artificial Sequence
  Synthetic
aggccctggctgctgatatgacattcaatgggacaggaccatgccataatgtcagcacagtacaatgtacacatggaattaaaccagtggtatcaactcaactactgttaaatggtagccgaccttttgggacagcggtg

SEQ ID NO: 404948 - DNA, 140 bp, Artificial Sequence
  Synthetic
caccgctgtcccaaaaggtcggctaccatttaacagtagttgagttgataccactggtttaattccatgtgtacattgtactgtgctgacattatggcatggtcctgtcccattgaatgtcatatcagcagccagggcct

SEQ ID NO: 404949 - DNA, 140 bp, Artificial Sequence
  Synthetic
aggccctggctgctgatatgaaaacaataatagtacaccttaatgaatctgtagaaattaattgtacaagacccaacaataatacaagaaaaagtataagaataggaccaggacaagcatgaccttttgggacagcggtg

SEQ ID NO: 404950 - DNA, 140 bp, Artificial Sequence
  Synthetic
caccgctgtcccaaaaggtcatgcttgtcctggtcctattcttatactttttcttgtattattgttgggtcttgtacaattaatttctacagattcattaaggtgtactattattgttttcatatcagcagccagggcct

SEQ ID NO: 404951 - DNA, 140 bp, Artificial Sequence
  Synthetic
aggccctggctgctgatatggggcattaagcagctccaggcaagagtcctggctatagaaagatacctaaaggatcaacagctcctaggaatttggggctgctctggaaaactcatctgcgaccttttgggacagcggtg

SEQ ID NO: 404952 - DNA, 140 bp, Artificial Sequence
  Synthetic
caccgctgtcccaaaaggtcgcagatgagttttccagagcagccccaaattcctaggagctgttgatcctttaggtatctttctatagccaggactcttgcctggagctgcttaatgccccatatcagcagccagggcct

SEQ ID NO: 404953 - DNA, 140 bp, Artificial Sequence
  Synthetic
aggccctggctgctgatatggaggaggtgggctttccagtcagacctcaggtacctttaagaccaatgactttcaagggagcatttgatctcagcttctttttaaaagaaaaggggggacgaccttttgggacagcggtg

SEQ ID NO: 404954 - DNA, 140 bp, Artificial Sequence
  Synthetic
caccgctgtcccaaaaggtcgtccccccttttcttttaaaaagaagctgagatcaaatgctcccttgaaagtcattggtcttaaaggtacctgaggtctgactggaaagcccacctcctccatatcagcagccagggcct

SEQ ID NO: 404955 - DNA, 140 bp, Artificial Sequence
  Synthetic
aggccctggctgctgatatgatgggtgcgagagcgtcaatattaagagggggaaaattagataaatgggaaaaaattaggttaaggccagggggaaagaaacattatatgctaaaacatcgaccttttgggacagcggtg

SEQ ID NO: 404956 - DNA, 140 bp, Artificial Sequence
  Synthetic
caccgctgtcccaaaaggtcgatgttttagcatataatgtttctttccccctggccttaacctaattttttcccatttatctaattttccccctcttaatattgacgctctcgcacccatcatatcagcagccagggcct

SEQ ID NO: 404957 - DNA, 140 bp, Artificial Sequence
  Synthetic
aggccctggctgctgatatgatccagactgtaagtccattttaagagcattaggaacaggagctacattagaagaaatgatgacagcatgccagggagtgggaggacctagccataaagcgaccttttgggacagcggtg

SEQ ID NO: 404958 - DNA, 140 bp, Artificial Sequence
  Synthetic
caccgctgtcccaaaaggtcgctttatggctaggtcctcccactccctggcatgctgtcatcatttcttctaatgtagctcctgttcctaatgctcttaaaatggacttacagtctggatcatatcagcagccagggcct

SEQ ID NO: 404959 - DNA, 140 bp, Artificial Sequence
  Synthetic
aggccctggctgctgatatgtgtggagttggtttagcataacaaattggctatggtacataaaaatattcataatgatagtaggaggcttgataggtttgagaataatttttgctgtgctgaccttttgggacagcggtg

SEQ ID NO: 404960 - DNA, 140 bp, Artificial Sequence
  Synthetic
caccgctgtcccaaaaggtcagcacagcaaaaattattctcaaacctatcaagcctcctactatcattatgaatatttttatgtaccatagccaatttgttatgctaaaccaactccacacatatcagcagccagggcct

SEQ ID NO: 404961 - DNA, 140 bp, Artificial Sequence
  Synthetic
aggccctggctgctgatatgtcttcagacaggaacagaggaacttagatcattatacaacacagtagcaactctctattgtgtacatgcagggatagaggtacgagacaccaaggaagccgaccttttgggacagcggtg

SEQ ID NO: 404962 - DNA, 140 bp, Artificial Sequence
  Synthetic
caccgctgtcccaaaaggtcggcttccttggtgtctcgtacctctatccctgcatgtacacaatagagagttgctactgtgttgtataatgatctaagttcctctgttcctgtctgaagacatatcagcagccagggcct

SEQ ID NO: 404963 - DNA, 140 bp, Artificial Sequence
  Synthetic
atacgccatgctgggtctcccaagcaaaagtatacacatgggaccggggcgagcattttatgcaacaggagaaataataggagatataagacaagcacattgtaatattagtaaaacaaacgtacttgggagtcggccat

SEQ ID NO: 404964 - DNA, 140 bp, Artificial Sequence
  Synthetic
atggccgactcccaagtacgtttgttttactaatattacaatgtgcttgtcttatatctcctattatttctcctgttgcataaaatgctcgccccggtcccatgtgtatacttttgcttgggagacccagcatggcgtat

SEQ ID NO: 404965 - DNA, 140 bp, Artificial Sequence
  Synthetic
atacgccatgctgggtctcctaatttggataataccacaaatagtactactaacagtagtagtaatgggatgaagggagatatgaaaaactgcactttcaatgttaccacaatcagaagacgtacttgggagtcggccat

SEQ ID NO: 404966 - DNA, 140 bp, Artificial Sequence
  Synthetic
atggccgactcccaagtacgtcttctgattgtggtaacattgaaagtgcagtttttcatatctcccttcatcccattactactactgttagtagtactatttgtggtattatccaaattaggagacccagcatggcgtat

SEQ ID NO: 404967 - DNA, 140 bp, Artificial Sequence
  Synthetic
aggccctggctgctgatatgaagaataagacagggttttgaagcagctttgctataaaatggggggcaaatggtcaaaaagcagcatagttggatggcctgaggtaagagaaagaataaggaccttttgggacagcggtg

SEQ ID NO: 404968 - DNA, 140 bp, Artificial Sequence
  Synthetic
caccgctgtcccaaaaggtccttattctttctcttacctcaggccatccaactatgctgctttttgaccatttgccccccattttatagcaaagctgcttcaaaaccctgtcttattcttcatatcagcagccagggcct

SEQ ID NO: 404969 - DNA, 140 bp, Artificial Sequence
  Synthetic
aggccctggctgctgatatgacaataatacaagaagaagtatgcatctaggaccagggagagcattatttcatgcaacagatataataggagatataagacaagcacattgtaaccttaggaccttttgggacagcggtg

SEQ ID NO: 404970 - DNA, 140 bp, Artificial Sequence
  Synthetic
caccgctgtcccaaaaggtcctaaggttacaatgtgcttgtcttatatctcctattatatctgttgcatgaaataatgctctccctggtcctagatgcatacttcttcttgtattattgtcatatcagcagccagggcct

SEQ ID NO: 404971 - DNA, 140 bp, Artificial Sequence
  Synthetic
aggccctggctgctgatatgagctattatccacatacctagaagaataagacagggcgcagaaaggattttgctataagatgggtggcaagtggtcaaaacgtagtacgggtgaatggttgaccttttgggacagcggtg

SEQ ID NO: 404972 - DNA, 140 bp, Artificial Sequence
  Synthetic
caccgctgtcccaaaaggtcaaccattcacccgtactacgttttgaccacttgccacccatcttatagcaaaatcctttctgcgccctgtcttattcttctaggtatgtggataatagctcatatcagcagccagggcct

SEQ ID NO: 404973 - DNA, 140 bp, Artificial Sequence
  Synthetic
aggccctggctgctgatatgctgagccagcagcagttggggtgggagcagcatctcgagacttggaaaaacatggagcaatcacaagtagcaatacagcagctactaatgctgattgtgcgaccttttgggacagcggtg

SEQ ID NO: 404974 - DNA, 140 bp, Artificial Sequence
  Synthetic
caccgctgtcccaaaaggtcgcacaatcagcattagtagctgctgtattgctacttgtgattgctccatgtttttccaagtctcgagatgctgctcccaccccaactgctgctggctcagcatatcagcagccagggcct

SEQ ID NO: 404975 - DNA, 140 bp, Artificial Sequence
  Synthetic
aggccctggctgctgatatgaatacaaagaacttgtagagctatcctccatatacctacaagaataagacagggcttagaaagggctttgctataaaatgggtggcaagtggtcaaaacggaccttttgggacagcggtg

SEQ ID NO: 404976 - DNA, 140 bp, Artificial Sequence
  Synthetic
caccgctgtcccaaaaggtccgttttgaccacttgccacccattttatagcaaagccctttctaagccctgtcttattcttgtaggtatatggaggatagctctacaagttctttgtattcatatcagcagccagggcct

SEQ ID NO: 404977 - DNA, 140 bp, Artificial Sequence
  Synthetic
atacgccatgctgggtctccgaggaggtgggctacccagacaaacctgacgtacctgtaagaccaatgacttacaaggcagctgtagataagagccactttttaaaagaaaaggggggaccgtacttgggagtcggccat

SEQ ID NO: 404978 - DNA, 140 bp, Artificial Sequence
  Synthetic
atggccgactcccaagtacggtccccccttttcttttaaaaagtggctcttatctacagctgccttgtaagtcattggtcttacaggtacgtcaggtttgtctgggtagcccacctcctcggagacccagcatggcgtat

SEQ ID NO: 404979 - DNA, 140 bp, Artificial Sequence
  Synthetic
aggccctggctgctgatatgaaaattaccctatagtgcagaacctccaggggcaaatggtacatcagcccttatcacctagaactttaaatgcatgggtaaaagtagtagaagagaaggcgaccttttgggacagcggtg

SEQ ID NO: 404980 - DNA, 140 bp, Artificial Sequence
  Synthetic
caccgctgtcccaaaaggtcgccttctcttctactacttttacccatgcatttaaagttctaggtgataagggctgatgtaccatttgcccctggaggttctgcactatagggtaattttcatatcagcagccagggcct

SEQ ID NO: 404981 - DNA, 140 bp, Artificial Sequence
  Synthetic
aggccctggctgctgatatgcatatttttcagttcctttagatgaaggattcaggaaatatactgcattcaccatacctagtataaacaatgaaacaccagggattagatatcaatataagaccttttgggacagcggtg

SEQ ID NO: 404982 - DNA, 140 bp, Artificial Sequence
  Synthetic
caccgctgtcccaaaaggtcttatattgatatctaatccctggtgtttcattgtttatactaggtatggtgaatgcagtatatttcctgaatccttcatctaaaggaactgaaaaatatgcatatcagcagccagggcct

SEQ ID NO: 404983 - DNA, 140 bp, Artificial Sequence
  Synthetic
aggccctggctgctgatatgaaataatagaacagttaataaaaaaggaaagggtctacctgtcatgggtaccagcacataaaggaattggaggaaatgaacaagtagataaattagtaaggaccttttgggacagcggtg

SEQ ID NO: 404984 - DNA, 140 bp, Artificial Sequence
  Synthetic
caccgctgtcccaaaaggtccttactaatttatctacttgttcatttcctccaattcctttatgtgctggtacccatgacaggtagaccctttccttttttattaactgttctattatttcatatcagcagccagggcct

SEQ ID NO: 404985 - DNA, 140 bp, Artificial Sequence
  Synthetic
aggccctggctgctgatatggaagtgacatagcaggaactactagtacccttcaagaacaaataggatggatgacaagcaatccacctatcccagtgggagaaatctataaaaggtggatgaccttttgggacagcggtg

SEQ ID NO: 404986 - DNA, 140 bp, Artificial Sequence
  Synthetic
caccgctgtcccaaaaggtcatccaccttttatagatttctcccactgggataggtggattgcttgtcatccatcctatttgttcttgaagggtactagtagttcctgctatgtcacttccatatcagcagccagggcct

SEQ ID NO: 404987 - DNA, 140 bp, Artificial Sequence
  Synthetic
atacgccatgctgggtctcccacacaggaaggggtagagctaaaaaatgagctaaaaaattgctctttcaatataaccacagaactaaaagataagaaaaggaaagaatatgcactttttcgtacttgggagtcggccat

SEQ ID NO: 404988 - DNA, 140 bp, Artificial Sequence
  Synthetic
atggccgactcccaagtacgaaaaagtgcatattctttccttttcttatcttttagttctgtggttatattgaaagagcaattttttagctcattttttagctctaccccttcctgtgtgggagacccagcatggcgtat

SEQ ID NO: 404989 - DNA, 140 bp, Artificial Sequence
  Synthetic
aggccctggctgctgatatgtaatgtcagcacagtacaatgtacacatggaattaagccagtggtatcaactcaattactgttaaatggtagtctagcagaagaagagataataattagagaccttttgggacagcggtg

SEQ ID NO: 404990 - DNA, 140 bp, Artificial Sequence
  Synthetic
caccgctgtcccaaaaggtctctaattattatctcttcttctgctagactaccatttaacagtaattgagttgataccactggcttaattccatgtgtacattgtactgtgctgacattacatatcagcagccagggcct

SEQ ID NO: 404991 - DNA, 140 bp, Artificial Sequence
  Synthetic
atacgccatgctgggtctccaagaatgaaactaagaccaatagtagtgatgccaatagtaatagcggggaaataatggggaacgaagagataaaaaattgctctttcaatgtcagcacagcgtacttgggagtcggccat

SEQ ID NO: 404992 - DNA, 140 bp, Artificial Sequence
  Synthetic
atggccgactcccaagtacgctgtgctgacattgaaagagcaattttttatctcttcgttccccattatttccccgctattactattggcatcactactattggtcttagtttcattcttggagacccagcatggcgtat

SEQ ID NO: 404993 - DNA, 140 bp, Artificial Sequence
  Synthetic
aggccctggctgctgatatggaccagggcaagcattctatgcaacaggtgaaataataggggacataagagaagcatattgtaatgtcagtaaaaaagactggaatgaaactttacaaaagaccttttgggacagcggtg

SEQ ID NO: 404994 - DNA, 140 bp, Artificial Sequence
  Synthetic
caccgctgtcccaaaaggtcttttgtaaagtttcattccagtcttttttactgacattacaatatgcttctcttatgtcccctattatttcacctgttgcatagaatgcttgccctggtccatatcagcagccagggcct

SEQ ID NO: 404995 - DNA, 140 bp, Artificial Sequence
  Synthetic
aggccctggctgctgatatggattaataaattgtaatacctcagccataacacaagcctgtccaaaggttacttttgatccaattcctatacactattgcactccagctggttatgcgatgaccttttgggacagcggtg

SEQ ID NO: 404996 - DNA, 140 bp, Artificial Sequence
  Synthetic
caccgctgtcccaaaaggtcatcgcataaccagctggagtgcaatagtgtataggaattggatcaaaagtaacctttggacaggcttgtgttatggctgaggtattacaatttattaatccatatcagcagccagggcct

SEQ ID NO: 404997 - DNA, 140 bp, Artificial Sequence
  Synthetic
aggccctggctgctgatatgtaggcatttcctatggcaggaagaagcggagacagcgacgaagcactcctcctagcagtgaggaccatcaagatcttatatcaaagcagtaagtatatgtgaccttttgggacagcggtg

SEQ ID NO: 404998 - DNA, 140 bp, Artificial Sequence
  Synthetic
caccgctgtcccaaaaggtcacatatacttactgctttgatataagatcttgatggtcctcactgctaggaggagtgcttcgtcgctgtctccgcttcttcctgccataggaaatgcctacatatcagcagccagggcct

SEQ ID NO: 404999 - DNA, 140 bp, Artificial Sequence
  Synthetic
aggccctggctgctgatatgccatcctcaggaggggacctagaaattacaacacatagctttaattgtggaggagaatttttctattgtaatacatcaagcctgtttaatagtacataccgaccttttgggacagcggtg

SEQ ID NO: 405000 - DNA, 140 bp, Artificial Sequence
  Synthetic
caccgctgtcccaaaaggtcggtatgtactattaaacaggcttgatgtattacaatagaaaaattctcctccacaattaaagctatgtgttgtaatttctaggtcccctcctgaggatggcatatcagcagccagggcct

SEQ ID NO: 405001 - DNA, 140 bp, Artificial Sequence
  Synthetic
aggccctggctgctgatatggatgcatgaggatataatcagtttatgggatcaaagtctaaaaccatgtgtaaagttgaccccactctgtgtcactttaaagtgtacagatgctaatgttgaccttttgggacagcggtg

SEQ ID NO: 405002 - DNA, 140 bp, Artificial Sequence
  Synthetic
caccgctgtcccaaaaggtcaacattagcatctgtacactttaaagtgacacagagtggggtcaactttacacatggttttagactttgatcccataaactgattatatcctcatgcatccatatcagcagccagggcct

SEQ ID NO: 405003 - DNA, 140 bp, Artificial Sequence
  Synthetic
aggccctggctgctgatatgggaagaaatatgttgactcagattggttgtactttaaattttccaattagtcctattgaaactgtaccagtaaaattaaagccaggaatggatggcccaagaccttttgggacagcggtg

SEQ ID NO: 405004 - DNA, 140 bp, Artificial Sequence
  Synthetic
caccgctgtcccaaaaggtcttgggccatccattcctggctttaattttactggtacagtttcaataggactaattggaaaatttaaagtacaaccaatctgagtcaacatatttcttcccatatcagcagccagggcct

SEQ ID NO: 405005 - DNA, 140 bp, Artificial Sequence
  Synthetic
aggccctggctgctgatatggaggaggtaggctttccagtcaggccacaggtacctctaagaccaatgacttacaagggagcttttgatcttagcttctttttaaaagaaaaggggggacgaccttttgggacagcggtg

SEQ ID NO: 405006 - DNA, 140 bp, Artificial Sequence
  Synthetic
caccgctgtcccaaaaggtcgtccccccttttcttttaaaaagaagctaagatcaaaagctcccttgtaagtcattggtcttagaggtacctgtggcctgactggaaagcctacctcctccatatcagcagccagggcct

SEQ ID NO: 405007 - DNA, 140 bp, Artificial Sequence
  Synthetic
aggccctggctgctgatatgcttgtaacaattgctattgtaaacagtgttgctatcattgtcaagtttgcttcatatcaaaaggcttaggcatctcctatggcaggaagaagcggagacagaccttttgggacagcggtg

SEQ ID NO: 405008 - DNA, 140 bp, Artificial Sequence
  Synthetic
caccgctgtcccaaaaggtctgtctccgcttcttcctgccataggagatgcctaagccttttgatatgaagcaaacttgacaatgatagcaacactgtttacaatagcaattgttacaagcatatcagcagccagggcct

SEQ ID NO: 405009 - DNA, 140 bp, Artificial Sequence
  Synthetic
aggccctggctgctgatatgcagctcctaggaatttggggctgctctggaaaactcatctgcaccactgctgtgccttggaactctagttggagtaataaatcttatgatgatatttggggaccttttgggacagcggtg

SEQ ID NO: 405010 - DNA, 140 bp, Artificial Sequence
  Synthetic
caccgctgtcccaaaaggtccccaaatatcatcataagatttattactccaactagagttccaaggcacagcagtggtgcagatgagttttccagagcagccccaaattcctaggagctgcatatcagcagccagggcct

SEQ ID NO: 405011 - DNA, 140 bp, Artificial Sequence
  Synthetic
atacgccatgctgggtctccgactgctgacaatagtagtagtagtggggaaaatctgaaggaagaaataaaaaactgctctttcaatatcaccacaaacagaagaactaaggtacaaagacgtacttgggagtcggccat

SEQ ID NO: 405012 - DNA, 140 bp, Artificial Sequence
  Synthetic
atggccgactcccaagtacgtctttgtaccttagttcttctgtttgtggtgatattgaaagagcagttttttatttcttccttcagattttccccactactactactattgtcagcagtcggagacccagcatggcgtat

SEQ ID NO: 405013 - DNA, 140 bp, Artificial Sequence
  Synthetic
atacgccatgctgggtctccaggcatagtagcattaatagtagcactaataatagcaatagttgtgtggactatagtatatatagaatataggaaaattgtaaggcaaagaagaataaatcgtacttgggagtcggccat

SEQ ID NO: 405014 - DNA, 140 bp, Artificial Sequence
  Synthetic
atggccgactcccaagtacgatttattcttctttgccttacaattttcctatattctatatatactatagtccacacaactattgctattattagtgctactattaatgctactatgcctggagacccagcatggcgtat

SEQ ID NO: 405015 - DNA, 140 bp, Artificial Sequence
  Synthetic
atacgccatgctgggtctccgtgtataatactactagcactagtaatactagcacaataatagtagggaatgaagaaatgaaaaactgctctttcaatatcaccacaagcataagaaatacgtacttgggagtcggccat

SEQ ID NO: 405016 - DNA, 140 bp, Artificial Sequence
  Synthetic
atggccgactcccaagtacgtatttcttatgcttgtggtgatattgaaagagcagtttttcatttcttcattccctactattattgtgctagtattactagtgctagtagtattatacacggagacccagcatggcgtat

SEQ ID NO: 405017 - DNA, 140 bp, Artificial Sequence
  Synthetic
  misc_feature (24)..(24): n is a, c, g, or t
atacgccatgctgggtctccaagnagtggtaattagatctgccaatttctcagacaatgctaaaaacataatagtacagctgaatgaaactgtagtaattaattgtacaagacccaacaacgtacttgggagtcggccat

SEQ ID NO: 405018 - DNA, 140 bp, Artificial Sequence
  Synthetic
  misc_feature (117)..(117): n is a, c, g, or t
atggccgactcccaagtacgttgttgggtcttgtacaattaattactacagtttcattcagctgtactattatgtttttagcattgtctgagaaattggcagatctaattaccactncttggagacccagcatggcgtat

SEQ ID NO: 405019 - DNA, 140 bp, Artificial Sequence
  Synthetic
atacgccatgctgggtctccagttaacaccacaacaataacctttaataaatcatcgggaggagacctagaaattgtaatgcacacttttaattgtggaggggaatttttctactgtaatcgtacttgggagtcggccat

SEQ ID NO: 405020 - DNA, 140 bp, Artificial Sequence
  Synthetic
atggccgactcccaagtacgattacagtagaaaaattcccctccacaattaaaagtgtgcattacaatttctaggtctcctcccgatgatttattaaaggttattgttgtggtgttaactggagacccagcatggcgtat

SEQ ID NO: 405021 - DNA, 140 bp, Artificial Sequence
  Synthetic
aggccctggctgctgatatgaaattgtaatgcacacttttaattgtggaggggaatttttctactgtaatacaacaaaattgtttaacagtacttggaagaagaataataacacttggacgaccttttgggacagcggtg

SEQ ID NO: 405022 - DNA, 140 bp, Artificial Sequence
  Synthetic
caccgctgtcccaaaaggtcgtccaagtgttattattcttcttccaagtactgttaaacaattttgttgtattacagtagaaaaattcccctccacaattaaaagtgtgcattacaatttcatatcagcagccagggcct

SEQ ID NO: 405023 - DNA, 140 bp, Artificial Sequence
  Synthetic
aggccctggctgctgatatgagatacctaaaggatcaacagctcctagggatttggggctgctctggaaaactcatctgcaccactgctgtgccttggaatactagttggagtaataaatgaccttttgggacagcggtg

SEQ ID NO: 405024 - DNA, 140 bp, Artificial Sequence
  Synthetic
caccgctgtcccaaaaggtcatttattactccaactagtattccaaggcacagcagtggtgcagatgagttttccagagcagccccaaatccctaggagctgttgatcctttaggtatctcatatcagcagccagggcct

SEQ ID NO: 405025 - DNA, 140 bp, Artificial Sequence
  Synthetic
aggccctggctgctgatatgtaaatacagtggggggacatcaagcagccatgcaaatgttaaaagataccatcaatgaggaggctgcagaatgggatagattacatccagtacatgcagggaccttttgggacagcggtg

SEQ ID NO: 405026 - DNA, 140 bp, Artificial Sequence
  Synthetic
caccgctgtcccaaaaggtccctgcatgtactggatgtaatctatcccattctgcagcctcctcattgatggtatcttttaacatttgcatggctgcttgatgtccccccactgtatttacatatcagcagccagggcct

SEQ ID NO: 405027 - DNA, 140 bp, Artificial Sequence
  Synthetic
aggccctggctgctgatatgcatagtatatatagaatataggaaattagtaaaacaaagaaaaatagactggttaattaaaagaattagggaaagagcagaagacagtggcaatgagagtgaccttttgggacagcggtg

SEQ ID NO: 405028 - DNA, 140 bp, Artificial Sequence
  Synthetic
caccgctgtcccaaaaggtcactctcattgccactgtcttctgctctttccctaattcttttaattaaccagtctatttttctttgttttactaatttcctatattctatatatactatgcatatcagcagccagggcct

SEQ ID NO: 405029 - DNA, 140 bp, Artificial Sequence
  Synthetic
aggccctggctgctgatatgggttaattaaaagaattagggaaagagcagaagacagtggcaatgagagtgatggggatacagaggaattgtcaacaatggtggatatggggaatcttaggaccttttgggacagcggtg

SEQ ID NO: 405030 - DNA, 140 bp, Artificial Sequence
  Synthetic
caccgctgtcccaaaaggtcctaagattccccatatccaccattgttgacaattcctctgtatccccatcactctcattgccactgtcttctgctctttccctaattcttttaattaacccatatcagcagccagggcct

SEQ ID NO: 405031 - DNA, 140 bp, Artificial Sequence
  Synthetic
aggccctggctgctgatatgttagggaagatctggccttcccacaagggaaggccagggaactttcttcagagcagaccagagccaacagccccaccagaagagagcttcaggtttgggggaccttttgggacagcggtg

SEQ ID NO: 405032 - DNA, 140 bp, Artificial Sequence
  Synthetic
caccgctgtcccaaaaggtcccccaaacctgaagctctcttctggtggggctgttggctctggtctgctctgaagaaagttccctggccttcccttgtgggaaggccagatcttccctaacatatcagcagccagggcct

SEQ ID NO: 405033 - DNA, 140 bp, Artificial Sequence
  Synthetic
atacgccatgctgggtctccccaaaatgacacagggataagaaattgctctttcaatgcaaccacagaaataagagataagaaaaagaaagaaggggcacttttttatagacttgatgtacgtacttgggagtcggccat

SEQ ID NO: 405034 - DNA, 140 bp, Artificial Sequence
  Synthetic
atggccgactcccaagtacgtacatcaagtctataaaaaagtgccccttctttctttttcttatctcttatttctgtggttgcattgaaagagcaatttcttatccctgtgtcattttggggagacccagcatggcgtat

SEQ ID NO: 405035 - DNA, 140 bp, Artificial Sequence
  Synthetic
aggccctggctgctgatatggagtgctattagtctgcttgatgccatagcaatagcagtagctgaaggaacagataggattatagaattaatacaaagaatttgtagagctatccgcaacgaccttttgggacagcggtg

SEQ ID NO: 405036 - DNA, 140 bp, Artificial Sequence
  Synthetic
caccgctgtcccaaaaggtcgttgcggatagctctacaaattctttgtattaattctataatcctatctgttccttcagctactgctattgctatggcatcaagcagactaatagcactccatatcagcagccagggcct

SEQ ID NO: 405037 - DNA, 140 bp, Artificial Sequence
  Synthetic
aggccctggctgctgatatgttgctaaccactcaggaggggatgtagaaattacaacacatagttttaattgtggaggagaatttttctattgcaatacatcaggactgtttaatagcacgaccttttgggacagcggtg

SEQ ID NO: 405038 - DNA, 140 bp, Artificial Sequence
  Synthetic
caccgctgtcccaaaaggtcgtgctattaaacagtcctgatgtattgcaatagaaaaattctcctccacaattaaaactatgtgttgtaatttctacatcccctcctgagtggttagcaacatatcagcagccagggcct

SEQ ID NO: 405039 - DNA, 140 bp, Artificial Sequence
  Synthetic
aggccctggctgctgatatggcagcaggaagcactatgggcgcggcgtcaataacgctgacggtacaggccagacaattattgtctggtatagtgcaacagcagagcaatctgctgagaggaccttttgggacagcggtg

SEQ ID NO: 405040 - DNA, 140 bp, Artificial Sequence
  Synthetic
caccgctgtcccaaaaggtcctctcagcagattgctctgctgttgcactataccagacaataattgtctggcctgtaccgtcagcgttattgacgccgcgcccatagtgcttcctgctgccatatcagcagccagggcct

SEQ ID NO: 405041 - DNA, 140 bp, Artificial Sequence
  Synthetic
aggccctggctgctgatatgaatattttgactgtttttcagactctgccataaggaaagccatattaggacaagtagttagacataggtgtgaatatccatcaggacacaacaaggtagggaccttttgggacagcggtg

SEQ ID NO: 405042 - DNA, 140 bp, Artificial Sequence
  Synthetic
caccgctgtcccaaaaggtccctaccttgttgtgtcctgatggatattcacacctatgtctaactacttgtcctaatatggctttccttatggcagagtctgaaaaacagtcaaaatattcatatcagcagccagggcct

SEQ ID NO: 405043 - DNA, 140 bp, Artificial Sequence
  Synthetic
atacgccatgctgggtctcctaaaattgaccccactctgtgtcactttagaatgtacaaaggttagaaatgggactaacagtaagggtaccaacaagacctacgatgagatgaaaaattgcgtacttgggagtcggccat

SEQ ID NO: 405044 - DNA, 140 bp, Artificial Sequence
  Synthetic
atggccgactcccaagtacgcaatttttcatctcatcgtaggtcttgttggtacccttactgttagtcccatttctaacctttgtacattctaaagtgacacagagtggggtcaattttaggagacccagcatggcgtat

SEQ ID NO: 405045 - DNA, 140 bp, Artificial Sequence
  Synthetic
aggccctggctgctgatatggtggggctgctctggaaaacgcatctgcaccactactgtgccttggaactctagttggaataatagaaattatagtgatatttgggataatctgacatgggaccttttgggacagcggtg

SEQ ID NO: 405046 - DNA, 140 bp, Artificial Sequence
  Synthetic
caccgctgtcccaaaaggtcccatgtcagattatcccaaatatcactataatttctattattccaactagagttccaaggcacagtagtggtgcagatgcgttttccagagcagccccaccatatcagcagccagggcct

SEQ ID NO: 405047 - DNA, 140 bp, Artificial Sequence
  Synthetic
aggccctggctgctgatatgcaatggacatatcaaatttatcaagagccatttaaaaatctgaaaacaggaaaatatgcaagaatgaggggtacccacactaatgatgtaaaacaattaagaccttttgggacagcggtg

SEQ ID NO: 405048 - DNA, 140 bp, Artificial Sequence
  Synthetic
caccgctgtcccaaaaggtcttaattgttttacatcattagtgtgggtacccctcattcttgcatattttcctgttttcagatttttaaatggctcttgataaatttgatatgtccattgcatatcagcagccagggcct

SEQ ID NO: 405049 - DNA, 140 bp, Artificial Sequence
  Synthetic
atacgccatgctgggtctccgagcagcgtctcaagacttagataaacatggggcacttacaatcaacaacacagtcagcaataatgctgcttgtgcctggttggcagcacaagaagaggacgtacttgggagtcggccat

SEQ ID NO: 405050 - DNA, 140 bp, Artificial Sequence
  Synthetic
atggccgactcccaagtacgtcctcttcttgtgctgccaaccaggcacaagcagcattattgctgactgtgttgttgattgtaagtgccccatgtttatctaagtcttgagacgctgctcggagacccagcatggcgtat

SEQ ID NO: 405051 - DNA, 140 bp, Artificial Sequence
  Synthetic
aggccctggctgctgatatgttgtattggggtcgggagctaaagaatagtgctattaatttgcttgatacaatagcaatagcagtagctaactggacagatagggttatagaaatagtacgaccttttgggacagcggtg

SEQ ID NO: 405052 - DNA, 140 bp, Artificial Sequence
  Synthetic
caccgctgtcccaaaaggtcgtactatttctataaccctatctgtccagttagctactgctattgctattgtatcaagcaaattaatagcactattctttagctcccgaccccaatacaacatatcagcagccagggcct

SEQ ID NO: 405053 - DNA, 140 bp, Artificial Sequence
  Synthetic
aggccctggctgctgatatgaacaagacttattggcatttgacaagtgggcaagtctgtggaattggtttgatatatcaaaatggctgtggtatataaaaatattcataatgatagtagggaccttttgggacagcggtg

SEQ ID NO: 405054 - DNA, 140 bp, Artificial Sequence
  Synthetic
caccgctgtcccaaaaggtccctactatcattatgaatatttttatataccacagccattttgatatatcaaaccaattccacagacttgcccacttgtcaaatgccaataagtcttgttcatatcagcagccagggcct

SEQ ID NO: 405055 - DNA, 140 bp, Artificial Sequence
  Synthetic
aggccctggctgctgatatgcaacatattggggtctgcatacaggagaaagagactggcatttgggtcagggagtctccatagaatggaggaaaaagagatatagcacacaagtagacccgaccttttgggacagcggtg

SEQ ID NO: 405056 - DNA, 140 bp, Artificial Sequence
  Synthetic
caccgctgtcccaaaaggtcgggtctacttgtgtgctatatctctttttcctccattctatggagactccctgacccaaatgccagtctctttctcctgtatgcagaccccaatatgttgcatatcagcagccagggcct

SEQ ID NO: 405057 - DNA, 140 bp, Artificial Sequence
  Synthetic
atacgccatgctgggtctccgtaaaaagtgttgctggcattggccaagttgcttctgaaaaaaggctaggcatctcctatggcaggaagaagcggaaacaacgacgaggaactcctcaaacgtacttgggagtcggccat

SEQ ID NO: 405058 - DNA, 140 bp, Artificial Sequence
  Synthetic
atggccgactcccaagtacgtttgaggagttcctcgtcgttgtttccgcttcttcctgccataggagatgcctagccttttttcagaagcaacttggccaatgccagcaacactttttacggagacccagcatggcgtat

SEQ ID NO: 405059 - DNA, 140 bp, Artificial Sequence
  Synthetic
atacgccatgctgggtctcccagctttgctataaaataaagaacaagtggtcaaaaagctagcctgctgtaagagcaagaatacaaagaactaagccagcagcaaaaagagcagcagagacgtacttgggagtcggccat

SEQ ID NO: 405060 - DNA, 140 bp, Artificial Sequence
  Synthetic
atggccgactcccaagtacgtctctgctgctctttttgctgctggcttagttctttgtattcttgctcttacagcaggctagctttttgaccacttgttctttattttatagcaaagctgggagacccagcatggcgtat

SEQ ID NO: 405061 - DNA, 140 bp, Artificial Sequence
  Synthetic
atacgccatgctgggtctcctacaagaccctaccacaatataagaagatggatacatataggaccagggagagcattttatgccgcaaaaggcatacaaggaactatgagacaagcacatcgtacttgggagtcggccat

SEQ ID NO: 405062 - DNA, 140 bp, Artificial Sequence
  Synthetic
atggccgactcccaagtacgatgtgcttgtctcatagttccttgtatgccttttgcggcataaaatgctctccctggtcctatatgtatccatcttcttatattgtggtagggtcttgtaggagacccagcatggcgtat

SEQ ID NO: 405063 - DNA, 140 bp, Artificial Sequence
  Synthetic
atacgccatgctgggtctcctcctactaccaagagtaatagtagttggataaatgaggagggagagatgaaaaactgctctttcaatgttaccacaagcagaaaagataagatgaaaaaacgtacttgggagtcggccat

SEQ ID NO: 405064 - DNA, 140 bp, Artificial Sequence
  Synthetic
atggccgactcccaagtacgttttttcatcttatcttttctgcttgtggtaacattgaaagagcagtttttcatctctccctcctcatttatccaactactattactcttggtagtaggaggagacccagcatggcgtat

SEQ ID NO: 405065 - DNA, 140 bp, Artificial Sequence
  Synthetic
aggccctggctgctgatatgccgcaacctacctagaagaataagacaaggttttgaagcagctttgctataaaatggggggcaaatggtcaaaaagcagcatagttggatggcctgaggtgaccttttgggacagcggtg

SEQ ID NO: 405066 - DNA, 140 bp, Artificial Sequence
  Synthetic
caccgctgtcccaaaaggtcacctcaggccatccaactatgctgctttttgaccatttgccccccattttatagcaaagctgcttcaaaaccttgtcttattcttctaggtaggttgcggcatatcagcagccagggcct

SEQ ID NO: 405067 - DNA, 140 bp, Artificial Sequence
  Synthetic
atacgccatgctgggtctccgtaataggaaagataagacaagcacattgtagccttagtgaatcaaaatggaaaaggactttagaacagatagctacaaaattaggagaacagtttaaaacgtacttgggagtcggccat

SEQ ID NO: 405068 - DNA, 140 bp, Artificial Sequence
  Synthetic
atggccgactcccaagtacgttttaaactgttctcctaattttgtagctatctgttctaaagtccttttccattttgattcactaaggctacaatgtgcttgtcttatctttcctattacggagacccagcatggcgtat

SEQ ID NO: 405069 - DNA, 140 bp, Artificial Sequence
  Synthetic
atacgccatgctgggtctccttgctctggaaaactcatttgcaccactactgtgccttggaatactagttggagtaatagatctcaggatgatatttggaataacaataacttgacctggcgtacttgggagtcggccat

SEQ ID NO: 405070 - DNA, 140 bp, Artificial Sequence
  Synthetic
atggccgactcccaagtacgccaggtcaagttattgttattccaaatatcatcctgagatctattactccaactagtattccaaggcacagtagtggtgcaaatgagttttccagagcaaggagacccagcatggcgtat

SEQ ID NO: 405071 - DNA, 140 bp, Artificial Sequence
  Synthetic
atacgccatgctgggtctccattgtaatgcacagttttaactgtggaggggaatttttctactgtaatacatcacggctgtttaatagtgtttggaggctggataataacacttcttgggcgtacttgggagtcggccat

SEQ ID NO: 405072 - DNA, 140 bp, Artificial Sequence
  Synthetic
atggccgactcccaagtacgcccaagaagtgttattatccagcctccaaacactattaaacagccgtgatgtattacagtagaaaaattcccctccacagttaaaactgtgcattacaatggagacccagcatggcgtat

SEQ ID NO: 405073 - DNA, 140 bp, Artificial Sequence
  Synthetic
atacgccatgctgggtctccacactcccatgcagaataaaacaaatcataaacatgtggctggcagtaggaaaagcaacgtctccccctcccatccgaggacaaataagatgttcatcaacgtacttgggagtcggccat

SEQ ID NO: 405074 - DNA, 140 bp, Artificial Sequence
  Synthetic
atggccgactcccaagtacgttgatgaacatcttatttgtcctcggatgggagggggagacgttgcttttcctactgccagccacatgtttatgatttgttttattctgcatgggagtgtggagacccagcatggcgtat

SEQ ID NO: 405075 - DNA, 140 bp, Artificial Sequence
  Synthetic
aggccctggctgctgatatgttggtggaatctcctacagtattggagtcaggaactaaagaatagtgctgttagcttgctcaacgccacagccatagcagtagctgaggggacagatagggaccttttgggacagcggtg

SEQ ID NO: 405076 - DNA, 140 bp, Artificial Sequence
  Synthetic
caccgctgtcccaaaaggtccctatctgtcccctcagctactgctatggctgtggcgttgagcaagctaacagcactattctttagttcctgactccaatactgtaggagattccaccaacatatcagcagccagggcct

SEQ ID NO: 405077 - DNA, 140 bp, Artificial Sequence
  Synthetic
aggccctggctgctgatatggtggcgcccgaacagggacgcgaaagcgaaagagaaaccagaggagatctctcgacgcaggactcggcttgctgaagcgcgcacagcaagaggcgagggggaccttttgggacagcggtg

SEQ ID NO: 405078 - DNA, 140 bp, Artificial Sequence
  Synthetic
caccgctgtcccaaaaggtccccctcgcctcttgctgtgcgcgcttcagcaagccgagtcctgcgtcgagagatctcctctggtttctctttcgctttcgcgtccctgttcgggcgccaccatatcagcagccagggcct

SEQ ID NO: 405079 - DNA, 140 bp, Artificial Sequence
  Synthetic
aggccctggctgctgatatgaggagaaaaatgaaaaagatttattagcattggacagttggaaaaacttgtggagttggtttgacatatcaaattggttgtggtatataaaaatattcatgaccttttgggacagcggtg

SEQ ID NO: 405080 - DNA, 140 bp, Artificial Sequence
  Synthetic
caccgctgtcccaaaaggtcatgaatatttttatataccacaaccaatttgatatgtcaaaccaactccacaagtttttccaactgtccaatgctaataaatctttttcatttttctcctcatatcagcagccagggcct

SEQ ID NO: 405081 - DNA, 140 bp, Artificial Sequence
  Synthetic
aggccctggctgctgatatgataactgcaatagtaggattagtagtagcatttatagcagccatagttgtgtggaccatagtatatatagaatataggaaaataagaaaacagaagaaaagaccttttgggacagcggtg

SEQ ID NO: 405082 - DNA, 140 bp, Artificial Sequence
  Synthetic
caccgctgtcccaaaaggtcttttcttctgttttcttattttcctatattctatatatactatggtccacacaactatggctgctataaatgctactactaatcctactattgcagttatcatatcagcagccagggcct

SEQ ID NO: 405083 - DNA, 140 bp, Artificial Sequence
  Synthetic
aggccctggctgctgatatgccaaaatgcgaacccagattgtaagaccattttaaaagcattaggaccagcagctacactagaagaaatgatgacagcatgtcagggagtgggaggacccgaccttttgggacagcggtg

SEQ ID NO: 405084 - DNA, 140 bp, Artificial Sequence
  Synthetic
caccgctgtcccaaaaggtcgggtcctcccactccctgacatgctgtcatcatttcttctagtgtagctgctggtcctaatgcttttaaaatggtcttacaatctgggttcgcattttggcatatcagcagccagggcct

SEQ ID NO: 405085 - DNA, 140 bp, Artificial Sequence
  Synthetic
atacgccatgctgggtctcctgggtcacggtctattatggggtacctgtgtggagagacgcagagaccaccctattttgtgcatcagatgctaaagcatatgataaagaagtacataatgcgtacttgggagtcggccat

SEQ ID NO: 405086 - DNA, 140 bp, Artificial Sequence
  Synthetic
atggccgactcccaagtacgcattatgtacttctttatcatatgctttagcatctgatgcacaaaatagggtggtctctgcgtctctccacacaggtaccccataatagaccgtgacccaggagacccagcatggcgtat

SEQ ID NO: 405087 - DNA, 140 bp, Artificial Sequence
  Synthetic
aggccctggctgctgatatggtctcttttgatccaattcctatacattattgtgctccagctggttatgcgattctaaagtgtaataataagacattcaatggaacaggaccatgcactagaccttttgggacagcggtg

SEQ ID NO: 405088 - DNA, 140 bp, Artificial Sequence
  Synthetic
caccgctgtcccaaaaggtctagtgcatggtcctgttccattgaatgtcttattattacactttagaatcgcataaccagctggagcacaataatgtataggaattggatcaaaagagaccatatcagcagccagggcct

SEQ ID NO: 405089 - DNA, 140 bp, Artificial Sequence
  Synthetic
atacgccatgctgggtctcctaatctttactaaccacgcaggaggggatttagaaattacaacacatagttttatttgtggaggagaatttttctattgcaatacaacaaatttgtttaacgtacttgggagtcggccat

SEQ ID NO: 405090 - DNA, 140 bp, Artificial Sequence
  Synthetic
atggccgactcccaagtacgttaaacaaatttgttgtattgcaatagaaaaattctcctccacaaataaaactatgtgttgtaatttctaaatcccctcctgcgtggttagtaaagattaggagacccagcatggcgtat

SEQ ID NO: 405091 - DNA, 140 bp, Artificial Sequence
  Synthetic
aggccctggctgctgatatgaatagttgtgtggaccatagtattcatagaatataggaaaatattaagacagagaaaaatagacaggttaattgatagaataagagaaagagcagaagacgaccttttgggacagcggtg

SEQ ID NO: 405092 - DNA, 140 bp, Artificial Sequence
  Synthetic
caccgctgtcccaaaaggtcgtcttctgctctttctcttattctatcaattaacctgtctatttttctctgtcttaatattttcctatattctatgaatactatggtccacacaactattcatatcagcagccagggcct

SEQ ID NO: 405093 - DNA, 140 bp, Artificial Sequence
  Synthetic
atacgccatgctgggtctcccgaggctaatttgatcaatagcatcaacacaaccagtaaccctaacggaataggaaatctaacagatgaagtaagcaactgcacttttaatgcaacaacacgtacttgggagtcggccat

SEQ ID NO: 405094 - DNA, 140 bp, Artificial Sequence
  Synthetic
atggccgactcccaagtacgtgttgttgcattaaaagtgcagttgcttacttcatctgttagatttcctattccgttagggttactggttgtgttgatgctattgatcaaattagcctcgggagacccagcatggcgtat

SEQ ID NO: 405095 - DNA, 140 bp, Artificial Sequence
  Synthetic
aggccctggctgctgatatgaagaatcgaagaagaaggtggagagcaagacagagacagatccattcgattagtgagcggattcttagcacttgcctgggacgacctgcggagcctgtgcgaccttttgggacagcggtg

SEQ ID NO: 405096 - DNA, 140 bp, Artificial Sequence
  Synthetic
caccgctgtcccaaaaggtcgcacaggctccgcaggtcgtcccaggcaagtgctaagaatccgctcactaatcgaatggatctgtctctgtcttgctctccaccttcttcttcgattcttcatatcagcagccagggcct

SEQ ID NO: 405097 - DNA, 140 bp, Artificial Sequence
  Synthetic
aggccctggctgctgatatgtcggatgctaaagcatatagtactgaaaagcataatgtctgggctacacatgcttgtgtacccacagaccccaacccacaagaaataactctggaaaatggaccttttgggacagcggtg

SEQ ID NO: 405098 - DNA, 140 bp, Artificial Sequence
  Synthetic
caccgctgtcccaaaaggtccattttccagagttatttcttgtgggttggggtctgtgggtacacaagcatgtgtagcccagacattatgcttttcagtactatatgctttagcatccgacatatcagcagccagggcct

SEQ ID NO: 405099 - DNA, 140 bp, Artificial Sequence
  Synthetic
atacgccatgctgggtctccgctaggcatggagcaatcacaaacagtaatacagcatctaataatcctgattgtgcctggctggaagcacaagaggacgaggatgtaggctttccagtcacgtacttgggagtcggccat

SEQ ID NO: 405100 - DNA, 140 bp, Artificial Sequence
  Synthetic
atggccgactcccaagtacgtgactggaaagcctacatcctcgtcctcttgtgcttccagccaggcacaatcaggattattagatgctgtattactgtttgtgattgctccatgcctagcggagacccagcatggcgtat

SEQ ID NO: 405101 - DNA, 140 bp, Artificial Sequence
  Synthetic
aggccctggctgctgatatgaatggggaacaaatggtcaaaaggctggcctgctgtaagagatagaataagaagaactgagccagcaactgagccagcggcagagggagtagggtcagcagaccttttgggacagcggtg

SEQ ID NO: 405102 - DNA, 140 bp, Artificial Sequence
  Synthetic
caccgctgtcccaaaaggtctgctgaccctactccctctgccgctggctcagttgctggctcagttcttcttattctatctcttacagcaggccagccttttgaccatttgttccccattcatatcagcagccagggcct

SEQ ID NO: 405103 - DNA, 140 bp, Artificial Sequence
  Synthetic
atacgccatgctgggtctccatagaagagatacaattagaaggaaaatggaagccaaaaatgataggaggaattggaggatttatcaaagtaagacaatatgataatgtaacaatagacacgtacttgggagtcggccat

SEQ ID NO: 405104 - DNA, 140 bp, Artificial Sequence
  Synthetic
atggccgactcccaagtacgtgtctattgttacattatcatattgtcttactttgataaatcctccaattcctcctatcatttttggcttccattttccttctaattgtatctcttctatggagacccagcatggcgtat

SEQ ID NO: 405105 - DNA, 140 bp, Artificial Sequence
  Synthetic
aggccctggctgctgatatgtgctttctatagtgaatagagttaggcagggatactcacctgtgtctttccagacccctacccatcatcagagggaacccgacaggcccgaaggaatcgagaccttttgggacagcggtg

SEQ ID NO: 405106 - DNA, 140 bp, Artificial Sequence
  Synthetic
caccgctgtcccaaaaggtctcgattccttcgggcctgtcgggttccctctgatgatgggtaggggtctggaaagacacaggtgagtatccctgcctaactctattcactatagaaagcacatatcagcagccagggcct

SEQ ID NO: 405107 - DNA, 140 bp, Artificial Sequence
  Synthetic
aggccctggctgctgatatggtaaaaaattgctctttcaatacaaccacagaaataagagataagaaacagaaagcgtatgcacttttttatagacctgatatagtaccacttaatgagagaccttttgggacagcggtg

SEQ ID NO: 405108 - DNA, 140 bp, Artificial Sequence
  Synthetic
caccgctgtcccaaaaggtctctcattaagtggtactatatcaggtctataaaaaagtgcatacgctttctgtttcttatctcttatttctgtggttgtattgaaagagcaattttttaccatatcagcagccagggcct

SEQ ID NO: 405109 - DNA, 140 bp, Artificial Sequence
  Synthetic
aggccctggctgctgatatgaaacaggtgactggaaaattaaatgaacactttaataaaacaataggctttgaaccatcctcagaaggagatctagaaattacaatgcatcattttaactgaccttttgggacagcggtg

SEQ ID NO: 405110 - DNA, 140 bp, Artificial Sequence
  Synthetic
caccgctgtcccaaaaggtcagttaaaatgatgcattgtaatttctagatctccttctgaggatggttcaaagcctattgttttattaaagtgttcatttaattttccagtcacctgtttcatatcagcagccagggcct

SEQ ID NO: 405111 - DNA, 140 bp, Artificial Sequence
  Synthetic
aggccctggctgctgatatgttacaaatattagcaatagtagcattagtagtagtagcaataatagcaatagttgtgtggaccatagtgcttatagaatataggaaaatattaagacaaagaccttttgggacagcggtg

SEQ ID NO: 405112 - DNA, 140 bp, Artificial Sequence
  Synthetic
caccgctgtcccaaaaggtctttgtcttaatattttcctatattctataagcactatggtccacacaactattgctattattgctactactactaatgctactattgctaatatttgtaacatatcagcagccagggcct

SEQ ID NO: 405113 - DNA, 140 bp, Artificial Sequence
  Synthetic
aggccctggctgctgatatggtagagctatctgcaacctacctagaagactaagacagggttttgaagcagctttgctataaaatggggggcaaatggtcaaaaagcagcatagttggatgaccttttgggacagcggtg

SEQ ID NO: 405114 - DNA, 140 bp, Artificial Sequence
  Synthetic
caccgctgtcccaaaaggtcatccaactatgctgctttttgaccatttgccccccattttatagcaaagctgcttcaaaaccctgtcttagtcttctaggtaggttgcagatagctctaccatatcagcagccagggcct

SEQ ID NO: 405115 - DNA, 140 bp, Artificial Sequence
  Synthetic
aggccctggctgctgatatggctttgctataaaatggggggcaaatggtcaaaaagcagcatagttggatggcctgatgtaagagaaagaatgagaagaactgagccagcagcagagggagaccttttgggacagcggtg

SEQ ID NO: 405116 - DNA, 140 bp, Artificial Sequence
  Synthetic
caccgctgtcccaaaaggtctccctctgctgctggctcagttcttctcattctttctcttacatcaggccatccaactatgctgctttttgaccatttgccccccattttatagcaaagccatatcagcagccagggcct

SEQ ID NO: 405117 - DNA, 140 bp, Artificial Sequence
  Synthetic
atacgccatgctgggtctccataaaataagaaggatacatataggaccagggagagcatttattggaacagacatagaaggaaatataagacaagcatattgtaacattagtggagaagacgtacttgggagtcggccat

SEQ ID NO: 405118 - DNA, 140 bp, Artificial Sequence
  Synthetic
atggccgactcccaagtacgtcttctccactaatgttacaatatgcttgtcttatatttccttctatgtctgttccaataaatgctctccctggtcctatatgtatccttcttattttatggagacccagcatggcgtat

SEQ ID NO: 405119 - DNA, 140 bp, Artificial Sequence
  Synthetic
atacgccatgctgggtctccattactaataatagtactaatgccaataatagtagtgttaacaatagtagtcttgaatatatgaaggaagaaatgacaaactgttctttcaatgtcacaacgtacttgggagtcggccat

SEQ ID NO: 405120 - DNA, 140 bp, Artificial Sequence
  Synthetic
atggccgactcccaagtacgttgtgacattgaaagaacagtttgtcatttcttccttcatatattcaagactactattgttaacactactattattggcattagtactattattagtaatggagacccagcatggcgtat

SEQ ID NO: 405121 - DNA, 140 bp, Artificial Sequence
  Synthetic
atacgccatgctgggtctccatgtggcaagaggtaggaaaagcaatgtatgcccctcccatcgaaggaaacattagctgctcatcaaatattacagggctgctattaacaagagatggggcgtacttgggagtcggccat

SEQ ID NO: 405122 - DNA, 140 bp, Artificial Sequence
  Synthetic
atggccgactcccaagtacgccccatctcttgttaatagcagccctgtaatatttgatgagcagctaatgtttccttcgatgggaggggcatacattgcttttcctacctcttgccacatggagacccagcatggcgtat

SEQ ID NO: 405123 - DNA, 140 bp, Artificial Sequence
  Synthetic
aggccctggctgctgatatgcagaagaagaggtagtaattagatctgaaaatttcacgaacaatgctaaaaccataatagtacagctgaacgaaactgtagaaattaattgtacaagaccgaccttttgggacagcggtg

SEQ ID NO: 405124 - DNA, 140 bp, Artificial Sequence
  Synthetic
caccgctgtcccaaaaggtcggtcttgtacaattaatttctacagtttcgttcagctgtactattatggttttagcattgttcgtgaaattttcagatctaattactacctcttcttctgcatatcagcagccagggcct

SEQ ID NO: 405125 - DNA, 140 bp, Artificial Sequence
  Synthetic
aggccctggctgctgatatgtgctattaatctgtttgataccatagcaatagcagtagctgaagggacagataggattatagaagcagtacaaagggctgttagagctatcctccacatagaccttttgggacagcggtg

SEQ ID NO: 405126 - DNA, 140 bp, Artificial Sequence
  Synthetic
caccgctgtcccaaaaggtctatgtggaggatagctctaacagccctttgtactgcttctataatcctatctgtcccttcagctactgctattgctatggtatcaaacagattaatagcacatatcagcagccagggcct

SEQ ID NO: 405127 - DNA, 140 bp, Artificial Sequence
  Synthetic
atacgccatgctgggtctcctgacaacacaaggaaaaggatacatctaggaagggggagagtattttatgcaacaggaggcataaaaggagatataaggtacgcacattgcaacgttagtcgtacttgggagtcggccat

SEQ ID NO: 405128 - DNA, 140 bp, Artificial Sequence
  Synthetic
atggccgactcccaagtacgactaacgttgcaatgtgcgtaccttatatctccttttatgcctcctgttgcataaaatactctcccccttcctagatgtatccttttccttgtgttgtcaggagacccagcatggcgtat

SEQ ID NO: 405129 - DNA, 140 bp, Artificial Sequence
  Synthetic
aggccctggctgctgatatgaactgtgtaaactcctcaggggagctaaagcactaacagacatagtaccactgactgaagaagcagaattagaattggcagagaacagggagattctaaagaccttttgggacagcggtg

SEQ ID NO: 405130 - DNA, 140 bp, Artificial Sequence
  Synthetic
caccgctgtcccaaaaggtctttagaatctccctgttctctgccaattctaattctgcttcttcagtcagtggtactatgtctgttagtgctttagctcccctgaggagtttacacagttcatatcagcagccagggcct

SEQ ID NO: 405131 - DNA, 140 bp, Artificial Sequence
  Synthetic
aggccctggctgctgatatgttagtaggtttaagaatagtttttgctgtactttctgtagtgaatagagttaggcagggatattcaccattatcatttcagacccgcttcccagccccgagaccttttgggacagcggtg

SEQ ID NO: 405132 - DNA, 140 bp, Artificial Sequence
  Synthetic
caccgctgtcccaaaaggtctcggggctgggaagcgggtctgaaatgataatggtgaatatccctgcctaactctattcactacagaaagtacagcaaaaactattcttaaacctactaacatatcagcagccagggcct

SEQ ID NO: 405133 - DNA, 140 bp, Artificial Sequence
  Synthetic
aggccctggctgctgatatggaagcagaagttatcccagcagaaacaggacaggagacagcatactttctgctaaaattagcaggaagatggccagtaaaagtaatacacacagacaatggaccttttgggacagcggtg

SEQ ID NO: 405134 - DNA, 140 bp, Artificial Sequence
  Synthetic
caccgctgtcccaaaaggtccattgtctgtgtgtattacttttactggccatcttcctgctaattttagcagaaagtatgctgtctcctgtcctgtttctgctgggataacttctgcttccatatcagcagccagggcct

SEQ ID NO: 405135 - DNA, 140 bp, Artificial Sequence
  Synthetic
aggccctggctgctgatatgccaaaatttttgactagcggaggctagaaggagagagatgggtgcgagagcgtcagtattaagcgggggagaattagatagatgggaaaaaattcggttagaccttttgggacagcggtg

SEQ ID NO: 405136 - DNA, 140 bp, Artificial Sequence
  Synthetic
caccgctgtcccaaaaggtctaaccgaattttttcccatctatctaattctcccccgcttaatactgacgctctcgcacccatctctctccttctagcctccgctagtcaaaaattttggcatatcagcagccagggcct

SEQ ID NO: 405137 - DNA, 140 bp, Artificial Sequence
  Synthetic
aggccctggctgctgatatgtattaagacaaagaaaaatagacagattaattgatagaatagcagaaagagcagaagacagtggcaatgagagtgaaggggatcaggaagaattgtcagcgaccttttgggacagcggtg

SEQ ID NO: 405138 - DNA, 140 bp, Artificial Sequence
  Synthetic
caccgctgtcccaaaaggtcgctgacaattcttcctgatccccttcactctcattgccactgtcttctgctctttctgctattctatcaattaatctgtctatttttctttgtcttaatacatatcagcagccagggcct

SEQ ID NO: 405139 - DNA, 140 bp, Artificial Sequence
  Synthetic
atacgccatgctgggtctccaggaccaggggccacaaagggaaccatacaatgaatggacattagaactgctagaagaccttaagaatgaagctgtcaggcattttcctaggccttggctcgtacttgggagtcggccat

SEQ ID NO: 405140 - DNA, 140 bp, Artificial Sequence
  Synthetic
atggccgactcccaagtacgagccaaggcctaggaaaatgcctgacagcttcattcttaaggtcttctagcagttctaatgtccattcattgtatggttccctttgtggcccctggtcctggagacccagcatggcgtat

SEQ ID NO: 405141 - DNA, 140 bp, Artificial Sequence
  Synthetic
atacgccatgctgggtctccaatgaaaggggaaataaaaaactgctctttcaatatgaccacagaattaagggataagaaacagaaagtgtatgcacttttttataaacttgatatagtacgtacttgggagtcggccat

SEQ ID NO: 405142 - DNA, 140 bp, Artificial Sequence
  Synthetic
atggccgactcccaagtacgtactatatcaagtttataaaaaagtgcatacactttctgtttcttatcccttaattctgtggtcatattgaaagagcagttttttatttcccctttcattggagacccagcatggcgtat

SEQ ID NO: 405143 - DNA, 140 bp, Artificial Sequence
  Synthetic
aggccctggctgctgatatgaacaacaatacaagaaaaagtatacgctttggaccaggacaagccttctatacaaatgaaataataggggacataagacaagcacattgtaatatcaacagaccttttgggacagcggtg

SEQ ID NO: 405144 - DNA, 140 bp, Artificial Sequence
  Synthetic
caccgctgtcccaaaaggtctgttgatattacaatgtgcttgtcttatgtcccctattatttcatttgtatagaaggcttgtcctggtccaaagcgtatactttttcttgtattgttgttcatatcagcagccagggcct

SEQ ID NO: 405145 - DNA, 140 bp, Artificial Sequence
  Synthetic
aggccctggctgctgatatgccccactctgtgtcactttaaattgtacaaatgttaatactacagttaatgctactggagaaataaaaaattgctctttcaatgcaaccacagaaataaggaccttttgggacagcggtg

SEQ ID NO: 405146 - DNA, 140 bp, Artificial Sequence
  Synthetic
caccgctgtcccaaaaggtccttatttctgtggttgcattgaaagagcaattttttatttctccagtagcattaactgtagtattaacatttgtacaatttaaagtgacacagagtggggcatatcagcagccagggcct

SEQ ID NO: 405147 - DNA, 140 bp, Artificial Sequence
  Synthetic
atacgccatgctgggtctcctctatcatactaggaaatataacagatgaagtaaaaaactgttcttttagtatgaccacagaactaagagataagaagcagaaggtctatgctcttttttcgtacttgggagtcggccat

SEQ ID NO: 405148 - DNA, 140 bp, Artificial Sequence
  Synthetic
atggccgactcccaagtacgaaaaaagagcatagaccttctgcttcttatctcttagttctgtggtcatactaaaagaacagttttttacttcatctgttatatttcctagtatgatagaggagacccagcatggcgtat

SEQ ID NO: 405149 - DNA, 140 bp, Artificial Sequence
  Synthetic
aggccctggctgctgatatgacaaattataaatatgtggcagggggtaggacgggcaatgtatgcccctcccattgcaggaaatataacatgtaaatcaaatatcacaggactaatattggaccttttgggacagcggtg

SEQ ID NO: 405150 - DNA, 140 bp, Artificial Sequence
  Synthetic
caccgctgtcccaaaaggtccaatattagtcctgtgatatttgatttacatgttatatttcctgcaatgggaggggcatacattgcccgtcctaccccctgccacatatttataatttgtcatatcagcagccagggcct

SEQ ID NO: 405151 - DNA, 140 bp, Artificial Sequence
  Synthetic
aggccctggctgctgatatgagaatgaacaagaattattggaattggataaatgggcaagtttgtggaattggtttgacataacaaattggctgtggtatataaaaatattcataatgatgaccttttgggacagcggtg

SEQ ID NO: 405152 - DNA, 140 bp, Artificial Sequence
  Synthetic
caccgctgtcccaaaaggtcatcattatgaatatttttatataccacagccaatttgttatgtcaaaccaattccacaaacttgcccatttatccaattccaataattcttgttcattctcatatcagcagccagggcct

SEQ ID NO: 405153 - DNA, 140 bp, Artificial Sequence
  Synthetic
atacgccatgctgggtctcctgctaagaatagtagtacaaatgctacgaatggtgcccacaataatacctaccttgagggcatggataaggaaataaaaaattgctcttttaatacaacccgtacttgggagtcggccat

SEQ ID NO: 405154 - DNA, 140 bp, Artificial Sequence
  Synthetic
atggccgactcccaagtacgggttgtattaaaagagcaattttttatttccttatccatgccctcaaggtaggtattattgtgggcaccattcgtagcatttgtactactattcttagcaggagacccagcatggcgtat

SEQ ID NO: 405155 - DNA, 140 bp, Artificial Sequence
  Synthetic
aggccctggctgctgatatgagggaacccgacaggcccgaaagaatcgaagaaggaggtggcgagcaagacagagacagatccgtgcgcttagtgagcggattcttagcacttgcctggggaccttttgggacagcggtg

SEQ ID NO: 405156 - DNA, 140 bp, Artificial Sequence
  Synthetic
caccgctgtcccaaaaggtccccaggcaagtgctaagaatccgctcactaagcgcacggatctgtctctgtcttgctcgccacctccttcttcgattctttcgggcctgtcgggttccctcatatcagcagccagggcct

SEQ ID NO: 405157 - DNA, 140 bp, Artificial Sequence
  Synthetic
atacgccatgctgggtctccgaaaagcatactgtcagattaatggaacagaatggtataaagttttaaaacaggtaactgggaaattaaaagagcactttcctaataagaatataagctacgtacttgggagtcggccat

SEQ ID NO: 405158 - DNA, 140 bp, Artificial Sequence
  Synthetic
atggccgactcccaagtacgtagcttatattcttattaggaaagtgctcttttaatttcccagttacctgttttaaaactttataccattctgttccattaatctgacagtatgcttttcggagacccagcatggcgtat

SEQ ID NO: 405159 - DNA, 140 bp, Artificial Sequence
  Synthetic
aggccctggctgctgatatgcatactggggtcaggaactaaagaatagtgctattagtttgcttgatacagtagcaatagcagtagctaactggacagacagagttatagaattaggacagaccttttgggacagcggtg

SEQ ID NO: 405160 - DNA, 140 bp, Artificial Sequence
  Synthetic
caccgctgtcccaaaaggtctgtcctaattctataactctgtctgtccagttagctactgctattgctactgtatcaagcaaactaatagcactattctttagttcctgaccccagtatgcatatcagcagccagggcct

SEQ ID NO: 405161 - DNA, 140 bp, Artificial Sequence
  Synthetic
atacgccatgctgggtctccgtagcaatagcagtagctaactggacagacagagttatagaattaggacaaagaattggtagagctatttgcaacatacctagaagaatcagacagggcccgtacttgggagtcggccat

SEQ ID NO: 405162 - DNA, 140 bp, Artificial Sequence
  Synthetic
atggccgactcccaagtacgggccctgtctgattcttctaggtatgttgcaaatagctctaccaattctttgtcctaattctataactctgtctgtccagttagctactgctattgctacggagacccagcatggcgtat

SEQ ID NO: 405163 - DNA, 140 bp, Artificial Sequence
  Synthetic
aggccctggctgctgatatggtagctgaggggacagataggattatagaagcagtacaaagaactggtagagctattctcaacatacctagaagaataagacagggcttagaaagggcttgaccttttgggacagcggtg

SEQ ID NO: 405164 - DNA, 140 bp, Artificial Sequence
  Synthetic
caccgctgtcccaaaaggtcaagccctttctaagccctgtcttattcttctaggtatgttgagaatagctctaccagttctttgtactgcttctataatcctatctgtcccctcagctaccatatcagcagccagggcct

SEQ ID NO: 405165 - DNA, 140 bp, Artificial Sequence
  Synthetic
aggccctggctgctgatatgtagtaggaggcttaataggtttaagaataatttttgctgtgctttctatagtaaatagagttaggcagggatactcacctttgtcgttccagacccttacgaccttttgggacagcggtg

SEQ ID NO: 405166 - DNA, 140 bp, Artificial Sequence
  Synthetic
caccgctgtcccaaaaggtcgtaagggtctggaacgacaaaggtgagtatccctgcctaactctatttactatagaaagcacagcaaaaattattcttaaacctattaagcctcctactacatatcagcagccagggcct

SEQ ID NO: 405167 - DNA, 140 bp, Artificial Sequence
  Synthetic
aggccctggctgctgatatggagccagcagcagagggagtaggagcagcgtctcgagacttagataaatatggagcacttacaagcagcaacacacccaccaataatgctgattgtgcctgaccttttgggacagcggtg

SEQ ID NO: 405168 - DNA, 140 bp, Artificial Sequence
  Synthetic
caccgctgtcccaaaaggtcaggcacaatcagcattattggtgggtgtgttgctgcttgtaagtgctccatatttatctaagtctcgagacgctgctcctactccctctgctgctggctccatatcagcagccagggcct

SEQ ID NO: 405169 - DNA, 140 bp, Artificial Sequence
  Synthetic
atacgccatgctgggtctccactactgtaccttggaactccagttggagtaacaaatctcaagaacagatttggaatcacacgacttggatgcaatgggataaggaaattagtaattacacgtacttgggagtcggccat

SEQ ID NO: 405170 - DNA, 140 bp, Artificial Sequence
  Synthetic
atggccgactcccaagtacgtgtaattactaatttccttatcccattgcatccaagtcgtgtgattccaaatctgttcttgagatttgttactccaactggagttccaaggtacagtagtggagacccagcatggcgtat

SEQ ID NO: 405171 - DNA, 140 bp, Artificial Sequence
  Synthetic
atacgccatgctgggtctcctgaatccaacagtaatagcacaagcatagataaagagatgatgatgaattgctctttcaatataaccacagaagtaagagataaagaaaagaaagaaaatcgtacttgggagtcggccat

SEQ ID NO: 405172 - DNA, 140 bp, Artificial Sequence
  Synthetic
atggccgactcccaagtacgattttctttcttttctttatctcttacttctgtggttatattgaaagagcaattcatcatcatctctttatctatgcttgtgctattactgttggattcaggagacccagcatggcgtat

SEQ ID NO: 405173 - DNA, 140 bp, Artificial Sequence
  Synthetic
atacgccatgctgggtctccagctaccataatgatgcagaaaggcaattttaggaaccaaagaaagattgttaagtgtttcaattgtggcaaagaagggcacatagccagaaattgcaggcgtacttgggagtcggccat

SEQ ID NO: 405174 - DNA, 140 bp, Artificial Sequence
  Synthetic
atggccgactcccaagtacgcctgcaatttctggctatgtgcccttctttgccacaattgaaacacttaacaatctttctttggttcctaaaattgcctttctgcatcattatggtagctggagacccagcatggcgtat

SEQ ID NO: 405175 - DNA, 140 bp, Artificial Sequence
  Synthetic
atacgccatgctgggtctccgtgtgagaataggaccaggacaaacattctatgcaacaggagaaataataggaaatataagactagcacactgtaacgttagtgcagaggcatggaataacgtacttgggagtcggccat

SEQ ID NO: 405176 - DNA, 140 bp, Artificial Sequence
  Synthetic
atggccgactcccaagtacgttattccatgcctctgcactaacgttacagtgtgctagtcttatatttcctattatttctcctgttgcatagaatgtttgtcctggtcctattctcacacggagacccagcatggcgtat

SEQ ID NO: 405177 - DNA, 140 bp, Artificial Sequence
  Synthetic
aggccctggctgctgatatgctgctctggaaaactcatctgcaccactaatgtgccttggaatgacacttggagtaataaatctgaaaatgaaatatgggagaacatgacctggatgcaggaccttttgggacagcggtg

SEQ ID NO: 405178 - DNA, 140 bp, Artificial Sequence
  Synthetic
caccgctgtcccaaaaggtcctgcatccaggtcatgttctcccatatttcattttcagatttattactccaagtgtcattccaaggcacattagtggtgcagatgagttttccagagcagcatatcagcagccagggcct

SEQ ID NO: 405179 - DNA, 140 bp, Artificial Sequence
  Synthetic
aggccctggctgctgatatgaaataatagagcagttaataaaaaaggaaaaggtctacctggcatgggtaccagcacacaaaggaattggaggaaatgaacaagtagataaattagtcaggaccttttgggacagcggtg

SEQ ID NO: 405180 - DNA, 140 bp, Artificial Sequence
  Synthetic
caccgctgtcccaaaaggtcctgactaatttatctacttgttcatttcctccaattcctttgtgtgctggtacccatgccaggtagaccttttccttttttattaactgctctattatttcatatcagcagccagggcct

SEQ ID NO: 405181 - DNA, 140 bp, Artificial Sequence
  Synthetic
aggccctggctgctgatatgggactgtcaatgatatacagaaattagtgggaaaactaaattgggcaagtcagatttatccaggaattaaagtaaagcaactatgtaaactcctcagggggaccttttgggacagcggtg

SEQ ID NO: 405182 - DNA, 140 bp, Artificial Sequence
  Synthetic
caccgctgtcccaaaaggtccccctgaggagtttacatagttgctttactttaattcctggataaatctgacttgcccaatttagttttcccactaatttctgtatatcattgacagtcccatatcagcagccagggcct

SEQ ID NO: 405183 - DNA, 140 bp, Artificial Sequence
  Synthetic
atacgccatgctgggtctccctgttacgaatagcaccatagacaaaaatatggagggagaaataaaaaactgctctttctatgtcaccacaggcgtaggagataataaacgtaaagaacacgtacttgggagtcggccat

SEQ ID NO: 405184 - DNA, 140 bp, Artificial Sequence
  Synthetic
atggccgactcccaagtacgtgttctttacgtttattatctcctacgcctgtggtgacatagaaagagcagttttttatttctccctccatatttttgtctatggtgctattcgtaacagggagacccagcatggcgtat

SEQ ID NO: 405185 - DNA, 140 bp, Artificial Sequence
  Synthetic
aggccctggctgctgatatggaagaagtaggctttccagtcagacctcaggtgcctttaagaccaatgacttttaagggagcttttgatctcagcttctttttaaaagaaaaggggggacgaccttttgggacagcggtg

SEQ ID NO: 405186 - DNA, 140 bp, Artificial Sequence
  Synthetic
caccgctgtcccaaaaggtcgtccccccttttcttttaaaaagaagctgagatcaaaagctcccttaaaagtcattggtcttaaaggcacctgaggtctgactggaaagcctacttcttccatatcagcagccagggcct

SEQ ID NO: 405187 - DNA, 140 bp, Artificial Sequence
  Synthetic
atacgccatgctgggtctcctgaacgagactgtagaaattaattgtacaagaccaaacaaaaagataggaaaaagtataactctaggatgggggagagcattttatgcaacagatggaatcgtacttgggagtcggccat

SEQ ID NO: 405188 - DNA, 140 bp, Artificial Sequence
  Synthetic
atggccgactcccaagtacgattccatctgttgcataaaatgctctcccccatcctagagttatactttttcctatctttttgtttggtcttgtacaattaatttctacagtctcgttcaggagacccagcatggcgtat

SEQ ID NO: 405189 - DNA, 140 bp, Artificial Sequence
  Synthetic
aggccctggctgctgatatgaaacaggacaggagacagcctactttatattaaaattagcagggaagatggccagtaaagtagtacacacagacaatggcagcaatttcaccagtgctgcgaccttttgggacagcggtg

SEQ ID NO: 405190 - DNA, 140 bp, Artificial Sequence
  Synthetic
caccgctgtcccaaaaggtcgcagcactggtgaaattgctgccattgtctgtgtgtactactttactggccatcttccctgctaattttaatataaagtaggctgtctcctgtcctgtttcatatcagcagccagggcct

SEQ ID NO: 405191 - DNA, 140 bp, Artificial Sequence
  Synthetic
aggccctggctgctgatatgatagaggagttaagagaacatctactaaaatggggctttactacaccagacaaaaaacatcagaaagaacctccattccattggatggggtatgaactccgaccttttgggacagcggtg

SEQ ID NO: 405192 - DNA, 140 bp, Artificial Sequence
  Synthetic
caccgctgtcccaaaaggtcggagttcataccccatccaatggaatggaggttctttctgatgttttttgtctggtgtagtaaagccccattttagtagatgttctcttaactcctctatcatatcagcagccagggcct

SEQ ID NO: 405193 - DNA, 140 bp, Artificial Sequence
  Synthetic
aggccctggctgctgatatgaaagccttattaggacaagtagttagacctaagtgtgaatatcaagcaggacataataaggtaggatcgctacaatatttggcactgaaagcattagtaagaccttttgggacagcggtg

SEQ ID NO: 405194 - DNA, 140 bp, Artificial Sequence
  Synthetic
caccgctgtcccaaaaggtcttactaatgctttcagtgccaaatattgtagcgatcctaccttattatgtcctgcttgatattcacacttaggtctaactacttgtcctaataaggctttcatatcagcagccagggcct

SEQ ID NO: 405195 - DNA, 140 bp, Artificial Sequence
  Synthetic
aggccctggctgctgatatgaagaattattggaattggataaatgggcaagtttgtggaattggtttgacataacaaattggctgtggtatataaaaatattcataatgatagtaggagggaccttttgggacagcggtg

SEQ ID NO: 405196 - DNA, 140 bp, Artificial Sequence
  Synthetic
caccgctgtcccaaaaggtccctcctactatcattatgaatatttttatataccacagccaatttgttatgtcaaaccaattccacaaacttgcccatttatccaattccaataattcttcatatcagcagccagggcct

SEQ ID NO: 405197 - DNA, 140 bp, Artificial Sequence
  Synthetic
aggccctggctgctgatatgaaggcttaggcatttcctatggcaggaagaagcggagacagcgacgaagcgctcctccaagcagtgagaatcatcaagatcttatatcaaagcagtaagtgaccttttgggacagcggtg

SEQ ID NO: 405198 - DNA, 140 bp, Artificial Sequence
  Synthetic
caccgctgtcccaaaaggtcacttactgctttgatataagatcttgatgattctcactgcttggaggagcgcttcgtcgctgtctccgcttcttcctgccataggaaatgcctaagccttcatatcagcagccagggcct

SEQ ID NO: 405199 - DNA, 140 bp, Artificial Sequence
  Synthetic
atacgccatgctgggtctccacacagggtcaaatgacactataactctcccatgcagaataaagcaatttgtaaacatgtggcagagagtaggacaagcaatgtatgcccctcccatccacgtacttgggagtcggccat

SEQ ID NO: 405200 - DNA, 140 bp, Artificial Sequence
  Synthetic
atggccgactcccaagtacgtggatgggaggggcatacattgcttgtcctactctctgccacatgtttacaaattgctttattctgcatgggagagttatagtgtcatttgaccctgtgtggagacccagcatggcgtat

SEQ ID NO: 405201 - DNA, 140 bp, Artificial Sequence
  Synthetic
atacgccatgctgggtctccacagtaagattaatgaagtgcaagaaatgaaaaactgctctttcaatatgaccacagtattaaaagataaaaaaaagaagatggcggcacttttttataacgtacttgggagtcggccat

SEQ ID NO: 405202 - DNA, 140 bp, Artificial Sequence
  Synthetic
atggccgactcccaagtacgttataaaaaagtgccgccatcttcttttttttatcttttaatactgtggtcatattgaaagagcagtttttcatttcttgcacttcattaatcttactgtggagacccagcatggcgtat

SEQ ID NO: 405203 - DNA, 140 bp, Artificial Sequence
  Synthetic
atacgccatgctgggtctccggtaataaagggaatgctacggttgatcctaccactaaggaagaaataaaaaattgctctttcaatgtaactacagaaataagagacaagaaacagcaagcgtacttgggagtcggccat

SEQ ID NO: 405204 - DNA, 140 bp, Artificial Sequence
  Synthetic
atggccgactcccaagtacgcttgctgtttcttgtctcttatttctgtagttacattgaaagagcaattttttatttcttccttagtggtaggatcaaccgtagcattccctttattaccggagacccagcatggcgtat

SEQ ID NO: 405205 - DNA, 140 bp, Artificial Sequence
  Synthetic
atacgccatgctgggtctccaataacatttaaacaagcctcaggaggggatctagaaattacaacacatagctttaattgtggaggagaatttttctattgtgatacatcacaactgtttcgtacttgggagtcggccat

SEQ ID NO: 405206 - DNA, 140 bp, Artificial Sequence
  Synthetic
atggccgactcccaagtacgaaacagttgtgatgtatcacaatagaaaaattctcctccacaattaaagctatgtgttgtaatttctagatcccctcctgaggcttgtttaaatgttattggagacccagcatggcgtat

SEQ ID NO: 405207 - DNA, 140 bp, Artificial Sequence
  Synthetic
aggccctggctgctgatatggctctattagatacaggagcagatgatacagtattagaagacataaatttgccaggaaaatggaaaccaaaaatgatagggggaattggaggttttatcagaccttttgggacagcggtg

SEQ ID NO: 405208 - DNA, 140 bp, Artificial Sequence
  Synthetic
caccgctgtcccaaaaggtctgataaaacctccaattccccctatcatttttggtttccattttcctggcaaatttatgtcttctaatactgtatcatctgctcctgtatctaatagagccatatcagcagccagggcct

SEQ ID NO: 405209 - DNA, 140 bp, Artificial Sequence
  Synthetic
aggccctggctgctgatatgtatagaataggaatagcagcatttgcagtagcactaatcatagcaataattgtgtggaccatagtatatatagaatatagaaaactggtaagacaaagaagaccttttgggacagcggtg

SEQ ID NO: 405210 - DNA, 140 bp, Artificial Sequence
  Synthetic
caccgctgtcccaaaaggtcttctttgtcttaccagttttctatattctatatatactatggtccacacaattattgctatgattagtgctactgcaaatgctgctattcctattctatacatatcagcagccagggcct

SEQ ID NO: 405211 - DNA, 140 bp, Artificial Sequence
  Synthetic
aggccctggctgctgatatgtctgtggaattggtttgacataacaaattggctgtggtatataaaaatattcataatgatagtaggaggcttaataggtttaagaataatttttgctgtggaccttttgggacagcggtg

SEQ ID NO: 405212 - DNA, 140 bp, Artificial Sequence
  Synthetic
caccgctgtcccaaaaggtccacagcaaaaattattcttaaacctattaagcctcctactatcattatgaatatttttatataccacagccaatttgttatgtcaaaccaattccacagacatatcagcagccagggcct

SEQ ID NO: 405213 - DNA, 140 bp, Artificial Sequence
  Synthetic
aggccctggctgctgatatgtattatagattaataaattgtaatacctcagccataacacaagcctgtccaaaggtctcttttgatccaattcctatacactattgcactccagctggttgaccttttgggacagcggtg

SEQ ID NO: 405214 - DNA, 140 bp, Artificial Sequence
  Synthetic
caccgctgtcccaaaaggtcaaccagctggagtgcaatagtgtataggaattggatcaaaagagacctttggacaggcttgtgttatggctgaggtattacaatttattaatctataatacatatcagcagccagggcct

SEQ ID NO: 405215 - DNA, 140 bp, Artificial Sequence
  Synthetic
aggccctggctgctgatatgcatgtgtaaagttgaccccactctgtgtcactttaaactgtagtgatacaaagaatactagtaccgtaaatactactatggatggagaaatgaaaaattggaccttttgggacagcggtg

SEQ ID NO: 405216 - DNA, 140 bp, Artificial Sequence
  Synthetic
caccgctgtcccaaaaggtccaatttttcatttctccatccatagtagtatttacggtactagtattctttgtatcactacagtttaaagtgacacagagtggggtcaactttacacatgcatatcagcagccagggcct

SEQ ID NO: 405217 - DNA, 140 bp, Artificial Sequence
  Synthetic
atacgccatgctgggtctccgtggcgcccgaacagggacttgaagttaatagggactcggaaagcgaaagtaccagagaagtctctccgacgcagtcgaaagcgaaagttccagagaagccgtacttgggagtcggccat

SEQ ID NO: 405218 - DNA, 140 bp, Artificial Sequence
  Synthetic
atggccgactcccaagtacggcttctctggaactttcgctttcgactgcgtcggagagacttctctggtactttcgctttccgagtccctattaacttcaagtccctgttcgggcgccacggagacccagcatggcgtat

SEQ ID NO: 405219 - DNA, 140 bp, Artificial Sequence
  Synthetic
aggccctggctgctgatatgcacttttttatagacttgatatagtaccacttgatgagaattccagtgagtatagattaataaattgtaatacctcagccgtaacacaagcctgtccaaagaccttttgggacagcggtg

SEQ ID NO: 405220 - DNA, 140 bp, Artificial Sequence
  Synthetic
caccgctgtcccaaaaggtctttggacaggcttgtgttacggctgaggtattacaatttattaatctatactcactggaattctcatcaagtggtactatatcaagtctataaaaaagtgcatatcagcagccagggcct

SEQ ID NO: 405221 - DNA, 140 bp, Artificial Sequence
  Synthetic
aggccctggctgctgatatgctgaaaatctgacagacaatgccaaaataataatagtacaccttaatgaatctatagagattaaatgtacaaggcccaacaataatacaaggaaaagtgtgaccttttgggacagcggtg

SEQ ID NO: 405222 - DNA, 140 bp, Artificial Sequence
  Synthetic
caccgctgtcccaaaaggtcacacttttccttgtattattgttgggccttgtacatttaatctctatagattcattaaggtgtactattattattttggcattgtctgtcagattttcagcatatcagcagccagggcct

SEQ ID NO: 405223 - DNA, 140 bp, Artificial Sequence
  Synthetic
aggccctggctgctgatatgtggaaaacagatggcaggtgatgattgtgtggcaggtagacaggatgaggattaacaaatggaaaagtttagtaaaataccatatgcatatttcaaagaagaccttttgggacagcggtg

SEQ ID NO: 405224 - DNA, 140 bp, Artificial Sequence
  Synthetic
caccgctgtcccaaaaggtcttctttgaaatatgcatatggtattttactaaacttttccatttgttaatcctcatcctgtctacctgccacacaatcatcacctgccatctgttttccacatatcagcagccagggcct

SEQ ID NO: 405225 - DNA, 140 bp, Artificial Sequence
  Synthetic
aggccctggctgctgatatgttaacaattacacaaacacaatatacagtttgcttgaagaatcgcaaaaccagcaggaaaaaaatgaaaaggatttactagcattggacagttggaaaaagaccttttgggacagcggtg

SEQ ID NO: 405226 - DNA, 140 bp, Artificial Sequence
  Synthetic
caccgctgtcccaaaaggtctttttccaactgtccaatgctagtaaatccttttcatttttttcctgctggttttgcgattcttcaagcaaactgtatattgtgtttgtgtaattgttaacatatcagcagccagggcct

SEQ ID NO: 405227 - DNA, 140 bp, Artificial Sequence
  Synthetic
aggccctggctgctgatatggacccttatcccaaccccgaggggacccgacaggctcggaggaatcgaagaagaaggtggagagcaagacagagacagatccgtgcgattagtgagcggagaccttttgggacagcggtg

SEQ ID NO: 405228 - DNA, 140 bp, Artificial Sequence
  Synthetic
caccgctgtcccaaaaggtctccgctcactaatcgcacggatctgtctctgtcttgctctccaccttcttcttcgattcctccgagcctgtcgggtcccctcggggttgggataagggtccatatcagcagccagggcct

SEQ ID NO: 405229 - DNA, 140 bp, Artificial Sequence
  Synthetic
aggccctggctgctgatatgagggggacagctaatagaagccctattagacacaggagcagatgatacagtattagaagaaataaatttaccaggaaaatggaaaccaaaaatgataggggaccttttgggacagcggtg

SEQ ID NO: 405230 - DNA, 140 bp, Artificial Sequence
  Synthetic
caccgctgtcccaaaaggtcccctatcatttttggtttccattttcctggtaaatttatttcttctaatactgtatcatctgctcctgtgtctaatagggcttctattagctgtccccctcatatcagcagccagggcct

SEQ ID NO: 405231 - DNA, 140 bp, Artificial Sequence
  Synthetic
aggccctggctgctgatatgaaactagtagaagacagatggaacaagccccagaagaccaggggccacagagagagccatacaatgaatggacactagagcttttagaggagcttaagaagaccttttgggacagcggtg

SEQ ID NO: 405232 - DNA, 140 bp, Artificial Sequence
  Synthetic
caccgctgtcccaaaaggtcttcttaagctcctctaaaagctctagtgtccattcattgtatggctctctctgtggcccctggtcttctggggcttgttccatctgtcttctactagtttcatatcagcagccagggcct

SEQ ID NO: 405233 - DNA, 140 bp, Artificial Sequence
  Synthetic
aggccctggctgctgatatgatagaatataggaaaatattaagacaaagaaagatagacaggatacttgatagaataagagaaagagcagaagacagtggcaatgagagcgaaggagaccgaccttttgggacagcggtg

SEQ ID NO: 405234 - DNA, 140 bp, Artificial Sequence
  Synthetic
caccgctgtcccaaaaggtcggtctccttcgctctcattgccactgtcttctgctctttctcttattctatcaagtatcctgtctatctttctttgtcttaatattttcctatattctatcatatcagcagccagggcct

SEQ ID NO: 405235 - DNA, 140 bp, Artificial Sequence
  Synthetic
aggccctggctgctgatatgtggcaactctctattgtgtacataacaacatagaggtacgagacaccaaggaagccctagacaagatagaggaagaacaaaacaaaagtcagcaaaaaacgaccttttgggacagcggtg

SEQ ID NO: 405236 - DNA, 140 bp, Artificial Sequence
  Synthetic
caccgctgtcccaaaaggtcgttttttgctgacttttgttttgttcttcctctatcttgtctagggcttccttggtgtctcgtacctctatgttgttatgtacacaatagagagttgccacatatcagcagccagggcct

SEQ ID NO: 405237 - DNA, 140 bp, Artificial Sequence
  Synthetic
atacgccatgctgggtctccccatgacgagcattaccaacacaacggaggacatgcaaggagaaataaaaaactgctctttcaatacaaccacagaactaagggataaaagaaagaaagtcgtacttgggagtcggccat

SEQ ID NO: 405238 - DNA, 140 bp, Artificial Sequence
  Synthetic
atggccgactcccaagtacgactttctttcttttatcccttagttctgtggttgtattgaaagagcagttttttatttctccttgcatgtcctccgttgtgttggtaatgctcgtcatggggagacccagcatggcgtat

SEQ ID NO: 405239 - DNA, 140 bp, Artificial Sequence
  Synthetic
atacgccatgctgggtctccataataatactgcggagggggtggaagaaatgacaaactgctctttcgatgtcacaaacatgggaaagaagcataaagaatatgcaattttttataaaaccgtacttgggagtcggccat

SEQ ID NO: 405240 - DNA, 140 bp, Artificial Sequence
  Synthetic
atggccgactcccaagtacggttttataaaaaattgcatattctttatgcttctttcccatgtttgtgacatcgaaagagcagtttgtcatttcttccaccccctccgcagtattattatggagacccagcatggcgtat

SEQ ID NO: 405241 - DNA, 140 bp, Artificial Sequence
  Synthetic
atacgccatgctgggtctccagaataatctatgcaaaaggaagaataataggagatataagaaaagcacagtgtaaccttaatagaacagaatgggaaaaaactttaaaacagatagttacgtacttgggagtcggccat

SEQ ID NO: 405242 - DNA, 140 bp, Artificial Sequence
  Synthetic
atggccgactcccaagtacgtaactatctgttttaaagttttttcccattctgttctattaaggttacactgtgcttttcttatatctcctattattcttccttttgcatagattattctggagacccagcatggcgtat

SEQ ID NO: 405243 - DNA, 140 bp, Artificial Sequence
  Synthetic
aggccctggctgctgatatgaataatacaaggaaaagtgtaaggataggaccaggacaagtattctatgcaacaggagacataataggagatataagacaagcacattgtaacattagcagaccttttgggacagcggtg

SEQ ID NO: 405244 - DNA, 140 bp, Artificial Sequence
  Synthetic
caccgctgtcccaaaaggtctgctaatgttacaatgtgcttgtcttatatctcctattatgtctcctgttgcatagaatacttgtcctggtcctatccttacacttttccttgtattattcatatcagcagccagggcct

SEQ ID NO: 405245 - DNA, 140 bp, Artificial Sequence
  Synthetic
aggccctggctgctgatatgggaatttttctactgtaatacaacaaagctgtttaatagtacttggcagcgtaatgacacttggaataacagcagcacttgggataacagcacttggaatgaccttttgggacagcggtg

SEQ ID NO: 405246 - DNA, 140 bp, Artificial Sequence
  Synthetic
caccgctgtcccaaaaggtcattccaagtgctgttatcccaagtgctgctgttattccaagtgtcattacgctgccaagtactattaaacagctttgttgtattacagtagaaaaattcccatatcagcagccagggcct

SEQ ID NO: 405247 - DNA, 140 bp, Artificial Sequence
  Synthetic
atacgccatgctgggtctccccgcctcccaacccagagggaccccgacaggcccggagaaatcgaaggagaaggtggagaaagagacaacaacagatccattcgattagtagacggattccgtacttgggagtcggccat

SEQ ID NO: 405248 - DNA, 140 bp, Artificial Sequence
  Synthetic
atggccgactcccaagtacggaatccgtctactaatcgaatggatctgttgttgtctctttctccaccttctccttcgatttctccgggcctgtcggggtccctctgggttgggaggcggggagacccagcatggcgtat

SEQ ID NO: 405249 - DNA, 140 bp, Artificial Sequence
  Synthetic
aggccctggctgctgatatgcattaaggattatggaaaacagatggcaggtgctgattgtgtggcaggtagacaggatgaggattagaacatggaatagtttagtaaagcaccatatgtagaccttttgggacagcggtg

SEQ ID NO: 405250 - DNA, 140 bp, Artificial Sequence
  Synthetic
caccgctgtcccaaaaggtctacatatggtgctttactaaactattccatgttctaatcctcatcctgtctacctgccacacaatcagcacctgccatctgttttccataatccttaatgcatatcagcagccagggcct

SEQ ID NO: 405251 - DNA, 140 bp, Artificial Sequence
  Synthetic
aggccctggctgctgatatgctgtggtatataaaaatattcataatgatagtaggaggcttgataggtttaagaatagtttttactgtactttctatagtgaatagagttaggcagggatgaccttttgggacagcggtg

SEQ ID NO: 405252 - DNA, 140 bp, Artificial Sequence
  Synthetic
caccgctgtcccaaaaggtcatccctgcctaactctattcactatagaaagtacagtaaaaactattcttaaacctatcaagcctcctactatcattatgaatatttttatataccacagcatatcagcagccagggcct

SEQ ID NO: 405253 - DNA, 140 bp, Artificial Sequence
  Synthetic
aggccctggctgctgatatggcggcgactggtgagtacgccaatttttgactagcggaggctagaaggagagagatgggtgcgagagcgtcagtattaagcgggggagaattagatagatgaccttttgggacagcggtg

SEQ ID NO: 405254 - DNA, 140 bp, Artificial Sequence
  Synthetic
caccgctgtcccaaaaggtcatctatctaattctcccccgcttaatactgacgctctcgcacccatctctctccttctagcctccgctagtcaaaaattggcgtactcaccagtcgccgccatatcagcagccagggcct

SEQ ID NO: 405255 - DNA, 140 bp, Artificial Sequence
  Synthetic
aggccctggctgctgatatggctttgcaagattcaggatcagaagtaaacatagtaacagactcacagtatgcattaggaatcattcaagcacaaccagataagagtgaatcagagttaggaccttttgggacagcggtg

SEQ ID NO: 405256 - DNA, 140 bp, Artificial Sequence
  Synthetic
caccgctgtcccaaaaggtcctaactctgattcactcttatctggttgtgcttgaatgattcctaatgcatactgtgagtctgttactatgtttacttctgatcctgaatcttgcaaagccatatcagcagccagggcct

SEQ ID NO: 405257 - DNA, 140 bp, Artificial Sequence
  Synthetic
aggccctggctgctgatatgatcatagcaatagttgtgtggaccatagcatatatagaatataggaaattgttaaggcagagaaaaatagacaggttagttgacagaattagggaaagaggaccttttgggacagcggtg

SEQ ID NO: 405258 - DNA, 140 bp, Artificial Sequence
  Synthetic
caccgctgtcccaaaaggtcctctttccctaattctgtcaactaacctgtctatttttctctgccttaacaatttcctatattctatatatgctatggtccacacaactattgctatgatcatatcagcagccagggcct

SEQ ID NO: 405259 - DNA, 140 bp, Artificial Sequence
  Synthetic
atacgccatgctgggtctcccggtaccattataaacagtaccaatataaatggtacaaacagcatgcgagaggaaatgagaaactgctctttcaatataaccacagaaataagggataagcgtacttgggagtcggccat

SEQ ID NO: 405260 - DNA, 140 bp, Artificial Sequence
  Synthetic
atggccgactcccaagtacgcttatcccttatttctgtggttatattgaaagagcagtttctcatttcctctcgcatgctgtttgtaccatttatattggtactgtttataatggtaccgggagacccagcatggcgtat

SEQ ID NO: 405261 - DNA, 140 bp, Artificial Sequence
  Synthetic
aggccctggctgctgatatggatggataatcctgggattaaataaaatagtaagaatgtatagccctgtcagcattttggacataaaacaagggccaaaggaaccctttagagactatgtgaccttttgggacagcggtg

SEQ ID NO: 405262 - DNA, 140 bp, Artificial Sequence
  Synthetic
caccgctgtcccaaaaggtcacatagtctctaaagggttcctttggcccttgttttatgtccaaaatgctgacagggctatacattcttactattttatttaatcccaggattatccatccatatcagcagccagggcct

SEQ ID NO: 405263 - DNA, 140 bp, Artificial Sequence
  Synthetic
atacgccatgctgggtctccgtacaaattttaatgctaccagtaatagcaatgctacggttagtagtaacagtacgggagaaataaaaaattgctctttcaatgcaaccacagaaataagcgtacttgggagtcggccat

SEQ ID NO: 405264 - DNA, 140 bp, Artificial Sequence
  Synthetic
atggccgactcccaagtacgcttatttctgtggttgcattgaaagagcaattttttatttctcccgtactgttactactaaccgtagcattgctattactggtagcattaaaatttgtacggagacccagcatggcgtat

SEQ ID NO: 405265 - DNA, 140 bp, Artificial Sequence
  Synthetic
aggccctggctgctgatatgggaagaatcgaagaagaaggtggagagcaagacagagacagatcagtgagattagtcagcggattcttagcacttgcctgggaagatctgaggaacctgtgaccttttgggacagcggtg

SEQ ID NO: 405266 - DNA, 140 bp, Artificial Sequence
  Synthetic
caccgctgtcccaaaaggtcacaggttcctcagatcttcccaggcaagtgctaagaatccgctgactaatctcactgatctgtctctgtcttgctctccaccttcttcttcgattcttcccatatcagcagccagggcct

SEQ ID NO: 405267 - DNA, 140 bp, Artificial Sequence
  Synthetic
atacgccatgctgggtctccgcaccagacctagcaataacacaagaaaaggtatacatataggaccagggcaaacattctatgcacacggtgacataataggggatataagacaagcacacgtacttgggagtcggccat

SEQ ID NO: 405268 - DNA, 140 bp, Artificial Sequence
  Synthetic
atggccgactcccaagtacgtgtgcttgtcttatatcccctattatgtcaccgtgtgcatagaatgtttgccctggtcctatatgtataccttttcttgtgttattgctaggtctggtgcggagacccagcatggcgtat

SEQ ID NO: 405269 - DNA, 140 bp, Artificial Sequence
  Synthetic
aggccctggctgctgatatgcaaacattctatgcacacggtgacataataggggatataagacaagcacattgtaatgtaagtaaaacaaaatggaatatcactttacaaagggtagctagaccttttgggacagcggtg

SEQ ID NO: 405270 - DNA, 140 bp, Artificial Sequence
  Synthetic
caccgctgtcccaaaaggtctagctaccctttgtaaagtgatattccattttgttttacttacattacaatgtgcttgtcttatatcccctattatgtcaccgtgtgcatagaatgtttgcatatcagcagccagggcct

SEQ ID NO: 405271 - DNA, 140 bp, Artificial Sequence
  Synthetic
aggccctggctgctgatatgagacccagcaataatacaagaaaaagtataaggataggaccaggacaagcattctatgcaacaaatgacataataggagacataagacaagcacattgtagaccttttgggacagcggtg

SEQ ID NO: 405272 - DNA, 140 bp, Artificial Sequence
  Synthetic
caccgctgtcccaaaaggtctacaatgtgcttgtcttatgtctcctattatgtcatttgttgcatagaatgcttgtcctggtcctatccttatactttttcttgtattattgctgggtctcatatcagcagccagggcct

SEQ ID NO: 405273 - DNA, 140 bp, Artificial Sequence
  Synthetic
aggccctggctgctgatatgttaaaagaacacttccctaataaaacaataaaatttgaacaaccctcaggaggggatctagaaattacaacacatagctttaattgtaggggggaattttgaccttttgggacagcggtg

SEQ ID NO: 405274 - DNA, 140 bp, Artificial Sequence
  Synthetic
caccgctgtcccaaaaggtcaaaattcccccctacaattaaagctatgtgttgtaatttctagatcccctcctgagggttgttcaaattttattgttttattagggaagtgttcttttaacatatcagcagccagggcct

SEQ ID NO: 405275 - DNA, 140 bp, Artificial Sequence
  Synthetic
aggccctggctgctgatatgtggcaagtggtcaaaaagcagcatagtaggatggcctaaggttagggaaagaatagtacaaacccctccagcagcaataggagtaggagcagcatctcaagaccttttgggacagcggtg

SEQ ID NO: 405276 - DNA, 140 bp, Artificial Sequence
  Synthetic
caccgctgtcccaaaaggtcttgagatgctgctcctactcctattgctgctggaggggtttgtactattctttccctaaccttaggccatcctactatgctgctttttgaccacttgccacatatcagcagccagggcct

SEQ ID NO: 405277 - DNA, 140 bp, Artificial Sequence
  Synthetic
atacgccatgctgggtctccaataataatatgtatggagaaataaaaaattgcacttacaatgtaaccacagtactaaaagataagaaaaagagtgaatatgcacttttttataaacttgcgtacttgggagtcggccat

SEQ ID NO: 405278 - DNA, 140 bp, Artificial Sequence
  Synthetic
atggccgactcccaagtacgcaagtttataaaaaagtgcatattcactctttttcttatcttttagtactgtggttacattgtaagtgcaattttttatttctccatacatattattattggagacccagcatggcgtat

SEQ ID NO: 405279 - DNA, 140 bp, Artificial Sequence
  Synthetic
aggccctggctgctgatatggtacaagacccaacaataatacaagaaaaagtataaggataggaccaggacaaacattctatgcaacagacataataggagacataagacaagcacattggaccttttgggacagcggtg

SEQ ID NO: 405280 - DNA, 140 bp, Artificial Sequence
  Synthetic
caccgctgtcccaaaaggtccaatgtgcttgtcttatgtctcctattatgtctgttgcatagaatgtttgtcctggtcctatccttatactttttcttgtattattgttgggtcttgtaccatatcagcagccagggcct

SEQ ID NO: 405281 - DNA, 140 bp, Artificial Sequence
  Synthetic
atacgccatgctgggtctcctgtgaaattaataaaaatgattggaataaaactttacaaaaggtaggggaaaggttacagaagcacttccctaataggacaataaaatttgaacggtccgcgtacttgggagtcggccat

SEQ ID NO: 405282 - DNA, 140 bp, Artificial Sequence
  Synthetic
atggccgactcccaagtacgcggaccgttcaaattttattgtcctattagggaagtgcttctgtaacctttcccctaccttttgtaaagttttattccaatcatttttattaatttcacaggagacccagcatggcgtat

SEQ ID NO: 405283 - DNA, 140 bp, Artificial Sequence
  Synthetic
aggccctggctgctgatatgaaggttacagaagcacttccctaataggacaataaaatttgaacggtccgcaggaggggacctggaaattacaacacatagctttaattgtagaggagaagaccttttgggacagcggtg

SEQ ID NO: 405284 - DNA, 140 bp, Artificial Sequence
  Synthetic
caccgctgtcccaaaaggtcttctcctctacaattaaagctatgtgttgtaatttccaggtcccctcctgcggaccgttcaaattttattgtcctattagggaagtgcttctgtaaccttcatatcagcagccagggcct

SEQ ID NO: 405285 - DNA, 140 bp, Artificial Sequence
  Synthetic
aggccctggctgctgatatgctacccatacaaaaagaaacatgggaaacatggtggatggagtattggcaggctacctggattcctgaatgggagtttgtcaatacccctcctctagtaagaccttttgggacagcggtg

SEQ ID NO: 405286 - DNA, 140 bp, Artificial Sequence
  Synthetic
caccgctgtcccaaaaggtcttactagaggaggggtattgacaaactcccattcaggaatccaggtagcctgccaatactccatccaccatgtttcccatgtttctttttgtatgggtagcatatcagcagccagggcct

SEQ ID NO: 405287 - DNA, 140 bp, Artificial Sequence
  Synthetic
aggccctggctgctgatatgatcctcaacgtacctagaagaatcagacagggcctagaaaggtcgttgttataacatggggggcaagtggtcaaaaagaagaagagaagtggaatggactgaccttttgggacagcggtg

SEQ ID NO: 405288 - DNA, 140 bp, Artificial Sequence
  Synthetic
caccgctgtcccaaaaggtcagtccattccacttctcttcttctttttgaccacttgccccccatgttataacaacgacctttctaggccctgtctgattcttctaggtacgttgaggatcatatcagcagccagggcct

SEQ ID NO: 405289 - DNA, 140 bp, Artificial Sequence
  Synthetic
aggccctggctgctgatatgatgatagggggaattggaggttttatcaaagtaagacaatatgatcagatacttatggaaatttgtggaaaaaaggccataggtacagtattagtaggacgaccttttgggacagcggtg

SEQ ID NO: 405290 - DNA, 140 bp, Artificial Sequence
  Synthetic
caccgctgtcccaaaaggtcgtcctactaatactgtacctatggccttttttccacaaatttccataagtatctgatcatattgtcttactttgataaaacctccaattccccctatcatcatatcagcagccagggcct

SEQ ID NO: 405291 - DNA, 140 bp, Artificial Sequence
  Synthetic
aggccctggctgctgatatgacatggtagagcagatgcaggaggatgtaatcagtttatgggatcaaagtctaaagccatgtgtaaagttaactcctctctgcgttactttaaattgtacgaccttttgggacagcggtg

SEQ ID NO: 405292 - DNA, 140 bp, Artificial Sequence
  Synthetic
caccgctgtcccaaaaggtcgtacaatttaaagtaacgcagagaggagttaactttacacatggctttagactttgatcccataaactgattacatcctcctgcatctgctctaccatgtcatatcagcagccagggcct

SEQ ID NO: 405293 - DNA, 140 bp, Artificial Sequence
  Synthetic
atacgccatgctgggtctccaagcggaagcaccgacgaggaactcctcagagcagtaaggatcatcagagacctataccaaagcagtaagtaactgtaatgacacctttggaaattagtgcgtacttgggagtcggccat

SEQ ID NO: 405294 - DNA, 140 bp, Artificial Sequence
  Synthetic
atggccgactcccaagtacgcactaatttccaaaggtgtcattacagttacttactgctttggtataggtctctgatgatccttactgctctgaggagttcctcgtcggtgcttccgcttggagacccagcatggcgtat

SEQ ID NO: 405295 - DNA, 140 bp, Artificial Sequence
  Synthetic
aggccctggctgctgatatgattaattgatagaataagagaaagagcagaagacagtggcaatgaaagtgaaggagatcaggatgagttggcagctctggagagggggcatcttgctcctgaccttttgggacagcggtg

SEQ ID NO: 405296 - DNA, 140 bp, Artificial Sequence
  Synthetic
caccgctgtcccaaaaggtcaggagcaagatgccccctctccagagctgccaactcatcctgatctccttcactttcattgccactgtcttctgctctttctcttattctatcaattaatcatatcagcagccagggcct

SEQ ID NO: 405297 - DNA, 140 bp, Artificial Sequence
  Synthetic
atacgccatgctgggtctccaatgtgactaatgtgactgctacccctaccatgaagccaggggaaataaaaaactgctctttcaatagcaccacaatcatgagagataaggtaaccaaagcgtacttgggagtcggccat

SEQ ID NO: 405298 - DNA, 140 bp, Artificial Sequence
  Synthetic
atggccgactcccaagtacgctttggttaccttatctctcatgattgtggtgctattgaaagagcagttttttatttcccctggcttcatggtaggggtagcagtcacattagtcacattggagacccagcatggcgtat

SEQ ID NO: 405299 - DNA, 140 bp, Artificial Sequence
  Synthetic
atacgccatgctgggtctccctactggaaccaataataatactgaagccagtaataatactagtttaaggatggaacaaggagaactaaaaaactgctctttcaatatcaccacaaacatcgtacttgggagtcggccat

SEQ ID NO: 405300 - DNA, 140 bp, Artificial Sequence
  Synthetic
atggccgactcccaagtacgatgtttgtggtgatattgaaagagcagttttttagttctccttgttccatccttaaactagtattattactggcttcagtattattattggttccagtagggagacccagcatggcgtat

SEQ ID NO: 405301 - DNA, 140 bp, Artificial Sequence
  Synthetic
atacgccatgctgggtctcccaatacaagaaaaagtataccgatgggaccagggaaagcattttatgcaacaggagacataataggaaatataagactagcatattgtaaccttagtagacgtacttgggagtcggccat

SEQ ID NO: 405302 - DNA, 140 bp, Artificial Sequence
  Synthetic
atggccgactcccaagtacgtctactaaggttacaatatgctagtcttatatttcctattatgtctcctgttgcataaaatgctttccctggtcccatcggtatactttttcttgtattgggagacccagcatggcgtat

SEQ ID NO: 405303 - DNA, 140 bp, Artificial Sequence
  Synthetic
aggccctggctgctgatatgttatgcaacaggagacataataggagatataagacaagcctattgtaatattagtggagaaaactggaataacgctttaagaaagatagttacaaaattagaccttttgggacagcggtg

SEQ ID NO: 405304 - DNA, 140 bp, Artificial Sequence
  Synthetic
caccgctgtcccaaaaggtctaattttgtaactatctttcttaaagcgttattccagttttctccactaatattacaataggcttgtcttatatctcctattatgtctcctgttgcataacatatcagcagccagggcct

SEQ ID NO: 405305 - DNA, 140 bp, Artificial Sequence
  Synthetic
atacgccatgctgggtctccacaaattataaacaggtggcagggagtaggaaaagtaatgtatgctcctcccatcaaagggataattagatgttcatcaaacattacaggattgttattacgtacttgggagtcggccat

SEQ ID NO: 405306 - DNA, 140 bp, Artificial Sequence
  Synthetic
atggccgactcccaagtacgtaataacaatcctgtaatgtttgatgaacatctaattatccctttgatgggaggagcatacattacttttcctactccctgccacctgtttataatttgtggagacccagcatggcgtat

SEQ ID NO: 405307 - DNA, 140 bp, Artificial Sequence
  Synthetic
aggccctggctgctgatatggagctattctccacataccaagaagactaagacagagcttagagcaaaggcttttaagatgggtggcaagtggtcagaacgtagtagagagagagaatgggaccttttgggacagcggtg

SEQ ID NO: 405308 - DNA, 140 bp, Artificial Sequence
  Synthetic
caccgctgtcccaaaaggtcccattctctctctctactacgttctgaccacttgccacccatcttaaaagcctttgctctaagctctgtcttagtcttcttggtatgtggagaatagctccatatcagcagccagggcct

SEQ ID NO: 405309 - DNA, 140 bp, Artificial Sequence
  Synthetic
atacgccatgctgggtctcccagttggggtgggagcagtatctcgagacttggaaaagcatggagcaattacaagcagcaatacagccgctactaatgctgcttgtgcctggctggaagccgtacttgggagtcggccat

SEQ ID NO: 405310 - DNA, 140 bp, Artificial Sequence
  Synthetic
atggccgactcccaagtacggcttccagccaggcacaagcagcattagtagcggctgtattgctgcttgtaattgctccatgcttttccaagtctcgagatactgctcccaccccaactgggagacccagcatggcgtat

SEQ ID NO: 405311 - DNA, 140 bp, Artificial Sequence
  Synthetic
aggccctggctgctgatatgggtctactatggggtacctgtgtggaaagacgcagagaccaccctattttgtgcatcagatgctaaagcatatgatacagaagtacataatgtctgggctgaccttttgggacagcggtg

SEQ ID NO: 405312 - DNA, 140 bp, Artificial Sequence
  Synthetic
caccgctgtcccaaaaggtcagcccagacattatgtacttctgtatcatatgctttagcatctgatgcacaaaatagggtggtctctgcgtctttccacacaggtaccccatagtagacccatatcagcagccagggcct

SEQ ID NO: 405313 - DNA, 140 bp, Artificial Sequence
  Synthetic
atacgccatgctgggtctcccaacaacacaggaaacgtatctactaaaatatctaatggaataacagaggaagtaaaaaactgctctttcaatatgaccacagaagtaagagatagggaacgtacttgggagtcggccat

SEQ ID NO: 405314 - DNA, 140 bp, Artificial Sequence
  Synthetic
atggccgactcccaagtacgttccctatctcttacttctgtggtcatattgaaagagcagttttttacttcctctgttattccattagatattttagtagatacgtttcctgtgttgttgggagacccagcatggcgtat

SEQ ID NO: 405315 - DNA, 140 bp, Artificial Sequence
  Synthetic
aggccctggctgctgatatgttaataatctgtagtgctgcagacaacttgtgggtcacagtatattatggggtacctgtgtggaaagaagcaaccactactctattttgtgcatcagatggaccttttgggacagcggtg

SEQ ID NO: 405316 - DNA, 140 bp, Artificial Sequence
  Synthetic
caccgctgtcccaaaaggtccatctgatgcacaaaatagagtagtggttgcttctttccacacaggtaccccataatatactgtgacccacaagttgtctgcagcactacagattattaacatatcagcagccagggcct

SEQ ID NO: 405317 - DNA, 140 bp, Artificial Sequence
  Synthetic
atacgccatgctgggtctcccactctgtgtcactttaaactgtagtacaaatattacaaaggctaatgttacaagtgaagaaatgagaagttgctctttcaatataaccacagaattaagcgtacttgggagtcggccat

SEQ ID NO: 405318 - DNA, 140 bp, Artificial Sequence
  Synthetic
atggccgactcccaagtacgcttaattctgtggttatattgaaagagcaacttctcatttcttcacttgtaacattagcctttgtaatatttgtactacagtttaaagtgacacagagtgggagacccagcatggcgtat

SEQ ID NO: 405319 - DNA, 140 bp, Artificial Sequence
  Synthetic
atacgccatgctgggtctccatacaagaaaaggtgtgcatataggaccagggcgagcattctatgcaacaggtgagataacaggggatataagaaaagcacattgtaatgtcagtagagccgtacttgggagtcggccat

SEQ ID NO: 405320 - DNA, 140 bp, Artificial Sequence
  Synthetic
atggccgactcccaagtacggctctactgacattacaatgtgcttttcttatatcccctgttatctcacctgttgcatagaatgctcgccctggtcctatatgcacaccttttcttgtatggagacccagcatggcgtat

SEQ ID NO: 405321 - DNA, 140 bp, Artificial Sequence
  Synthetic
atacgccatgctgggtctccgtgccgcccgaacagggacttaaaagcgaaattagacccagagaagctctctcgacgcaggactcggcttgctgaaccccccccggcaagagccgagggccgtacttgggagtcggccat

SEQ ID NO: 405322 - DNA, 140 bp, Artificial Sequence
  Synthetic
atggccgactcccaagtacggccctcggctcttgccggggggggttcagcaagccgagtcctgcgtcgagagagcttctctgggtctaatttcgcttttaagtccctgttcgggcggcacggagacccagcatggcgtat

SEQ ID NO: 405323 - DNA, 140 bp, Artificial Sequence
  Synthetic
aggccctggctgctgatatgagacccaacaataatacaaggaaaagtataagaataggaccaggacaagcattctatgcaacaggagacataataggaaatataagacaagcacattgtagaccttttgggacagcggtg

SEQ ID NO: 405324 - DNA, 140 bp, Artificial Sequence
  Synthetic
caccgctgtcccaaaaggtctacaatgtgcttgtcttatatttcctattatgtctcctgttgcatagaatgcttgtcctggtcctattcttatacttttccttgtattattgttgggtctcatatcagcagccagggcct

SEQ ID NO: 405325 - DNA, 140 bp, Artificial Sequence
  Synthetic
atacgccatgctgggtctcccagcaagcagcagctgacacaggaaatagcagccaggtcagccaaaattaccctatagtgcagaaccttcaggggcaaatggtacatcaacccatatcaccgtacttgggagtcggccat

SEQ ID NO: 405326 - DNA, 140 bp, Artificial Sequence
  Synthetic
atggccgactcccaagtacggtgatatgggttgatgtaccatttgcccctgaaggttctgcactatagggtaattttggctgacctggctgctatttcctgtgtcagctgctgcttgctgggagacccagcatggcgtat

SEQ ID NO: 405327 - DNA, 140 bp, Artificial Sequence
  Synthetic
aggccctggctgctgatatggcaagacagagacagatccgtgcgattagtgagcggattcttagcacttgcctgggacgatctgcggagcctgtgcctcttcagctaccaccgattgagagaccttttgggacagcggtg

SEQ ID NO: 405328 - DNA, 140 bp, Artificial Sequence
  Synthetic
caccgctgtcccaaaaggtctctcaatcggtggtagctgaagaggcacaggctccgcagatcgtcccaggcaagtgctaagaatccgctcactaatcgcacggatctgtctctgtcttgccatatcagcagccagggcct

SEQ ID NO: 405329 - DNA, 140 bp, Artificial Sequence
  Synthetic
aggccctggctgctgatatggaatcgaagaagaaggtggagagcaagacagagacagatccattcgattagtgaacggattcttagcgcttgcctgggacgacctgcggagcctgtgcctgaccttttgggacagcggtg

SEQ ID NO: 405330 - DNA, 140 bp, Artificial Sequence
  Synthetic
caccgctgtcccaaaaggtcaggcacaggctccgcaggtcgtcccaggcaagcgctaagaatccgttcactaatcgaatggatctgtctctgtcttgctctccaccttcttcttcgattccatatcagcagccagggcct

SEQ ID NO: 405331 - DNA, 140 bp, Artificial Sequence
  Synthetic
atacgccatgctgggtctccttggtaatgacatgcaaaattgctctttcaatacaaccacagaactaagagataaggaacagaaggtatatgcactcttttatagactggatatagtacccgtacttgggagtcggccat

SEQ ID NO: 405332 - DNA, 140 bp, Artificial Sequence
  Synthetic
atggccgactcccaagtacgggtactatatccagtctataaaagagtgcatataccttctgttccttatctcttagttctgtggttgtattgaaagagcaattttgcatgtcattaccaaggagacccagcatggcgtat

SEQ ID NO: 405333 - DNA, 140 bp, Artificial Sequence
  Synthetic
aggccctggctgctgatatgcaattggagaagtgaattatataaatataaagtggtagaaattaagccattaggaatagcacccactaaggcaaaaaggagagtggtggagagagaaaaagaccttttgggacagcggtg

SEQ ID NO: 405334 - DNA, 140 bp, Artificial Sequence
  Synthetic
caccgctgtcccaaaaggtctttttctctctccaccactctcctttttgccttagtgggtgctattcctaatggcttaatttctaccactttatatttatataattcacttctccaattgcatatcagcagccagggcct

SEQ ID NO: 405335 - DNA, 140 bp, Artificial Sequence
  Synthetic
  misc_feature (35)..(35): n is a, c, g, or t
  misc_feature (61)..(61): n is a, c, g, or t
  misc_feature (92)..(92): n is a, c, g, or t
  misc_feature (97)..(97): n is a, c, g, or t
  misc_feature (106)..(106): n is a, c, g, or t
  misc_feature (109)..(109): n is a, c, g, or t
atacgccatgctgggtctccagggaaaaattatcntagtagcagttcatgtagccagtggntatatagaagcagaagttattccagcagagncaggncaagaaacngcntattttctcttcgtacttgggagtcggccat

SEQ ID NO: 405336 - DNA, 140 bp, Artificial Sequence
  Synthetic
  misc_feature (32)..(32): n is a, c, g, or t
  misc_feature (35)..(35): n is a, c, g, or t
  misc_feature (44)..(44): n is a, c, g, or t
  misc_feature (49)..(49): n is a, c, g, or t
  misc_feature (80)..(80): n is a, c, g, or t
  misc_feature (106)..(106): n is a, c, g, or t
atggccgactcccaagtacgaagagaaaatangcngtttcttgncctgnctctgctggaataacttctgcttctatatanccactggctacatgaactgctactangataatttttccctggagacccagcatggcgtat

SEQ ID NO: 405337 - DNA, 140 bp, Artificial Sequence
  Synthetic
aggccctggctgctgatatgtgtagcgagagcggcgaatcttctgggacgcagggggtgggaaaccctgaaatatctgggaagtcttgcacagtactggggtctggaactgaaaaagagtgaccttttgggacagcggtg

SEQ ID NO: 405338 - DNA, 140 bp, Artificial Sequence
  Synthetic
caccgctgtcccaaaaggtcactctttttcagttccagaccccagtactgtgcaagacttcccagatatttcagggtttcccaccccctgcgtcccagaagattcgccgctctcgctacacatatcagcagccagggcct

SEQ ID NO: 405339 - DNA, 140 bp, Artificial Sequence
  Synthetic
aggccctggctgctgatatgctcttcagctaccaccgcttgagagacttagtcttgattgcagcgaggactgtggaacttctgggacgcagcagtctcaagggactgagacgggggtggggaccttttgggacagcggtg

SEQ ID NO: 405340 - DNA, 140 bp, Artificial Sequence
  Synthetic
caccgctgtcccaaaaggtccccacccccgtctcagtcccttgagactgctgcgtcccagaagttccacagtcctcgctgcaatcaagactaagtctctcaagcggtggtagctgaagagcatatcagcagccagggcct

SEQ ID NO: 405341 - DNA, 140 bp, Artificial Sequence
  Synthetic
atacgccatgctgggtctccctgttagacattttcctagggcatggcttcatggcctaggacaaaacaaaaaaaaatagacaggttaattgatagaataatagaaagagcagaagacagtcgtacttgggagtcggccat

SEQ ID NO: 405342 - DNA, 140 bp, Artificial Sequence
  Synthetic
atggccgactcccaagtacgactgtcttctgctctttctattattctatcaattaacctgtctatttttttttgttttgtcctaggccatgaagccatgccctaggaaaatgtctaacagggagacccagcatggcgtat

SEQ ID NO: 405343 - DNA, 140 bp, Artificial Sequence
  Synthetic
aggccctggctgctgatatgccaaggaagccctagacaagatagaggaagaacaaaacaaaagtcagcaaaaaacacagcaggcagaagcggctgccggaaaagtcagtcaaaattatccgaccttttgggacagcggtg

SEQ ID NO: 405344 - DNA, 140 bp, Artificial Sequence
  Synthetic
caccgctgtcccaaaaggtcggataattttgactgacttttccggcagccgcttctgcctgctgtgttttttgctgacttttgttttgttcttcctctatcttgtctagggcttccttggcatatcagcagccagggcct

SEQ ID NO: 405345 - DNA, 140 bp, Artificial Sequence
  Synthetic
atacgccatgctgggtctcccccggagaaacgagaactaaaaaactgctctttcaatgtcaccacacccataggaaataagaagcagaaagaacatgcaatttttaatacacttgatgtacgtacttgggagtcggccat

SEQ ID NO: 405346 - DNA, 140 bp, Artificial Sequence
  Synthetic
atggccgactcccaagtacgtacatcaagtgtattaaaaattgcatgttctttctgcttcttatttcctatgggtgtggtgacattgaaagagcagttttttagttctcgtttctccgggggagacccagcatggcgtat

SEQ ID NO: 405347 - DNA, 140 bp, Artificial Sequence
  Synthetic
aggccctggctgctgatatgtacagattaattgtacaagacctaacaacaatacaagaaaaagtatacattttggaccaggaagacaatttgcaacaggagaaataataggagatataaggaccttttgggacagcggtg

SEQ ID NO: 405348 - DNA, 140 bp, Artificial Sequence
  Synthetic
caccgctgtcccaaaaggtccttatatctcctattatttctcctgttgcaaattgtcttcctggtccaaaatgtatactttttcttgtattgttgttaggtcttgtacaattaatctgtacatatcagcagccagggcct

SEQ ID NO: 405349 - DNA, 140 bp, Artificial Sequence
  Synthetic
  misc_feature (75)..(75): n is a, c, g, or t
atacgccatgctgggtctccgggtagttaccaaattaggaaaacaatttaaggaaataatttttaatcagttttnaggaggcggcttggagattatgatgcagacttctaattgtggaggcgtacttgggagtcggccat

SEQ ID NO: 405350 - DNA, 140 bp, Artificial Sequence
  Synthetic
  misc_feature (66)..(66): n is a, c, g, or t
atggccgactcccaagtacgcctccacaattagaagtctgcatcataatctccaagccgcctcctnaaaactgattaaaaattatttccttaaattgttttcctaatttggtaactacccggagacccagcatggcgtat

SEQ ID NO: 405351 - DNA, 140 bp, Artificial Sequence
  Synthetic
  misc_feature (25)..(25): n is a, c, g, or t
  misc_feature (112)..(112): n is a, c, g, or t
aggccctggctgctgatatgttttnaggaggcggcttggagattatgatgcagacttctaattgtggaggggaatttttctactgtgattcaacacagctgtttaatagtanttggadgagaccttttgggacagcggtg

SEQ ID NO: 405352 - DNA, 140 bp, Artificial Sequence
  Synthetic
  misc_feature (29)..(29): n is a, c, g, or t
  misc_feature (116)..(116): n is a, c, g, or t
caccgctgtcccaaaaggtctcdtccaantactattaaacagctgtgttgaatcacagtagaaaaattcccctccacaattagaagtctgcatcataatctccaagccgcctcctnaaaacatatcagcagccagggcct

SEQ ID NO: 405353 - DNA, 140 bp, Artificial Sequence
  Synthetic
atacgccatgctgggtctccagcgacacaatcacactcccatgcagaagaagacaaattgtaaataggtggcaggaagtaggaaaagcagtgtatgccctccctattgcaggaggcattacgtacttgggagtcggccat

SEQ ID NO: 405354 - DNA, 140 bp, Artificial Sequence
  Synthetic
atggccgactcccaagtacgtaatgcctcctgcaatagggagggcatacactgcttttcctacttcctgccacctatttacaatttgtcttcttctgcatgggagtgtgattgtgtcgctggagacccagcatggcgtat

SEQ ID NO: 405355 - DNA, 140 bp, Artificial Sequence
  Synthetic
aggccctggctgctgatatgtttagggaaaatttggccttccaacaaggggaggccaggaaattttcctcagaacagactggaaccaacagccccaccagcagagagctttgggacgggggaccttttgggacagcggtg

SEQ ID NO: 405356 - DNA, 140 bp, Artificial Sequence
  Synthetic
caccgctgtcccaaaaggtcccccgtcccaaagctctctgctggtggggctgttggttccagtctgttctgaggaaaatttcctggcctccccttgttggaaggccaaattttccctaaacatatcagcagccagggcct

SEQ ID NO: 405357 - DNA, 140 bp, Artificial Sequence
  Synthetic
aggccctggctgctgatatggatctaaggaatgctactaataccaatagtagtagcgaggaaaagatagagggaggaggaatgaccaactgctctttcaatgtcaccacagccttacaaggaccttttgggacagcggtg

SEQ ID NO: 405358 - DNA, 140 bp, Artificial Sequence
  Synthetic
caccgctgtcccaaaaggtccttgtaaggctgtggtgacattgaaagagcagttggtcattcctcctccctctatcttttcctcgctactactattggtattagtagcattccttagatccatatcagcagccagggcct

SEQ ID NO: 405359 - DNA, 140 bp, Artificial Sequence
  Synthetic
  misc_feature (68)..(68): n is a, c, g, or t
aggccctggctgctgatatgtggaatgctagttggagcaataaaactctaaaagatatttgggagaanatgacctggatggagtgggaaagagaaattgacaattacacaggtttaatatgaccttttgggacagcggtg

SEQ ID NO: 405360 - DNA, 140 bp, Artificial Sequence
  Synthetic
  misc_feature (73)..(73): n is a, c, g, or t
caccgctgtcccaaaaggtcatattaaacctgtgtaattgtcaatttctctttcccactccatccaggtcatnttctcccaaatatcttttagagttttattgctccaactagcattccacatatcagcagccagggcct

SEQ ID NO: 405361 - DNA, 140 bp, Artificial Sequence
  Synthetic
aggccctggctgctgatatgcaacaacaatacaagaaaaagtatacatatagcaccagggagagcattttatgcaacaggagaaataataggagatataagacaagcacattgtaacattgaccttttgggacagcggtg

SEQ ID NO: 405362 - DNA, 140 bp, Artificial Sequence
  Synthetic
caccgctgtcccaaaaggtcaatgttacaatgtgcttgtcttatatctcctattatttctcctgttgcataaaatgctctccctggtgctatatgtatactttttcttgtattgttgttgcatatcagcagccagggcct

SEQ ID NO: 405363 - DNA, 140 bp, Artificial Sequence
  Synthetic
aggccctggctgctgatatgtcacactcccatgcagaataaaacaaattataaacatgtggcaggaagtaggaaaagcaatgtatgcccctcccatcagaggacaaattagatgttcatcgaccttttgggacagcggtg

SEQ ID NO: 405364 - DNA, 140 bp, Artificial Sequence
  Synthetic
caccgctgtcccaaaaggtcgatgaacatctaatttgtcctctgatgggaggggcatacattgcttttcctacttcctgccacatgtttataatttgttttattctgcatgggagtgtgacatatcagcagccagggcct

SEQ ID NO: 405365 - DNA, 140 bp, Artificial Sequence
  Synthetic
aggccctggctgctgatatgagtgctgttagtttgtttaatgctatagccatagcagtagctgaggggacagataggattatagaactaggacaaagattttgtagaggcattctccacagaccttttgggacagcggtg

SEQ ID NO: 405366 - DNA, 140 bp, Artificial Sequence
  Synthetic
caccgctgtcccaaaaggtctgtggagaatgcctctacaaaatctttgtcctagttctataatcctatctgtcccctcagctactgctatggctatagcattaaacaaactaacagcactcatatcagcagccagggcct

SEQ ID NO: 405367 - DNA, 140 bp, Artificial Sequence
  Synthetic
aggccctggctgctgatatgacccaccaaggcaaagagaagagtggtgcagagagaaaaaagagcagtgggaataggagctatgttccttgggttcttgggagcagcaggaagcactatggaccttttgggacagcggtg

SEQ ID NO: 405368 - DNA, 140 bp, Artificial Sequence
  Synthetic
caccgctgtcccaaaaggtccatagtgcttcctgctgctcccaagaacccaaggaacatagctcctattcccactgctcttttttctctctgcaccactcttctctttgccttggtgggtcatatcagcagccagggcct

SEQ ID NO: 405369 - DNA, 140 bp, Artificial Sequence
  Synthetic
atacgccatgctgggtctcctggcaagtggtcaaaacgcagtatgagggaatggcctactgtaagggacagaataagaagagagccagcagcggatggggtgggagcagtatctcgagaccgtacttgggagtcggccat

SEQ ID NO: 405370 - DNA, 140 bp, Artificial Sequence
  Synthetic
atggccgactcccaagtacggtctcgagatactgctcccaccccatccgctgctggctctcttcttattctgtcccttacagtaggccattccctcatactgcgttttgaccacttgccaggagacccagcatggcgtat

SEQ ID NO: 405371 - DNA, 140 bp, Artificial Sequence
  Synthetic
aggccctggctgctgatatgtgagccagcagcagagggggtgggagcagtatctcgagacctggaaagacatggagcaatcacaagtagcaatacagcagctactaatgctgattgtgccgaccttttgggacagcggtg

SEQ ID NO: 405372 - DNA, 140 bp, Artificial Sequence
  Synthetic
caccgctgtcccaaaaggtcggcacaatcagcattagtagctgctgtattgctacttgtgattgctccatgtctttccaggtctcgagatactgctcccaccccctctgctgctggctcacatatcagcagccagggcct

SEQ ID NO: 405373 - DNA, 140 bp, Artificial Sequence
  Synthetic
aggccctggctgctgatatgatggagcaatcacaagtagcaatacagcagctactaatgctgattgtgcctggctagaagcacaagaggaggaggaagtgggttttccagtcagacctcagaccttttgggacagcggtg

SEQ ID NO: 405374 - DNA, 140 bp, Artificial Sequence
  Synthetic
caccgctgtcccaaaaggtctgaggtctgactggaaaacccacttcctcctcctcttgtgcttctagccaggcacaatcagcattagtagctgctgtattgctacttgtgattgctccatcatatcagcagccagggcct

SEQ ID NO: 405375 - DNA, 140 bp, Artificial Sequence
  Synthetic
atacgccatgctgggtctcctcagtcccagtatgcagggagacataaagaattgttctttcaatataaccacagaaataagagacaagagaaggaaagtatatgcacttttttataaactcgtacttgggagtcggccat

SEQ ID NO: 405376 - DNA, 140 bp, Artificial Sequence
  Synthetic
atggccgactcccaagtacgagtttataaaaaagtgcatatactttccttctcttgtctcttatttctgtggttatattgaaagaacaattctttatgtctccctgcatactgggactgaggagacccagcatggcgtat

SEQ ID NO: 405377 - DNA, 140 bp, Artificial Sequence
  Synthetic
atacgccatgctgggtctccaataagacatacaatgggaacatgaatgaaataaaaaattgctctttcaattcaaccacagaactaagagacaagaagaagaaagagtttgcacttttttcgtacttgggagtcggccat

SEQ ID NO: 405378 - DNA, 140 bp, Artificial Sequence
  Synthetic
atggccgactcccaagtacgaaaaaagtgcaaactctttcttcttcttgtctcttagttctgtggttgaattgaaagagcaattttttatttcattcatgttcccattgtatgtcttattggagacccagcatggcgtat

SEQ ID NO: 405379 - DNA, 140 bp, Artificial Sequence
  Synthetic
aggccctggctgctgatatgggttttacagacatcattatgaaagcagacatccaaaagtaagttcagaagtacacatcccattaggggaagctagattagtaataacaacatattgggggaccttttgggacagcggtg

SEQ ID NO: 405380 - DNA, 140 bp, Artificial Sequence
  Synthetic
caccgctgtcccaaaaggtcccccaatatgttgttattactaatctagcttcccctaatgggatgtgtacttctgaacttacttttggatgtctgctttcataatgatgtctgtaaaacccatatcagcagccagggcct

SEQ ID NO: 405381 - DNA, 140 bp, Artificial Sequence
  Synthetic
atacgccatgctgggtctcctgataggataagagaaagagcagaagatagtggcaatgagagtgatggggatactgaagagttgtccacccttctggagatggggtatgataatgctgctcgtacttgggagtcggccat

SEQ ID NO: 405382 - DNA, 140 bp, Artificial Sequence
  Synthetic
atggccgactcccaagtacgagcagcattatcataccccatctccagaagggtggacaactcttcagtatccccatcactctcattgccactatcttctgctctttctcttatcctatcaggagacccagcatggcgtat

SEQ ID NO: 405383 - DNA, 140 bp, Artificial Sequence
  Synthetic
aggccctggctgctgatatgaagtataaggataggaccaggacaaacattctatgcaacaggagacataataggagacataagacaagcatattgtaacattagtgaagaaaaatggaatgaccttttgggacagcggtg

SEQ ID NO: 405384 - DNA, 140 bp, Artificial Sequence
  Synthetic
caccgctgtcccaaaaggtcattccatttttcttcactaatgttacaatatgcttgtcttatgtctcctattatgtctcctgttgcatagaatgtttgtcctggtcctatccttatacttcatatcagcagccagggcct

SEQ ID NO: 405385 - DNA, 140 bp, Artificial Sequence
  Synthetic
aggccctggctgctgatatgctcaagatttctgggaggttcaattaggaataccacatcctgcagggttaaaaaagaaaaaatcagtaacagtactggatgtgggtgatgcatatttttcgaccttttgggacagcggtg

SEQ ID NO: 405386 - DNA, 140 bp, Artificial Sequence
  Synthetic
caccgctgtcccaaaaggtcgaaaaatatgcatcacccacatccagtactgttactgattttttcttttttaaccctgcaggatgtggtattcctaattgaacctcccagaaatcttgagcatatcagcagccagggcct

SEQ ID NO: 405387 - DNA, 140 bp, Artificial Sequence
  Synthetic
aggccctggctgctgatatgtataaaaatattcataatgatagtaggaggcttgataggtttaagaataatttttgctgtgctttctatagtaaatagagttaggcagggatactcacctgaccttttgggacagcggtg

SEQ ID NO: 405388 - DNA, 140 bp, Artificial Sequence
  Synthetic
caccgctgtcccaaaaggtcaggtgagtatccctgcctaactctatttactatagaaagcacagcaaaaattattcttaaacctatcaagcctcctactatcattatgaatatttttatacatatcagcagccagggcct

SEQ ID NO: 405389 - DNA, 140 bp, Artificial Sequence
  Synthetic
aggccctggctgctgatatgttgaccccactctgtgtcactttaaaatgtagcgatgcaaagggtaatgctacctatgaaggtaacaggactggagaaataaaaaattgctctttcaatggaccttttgggacagcggtg

SEQ ID NO: 405390 - DNA, 140 bp, Artificial Sequence
  Synthetic
caccgctgtcccaaaaggtccattgaaagagcaattttttatttctccagtcctgttaccttcataggtagcattaccctttgcatcgctacattttaaagtgacacagagtggggtcaacatatcagcagccagggcct

SEQ ID NO: 405391 - DNA, 140 bp, Artificial Sequence
  Synthetic
atacgccatgctgggtctccccagcagcaataacacagacacagcctctatcaaagacaggccggaaacaaaaaactgctctttcgatataaccacagtactaagagataagaaagagaacgtacttgggagtcggccat

SEQ ID NO: 405392 - DNA, 140 bp, Artificial Sequence
  Synthetic
atggccgactcccaagtacgttctctttcttatctcttagtactgtggttatatcgaaagagcagttttttgtttccggcctgtctttgatagaggctgtgtctgtgttattgctgctggggagacccagcatggcgtat

SEQ ID NO: 405393 - DNA, 140 bp, Artificial Sequence
  Synthetic
atacgccatgctgggtctccagaaaaagtatgcgtataggaccaggacaaacattctatgcaacaggtgacataacaggaaacataagaagagcacattgtaatgtcagtagagcagaatcgtacttgggagtcggccat

SEQ ID NO: 405394 - DNA, 140 bp, Artificial Sequence
  Synthetic
atggccgactcccaagtacgattctgctctactgacattacaatgtgctcttcttatgtttcctgttatgtcacctgttgcatagaatgtttgtcctggtcctatacgcatactttttctggagacccagcatggcgtat

SEQ ID NO: 405395 - DNA, 140 bp, Artificial Sequence
  Synthetic
aggccctggctgctgatatggcagaataaaacaaattataaacatgtggcagggggtaggacgagcaatatatgcccctcccattgaaggaaacataacatgtaaatcaaatatcacagggaccttttgggacagcggtg

SEQ ID NO: 405396 - DNA, 140 bp, Artificial Sequence
  Synthetic
caccgctgtcccaaaaggtccctgtgatatttgatttacatgttatgtttccttcaatgggaggggcatatattgctcgtcctaccccctgccacatgtttataatttgttttattctgccatatcagcagccagggcct

SEQ ID NO: 405397 - DNA, 140 bp, Artificial Sequence
  Synthetic
atacgccatgctgggtctccattaattgtaccagacctggcaacaatacaagaaaaagtatacatttaggaccaggacacgctttctatgccacaggtgctataataggggatataagaccgtacttgggagtcggccat

SEQ ID NO: 405398 - DNA, 140 bp, Artificial Sequence
  Synthetic
atggccgactcccaagtacggtcttatatcccctattatagcacctgtggcatagaaagcgtgtcctggtcctaaatgtatactttttcttgtattgttgccaggtctggtacaattaatggagacccagcatggcgtat

SEQ ID NO: 405399 - DNA, 140 bp, Artificial Sequence
  Synthetic
aggccctggctgctgatatggttgctggcattgccaagtttgctttctaaaaaaggcttaggcatctcctatggcaggaagaagcggagcaccgacgaggaccttctcacagcagtaagggaccttttgggacagcggtg

SEQ ID NO: 405400 - DNA, 140 bp, Artificial Sequence
  Synthetic
caccgctgtcccaaaaggtcccttactgctgtgagaaggtcctcgtcggtgctccgcttcttcctgccataggagatgcctaagccttttttagaaagcaaacttggcaatgccagcaaccatatcagcagccagggcct

SEQ ID NO: 405401 - DNA, 140 bp, Artificial Sequence
  Synthetic
aggccctggctgctgatatggggcattaaacagctccaggcaagagtcctggctctggaaagatacctaagggatcaacagctcctaggaatttggggctgctctggaaaactcatctgcgaccttttgggacagcggtg

SEQ ID NO: 405402 - DNA, 140 bp, Artificial Sequence
  Synthetic
caccgctgtcccaaaaggtcgcagatgagttttccagagcagccccaaattcctaggagctgttgatcccttaggtatctttccagagccaggactcttgcctggagctgtttaatgccccatatcagcagccagggcct

SEQ ID NO: 405403 - DNA, 140 bp, Artificial Sequence
  Synthetic
aggccctggctgctgatatgcttttagaaaacaaaatccagacatagttatctatcagtacatggatgatttgtatgtaggatctgacttagaaatagggcagcatagaacaaaaatagagaccttttgggacagcggtg

SEQ ID NO: 405404 - DNA, 140 bp, Artificial Sequence
  Synthetic
caccgctgtcccaaaaggtctctatttttgttctatgctgccctatttctaagtcagatcctacatacaaatcatccatgtactgatagataactatgtctggattttgttttctaaaagcatatcagcagccagggcct

SEQ ID NO: 405405 - DNA, 140 bp, Artificial Sequence
  Synthetic
aggccctggctgctgatatgagaggatagatggaacaagccccagaagaccaagggccacagagggagccatacaatgaatggacactagagcttttagaggagcttaagaatgaagctggaccttttgggacagcggtg

SEQ ID NO: 405406 - DNA, 140 bp, Artificial Sequence
  Synthetic
caccgctgtcccaaaaggtccagcttcattcttaagctcctctaaaagctctagtgtccattcattgtatggctccctctgtggcccttggtcttctggggcttgttccatctatcctctcatatcagcagccagggcct

SEQ ID NO: 405407 - DNA, 140 bp, Artificial Sequence
  Synthetic
aggccctggctgctgatatgggacctgaaagcgaaagagaaaccagaggagatctctcgacgcaggactcggcttgctgaagcgcgcggcaagaggcgaggggcggcgactggtgagtacgaccttttgggacagcggtg

SEQ ID NO: 405408 - DNA, 140 bp, Artificial Sequence
  Synthetic
caccgctgtcccaaaaggtcgtactcaccagtcgccgcccctcgcctcttgccgcgcgcttcagcaagccgagtcctgcgtcgagagatctcctctggtttctctttcgctttcaggtcccatatcagcagccagggcct

SEQ ID NO: 405409 - DNA, 140 bp, Artificial Sequence
  Synthetic
aggccctggctgctgatatgaaaggcttaggcatctcctatggcaggaagaagcggagacagcgacgaagacctcctcaagacagtcagactaatcaagttcctctatcagagcagtaaggaccttttgggacagcggtg

SEQ ID NO: 405410 - DNA, 140 bp, Artificial Sequence
  Synthetic
caccgctgtcccaaaaggtccttactgctctgatagaggaacttgattagtctgactgtcttgaggaggtcttcgtcgctgtctccgcttcttcctgccataggagatgcctaagcctttcatatcagcagccagggcct

SEQ ID NO: 405411 - DNA, 140 bp, Artificial Sequence
  Synthetic
aggccctggctgctgatatgcctgtgtggaaagaagcaaccaccactctattttgtgcatcagatgctaaagcatatgacacagaggcacataatgtttgggccacacatgcctgtgtacgaccttttgggacagcggtg

SEQ ID NO: 405412 - DNA, 140 bp, Artificial Sequence
  Synthetic
caccgctgtcccaaaaggtcgtacacaggcatgtgtggcccaaacattatgtgcctctgtgtcatatgctttagcatctgatgcacaaaatagagtggtggttgcttctttccacacaggcatatcagcagccagggcct

SEQ ID NO: 405413 - DNA, 140 bp, Artificial Sequence
  Synthetic
atacgccatgctgggtctccaaccagctcttcagacaggaacagaggaacttagatcattatacaacacagtagcaactctctattgtgtacataaagggataaaagtacaagacaccaacgtacttgggagtcggccat

SEQ ID NO: 405414 - DNA, 140 bp, Artificial Sequence
  Synthetic
atggccgactcccaagtacgttggtgtcttgtacttttatccctttatgtacacaatagagagttgctactgtgttgtataatgatctaagttcctctgttcctgtctgaagagctggttggagacccagcatggcgtat

SEQ ID NO: 405415 - DNA, 140 bp, Artificial Sequence
  Synthetic
  misc_feature (40)..(40): n is a, c, g, or t
atacgccatgctgggtctccattactggaatcaataatantggttgggaaaacatgaagggagaaataaaaaactgctctttcaatgtcaccacaagtataggaaataagtctcataaagcgtacttgggagtcggccat

SEQ ID NO: 405416 - DNA, 140 bp, Artificial Sequence
  Synthetic
  misc_feature (101)..(101): n is a, c, g, or t
atggccgactcccaagtacgctttatgagacttatttcctatacttgtggtgacattgaaagagcagttttttatttctcccttcatgttttcccaaccantattattgattccagtaatggagacccagcatggcgtat

SEQ ID NO: 405417 - DNA, 140 bp, Artificial Sequence
  Synthetic
aggccctggctgctgatatgtgtggcaggtagacaggatgaggattagaacatggaacagtttagtaaaacatcacatgtatgtctcaaagaaagctaaagggtggttttatagacatcagaccttttgggacagcggtg

SEQ ID NO: 405418 - DNA, 140 bp, Artificial Sequence
  Synthetic
caccgctgtcccaaaaggtctgatgtctataaaaccaccctttagctttctttgagacatacatgtgatgttttactaaactgttccatgttctaatcctcatcctgtctacctgccacacatatcagcagccagggcct

SEQ ID NO: 405419 - DNA, 140 bp, Artificial Sequence
  Synthetic
aggccctggctgctgatatgtgttagctcagtacaatgtacacatggaattaggccattggcatcaactcaactgctgctgaatggcagtctagcagaaggaggggagataatgattagagaccttttgggacagcggtg

SEQ ID NO: 405420 - DNA, 140 bp, Artificial Sequence
  Synthetic
caccgctgtcccaaaaggtctctaatcattatctcccctccttctgctagactgccattcagcagcagttgagttgatgccaatggcctaattccatgtgtacattgtactgagctaacacatatcagcagccagggcct

SEQ ID NO: 405421 - DNA, 140 bp, Artificial Sequence
  Synthetic
aggccctggctgctgatatgaatgaaactgtagtaattaattgtacaagacccaacaacaatacaagaaaaagtatacatatgggatgggggagagcattttatgcaacaggagaaataagaccttttgggacagcggtg

SEQ ID NO: 405422 - DNA, 140 bp, Artificial Sequence
  Synthetic
caccgctgtcccaaaaggtcttatttctcctgttgcataaaatgctctcccccatcccatatgtatactttttcttgtattgttgttgggtcttgtacaattaattactacagtttcattcatatcagcagccagggcct

SEQ ID NO: 405423 - DNA, 140 bp, Artificial Sequence
  Synthetic
aggccctggctgctgatatgagggagctggaaagatttgcacttaaccctggccttttagaaacagcagaaggctgtaaacaaataataaaacagctacaaccagctcttcagacaggaagaccttttgggacagcggtg

SEQ ID NO: 405424 - DNA, 140 bp, Artificial Sequence
  Synthetic
caccgctgtcccaaaaggtcttcctgtctgaagagctggttgtagctgttttattatttgtttacagccttctgctgtttctaaaaggccagggttaagtgcaaatctttccagctccctcatatcagcagccagggcct

SEQ ID NO: 405425 - DNA, 140 bp, Artificial Sequence
  Synthetic
atacgccatgctgggtctccttcaatatcaccacaaccatggataaggtgcaggaagaacgtgcaattttttataaccttgatatagtaccaatggatgataataataagactagaactgcgtacttgggagtcggccat

SEQ ID NO: 405426 - DNA, 140 bp, Artificial Sequence
  Synthetic
atggccgactcccaagtacgcagttctagtcttattattatcatccattggtactatatcaaggttataaaaaattgcacgttcttcctgcaccttatccatggttgtggtgatattgaaggagacccagcatggcgtat

SEQ ID NO: 405427 - DNA, 140 bp, Artificial Sequence
  Synthetic
atacgccatgctgggtctccaacatttcagacaacaagaacagtagatggagatataagaaaagcatattgtattcttaatggaacaaaatggaacgacactttagcacagatagctaaacgtacttgggagtcggccat

SEQ ID NO: 405428 - DNA, 140 bp, Artificial Sequence
  Synthetic
atggccgactcccaagtacgtttagctatctgtgctaaagtgtcgttccattttgttccattaagaatacaatatgcttttcttatatctccatctactgttcttgttgtctgaaatgttggagacccagcatggcgtat

SEQ ID NO: 405429 - DNA, 140 bp, Artificial Sequence
  Synthetic
aggccctggctgctgatatgaggccagggaattttcttcagagcagaccagagccaacagccccaccagaggagagcttcaggtttggggaagagacaacaactccctctcagaagcagggaccttttgggacagcggtg

SEQ ID NO: 405430 - DNA, 140 bp, Artificial Sequence
  Synthetic
caccgctgtcccaaaaggtccctgcttctgagagggagttgttgtctcttccccaaacctgaagctctcctctggtggggctgttggctctggtctgctctgaagaaaattccctggcctcatatcagcagccagggcct

SEQ ID NO: 405431 - DNA, 140 bp, Artificial Sequence
  Synthetic
atacgccatgctgggtctccgactgaggatcctagggcagaagataattgatgcttgcagaatttgtacagctgtaactcaatactggctacaagaattgcagaatagtgctacaagtctcgtacttgggagtcggccat

SEQ ID NO: 405432 - DNA, 140 bp, Artificial Sequence
  Synthetic
atggccgactcccaagtacgagacttgtagcactattctgcaattcttgtagccagtattgagttacagctgtacaaattctgcaagcatcaattatcttctgccctaggatcctcagtcggagacccagcatggcgtat

SEQ ID NO: 405433 - DNA, 140 bp, Artificial Sequence
  Synthetic
atacgccatgctgggtctccatgctactgccggtaatagtgcaaatgctactgtcagtgaggataaggaagaaatgagaaattgctctttcaatgcaaccacagaaataagagataagaacgtacttgggagtcggccat

SEQ ID NO: 405434 - DNA, 140 bp, Artificial Sequence
  Synthetic
atggccgactcccaagtacgttcttatctcttatttctgtggttgcattgaaagagcaatttctcatttcttccttatcctcactgacagtagcatttgcactattaccggcagtagcatggagacccagcatggcgtat

SEQ ID NO: 405435 - DNA, 140 bp, Artificial Sequence
  Synthetic
aggccctggctgctgatatgttaattttttagggaaaatctggccttcccacaaggggaggccaggaaactttctccagagcagtccagagagcagaccagaaccaacagccccaccagagaccttttgggacagcggtg

SEQ ID NO: 405436 - DNA, 140 bp, Artificial Sequence
  Synthetic
caccgctgtcccaaaaggtctctggtggggctgttggttctggtctgctctctggactgctctggagaaagtttcctggcctccccttgtgggaaggccagattttccctaaaaaattaacatatcagcagccagggcct

SEQ ID NO: 405437 - DNA, 140 bp, Artificial Sequence
  Synthetic
aggccctggctgctgatatgtttggcaacgacccatcgtcacaataaagataggggggcaactgagggaagctctattggatacaggagcagatgatacagtgttagaagaaataaatttgaccttttgggacagcggtg

SEQ ID NO: 405438 - DNA, 140 bp, Artificial Sequence
  Synthetic
caccgctgtcccaaaaggtcaaatttatttcttctaacactgtatcatctgctcctgtatccaatagagcttccctcagttgcccccctatctttattgtgacgatgggtcgttgccaaacatatcagcagccagggcct

SEQ ID NO: 405439 - DNA, 140 bp, Artificial Sequence
  Synthetic
aggccctggctgctgatatgaaatgaaaaggatttattagcattggacagttggcaaaatctgtggaattggtttagcataacaaattggctgtggtatataaaaatattcataatgatagaccttttgggacagcggtg

SEQ ID NO: 405440 - DNA, 140 bp, Artificial Sequence
  Synthetic
caccgctgtcccaaaaggtctatcattatgaatatttttatataccacagccaatttgttatgctaaaccaattccacagattttgccaactgtccaatgctaataaatccttttcatttcatatcagcagccagggcct

SEQ ID NO: 405441 - DNA, 140 bp, Artificial Sequence
  Synthetic
aggccctggctgctgatatgagaccaggggccgcagagggaaccatacaatgaatggacactagagattctagaagaactaaagcaggaagctgtcagacactttcctagaccatggctcgaccttttgggacagcggtg

SEQ ID NO: 405442 - DNA, 140 bp, Artificial Sequence
  Synthetic
caccgctgtcccaaaaggtcgagccatggtctaggaaagtgtctgacagcttcctgctttagttcttctagaatctctagtgtccattcattgtatggttccctctgcggcccctggtctcatatcagcagccagggcct

SEQ ID NO: 405443 - DNA, 140 bp, Artificial Sequence
  Synthetic
aggccctggctgctgatatgtagaataagagagagaacagaagatagtggcaatgagagtgaaggggacacagaagaattggcaaggcttgtggacatggggcctcatgatctttggaatgaccttttgggacagcggtg

SEQ ID NO: 405444 - DNA, 140 bp, Artificial Sequence
  Synthetic
caccgctgtcccaaaaggtcattccaaagatcatgaggccccatgtccacaagccttgccaattcttctgtgtccccttcactctcattgccactatcttctgttctctctcttattctacatatcagcagccagggcct

SEQ ID NO: 405445 - DNA, 140 bp, Artificial Sequence
  Synthetic
atacgccatgctgggtctccgtcagcctaaaactccttgtaattcatgctattgtaaaaaatgcagctatcattgtttagtttgctttcagacaaaaggcttaggcatttactatggcagcgtacttgggagtcggccat

SEQ ID NO: 405446 - DNA, 140 bp, Artificial Sequence
  Synthetic
atggccgactcccaagtacgctgccatagtaaatgcctaagccttttgtctgaaagcaaactaaacaatgatagctgcattttttacaatagcatgaattacaaggagttttaggctgacggagacccagcatggcgtat

SEQ ID NO: 405447 - DNA, 140 bp, Artificial Sequence
  Synthetic
aggccctggctgctgatatgaccactgctgtgccttggaactccagttggagtaataaatctcaagaagatatttggggtaacatgacctggatgcagtgggatagagaaattagtaattgaccttttgggacagcggtg

SEQ ID NO: 405448 - DNA, 140 bp, Artificial Sequence
  Synthetic
caccgctgtcccaaaaggtcaattactaatttctctatcccactgcatccaggtcatgttaccccaaatatcttcttgagatttattactccaactggagttccaaggcacagcagtggtcatatcagcagccagggcct

SEQ ID NO: 405449 - DNA, 140 bp, Artificial Sequence
  Synthetic
atacgccatgctgggtctccataataatgccactctaatttgtgatgttaatggtaccaatgttacctatgataaggccatgggtgaaggaataaaatattgctctttcaacatgaccaccgtacttgggagtcggccat

SEQ ID NO: 405450 - DNA, 140 bp, Artificial Sequence
  Synthetic
atggccgactcccaagtacggtggtcatgttgaaagagcaatattttattccttcacccatggccttatcataggtaacattggtaccattaacatcacaaattagagtggcattattatggagacccagcatggcgtat

SEQ ID NO: 405451 - DNA, 140 bp, Artificial Sequence
  Synthetic
atacgccatgctgggtctcccatctctgctaacttaaccaataacatgcaaggggaaataaaaaactgctctttcaatatgaccacagaagtaaaagataagaaaaggagagtgtctgcacgtacttgggagtcggccat

SEQ ID NO: 405452 - DNA, 140 bp, Artificial Sequence
  Synthetic
atggccgactcccaagtacgtgcagacactctccttttcttatcttttacttctgtggtcatattgaaagagcagttttttatttccccttgcatgttattggttaagttagcagagatgggagacccagcatggcgtat

SEQ ID NO: 405453 - DNA, 140 bp, Artificial Sequence
  Synthetic
atacgccatgctgggtctccgtaaggtcaatagaacagaatggagtggagctttaaatcaggtagtaggaaaattaagagaacattggaacagaacaataatcttcaatagctcctcaggcgtacttgggagtcggccat

SEQ ID NO: 405454 - DNA, 140 bp, Artificial Sequence
  Synthetic
atggccgactcccaagtacgcctgaggagctattgaagattattgttctgttccaatgttctcttaattttcctactacctgatttaaagctccactccattctgttctattgaccttacggagacccagcatggcgtat

SEQ ID NO: 405455 - DNA, 140 bp, Artificial Sequence
  Synthetic
aggccctggctgctgatatggaaaaagtgtacgtataggaccaggacaaacattctatgcaacaggtgacataataggagatataagacaagcacattgtaatgttagtagagcaaaatggaccttttgggacagcggtg

SEQ ID NO: 405456 - DNA, 140 bp, Artificial Sequence
  Synthetic
caccgctgtcccaaaaggtccattttgctctactaacattacaatgtgcttgtcttatatctcctattatgtcacctgttgcatagaatgtttgtcctggtcctatacgtacactttttccatatcagcagccagggcct

SEQ ID NO: 405457 - DNA, 140 bp, Artificial Sequence
  Synthetic
atacgccatgctgggtctccccaatcagtctcaggaggggacctagaaattacaacacatacctttaattgtggaggagaatttttctattgtaatacatcagacctgtttaatgaatcccgtacttgggagtcggccat

SEQ ID NO: 405458 - DNA, 140 bp, Artificial Sequence
  Synthetic
atggccgactcccaagtacgggattcattaaacaggtctgatgtattacaatagaaaaattctcctccacaattaaaggtatgtgttgtaatttctaggtcccctcctgagactgattggggagacccagcatggcgtat

SEQ ID NO: 405459 - DNA, 140 bp, Artificial Sequence
  Synthetic
aggccctggctgctgatatgtgcagaataaagcaaattgtaaatatgtggcagagagtaggacaagcaatatatgcccctcccatcccaggagtagtaaggtgtgtctcaaacattacaggaccttttgggacagcggtg

SEQ ID NO: 405460 - DNA, 140 bp, Artificial Sequence
  Synthetic
caccgctgtcccaaaaggtcctgtaatgtttgagacacaccttactactcctgggatgggaggggcatatattgcttgtcctactctctgccacatatttacaatttgctttattctgcacatatcagcagccagggcct

SEQ ID NO: 405461 - DNA, 140 bp, Artificial Sequence
  Synthetic
aggccctggctgctgatatgtaccaccgcttgagagactttctcttgattgcagcgaggactgtggaacttctgggacacagcagtctcaagggactgagactggggtgggaaggcctcagaccttttgggacagcggtg

SEQ ID NO: 405462 - DNA, 140 bp, Artificial Sequence
  Synthetic
caccgctgtcccaaaaggtctgaggccttcccaccccagtctcagtcccttgagactgctgtgtcccagaagttccacagtcctcgctgcaatcaagagaaagtctctcaagcggtggtacatatcagcagccagggcct

SEQ ID NO: 405463 - DNA, 140 bp, Artificial Sequence
  Synthetic
atacgccatgctgggtctcccaagttgtcaaaaagcagcatagtgggatgggccagggttagagaaagaataagacaaccccatgtaagacaaacccctgaaagacaaacccctgcagcacgtacttgggagtcggccat

SEQ ID NO: 405464 - DNA, 140 bp, Artificial Sequence
  Synthetic
atggccgactcccaagtacgtgctgcaggggtttgtctttcaggggtttgtcttacatggggttgtcttattctttctctaaccctggcccatcccactatgctgctttttgacaacttgggagacccagcatggcgtat

SEQ ID NO: 405465 - DNA, 140 bp, Artificial Sequence
  Synthetic
aggccctggctgctgatatgcagactcatcaagtttctctatcaaagcagtaagtaatatatgtaatgcagtctctagaaacattaggaatagtagcattagtagtagcatttatattaggaccttttgggacagcggtg

SEQ ID NO: 405466 - DNA, 140 bp, Artificial Sequence
  Synthetic
caccgctgtcccaaaaggtcctaatataaatgctactactaatgctactattcctaatgtttctagagactgcattacatatattacttactgctttgatagagaaacttgatgagtctgcatatcagcagccagggcct

SEQ ID NO: 405467 - DNA, 140 bp, Artificial Sequence
  Synthetic
aggccctggctgctgatatgcacaagaggacgaggaggtaggctttccagtcaggccgcaggtacctttaagaccaatgacttttaaggcagctttcgatctcagccactttttaaaagagaccttttgggacagcggtg

SEQ ID NO: 405468 - DNA, 140 bp, Artificial Sequence
  Synthetic
caccgctgtcccaaaaggtctcttttaaaaagtggctgagatcgaaagctgccttaaaagtcattggtcttaaaggtacctgcggcctgactggaaagcctacctcctcgtcctcttgtgcatatcagcagccagggcct

SEQ ID NO: 405469 - DNA, 140 bp, Artificial Sequence
  Synthetic
atacgccatgctgggtctcccaaaaaagaatagacaggttaattcagagaataagtgaaagagcagaagacagtggcaatgagagtgaaggagatgaagaagcattggcagcacttgtggcgtacttgggagtcggccat

SEQ ID NO: 405470 - DNA, 140 bp, Artificial Sequence
  Synthetic
atggccgactcccaagtacgccacaagtgctgccaatgcttcttcatctccttcactctcattgccactgtcttctgctctttcacttattctctgaattaacctgtctattcttttttgggagacccagcatggcgtat

SEQ ID NO: 405471 - DNA, 140 bp, Artificial Sequence
  Synthetic
atacgccatgctgggtctccgtggcgcccgaacagggacttgaagataatagggactcgaaagcgaaagttccagggagctctctcgacgcagagactcggcttgctgaggtgcacgcagcgtacttgggagtcggccat

SEQ ID NO: 405472 - DNA, 140 bp, Artificial Sequence
  Synthetic
atggccgactcccaagtacgctgcgtgcacctcagcaagccgagtctctgcgtcgagagagctccctggaactttcgctttcgagtccctattatcttcaagtccctgttcgggcgccacggagacccagcatggcgtat

SEQ ID NO: 405473 - DNA, 140 bp, Artificial Sequence
  Synthetic
atacgccatgctgggtctccaaaactgctcttttaatgttaccacagagataagagagaaggtgaagaacgaatatgcaattttttataaacttgatgtaataccaataaagaatagtgacgtacttgggagtcggccat

SEQ ID NO: 405474 - DNA, 140 bp, Artificial Sequence
  Synthetic
atggccgactcccaagtacgtcactattctttattggtattacatcaagtttataaaaaattgcatattcgttcttcaccttctctcttatctctgtggtaacattaaaagagcagttttggagacccagcatggcgtat

SEQ ID NO: 405475 - DNA, 140 bp, Artificial Sequence
  Synthetic
atacgccatgctgggtctccgcatgaatctgtacaaattaattgtacaagacccaacaacaatacaagaaaaagtatacgtatacatagaggaccagggagagcatttgttacatcaggccgtacttgggagtcggccat

SEQ ID NO: 405476 - DNA, 140 bp, Artificial Sequence
  Synthetic
atggccgactcccaagtacggcctgatgtaacaaatgctctccctggtcctctatgtatacgtatactttttcttgtattgttgttgggtcttgtacaattaatttgtacagattcatgcggagacccagcatggcgtat

SEQ ID NO: 405477 - DNA, 140 bp, Artificial Sequence
  Synthetic
atacgccatgctgggtctccgaataaaatgttaaaacatgtagttacaaaattaggaatgcaatttaacaatagaacaataaaatttcaaccatcctcaggaggggacccagagattgtacgtacttgggagtcggccat

SEQ ID NO: 405478 - DNA, 140 bp, Artificial Sequence
  Synthetic
atggccgactcccaagtacgtacaatctctgggtcccctcctgaggatggttgaaattttattgttctattgttaaattgcattcctaattttgtaactacatgttttaacattttattcggagacccagcatggcgtat

SEQ ID NO: 405479 - DNA, 140 bp, Artificial Sequence
  Synthetic
aggccctggctgctgatatgatagaacaataaaatttcaaccatcctcaggaggggacccagagattgtaactcacagttttaattgtggcggggaatttttctactgtaattcaacaccgaccttttgggacagcggtg

SEQ ID NO: 405480 - DNA, 140 bp, Artificial Sequence
  Synthetic
caccgctgtcccaaaaggtcggtgttgaattacagtagaaaaattccccgccacaattaaaactgtgagttacaatctctgggtcccctcctgaggatggttgaaattttattgttctatcatatcagcagccagggcct

SEQ ID NO: 405481 - DNA, 140 bp, Artificial Sequence
  Synthetic
aggccctggctgctgatatgattataaacatgtggcaggaagtaggaaaagcaatgtatgcccctcccatcgagggactaattagatgtacatcaaatattacagggctgctattaacaagaccttttgggacagcggtg

SEQ ID NO: 405482 - DNA, 140 bp, Artificial Sequence
  Synthetic
caccgctgtcccaaaaggtcttgttaatagcagccctgtaatatttgatgtacatctaattagtccctcgatgggaggggcatacattgcttttcctacttcctgccacatgtttataatcatatcagcagccagggcct

SEQ ID NO: 405483 - DNA, 140 bp, Artificial Sequence
  Synthetic
aggccctggctgctgatatgttgctgtcgaccgaattactgctgaatgacagtttatcagaagaagaaataataattacatctgaaaatatcacaaataatgctaaaaacataatagtacgaccttttgggacagcggtg

SEQ ID NO: 405484 - DNA, 140 bp, Artificial Sequence
  Synthetic
caccgctgtcccaaaaggtcgtactattatgtttttagcattatttgtgatattttcagatgtaattattatttcttcttctgataaactgtcattcagcagtaattcggtcgacagcaacatatcagcagccagggcct

SEQ ID NO: 405485 - DNA, 140 bp, Artificial Sequence
  Synthetic
aggccctggctgctgatatggaaagcgaaagtaagaccagaggagatctctcgacgcaggactcggcttgctgaagtgcactcggcaagaggcgagagcggcgactggtgagtacgccaagaccttttgggacagcggtg

SEQ ID NO: 405486 - DNA, 140 bp, Artificial Sequence
  Synthetic
caccgctgtcccaaaaggtcttggcgtactcaccagtcgccgctctcgcctcttgccgagtgcacttcagcaagccgagtcctgcgtcgagagatctcctctggtcttactttcgctttccatatcagcagccagggcct

SEQ ID NO: 405487 - DNA, 140 bp, Artificial Sequence
  Synthetic
aggccctggctgctgatatggctgtaaacaaataataaaacagctacaaccagctcttcagacaggaacagaggaacttagatcattattcaacacagtagcaactctctattgtgtacagaccttttgggacagcggtg

SEQ ID NO: 405488 - DNA, 140 bp, Artificial Sequence
  Synthetic
caccgctgtcccaaaaggtctgtacacaatagagagttgctactgtgttgaataatgatctaagttcctctgttcctgtctgaagagctggttgtagctgttttattatttgtttacagccatatcagcagccagggcct

SEQ ID NO: 405489 - DNA, 140 bp, Artificial Sequence
  Synthetic
  misc_feature (37)..(37): n is a, c, g, or t
atacgccatgctgggtctccgggtgaataacactganatcaatagtaccgtaaaaaattgctctttcaatgtcaccacaagcataaggaatgagaggcagaaagaatatgcactttttaacgtacttgggagtcggccat

SEQ ID NO: 405490 - DNA, 140 bp, Artificial Sequence
  Synthetic
  misc_feature (104)..(104): n is a, c, g, or t
atggccgactcccaagtacgttaaaaagtgcatattctttctgcctctcattccttatgcttgtggtgacattgaaagagcaattttttacggtactattgatntcagtgttattcacccggagacccagcatggcgtat

SEQ ID NO: 405491 - DNA, 140 bp, Artificial Sequence
  Synthetic
atacgccatgctgggtctccctttactataaaatggggggcaagtggtcaaaaagaatggagagaggctggcaggcggtaagggaaagaatgcgacgagctgagccacgagctgagccagcgtacttgggagtcggccat

SEQ ID NO: 405492 - DNA, 140 bp, Artificial Sequence
  Synthetic
atggccgactcccaagtacgctggctcagctcgtggctcagctcgtcgcattctttcccttaccgcctgccagcctctctccattctttttgaccacttgccccccattttatagtaaagggagacccagcatggcgtat

SEQ ID NO: 405493 - DNA, 140 bp, Artificial Sequence
  Synthetic
aggccctggctgctgatatgtctggaaaactcatctgcaccactaatgtgccctggaactctagttggagtaacaaatctcatgatgagatatgggataacatgacctggctgcaatggggaccttttgggacagcggtg

SEQ ID NO: 405494 - DNA, 140 bp, Artificial Sequence
  Synthetic
caccgctgtcccaaaaggtccccattgcagccaggtcatgttatcccatatctcatcatgagatttgttactccaactagagttccagggcacattagtggtgcagatgagttttccagacatatcagcagccagggcct

SEQ ID NO: 405495 - DNA, 140 bp, Artificial Sequence
  Synthetic
atacgccatgctgggtctccgaagcggagacagcgacgagggactcctgcaggtttgcaagataatcaagatcctataccaaagcagtaagtaccataaatgtacatattaggaataggacgtacttgggagtcggccat

SEQ ID NO: 405496 - DNA, 140 bp, Artificial Sequence
  Synthetic
atggccgactcccaagtacgtcctattcctaatatgtacatttatggtacttactgctttggtataggatcttgattatcttgcaaacctgcaggagtccctcgtcgctgtctccgcttcggagacccagcatggcgtat

SEQ ID NO: 405497 - DNA, 140 bp, Artificial Sequence
  Synthetic
aggccctggctgctgatatggaggaagtgggttttccagtcagacctcaggtacctttaagaccaatgacttacaagggagctttggatcttagccactttttaaaagaaaaggggggacgaccttttgggacagcggtg

SEQ ID NO: 405498 - DNA, 140 bp, Artificial Sequence
  Synthetic
caccgctgtcccaaaaggtcgtccccccttttcttttaaaaagtggctaagatccaaagctcccttgtaagtcattggtcttaaaggtacctgaggtctgactggaaaacccacttcctccatatcagcagccagggcct

SEQ ID NO: 405499 - DNA, 140 bp, Artificial Sequence
  Synthetic
  misc_feature (112)..(112): n is a, c, g, or t
aggccctggctgctgatatgataggctttaatccatcctcaggaggggacccagaaattgtaatgcacagttttaattgtggaggggaatttttctactgtaatacaacacngctgtttagaccttttgggacagcggtg

SEQ ID NO: 405500 - DNA, 140 bp, Artificial Sequence
  Synthetic
  misc_feature (29)..(29): n is a, c, g, or t
caccgctgtcccaaaaggtctaaacagcngtgttgtattacagtagaaaaattcccctccacaattaaaactgtgcattacaatttctgggtcccctcctgaggatggattaaagcctatcatatcagcagccagggcct

SEQ ID NO: 405501 - DNA, 140 bp, Artificial Sequence
  Synthetic
atacgccatgctgggtctcctagtaataataccctctgtaataatactatctgtgaacaaatgagaaattgctctttcaatgcaaccacagaaataagagataaaaaacagaaagtgtatcgtacttgggagtcggccat

SEQ ID NO: 405502 - DNA, 140 bp, Artificial Sequence
  Synthetic
atggccgactcccaagtacgatacactttctgttttttatctcttatttctgtggttgcattgaaagagcaatttctcatttgttcacagatagtattattacagagggtattattactaggagacccagcatggcgtat

SEQ ID NO: 405503 - DNA, 140 bp, Artificial Sequence
  Synthetic
atacgccatgctgggtctcctacttgaaagaataagagaaagagcagaagacagtggcaacgagagtgatggagacacagaggaactatccacacttgttgagcgggggcatcttaatctcgtacttgggagtcggccat

SEQ ID NO: 405504 - DNA, 140 bp, Artificial Sequence
  Synthetic
atggccgactcccaagtacgagattaagatgcccccgctcaacaagtgtggatagttcctctgtgtctccatcactctcgttgccactgtcttctgctctttctcttattctttcaagtaggagacccagcatggcgtat

SEQ ID NO: 405505 - DNA, 140 bp, Artificial Sequence
  Synthetic
aggccctggctgctgatatgcaactcaactactgttaaatggtagcctagcagaagaagagataataattagatctgaaaatctgacaaacaatgccaaaacaataatagtacaccttaagaccttttgggacagcggtg

SEQ ID NO: 405506 - DNA, 140 bp, Artificial Sequence
  Synthetic
caccgctgtcccaaaaggtcttaaggtgtactattattgttttggcattgtttgtcagattttcagatctaattattatctcttcttctgctaggctaccatttaacagtagttgagttgcatatcagcagccagggcct

SEQ ID NO: 405507 - DNA, 140 bp, Artificial Sequence
  Synthetic
aggccctggctgctgatatgtgactctgtagaaattgtgtgtacaagacccaacaataatacaaggaagagcataaggataggaccaggacaggcattttatgcaacagatgccataatagaccttttgggacagcggtg

SEQ ID NO: 405508 - DNA, 140 bp, Artificial Sequence
  Synthetic
caccgctgtcccaaaaggtctattatggcatctgttgcataaaatgcctgtcctggtcctatccttatgctcttccttgtattattgttgggtcttgtacacacaatttctacagagtcacatatcagcagccagggcct

SEQ ID NO: 405509 - DNA, 140 bp, Artificial Sequence
  Synthetic
aggccctggctgctgatatgtcacactcccatgcagaataaaacaaattataaacatgtggcaagaggtaggacgagcaatgtatgcccctcccattgcaggaaacataacatgtaaatcgaccttttgggacagcggtg

SEQ ID NO: 405510 - DNA, 140 bp, Artificial Sequence
  Synthetic
caccgctgtcccaaaaggtcgatttacatgttatgtttcctgcaatgggaggggcatacattgctcgtcctacctcttgccacatgtttataatttgttttattctgcatgggagtgtgacatatcagcagccagggcct

SEQ ID NO: 405511 - DNA, 140 bp, Artificial Sequence
  Synthetic
atacgccatgctgggtctcctattatggggtgcctgtgtggaaagaagcaaaaactactctattctgtgcatcagatgctaaggcatatagcacagaaaaacataatgtatgggctacaccgtacttgggagtcggccat

SEQ ID NO: 405512 - DNA, 140 bp, Artificial Sequence
  Synthetic
atggccgactcccaagtacggtgtagcccatacattatgtttttctgtgctatatgccttagcatctgatgcacagaatagagtagtttttgcttctttccacacaggcaccccataataggagacccagcatggcgtat

SEQ ID NO: 405513 - DNA, 140 bp, Artificial Sequence
  Synthetic
aggccctggctgctgatatgcttaggcatttactatggcaggaagaagcggagacagcagcgacgaagcgctcctccaagcagtaaggatcatcaaaatcctatatcaaagcagtaagtagaccttttgggacagcggtg

SEQ ID NO: 405514 - DNA, 140 bp, Artificial Sequence
  Synthetic
caccgctgtcccaaaaggtctacttactgctttgatataggattttgatgatccttactgcttggaggagcgcttcgtcgctgctgtctccgcttcttcctgccatagtaaatgcctaagcatatcagcagccagggcct

SEQ ID NO: 405515 - DNA, 140 bp, Artificial Sequence
  Synthetic
atacgccatgctgggtctccgtggcgcccgaacagggacccgaaaacgaaagtagaaccggaggagatctctcgacgcaggactcggcttgctgaaagcgcgcggcaagaggcgaggggccgtacttgggagtcggccat

SEQ ID NO: 405516 - DNA, 140 bp, Artificial Sequence
  Synthetic
atggccgactcccaagtacggcccctcgcctcttgccgcgcgctttcagcaagccgagtcctgcgtcgagagatctcctccggttctactttcgttttcgggtccctgttcgggcgccacggagacccagcatggcgtat

SEQ ID NO: 405517 - DNA, 140 bp, Artificial Sequence
  Synthetic
atacgccatgctgggtctccataataccagtaatggtactactacccctagtactactacccctacccccaatatggacacggggggaatgaaaaattgctctttcaatataaccacagacgtacttgggagtcggccat

SEQ ID NO: 405518 - DNA, 140 bp, Artificial Sequence
  Synthetic
atggccgactcccaagtacgtctgtggttatattgaaagagcaatttttcattccccccgtgtccatattgggggtaggggtagtagtactaggggtagtagtaccattactggtattatggagacccagcatggcgtat

SEQ ID NO: 405519 - DNA, 140 bp, Artificial Sequence
  Synthetic
aggccctggctgctgatatgaatatggacacggggggaatgaaaaattgctctttcaatataaccacagaactaagagataaggaaaagaaagtgaatgcacttttttatagacttgatagaccttttgggacagcggtg

SEQ ID NO: 405520 - DNA, 140 bp, Artificial Sequence
  Synthetic
caccgctgtcccaaaaggtctatcaagtctataaaaaagtgcattcactttcttttccttatctcttagttctgtggttatattgaaagagcaatttttcattccccccgtgtccatattcatatcagcagccagggcct

SEQ ID NO: 405521 - DNA, 140 bp, Artificial Sequence
  Synthetic
atacgccatgctgggtctccaatgacacgcaagaggaaataagaaactgctctttcaatgtgaccacagaattaagagataagaaacagaaagtgtatgcacttttttataggcttgatgcgtacttgggagtcggccat

SEQ ID NO: 405522 - DNA, 140 bp, Artificial Sequence
  Synthetic
atggccgactcccaagtacgcatcaagcctataaaaaagtgcatacactttctgtttcttatctcttaattctgtggtcacattgaaagagcagtttcttatttcctcttgcgtgtcattggagacccagcatggcgtat

SEQ ID NO: 405523 - DNA, 140 bp, Artificial Sequence
  Synthetic
atacgccatgctgggtctccgagtaggagcagcatctcaagacttagataaacatggggcacttacacccagcaacacagccggcaacaatagtacttgtgcctggctgcaagcgcaagacgtacttgggagtcggccat

SEQ ID NO: 405524 - DNA, 140 bp, Artificial Sequence
  Synthetic
atggccgactcccaagtacgtcttgcgcttgcagccaggcacaagtactattgttgccggctgtgttgctgggtgtaagtgccccatgtttatctaagtcttgagatgctgctcctactcggagacccagcatggcgtat

SEQ ID NO: 405525 - DNA, 140 bp, Artificial Sequence
  Synthetic
atacgccatgctgggtctccttcctcagggggggacctagaagttacaatgcacacatttaattgtggaggagaatttttctattgcaatacatcacagttgtttaatacatcatatgtgcgtacttgggagtcggccat

SEQ ID NO: 405526 - DNA, 140 bp, Artificial Sequence
  Synthetic
atggccgactcccaagtacgcacatatgatgtattaaacaactgtgatgtattgcaatagaaaaattctcctccacaattaaatgtgtgcattgtaacttctaggtccccccctgaggaaggagacccagcatggcgtat

SEQ ID NO: 405527 - DNA, 140 bp, Artificial Sequence
  Synthetic
aggccctggctgctgatatgtagtaacaataatagcaatagttgtgtggaccatagtattcatagaatataggaaaatattaagacagagaaaaatagacaggttaattgatagaataaggaccttttgggacagcggtg

SEQ ID NO: 405528 - DNA, 140 bp, Artificial Sequence
  Synthetic
caccgctgtcccaaaaggtccttattctatcaattaacctgtctatttttctctgtcttaatattttcctatattctatgaatactatggtccacacaactattgctattattgttactacatatcagcagccagggcct

SEQ ID NO: 405529 - DNA, 140 bp, Artificial Sequence
  Synthetic
aggccctggctgctgatatgcagacaccttgttgatccaaaatgcgaacccagattgtaagaccattttaaaagcattaggaccaggggcttcattagaagaaatgatgacagcatgtcagaccttttgggacagcggtg

SEQ ID NO: 405530 - DNA, 140 bp, Artificial Sequence
  Synthetic
caccgctgtcccaaaaggtctgacatgctgtcatcatttcttctaatgaagcccctggtcctaatgcttttaaaatggtcttacaatctgggttcgcattttggatcaacaaggtgtctgcatatcagcagccagggcct

SEQ ID NO: 405531 - DNA, 140 bp, Artificial Sequence
  Synthetic
aggccctggctgctgatatggaatttggggctgctctggaaaactcatctgccccactactgtaccttggaattctagctggagtaataaaacttatgatgaaatatggggcaacatgacgaccttttgggacagcggtg

SEQ ID NO: 405532 - DNA, 140 bp, Artificial Sequence
  Synthetic
caccgctgtcccaaaaggtcgtcatgttgccccatatttcatcataagttttattactccagctagaattccaaggtacagtagtggggcagatgagttttccagagcagccccaaattccatatcagcagccagggcct

SEQ ID NO: 405533 - DNA, 140 bp, Artificial Sequence
  Synthetic
atacgccatgctgggtctcctgggaagccctcaaatatctgtggaatcttctatcatactggggtcaggaactaaagaatagtgctattaatttgcttgatacaatagcaatagcagtagcgtacttgggagtcggccat

SEQ ID NO: 405534 - DNA, 140 bp, Artificial Sequence
  Synthetic
atggccgactcccaagtacgctactgctattgctattgtatcaagcaaattaatagcactattctttagttcctgaccccagtatgatagaagattccacagatatttgagggcttcccaggagacccagcatggcgtat

SEQ ID NO: 405535 - DNA, 140 bp, Artificial Sequence
  Synthetic
atacgccatgctgggtctccatagcatgggtggcaagtggtcaaaaagcagcttagtgggatggcctaaggttagggaaagaataagacaaacccctgtaagtgaaagggcagcaaaaggcgtacttgggagtcggccat

SEQ ID NO: 405536 - DNA, 140 bp, Artificial Sequence
  Synthetic
atggccgactcccaagtacgccttttgctgccctttcacttacaggggtttgtcttattctttccctaaccttaggccatcccactaagctgctttttgaccacttgccacccatgctatggagacccagcatggcgtat

SEQ ID NO: 405537 - DNA, 140 bp, Artificial Sequence
  Synthetic
aggccctggctgctgatatgttgtcaatacccctcccttagtaaagttgtagtaccagttagaaaaagaacccataatagaggcagaaactttttatgtagatagagcagctaataaaaagaccttttgggacagcggtg

SEQ ID NO: 405538 - DNA, 140 bp, Artificial Sequence
  Synthetic
caccgctgtcccaaaaggtctttttattagctgctctatctacataaaaagtttctgcctctattatgggttctttttctaactggtactacaactttactaagggaggggtattgacaacatatcagcagccagggcct

SEQ ID NO: 405539 - DNA, 140 bp, Artificial Sequence
  Synthetic
aggccctggctgctgatatgatagagcaaaaatagaggagttaagagaacacctattgagatggggatttaccacaccagacaagaaacatcaaaaagaacccccatttctttggatggggaccttttgggacagcggtg

SEQ ID NO: 405540 - DNA, 140 bp, Artificial Sequence
  Synthetic
caccgctgtcccaaaaggtccccatccaaagaaatgggggttctttttgatgtttcttgtctggtgtggtaaatccccatctcaataggtgttctcttaactcctctatttttgctctatcatatcagcagccagggcct

SEQ ID NO: 405541 - DNA, 140 bp, Artificial Sequence
  Synthetic
aggccctggctgctgatatgaaattcggttaaggccagggggaaagaaaaaatatagactaaaacatttagtatgggcaagcagggagctggaaagattcgcacttaaccctggccttttgaccttttgggacagcggtg

SEQ ID NO: 405542 - DNA, 140 bp, Artificial Sequence
  Synthetic
caccgctgtcccaaaaggtcaaaaggccagggttaagtgcgaatctttccagctccctgcttgcccatactaaatgttttagtctatattttttctttccccctggccttaaccgaatttcatatcagcagccagggcct

SEQ ID NO: 405543 - DNA, 140 bp, Artificial Sequence
  Synthetic
atacgccatgctgggtctccccactaatagtaacggggaaatgatggagaaaggagaagtaaaaaactgttctttcaaggtcaccacagacataaaagatagaacgcggaaggaatatgccgtacttgggagtcggccat

SEQ ID NO: 405544 - DNA, 140 bp, Artificial Sequence
  Synthetic
atggccgactcccaagtacggcatattccttccgcgttctatcttttatgtctgtggtgaccttgaaagaacagttttttacttctcctttctccatcatttccccgttactattagtggggagacccagcatggcgtat

SEQ ID NO: 405545 - DNA, 140 bp, Artificial Sequence
  Synthetic
aggccctggctgctgatatgacatattggggtttgcagacaggagaaagagattggcatttgggtcatggagtctccatagaatggagattgagaagatatagcacacaagtagaccctggaccttttgggacagcggtg

SEQ ID NO: 405546 - DNA, 140 bp, Artificial Sequence
  Synthetic
caccgctgtcccaaaaggtccagggtctacttgtgtgctatatcttctcaatctccattctatggagactccatgacccaaatgccaatctctttctcctgtctgcaaaccccaatatgtcatatcagcagccagggcct

SEQ ID NO: 405547 - DNA, 140 bp, Artificial Sequence
  Synthetic
aggccctggctgctgatatggggatatagagattacatcacatacttttaattgtggaggagaatttttctattgcaatacatcaagattgtttaatagtacctggaacagcaatgatacgaccttttgggacagcggtg

SEQ ID NO: 405548 - DNA, 140 bp, Artificial Sequence
  Synthetic
caccgctgtcccaaaaggtcgtatcattgctgttccaggtactattaaacaatcttgatgtattgcaatagaaaaattctcctccacaattaaaagtatgtgatgtaatctctatatccccatatcagcagccagggcct

SEQ ID NO: 405549 - DNA, 140 bp, Artificial Sequence
  Synthetic
atacgccatgctgggtctccaaattacttgcacaagacccaacaacaatacaagaaaaagtatacccatgggaccagggaaagcattttatgcaagaggagacataacaggagacataagcgtacttgggagtcggccat

SEQ ID NO: 405550 - DNA, 140 bp, Artificial Sequence
  Synthetic
atggccgactcccaagtacgcttatgtctcctgttatgtctcctcttgcataaaatgctttccctggtcccatgggtatactttttcttgtattgttgttgggtcttgtgcaagtaatttggagacccagcatggcgtat

SEQ ID NO: 405551 - DNA, 140 bp, Artificial Sequence
  Synthetic
aggccctggctgctgatatggaagcagaattagaattggcagagaacagggaaattctaaaagaaccagtacatggagtatattatgacccatcaaaagacttgatagctgaaatacagagaccttttgggacagcggtg

SEQ ID NO: 405552 - DNA, 140 bp, Artificial Sequence
  Synthetic
caccgctgtcccaaaaggtctctgtatttcagctatcaagtcttttgatgggtcataatatactccatgtactggttcttttagaatttccctgttctctgccaattctaattctgcttccatatcagcagccagggcct

SEQ ID NO: 405553 - DNA, 140 bp, Artificial Sequence
  Synthetic
aggccctggctgctgatatgcaataatacaagaaaaagtgtaaggataggaccaggacaaacattctatgcaacaggagaaataataggagacataagacaagcatattgtatcattaatgaccttttgggacagcggtg

SEQ ID NO: 405554 - DNA, 140 bp, Artificial Sequence
  Synthetic
caccgctgtcccaaaaggtcattaatgatacaatatgcttgtcttatgtctcctattatttctcctgttgcatagaatgtttgtcctggtcctatccttacactttttcttgtattattgcatatcagcagccagggcct

SEQ ID NO: 405555 - DNA, 140 bp, Artificial Sequence
  Synthetic
atacgccatgctgggtctcctaataccaatagtaacagcagtagtacagaaatacaacaacagggagaaataaaaaactgctctttcaatgtcaccacaaacataagagataagataagtcgtacttgggagtcggccat

SEQ ID NO: 405556 - DNA, 140 bp, Artificial Sequence
  Synthetic
atggccgactcccaagtacgacttatcttatctcttatgtttgtggtgacattgaaagagcagttttttatttctccctgttgttgtatttctgtactactgctgttactattggtattaggagacccagcatggcgtat

SEQ ID NO: 405557 - DNA, 140 bp, Artificial Sequence
  Synthetic
aggccctggctgctgatatgcataataatacagctgaatgaagctgtagaaattaactgtacaagacccaacaataatacaagaagaagtatacatataggaccagggagaacaatttttgaccttttgggacagcggtg

SEQ ID NO: 405558 - DNA, 140 bp, Artificial Sequence
  Synthetic
caccgctgtcccaaaaggtcaaaaattgttctccctggtcctatatgtatacttcttcttgtattattgttgggtcttgtacagttaatttctacagcttcattcagctgtattattatgcatatcagcagccagggcct

SEQ ID NO: 405559 - DNA, 140 bp, Artificial Sequence
  Synthetic
atacgccatgctgggtctcctacaaagtggaataaaactttaaaacagatagccaaaaagttaggagatcaatttggagaaaataaaacaataagctttaacaaatcctcaggaggggaccgtacttgggagtcggccat

SEQ ID NO: 405560 - DNA, 140 bp, Artificial Sequence
  Synthetic
atggccgactcccaagtacggtcccctcctgaggatttgttaaagcttattgttttattttctccaaattgatctcctaactttttggctatctgttttaaagttttattccactttgtaggagacccagcatggcgtat

SEQ ID NO: 405561 - DNA, 140 bp, Artificial Sequence
  Synthetic
atacgccatgctgggtctccccagaaattacaatgcacagttttatttgtggaggagaatttttctactgcaatacaacagaactatttaatagtagttggaatgagagtacctggaatgcgtacttgggagtcggccat

SEQ ID NO: 405562 - DNA, 140 bp, Artificial Sequence
  Synthetic
atggccgactcccaagtacgcattccaggtactctcattccaactactattaaatagttctgttgtattgcagtagaaaaattctcctccacaaataaaactgtgcattgtaatttctggggagacccagcatggcgtat

SEQ ID NO: 405563 - DNA, 140 bp, Artificial Sequence
  Synthetic
atacgccatgctgggtctccgctaaggttaatggtactgtcaatgataccatgaccgtcaataatatcatgaatggagaaataaaaaattgctctttcaatataaccacagagataagagcgtacttgggagtcggccat

SEQ ID NO: 405564 - DNA, 140 bp, Artificial Sequence
  Synthetic
atggccgactcccaagtacgctcttatctctgtggttatattgaaagagcaattttttatttctccattcatgatattattgacggtcatggtatcattgacagtaccattaaccttagcggagacccagcatggcgtat

SEQ ID NO: 405565 - DNA, 140 bp, Artificial Sequence
  Synthetic
aggccctggctgctgatatgagtacaaagagcttgtagagctattctccacatacctagaagaataagacagggcttggaaagggctttgctataagatgggtggcaagtggtcaaaatggaccttttgggacagcggtg

SEQ ID NO: 405566 - DNA, 140 bp, Artificial Sequence
  Synthetic
caccgctgtcccaaaaggtccattttgaccacttgccacccatcttatagcaaagccctttccaagccctgtcttattcttctaggtatgtggagaatagctctacaagctctttgtactcatatcagcagccagggcct

SEQ ID NO: 405567 - DNA, 140 bp, Artificial Sequence
  Synthetic
aggccctggctgctgatatgtaatacaaggaaaagtgtgaggataggaccaggacaaacattctatgcaacaggagacataataggagatataagacaagcacattgtaacattagtgaagaccttttgggacagcggtg

SEQ ID NO: 405568 - DNA, 140 bp, Artificial Sequence
  Synthetic
caccgctgtcccaaaaggtcttcactaatgttacaatgtgcttgtcttatatctcctattatgtctcctgttgcatagaatgtttgtcctggtcctatcctcacacttttccttgtattacatatcagcagccagggcct

SEQ ID NO: 405569 - DNA, 140 bp, Artificial Sequence
  Synthetic
aggccctggctgctgatatgttcaaacatcacacttcaatgcagaataaaacaaattataaacatgtggcagggggtaggacaagcaatgtatgcccctcctattgcaggaaacataacagaccttttgggacagcggtg

SEQ ID NO: 405570 - DNA, 140 bp, Artificial Sequence
  Synthetic
caccgctgtcccaaaaggtctgttatgtttcctgcaataggaggggcatacattgcttgtcctaccccctgccacatgtttataatttgttttattctgcattgaagtgtgatgtttgaacatatcagcagccagggcct

SEQ ID NO: 405571 - DNA, 140 bp, Artificial Sequence
  Synthetic
atacgccatgctgggtctccaggaatcgaagaagaaggtggagggaacgacagaggcaggtcaacgcgcatagtgaatggattcttagctctgttctgggacgatctacggagcctgtgccgtacttgggagtcggccat

SEQ ID NO: 405572 - DNA, 140 bp, Artificial Sequence
  Synthetic
atggccgactcccaagtacggcacaggctccgtagatcgtcccagaacagagctaagaatccattcactatgcgcgttgacctgcctctgtcgttccctccaccttcttcttcgattcctggagacccagcatggcgtat

SEQ ID NO: 405573 - DNA, 140 bp, Artificial Sequence
  Synthetic
atacgccatgctgggtctcctgtggagattctgggacacagggggtgggagatcctcaagtattggtggaaccttctgcagtattggagccaggaactaaagaatagtgctattagcttgcgtacttgggagtcggccat

SEQ ID NO: 405574 - DNA, 140 bp, Artificial Sequence
  Synthetic
atggccgactcccaagtacgcaagctaatagcactattctttagttcctggctccaatactgcagaaggttccaccaatacttgaggatctcccaccccctgtgtcccagaatctccacaggagacccagcatggcgtat

SEQ ID NO: 405575 - DNA, 140 bp, Artificial Sequence
  Synthetic
aggccctggctgctgatatggcagtgggataaagaaattaataattacacaaccataatatacgggttgcttgaagactcacaaagccagcaggagaaaaatgaacaggatttattagctgaccttttgggacagcggtg

SEQ ID NO: 405576 - DNA, 140 bp, Artificial Sequence
  Synthetic
caccgctgtcccaaaaggtcagctaataaatcctgttcatttttctcctgctggctttgtgagtcttcaagcaacccgtatattatggttgtgtaattattaatttctttatcccactgccatatcagcagccagggcct

SEQ ID NO: 405577 - DNA, 140 bp, Artificial Sequence
  Synthetic
atacgccatgctgggtctccggcagggagcagaaagagctttgcaataaaatgggtggcaagtggtcaaaatttagtgggtggtctactgtaagggaaagaatgagacgagctgagccaacgtacttgggagtcggccat

SEQ ID NO: 405578 - DNA, 140 bp, Artificial Sequence
  Synthetic
atggccgactcccaagtacgttggctcagctcgtctcattctttcccttacagtagaccacccactaaattttgaccacttgccacccattttattgcaaagctctttctgctccctgccggagacccagcatggcgtat

SEQ ID NO: 405579 - DNA, 140 bp, Artificial Sequence
  Synthetic
atacgccatgctgggtctccagattatagaataggaatagcagcatttatagtagcactaattatagcaataattgtgtggaccatagtatatatagaatataggaaactagtaaaacaacgtacttgggagtcggccat

SEQ ID NO: 405580 - DNA, 140 bp, Artificial Sequence
  Synthetic
atggccgactcccaagtacgttgttttactagtttcctatattctatatatactatggtccacacaattattgctataattagtgctactataaatgctgctattcctattctataatctggagacccagcatggcgtat

SEQ ID NO: 405581 - DNA, 140 bp, Artificial Sequence
  Synthetic
aggccctggctgctgatatgtaattgtgtggaccatagtatatatagaatataggaaactagtaaaacaaagaaaaatagacaggttaattaaaagaattagggaaagagaagaagacaggaccttttgggacagcggtg

SEQ ID NO: 405582 - DNA, 140 bp, Artificial Sequence
  Synthetic
caccgctgtcccaaaaggtcctgtcttcttctctttccctaattcttttaattaacctgtctatttttctttgttttactagtttcctatattctatatatactatggtccacacaattacatatcagcagccagggcct

SEQ ID NO: 405583 - DNA, 140 bp, Artificial Sequence
  Synthetic
aggccctggctgctgatatgacgccacagccatagcagtagctgaggggacagatagggttatagaagtagtacaaagagcttgtagagctattctccacatacctagaagaataagacagaccttttgggacagcggtg

SEQ ID NO: 405584 - DNA, 140 bp, Artificial Sequence
  Synthetic
caccgctgtcccaaaaggtctgtcttattcttctaggtatgtggagaatagctctacaagctctttgtactacttctataaccctatctgtcccctcagctactgctatggctgtggcgtcatatcagcagccagggcct

SEQ ID NO: 405585 - DNA, 140 bp, Artificial Sequence
  Synthetic
aggccctggctgctgatatggtacaaagagcttgtagagctattctccacatacctagaagaataagacagggcttggaaagggctttgctataagatgggtggcaagtggtcaaaatgtgaccttttgggacagcggtg

SEQ ID NO: 405586 - DNA, 140 bp, Artificial Sequence
  Synthetic
caccgctgtcccaaaaggtcacattttgaccacttgccacccatcttatagcaaagccctttccaagccctgtcttattcttctaggtatgtggagaatagctctacaagctctttgtaccatatcagcagccagggcct

SEQ ID NO: 405587 - DNA, 140 bp, Artificial Sequence
  Synthetic
atacgccatgctgggtctcctaatagtaccagtaatggtactgctacctacaatggtaccaggtgggaagaaatgaaaaattgctctttcaatataaccacagaactaagagataagagacgtacttgggagtcggccat

SEQ ID NO: 405588 - DNA, 140 bp, Artificial Sequence
  Synthetic
atggccgactcccaagtacgtctcttatctcttagttctgtggttatattgaaagagcaatttttcatttcttcccacctggtaccattgtaggtagcagtaccattactggtactattaggagacccagcatggcgtat

SEQ ID NO: 405589 - DNA, 140 bp, Artificial Sequence
  Synthetic
atacgccatgctgggtctccagaaggactgagccaagaagagctgagccagcagcagtaggagtaggggcagcatctcaagacttagatagacatggggcacttacaagcagcaacacaccgtacttgggagtcggccat

SEQ ID NO: 405590 - DNA, 140 bp, Artificial Sequence
  Synthetic
atggccgactcccaagtacggtgtgttgctgcttgtaagtgccccatgtctatctaagtcttgagatgctgcccctactcctactgctgctggctcagctcttcttggctcagtccttctggagacccagcatggcgtat

SEQ ID NO: 405591 - DNA, 140 bp, Artificial Sequence
  Synthetic
atacgccatgctgggtctccgtggcgcccgaacagggacctgaaagcgaaagtaagaccagaggagatctctcgacgcaggactcggcttgctgaagtgcactccggcaagaggcgagagcgtacttgggagtcggccat

SEQ ID NO: 405592 - DNA, 140 bp, Artificial Sequence
  Synthetic
atggccgactcccaagtacgctctcgcctcttgccggagtgcacttcagcaagccgagtcctgcgtcgagagatctcctctggtcttactttcgctttcaggtccctgttcgggcgccacggagacccagcatggcgtat

SEQ ID NO: 405593 - DNA, 140 bp, Artificial Sequence
  Synthetic
atacgccatgctgggtctcctagtatatgtgatgcaatctttagtaatagctgcaatagtaggactagtagtagcattcatagcagccatagttgtgtggaccatagtatttatagaatacgtacttgggagtcggccat

SEQ ID NO: 405594 - DNA, 140 bp, Artificial Sequence
  Synthetic
atggccgactcccaagtacgtattctataaatactatggtccacacaactatggctgctatgaatgctactactagtcctactattgcagctattactaaagattgcatcacatatactaggagacccagcatggcgtat

SEQ ID NO: 405595 - DNA, 140 bp, Artificial Sequence
  Synthetic
aggccctggctgctgatatgtaggaaaataaggaaacagaagaaaatagacaggatacttgatagaataagagaaagagcagaagatagtggcaatgagagtgatggggatacagaagaagaccttttgggacagcggtg

SEQ ID NO: 405596 - DNA, 140 bp, Artificial Sequence
  Synthetic
caccgctgtcccaaaaggtcttcttctgtatccccatcactctcattgccactatcttctgctctttctcttattctatcaagtatcctgtctattttcttctgtttccttattttcctacatatcagcagccagggcct

SEQ ID NO: 405597 - DNA, 140 bp, Artificial Sequence
  Synthetic
atacgccatgctgggtctcctcaataagacaatcaaatttaattcatccgcaggaggggacctagaagttacatcacatacctttaattgtggaggagaatttttctattgcaatacatccgtacttgggagtcggccat

SEQ ID NO: 405598 - DNA, 140 bp, Artificial Sequence
  Synthetic
atggccgactcccaagtacggatgtattgcaatagaaaaattctcctccacaattaaaggtatgtgatgtaacttctaggtcccctcctgcggatgaattaaatttgattgtcttattgaggagacccagcatggcgtat

SEQ ID NO: 405599 - DNA, 140 bp, Artificial Sequence
  Synthetic
aggccctggctgctgatatgtggagagacgcagagaccaccctattttgtgcatcagatgccaaagcatatgatacagaagcacataatgtctgggctacacatgcctgtgtacccacaggaccttttgggacagcggtg

SEQ ID NO: 405600 - DNA, 140 bp, Artificial Sequence
  Synthetic
caccgctgtcccaaaaggtcctgtgggtacacaggcatgtgtagcccagacattatgtgcttctgtatcatatgctttggcatctgatgcacaaaatagggtggtctctgcgtctctccacatatcagcagccagggcct

SEQ ID NO: 405601 - DNA, 140 bp, Artificial Sequence
  Synthetic
aggccctggctgctgatatgaactcctccagcagcagagggagtaggagcagtatctcaagatctagataaacatggagcaataacaagtagtaatatgaataatgctgattgtgtctgggaccttttgggacagcggtg

SEQ ID NO: 405602 - DNA, 140 bp, Artificial Sequence
  Synthetic
caccgctgtcccaaaaggtcccagacacaatcagcattattcatattactacttgttattgctccatgtttatctagatcttgagatactgctcctactccctctgctgctggaggagttcatatcagcagccagggcct

SEQ ID NO: 405603 - DNA, 140 bp, Artificial Sequence
  Synthetic
atacgccatgctgggtctccctacaagcacaagaggatgaggaggtaggctttccagtcaggccgcaggtacctctaagaccaatgacttataaggcagcttttgatcttagcttcttttcgtacttgggagtcggccat

SEQ ID NO: 405604 - DNA, 140 bp, Artificial Sequence
  Synthetic
atggccgactcccaagtacgaaaagaagctaagatcaaaagctgccttataagtcattggtcttagaggtacctgcggcctgactggaaagcctacctcctcatcctcttgtgcttgtagggagacccagcatggcgtat

SEQ ID NO: 405605 - DNA, 140 bp, Artificial Sequence
  Synthetic
atacgccatgctgggtctccgaagaaacaaaaaactgctctttcaatatgaccacagacttaagagacaaggaacagaaagtgtatgcacttttttatagaattgatatagtacaatttacgtacttgggagtcggccat

SEQ ID NO: 405606 - DNA, 140 bp, Artificial Sequence
  Synthetic
atggccgactcccaagtacgtaaattgtactatatcaattctataaaaaagtgcatacactttctgttccttgtctcttaagtctgtggtcatattgaaagagcagttttttgtttcttcggagacccagcatggcgtat

SEQ ID NO: 405607 - DNA, 140 bp, Artificial Sequence
  Synthetic
aggccctggctgctgatatgacagtacaatgcacacatggaatcaggccagtagtatcaactcaactgctgttaaatggcagtctagcagaaaaagagatagtgattagatctgaaaatagaccttttgggacagcggtg

SEQ ID NO: 405608 - DNA, 140 bp, Artificial Sequence
  Synthetic
caccgctgtcccaaaaggtctattttcagatctaatcactatctctttttctgctagactgccatttaacagcagttgagttgatactactggcctgattccatgtgtgcattgtactgtcatatcagcagccagggcct

SEQ ID NO: 405609 - DNA, 140 bp, Artificial Sequence
  Synthetic
aggccctggctgctgatatgattaattgtaccagacctagcaacaatacaagaaaaagtgtacgtattggaccagggcaaacattctatgcagcaggtgaaataataggagatataagacgaccttttgggacagcggtg

SEQ ID NO: 405610 - DNA, 140 bp, Artificial Sequence
  Synthetic
caccgctgtcccaaaaggtcgtcttatatctcctattatttcacctgctgcatagaatgtttgccctggtccaatacgtacactttttcttgtattgttgctaggtctggtacaattaatcatatcagcagccagggcct

SEQ ID NO: 405611 - DNA, 140 bp, Artificial Sequence
  Synthetic
aggccctggctgctgatatgaccagggcaaacattctatgcagcaggtgaaataataggagatataagacgagcacattgtaatgtcagtggatcaaaatggaatagcaccttacaaaaggaccttttgggacagcggtg

SEQ ID NO: 405612 - DNA, 140 bp, Artificial Sequence
  Synthetic
caccgctgtcccaaaaggtccttttgtaaggtgctattccattttgatccactgacattacaatgtgctcgtcttatatctcctattatttcacctgctgcatagaatgtttgccctggtcatatcagcagccagggcct

SEQ ID NO: 405613 - DNA, 140 bp, Artificial Sequence
  Synthetic
aggccctggctgctgatatggctgaacggattcttagcgattgcctgggacgatctgcggagcctgtgccttttcagccaccaccgattgagagacttcatcttgattgcagcgagagtagaccttttgggacagcggtg

SEQ ID NO: 405614 - DNA, 140 bp, Artificial Sequence
  Synthetic
caccgctgtcccaaaaggtctactctcgctgcaatcaagatgaagtctctcaatcggtggtggctgaaaaggcacaggctccgcagatcgtcccaggcaatcgctaagaatccgttcagccatatcagcagccagggcct

SEQ ID NO: 405615 - DNA, 140 bp, Artificial Sequence
  Synthetic
aggccctggctgctgatatgttgtatgtacaagacccggcaataatacaagaaaaagtataaggataggaccaggacaaacattctatgcaacaggagacataataggagacataagacagaccttttgggacagcggtg

SEQ ID NO: 405616 - DNA, 140 bp, Artificial Sequence
  Synthetic
caccgctgtcccaaaaggtctgtcttatgtctcctattatgtctcctgttgcatagaatgtttgtcctggtcctatccttatactttttcttgtattattgccgggtcttgtacatacaacatatcagcagccagggcct

SEQ ID NO: 405617 - DNA, 140 bp, Artificial Sequence
  Synthetic
aggccctggctgctgatatgagctggcctgctgtaagagaaagaataagaaaaaccgaaccagtagcagagggtgtaggagcagcagcagagggagtaggagcagcatctcaagacttaggaccttttgggacagcggtg

SEQ ID NO: 405618 - DNA, 140 bp, Artificial Sequence
  Synthetic
caccgctgtcccaaaaggtcctaagtcttgagatgctgctcctactccctctgctgctgctcctacaccctctgctactggttcggtttttcttattctttctcttacagcaggccagctcatatcagcagccagggcct

SEQ ID NO: 405619 - DNA, 140 bp, Artificial Sequence
  Synthetic
aggccctggctgctgatatggaggaagtaggctttccagtcaagcctcaagtacctttaaggccaatgacttataaagcagcatttgacctcggcttctttttaaaagaaaaggggggacgaccttttgggacagcggtg

SEQ ID NO: 405620 - DNA, 140 bp, Artificial Sequence
  Synthetic
caccgctgtcccaaaaggtcgtccccccttttcttttaaaaagaagccgaggtcaaatgctgctttataagtcattggccttaaaggtacttgaggcttgactggaaagcctacttcctccatatcagcagccagggcct

SEQ ID NO: 405621 - DNA, 140 bp, Artificial Sequence
  Synthetic
aggccctggctgctgatatgcaggagcagatgatacagtattagaagaaatagatttgccaggaagatggaaaccaaaaatgatagggggaattggaggttttatcaaagtaagacagtagaccttttgggacagcggtg

SEQ ID NO: 405622 - DNA, 140 bp, Artificial Sequence
  Synthetic
caccgctgtcccaaaaggtctactgtcttactttgataaaacctccaattccccctatcatttttggtttccatcttcctggcaaatctatttcttctaatactgtatcatctgctcctgcatatcagcagccagggcct

SEQ ID NO: 405623 - DNA, 140 bp, Artificial Sequence
  Synthetic
atacgccatgctgggtctcccagggcctcgaaaggtctttgctataacatgggtggcaagtgttcaaaaagcatagtgggatggcctaaggttagagaaagaataagacaaaccccagtacgtacttgggagtcggccat

SEQ ID NO: 405624 - DNA, 140 bp, Artificial Sequence
  Synthetic
atggccgactcccaagtacgtactggggtttgtcttattctttctctaaccttaggccatcccactatgctttttgaacacttgccacccatgttatagcaaagacctttcgaggccctgggagacccagcatggcgtat

SEQ ID NO: 405625 - DNA, 140 bp, Artificial Sequence
  Synthetic
aggccctggctgctgatatgagcagcatctcaagatttagatagacatggagcaatcacaagcagtaatacatcagctactaatgctgattgtgcctggctggaagcacaagaggaagaggaccttttgggacagcggtg

SEQ ID NO: 405626 - DNA, 140 bp, Artificial Sequence
  Synthetic
caccgctgtcccaaaaggtcctcttcctcttgtgcttccagccaggcacaatcagcattagtagctgatgtattactgcttgtgattgctccatgtctatctaaatcttgagatgctgctcatatcagcagccagggcct

SEQ ID NO: 405627 - DNA, 140 bp, Artificial Sequence
  Synthetic
aggccctggctgctgatatgagaaagaaacatgggaggcatggtggacagattattggcaagccacctggattcctgagtgggagtttgttaatacccctcccctagtaaaattatggtagaccttttgggacagcggtg

SEQ ID NO: 405628 - DNA, 140 bp, Artificial Sequence
  Synthetic
caccgctgtcccaaaaggtctaccataattttactaggggaggggtattaacaaactcccactcaggaatccaggtggcttgccaataatctgtccaccatgcctcccatgtttctttctcatatcagcagccagggcct

SEQ ID NO: 405629 - DNA, 140 bp, Artificial Sequence
  Synthetic
aggccctggctgctgatatgacgggaaggtcagtcaaaattatcctatagtgcagaatctccaagggcaaatggtacatcaggccctatcacctagaactttaaatgcatgggtaaaagtgaccttttgggacagcggtg

SEQ ID NO: 405630 - DNA, 140 bp, Artificial Sequence
  Synthetic
caccgctgtcccaaaaggtcacttttacccatgcatttaaagttctaggtgatagggcctgatgtaccatttgcccttggagattctgcactataggataattttgactgaccttcccgtcatatcagcagccagggcct

SEQ ID NO: 405631 - DNA, 140 bp, Artificial Sequence
  Synthetic
aggccctggctgctgatatgcaggggccgcagagggaaccatacaatgaatggacactagagcttctagaggaactcaagcaggaagctgtcagacactttcctagaccatggctccatagaccttttgggacagcggtg

SEQ ID NO: 405632 - DNA, 140 bp, Artificial Sequence
  Synthetic
caccgctgtcccaaaaggtctatggagccatggtctaggaaagtgtctgacagcttcctgcttgagttcctctagaagctctagtgtccattcattgtatggttccctctgcggcccctgcatatcagcagccagggcct

SEQ ID NO: 405633 - DNA, 140 bp, Artificial Sequence
  Synthetic
atacgccatgctgggtctccatgggatcaaagcctaaagccatgtgtaaagttaaccccactctgtgtctctttaaattgcacaaatattaccaaaagtagtagcaatactaatagcagccgtacttgggagtcggccat

SEQ ID NO: 405634 - DNA, 140 bp, Artificial Sequence
  Synthetic
atggccgactcccaagtacggctgctattagtattgctactacttttggtaatatttgtgcaatttaaagagacacagagtggggttaactttacacatggctttaggctttgatcccatggagacccagcatggcgtat

SEQ ID NO: 405635 - DNA, 140 bp, Artificial Sequence
  Synthetic
aggccctggctgctgatatgatttcaggcaagcatgacaaaaatcttagagccctttagaacaaaaaatccagaaatggtgatctatcaatatatggatgatttatatgtaggatctgacgaccttttgggacagcggtg

SEQ ID NO: 405636 - DNA, 140 bp, Artificial Sequence
  Synthetic
caccgctgtcccaaaaggtcgtcagatcctacatataaatcatccatatattgatagatcaccatttctggattttttgttctaaagggctctaagatttttgtcatgcttgcctgaaatcatatcagcagccagggcct

SEQ ID NO: 405637 - DNA, 140 bp, Artificial Sequence
  Synthetic
aggccctggctgctgatatggttgataagttgtaacacctcagtccttacacaggcctgtccaaaggtatcctttgagccaattcccatacattattgtgccccggctggttttgcgattgaccttttgggacagcggtg

SEQ ID NO: 405638 - DNA, 140 bp, Artificial Sequence
  Synthetic
caccgctgtcccaaaaggtcaatcgcaaaaccagccggggcacaataatgtatgggaattggctcaaaggatacctttggacaggcctgtgtaaggactgaggtgttacaacttatcaaccatatcagcagccagggcct

SEQ ID NO: 405639 - DNA, 140 bp, Artificial Sequence
  Synthetic
atacgccatgctgggtctccacctacaatggtacctacagtgatggaatgaaaagttgctctttcaatattaccacagaactaagagataagagaaggaaagaatatgcaatttttcatacgtacttgggagtcggccat

SEQ ID NO: 405640 - DNA, 140 bp, Artificial Sequence
  Synthetic
atggccgactcccaagtacgtatgaaaaattgcatattctttccttctcttatctcttagttctgtggtaatattgaaagagcaacttttcattccatcactgtaggtaccattgtaggtggagacccagcatggcgtat

SEQ ID NO: 405641 - DNA, 140 bp, Artificial Sequence
  Synthetic
aggccctggctgctgatatgcagcaacaatacaagaaaaaggatacatatagggccagggagagcagtgtatacaacagatcaaataacaggagatataagaaaagcatcttgtaatgttgaccttttgggacagcggtg

SEQ ID NO: 405642 - DNA, 140 bp, Artificial Sequence
  Synthetic
caccgctgtcccaaaaggtcaacattacaagatgcttttcttatatctcctgttatttgatctgttgtatacactgctctccctggccctatatgtatcctttttcttgtattgttgctgcatatcagcagccagggcct

SEQ ID NO: 405643 - DNA, 140 bp, Artificial Sequence
  Synthetic
aggccctggctgctgatatgagaacaatttgggaataataaaacaatagcctttaatcaatcctcaggaggggacccagaaatagcaatgcacatgtttaattgtagaggggaatttttcgaccttttgggacagcggtg

SEQ ID NO: 405644 - DNA, 140 bp, Artificial Sequence
  Synthetic
caccgctgtcccaaaaggtcgaaaaattcccctctacaattaaacatgtgcattgctatttctgggtcccctcctgaggattgattaaaggctattgttttattattcccaaattgttctcatatcagcagccagggcct

SEQ ID NO: 405645 - DNA, 140 bp, Artificial Sequence
  Synthetic
aggccctggctgctgatatgagcactgtacaatgtacacatggaattaagccagtagtatcaacccaactactgttaaatggtagcctagcagaagaagagatagtaattagatctgagagaccttttgggacagcggtg

SEQ ID NO: 405646 - DNA, 140 bp, Artificial Sequence
  Synthetic
caccgctgtcccaaaaggtctctcagatctaattactatctcttcttctgctaggctaccatttaacagtagttgggttgatactactggcttaattccatgtgtacattgtacagtgctcatatcagcagccagggcct

SEQ ID NO: 405647 - DNA, 140 bp, Artificial Sequence
  Synthetic
atacgccatgctgggtctcccaactcatccgcaggaggggacttagaaattacaacacatagctttaactgtagaggagagttcttctattgcaatacatcaaaactgtttaatggtacacgtacttgggagtcggccat

SEQ ID NO: 405648 - DNA, 140 bp, Artificial Sequence
  Synthetic
atggccgactcccaagtacgtgtaccattaaacagttttgatgtattgcaatagaagaactctcctctacagttaaagctatgtgttgtaatttctaagtcccctcctgcggatgagttgggagacccagcatggcgtat

SEQ ID NO: 405649 - DNA, 140 bp, Artificial Sequence
  Synthetic
aggccctggctgctgatatgtgtgccttggaatagtagttggagtaataaatctcaagatgatatttggaataacatgacctggatgcagtgggaaaaagaaattgacaattacacaggcgaccttttgggacagcggtg

SEQ ID NO: 405650 - DNA, 140 bp, Artificial Sequence
  Synthetic
caccgctgtcccaaaaggtcgcctgtgtaattgtcaatttctttttcccactgcatccaggtcatgttattccaaatatcatcttgagatttattactccaactactattccaaggcacacatatcagcagccagggcct

SEQ ID NO: 405651 - DNA, 140 bp, Artificial Sequence
  Synthetic
atacgccatgctgggtctccaaaggacttgttagaattagataaatgggacagtttgtggaattggtttgacataacacactggctgtggtatataaaaatattcattatgatagtaggacgtacttgggagtcggccat

SEQ ID NO: 405652 - DNA, 140 bp, Artificial Sequence
  Synthetic
atggccgactcccaagtacgtcctactatcataatgaatatttttatataccacagccagtgtgttatgtcaaaccaattccacaaactgtcccatttatctaattctaacaagtcctttggagacccagcatggcgtat

SEQ ID NO: 405653 - DNA, 140 bp, Artificial Sequence
  Synthetic
atacgccatgctgggtctccgcatgaaggaaatgaaaaattgctctttcaatgcaaccacagtagtaagagataagaagcagacagtgtatgcacttttttatagacttgatatagtacccgtacttgggagtcggccat

SEQ ID NO: 405654 - DNA, 140 bp, Artificial Sequence
  Synthetic
atggccgactcccaagtacgggtactatatcaagtctataaaaaagtgcatacactgtctgcttcttatctcttactactgtggttgcattgaaagagcaatttttcatttccttcatgcggagacccagcatggcgtat

SEQ ID NO: 405655 - DNA, 140 bp, Artificial Sequence
  Synthetic
aggccctggctgctgatatgctttcagaaaaaaggcttaggcatttactatggcaggaagaagcggagacagcagcgacgaagcgctcctccaagcaataaggaccatcaaaatcctatagaccttttgggacagcggtg

SEQ ID NO: 405656 - DNA, 140 bp, Artificial Sequence
  Synthetic
caccgctgtcccaaaaggtctataggattttgatggtccttattgcttggaggagcgcttcgtcgctgctgtctccgcttcttcctgccatagtaaatgcctaagccttttttctgaaagcatatcagcagccagggcct

SEQ ID NO: 405657 - DNA, 140 bp, Artificial Sequence
  Synthetic
atacgccatgctgggtctcctcaaagcagtaagtaccatatagtagatgtaatgatagattgggcagcaaaagtagattatagagtaggagtagtagcatttataatagcattactcatacgtacttgggagtcggccat

SEQ ID NO: 405658 - DNA, 140 bp, Artificial Sequence
  Synthetic
atggccgactcccaagtacgtatgagtaatgctattataaatgctactactcctactctataatctacttttgctgcccaatctatcattacatctactatatggtacttactgctttgaggagacccagcatggcgtat

SEQ ID NO: 405659 - DNA, 140 bp, Artificial Sequence
  Synthetic
atacgccatgctgggtctccaggggacagataggattatagaattagcacaaaggatttttagagctttcatacacatacctagaagaataagacagggctttgaaagggctttgctttacgtacttgggagtcggccat

SEQ ID NO: 405660 - DNA, 140 bp, Artificial Sequence
  Synthetic
atggccgactcccaagtacgtaaagcaaagccctttcaaagccctgtcttattcttctaggtatgtgtatgaaagctctaaaaatcctttgtgctaattctataatcctatctgtcccctggagacccagcatggcgtat

SEQ ID NO: 405661 - DNA, 140 bp, Artificial Sequence
  Synthetic
aggccctggctgctgatatgcctgtaccaaagcagtaagtaacgctgatgtatcttaaggacctgctactgtatcataaggacctgatactagtattaattatcattgctttgctgcttagaccttttgggacagcggtg

SEQ ID NO: 405662 - DNA, 140 bp, Artificial Sequence
  Synthetic
caccgctgtcccaaaaggtctaagcagcaaagcaatgataattaatactagtatcaggtccttatgatacagtagcaggtccttaagatacatcagcgttacttactgctttggtacaggcatatcagcagccagggcct

SEQ ID NO: 405663 - DNA, 140 bp, Artificial Sequence
  Synthetic
atacgccatgctgggtctccatggtactgtcaatatcacactcccatgcaaaataaaacaaattgtaaaccggtggcaggaagtagggaaagcaatgtatgcccctcccatcaaagggcccgtacttgggagtcggccat

SEQ ID NO: 405664 - DNA, 140 bp, Artificial Sequence
  Synthetic
atggccgactcccaagtacgggccctttgatgggaggggcatacattgctttccctacttcctgccaccggtttacaatttgttttattttgcatgggagtgtgatattgacagtaccatggagacccagcatggcgtat

SEQ ID NO: 405665 - DNA, 140 bp, Artificial Sequence
  Synthetic
aggccctggctgctgatatgtcatcctcaggaggggacctagaaattacaacacatagctttaattgtagaggagaatttttctattgtaatacatcaggcctgtttaatggtacatacagaccttttgggacagcggtg

SEQ ID NO: 405666 - DNA, 140 bp, Artificial Sequence
  Synthetic
caccgctgtcccaaaaggtctgtatgtaccattaaacaggcctgatgtattacaatagaaaaattctcctctacaattaaagctatgtgttgtaatttctaggtcccctcctgaggatgacatatcagcagccagggcct

SEQ ID NO: 405667 - DNA, 140 bp, Artificial Sequence
  Synthetic
aggccctggctgctgatatggggagcagcatctcgggatctggaaagacatggagcaatcacaagcagcaatacagcagctaacaatgctgatgttgcctggctagaagcacaagaggaggaccttttgggacagcggtg

SEQ ID NO: 405668 - DNA, 140 bp, Artificial Sequence
  Synthetic
caccgctgtcccaaaaggtcctcctcttgtgcttctagccaggcaacatcagcattgttagctgctgtattgctgcttgtgattgctccatgtctttccagatcccgagatgctgctccccatatcagcagccagggcct

SEQ ID NO: 405669 - DNA, 140 bp, Artificial Sequence
  Synthetic
atacgccatgctgggtctccagtaatgttactggtacccccaatgagggcagggatggacaaatgaaaaattgctctttcaatgtaaccacagaactaagagataagaaacaaaatgtgtcgtacttgggagtcggccat

SEQ ID NO: 405670 - DNA, 140 bp, Artificial Sequence
  Synthetic
atggccgactcccaagtacgacacattttgtttcttatctcttagttctgtggttacattgaaagagcaatttttcatttgtccatccctgccctcattgggggtaccagtaacattactggagacccagcatggcgtat

SEQ ID NO: 405671 - DNA, 140 bp, Artificial Sequence
  Synthetic
aggccctggctgctgatatgcaataatacaagaaaaagtataaggataggaccaggacaaacattctatgcaacaggagacataataggagacataagacaagcacactgtaaaattaatgaccttttgggacagcggtg

SEQ ID NO: 405672 - DNA, 140 bp, Artificial Sequence
  Synthetic
caccgctgtcccaaaaggtcattaattttacagtgtgcttgtcttatgtctcctattatgtctcctgttgcatagaatgtttgtcctggtcctatccttatactttttcttgtattattgcatatcagcagccagggcct

SEQ ID NO: 405673 - DNA, 140 bp, Artificial Sequence
  Synthetic
atacgccatgctgggtctccgcacttccctaataaaacaataaactttacacaaccctcaggaggggacttagaaatcacaacacatacctttaactgtagaggagaatttttctattgccgtacttgggagtcggccat

SEQ ID NO: 405674 - DNA, 140 bp, Artificial Sequence
  Synthetic
atggccgactcccaagtacggcaatagaaaaattctcctctacagttaaaggtatgtgttgtgatttctaagtcccctcctgagggttgtgtaaagtttattgttttattagggaagtgcggagacccagcatggcgtat

SEQ ID NO: 405675 - DNA, 140 bp, Artificial Sequence
  Synthetic
aggccctggctgctgatatggacttactcttgattgtaacgaggattgtggaacttctgggacgcagggggtgggaagccctcaaatattggtggaatctcctgcagtattggagtcagggaccttttgggacagcggtg

SEQ ID NO: 405676 - DNA, 140 bp, Artificial Sequence
  Synthetic
caccgctgtcccaaaaggtccctgactccaatactgcaggagattccaccaatatttgagggcttcccaccccctgcgtcccagaagttccacaatcctcgttacaatcaagagtaagtccatatcagcagccagggcct

SEQ ID NO: 405677 - DNA, 140 bp, Artificial Sequence
  Synthetic
atacgccatgctgggtctccgttaactacaataatacctctaaagacatgaaaaattgctctttctatgtaaccacagaattaagagataagaaaaagaaagaaaatgcacttttttatacgtacttgggagtcggccat

SEQ ID NO: 405678 - DNA, 140 bp, Artificial Sequence
  Synthetic
atggccgactcccaagtacgtataaaaaagtgcattttctttctttttcttatctcttaattctgtggttacatagaaagagcaatttttcatgtctttagaggtattattgtagttaacggagacccagcatggcgtat

SEQ ID NO: 405679 - DNA, 140 bp, Artificial Sequence
  Synthetic
atacgccatgctgggtctccttcaacgggagcagcaacataactaacgaaatgctaggggaaataaaaaactgctctttcaatatgaccacagaattaagagacaggaaaaagaaaatgccgtacttgggagtcggccat

SEQ ID NO: 405680 - DNA, 140 bp, Artificial Sequence
  Synthetic
atggccgactcccaagtacggcattttctttttcctgtctcttaattctgtggtcatattgaaagagcagttttttatttcccctagcatttcgttagttatgttgctgctcccgttgaaggagacccagcatggcgtat

SEQ ID NO: 405681 - DNA, 140 bp, Artificial Sequence
  Synthetic
aggccctggctgctgatatgtgggaaaaaattcggttacggccaggaggaaagaaaaaatatagactaaaacatctagtatgggcaagcagggagctagaacgatttgcacttaatcctggaccttttgggacagcggtg

SEQ ID NO: 405682 - DNA, 140 bp, Artificial Sequence
  Synthetic
caccgctgtcccaaaaggtccaggattaagtgcaaatcgttctagctccctgcttgcccatactagatgttttagtctatattttttctttcctcctggccgtaaccgaattttttcccacatatcagcagccagggcct

SEQ ID NO: 405683 - DNA, 140 bp, Artificial Sequence
  Synthetic
aggccctggctgctgatatgacaatatacaggttgcttgaagaatcacaaagccagcaggaacaaaatgaaaaagatttattagcattggacagttggaataacctgtggaattggtttagaccttttgggacagcggtg

SEQ ID NO: 405684 - DNA, 140 bp, Artificial Sequence
  Synthetic
caccgctgtcccaaaaggtctaaaccaattccacaggttattccaactgtccaatgctaataaatctttttcattttgttcctgctggctttgtgattcttcaagcaacctgtatattgtcatatcagcagccagggcct

SEQ ID NO: 405685 - DNA, 140 bp, Artificial Sequence
  Synthetic
aggccctggctgctgatatgtaggagatataagacaagcatattgtaatgtcagtggaacaggctggaatacagctttacaagaggtagtggatcagttacagaactactttaacacaacgaccttttgggacagcggtg

SEQ ID NO: 405686 - DNA, 140 bp, Artificial Sequence
  Synthetic
caccgctgtcccaaaaggtcgttgtgttaaagtagttctgtaactgatccactacctcttgtaaagctgtattccagcctgttccactgacattacaatatgcttgtcttatatctcctacatatcagcagccagggcct

SEQ ID NO: 405687 - DNA, 140 bp, Artificial Sequence
  Synthetic
aggccctggctgctgatatgggcacatagccaaaaattgcagggctcctaggaaaaagggctgttggaaatgtggaaaggaaggacaccaaatgaaagattgtactgagagacaggctaagaccttttgggacagcggtg

SEQ ID NO: 405688 - DNA, 140 bp, Artificial Sequence
  Synthetic
caccgctgtcccaaaaggtcttagcctgtctctcagtacaatctttcatttggtgtccttcctttccacatttccaacagccctttttcctaggagccctgcaatttttggctatgtgcccatatcagcagccagggcct

SEQ ID NO: 405689 - DNA, 140 bp, Artificial Sequence
  Synthetic
aggccctggctgctgatatgacacaaatagatcctgacctagcagaccaactgattcatctacaatattttgactgtttttcagaatctgccataaggagagccatattaggacaagtaggaccttttgggacagcggtg

SEQ ID NO: 405690 - DNA, 140 bp, Artificial Sequence
  Synthetic
caccgctgtcccaaaaggtcctacttgtcctaatatggctctccttatggcagattctgaaaaacagtcaaaatattgtagatgaatcagttggtctgctaggtcaggatctatttgtgtcatatcagcagccagggcct

SEQ ID NO: 405691 - DNA, 140 bp, Artificial Sequence
  Synthetic
aggccctggctgctgatatgtgcagatgttaaaagataccatcaatgaggaagctgcagaatgggacagggtacatccagtacatgcagggcctattccaccaggccagatgagggaaccgaccttttgggacagcggtg

SEQ ID NO: 405692 - DNA, 140 bp, Artificial Sequence
  Synthetic
caccgctgtcccaaaaggtcggttccctcatctggcctggtggaataggccctgcatgtactggatgtaccctgtcccattctgcagcttcctcattgatggtatcttttaacatctgcacatatcagcagccagggcct

SEQ ID NO: 405693 - DNA, 140 bp, Artificial Sequence
  Synthetic
aggccctggctgctgatatgaatagtgacataaaggtagtaccaaggaggaaagcaaaaatcattaaggactatggaaaacagatggcaggtgctgattgtgtggcaggtagacaggatggaccttttgggacagcggtg

SEQ ID NO: 405694 - DNA, 140 bp, Artificial Sequence
  Synthetic
caccgctgtcccaaaaggtccatcctgtctacctgccacacaatcagcacctgccatctgttttccatagtccttaatgatttttgctttcctccttggtactacctttatgtcactattcatatcagcagccagggcct

SEQ ID NO: 405695 - DNA, 140 bp, Artificial Sequence
  Synthetic
aggccctggctgctgatatgcagaaatggtgatctaccaatatatggatgatttatatgtaggatctgacttagaaatagggcagcatagagcaaaaatagaggagttgagagaacatctgaccttttgggacagcggtg

SEQ ID NO: 405696 - DNA, 140 bp, Artificial Sequence
  Synthetic
caccgctgtcccaaaaggtcagatgttctctcaactcctctatttttgctctatgctgccctatttctaagtcagatcctacatataaatcatccatatattggtagatcaccatttctgcatatcagcagccagggcct

SEQ ID NO: 405697 - DNA, 140 bp, Artificial Sequence
  Synthetic
aggccctggctgctgatatgcattcctttggatgggttatgaactccatcctgataaatggacagtccagcctataaagctgccagaaaaagacagctggactgtcaatgatatacagaagaccttttgggacagcggtg

SEQ ID NO: 405698 - DNA, 140 bp, Artificial Sequence
  Synthetic
caccgctgtcccaaaaggtcttctgtatatcattgacagtccagctgtctttttctggcagctttataggctggactgtccatttatcaggatggagttcataacccatccaaaggaatgcatatcagcagccagggcct

SEQ ID NO: 405699 - DNA, 140 bp, Artificial Sequence
  Synthetic
atacgccatgctgggtctccaataacaaatgcaactgttacaaatacaactaatgaaatgaagaattgctctttcaatgtaaccacagaagtaagagataaggaaaaggaacaatatgcacgtacttgggagtcggccat

SEQ ID NO: 405700 - DNA, 140 bp, Artificial Sequence
  Synthetic
atggccgactcccaagtacgtgcatattgttccttttccttatctcttacttctgtggttacattgaaagagcaattcttcatttcattagttgtatttgtaacagttgcatttgttattggagacccagcatggcgtat

SEQ ID NO: 405701 - DNA, 140 bp, Artificial Sequence
  Synthetic
aggccctggctgctgatatgttatttaatacagtagcagttctctattgtgtgcatcaaaagatagatgtaaaagacaccaaggaagccttagagaagatagaggaagagcaaaacaaaagaccttttgggacagcggtg

SEQ ID NO: 405702 - DNA, 140 bp, Artificial Sequence
  Synthetic
caccgctgtcccaaaaggtcttttgttttgctcttcctctatcttctctaaggcttccttggtgtcttttacatctatcttttgatgcacacaatagagaactgctactgtattaaataacatatcagcagccagggcct

SEQ ID NO: 405703 - DNA, 140 bp, Artificial Sequence
  Synthetic
atacgccatgctgggtctccccaacaataatacaagaaaaagtataggaataggaccaggacgaacattttatgcaacaggggacataataggagatatcaggcaagcacattgtaacatcgtacttgggagtcggccat

SEQ ID NO: 405704 - DNA, 140 bp, Artificial Sequence
  Synthetic
atggccgactcccaagtacgatgttacaatgtgcttgcctgatatctcctattatgtcccctgttgcataaaatgttcgtcctggtcctattcctatactttttcttgtattattgttggggagacccagcatggcgtat

SEQ ID NO: 405705 - DNA, 140 bp, Artificial Sequence
  Synthetic
atacgccatgctgggtctccaatttgaagaatggtactaaaatcattgggaaatcaataagaggagaaataaaaaactgctctttcaatgtcaccaaaaacataatagataaggtgaaaacgtacttgggagtcggccat

SEQ ID NO: 405706 - DNA, 140 bp, Artificial Sequence
  Synthetic
atggccgactcccaagtacgttttcaccttatctattatgtttttggtgacattgaaagagcagttttttatttctcctcttattgatttcccaatgattttagtaccattcttcaaattggagacccagcatggcgtat

SEQ ID NO: 405707 - DNA, 140 bp, Artificial Sequence
  Synthetic
  misc_feature (32)..(32): n is a, c, g, or t
  misc_feature (34)..(34): n is a, c, g, or t
  misc_feature (43)..(43): n is a, c, g, or t
atacgccatgctgggtctccatagtagtattngnggactgatngagacaggagacataaaaaactgcactttcaatgtcaccacaaacatacaagataagaggcaggaagaatatgcactcgtacttgggagtcggccat

SEQ ID NO: 405708 - DNA, 140 bp, Artificial Sequence
  Synthetic
  misc_feature (98)..(98): n is a, c, g, or t
  misc_feature (107)..(107): n is a, c, g, or t
  misc_feature (109)..(109): n is a, c, g, or t
atggccgactcccaagtacgagtgcatattcttcctgcctcttatcttgtatgtttgtggtgacattgaaagtgcagttttttatgtctcctgtctcnatcagtccncnaatactactatggagacccagcatggcgtat

SEQ ID NO: 405709 - DNA, 140 bp, Artificial Sequence
  Synthetic
aggccctggctgctgatatgcaggctaattttttagggaaaatttggccttcccacaaggggaggcccggaaatttccttcagaacaggccagagccaacagccccaccagcagagagctgaccttttgggacagcggtg

SEQ ID NO: 405710 - DNA, 140 bp, Artificial Sequence
  Synthetic
caccgctgtcccaaaaggtcagctctctgctggtggggctgttggctctggcctgttctgaaggaaatttccgggcctccccttgtgggaaggccaaattttccctaaaaaattagcctgcatatcagcagccagggcct

SEQ ID NO: 405711 - DNA, 140 bp, Artificial Sequence
  Synthetic
atacgccatgctgggtctccaaatgacactatcacactcccatgcagaataaaacaaattataaacatgtggcaggaagtaggaaaagcaatgtatgcccctcccatcagtggacaaattcgtacttgggagtcggccat

SEQ ID NO: 405712 - DNA, 140 bp, Artificial Sequence
  Synthetic
atggccgactcccaagtacgaatttgtccactgatgggaggggcatacattgcttttcctacttcctgccacatgtttataatttgttttattctgcatgggagtgtgatagtgtcatttggagacccagcatggcgtat

SEQ ID NO: 405713 - DNA, 140 bp, Artificial Sequence
  Synthetic
aggccctggctgctgatatgatcaaagcctaaagccatgtgtaaagttaaccccactctgtgttactctaaattgtactaatgccaagggcaatttcactagccaaagcagcactgagcagaccttttgggacagcggtg

SEQ ID NO: 405714 - DNA, 140 bp, Artificial Sequence
  Synthetic
caccgctgtcccaaaaggtctgctcagtgctgctttggctagtgaaattgcccttggcattagtacaatttagagtaacacagagtggggttaactttacacatggctttaggctttgatcatatcagcagccagggcct

SEQ ID NO: 405715 - DNA, 140 bp, Artificial Sequence
  Synthetic
aggccctggctgctgatatgttgataccatagcaatagcagtagctgaaggaacagataggcttatagaattcatacaaagcccttggagaggtatccgcaacgtacctagaagaataaggaccttttgggacagcggtg

SEQ ID NO: 405716 - DNA, 140 bp, Artificial Sequence
  Synthetic
caccgctgtcccaaaaggtccttattcttctaggtacgttgcggatacctctccaagggctttgtatgaattctataagcctatctgttccttcagctactgctattgctatggtatcaacatatcagcagccagggcct

SEQ ID NO: 405717 - DNA, 140 bp, Artificial Sequence
  Synthetic
atacgccatgctgggtctccttcatacaaagcccttggagaggtatccgcaacgtacctagaagaataagacagggcttcgaagcagctttgcaataaaatggggggcaagtggtcaaaacgtacttgggagtcggccat

SEQ ID NO: 405718 - DNA, 140 bp, Artificial Sequence
  Synthetic
atggccgactcccaagtacgttttgaccacttgccccccattttattgcaaagctgcttcgaagccctgtcttattcttctaggtacgttgcggatacctctccaagggctttgtatgaaggagacccagcatggcgtat

SEQ ID NO: 405719 - DNA, 140 bp, Artificial Sequence
  Synthetic
aggccctggctgctgatatgtgtacgcccctcccatcccaagatacattagctgttcatcaaatattacagggctgctattaacaagagatagtggtaccgccacgaacgaaaccttcaggaccttttgggacagcggtg

SEQ ID NO: 405720 - DNA, 140 bp, Artificial Sequence
  Synthetic
caccgctgtcccaaaaggtcctgaaggtttcgttcgtggcggtaccactatctcttgttaatagcagccctgtaatatttgatgaacagctaatgtatcttgggatgggaggggcgtacacatatcagcagccagggcct

SEQ ID NO: 405721 - DNA, 140 bp, Artificial Sequence
  Synthetic
aggccctggctgctgatatgagaagaaaatagacaggttacttgatagaataagagaaagagcagaagatagtggcaatgagagtgatggggatacagaagaactgtccactcttatggagaccttttgggacagcggtg

SEQ ID NO: 405722 - DNA, 140 bp, Artificial Sequence
  Synthetic
caccgctgtcccaaaaggtctccataagagtggacagttcttctgtatccccatcactctcattgccactatcttctgctctttctcttattctatcaagtaacctgtctattttcttctcatatcagcagccagggcct

SEQ ID NO: 405723 - DNA, 140 bp, Artificial Sequence
  Synthetic
atacgccatgctgggtctccagggtaatggtaccagtgttaataatactaccctcaatcaggaagaaatgaaaaattgccctttcaatatgaccacagaactaagagataagcaaaagaacgtacttgggagtcggccat

SEQ ID NO: 405724 - DNA, 140 bp, Artificial Sequence
  Synthetic
atggccgactcccaagtacgttcttttgcttatctcttagttctgtggtcatattgaaagggcaatttttcatttcttcctgattgagggtagtattattaacactggtaccattaccctggagacccagcatggcgtat

SEQ ID NO: 405725 - DNA, 140 bp, Artificial Sequence
  Synthetic
aggccctggctgctgatatgaaactgctctttcaatatgaccacagaattaagagataagaaaaagaaagtgtttgcactcttttataggcttgatgtagtacaaattagtgaaaataacgaccttttgggacagcggtg

SEQ ID NO: 405726 - DNA, 140 bp, Artificial Sequence
  Synthetic
caccgctgtcccaaaaggtcgttattttcactaatttgtactacatcaagcctataaaagagtgcaaacactttctttttcttatctcttaattctgtggtcatattgaaagagcagtttcatatcagcagccagggcct

SEQ ID NO: 405727 - DNA, 140 bp, Artificial Sequence
  Synthetic
atacgccatgctgggtctccgaattatagaaatattacaaagagctggtagagctattctcaacatacctacgagaataagacagggcttagaaagggctttgctataagcttatgggtgcgtacttgggagtcggccat

SEQ ID NO: 405728 - DNA, 140 bp, Artificial Sequence
  Synthetic
atggccgactcccaagtacgcacccataagcttatagcaaagccctttctaagccctgtcttattctcgtaggtatgttgagaatagctctaccagctctttgtaatatttctataattcggagacccagcatggcgtat

SEQ ID NO: 405729 - DNA, 140 bp, Artificial Sequence
  Synthetic
atacgccatgctgggtctccaacaaaacaataatatttaactcatcctcaggaggggacctagaaattacatatcatacctttaattgtagaggagaatttttctattgcaatgcatcaccgtacttgggagtcggccat

SEQ ID NO: 405730 - DNA, 140 bp, Artificial Sequence
  Synthetic
atggccgactcccaagtacggtgatgcattgcaatagaaaaattctcctctacaattaaaggtatgatatgtaatttctaggtcccctcctgaggatgagttaaatattattgttttgttggagacccagcatggcgtat

SEQ ID NO: 405731 - DNA, 140 bp, Artificial Sequence
  Synthetic
atacgccatgctgggtctcctatggatgatatagataaggaagatgatgacttggtaggggtatcagtgaggccaaaagttcccctaagaacaatgagttacaaattggcaatagacatgcgtacttgggagtcggccat

SEQ ID NO: 405732 - DNA, 140 bp, Artificial Sequence
  Synthetic
atggccgactcccaagtacgcatgtctattgccaatttgtaactcattgttcttaggggaacttttggcctcactgatacccctaccaagtcatcatcttccttatctatatcatccataggagacccagcatggcgtat

SEQ ID NO: 405733 - DNA, 140 bp, Artificial Sequence
  Synthetic
aggccctggctgctgatatgaagaagtgtacgtataggaccagggcaaactttctatgcaacagatgacataataggagatataagacaagcacattgtaatgtcagtggaacagactgggaccttttgggacagcggtg

SEQ ID NO: 405734 - DNA, 140 bp, Artificial Sequence
  Synthetic
caccgctgtcccaaaaggtcccagtctgttccactgacattacaatgtgcttgtcttatatctcctattatgtcatctgttgcatagaaagtttgccctggtcctatacgtacacttcttcatatcagcagccagggcct

SEQ ID NO: 405735 - DNA, 140 bp, Artificial Sequence
  Synthetic
atacgccatgctgggtctccaacaacaatactctttgctaacgcctcaggaggggatttagaaattacaacacatagttttaattgtggaggagaatttttctattgcaatacatcaaaacgtacttgggagtcggccat

SEQ ID NO: 405736 - DNA, 140 bp, Artificial Sequence
  Synthetic
atggccgactcccaagtacgttttgatgtattgcaatagaaaaattctcctccacaattaaaactatgtgttgtaatttctaaatcccctcctgaggcgttagcaaagagtattgttgttggagacccagcatggcgtat

SEQ ID NO: 405737 - DNA, 140 bp, Artificial Sequence
  Synthetic
atacgccatgctgggtctccaccatctattcagacaggaacagaggaacttaaatcattattcaacacagtagtaactctatggtgtgtacatgaagatataacagtacgagacaccaagcgtacttgggagtcggccat

SEQ ID NO: 405738 - DNA, 140 bp, Artificial Sequence
  Synthetic
atggccgactcccaagtacgcttggtgtctcgtactgttatatcttcatgtacacaccatagagttactactgtgttgaataatgatttaagttcctctgttcctgtctgaatagatggtggagacccagcatggcgtat

SEQ ID NO: 405739 - DNA, 140 bp, Artificial Sequence
  Synthetic
aggccctggctgctgatatgcatgacctggatgcagtgggatagagaaattaataattacacaggaataatatacagtttgcttgaagaatcgcaaaaccagcaggaaagaaatgaaaaagaccttttgggacagcggtg

SEQ ID NO: 405740 - DNA, 140 bp, Artificial Sequence
  Synthetic
caccgctgtcccaaaaggtctttttcatttctttcctgctggttttgcgattcttcaagcaaactgtatattattcctgtgtaattattaatttctctatcccactgcatccaggtcatgcatatcagcagccagggcct

SEQ ID NO: 405741 - DNA, 140 bp, Artificial Sequence
  Synthetic
atacgccatgctgggtctccattgattgtagcgagggcggtggagattctgggacgcagggggtgggaaacccttaagtatctgaaaagtattatacagtattggtgtctggagctaaaacgtacttgggagtcggccat

SEQ ID NO: 405742 - DNA, 140 bp, Artificial Sequence
  Synthetic
atggccgactcccaagtacgttttagctccagacaccaatactgtataatacttttcagatacttaagggtttcccaccccctgcgtcccagaatctccaccgccctcgctacaatcaatggagacccagcatggcgtat

SEQ ID NO: 405743 - DNA, 140 bp, Artificial Sequence
  Synthetic
atacgccatgctgggtctccattgccaaaagtgtttcataacaaaaggcttaggcatctcctatggcaggaagaagcggagacagcgacgaagatctcctaggcacagtccggctcatcacgtacttgggagtcggccat

SEQ ID NO: 405744 - DNA, 140 bp, Artificial Sequence
  Synthetic
atggccgactcccaagtacgtgatgagccggactgtgcctaggagatcttcgtcgctgtctccgcttcttcctgccataggagatgcctaagccttttgttatgaaacacttttggcaatggagacccagcatggcgtat

SEQ ID NO: 405745 - DNA, 140 bp, Artificial Sequence
  Synthetic
aggccctggctgctgatatgatagcatgggtggcaagtggtcaaaaagcagcatagtgggatggcctaaggttagggaaagaataagacagacccctccagcagcaataggagtaggagcgaccttttgggacagcggtg

SEQ ID NO: 405746 - DNA, 140 bp, Artificial Sequence
  Synthetic
caccgctgtcccaaaaggtcgctcctactcctattgctgctggaggggtctgtcttattctttccctaaccttaggccatcccactatgctgctttttgaccacttgccacccatgctatcatatcagcagccagggcct

SEQ ID NO: 405747 - DNA, 140 bp, Artificial Sequence
  Synthetic
atacgccatgctgggtctccgagaccaaggtcaacgtgaccactgtctctataggaaatctaacagatgaagtaagaaactgttcttttaatgtgaccacagaactaaaagataagaagacgtacttgggagtcggccat

SEQ ID NO: 405748 - DNA, 140 bp, Artificial Sequence
  Synthetic
atggccgactcccaagtacgtcttcttatcttttagttctgtggtcacattaaaagaacagtttcttacttcatctgttagatttcctatagagacagtggtcacgttgaccttggtctcggagacccagcatggcgtat

SEQ ID NO: 405749 - DNA, 140 bp, Artificial Sequence
  Synthetic
atacgccatgctgggtctccaaaaattgctctttcaatatcaccacagacctaagagataagaagcagaaagaatatgcagttttttataaacttgatgtgacaccaataggaaatgatacgtacttgggagtcggccat

SEQ ID NO: 405750 - DNA, 140 bp, Artificial Sequence
  Synthetic
atggccgactcccaagtacgtatcatttcctattggtgtcacatcaagtttataaaaaactgcatattctttctgcttcttatctcttaggtctgtggtgatattgaaagagcaatttttggagacccagcatggcgtat

SEQ ID NO: 405751 - DNA, 140 bp, Artificial Sequence
  Synthetic
aggccctggctgctgatatgaaaagtatacatatgggatgggggagagcattttacacaacaggagaaataatagatgatataagaaaagcacattgtaacattagtaaagcaaaatggggaccttttgggacagcggtg

SEQ ID NO: 405752 - DNA, 140 bp, Artificial Sequence
  Synthetic
caccgctgtcccaaaaggtccccattttgctttactaatgttacaatgtgcttttcttatatcatctattatttctcctgttgtgtaaaatgctctcccccatcccatatgtatacttttcatatcagcagccagggcct

SEQ ID NO: 405753 - DNA, 140 bp, Artificial Sequence
  Synthetic
aggccctggctgctgatatggaaagcatagtaatatggggaaagactcctaaatttagactacccatacaaaaagaaacatgggaaacatggtggacagagtattggcaagccacctggagaccttttgggacagcggtg

SEQ ID NO: 405754 - DNA, 140 bp, Artificial Sequence
  Synthetic
caccgctgtcccaaaaggtctccaggtggcttgccaatactctgtccaccatgtttcccatgtttctttttgtatgggtagtctaaatttaggagtctttccccatattactatgctttccatatcagcagccagggcct

SEQ ID NO: 405755 - DNA, 140 bp, Artificial Sequence
  Synthetic
aggccctggctgctgatatgtagtaataaaaacatattggggtttgcaaacaggagaaagagattggcatttgggtcatggagtctccatagaatggagattgagaagatataccacacagaccttttgggacagcggtg

SEQ ID NO: 405756 - DNA, 140 bp, Artificial Sequence
  Synthetic
caccgctgtcccaaaaggtctgtgtggtatatcttctcaatctccattctatggagactccatgacccaaatgccaatctctttctcctgtttgcaaaccccaatatgtttttattactacatatcagcagccagggcct

SEQ ID NO: 405757 - DNA, 140 bp, Artificial Sequence
  Synthetic
aggccctggctgctgatatgaggaaagtatgcaaaaaggaggactgcccacactaatgatgtaaaacagttaacagaggcagtgcaaaaaatagccatggaaagcatagtaatatggggagaccttttgggacagcggtg

SEQ ID NO: 405758 - DNA, 140 bp, Artificial Sequence
  Synthetic
caccgctgtcccaaaaggtctccccatattactatgctttccatggctattttttgcactgcctctgttaactgttttacatcattagtgtgggcagtcctcctttttgcatactttcctcatatcagcagccagggcct

SEQ ID NO: 405759 - DNA, 140 bp, Artificial Sequence
  Synthetic
atacgccatgctgggtctccacagcacctgtaagggtaacacaagtgaaataaaaaattgctctttcgacacaacctcagaaatggaagataagaagaaaagacagaatgcacttttctacgtacttgggagtcggccat

SEQ ID NO: 405760 - DNA, 140 bp, Artificial Sequence
  Synthetic
atggccgactcccaagtacgtagaaaagtgcattctgtcttttcttcttatcttccatttctgaggttgtgtcgaaagagcaattttttatttcacttgtgttacccttacaggtgctgtggagacccagcatggcgtat

SEQ ID NO: 405761 - DNA, 140 bp, Artificial Sequence
  Synthetic
aggccctggctgctgatatgtagttgtgtggaccatagcatatatagaatataggaaattgttaagacaaagaaaaatagacaggttaattaaaagaattagggaaagagcagaagacaggaccttttgggacagcggtg

SEQ ID NO: 405762 - DNA, 140 bp, Artificial Sequence
  Synthetic
caccgctgtcccaaaaggtcctgtcttctgctctttccctaattcttttaattaacctgtctatttttctttgtcttaacaatttcctatattctatatatgctatggtccacacaactacatatcagcagccagggcct

SEQ ID NO: 405763 - DNA, 140 bp, Artificial Sequence
  Synthetic
aggccctggctgctgatatgattgaagaatcgcagaaccagcaggaaaagaatgaacaagaattgttggcattggacaagtgggcaagtctgtggaattggtttgacataacaaaatggcgaccttttgggacagcggtg

SEQ ID NO: 405764 - DNA, 140 bp, Artificial Sequence
  Synthetic
caccgctgtcccaaaaggtcgccattttgttatgtcaaaccaattccacagacttgcccacttgtccaatgccaacaattcttgttcattcttttcctgctggttctgcgattcttcaatcatatcagcagccagggcct

SEQ ID NO: 405765 - DNA, 140 bp, Artificial Sequence
  Synthetic
atacgccatgctgggtctcctacagacaatgtcaaaacaataatagtacaccttaaggatgctgtagaaattgtgtgtataagacccggcaataatacaagaaccagtgtgaggataggccgtacttgggagtcggccat

SEQ ID NO: 405766 - DNA, 140 bp, Artificial Sequence
  Synthetic
atggccgactcccaagtacggcctatcctcacactggttcttgtattattgccgggtcttatacacacaatttctacagcatccttaaggtgtactattattgttttgacattgtctgtaggagacccagcatggcgtat

SEQ ID NO: 405767 - DNA, 140 bp, Artificial Sequence
  Synthetic
atacgccatgctgggtctccagcacattgtaacattactgaaagcaagtggaataacactttaaaaaaggtaacaggaaaattaggagaatacttccctaatcgaacaatacaatttgcacgtacttgggagtcggccat

SEQ ID NO: 405768 - DNA, 140 bp, Artificial Sequence
  Synthetic
atggccgactcccaagtacgtgcaaattgtattgttcgattagggaagtattctcctaattttcctgttaccttttttaaagtgttattccacttgctttcagtaatgttacaatgtgctggagacccagcatggcgtat

SEQ ID NO: 405769 - DNA, 140 bp, Artificial Sequence
  Synthetic
aggccctggctgctgatatgtaacaggaaaattaggagaatacttccctaatcgaacaatacaatttgcaccatcctcaggaggagatttagaaattacaacacatagctttaattgtgggaccttttgggacagcggtg

SEQ ID NO: 405770 - DNA, 140 bp, Artificial Sequence
  Synthetic
caccgctgtcccaaaaggtcccacaattaaagctatgtgttgtaatttctaaatctcctcctgaggatggtgcaaattgtattgttcgattagggaagtattctcctaattttcctgttacatatcagcagccagggcct

SEQ ID NO: 405771 - DNA, 140 bp, Artificial Sequence
  Synthetic
aggccctggctgctgatatgaaatgttaatgttacccatgagaatagcacgaagggggaaatgaaaaattgctctttcaatgcaaccacagaactaaaagataaaaaacagagagtgtatgaccttttgggacagcggtg

SEQ ID NO: 405772 - DNA, 140 bp, Artificial Sequence
  Synthetic
caccgctgtcccaaaaggtcatacactctctgttttttatcttttagttctgtggttgcattgaaagagcaatttttcatttcccccttcgtgctattctcatgggtaacattaacatttcatatcagcagccagggcct

SEQ ID NO: 405773 - DNA, 140 bp, Artificial Sequence
  Synthetic
aggccctggctgctgatatgtactaactataggttgataagttgtaacacctcagtcattacacaggcctgtccaaaggtatcctttgagccaattcccatacattattgtgccccggctgaccttttgggacagcggtg

SEQ ID NO: 405774 - DNA, 140 bp, Artificial Sequence
  Synthetic
caccgctgtcccaaaaggtcagccggggcacaataatgtatgggaattggctcaaaggatacctttggacaggcctgtgtaatgactgaggtgttacaacttatcaacctatagttagtacatatcagcagccagggcct

SEQ ID NO: 405775 - DNA, 140 bp, Artificial Sequence
  Synthetic
aggccctggctgctgatatgaatagtacatcttaatgaatctgtagaaattgtgtgtacaagacccaacaataatacaagaaaaagtataaggataggaccaggacaagcattctatgcagaccttttgggacagcggtg

SEQ ID NO: 405776 - DNA, 140 bp, Artificial Sequence
  Synthetic
caccgctgtcccaaaaggtctgcatagaatgcttgtcctggtcctatccttatactttttcttgtattattgttgggtcttgtacacacaatttctacagattcattaagatgtactattcatatcagcagccagggcct

SEQ ID NO: 405777 - DNA, 140 bp, Artificial Sequence
  Synthetic
aggccctggctgctgatatgacttccctaataaaacaataaaatttgaccaacactcaggaggggacctagaaattacaacacatagctttaattgtagaggagaatttttctattgcaagaccttttgggacagcggtg

SEQ ID NO: 405778 - DNA, 140 bp, Artificial Sequence
  Synthetic
caccgctgtcccaaaaggtcttgcaatagaaaaattctcctctacaattaaagctatgtgttgtaatttctaggtcccctcctgagtgttggtcaaattttattgttttattagggaagtcatatcagcagccagggcct

SEQ ID NO: 405779 - DNA, 140 bp, Artificial Sequence
  Synthetic
aggccctggctgctgatatgaaaatgaacaagatttactagcattggacagttgggcaagtctgtggaattggtttagcataacaaaatggctgtggtatataaaaatattcataatgatgaccttttgggacagcggtg

SEQ ID NO: 405780 - DNA, 140 bp, Artificial Sequence
  Synthetic
caccgctgtcccaaaaggtcatcattatgaatatttttatataccacagccattttgttatgctaaaccaattccacagacttgcccaactgtccaatgctagtaaatcttgttcattttcatatcagcagccagggcct

SEQ ID NO: 405781 - DNA, 140 bp, Artificial Sequence
  Synthetic
aggccctggctgctgatatgatatagaatataggaaactagtaagacaaagaagaatagactggttaattgaaagaattagggaaagagcagaagacagtggcaatgagagtgagggggagaccttttgggacagcggtg

SEQ ID NO: 405782 - DNA, 140 bp, Artificial Sequence
  Synthetic
caccgctgtcccaaaaggtctccccctcactctcattgccactgtcttctgctctttccctaattctttcaattaaccagtctattcttctttgtcttactagtttcctatattctatatcatatcagcagccagggcct

SEQ ID NO: 405783 - DNA, 140 bp, Artificial Sequence
  Synthetic
atacgccatgctgggtctcccaataatagtacagacatgagaaattgctctttcaatacaaccacagaactaagagataagggacagaaagcgcatgcacttttttatagacttgatatacgtacttgggagtcggccat

SEQ ID NO: 405784 - DNA, 140 bp, Artificial Sequence
  Synthetic
atggccgactcccaagtacgtatatcaagtctataaaaaagtgcatgcgctttctgtcccttatctcttagttctgtggttgtattgaaagagcaatttctcatgtctgtactattattgggagacccagcatggcgtat

SEQ ID NO: 405785 - DNA, 140 bp, Artificial Sequence
  Synthetic
atacgccatgctgggtctccaatgagaaaaactgagccagcagagccagcagcagctggggtgggagcagtatctcgagacctggaaaaacatggagcaatcacaagtaacaatgttaatcgtacttgggagtcggccat

SEQ ID NO: 405786 - DNA, 140 bp, Artificial Sequence
  Synthetic
atggccgactcccaagtacgattaacattgttacttgtgattgctccatgtttttccaggtctcgagatactgctcccaccccagctgctgctggctctgctggctcagtttttctcattggagacccagcatggcgtat

SEQ ID NO: 405787 - DNA, 140 bp, Artificial Sequence
  Synthetic
atacgccatgctgggtctccagcaaggagcagctgcagctgacgcaggaaacaacagccaggtcagccagaattaccctatagtgcaaaaccttcaggggcaaatggtacatcagcccatcgtacttgggagtcggccat

SEQ ID NO: 405788 - DNA, 140 bp, Artificial Sequence
  Synthetic
atggccgactcccaagtacgatgggctgatgtaccatttgcccctgaaggttttgcactatagggtaattctggctgacctggctgttgtttcctgcgtcagctgcagctgctccttgctggagacccagcatggcgtat

SEQ ID NO: 405789 - DNA, 140 bp, Artificial Sequence
  Synthetic
aggccctggctgctgatatgaacacctagtatgggcaagcagggagctggaaaaatttgcacttaaccctggccttttagagacatcagaaggctgtaaacaaataataaaacagctacagaccttttgggacagcggtg

SEQ ID NO: 405790 - DNA, 140 bp, Artificial Sequence
  Synthetic
caccgctgtcccaaaaggtctgtagctgttttattatttgtttacagccttctgatgtctctaaaaggccagggttaagtgcaaatttttccagctccctgcttgcccatactaggtgttcatatcagcagccagggcct

SEQ ID NO: 405791 - DNA, 140 bp, Artificial Sequence
  Synthetic
atacgccatgctgggtctccagatttgggataacatgacctggatgcagtgggatagagaaattagtaattactcagacacaatatacaggttgcttgaagaatcgcaaaaccagcaggacgtacttgggagtcggccat

SEQ ID NO: 405792 - DNA, 140 bp, Artificial Sequence
  Synthetic
atggccgactcccaagtacgtcctgctggttttgcgattcttcaagcaacctgtatattgtgtctgagtaattactaatttctctatcccactgcatccaggtcatgttatcccaaatctggagacccagcatggcgtat

SEQ ID NO: 405793 - DNA, 140 bp, Artificial Sequence
  Synthetic
atacgccatgctgggtctccccagagccaacagccccaccagcagagccaacagctccaccagcagagagcttcaggttcgaggagacaacccccgctccgaagcaggagctgaaagacacgtacttgggagtcggccat

SEQ ID NO: 405794 - DNA, 140 bp, Artificial Sequence
  Synthetic
atggccgactcccaagtacgtgtctttcagctcctgcttcggagcgggggttgtctcctcgaacctgaagctctctgctggtggagctgttggctctgctggtggggctgttggctctggggagacccagcatggcgtat

SEQ ID NO: 405795 - DNA, 140 bp, Artificial Sequence
  Synthetic
aggccctggctgctgatatgaaaaagaccccatagtaggagcagaaactttctatgtagatggggcagctaatagggagactaagataggaaaagcagggtatgttactgacagaggaaggaccttttgggacagcggtg

SEQ ID NO: 405796 - DNA, 140 bp, Artificial Sequence
  Synthetic
caccgctgtcccaaaaggtccttcctctgtcagtaacataccctgcttttcctatcttagtctccctattagctgccccatctacatagaaagtttctgctcctactatggggtctttttcatatcagcagccagggcct

SEQ ID NO: 405797 - DNA, 140 bp, Artificial Sequence
  Synthetic
aggccctggctgctgatatgtgagagacttcatattgattgcagcgagggcggcggaacttctgggacgcagcagtctcaggggactacagagggggtgggaaatccttaagtatctggggaccttttgggacagcggtg

SEQ ID NO: 405798 - DNA, 140 bp, Artificial Sequence
  Synthetic
caccgctgtcccaaaaggtccccagatacttaaggatttcccaccccctctgtagtcccctgagactgctgcgtcccagaagttccgccgccctcgctgcaatcaatatgaagtctctcacatatcagcagccagggcct

SEQ ID NO: 405799 - DNA, 140 bp, Artificial Sequence
  Synthetic
aggccctggctgctgatatgagcagtctcaggggactacagagggggtgggaaatccttaagtatctgggaagccttctacagtactggggtctagagctaaaaaagagtgctattagtcgaccttttgggacagcggtg

SEQ ID NO: 405800 - DNA, 140 bp, Artificial Sequence
  Synthetic
caccgctgtcccaaaaggtcgactaatagcactcttttttagctctagaccccagtactgtagaaggcttcccagatacttaaggatttcccaccccctctgtagtcccctgagactgctcatatcagcagccagggcct

SEQ ID NO: 405801 - DNA, 140 bp, Artificial Sequence
  Synthetic
aggccctggctgctgatatgtagatggaacaagccccagaagaccaagggccacagagggagccatacaatgaatgggcactagaacttttagaggagcttaagaatgaagctgttagacgaccttttgggacagcggtg

SEQ ID NO: 405802 - DNA, 140 bp, Artificial Sequence
  Synthetic
caccgctgtcccaaaaggtcgtctaacagcttcattcttaagctcctctaaaagttctagtgcccattcattgtatggctccctctgtggcccttggtcttctggggcttgttccatctacatatcagcagccagggcct

SEQ ID NO: 405803 - DNA, 140 bp, Artificial Sequence
  Synthetic
aggccctggctgctgatatgaaaagctggcctgctgtaagagaaagaataagaagaactagaactgaaccagcagcagagggagtaggagcagcatctcaagacttagataaacatggaggaccttttgggacagcggtg

SEQ ID NO: 405804 - DNA, 140 bp, Artificial Sequence
  Synthetic
caccgctgtcccaaaaggtcctccatgtttatctaagtcttgagatgctgctcctactccctctgctgctggttcagttctagttcttcttattctttctcttacagcaggccagcttttcatatcagcagccagggcct

SEQ ID NO: 405805 - DNA, 140 bp, Artificial Sequence
  Synthetic
aggccctggctgctgatatgttagtcaacagaggagagcaagaaatggagccagtagatcctagcctagagccctggaagcatccaggaagtcagcctaagactgcttgtaccaaatgctgaccttttgggacagcggtg

SEQ ID NO: 405806 - DNA, 140 bp, Artificial Sequence
  Synthetic
caccgctgtcccaaaaggtcagcatttggtacaagcagtcttaggctgacttcctggatgcttccagggctctaggctaggatctactggctccatttcttgctctcctctgttgactaacatatcagcagccagggcct

SEQ ID NO: 405807 - DNA, 140 bp, Artificial Sequence
  Synthetic
aggccctggctgctgatatgagacagtggaaatgagagtgaaggagacacagatgaattggcaaaacttgtggaaatgggggactttgatccttgggttggtgataatttgtagtgcctcgaccttttgggacagcggtg

SEQ ID NO: 405808 - DNA, 140 bp, Artificial Sequence
  Synthetic
caccgctgtcccaaaaggtcgaggcactacaaattatcaccaacccaaggatcaaagtcccccatttccacaagttttgccaattcatctgtgtctccttcactctcatttccactgtctcatatcagcagccagggcct

SEQ ID NO: 405809 - DNA, 140 bp, Artificial Sequence
  Synthetic
aggccctggctgctgatatggagaaagaacccatagcaggagcagaaactttctatgtagatggagcagctaatagggaaactaaaataggaaaagcagggtatgttactgacagaggaagaccttttgggacagcggtg

SEQ ID NO: 405810 - DNA, 140 bp, Artificial Sequence
  Synthetic
caccgctgtcccaaaaggtcttcctctgtcagtaacataccctgcttttcctattttagtttccctattagctgctccatctacatagaaagtttctgctcctgctatgggttctttctccatatcagcagccagggcct

SEQ ID NO: 405811 - DNA, 140 bp, Artificial Sequence
  Synthetic
atacgccatgctgggtctccaacagtagttgcgaaaacagggagggagaaatgacaaactgctctttcaatatcacaagcataggaaataagatgcagaaagaatatgcacttttttatacgtacttgggagtcggccat

SEQ ID NO: 405812 - DNA, 140 bp, Artificial Sequence
  Synthetic
atggccgactcccaagtacgtataaaaaagtgcatattctttctgcatcttatttcctatgcttgtgatattgaaagagcagtttgtcatttctccctccctgttttcgcaactactgttggagacccagcatggcgtat

SEQ ID NO: 405813 - DNA, 140 bp, Artificial Sequence
  Synthetic
atacgccatgctgggtctccaaaaaactacgagaacaatttaataaaactaacacaataatctttgatcaaccctcaggaggggacctagaagttcaaatgcacacgtttaattgtggagcgtacttgggagtcggccat

SEQ ID NO: 405814 - DNA, 140 bp, Artificial Sequence
  Synthetic
atggccgactcccaagtacgctccacaattaaacgtgtgcatttgaacttctaggtcccctcctgagggttgatcaaagattattgtgttagttttattaaattgttctcgtagttttttggagacccagcatggcgtat

SEQ ID NO: 405815 - DNA, 140 bp, Artificial Sequence
  Synthetic
aggccctggctgctgatatgaccctcaggaggggacctagaagttcaaatgcacacgtttaattgtggaggggaatttttctactgtaatacatcacagctgtttaatagtacttggaatgaccttttgggacagcggtg

SEQ ID NO: 405816 - DNA, 140 bp, Artificial Sequence
  Synthetic
caccgctgtcccaaaaggtcattccaagtactattaaacagctgtgatgtattacagtagaaaaattcccctccacaattaaacgtgtgcatttgaacttctaggtcccctcctgagggtcatatcagcagccagggcct

SEQ ID NO: 405817 - DNA, 140 bp, Artificial Sequence
  Synthetic
aggccctggctgctgatatgaaatgtaacagaagattttaacatgtggaaaaatagcatggtagagcagatgcatgaagatataattagtctatgggatcaaagcctaaagccatgtgtagaccttttgggacagcggtg

SEQ ID NO: 405818 - DNA, 140 bp, Artificial Sequence
  Synthetic
caccgctgtcccaaaaggtctacacatggctttaggctttgatcccatagactaattatatcttcatgcatctgctctaccatgctatttttccacatgttaaaatcttctgttacatttcatatcagcagccagggcct

SEQ ID NO: 405819 - DNA, 140 bp, Artificial Sequence
  Synthetic
atacgccatgctgggtctccaaaactcatttgcaccactactgtgccttagaatgccagttagagtataaaatccaagtgagatttaagataactgacctaggtacagtaagagagagaacgtacttgggagtcggccat

SEQ ID NO: 405820 - DNA, 140 bp, Artificial Sequence
  Synthetic
atggccgactcccaagtacgttctctctcttactgtacctaggtcagttatcttaaatctcacttggattttatactctaactggcattctaaggcacagtagtggtgcaaatgagttttggagacccagcatggcgtat

SEQ ID NO: 405821 - DNA, 140 bp, Artificial Sequence
  Synthetic
aggccctggctgctgatatgaatccaagtgagatttaagataactgacctaggtacagtaagagagagaaataagcaattacacagaccaaatatacagcttactcgaagaagcgcagaagaccttttgggacagcggtg

SEQ ID NO: 405822 - DNA, 140 bp, Artificial Sequence
  Synthetic
caccgctgtcccaaaaggtcttctgcgcttcttcgagtaagctgtatatttggtctgtgtaattgcttatttctctctcttactgtacctaggtcagttatcttaaatctcacttggattcatatcagcagccagggcct

SEQ ID NO: 405823 - DNA, 140 bp, Artificial Sequence
  Synthetic
atacgccatgctgggtctcctttgcagaattggtttgacatatcaaactggctggagtatataaaaatattcataataatagtaagaagcttaataagtttaagaatagtttttgctgtgcgtacttgggagtcggccat

SEQ ID NO: 405824 - DNA, 140 bp, Artificial Sequence
  Synthetic
atggccgactcccaagtacgcacagcaaaaactattcttaaacttattaagcttcttactattattatgaatatttttatatactccagccagtttgatatgtcaaaccaattctgcaaaggagacccagcatggcgtat

SEQ ID NO: 405825 - DNA, 140 bp, Artificial Sequence
  Synthetic
aggccctggctgctgatatgtcataataatagtaagaagcttaataagtttaagaatagtttttgctgtgctttctataatgaatacagttaggcagagatactcaccattgtcattccagaccttttgggacagcggtg

SEQ ID NO: 405826 - DNA, 140 bp, Artificial Sequence
  Synthetic
caccgctgtcccaaaaggtctggaatgacaatggtgagtatctctgcctaactgtattcattatagaaagcacagcaaaaactattcttaaacttattaagcttcttactattattatgacatatcagcagccagggcct

SEQ ID NO: 405827 - DNA, 140 bp, Artificial Sequence
  Synthetic
atacgccatgctgggtctccaagaaggtggagaaaaaaacagagacagatcaaatcgattagtaactggcttcttaccactcatccaagacgacctacagagcctgagccttttcagttacgtacttgggagtcggccat

SEQ ID NO: 405828 - DNA, 140 bp, Artificial Sequence
  Synthetic
atggccgactcccaagtacgtaactgaaaaggctcaggctctgtaggtcgtcttggatgagtggtaagaagccagttactaatcgatttgatctgtctctgtttttttctccaccttcttggagacccagcatggcgtat

SEQ ID NO: 405829 - DNA, 140 bp, Artificial Sequence
  Synthetic
aggccctggctgctgatatgttcttaccactcatccaagacgacctacagagcctgagccttttcagttaccgccacttaagagactttctcttaattgtagcgaggattgtagaactttgaccttttgggacagcggtg

SEQ ID NO: 405830 - DNA, 140 bp, Artificial Sequence
  Synthetic
caccgctgtcccaaaaggtcaaagttctacaatcctcgctacaattaagagaaagtctcttaagtggcggtaactgaaaaggctcaggctctgtaggtcgtcttggatgagtggtaagaacatatcagcagccagggcct

SEQ ID NO: 405831 - DNA, 140 bp, Artificial Sequence
  Synthetic
atacgccatgctgggtctcctaatctttgatgaaccctcaggaggggatttagaaattacaacacatagttttaattgtggaggagaatttttctattgcaatacatcaaatctgtttaacgtacttgggagtcggccat

SEQ ID NO: 405832 - DNA, 140 bp, Artificial Sequence
  Synthetic
atggccgactcccaagtacgttaaacagatttgatgtattgcaatagaaaaattctcctccacaattaaaactatgtgttgtaatttctaaatcccctcctgagggttcatcaaagattaggagacccagcatggcgtat

SEQ ID NO: 405833 - DNA, 140 bp, Artificial Sequence
  Synthetic
aggccctggctgctgatatgtttaattgtggaggagaatttttctattgcaatacatcaaatctgtttaatagaacttggaatcataatggcacttggaatgcaccaggaccgtttaatggaccttttgggacagcggtg

SEQ ID NO: 405834 - DNA, 140 bp, Artificial Sequence
  Synthetic
caccgctgtcccaaaaggtccattaaacggtcctggtgcattccaagtgccattatgattccaagttctattaaacagatttgatgtattgcaatagaaaaattctcctccacaattaaacatatcagcagccagggcct

SEQ ID NO: 405835 - DNA, 140 bp, Artificial Sequence
  Synthetic
atacgccatgctgggtctccatagatggactgctataaaagaaagaataagacgagttaggcccgagccagcagcagaagaagtaagaccagcatctcgagacttaaagaaatataaagccgtacttgggagtcggccat

SEQ ID NO: 405836 - DNA, 140 bp, Artificial Sequence
  Synthetic
atggccgactcccaagtacggctttatatttctttaagtctcgagatgctggtcttacttcttctgctgctggctcgggcctaactcgtcttattctttcttttatagcagtccatctatggagacccagcatggcgtat

SEQ ID NO: 405837 - DNA, 140 bp, Artificial Sequence
  Synthetic
aggccctggctgctgatatgaacaacatattggggtctgcatacaggagaaagagactggcatttgggccagggagtctccatagaatggaggaaaaagagatatagcacacaagtagacgaccttttgggacagcggtg

SEQ ID NO: 405838 - DNA, 140 bp, Artificial Sequence
  Synthetic
caccgctgtcccaaaaggtcgtctacttgtgtgctatatctctttttcctccattctatggagactccctggcccaaatgccagtctctttctcctgtatgcagaccccaatatgttgttcatatcagcagccagggcct

SEQ ID NO: 405839 - DNA, 140 bp, Artificial Sequence
  Synthetic
atacgccatgctgggtctccagtgatgctagggatgatctcagaaattgctctttcaatatgaccacagaattaagagataagagaaagaatgtatatgcacttttttataaacttgatacgtacttgggagtcggccat

SEQ ID NO: 405840 - DNA, 140 bp, Artificial Sequence
  Synthetic
atggccgactcccaagtacgtatcaagtttataaaaaagtgcatatacattctttctcttatctcttaattctgtggtcatattgaaagagcaatttctgagatcatccctagcatcactggagacccagcatggcgtat

SEQ ID NO: 405841 - DNA, 140 bp, Artificial Sequence
  Synthetic
aggccctggctgctgatatgtatagattaataaattgtaatacctcagccataacacaagcctgtccaaaggtctcttttgacccaattcctatacattattgtgctccagctggttatggaccttttgggacagcggtg

SEQ ID NO: 405842 - DNA, 140 bp, Artificial Sequence
  Synthetic
caccgctgtcccaaaaggtccataaccagctggagcacaataatgtataggaattgggtcaaaagagacctttggacaggcttgtgttatggctgaggtattacaatttattaatctatacatatcagcagccagggcct

SEQ ID NO: 405843 - DNA, 140 bp, Artificial Sequence
  Synthetic
aggccctggctgctgatatgaatgtcagcacagtacaatgtacacatggaattaagccagtggtatcaactcaactactgttaaatggtagcctagcagaaggagagataataattagatgaccttttgggacagcggtg

SEQ ID NO: 405844 - DNA, 140 bp, Artificial Sequence
  Synthetic
caccgctgtcccaaaaggtcatctaattattatctctccttctgctaggctaccatttaacagtagttgagttgataccactggcttaattccatgtgtacattgtactgtgctgacattcatatcagcagccagggcct

SEQ ID NO: 405845 - DNA, 140 bp, Artificial Sequence
  Synthetic
aggccctggctgctgatatgaaggccagggggaaagaaacactatatgctaaaacacctagtatgggcaagcagggagctggaaagatttgcacttaaccctggccttttagagacatcagaccttttgggacagcggtg

SEQ ID NO: 405846 - DNA, 140 bp, Artificial Sequence
  Synthetic
caccgctgtcccaaaaggtctgatgtctctaaaaggccagggttaagtgcaaatctttccagctccctgcttgcccatactaggtgttttagcatatagtgtttctttccccctggccttcatatcagcagccagggcct

SEQ ID NO: 405847 - DNA, 140 bp, Artificial Sequence
  Synthetic
aggccctggctgctgatatggcagggagctggaaagatttgcacttaaccctggccttttagagacatcagaaggctgtaaacaaataataaaacagctacaaccagctcttcagacagggaccttttgggacagcggtg

SEQ ID NO: 405848 - DNA, 140 bp, Artificial Sequence
  Synthetic
caccgctgtcccaaaaggtccctgtctgaagagctggttgtagctgttttattatttgtttacagccttctgatgtctctaaaaggccagggttaagtgcaaatctttccagctccctgccatatcagcagccagggcct

SEQ ID NO: 405849 - DNA, 140 bp, Artificial Sequence
  Synthetic
atacgccatgctgggtctcccagcagcaagaggagtaggagcagcatctcaagatttagatagacatggagcaatcacaagcagtaatacagcagctactaatgctgcttgtgcctggctcgtacttgggagtcggccat

SEQ ID NO: 405850 - DNA, 140 bp, Artificial Sequence
  Synthetic
atggccgactcccaagtacgagccaggcacaagcagcattagtagctgctgtattactgcttgtgattgctccatgtctatctaaatcttgagatgctgctcctactcctcttgctgctgggagacccagcatggcgtat

SEQ ID NO: 405851 - DNA, 140 bp, Artificial Sequence
  Synthetic
aggccctggctgctgatatgggacacatagttattcctaggtgtgactatcaagcaggacataataataaggtaggatctctacaatacttggcactgacagcattgataaaaccaaaaagaccttttgggacagcggtg

SEQ ID NO: 405852 - DNA, 140 bp, Artificial Sequence
  Synthetic
caccgctgtcccaaaaggtctttttggttttatcaatgctgtcagtgccaagtattgtagagatcctaccttattattatgtcctgcttgatagtcacacctaggaataactatgtgtcccatatcagcagccagggcct

SEQ ID NO: 405853 - DNA, 140 bp, Artificial Sequence
  Synthetic
atacgccatgctgggtctccaataccactgaaaatagttgggaaaagatggagccaggagaaataaaaaattgctctttcaatttcaccacaagcatgagaactaaggtgcagacacaaccgtacttgggagtcggccat

SEQ ID NO: 405854 - DNA, 140 bp, Artificial Sequence
  Synthetic
atggccgactcccaagtacggttgtgtctgcaccttagttctcatgcttgtggtgaaattgaaagagcaattttttatttctcctggctccatcttttcccaactattttcagtggtattggagacccagcatggcgtat

SEQ ID NO: 405855 - DNA, 140 bp, Artificial Sequence
  Synthetic
atacgccatgctgggtctccagttaatagggactcgaaagcgaaagttccagagaagatctctcgacgcagggactcggcttgctgaggtgcacacagcaagaggcgagagcggcgactgcgtacttgggagtcggccat

SEQ ID NO: 405856 - DNA, 140 bp, Artificial Sequence
  Synthetic
atggccgactcccaagtacgcagtcgccgctctcgcctcttgctgtgtgcacctcagcaagccgagtccctgcgtcgagagatcttctctggaactttcgctttcgagtccctattaactggagacccagcatggcgtat

SEQ ID NO: 405857 - DNA, 140 bp, Artificial Sequence
  Synthetic
aggccctggctgctgatatggggactcggcttgctgaggtgcacacagcaagaggcgagagcggcgactggtgagtacgccaaattttgactagcggaggctagaaggagagagatgggtgaccttttgggacagcggtg

SEQ ID NO: 405858 - DNA, 140 bp, Artificial Sequence
  Synthetic
caccgctgtcccaaaaggtcacccatctctctccttctagcctccgctagtcaaaatttggcgtactcaccagtcgccgctctcgcctcttgctgtgtgcacctcagcaagccgagtccccatatcagcagccagggcct

SEQ ID NO: 405859 - DNA, 140 bp, Artificial Sequence
  Synthetic
aggccctggctgctgatatgtaagaatactgcaacaactactgtttattcatttcagaattgggtgccagcatagcagaataggcattttgcgacagagaagagcaagaaatggagccaggaccttttgggacagcggtg

SEQ ID NO: 405860 - DNA, 140 bp, Artificial Sequence
  Synthetic
caccgctgtcccaaaaggtcctggctccatttcttgctcttctctgtcgcaaaatgcctattctgctatgctggcacccaattctgaaatgaataaacagtagttgttgcagtattcttacatatcagcagccagggcct

SEQ ID NO: 405861 - DNA, 140 bp, Artificial Sequence
  Synthetic
aggccctggctgctgatatggacaggatcagaagaacttaaatcattatataatacaatagcaaccctttggtgcgtacatcaaaggatagacataaaagacaccaaggaagccttagatgaccttttgggacagcggtg

SEQ ID NO: 405862 - DNA, 140 bp, Artificial Sequence
  Synthetic
caccgctgtcccaaaaggtcatctaaggcttccttggtgtcttttatgtctatcctttgatgtacgcaccaaagggttgctattgtattatataatgatttaagttcttctgatcctgtccatatcagcagccagggcct

SEQ ID NO: 405863 - DNA, 140 bp, Artificial Sequence
  Synthetic
aggccctggctgctgatatgctttcagacaaaaggcttaggcatttactatggcaggaagaagcggagacagcgacgaagcgctccttcaagcagtaaggatcatcaaaatcctatatcagaccttttgggacagcggtg

SEQ ID NO: 405864 - DNA, 140 bp, Artificial Sequence
  Synthetic
caccgctgtcccaaaaggtctgatataggattttgatgatccttactgcttgaaggagcgcttcgtcgctgtctccgcttcttcctgccatagtaaatgcctaagccttttgtctgaaagcatatcagcagccagggcct

SEQ ID NO: 405865 - DNA, 140 bp, Artificial Sequence
  Synthetic
aggccctggctgctgatatgcacaatagtttttaaaaattcctcaggaggggacccagaaattgcaatgcacagttttaattgtggaggggaatttttctactgtaatacaacaaaactggaccttttgggacagcggtg

SEQ ID NO: 405866 - DNA, 140 bp, Artificial Sequence
  Synthetic
caccgctgtcccaaaaggtccagttttgttgtattacagtagaaaaattcccctccacaattaaaactgtgcattgcaatttctgggtcccctcctgaggaatttttaaaaactattgtgcatatcagcagccagggcct

SEQ ID NO: 405867 - DNA, 140 bp, Artificial Sequence
  Synthetic
aggccctggctgctgatatgaagaaaaatagactggttaattgaaagaattagggaaagagcagaagacagtggcaatgagagtgagggggatactgaggaattggcaacaatggtggatgaccttttgggacagcggtg

SEQ ID NO: 405868 - DNA, 140 bp, Artificial Sequence
  Synthetic
caccgctgtcccaaaaggtcatccaccattgttgccaattcctcagtatccccctcactctcattgccactgtcttctgctctttccctaattctttcaattaaccagtctatttttcttcatatcagcagccagggcct

SEQ ID NO: 405869 - DNA, 140 bp, Artificial Sequence
  Synthetic
atacgccatgctgggtctccatgttaccagtagtagtaatgttaccagtaatagtaatgataccagtattcaggacatgagaaattgctctttcaatgcaagcacagaaacattagataacgtacttgggagtcggccat

SEQ ID NO: 405870 - DNA, 140 bp, Artificial Sequence
  Synthetic
atggccgactcccaagtacgttatctaatgtttctgtgcttgcattgaaagagcaatttctcatgtcctgaatactggtatcattactattactggtaacattactactactggtaacatggagacccagcatggcgtat

SEQ ID NO: 405871 - DNA, 140 bp, Artificial Sequence
  Synthetic
aggccctggctgctgatatgtaggagccaaagaaagactgttaagtgtttcaattgtggcaaagaagggcacatagccagaaattgcagggcccctaggaaaaagggctgttggaaatgtgaccttttgggacagcggtg

SEQ ID NO: 405872 - DNA, 140 bp, Artificial Sequence
  Synthetic
caccgctgtcccaaaaggtcacatttccaacagccctttttcctaggggccctgcaatttctggctatgtgcccttctttgccacaattgaaacacttaacagtctttctttggctcctacatatcagcagccagggcct

SEQ ID NO: 405873 - DNA, 140 bp, Artificial Sequence
  Synthetic
aggccctggctgctgatatgcactctttggcaacgacccttagtcacagtaagaatagggggacagctaatagaagccctattagacacaggagcagatgatacagtattagaagaaatagaccttttgggacagcggtg

SEQ ID NO: 405874 - DNA, 140 bp, Artificial Sequence
  Synthetic
caccgctgtcccaaaaggtctatttcttctaatactgtatcatctgctcctgtgtctaatagggcttctattagctgtccccctattcttactgtgactaagggtcgttgccaaagagtgcatatcagcagccagggcct

SEQ ID NO: 405875 - DNA, 140 bp, Artificial Sequence
  Synthetic
atacgccatgctgggtctcccacttccctaatagaacaataaaatttgcaaaaccctcaggaggggacccagaagttacaatgcatacctttaattgtagaggagaatttttctattgcacgtacttgggagtcggccat

SEQ ID NO: 405876 - DNA, 140 bp, Artificial Sequence
  Synthetic
atggccgactcccaagtacgtgcaatagaaaaattctcctctacaattaaaggtatgcattgtaacttctgggtcccctcctgagggttttgcaaattttattgttctattagggaagtgggagacccagcatggcgtat

SEQ ID NO: 405877 - DNA, 140 bp, Artificial Sequence
  Synthetic
aggccctggctgctgatatgacacagaggaattggcaacccttgtggacatgggggactttgatccttgggttggtgataatttgtagtgcctcaaataacttgtgggtcacagtctattgaccttttgggacagcggtg

SEQ ID NO: 405878 - DNA, 140 bp, Artificial Sequence
  Synthetic
caccgctgtcccaaaaggtcaatagactgtgacccacaagttatttgaggcactacaaattatcaccaacccaaggatcaaagtcccccatgtccacaagggttgccaattcctctgtgtcatatcagcagccagggcct

SEQ ID NO: 405879 - DNA, 140 bp, Artificial Sequence
  Synthetic
atacgccatgctgggtctccgtggcgcccgaacagggacttgaaagcgaaagtaaaaccagaggagatctctcgacgcaggactcggcttgctgaagaagaagcgcgcgcggcaagaggccgtacttgggagtcggccat

SEQ ID NO: 405880 - DNA, 140 bp, Artificial Sequence
  Synthetic
atggccgactcccaagtacggcctcttgccgcgcgcgcttcttcttcagcaagccgagtcctgcgtcgagagatctcctctggttttactttcgctttcaagtccctgttcgggcgccacggagacccagcatggcgtat

SEQ ID NO: 405881 - DNA, 140 bp, Artificial Sequence
  Synthetic
aggccctggctgctgatatgggcaattagattgtacacatttagaaggaaaaattatcctggtagcagtccatgtagccagtggctatatagaagcagaagttatcccagcagaaacagggaccttttgggacagcggtg

SEQ ID NO: 405882 - DNA, 140 bp, Artificial Sequence
  Synthetic
caccgctgtcccaaaaggtccctgtttctgctgggataacttctgcttctatatagccactggctacatggactgctaccaggataatttttccttctaaatgtgtacaatctaattgcccatatcagcagccagggcct

SEQ ID NO: 405883 - DNA, 140 bp, Artificial Sequence
  Synthetic
atacgccatgctgggtctcccactggtaataataccactattagcaacggagaaatgaaaaattgctctttcaatatcaccacaaacatgagcaataaggtaaagaaagaatatgcacttcgtacttgggagtcggccat

SEQ ID NO: 405884 - DNA, 140 bp, Artificial Sequence
  Synthetic
atggccgactcccaagtacgaagtgcatattctttctttaccttattgctcatgtttgtggtgatattgaaagagcaatttttcatttctccgttgctaatagtggtattattaccagtgggagacccagcatggcgtat

SEQ ID NO: 405885 - DNA, 140 bp, Artificial Sequence
  Synthetic
aggccctggctgctgatatgattagatctgagaatttcacagacaatgctaaaaacataatagtacagctgaataaaactgtagtaattaattgtacaagacccaacatcaatagaagaagaccttttgggacagcggtg

SEQ ID NO: 405886 - DNA, 140 bp, Artificial Sequence
  Synthetic
caccgctgtcccaaaaggtcttcttctattgatgttgggtcttgtacaattaattactacagttttattcagctgtactattatgtttttagcattgtctgtgaaattctcagatctaatcatatcagcagccagggcct

SEQ ID NO: 405887 - DNA, 140 bp, Artificial Sequence
  Synthetic
atacgccatgctgggtctccgcaagaaatacaaaattgctctttcaatgcaaccacagaaataagagataggaagcagagagtgtatgcacttttttatagacttgatatagtaccacttcgtacttgggagtcggccat

SEQ ID NO: 405888 - DNA, 140 bp, Artificial Sequence
  Synthetic
atggccgactcccaagtacgaagtggtactatatcaagtctataaaaaagtgcatacactctctgcttcctatctcttatttctgtggttgcattgaaagagcaattttgtatttcttgcggagacccagcatggcgtat

SEQ ID NO: 405889 - DNA, 140 bp, Artificial Sequence
  Synthetic
atacgccatgctgggtctccaaacaatagtctttaagcaatcctcaggaggagatctagaaatcacaatgcacagttttaattgtggaggggaatttttctactgcaatacaacaaaattcgtacttgggagtcggccat

SEQ ID NO: 405890 - DNA, 140 bp, Artificial Sequence
  Synthetic
atggccgactcccaagtacgaattttgttgtattgcagtagaaaaattcccctccacaattaaaactgtgcattgtgatttctagatctcctcctgaggattgcttaaagactattgtttggagacccagcatggcgtat

SEQ ID NO: 405891 - DNA, 140 bp, Artificial Sequence
  Synthetic
aggccctggctgctgatatgaggaaaataaggaaacagaagaaaatagacaagttacttgatagaataagagaaagagcagaagatagtggcaatgagagtgatggggatacagaggaatgaccttttgggacagcggtg

SEQ ID NO: 405892 - DNA, 140 bp, Artificial Sequence
  Synthetic
caccgctgtcccaaaaggtcattcctctgtatccccatcactctcattgccactatcttctgctctttctcttattctatcaagtaacttgtctattttcttctgtttccttattttcctcatatcagcagccagggcct

SEQ ID NO: 405893 - DNA, 140 bp, Artificial Sequence
  Synthetic
aggccctggctgctgatatggagccctggaaccatccaggaagtcagcctcaaactgcttgtaacaattgttattgtaaaaagtgctgctatcattgccaaatgtgctttttaaagaaaggaccttttgggacagcggtg

SEQ ID NO: 405894 - DNA, 140 bp, Artificial Sequence
  Synthetic
caccgctgtcccaaaaggtcctttctttaaaaagcacatttggcaatgatagcagcactttttacaataacaattgttacaagcagtttgaggctgacttcctggatggttccagggctccatatcagcagccagggcct

SEQ ID NO: 405895 - DNA, 140 bp, Artificial Sequence
  Synthetic
aggccctggctgctgatatgaacatgacttggatgcagtgggaaaaagaaatagacaattacacaggcataatatacagactaattgaaaaatcgcaaaaccagcaagaaaagaatgaacgaccttttgggacagcggtg

SEQ ID NO: 405896 - DNA, 140 bp, Artificial Sequence
  Synthetic
caccgctgtcccaaaaggtcgttcattcttttcttgctggttttgcgatttttcaattagtctgtatattatgcctgtgtaattgtctatttctttttcccactgcatccaagtcatgttcatatcagcagccagggcct

SEQ ID NO: 405897 - DNA, 140 bp, Artificial Sequence
  Synthetic
aggccctggctgctgatatgtacaatgcacacatggaatcaagccagtagtatcaactcaactactgttaaatggcagtctagcagaagaagaggtagtgattagatctgaaaatatcacgaccttttgggacagcggtg

SEQ ID NO: 405898 - DNA, 140 bp, Artificial Sequence
  Synthetic
caccgctgtcccaaaaggtcgtgatattttcagatctaatcactacctcttcttctgctagactgccatttaacagtagttgagttgatactactggcttgattccatgtgtgcattgtacatatcagcagccagggcct

SEQ ID NO: 405899 - DNA, 140 bp, Artificial Sequence
  Synthetic
aggccctggctgctgatatgttaggcagggatactcaccattgtcattccagacccgcctcccaacccagaggggacccgacaggcccgaaggaatcgaagaagaaggtggagagagagagaccttttgggacagcggtg

SEQ ID NO: 405900 - DNA, 140 bp, Artificial Sequence
  Synthetic
caccgctgtcccaaaaggtctctctctctccaccttcttcttcgattccttcgggcctgtcgggtcccctctgggttgggaggcgggtctggaatgacaatggtgagtatccctgcctaacatatcagcagccagggcct

SEQ ID NO: 405901 - DNA, 140 bp, Artificial Sequence
  Synthetic
atacgccatgctgggtctccgtggcgcccgaacagggactcgaaagtgaaagttaatagggactcgaaagcggaaggttccagagaagttctctcgacgcaggactcggcttgctgaggtcgtacttgggagtcggccat

SEQ ID NO: 405902 - DNA, 140 bp, Artificial Sequence
  Synthetic
atggccgactcccaagtacgacctcagcaagccgagtcctgcgtcgagagaacttctctggaaccttccgctttcgagtccctattaactttcactttcgagtccctgttcgggcgccacggagacccagcatggcgtat

SEQ ID NO: 405903 - DNA, 140 bp, Artificial Sequence
  Synthetic
aggccctggctgctgatatgaggccagggggaaagaaaaaatatagattaaaacatatagtatgggcaagcagggagctagagcgatttgcagttaatcctggcctattagaaacatcaggaccttttgggacagcggtg

SEQ ID NO: 405904 - DNA, 140 bp, Artificial Sequence
  Synthetic
caccgctgtcccaaaaggtcctgatgtttctaataggccaggattaactgcaaatcgctctagctccctgcttgcccatactatatgttttaatctatattttttctttccccctggcctcatatcagcagccagggcct

SEQ ID NO: 405905 - DNA, 140 bp, Artificial Sequence
  Synthetic
aggccctggctgctgatatgtgcagaataaagcaaattgtaaatatgtggcagaaagtaggacgagcaatgtatgcccctcccatcccaggagaaataaggtgtgaatcaaacattacaggaccttttgggacagcggtg

SEQ ID NO: 405906 - DNA, 140 bp, Artificial Sequence
  Synthetic
caccgctgtcccaaaaggtcctgtaatgtttgattcacaccttatttctcctgggatgggaggggcatacattgctcgtcctactttctgccacatatttacaatttgctttattctgcacatatcagcagccagggcct

SEQ ID NO: 405907 - DNA, 140 bp, Artificial Sequence
  Synthetic
atacgccatgctgggtctccccacatacctagaagaataagacagggctttgaaagggctttgatataagatgggtaacaagtggtcaaaaagtaaggctgggtggtctgatataagggacgtacttgggagtcggccat

SEQ ID NO: 405908 - DNA, 140 bp, Artificial Sequence
  Synthetic
atggccgactcccaagtacgtcccttatatcagaccacccagccttactttttgaccacttgttacccatcttatatcaaagccctttcaaagccctgtcttattcttctaggtatgtggggagacccagcatggcgtat

SEQ ID NO: 405909 - DNA, 140 bp, Artificial Sequence
  Synthetic
atacgccatgctgggtctccgggtgggagcagcatctcgagacctagacagatatggagcactcacaactagcaatacagcagccaacaatgctgattgcgcctggctagaagcacaagacgtacttgggagtcggccat

SEQ ID NO: 405910 - DNA, 140 bp, Artificial Sequence
  Synthetic
atggccgactcccaagtacgtcttgtgcttctagccaggcgcaatcagcattgttggctgctgtattgctagttgtgagtgctccatatctgtctaggtctcgagatgctgctcccacccggagacccagcatggcgtat

SEQ ID NO: 405911 - DNA, 140 bp, Artificial Sequence
  Synthetic
aggccctggctgctgatatgatcagatgcatgaggatataattagtttatgggatcaaagtctaaagccatgtgtaaagctgaccccactctgtgtcactttaacctgtacaaactgtacgaccttttgggacagcggtg

SEQ ID NO: 405912 - DNA, 140 bp, Artificial Sequence
  Synthetic
caccgctgtcccaaaaggtcgtacagtttgtacaggttaaagtgacacagagtggggtcagctttacacatggctttagactttgatcccataaactaattatatcctcatgcatctgatcatatcagcagccagggcct

SEQ ID NO: 405913 - DNA, 140 bp, Artificial Sequence
  Synthetic
  misc_feature (26)..(26): n is a, c, g, or t
  misc_feature (31)..(31): n is a, c, g, or t
  misc_feature (33)..(33): n is a, c, g, or t
atacgccatgctgggtctccatgaantgaananctgctctttcaatataaccacagtactaagagataaaaagcagacaggaaatgcacttttttataaccttgatatagtaccacttaacgtacttgggagtcggccat

SEQ ID NO: 405914 - DNA, 140 bp, Artificial Sequence
  Synthetic
  misc_feature (108)..(108): n is a, c, g, or t
  misc_feature (110)..(110): n is a, c, g, or t
  misc_feature (115)..(115): n is a, c, g, or t
atggccgactcccaagtacgttaagtggtactatatcaaggttataaaaaagtgcatttcctgtctgctttttatctcttagtactgtggttatattgaaagagcagntnttcanttcatggagacccagcatggcgtat

SEQ ID NO: 405915 - DNA, 140 bp, Artificial Sequence
  Synthetic
atacgccatgctgggtctccaaataaaaaactgctctttcaatgtcaccacaaccataaaaaataagagacagagagaatttgcactgttgagtaaacttgatatagtaccaatagataacgtacttgggagtcggccat

SEQ ID NO: 405916 - DNA, 140 bp, Artificial Sequence
  Synthetic
atggccgactcccaagtacgttatctattggtactatatcaagtttactcaacagtgcaaattctctctgtctcttattttttatggttgtggtgacattgaaagagcagttttttatttggagacccagcatggcgtat

SEQ ID NO: 405917 - DNA, 140 bp, Artificial Sequence
  Synthetic
aggccctggctgctgatatgatagccagaaattgcagggcccctaggaaaaagggctgttggaaatgtggacaggaaggacatcaaatgaaagattgtactgaaagacaggctaatttttgaccttttgggacagcggtg

SEQ ID NO: 405918 - DNA, 140 bp, Artificial Sequence
  Synthetic
caccgctgtcccaaaaggtcaaaaattagcctgtctttcagtacaatctttcatttgatgtccttcctgtccacatttccaacagccctttttcctaggggccctgcaatttctggctatcatatcagcagccagggcct

SEQ ID NO: 405919 - DNA, 140 bp, Artificial Sequence
  Synthetic
aggccctggctgctgatatgcctgggacgacctgcggagcctgtgccttttcagctaccaccgattgagagacttcatattggtgacagcgagagcagtggaacttctgggacgcagcaggaccttttgggacagcggtg

SEQ ID NO: 405920 - DNA, 140 bp, Artificial Sequence
  Synthetic
caccgctgtcccaaaaggtcctgctgcgtcccagaagttccactgctctcgctgtcaccaatatgaagtctctcaatcggtggtagctgaaaaggcacaggctccgcaggtcgtcccaggcatatcagcagccagggcct

SEQ ID NO: 405921 - DNA, 140 bp, Artificial Sequence
  Synthetic
aggccctggctgctgatatgcatacaaagaatttgtgaagctattcgcaacgtacctagaaggataagacagggctttgaagcagctttgctataaatggggggcaagtggtcaaagagcgaccttttgggacagcggtg

SEQ ID NO: 405922 - DNA, 140 bp, Artificial Sequence
  Synthetic
caccgctgtcccaaaaggtcgctctttgaccacttgccccccatttatagcaaagctgcttcaaagccctgtcttatccttctaggtacgttgcgaatagcttcacaaattctttgtatgcatatcagcagccagggcct

SEQ ID NO: 405923 - DNA, 140 bp, Artificial Sequence
  Synthetic
atacgccatgctgggtctccagatgctccagcaacaggagtaggagcagcatctcaagacttagctagacatggggcacttacaaccagcaacacagccaccaacaatgctgattgtgcccgtacttgggagtcggccat

SEQ ID NO: 405924 - DNA, 140 bp, Artificial Sequence
  Synthetic
atggccgactcccaagtacgggcacaatcagcattgttggtggctgtgttgctggttgtaagtgccccatgtctagctaagtcttgagatgctgctcctactcctgttgctggagcatctggagacccagcatggcgtat

SEQ ID NO: 405925 - DNA, 140 bp, Artificial Sequence
  Synthetic
aggccctggctgctgatatggcagtaaagatcatcaagatcctgtatcaaagcagtaagtaacatatagtaggggtaatgatagatttagtagcaaaattagattatagattaggaataggaccttttgggacagcggtg

SEQ ID NO: 405926 - DNA, 140 bp, Artificial Sequence
  Synthetic
caccgctgtcccaaaaggtcctattcctaatctataatctaattttgctactaaatctatcattacccctactatatgttacttactgctttgatacaggatcttgatgatctttactgccatatcagcagccagggcct

SEQ ID NO: 405927 - DNA, 140 bp, Artificial Sequence
  Synthetic
atacgccatgctgggtctcctaatattactggtgacatgagtggagaaatgaagaattgctctttcaatataaccacagaaataagagataggaaaaagcaagtgtatgcacttttttatcgtacttgggagtcggccat

SEQ ID NO: 405928 - DNA, 140 bp, Artificial Sequence
  Synthetic
atggccgactcccaagtacgataaaaaagtgcatacacttgctttttcctatctcttatttctgtggttatattgaaagagcaattcttcatttctccactcatgtcaccagtaatattaggagacccagcatggcgtat

SEQ ID NO: 405929 - DNA, 140 bp, Artificial Sequence
  Synthetic
aggccctggctgctgatatgctcctaagagcagtaagaatcatcaagatcctataccagagcagtaagtaaaagctgtatatatgctggagtggggattcgcagcgttgggagtggcaatgaccttttgggacagcggtg

SEQ ID NO: 405930 - DNA, 140 bp, Artificial Sequence
  Synthetic
caccgctgtcccaaaaggtcattgccactcccaacgctgcgaatccccactccagcatatatacagcttttacttactgctctggtataggatcttgatgattcttactgctcttaggagcatatcagcagccagggcct

SEQ ID NO: 405931 - DNA, 140 bp, Artificial Sequence
  Synthetic
aggccctggctgctgatatgaagaaagctaggggatgggtttatagacatcactatcaaagcatgaatccaagaataagttcagaggtacacattccactaggggaagctagactggaaagaccttttgggacagcggtg

SEQ ID NO: 405932 - DNA, 140 bp, Artificial Sequence
  Synthetic
caccgctgtcccaaaaggtctttccagtctagcttcccctagtggaatgtgtacctctgaacttattcttggattcatgctttgatagtgatgtctataaacccatcccctagctttcttcatatcagcagccagggcct

SEQ ID NO: 405933 - DNA, 140 bp, Artificial Sequence
  Synthetic
aggccctggctgctgatatgcaggatcagaagtaaatatagtaacagactcacagtatgcattaggaatcattcaggcacaaccagacaggagtgaatcagagttagtcaatcaaataatgaccttttgggacagcggtg

SEQ ID NO: 405934 - DNA, 140 bp, Artificial Sequence
  Synthetic
caccgctgtcccaaaaggtcattatttgattgactaactctgattcactcctgtctggttgtgcctgaatgattcctaatgcatactgtgagtctgttactatatttacttctgatcctgcatatcagcagccagggcct

SEQ ID NO: 405935 - DNA, 140 bp, Artificial Sequence
  Synthetic
aggccctggctgctgatatggcaaaaccagcaggaaaaaaatgaaaaagatttattagcattggacagttggaaaaatctgtggagttggtttaccataacaaattggctgtggtatatagaccttttgggacagcggtg

SEQ ID NO: 405936 - DNA, 140 bp, Artificial Sequence
  Synthetic
caccgctgtcccaaaaggtctatataccacagccaatttgttatggtaaaccaactccacagatttttccaactgtccaatgctaataaatctttttcatttttttcctgctggttttgccatatcagcagccagggcct

SEQ ID NO: 405937 - DNA, 140 bp, Artificial Sequence
  Synthetic
aggccctggctgctgatatgaatggtggatatggggcatcttaggcttttggatgttaatgatttgtaatgtgggaggaaacttgtgggtcacagtctattatggggtacctgtgtggaagaccttttgggacagcggtg

SEQ ID NO: 405938 - DNA, 140 bp, Artificial Sequence
  Synthetic
caccgctgtcccaaaaggtcttccacacaggtaccccataatagactgtgacccacaagtttcctcccacattacaaatcattaacatccaaaagcctaagatgccccatatccaccattcatatcagcagccagggcct

SEQ ID NO: 405939 - DNA, 140 bp, Artificial Sequence
  Synthetic
  misc_feature (43)..(43): n is a, c, g, or t
aggccctggctgctgatatgaccccactctgtgttactttagngtgcactgaattacggactaatggtactaataccacttattccaataatgaggaaatgaaaggagaaataaaaaactgaccttttgggacagcggtg

SEQ ID NO: 405940 - DNA, 140 bp, Artificial Sequence
  Synthetic
  misc_feature (98)..(98): n is a, c, g, or t
caccgctgtcccaaaaggtcagttttttatttctcctttcatttcctcattattggaataagtggtattagtaccattagtccgtaattcagtgcacnctaaagtaacacagagtggggtcatatcagcagccagggcct

SEQ ID NO: 405941 - DNA, 140 bp, Artificial Sequence
  Synthetic
atacgccatgctgggtctccgggggatgcaaatgttacccacaatgagggtgcaaatgaaataaaaaattgctctttcaagatagccacagaattaagagataaggagcagaaagtgtatcgtacttgggagtcggccat

SEQ ID NO: 405942 - DNA, 140 bp, Artificial Sequence
  Synthetic
atggccgactcccaagtacgatacactttctgctccttatctcttaattctgtggctatcttgaaagagcaattttttatttcatttgcaccctcattgtgggtaacatttgcatcccccggagacccagcatggcgtat

SEQ ID NO: 405943 - DNA, 140 bp, Artificial Sequence
  Synthetic
aggccctggctgctgatatgagaataataaacactgatccagcagcagagggagtaggagcagcgtctcaagacttagataaacatggggcacttacaatcaacaatacagccagcaatagaccttttgggacagcggtg

SEQ ID NO: 405944 - DNA, 140 bp, Artificial Sequence
  Synthetic
caccgctgtcccaaaaggtctattgctggctgtattgttgattgtaagtgccccatgtttatctaagtcttgagacgctgctcctactccctctgctgctggatcagtgtttattattctcatatcagcagccagggcct

SEQ ID NO: 405945 - DNA, 140 bp, Artificial Sequence
  Synthetic
aggccctggctgctgatatgcaaacattctatgcaacaggagagataataggagacataaggaaagcatattgtgagattaatgaacagaaatggaataaaacattacgagaggtagctagaccttttgggacagcggtg

SEQ ID NO: 405946 - DNA, 140 bp, Artificial Sequence
  Synthetic
caccgctgtcccaaaaggtctagctacctctcgtaatgttttattccatttctgttcattaatctcacaatatgctttccttatgtctcctattatctctcctgttgcatagaatgtttgcatatcagcagccagggcct

SEQ ID NO: 405947 - DNA, 140 bp, Artificial Sequence
  Synthetic
aggccctggctgctgatatggaaaaataacatggtagaacagatgcatgaagatataattagtctatgggaccaaagcctaaagccatgtgtaaagttaacccctctctgtgttactttagaccttttgggacagcggtg

SEQ ID NO: 405948 - DNA, 140 bp, Artificial Sequence
  Synthetic
caccgctgtcccaaaaggtctaaagtaacacagagaggggttaactttacacatggctttaggctttggtcccatagactaattatatcttcatgcatctgttctaccatgttatttttccatatcagcagccagggcct

SEQ ID NO: 405949 - DNA, 140 bp, Artificial Sequence
  Synthetic
atacgccatgctgggtctccaccaaagcctaaagccatgtgtaaagttaacccctctctgtgttactttagattgtcataatgtcaacagcagcaatagcagcacctctaacagcagcaacgtacttgggagtcggccat

SEQ ID NO: 405950 - DNA, 140 bp, Artificial Sequence
  Synthetic
atggccgactcccaagtacgttgctgctgttagaggtgctgctattgctgctgttgacattatgacaatctaaagtaacacagagaggggttaactttacacatggctttaggctttggtggagacccagcatggcgtat

SEQ ID NO: 405951 - DNA, 140 bp, Artificial Sequence
  Synthetic
aggccctggctgctgatatgtaaaaaactgctctttcaatatgaccacagaactaagagataagaaacagaaagtgtctgcacttttttatagacttgatgtagtacaaattaatgaaaggaccttttgggacagcggtg

SEQ ID NO: 405952 - DNA, 140 bp, Artificial Sequence
  Synthetic
caccgctgtcccaaaaggtcctttcattaatttgtactacatcaagtctataaaaaagtgcagacactttctgtttcttatctcttagttctgtggtcatattgaaagagcagttttttacatatcagcagccagggcct

SEQ ID NO: 405953 - DNA, 140 bp, Artificial Sequence
  Synthetic
aggccctggctgctgatatgcaagaaaaagtgtacgtataggaccagggcaaacattctatgcaacaggtgacataataggggatataagacaagcacattgtaatgttagtagatcagagaccttttgggacagcggtg

SEQ ID NO: 405954 - DNA, 140 bp, Artificial Sequence
  Synthetic
caccgctgtcccaaaaggtctctgatctactaacattacaatgtgcttgtcttatatcccctattatgtcacctgttgcatagaatgtttgccctggtcctatacgtacactttttcttgcatatcagcagccagggcct

SEQ ID NO: 405955 - DNA, 140 bp, Artificial Sequence
  Synthetic
aggccctggctgctgatatggcatactttctgctaaaattagcaggaagatggccagtaaaagtaatacacacagacaatggtagcaatttcaccagcgctgcagttaaagcagcctgttgaccttttgggacagcggtg

SEQ ID NO: 405956 - DNA, 140 bp, Artificial Sequence
  Synthetic
caccgctgtcccaaaaggtcaacaggctgctttaactgcagcgctggtgaaattgctaccattgtctgtgtgtattacttttactggccatcttcctgctaattttagcagaaagtatgccatatcagcagccagggcct

SEQ ID NO: 405957 - DNA, 140 bp, Artificial Sequence
  Synthetic
atacgccatgctgggtctccaaaggatagaggtaaaagacaccaaggaagctttagataagatagaggaagaacaaaacaaaagtaagaaaaaggcacagcaagcagcagcagctgatgacgtacttgggagtcggccat

SEQ ID NO: 405958 - DNA, 140 bp, Artificial Sequence
  Synthetic
atggccgactcccaagtacgtcatcagctgctgctgcttgctgtgcctttttcttacttttgttttgttcttcctctatcttatctaaagcttccttggtgtcttttacctctatcctttggagacccagcatggcgtat

SEQ ID NO: 405959 - DNA, 140 bp, Artificial Sequence
  Synthetic
atacgccatgctgggtctccagtatagaagaaaggctttcagcccagaagtaatacccatgttttcagcattatcagaaggagccaccccacaagatttaaacaccatgctaaacacagtcgtacttgggagtcggccat

SEQ ID NO: 405960 - DNA, 140 bp, Artificial Sequence
  Synthetic
atggccgactcccaagtacgactgtgtttagcatggtgtttaaatcttgtggggtggctccttctgataatgctgaaaacatgggtattacttctgggctgaaagcctttcttctatactggagacccagcatggcgtat

SEQ ID NO: 405961 - DNA, 140 bp, Artificial Sequence
  Synthetic
atacgccatgctgggtctccggagtaataaaacttacaatgagatttgggacaatatgacctggatgcagtgggatagagaaattaataattacacagatacaatatataggttgcttgacgtacttgggagtcggccat

SEQ ID NO: 405962 - DNA, 140 bp, Artificial Sequence
  Synthetic
atggccgactcccaagtacgtcaagcaacctatatattgtatctgtgtaattattaatttctctatcccactgcatccaggtcatattgtcccaaatctcattgtaagttttattactccggagacccagcatggcgtat

SEQ ID NO: 405963 - DNA, 140 bp, Artificial Sequence
  Synthetic
aggccctggctgctgatatggaggaggtaggctttccagtcaggccacaggtacctttgagaccaatgacttataaggcagcattcgatctcggcttctttttaaaagaaaaggggggacgaccttttgggacagcggtg

SEQ ID NO: 405964 - DNA, 140 bp, Artificial Sequence
  Synthetic
caccgctgtcccaaaaggtcgtccccccttttcttttaaaaagaagccgagatcgaatgctgccttataagtcattggtctcaaaggtacctgtggcctgactggaaagcctacctcctccatatcagcagccagggcct

SEQ ID NO: 405965 - DNA, 140 bp, Artificial Sequence
  Synthetic
aggccctggctgctgatatgagagacaggctaattttttagggaaaatttggccttcccacaagggaaggccagggaattttcctcagagcagaccagagccatcagccccaccagcagagaccttttgggacagcggtg

SEQ ID NO: 405966 - DNA, 140 bp, Artificial Sequence
  Synthetic
caccgctgtcccaaaaggtctctgctggtggggctgatggctctggtctgctctgaggaaaattccctggccttcccttgtgggaaggccaaattttccctaaaaaattagcctgtctctcatatcagcagccagggcct

SEQ ID NO: 405967 - DNA, 140 bp, Artificial Sequence
  Synthetic
aggccctggctgctgatatgtgcagatgttaaaagataccatcaatgaggaagctgcagaatgggacagagtacatccagtacatgcagggcctattccaccaggccaaatgagggaaccgaccttttgggacagcggtg

SEQ ID NO: 405968 - DNA, 140 bp, Artificial Sequence
  Synthetic
caccgctgtcccaaaaggtcggttccctcatttggcctggtggaataggccctgcatgtactggatgtactctgtcccattctgcagcttcctcattgatggtatcttttaacatctgcacatatcagcagccagggcct

SEQ ID NO: 405969 - DNA, 140 bp, Artificial Sequence
  Synthetic
atacgccatgctgggtctccgggaaagaataagacgaacccctccagcagcagtaggagtaggagcagtatctcaagatttagataggcatggagcaattacaagcagcaatacagcagccgtacttgggagtcggccat

SEQ ID NO: 405970 - DNA, 140 bp, Artificial Sequence
  Synthetic
atggccgactcccaagtacggctgctgtattgctgcttgtaattgctccatgcctatctaaatcttgagatactgctcctactcctactgctgctggaggggttcgtcttattctttcccggagacccagcatggcgtat

SEQ ID NO: 405971 - DNA, 140 bp, Artificial Sequence
  Synthetic
atacgccatgctgggtctccgaagatgtaggctttccagtcagacctcaggtaccctgtaagaccaatgacctataaagcagcagttgattcagcttctttttaaaagaaaaagggggaccgtacttgggagtcggccat

SEQ ID NO: 405972 - DNA, 140 bp, Artificial Sequence
  Synthetic
atggccgactcccaagtacggtccccctttttcttttaaaaagaagctgaatcaactgctgctttataggtcattggtcttacagggtacctgaggtctgactggaaagcctacatcttcggagacccagcatggcgtat

SEQ ID NO: 405973 - DNA, 140 bp, Artificial Sequence
  Synthetic
atacgccatgctgggtctcctctgcaccactaatgtgccttggaactctagttggagtaataaatcacagagtgaaatctgggacaacatgacttggatggaatgggataaacaaattagcgtacttgggagtcggccat

SEQ ID NO: 405974 - DNA, 140 bp, Artificial Sequence
  Synthetic
atggccgactcccaagtacgctaatttgtttatcccattccatccaagtcatgttgtcccagatttcactctgtgatttattactccaactagagttccaaggcacattagtggtgcagaggagacccagcatggcgtat

SEQ ID NO: 405975 - DNA, 140 bp, Artificial Sequence
  Synthetic
aggccctggctgctgatatgatggggatacttggacaggagttgaagctataataagaatactgcaacaactactgtttattcatttcagaattgggtgccagcatagcagaataggcatgaccttttgggacagcggtg

SEQ ID NO: 405976 - DNA, 140 bp, Artificial Sequence
  Synthetic
caccgctgtcccaaaaggtcatgcctattctgctatgctggcacccaattctgaaatgaataaacagtagttgttgcagtattcttattatagcttcaactcctgtccaagtatccccatcatatcagcagccagggcct

SEQ ID NO: 405977 - DNA, 140 bp, Artificial Sequence
  Synthetic
atacgccatgctgggtctccacctatgtatccaataatgatatccacgttggtaacataactacagaaatgaaaaattgctctttcaatatgaccacagaactaagagataagaataagacgtacttgggagtcggccat

SEQ ID NO: 405978 - DNA, 140 bp, Artificial Sequence
  Synthetic
atggccgactcccaagtacgtcttattcttatctcttagttctgtggtcatattgaaagagcaatttttcatttctgtagttatgttaccaacgtggatatcattattggatacataggtggagacccagcatggcgtat

SEQ ID NO: 405979 - DNA, 140 bp, Artificial Sequence
  Synthetic
aggccctggctgctgatatgaagtctacctgtcatgggtaccagcacacaaagggattggaggaaatgaacaagtagataaattagtcagtaatggaatcaggaaggtactatttttagagaccttttgggacagcggtg

SEQ ID NO: 405980 - DNA, 140 bp, Artificial Sequence
  Synthetic
caccgctgtcccaaaaggtctctaaaaatagtaccttcctgattccattactgactaatttatctacttgttcatttcctccaatccctttgtgtgctggtacccatgacaggtagacttcatatcagcagccagggcct

SEQ ID NO: 405981 - DNA, 140 bp, Artificial Sequence
  Synthetic
aggccctggctgctgatatggtggcaaagaagggcacatagccagaaattgcagggcccctaggaaaaagggctgttggaaatgtggaaaggaaggacaccaaatgaaagattgtactgagaccttttgggacagcggtg

SEQ ID NO: 405982 - DNA, 140 bp, Artificial Sequence
  Synthetic
caccgctgtcccaaaaggtctcagtacaatctttcatttggtgtccttcctttccacatttccaacagccctttttcctaggggccctgcaatttctggctatgtgcccttctttgccaccatatcagcagccagggcct

SEQ ID NO: 405983 - DNA, 140 bp, Artificial Sequence
  Synthetic
aggccctggctgctgatatgagtgggataaagaaattagtaattacacagacacaatatacaggttgcttgaagtctcacaaaaccagcaggaacaaaatgaaaaggatttattagcattgaccttttgggacagcggtg

SEQ ID NO: 405984 - DNA, 140 bp, Artificial Sequence
  Synthetic
caccgctgtcccaaaaggtcaatgctaataaatccttttcattttgttcctgctggttttgtgagacttcaagcaacctgtatattgtgtctgtgtaattactaatttctttatcccactcatatcagcagccagggcct

SEQ ID NO: 405985 - DNA, 140 bp, Artificial Sequence
  Synthetic
atacgccatgctgggtctccgaatctcctatggcaggaagaagcggagacagcgacgaagagctcctcaaggccgtcagactcatcaaggctctctaccagagcagtaagtagtgcatgtcgtacttgggagtcggccat

SEQ ID NO: 405986 - DNA, 140 bp, Artificial Sequence
  Synthetic
atggccgactcccaagtacgacatgcactacttactgctctggtagagagccttgatgagtctgacggccttgaggagctcttcgtcgctgtctccgcttcttcctgccataggagattcggagacccagcatggcgtat

SEQ ID NO: 405987 - DNA, 140 bp, Artificial Sequence
  Synthetic
atacgccatgctgggtctcctaccagttgtctgggacgacctccggagcctgtcactcttcagctaccgcctcttgagagacttactcttaattgtagtgaggactgtggaacttctgggcgtacttgggagtcggccat

SEQ ID NO: 405988 - DNA, 140 bp, Artificial Sequence
  Synthetic
atggccgactcccaagtacgcccagaagttccacagtcctcactacaattaagagtaagtctctcaagaggcggtagctgaagagtgacaggctccggaggtcgtcccagacaactggtaggagacccagcatggcgtat

SEQ ID NO: 405989 - DNA, 140 bp, Artificial Sequence
  Synthetic
atacgccatgctgggtctcctaatgttagctcgaatagtgataacaatactaggggagaaataaggaattgcacttttaatatgaccacagagctaaaagataagaaaaagcaagtgtctcgtacttgggagtcggccat

SEQ ID NO: 405990 - DNA, 140 bp, Artificial Sequence
  Synthetic
atggccgactcccaagtacgagacacttgctttttcttatcttttagctctgtggtcatattaaaagtgcaattccttatttctcccctagtattgttatcactattcgagctaacattaggagacccagcatggcgtat

SEQ ID NO: 405991 - DNA, 140 bp, Artificial Sequence
  Synthetic
aggccctggctgctgatatgctgcttgtagcaagtgttactgtaaaatatgctgctggcattgtcaattgtgctttctgaacaagggcttaggcatctcctatggcaggaagaagcggaggaccttttgggacagcggtg

SEQ ID NO: 405992 - DNA, 140 bp, Artificial Sequence
  Synthetic
caccgctgtcccaaaaggtcctccgcttcttcctgccataggagatgcctaagcccttgttcagaaagcacaattgacaatgccagcagcatattttacagtaacacttgctacaagcagcatatcagcagccagggcct

SEQ ID NO: 405993 - DNA, 140 bp, Artificial Sequence
  Synthetic
atacgccatgctgggtctcccagccaaggaagacataatgaaaaactgctctttcaatatcaccacaggcgtgaaagatagggtgaaaaaagaatatgcaactttttatagccttgatatcgtacttgggagtcggccat

SEQ ID NO: 405994 - DNA, 140 bp, Artificial Sequence
  Synthetic
atggccgactcccaagtacgatatcaaggctataaaaagttgcatattcttttttcaccctatctttcacgcctgtggtgatattgaaagagcagtttttcattatgtcttccttggctgggagacccagcatggcgtat

SEQ ID NO: 405995 - DNA, 140 bp, Artificial Sequence
  Synthetic
aggccctggctgctgatatggtagaggatagatggaacaagccccagaagaccagggaccgcagagggaaccatacaatgaatggacactagagcttttagaggaactcaagcaggaagcgaccttttgggacagcggtg

SEQ ID NO: 405996 - DNA, 140 bp, Artificial Sequence
  Synthetic
caccgctgtcccaaaaggtcgcttcctgcttgagttcctctaaaagctctagtgtccattcattgtatggttccctctgcggtccctggtcttctggggcttgttccatctatcctctaccatatcagcagccagggcct

SEQ ID NO: 405997 - DNA, 140 bp, Artificial Sequence
  Synthetic
aggccctggctgctgatatgttgctaactcctcaggaggggatatagaaattacaacacatagttttaattgtggaggagaatttttctattgcaatacatcggaactgtttaatagcacgaccttttgggacagcggtg

SEQ ID NO: 405998 - DNA, 140 bp, Artificial Sequence
  Synthetic
caccgctgtcccaaaaggtcgtgctattaaacagttccgatgtattgcaatagaaaaattctcctccacaattaaaactatgtgttgtaatttctatatcccctcctgaggagttagcaacatatcagcagccagggcct

SEQ ID NO: 405999 - DNA, 140 bp, Artificial Sequence
  Synthetic
aggccctggctgctgatatgagcgctcctcctagcagtgagagccatcaagatcttatatcaaagcagtaagtatcaaataaatagatgtaatggtagacttcctagcaagagtagattagaccttttgggacagcggtg

SEQ ID NO: 406000 - DNA, 140 bp, Artificial Sequence
  Synthetic
caccgctgtcccaaaaggtctaatctactcttgctaggaagtctaccattacatctatttatttgatacttactgctttgatataagatcttgatggctctcactgctaggaggagcgctcatatcagcagccagggcct

SEQ ID NO: 406001 - DNA, 140 bp, Artificial Sequence
  Synthetic
aggccctggctgctgatatggcttagtgagcggattcttagctcttgtctgggacgatctacggagcctgtgcctcttcagctaccaccgcttgagagacttcatcttgattgcagcgaggaccttttgggacagcggtg

SEQ ID NO: 406002 - DNA, 140 bp, Artificial Sequence
  Synthetic
caccgctgtcccaaaaggtcctcgctgcaatcaagatgaagtctctcaagcggtggtagctgaagaggcacaggctccgtagatcgtcccagacaagagctaagaatccgctcactaagccatatcagcagccagggcct

SEQ ID NO: 406003 - DNA, 140 bp, Artificial Sequence
  Synthetic
atacgccatgctgggtctccgcgcagtggatggcctgctataagagaaagaatgagacgagctgagccagcagcagaaccagcagcagaaagagtaggagcagcgtctcaagacttagatcgtacttgggagtcggccat

SEQ ID NO: 406004 - DNA, 140 bp, Artificial Sequence
  Synthetic
atggccgactcccaagtacgatctaagtcttgagacgctgctcctactctttctgctgctggttctgctgctggctcagctcgtctcattctttctcttatagcaggccatccactgcgcggagacccagcatggcgtat

SEQ ID NO: 406005 - DNA, 140 bp, Artificial Sequence
  Synthetic
atacgccatgctgggtctccagttaatgctaatgctagtgctaccatagagagagaaatggagggagaaataaaaaattgctctttcaatgtaatcacagaaataagagacaagagacgacgtacttgggagtcggccat

SEQ ID NO: 406006 - DNA, 140 bp, Artificial Sequence
  Synthetic
atggccgactcccaagtacgtcgtctcttgtctcttatttctgtgattacattgaaagagcaattttttatttctccctccatttctctctctatggtagcactagcattagcattaactggagacccagcatggcgtat

SEQ ID NO: 406007 - DNA, 140 bp, Artificial Sequence
  Synthetic
atacgccatgctgggtctccggaactctagttggagtaataaaacttataatgacatatgggataacatgacctggctgcaatgggataaagaagttagcaattacacagacataatatacgtacttgggagtcggccat

SEQ ID NO: 406008 - DNA, 140 bp, Artificial Sequence
  Synthetic
atggccgactcccaagtacgtatattatgtctgtgtaattgctaacttctttatcccattgcagccaggtcatgttatcccatatgtcattataagttttattactccaactagagttccggagacccagcatggcgtat

SEQ ID NO: 406009 - DNA, 140 bp, Artificial Sequence
  Synthetic
aggccctggctgctgatatgacctggctgcaatgggataaagaagttagcaattacacagacataatatataatctaattgaagaatcgcagaaccagcaggaaaagaatgaacaagactgaccttttgggacagcggtg

SEQ ID NO: 406010 - DNA, 140 bp, Artificial Sequence
  Synthetic
caccgctgtcccaaaaggtcagtcttgttcattcttttcctgctggttctgcgattcttcaattagattatatattatgtctgtgtaattgctaacttctttatcccattgcagccaggtcatatcagcagccagggcct

SEQ ID NO: 406011 - DNA, 140 bp, Artificial Sequence
  Synthetic
aggccctggctgctgatatgaagttcagaagtacacatcccactaggggatgctaaattagtaataacaacatattggggtctgcatacaggagaaagagactggcatttgggtcagggagaccttttgggacagcggtg

SEQ ID NO: 406012 - DNA, 140 bp, Artificial Sequence
  Synthetic
caccgctgtcccaaaaggtctccctgacccaaatgccagtctctttctcctgtatgcagaccccaatatgttgttattactaatttagcatcccctagtgggatgtgtacttctgaacttcatatcagcagccagggcct

SEQ ID NO: 406013 - DNA, 140 bp, Artificial Sequence
  Synthetic
aggccctggctgctgatatggtacacatggaattaagccagtggtatcaactcaactactgttaaatggtagtctagctgagcaggaaataataattaaatctgaaaatataacaaacaagaccttttgggacagcggtg

SEQ ID NO: 406014 - DNA, 140 bp, Artificial Sequence
  Synthetic
caccgctgtcccaaaaggtcttgtttgttatattttcagatttaattattatttcctgctcagctagactaccatttaacagtagttgagttgataccactggcttaattccatgtgtaccatatcagcagccagggcct

SEQ ID NO: 406015 - DNA, 140 bp, Artificial Sequence
  Synthetic
aggccctggctgctgatatgccagctcttcagacagggacagaggaacttaggtcattatacaacacagtagcaactctctattgtgtacatgcagatatagaggtacgagacaccaagggaccttttgggacagcggtg

SEQ ID NO: 406016 - DNA, 140 bp, Artificial Sequence
  Synthetic
caccgctgtcccaaaaggtcccttggtgtctcgtacctctatatctgcatgtacacaatagagagttgctactgtgttgtataatgacctaagttcctctgtccctgtctgaagagctggcatatcagcagccagggcct

SEQ ID NO: 406017 - DNA, 140 bp, Artificial Sequence
  Synthetic
atacgccatgctgggtctccaattaaatacctactttcctaatgaaacaatactatttgaaccacactcaggaggggacctagaaattacaacacacagctttaattgtagaggagagttcgtacttgggagtcggccat

SEQ ID NO: 406018 - DNA, 140 bp, Artificial Sequence
  Synthetic
atggccgactcccaagtacgaactctcctctacaattaaagctgtgtgttgtaatttctaggtcccctcctgagtgtggttcaaatagtattgtttcattaggaaagtaggtatttaattggagacccagcatggcgtat

SEQ ID NO: 406019 - DNA, 140 bp, Artificial Sequence
  Synthetic
atacgccatgctgggtctccgggccacacatgcctgtgtacccacagatctaacccacaggcaagtagaattggtaaatgtgacagaaaattttaacatgtggaaaaataacatggtagacgtacttgggagtcggccat

SEQ ID NO: 406020 - DNA, 140 bp, Artificial Sequence
  Synthetic
atggccgactcccaagtacgtctaccatgttatttttccacatgttaaaattttctgtcacatttaccaattctacttgcctgtgggttagatctgtgggtacacaggcatgtgtggcccggagacccagcatggcgtat

SEQ ID NO: 406021 - DNA, 140 bp, Artificial Sequence
  Synthetic
atacgccatgctgggtctcccctggacaacaaggaacaataatcctataccagtaggagatatctatagaaagtggatagtgttggggctcaataaagtggtaaaaatgtatagccccatcgtacttgggagtcggccat

SEQ ID NO: 406022 - DNA, 140 bp, Artificial Sequence
  Synthetic
atggccgactcccaagtacgatggggctatacatttttaccactttattgagccccaacactatccactttctatagatatctcctactggtataggattattgttccttgttgtccaggggagacccagcatggcgtat

SEQ ID NO: 406023 - DNA, 140 bp, Artificial Sequence
  Synthetic
aggccctggctgctgatatggggctgttggaaatgtggaaaggaaggacatcaaatgaaagactgcactgagagacaggctaattttttagggaaaatttggccttccaacaagggaagggaccttttgggacagcggtg

SEQ ID NO: 406024 - DNA, 140 bp, Artificial Sequence
  Synthetic
caccgctgtcccaaaaggtcccttcccttgttggaaggccaaattttccctaaaaaattagcctgtctctcagtgcagtctttcatttgatgtccttcctttccacatttccaacagccccatatcagcagccagggcct

SEQ ID NO: 406025 - DNA, 140 bp, Artificial Sequence
  Synthetic
  misc_feature (40)..(40): n is a, c, g, or t
aggccctggctgctgatatgtagatagattctacaaaacnctcagagcagaacaagctagtcaggaagtaaagagttggatgacagacacattattaatacaaaatgctaatccagattggaccttttgggacagcggtg

SEQ ID NO: 406026 - DNA, 140 bp, Artificial Sequence
  Synthetic
  misc_feature (101)..(101): n is a, c, g, or t
caccgctgtcccaaaaggtccaatctggattagcattttgtattaataatgtgtctgtcatccaactctttacttcctgactagcttgttctgctctgagngttttgtagaatctatctacatatcagcagccagggcct

SEQ ID NO: 406027 - DNA, 140 bp, Artificial Sequence
  Synthetic
atacgccatgctgggtctccgaagccttagacaagatagaggaagaacaaaacaaaagtcagcaaaaaacacagcaggcagaagcggctgacaaaggaaaggtcagtcaaaattatccaacgtacttgggagtcggccat

SEQ ID NO: 406028 - DNA, 140 bp, Artificial Sequence
  Synthetic
atggccgactcccaagtacgttggataattttgactgacctttcctttgtcagccgcttctgcctgctgtgttttttgctgacttttgttttgttcttcctctatcttgtctaaggcttcggagacccagcatggcgtat

SEQ ID NO: 406029 - DNA, 140 bp, Artificial Sequence
  Synthetic
atacgccatgctgggtctcccagcaggcagaagcggctgccgaaaaggctgccggaaaggtcagtcaaaattaccctatagtacagaatcttcaagggcaaatggtacaccaggccatatcgtacttgggagtcggccat

SEQ ID NO: 406030 - DNA, 140 bp, Artificial Sequence
  Synthetic
atggccgactcccaagtacgatatggcctggtgtaccatttgcccttgaagattctgtactatagggtaattttgactgacctttccggcagccttttcggcagccgcttctgcctgctgggagacccagcatggcgtat

SEQ ID NO: 406031 - DNA, 140 bp, Artificial Sequence
  Synthetic
aggccctggctgctgatatgtacaaagaatttatagagctatccgcaacatacctacaagaataaggcagggctttgaagcagctttgctataagatggggagcaagtggtcaaaaagcagaccttttgggacagcggtg

SEQ ID NO: 406032 - DNA, 140 bp, Artificial Sequence
  Synthetic
caccgctgtcccaaaaggtctgctttttgaccacttgctccccatcttatagcaaagctgcttcaaagccctgccttattcttgtaggtatgttgcggatagctctataaattctttgtacatatcagcagccagggcct

SEQ ID NO: 406033 - DNA, 140 bp, Artificial Sequence
  Synthetic
atacgccatgctgggtctcccagatccagtccattagtgaatggattcttagcaatcatctgggtcgacctgcggagcctgtgcctcttcagctaccaccgcttgagagacttactcttgcgtacttgggagtcggccat

SEQ ID NO: 406034 - DNA, 140 bp, Artificial Sequence
  Synthetic
atggccgactcccaagtacgcaagagtaagtctctcaagcggtggtagctgaagaggcacaggctccgcaggtcgacccagatgattgctaagaatccattcactaatggactggatctgggagacccagcatggcgtat

SEQ ID NO: 406035 - DNA, 140 bp, Artificial Sequence
  Synthetic
aggccctggctgctgatatgatagcatatatagaatataggaaactagtaagacaaaggaaaatagactggttaattaaaagaattagggaaagagcagaagacagtggaaatgagagtggaccttttgggacagcggtg

SEQ ID NO: 406036 - DNA, 140 bp, Artificial Sequence
  Synthetic
caccgctgtcccaaaaggtccactctcatttccactgtcttctgctctttccctaattcttttaattaaccagtctattttcctttgtcttactagtttcctatattctatatatgctatcatatcagcagccagggcct

SEQ ID NO: 406037 - DNA, 140 bp, Artificial Sequence
  Synthetic
aggccctggctgctgatatgtcctcaggaggggatatagaaattacaacacatagttttaattgtggaggagaatttttctattgcaatacatcggaactgtttaatagcacttggaatagaccttttgggacagcggtg

SEQ ID NO: 406038 - DNA, 140 bp, Artificial Sequence
  Synthetic
caccgctgtcccaaaaggtctattccaagtgctattaaacagttccgatgtattgcaatagaaaaattctcctccacaattaaaactatgtgttgtaatttctatatcccctcctgaggacatatcagcagccagggcct

SEQ ID NO: 406039 - DNA, 140 bp, Artificial Sequence
  Synthetic
aggccctggctgctgatatgacctagaagaataagacagggcttagaaaggcttttactataagatgggtggaaagtggtcaaaacatagtgggggtggatggcctgcggtgagggaaaggaccttttgggacagcggtg

SEQ ID NO: 406040 - DNA, 140 bp, Artificial Sequence
  Synthetic
caccgctgtcccaaaaggtcctttccctcaccgcaggccatccacccccactatgttttgaccactttccacccatcttatagtaaaagcctttctaagccctgtcttattcttctaggtcatatcagcagccagggcct

SEQ ID NO: 406041 - DNA, 140 bp, Artificial Sequence
  Synthetic
aggccctggctgctgatatgagcataagaaataagatgcagaaagaatatgcacttttttataaacttgatatagtaccaatagataatgataatacaagctatacattgataaattgtagaccttttgggacagcggtg

SEQ ID NO: 406042 - DNA, 140 bp, Artificial Sequence
  Synthetic
caccgctgtcccaaaaggtctacaatttatcaatgtatagcttgtattatcattatctattggtactatatcaagtttataaaaaagtgcatattctttctgcatcttatttcttatgctcatatcagcagccagggcct

SEQ ID NO: 406043 - DNA, 140 bp, Artificial Sequence
  Synthetic
atacgccatgctgggtctccgtggcgcccgaacagggacttgaagaaagtaaaaccagaggagatctctcgacgcaggactcggcttgctgaagaagaagcgcgcgcggcaagaggcgagcgtacttgggagtcggccat

SEQ ID NO: 406044 - DNA, 140 bp, Artificial Sequence
  Synthetic
atggccgactcccaagtacgctcgcctcttgccgcgcgcgcttcttcttcagcaagccgagtcctgcgtcgagagatctcctctggttttactttcttcaagtccctgttcgggcgccacggagacccagcatggcgtat

SEQ ID NO: 406045 - DNA, 140 bp, Artificial Sequence
  Synthetic
aggccctggctgctgatatggggcggcgactggtgagtacgcctaaaaattttgactagcggaggctagaaggagagagatgggtgcgagagcgtcagtattaagcgggggagaattagagaccttttgggacagcggtg

SEQ ID NO: 406046 - DNA, 140 bp, Artificial Sequence
  Synthetic
caccgctgtcccaaaaggtctctaattctcccccgcttaatactgacgctctcgcacccatctctctccttctagcctccgctagtcaaaatttttaggcgtactcaccagtcgccgccccatatcagcagccagggcct

SEQ ID NO: 406047 - DNA, 140 bp, Artificial Sequence
  Synthetic
aggccctggctgctgatatgggggctgctctggaaaactcatctgcaccactaatgtaccctggaactctagttggagtaataaaacttataatgacatatgggataacatgacctggctgaccttttgggacagcggtg

SEQ ID NO: 406048 - DNA, 140 bp, Artificial Sequence
  Synthetic
caccgctgtcccaaaaggtcagccaggtcatgttatcccatatgtcattataagttttattactccaactagagttccagggtacattagtggtgcagatgagttttccagagcagcccccatatcagcagccagggcct

SEQ ID NO: 406049 - DNA, 140 bp, Artificial Sequence
  Synthetic
aggccctggctgctgatatgctatccgcaacacacctagaagaataagacagggctttgaagcagctttgctataaaatggggggcaagtggtcaaaaagaagcaaagctgaatggcctggaccttttgggacagcggtg

SEQ ID NO: 406050 - DNA, 140 bp, Artificial Sequence
  Synthetic
caccgctgtcccaaaaggtccaggccattcagctttgcttctttttgaccacttgccccccattttatagcaaagctgcttcaaagccctgtcttattcttctaggtgtgttgcggatagcatatcagcagccagggcct

SEQ ID NO: 406051 - DNA, 140 bp, Artificial Sequence
  Synthetic
atacgccatgctgggtctccgacttgatagctgaaatacagaaacaggggcatgaccaatggacatatcaaatttatcaagaaccatacaaaaatctgaaaacagggaaatatgcaaaaacgtacttgggagtcggccat

SEQ ID NO: 406052 - DNA, 140 bp, Artificial Sequence
  Synthetic
atggccgactcccaagtacgtttttgcatatttccctgttttcagatttttgtatggttcttgataaatttgatatgtccattggtcatgcccctgtttctgtatttcagctatcaagtcggagacccagcatggcgtat

SEQ ID NO: 406053 - DNA, 140 bp, Artificial Sequence
  Synthetic
aggccctggctgctgatatgtaaggcaaactcctccagcaacagaaggagtaggagcagtatctcaagatctagataaacatggagcagtaacaagtagtaatatgaataatgctgataggaccttttgggacagcggtg

SEQ ID NO: 406054 - DNA, 140 bp, Artificial Sequence
  Synthetic
caccgctgtcccaaaaggtcctatcagcattattcatattactacttgttactgctccatgtttatctagatcttgagatactgctcctactccttctgttgctggaggagtttgccttacatatcagcagccagggcct

SEQ ID NO: 406055 - DNA, 140 bp, Artificial Sequence
  Synthetic
aggccctggctgctgatatgattgagagacttcatattgattgtagcgagagtggtggaacttctgggacgcagcagtctcaggggactacagaaggggtgggaaacccttaagtatctggaccttttgggacagcggtg

SEQ ID NO: 406056 - DNA, 140 bp, Artificial Sequence
  Synthetic
caccgctgtcccaaaaggtccagatacttaagggtttcccaccccttctgtagtcccctgagactgctgcgtcccagaagttccaccactctcgctacaatcaatatgaagtctctcaatcatatcagcagccagggcct

SEQ ID NO: 406057 - DNA, 140 bp, Artificial Sequence
  Synthetic
aggccctggctgctgatatgtagaattaatacaaagaatttgtagagctgtccgcaacatacctagaagactaagacagggctttgaagcagctttgctataaaatggggagcaagtggtgaccttttgggacagcggtg

SEQ ID NO: 406058 - DNA, 140 bp, Artificial Sequence
  Synthetic
caccgctgtcccaaaaggtcaccacttgctccccattttatagcaaagctgcttcaaagccctgtcttagtcttctaggtatgttgcggacagctctacaaattctttgtattaattctacatatcagcagccagggcct

SEQ ID NO: 406059 - DNA, 140 bp, Artificial Sequence
  Synthetic
atacgccatgctgggtctccagcaagacacatgaaaaattgctcattcaatataaccactgaaatacatgacaaaaagaagcaagcttactctctgttttatgtagaagatgtagtgccacgtacttgggagtcggccat

SEQ ID NO: 406060 - DNA, 140 bp, Artificial Sequence
  Synthetic
atggccgactcccaagtacgtggcactacatcttctacataaaacagagagtaagcttgcttctttttgtcatgtatttcagtggttatattgaatgagcaatttttcatgtgtcttgctggagacccagcatggcgtat

SEQ ID NO: 406061 - DNA, 140 bp, Artificial Sequence
  Synthetic
aggccctggctgctgatatggtgatggagaccaggaagaattgtcagcactggtggtggagatggggcaccatgctccttgggatgttgatgatttgtagtgctgcaaaacaatcagaacgaccttttgggacagcggtg

SEQ ID NO: 406062 - DNA, 140 bp, Artificial Sequence
  Synthetic
caccgctgtcccaaaaggtcgttctgattgttttgcagcactacaaatcatcaacatcccaaggagcatggtgccccatctccaccaccagtgctgacaattcttcctggtctccatcaccatatcagcagccagggcct

SEQ ID NO: 406063 - DNA, 140 bp, Artificial Sequence
  Synthetic
atacgccatgctgggtctccatgttaaatttaattgcaagagtagattatagattaggagtaggagcattgatagtagcactaatcatagcaataatagtgtggaccatagtatatatagcgtacttgggagtcggccat

SEQ ID NO: 406064 - DNA, 140 bp, Artificial Sequence
  Synthetic
atggccgactcccaagtacgctatatatactatggtccacactattattgctatgattagtgctactatcaatgctcctactcctaatctataatctactcttgcaattaaatttaacatggagacccagcatggcgtat

SEQ ID NO: 406065 - DNA, 140 bp, Artificial Sequence
  Synthetic
atacgccatgctgggtctccgagaaaggggaaataaaaaactgctctttcaatattaccacaaacatgagagataagatgcagaaagaatatgcacttttttataaacttgatgtagttccgtacttgggagtcggccat

SEQ ID NO: 406066 - DNA, 140 bp, Artificial Sequence
  Synthetic
atggccgactcccaagtacggaactacatcaagtttataaaaaagtgcatattctttctgcatcttatctctcatgtttgtggtaatattgaaagagcagttttttatttcccctttctcggagacccagcatggcgtat

SEQ ID NO: 406067 - DNA, 140 bp, Artificial Sequence
  Synthetic
atacgccatgctgggtctcccaataatgctacccacaataatgctacccacaataatagtgaagagatgaaaaattgttctttcaatgcaaccacagaaatacaagacaagaaaaggaaacgtacttgggagtcggccat

SEQ ID NO: 406068 - DNA, 140 bp, Artificial Sequence
  Synthetic
atggccgactcccaagtacgtttccttttcttgtcttgtatttctgtggttgcattgaaagaacaatttttcatctcttcactattattgtgggtagcattattgtgggtagcattattgggagacccagcatggcgtat

SEQ ID NO: 406069 - DNA, 140 bp, Artificial Sequence
  Synthetic
aggccctggctgctgatatgatcctcaggaggggacctagaaattgtaatgcacagttttaattgtggaggggaatttttttactgtaatacaacacaattgtttaatagtacttggaatgaccttttgggacagcggtg

SEQ ID NO: 406070 - DNA, 140 bp, Artificial Sequence
  Synthetic
caccgctgtcccaaaaggtcattccaagtactattaaacaattgtgttgtattacagtaaaaaaattcccctccacaattaaaactgtgcattacaatttctaggtcccctcctgaggatcatatcagcagccagggcct

SEQ ID NO: 406071 - DNA, 140 bp, Artificial Sequence
  Synthetic
aggccctggctgctgatatggaatagtttagtaaagcaccatatgtatatttcaaagagagctaagggatggttttacagacatcattatgaaagcagacatccaagagtaagttcagaagaccttttgggacagcggtg

SEQ ID NO: 406072 - DNA, 140 bp, Artificial Sequence
  Synthetic
caccgctgtcccaaaaggtcttctgaacttactcttggatgtctgctttcataatgatgtctgtaaaaccatcccttagctctctttgaaatatacatatggtgctttactaaactattccatatcagcagccagggcct

SEQ ID NO: 406073 - DNA, 140 bp, Artificial Sequence
  Synthetic
atacgccatgctgggtctcctccctaatagaacaataaaatttgaacaaccctcaggaggagatctagaagttacaacacatagcttcaattgtggaggagaacttttctattgtaataccgtacttgggagtcggccat

SEQ ID NO: 406074 - DNA, 140 bp, Artificial Sequence
  Synthetic
atggccgactcccaagtacggtattacaatagaaaagttctcctccacaattgaagctatgtgttgtaacttctagatctcctcctgagggttgttcaaattttattgttctattagggaggagacccagcatggcgtat

SEQ ID NO: 406075 - DNA, 140 bp, Artificial Sequence
  Synthetic
aggccctggctgctgatatgatagaatataggaaaatattaagacaaaggaaaatagataggttaattgatagaataagagaaagagcagaagacagtggcaatgaaagtgaaggggatcgaccttttgggacagcggtg

SEQ ID NO: 406076 - DNA, 140 bp, Artificial Sequence
  Synthetic
caccgctgtcccaaaaggtcgatccccttcactttcattgccactgtcttctgctctttctcttattctatcaattaacctatctattttcctttgtcttaatattttcctatattctatcatatcagcagccagggcct

SEQ ID NO: 406077 - DNA, 140 bp, Artificial Sequence
  Synthetic
aggccctggctgctgatatgtggaatctcctgcagtattggagtcaggaactaaagaagagtgctgttagcttgcttgacaccacagccataatagtagctgaggggacagataggattagaccttttgggacagcggtg

SEQ ID NO: 406078 - DNA, 140 bp, Artificial Sequence
  Synthetic
caccgctgtcccaaaaggtctaatcctatctgtcccctcagctactattatggctgtggtgtcaagcaagctaacagcactcttctttagttcctgactccaatactgcaggagattccacatatcagcagccagggcct

SEQ ID NO: 406079 - DNA, 140 bp, Artificial Sequence
  Synthetic
aggccctggctgctgatatgataagacagggcttggaaagggctttgctataaaatgggtggcaagtggtcaaaacgtggtgttcctggatgggatactataagggaaagaatgagacgagaccttttgggacagcggtg

SEQ ID NO: 406080 - DNA, 140 bp, Artificial Sequence
  Synthetic
caccgctgtcccaaaaggtctcgtctcattctttcccttatagtatcccatccaggaacaccacgttttgaccacttgccacccattttatagcaaagccctttccaagccctgtcttatcatatcagcagccagggcct

SEQ ID NO: 406081 - DNA, 140 bp, Artificial Sequence
  Synthetic
atacgccatgctgggtctcccagagcagaccagagccaacagccccaccagcagagagcttcgggtttggagaggagacagccccctccccgaagcaggaggggaaggacaaggaactgtcgtacttgggagtcggccat

SEQ ID NO: 406082 - DNA, 140 bp, Artificial Sequence
  Synthetic
atggccgactcccaagtacgacagttccttgtccttcccctcctgcttcggggagggggctgtctcctctccaaacccgaagctctctgctggtggggctgttggctctggtctgctctgggagacccagcatggcgtat

SEQ ID NO: 406083 - DNA, 140 bp, Artificial Sequence
  Synthetic
aggccctggctgctgatatgtctagcaaaagaagaggtagtaattagatccaagaatttcacggacaatgcaaaagtcataatagtacagctgaatgaatctgtaataattaattgtacagaccttttgggacagcggtg

SEQ ID NO: 406084 - DNA, 140 bp, Artificial Sequence
  Synthetic
caccgctgtcccaaaaggtctgtacaattaattattacagattcattcagctgtactattatgacttttgcattgtccgtgaaattcttggatctaattactacctcttcttttgctagacatatcagcagccagggcct

SEQ ID NO: 406085 - DNA, 140 bp, Artificial Sequence
  Synthetic
aggccctggctgctgatatgcatagcagaataggtgttacgcggcagagaagagtaaggaatggacccagtagaccataacctagagccctggaaccagccaggaagtcagcctaacactgaccttttgggacagcggtg

SEQ ID NO: 406086 - DNA, 140 bp, Artificial Sequence
  Synthetic
caccgctgtcccaaaaggtcagtgttaggctgacttcctggctggttccagggctctaggttatggtctactgggtccattccttactcttctctgccgcgtaacacctattctgctatgcatatcagcagccagggcct

SEQ ID NO: 406087 - DNA, 140 bp, Artificial Sequence
  Synthetic
atacgccatgctgggtctcctagaccataacctagagccctggaaccagccaggaagtcagcctaacactccttgtaataactgctattgtaaacagtgctgctatcattgccaattgtgcgtacttgggagtcggccat

SEQ ID NO: 406088 - DNA, 140 bp, Artificial Sequence
  Synthetic
atggccgactcccaagtacgcacaattggcaatgatagcagcactgtttacaatagcagttattacaaggagtgttaggctgacttcctggctggttccagggctctaggttatggtctaggagacccagcatggcgtat

SEQ ID NO: 406089 - DNA, 140 bp, Artificial Sequence
  Synthetic
atacgccatgctgggtctccgctgtaagagaaagaataaggcgaactaggcctgaacctgaaccagcagcagagggagtaggagcagcatctcaggacttagataaacatggagcgcttacgtacttgggagtcggccat

SEQ ID NO: 406090 - DNA, 140 bp, Artificial Sequence
  Synthetic
atggccgactcccaagtacgtaagcgctccatgtttatctaagtcctgagatgctgctcctactccctctgctgctggttcaggttcaggcctagttcgccttattctttctcttacagcggagacccagcatggcgtat

SEQ ID NO: 406091 - DNA, 140 bp, Artificial Sequence
  Synthetic
atacgccatgctgggtctcccgcgacgccgacctcctaaaagcagtcaggatcatcaagattttataccaaagcagtaagtatcataaatgtatattttaggaataggaataggagccttcgtacttgggagtcggccat

SEQ ID NO: 406092 - DNA, 140 bp, Artificial Sequence
  Synthetic
atggccgactcccaagtacgaaggctcctattcctattcctaaaatatacatttatgatacttactgctttggtataaaatcttgatgatcctgactgcttttaggaggtcggcgtcgcgggagacccagcatggcgtat

SEQ ID NO: 406093 - DNA, 140 bp, Artificial Sequence
  Synthetic
aggccctggctgctgatatgaagcagtaagtatcataaatgtatattttaggaataggaataggagccttaatagtagcatttatcatagtcatagtagtgtggaccatagtatatttaggaccttttgggacagcggtg

SEQ ID NO: 406094 - DNA, 140 bp, Artificial Sequence
  Synthetic
caccgctgtcccaaaaggtcctaaatatactatggtccacactactatgactatgataaatgctactattaaggctcctattcctattcctaaaatatacatttatgatacttactgcttcatatcagcagccagggcct

SEQ ID NO: 406095 - DNA, 140 bp, Artificial Sequence
  Synthetic
atacgccatgctgggtctccataagagaaagagcagaagacagtggcaatgaaagtgatggggacacagaggaattatccgaactggtggagatggggcgtcttaatcttgggtatgttgcgtacttgggagtcggccat

SEQ ID NO: 406096 - DNA, 140 bp, Artificial Sequence
  Synthetic
atggccgactcccaagtacgcaacatacccaagattaagacgccccatctccaccagttcggataattcctctgtgtccccatcactttcattgccactgtcttctgctctttctcttatggagacccagcatggcgtat

SEQ ID NO: 406097 - DNA, 140 bp, Artificial Sequence
  Synthetic
atacgccatgctgggtctcctgtgttactctaaactgtacagacccagccaatcatacagacacaaccaataataccagtatacaacctagtcagcccagtgcaaactgctctttcaatgcgtacttgggagtcggccat

SEQ ID NO: 406098 - DNA, 140 bp, Artificial Sequence
  Synthetic
atggccgactcccaagtacgcattgaaagagcagtttgcactgggctgactaggttgtatactggtattattggttgtgtctgtatgattggctgggtctgtacagtttagagtaacacaggagacccagcatggcgtat

SEQ ID NO: 406099 - DNA, 140 bp, Artificial Sequence
  Synthetic
aggccctggctgctgatatgtaataccagtatacaacctagtcagcccagtgcaaactgctctttcaatgtaactacagcaatcagagataagcagcagaaagtacatgcactcttttatgaccttttgggacagcggtg

SEQ ID NO: 406100 - DNA, 140 bp, Artificial Sequence
  Synthetic
caccgctgtcccaaaaggtcataaaagagtgcatgtactttctgctgcttatctctgattgctgtagttacattgaaagagcagtttgcactgggctgactaggttgtatactggtattacatatcagcagccagggcct

SEQ ID NO: 406101 - DNA, 140 bp, Artificial Sequence
  Synthetic
aggccctggctgctgatatgtaatggaacaaaatggaatgaaactttaaaacaggtagctgaaaaattaaaagagcattttaataataagacaataatctttcaaccaccctcaggaggagaccttttgggacagcggtg

SEQ ID NO: 406102 - DNA, 140 bp, Artificial Sequence
  Synthetic
caccgctgtcccaaaaggtctcctcctgagggtggttgaaagattattgtcttattattaaaatgctcttttaatttttcagctacctgttttaaagtttcattccattttgttccattacatatcagcagccagggcct

SEQ ID NO: 406103 - DNA, 140 bp, Artificial Sequence
  Synthetic
aggccctggctgctgatatgataaacatgtggcagggagtaggacaagcaatgtatgctcctcccatcagtggaagaattaattgtgtatcaaatattacaggaatactattgacaagaggaccttttgggacagcggtg

SEQ ID NO: 406104 - DNA, 140 bp, Artificial Sequence
  Synthetic
caccgctgtcccaaaaggtcctcttgtcaatagtattcctgtaatatttgatacacaattaattcttccactgatgggaggagcatacattgcttgtcctactccctgccacatgtttatcatatcagcagccagggcct

SEQ ID NO: 406105 - DNA, 140 bp, Artificial Sequence
  Synthetic
atacgccatgctgggtctccaattaactgtactagaatagccaacaatacgagaaaaagtatacatatagggccaggacaagcattctatgcagcagagccagtcataggagatataagacgtacttgggagtcggccat

SEQ ID NO: 406106 - DNA, 140 bp, Artificial Sequence
  Synthetic
atggccgactcccaagtacgtcttatatctcctatgactggctctgctgcatagaatgcttgtcctggccctatatgtatactttttctcgtattgttggctattctagtacagttaattggagacccagcatggcgtat

SEQ ID NO: 406107 - DNA, 140 bp, Artificial Sequence
  Synthetic
  misc_feature (37)..(37): n is a, c, g, or t
atacgccatgctgggtctccagtagccacacaattangacaacactttagtaataaaacaataattttcaacgcatccgcaggaggggatatagagattacaacacatagttttaattgtcgtacttgggagtcggccat

SEQ ID NO: 406108 - DNA, 140 bp, Artificial Sequence
  Synthetic
  misc_feature (104)..(104): n is a, c, g, or t
atggccgactcccaagtacgacaattaaaactatgtgttgtaatctctatatcccctcctgcggatgcgttgaaaattattgttttattactaaagtgttgtcntaattgtgtggctactggagacccagcatggcgtat

SEQ ID NO: 406109 - DNA, 140 bp, Artificial Sequence
  Synthetic
aggccctggctgctgatatgacgcatccgcaggaggggatatagagattacaacacatagttttaattgtgcaggagaatttttctattgcaatacatcacaattgtttaatagtacttggaccttttgggacagcggtg

SEQ ID NO: 406110 - DNA, 140 bp, Artificial Sequence
  Synthetic
caccgctgtcccaaaaggtccaagtactattaaacaattgtgatgtattgcaatagaaaaattctcctgcacaattaaaactatgtgttgtaatctctatatcccctcctgcggatgcgtcatatcagcagccagggcct

SEQ ID NO: 406111 - DNA, 140 bp, Artificial Sequence
  Synthetic
atacgccatgctgggtctcccatgcaaaataaaacaaattgtaaacatgtggcagagagtaggacaagcaatgtatgcccctcctatcaaaggaaacattacatgtgtatcaaatattaccgtacttgggagtcggccat

SEQ ID NO: 406112 - DNA, 140 bp, Artificial Sequence
  Synthetic
atggccgactcccaagtacggtaatatttgatacacatgtaatgtttcctttgataggaggggcatacattgcttgtcctactctctgccacatgtttacaatttgttttattttgcatgggagacccagcatggcgtat

SEQ ID NO: 406113 - DNA, 140 bp, Artificial Sequence
  Synthetic
  misc_feature (45)..(45): n is a, c, g, or t
atacgccatgctgggtctccaggactaatattgacaatagacagnggtaacatgtctgcagagaactttaccttcagacctggaggaggagatatgagagacaattggagaagtgaactacgtacttgggagtcggccat

SEQ ID NO: 406114 - DNA, 140 bp, Artificial Sequence
  Synthetic
  misc_feature (96)..(96): n is a, c, g, or t
atggccgactcccaagtacgtagttcacttctccaattgtctctcatatctcctcctccaggtctgaaggtaaagttctctgcagacatgttaccnctgtctattgtcaatattagtcctggagacccagcatggcgtat

SEQ ID NO: 406115 - DNA, 140 bp, Artificial Sequence
  Synthetic
aggccctggctgctgatatgcccatcgtattaccagaaaaggaagcttggacagtaaatgacatccagaagctagtaggaaagttaaattgggcaagtcagatttatccaggaataaggggaccttttgggacagcggtg

SEQ ID NO: 406116 - DNA, 140 bp, Artificial Sequence
  Synthetic
caccgctgtcccaaaaggtccccttattcctggataaatctgacttgcccaatttaactttcctactagcttctggatgtcatttactgtccaagcttccttttctggtaatacgatgggcatatcagcagccagggcct

SEQ ID NO: 406117 - DNA, 140 bp, Artificial Sequence
  Synthetic
atacgccatgctgggtctccgagagaaggaatgagagaaataaaaaattgctctttcaatgtaaccacagaattaagagataagagaaagaatgtgtatgcacttttttataaacttgatcgtacttgggagtcggccat

SEQ ID NO: 406118 - DNA, 140 bp, Artificial Sequence
  Synthetic
atggccgactcccaagtacgatcaagtttataaaaaagtgcatacacattctttctcttatctcttaattctgtggttacattgaaagagcaattttttatttctctcattccttctctcggagacccagcatggcgtat

SEQ ID NO: 406119 - DNA, 140 bp, Artificial Sequence
  Synthetic
aggccctggctgctgatatgcgggttcttgccacttgtatgggaagacctgcggaacctgtgcctcttcagctaccgcctcttgagagacttactcttgattctagcgaggactgtgacagaccttttgggacagcggtg

SEQ ID NO: 406120 - DNA, 140 bp, Artificial Sequence
  Synthetic
caccgctgtcccaaaaggtctgtcacagtcctcgctagaatcaagagtaagtctctcaagaggcggtagctgaagaggcacaggttccgcaggtcttcccatacaagtggcaagaacccgcatatcagcagccagggcct

SEQ ID NO: 406121 - DNA, 140 bp, Artificial Sequence
  Synthetic
atacgccatgctgggtctccaatcaccctcaggaggagacctagaaattacaacacatacctttaattgtagaggagaattcttctattgcaatacatcaaatctgtctaatgagacatacgtacttgggagtcggccat

SEQ ID NO: 406122 - DNA, 140 bp, Artificial Sequence
  Synthetic
atggccgactcccaagtacgtatgtctcattagacagatttgatgtattgcaatagaagaattctcctctacaattaaaggtatgtgttgtaatttctaggtctcctcctgagggtgattggagacccagcatggcgtat

SEQ ID NO: 406123 - DNA, 140 bp, Artificial Sequence
  Synthetic
aggccctggctgctgatatgccacagcaatagcagtagctgagggaacagataggattatagaaatagtgcaaagaactggaagagctgttctccacatacctagaagaataagacaagggaccttttgggacagcggtg

SEQ ID NO: 406124 - DNA, 140 bp, Artificial Sequence
  Synthetic
caccgctgtcccaaaaggtcccttgtcttattcttctaggtatgtggagaacagctcttccagttctttgcactatttctataatcctatctgttccctcagctactgctattgctgtggcatatcagcagccagggcct

SEQ ID NO: 406125 - DNA, 140 bp, Artificial Sequence
  Synthetic
atacgccatgctgggtctcctatagttgggtggcctgctataagagaaagaatgaggcgagctgagccagcagcagaaggagtaggagcagcgtctcgagatttggatagacgtggggcacgtacttgggagtcggccat

SEQ ID NO: 406126 - DNA, 140 bp, Artificial Sequence
  Synthetic
atggccgactcccaagtacgtgccccacgtctatccaaatctcgagacgctgctcctactccttctgctgctggctcagctcgcctcattctttctcttatagcaggccacccaactataggagacccagcatggcgtat

SEQ ID NO: 406127 - DNA, 140 bp, Artificial Sequence
  Synthetic
aggccctggctgctgatatggagagacaggctaattttttagggaaaatttggccttcccacaagggaaggccaggaaattttcctcagagcagaccagagccatcagccccaccagcaggaccttttgggacagcggtg

SEQ ID NO: 406128 - DNA, 140 bp, Artificial Sequence
  Synthetic
caccgctgtcccaaaaggtcctgctggtggggctgatggctctggtctgctctgaggaaaatttcctggccttcccttgtgggaaggccaaattttccctaaaaaattagcctgtctctccatatcagcagccagggcct

SEQ ID NO: 406129 - DNA, 140 bp, Artificial Sequence
  Synthetic
aggccctggctgctgatatgtttgaatgcatgggtgaaagtaatagaagaaaaggcttttagcccagaagtaatacccatgttctcagcattatcagagggagccaccccacaagatttagaccttttgggacagcggtg

SEQ ID NO: 406130 - DNA, 140 bp, Artificial Sequence
  Synthetic
caccgctgtcccaaaaggtctaaatcttgtggggtggctccctctgataatgctgagaacatgggtattacttctgggctaaaagccttttcttctattactttcacccatgcattcaaacatatcagcagccagggcct

SEQ ID NO: 406131 - DNA, 140 bp, Artificial Sequence
  Synthetic
atacgccatgctgggtctccgcaagtagacaggatgaggattagaacatggaaaagtttagtaaaacaccatatgtatatttcaaagaaagctaaaggatggttttatagacatcactatcgtacttgggagtcggccat

SEQ ID NO: 406132 - DNA, 140 bp, Artificial Sequence
  Synthetic
atggccgactcccaagtacgatagtgatgtctataaaaccatcctttagctttctttgaaatatacatatggtgttttactaaacttttccatgttctaatcctcatcctgtctacttgcggagacccagcatggcgtat

SEQ ID NO: 406133 - DNA, 140 bp, Artificial Sequence
  Synthetic
aggccctggctgctgatatggaggaggtaggctttccagtcagacctcaagtacctttaagaccaatgacttataagggagcatttgatctcggcttctttttaaaagaaaaggggggacgaccttttgggacagcggtg

SEQ ID NO: 406134 - DNA, 140 bp, Artificial Sequence
  Synthetic
caccgctgtcccaaaaggtcgtccccccttttcttttaaaaagaagccgagatcaaatgctcccttataagtcattggtcttaaaggtacttgaggtctgactggaaagcctacctcctccatatcagcagccagggcct

SEQ ID NO: 406135 - DNA, 140 bp, Artificial Sequence
  Synthetic
aggccctggctgctgatatgccactaggggatgctagattggtaataaaaacatattggggtctgcatacaggagaaagagactggcatttgggtcagggagtctccatagaatggaggagaccttttgggacagcggtg

SEQ ID NO: 406136 - DNA, 140 bp, Artificial Sequence
  Synthetic
caccgctgtcccaaaaggtctcctccattctatggagactccctgacccaaatgccagtctctttctcctgtatgcagaccccaatatgtttttattaccaatctagcatcccctagtggcatatcagcagccagggcct

SEQ ID NO: 406137 - DNA, 140 bp, Artificial Sequence
  Synthetic
aggccctggctgctgatatgagcacacaagtagaccctggcctggcagaccagctaattcatatgcattattttgattgttttgcagactctgccataagaaaagccatattaggacatagaccttttgggacagcggtg

SEQ ID NO: 406138 - DNA, 140 bp, Artificial Sequence
  Synthetic
caccgctgtcccaaaaggtctatgtcctaatatggcttttcttatggcagagtctgcaaaacaatcaaaataatgcatatgaattagctggtctgccaggccagggtctacttgtgtgctcatatcagcagccagggcct

SEQ ID NO: 406139 - DNA, 140 bp, Artificial Sequence
  Synthetic
aggccctggctgctgatatgttttgattgttttgcagactctgccataagaaaagccatattaggacatatagttattcctaggtgtgactatcaagcaggacatactaaggtaggatctgaccttttgggacagcggtg

SEQ ID NO: 406140 - DNA, 140 bp, Artificial Sequence
  Synthetic
caccgctgtcccaaaaggtcagatcctaccttagtatgtcctgcttgatagtcacacctaggaataactatatgtcctaatatggcttttcttatggcagagtctgcaaaacaatcaaaacatatcagcagccagggcct

SEQ ID NO: 406141 - DNA, 140 bp, Artificial Sequence
  Synthetic
atacgccatgctgggtctccatcaagtttctctatcaaagcagtaagtaatacatgtgatgcaacccttagtaatattagcaatagtagcattagtagtagcagcaataatagcaatagtcgtacttgggagtcggccat

SEQ ID NO: 406142 - DNA, 140 bp, Artificial Sequence
  Synthetic
atggccgactcccaagtacgactattgctattattgctgctactactaatgctactattgctaatattactaagggttgcatcacatgtattacttactgctttgatagagaaacttgatggagacccagcatggcgtat

SEQ ID NO: 406143 - DNA, 140 bp, Artificial Sequence
  Synthetic
aggccctggctgctgatatgtgaggggacagatagggttatagaagtagtacaaagaattggtagagctattctccacatacctacaagaataagacagggcttagaaaggcttttgctagaccttttgggacagcggtg

SEQ ID NO: 406144 - DNA, 140 bp, Artificial Sequence
  Synthetic
caccgctgtcccaaaaggtctagcaaaagcctttctaagccctgtcttattcttgtaggtatgtggagaatagctctaccaattctttgtactacttctataaccctatctgtcccctcacatatcagcagccagggcct

SEQ ID NO: 406145 - DNA, 140 bp, Artificial Sequence
  Synthetic
  misc_feature (36)..(36): n is a, c, g, or t
atacgccatgctgggtctccagataggggtaggcanaagataatcaaactagaaggaacaaccaatcaaaaagcagaattagaagcagtgctgttagccttaaaagaatcaggaaaacagcgtacttgggagtcggccat

SEQ ID NO: 406146 - DNA, 140 bp, Artificial Sequence
  Synthetic
  misc_feature (105)..(105): n is a, c, g, or t
atggccgactcccaagtacgctgttttcctgattcttttaaggctaacagcactgcttctaattctgctttttgattggttgttccttctagtttgattatcttntgcctacccctatctggagacccagcatggcgtat

SEQ ID NO: 406147 - DNA, 140 bp, Artificial Sequence
  Synthetic
aggccctggctgctgatatgccagaccaaaagcatcagaaagaacccccatttctttggatggggtatgaactccatcctgacaaatggacagtacagcctatacaactgccagacaagggaccttttgggacagcggtg

SEQ ID NO: 406148 - DNA, 140 bp, Artificial Sequence
  Synthetic
caccgctgtcccaaaaggtcccttgtctggcagttgtataggctgtactgtccatttgtcaggatggagttcataccccatccaaagaaatgggggttctttctgatgcttttggtctggcatatcagcagccagggcct

SEQ ID NO: 406149 - DNA, 140 bp, Artificial Sequence
  Synthetic
atacgccatgctgggtctcctttaatggagagaggggaaataaaaaactgctctttcaatgttaccacaggcataagagataagatgcaaagagaatatgcacttttttataaacttgatcgtacttgggagtcggccat

SEQ ID NO: 406150 - DNA, 140 bp, Artificial Sequence
  Synthetic
atggccgactcccaagtacgatcaagtttataaaaaagtgcatattctctttgcatcttatctcttatgcctgtggtaacattgaaagagcagttttttatttcccctctctccattaaaggagacccagcatggcgtat

SEQ ID NO: 406151 - DNA, 140 bp, Artificial Sequence
  Synthetic
aggccctggctgctgatatgaaagcctaaagccatgtgtaaagttgaccccactctgtgtcactttaaactgtagtatggttaataatatcacctgtaatgtcacccatgatgataatgggaccttttgggacagcggtg

SEQ ID NO: 406152 - DNA, 140 bp, Artificial Sequence
  Synthetic
caccgctgtcccaaaaggtcccattatcatcatgggtgacattacaggtgatattattaaccatactacagtttaaagtgacacagagtggggtcaactttacacatggctttaggctttcatatcagcagccagggcct

SEQ ID NO: 406153 - DNA, 140 bp, Artificial Sequence
  Synthetic
atacgccatgctgggtctccaaataaaaaattgctctttcaatataaccacagaaataagagataggcaaaagaaagaatatgcacttttttataggcctgatatagtaccacttgaaggcgtacttgggagtcggccat

SEQ ID NO: 406154 - DNA, 140 bp, Artificial Sequence
  Synthetic
atggccgactcccaagtacgccttcaagtggtactatatcaggcctataaaaaagtgcatattctttcttttgcctatctcttatttctgtggttatattgaaagagcaattttttatttggagacccagcatggcgtat

SEQ ID NO: 406155 - DNA, 140 bp, Artificial Sequence
  Synthetic
atacgccatgctgggtctccagaaaagatagctataaaattaagagaacaatataaaaataaaacaatagaatttaaacaatcctcaggaggggacctagaacttgtaatgcacagtgttcgtacttgggagtcggccat

SEQ ID NO: 406156 - DNA, 140 bp, Artificial Sequence
  Synthetic
atggccgactcccaagtacgaacactgtgcattacaagttctaggtcccctcctgaggattgtttaaattctattgttttatttttatattgttctcttaattttatagctatcttttctggagacccagcatggcgtat

SEQ ID NO: 406157 - DNA, 140 bp, Artificial Sequence
  Synthetic
aggccctggctgctgatatgtgtgtggactatagtaggcatagaatataagagattgctaaaacaaaggaaaatagacaggttaattgagagaataagagaaagagcagaagacagtggcgaccttttgggacagcggtg

SEQ ID NO: 406158 - DNA, 140 bp, Artificial Sequence
  Synthetic
caccgctgtcccaaaaggtcgccactgtcttctgctctttctcttattctctcaattaacctgtctattttcctttgttttagcaatctcttatattctatgcctactatagtccacacacatatcagcagccagggcct

SEQ ID NO: 406159 - DNA, 140 bp, Artificial Sequence
  Synthetic
atacgccatgctgggtctccgaacaggaaggaggaaatgaaaaattgctctttcaatgcaaccacattattacatgataagaaacagaaagtgtatgcccttttttataaacttgatatacgtacttgggagtcggccat

SEQ ID NO: 406160 - DNA, 140 bp, Artificial Sequence
  Synthetic
atggccgactcccaagtacgtatatcaagtttataaaaaagggcatacactttctgtttcttatcatgtaataatgtggttgcattgaaagagcaatttttcatttcctccttcctgttcggagacccagcatggcgtat

SEQ ID NO: 406161 - DNA, 140 bp, Artificial Sequence
  Synthetic
atacgccatgctgggtctccagtataattaagtagtatatgtaatgaattatttaatagtaggaatagcagctttaatagtagcagctctactagcaataattgtgtggaccatagtatacgtacttgggagtcggccat

SEQ ID NO: 406162 - DNA, 140 bp, Artificial Sequence
  Synthetic
atggccgactcccaagtacgtatactatggtccacacaattattgctagtagagctgctactattaaagctgctattcctactattaaataattcattacatatactacttaattatactggagacccagcatggcgtat

SEQ ID NO: 406163 - DNA, 140 bp, Artificial Sequence
  Synthetic
atacgccatgctgggtctccggaactaaaaattagtgctatttctttgcttaatgctacagcaatagcagtagcggggtggacagatagggttatagaagtagcacaaagagcttggagacgtacttgggagtcggccat

SEQ ID NO: 406164 - DNA, 140 bp, Artificial Sequence
  Synthetic
atggccgactcccaagtacgtctccaagctctttgtgctacttctataaccctatctgtccaccccgctactgctattgctgtagcattaagcaaagaaatagcactaatttttagttccggagacccagcatggcgtat

SEQ ID NO: 406165 - DNA, 140 bp, Artificial Sequence
  Synthetic
aggccctggctgctgatatgtgctgaagtgcactcggcaagaggcgagagcggcggctggtgagtacgccaattttatttgactagcggaggctagaaggagagagatgggtgcgagagcgaccttttgggacagcggtg

SEQ ID NO: 406166 - DNA, 140 bp, Artificial Sequence
  Synthetic
caccgctgtcccaaaaggtcgctctcgcacccatctctctccttctagcctccgctagtcaaataaaattggcgtactcaccagccgccgctctcgcctcttgccgagtgcacttcagcacatatcagcagccagggcct

SEQ ID NO: 406167 - DNA, 140 bp, Artificial Sequence
  Synthetic
atacgccatgctgggtctccctctctgtgtcactttaaattgtaatgacatcacaaacagaaacggcagtgctgttgaagagatgagaaactgctctttcaatatgactacagaactaagcgtacttgggagtcggccat

SEQ ID NO: 406168 - DNA, 140 bp, Artificial Sequence
  Synthetic
atggccgactcccaagtacgcttagttctgtagtcatattgaaagagcagtttctcatctcttcaacagcactgccgtttctgtttgtgatgtcattacaatttaaagtgacacagagagggagacccagcatggcgtat

SEQ ID NO: 406169 - DNA, 140 bp, Artificial Sequence
  Synthetic
  misc_feature (21)..(21): n is a, c, g, or t
  misc_feature (87)..(87): n is a, c, g, or t
  misc_feature (93)..(93): n is a, c, g, or t
  misc_feature (105)..(105): n is a, c, g, or t
atacgccatgctgggtctccntttgtgctcaaattggcagcaagatggcctgtaaaagtgatacacacagacaatgggcctaacttnactagngctgcagtaaangcagcctgttggtggcgtacttgggagtcggccat

SEQ ID NO: 406170 - DNA, 140 bp, Artificial Sequence
  Synthetic
  misc_feature (36)..(36): n is a, c, g, or t
  misc_feature (48)..(48): n is a, c, g, or t
  misc_feature (54)..(54): n is a, c, g, or t
  misc_feature (120)..(120): n is a, c, g, or t
atggccgactcccaagtacgccaccaacaggctgcntttactgcagcnctagtnaagttaggcccattgtctgtgtgtatcacttttacaggccatcttgctgccaatttgagcacaaanggagacccagcatggcgtat

SEQ ID NO: 406171 - DNA, 140 bp, Artificial Sequence
  Synthetic
atacgccatgctgggtctcccctacaaacaatacaagaacaagtgtgcgtataggaccaggacaagtgttctatgcaacaggtgatataacaggaaatataaggaaagcacattgtaatgcgtacttgggagtcggccat

SEQ ID NO: 406172 - DNA, 140 bp, Artificial Sequence
  Synthetic
atggccgactcccaagtacgcattacaatgtgctttccttatatttcctgttatatcacctgttgcatagaacacttgtcctggtcctatacgcacacttgttcttgtattgtttgtaggggagacccagcatggcgtat

SEQ ID NO: 406173 - DNA, 140 bp, Artificial Sequence
  Synthetic
atacgccatgctgggtctccggaacagatagaattatacatttagtacaagcaatttgtagagctatccgcaacatacctcgcagaataagacagggcttggaagcatctttgcaataaacgtacttgggagtcggccat

SEQ ID NO: 406174 - DNA, 140 bp, Artificial Sequence
  Synthetic
atggccgactcccaagtacgtttattgcaaagatgcttccaagccctgtcttattctgcgaggtatgttgcggatagctctacaaattgcttgtactaaatgtataattctatctgttccggagacccagcatggcgtat

SEQ ID NO: 406175 - DNA, 140 bp, Artificial Sequence
  Synthetic
aggccctggctgctgatatgttttgggaaatgtaacagaaaattttaacatgtggaaaaatgacatggtggatcagatgcatgaagatataatcagtttatgggatcaaagcctaaagccgaccttttgggacagcggtg

SEQ ID NO: 406176 - DNA, 140 bp, Artificial Sequence
  Synthetic
caccgctgtcccaaaaggtcggctttaggctttgatcccataaactgattatatcttcatgcatctgatccaccatgtcatttttccacatgttaaaattttctgttacatttcccaaaacatatcagcagccagggcct

SEQ ID NO: 406177 - DNA, 140 bp, Artificial Sequence
  Synthetic
atacgccatgctgggtctccgatggagaaatgagaaattgctctttcaaaataaccacagaactaaaagataagaaacagaaagtgtatgcacttttttataaacttgatatagtatcaccgtacttgggagtcggccat

SEQ ID NO: 406178 - DNA, 140 bp, Artificial Sequence
  Synthetic
atggccgactcccaagtacggtgatactatatcaagtttataaaaaagtgcatacactttctgtttcttatcttttagttctgtggttattttgaaagagcaatttctcatttctccatcggagacccagcatggcgtat

SEQ ID NO: 406179 - DNA, 140 bp, Artificial Sequence
  Synthetic
atacgccatgctgggtctcccacttcaataaaacaataatgtttaaccaatcctcaggaggggacctagaagttacaacacatacctttaattgtggaggagaatttttctattgcaatacgtacttgggagtcggccat

SEQ ID NO: 406180 - DNA, 140 bp, Artificial Sequence
  Synthetic
atggccgactcccaagtacgtattgcaatagaaaaattctcctccacaattaaaggtatgtgttgtaacttctaggtcccctcctgaggattggttaaacattattgttttattgaagtgggagacccagcatggcgtat

SEQ ID NO: 406181 - DNA, 140 bp, Artificial Sequence
  Synthetic
aggccctggctgctgatatgtagtaggatggcctgagattagggaaagaataagacgaactcccccagcagcaacaggagtaggagcagtttctcaagatttagataaacatggagcagtgaccttttgggacagcggtg

SEQ ID NO: 406182 - DNA, 140 bp, Artificial Sequence
  Synthetic
caccgctgtcccaaaaggtcactgctccatgtttatctaaatcttgagaaactgctcctactcctgttgctgctgggggagttcgtcttattctttccctaatctcaggccatcctactacatatcagcagccagggcct

SEQ ID NO: 406183 - DNA, 140 bp, Artificial Sequence
  Synthetic
atacgccatgctgggtctcccctatttggaaaggaccagcgacgcttctgtggaaaggtgaaggggcagtagtcatacaagacaaaggagatattaaagtagtccctaggagaaaagcaacgtacttgggagtcggccat

SEQ ID NO: 406184 - DNA, 140 bp, Artificial Sequence
  Synthetic
atggccgactcccaagtacgttgcttttctcctagggactactttaatatctcctttgtcttgtatgactactgccccttcacctttccacagaagcgtcgctggtcctttccaaataggggagacccagcatggcgtat

SEQ ID NO: 406185 - DNA, 140 bp, Artificial Sequence
  Synthetic
atacgccatgctgggtctccaaccctctattgcgtacatcaaaggatagaggtaagagacaccaaagaagctctagataaaatagaggcactgcaaaacaaaagcaagcaaagaacacaacgtacttgggagtcggccat

SEQ ID NO: 406186 - DNA, 140 bp, Artificial Sequence
  Synthetic
atggccgactcccaagtacgttgtgttctttgcttgcttttgttttgcagtgcctctattttatctagagcttctttggtgtctcttacctctatcctttgatgtacgcaatagagggttggagacccagcatggcgtat

SEQ ID NO: 406187 - DNA, 140 bp, Artificial Sequence
  Synthetic
aggccctggctgctgatatggggactcgacaggctcggaagaatcgaagaagaaggtggagagcaagacagaaacagatccattcgattagtgaacggattcttagcacttgcctgggaagaccttttgggacagcggtg

SEQ ID NO: 406188 - DNA, 140 bp, Artificial Sequence
  Synthetic
caccgctgtcccaaaaggtcttcccaggcaagtgctaagaatccgttcactaatcgaatggatctgtttctgtcttgctctccaccttcttcttcgattcttccgagcctgtcgagtccccatatcagcagccagggcct

SEQ ID NO: 406189 - DNA, 140 bp, Artificial Sequence
  Synthetic
atacgccatgctgggtctcctaacaacagtagttgggacaagggagagatgaaaaaatgctctttcaatatcaccacaagcataagaggtaagatgcagaaagaatatgcacttttttatcgtacttgggagtcggccat

SEQ ID NO: 406190 - DNA, 140 bp, Artificial Sequence
  Synthetic
atggccgactcccaagtacgataaaaaagtgcatattctttctgcatcttacctcttatgcttgtggtgatattgaaagagcattttttcatctctcccttgtcccaactactgttgttaggagacccagcatggcgtat

SEQ ID NO: 406191 - DNA, 140 bp, Artificial Sequence
  Synthetic
aggccctggctgctgatatgtattggggtctagagctaaaaaggagtgctattagtctgcttgataccatagcaatagcagtagctgagggaacagatagaattatagaagtaatacaaagaccttttgggacagcggtg

SEQ ID NO: 406192 - DNA, 140 bp, Artificial Sequence
  Synthetic
caccgctgtcccaaaaggtctttgtattacttctataattctatctgttccctcagctactgctattgctatggtatcaagcagactaatagcactcctttttagctctagaccccaatacatatcagcagccagggcct

SEQ ID NO: 406193 - DNA, 140 bp, Artificial Sequence
  Synthetic
aggccctggctgctgatatgaagtgatatagcaggaactactagtacccttcaggaacaaataggatggatgacaagcaatccacctatcccagtgggagaaatctataaaagatggatagaccttttgggacagcggtg

SEQ ID NO: 406194 - DNA, 140 bp, Artificial Sequence
  Synthetic
caccgctgtcccaaaaggtctatccatcttttatagatttctcccactgggataggtggattgcttgtcatccatcctatttgttcctgaagggtactagtagttcctgctatatcacttcatatcagcagccagggcct

SEQ ID NO: 406195 - DNA, 140 bp, Artificial Sequence
  Synthetic
aggccctggctgctgatatggaagcagctttgcaataaaatggggggcaagtggtcaaaaagcagtatagttggatggcctgctgtaagagaaagaataagaagaactgatccagcagcagaccttttgggacagcggtg

SEQ ID NO: 406196 - DNA, 140 bp, Artificial Sequence
  Synthetic
caccgctgtcccaaaaggtctgctgctggatcagttcttcttattctttctcttacagcaggccatccaactatactgctttttgaccacttgccccccattttattgcaaagctgcttccatatcagcagccagggcct

SEQ ID NO: 406197 - DNA, 140 bp, Artificial Sequence
  Synthetic
aggccctggctgctgatatggagggagtaggagcagcgtctcaagacttagataaatatggagcacttacaagcagcaacacagccaccaataatgctgactgtgcctggctggaagcgcgaccttttgggacagcggtg

SEQ ID NO: 406198 - DNA, 140 bp, Artificial Sequence
  Synthetic
caccgctgtcccaaaaggtcgcgcttccagccaggcacagtcagcattattggtggctgtgttgctgcttgtaagtgctccatatttatctaagtcttgagacgctgctcctactccctccatatcagcagccagggcct

SEQ ID NO: 406199 - DNA, 140 bp, Artificial Sequence
  Synthetic
aggccctggctgctgatatgcaatagtctttaatcaatcctcaggaggggacccagaaattgtaatgcacagctttaattgtggaggggaatttttctactgtaatacaacacaactgttgaccttttgggacagcggtg

SEQ ID NO: 406200 - DNA, 140 bp, Artificial Sequence
  Synthetic
caccgctgtcccaaaaggtcaacagttgtgttgtattacagtagaaaaattcccctccacaattaaagctgtgcattacaatttctgggtcccctcctgaggattgattaaagactattgcatatcagcagccagggcct

SEQ ID NO: 406201 - DNA, 140 bp, Artificial Sequence
  Synthetic
atacgccatgctgggtctccagggaaagtttggccttccaacagaggaaggccagggaactttccccagaaaagactggagccaacagccccgccagcagagagcctagggatgggggaacgtacttgggagtcggccat

SEQ ID NO: 406202 - DNA, 140 bp, Artificial Sequence
  Synthetic
atggccgactcccaagtacgttcccccatccctaggctctctgctggcggggctgttggctccagtcttttctggggaaagttccctggccttcctctgttggaaggccaaactttccctggagacccagcatggcgtat

SEQ ID NO: 406203 - DNA, 140 bp, Artificial Sequence
  Synthetic
atacgccatgctgggtctccacaccctcatactcccatgcaaaataaaacaaattataaacatgtggcaagaggtaggaaaagcaatgtatgcccctcccatccaagggataattagctgcgtacttgggagtcggccat

SEQ ID NO: 406204 - DNA, 140 bp, Artificial Sequence
  Synthetic
atggccgactcccaagtacgcagctaattatcccttggatgggaggggcatacattgcttttcctacctcttgccacatgtttataatttgttttattttgcatgggagtatgagggtgtggagacccagcatggcgtat

SEQ ID NO: 406205 - DNA, 140 bp, Artificial Sequence
  Synthetic
aggccctggctgctgatatggctacactagaagaaatgatgacagcatgtcagggagtggggggacccggccataaagcaagagtcttagctgaagcaatgagccaagtaacaaattcaggaccttttgggacagcggtg

SEQ ID NO: 406206 - DNA, 140 bp, Artificial Sequence
  Synthetic
caccgctgtcccaaaaggtcctgaatttgttacttggctcattgcttcagctaagactcttgctttatggccgggtccccccactccctgacatgctgtcatcatttcttctagtgtagccatatcagcagccagggcct

SEQ ID NO: 406207 - DNA, 140 bp, Artificial Sequence
  Synthetic
aggccctggctgctgatatgcactatcatacttccatgcaggataaagcaaattataaacatgtggcagggagtaggacaagcaatgtatgctcctcccatcagtggaagaattaattgtgaccttttgggacagcggtg

SEQ ID NO: 406208 - DNA, 140 bp, Artificial Sequence
  Synthetic
caccgctgtcccaaaaggtcacaattaattcttccactgatgggaggagcatacattgcttgtcctactccctgccacatgtttataatttgctttatcctgcatggaagtatgatagtgcatatcagcagccagggcct

SEQ ID NO: 406209 - DNA, 140 bp, Artificial Sequence
  Synthetic
atacgccatgctgggtctcctataaccaacaatgctaatataaccaactataataatgaaactgacatgagaaattgctctttcaatataaccacagaattaagagataagaggaggcaacgtacttgggagtcggccat

SEQ ID NO: 406210 - DNA, 140 bp, Artificial Sequence
  Synthetic
atggccgactcccaagtacgttgcctcctcttatctcttaattctgtggttatattgaaagagcaatttctcatgtcagtttcattattatagttggttatattagcattgttggttataggagacccagcatggcgtat

SEQ ID NO: 406211 - DNA, 140 bp, Artificial Sequence
  Synthetic
aggccctggctgctgatatgtaatgaatctgtagaaattgtgtgtacaagacccaacaataatacaaggaaaagtgtgaggataggaccaggacaaacattctatgcaacaggagaaatagaccttttgggacagcggtg

SEQ ID NO: 406212 - DNA, 140 bp, Artificial Sequence
  Synthetic
caccgctgtcccaaaaggtctatttctcctgttgcatagaatgtttgtcctggtcctatcctcacacttttccttgtattattgttgggtcttgtacacacaatttctacagattcattacatatcagcagccagggcct

SEQ ID NO: 406213 - DNA, 140 bp, Artificial Sequence
  Synthetic
aggccctggctgctgatatgaaacaataagctttgcaccatcctcaggaggggacctagaaattacaacacatagctttaattgtagaggagaatttttctattgcaatacatcaaaactgaccttttgggacagcggtg

SEQ ID NO: 406214 - DNA, 140 bp, Artificial Sequence
  Synthetic
caccgctgtcccaaaaggtcagttttgatgtattgcaatagaaaaattctcctctacaattaaagctatgtgttgtaatttctaggtcccctcctgaggatggtgcaaagcttattgtttcatatcagcagccagggcct

SEQ ID NO: 406215 - DNA, 140 bp, Artificial Sequence
  Synthetic
aggccctggctgctgatatgtttttcagactctgctataagaaatgccttattaggacgcatagttagacataggtgtgagtaccaagcaggacacaataaggtaggatctctacagtacgaccttttgggacagcggtg

SEQ ID NO: 406216 - DNA, 140 bp, Artificial Sequence
  Synthetic
caccgctgtcccaaaaggtcgtactgtagagatcctaccttattgtgtcctgcttggtactcacacctatgtctaactatgcgtcctaataaggcatttcttatagcagagtctgaaaaacatatcagcagccagggcct

SEQ ID NO: 406217 - DNA, 140 bp, Artificial Sequence
  Synthetic
atacgccatgctgggtctcctagtaaggagaatgaaacaacccacaatgggacctacaacaatgatgagatcaaaaattgctctttcaatgcaaccccagaagtaaaagataggaaggagcgtacttgggagtcggccat

SEQ ID NO: 406218 - DNA, 140 bp, Artificial Sequence
  Synthetic
atggccgactcccaagtacgctccttcctatcttttacttctggggttgcattgaaagagcaatttttgatctcatcattgttgtaggtcccattgtgggttgtttcattctccttactaggagacccagcatggcgtat

SEQ ID NO: 406219 - DNA, 140 bp, Artificial Sequence
  Synthetic
aggccctggctgctgatatgaacatattggggcctgcaaacaggagaaagagactggcacttgggtcatggggtctccatagaatggcaactgaaaaggtatagtacacaaatagaccctgaccttttgggacagcggtg

SEQ ID NO: 406220 - DNA, 140 bp, Artificial Sequence
  Synthetic
caccgctgtcccaaaaggtcagggtctatttgtgtactataccttttcagttgccattctatggagaccccatgacccaagtgccagtctctttctcctgtttgcaggccccaatatgttcatatcagcagccagggcct

SEQ ID NO: 406221 - DNA, 140 bp, Artificial Sequence
  Synthetic
atacgccatgctgggtctccaagaatcttgcaccagctactatttatccattacagaattgggtgccaacatagcagaataggcattattcgaagcagaagaaggagggatggaactggtcgtacttgggagtcggccat

SEQ ID NO: 406222 - DNA, 140 bp, Artificial Sequence
  Synthetic
atggccgactcccaagtacgaccagttccatccctccttcttctgcttcgaataatgcctattctgctatgttggcacccaattctgtaatggataaatagtagctggtgcaagattcttggagacccagcatggcgtat

SEQ ID NO: 406223 - DNA, 140 bp, Artificial Sequence
  Synthetic
aggccctggctgctgatatgatagcagaataggcattattcgaagcagaagaaggagggatggaactggtagatcctaacctagagccctggaagcatccgggaagtcagcctaaaactcgaccttttgggacagcggtg

SEQ ID NO: 406224 - DNA, 140 bp, Artificial Sequence
  Synthetic
caccgctgtcccaaaaggtcgagttttaggctgacttcccggatgcttccagggctctaggttaggatctaccagttccatccctccttcttctgcttcgaataatgcctattctgctatcatatcagcagccagggcct

SEQ ID NO: 406225 - DNA, 140 bp, Artificial Sequence
  Synthetic
aggccctggctgctgatatgccgacgaggaacttctcacagcagtaaggatcatcaaaatcatataccaaagcagtgagtacatgtaatgtctcttttggaaatatggtcaataatagcagaccttttgggacagcggtg

SEQ ID NO: 406226 - DNA, 140 bp, Artificial Sequence
  Synthetic
caccgctgtcccaaaaggtctgctattattgaccatatttccaaaagagacattacatgtactcactgctttggtatatgattttgatgatccttactgctgtgagaagttcctcgtcggcatatcagcagccagggcct

SEQ ID NO: 406227 - DNA, 140 bp, Artificial Sequence
  Synthetic
atacgccatgctgggtctccagaatataggaaactgagaaagcaaagaaaaatagacaggctgattgaaagaataagagaaagagcagaagacagtggcaatgaaagcgagggggatacacgtacttgggagtcggccat

SEQ ID NO: 406228 - DNA, 140 bp, Artificial Sequence
  Synthetic
atggccgactcccaagtacgtgtatccccctcgctttcattgccactgtcttctgctctttctcttattctttcaatcagcctgtctatttttctttgctttctcagtttcctatattctggagacccagcatggcgtat

SEQ ID NO: 406229 - DNA, 140 bp, Artificial Sequence
  Synthetic
atacgccatgctgggtctcctaccaatagtagtagttgggaaaagatggagggagaaataaaaaactgctctttcaatatcacctcaagcataagagataaggtgaaaaaagaatatgcacgtacttgggagtcggccat

SEQ ID NO: 406230 - DNA, 140 bp, Artificial Sequence
  Synthetic
atggccgactcccaagtacgtgcatattcttttttcaccttatctcttatgcttgaggtgatattgaaagagcagttttttatttctccctccatcttttcccaactactactattggtaggagacccagcatggcgtat

SEQ ID NO: 406231 - DNA, 140 bp, Artificial Sequence
  Synthetic
aggccctggctgctgatatgaattttaacatgtggaaaaataatatggtagagcagatgcatgaagatataatcagtttatgggatcaaagcttaaagccatgtgtaaagttaacccctcgaccttttgggacagcggtg

SEQ ID NO: 406232 - DNA, 140 bp, Artificial Sequence
  Synthetic
caccgctgtcccaaaaggtcgaggggttaactttacacatggctttaagctttgatcccataaactgattatatcttcatgcatctgctctaccatattatttttccacatgttaaaattcatatcagcagccagggcct

SEQ ID NO: 406233 - DNA, 140 bp, Artificial Sequence
  Synthetic
aggccctggctgctgatatgacatagctttaattgtggaggagaatttttctattgcaataccacaaaactgtttaatagtacacataatagtactgatagtacagtaaatagtactgatgaccttttgggacagcggtg

SEQ ID NO: 406234 - DNA, 140 bp, Artificial Sequence
  Synthetic
caccgctgtcccaaaaggtcatcagtactatttactgtactatcagtactattatgtgtactattaaacagttttgtggtattgcaatagaaaaattctcctccacaattaaagctatgtcatatcagcagccagggcct

SEQ ID NO: 406235 - DNA, 140 bp, Artificial Sequence
  Synthetic
atacgccatgctgggtctccaatgacaaactgctctttcaatgtgaccacagcaataagagataaacaacagaaagtacattctctcttttataaggttgatttagtacaattaggggaacgtacttgggagtcggccat

SEQ ID NO: 406236 - DNA, 140 bp, Artificial Sequence
  Synthetic
atggccgactcccaagtacgttcccctaattgtactaaatcaaccttataaaagagagaatgtactttctgttgtttatctcttattgctgtggtcacattgaaagagcagtttgtcattggagacccagcatggcgtat

SEQ ID NO: 406237 - DNA, 140 bp, Artificial Sequence
  Synthetic
aggccctggctgctgatatgaattaattgtacaagacccaacaacaatacaagcaaaagtatacatataggacctgggagagcagtttatgcaacagatagaataataggagatataagagaccttttgggacagcggtg

SEQ ID NO: 406238 - DNA, 140 bp, Artificial Sequence
  Synthetic
caccgctgtcccaaaaggtctcttatatctcctattattctatctgttgcataaactgctctcccaggtcctatatgtatacttttgcttgtattgttgttgggtcttgtacaattaattcatatcagcagccagggcct

SEQ ID NO: 406239 - DNA, 140 bp, Artificial Sequence
  Synthetic
atacgccatgctgggtctccgacctgggagagcagtttatgcaacagatagaataataggagatataagacaagcacattgtaacattagtagagcaaaatggaacaccactttagaacacgtacttgggagtcggccat

SEQ ID NO: 406240 - DNA, 140 bp, Artificial Sequence
  Synthetic
atggccgactcccaagtacgtgttctaaagtggtgttccattttgctctactaatgttacaatgtgcttgtcttatatctcctattattctatctgttgcataaactgctctcccaggtcggagacccagcatggcgtat

SEQ ID NO: 406241 - DNA, 140 bp, Artificial Sequence
  Synthetic
aggccctggctgctgatatggacctacacctgtcaacataattggaagaaatatgttgactcagattggttgcactttaaattttccaattagtcctattgaaactgtaccagtaaaattgaccttttgggacagcggtg

SEQ ID NO: 406242 - DNA, 140 bp, Artificial Sequence
  Synthetic
caccgctgtcccaaaaggtcaattttactggtacagtttcaataggactaattggaaaatttaaagtgcaaccaatctgagtcaacatatttcttccaattatgttgacaggtgtaggtccatatcagcagccagggcct

SEQ ID NO: 406243 - DNA, 140 bp, Artificial Sequence
  Synthetic
atacgccatgctgggtctcccaggacaagtattttatgcaacaggaggcataataggggatataagaaaagccttctgtatagtcaatgcaacagaatgggatacaactataagcagggtcgtacttgggagtcggccat

SEQ ID NO: 406244 - DNA, 140 bp, Artificial Sequence
  Synthetic
atggccgactcccaagtacgaccctgcttatagttgtatcccattctgttgcattgactatacagaaggcttttcttatatcccctattatgcctcctgttgcataaaatacttgtcctgggagacccagcatggcgtat

SEQ ID NO: 406245 - DNA, 140 bp, Artificial Sequence
  Synthetic
aggccctggctgctgatatggccttctgtatagtcaatgcaacagaatgggatacaactataagcagggtgagggaacaattacgagcacacttcccaaataaaacaatagtttttgctagaccttttgggacagcggtg

SEQ ID NO: 406246 - DNA, 140 bp, Artificial Sequence
  Synthetic
caccgctgtcccaaaaggtctagcaaaaactattgttttatttgggaagtgtgctcgtaattgttccctcaccctgcttatagttgtatcccattctgttgcattgactatacagaaggccatatcagcagccagggcct

SEQ ID NO: 406247 - DNA, 140 bp, Artificial Sequence
  Synthetic
atacgccatgctgggtctccggagaatttttttattgcaatacatcaggtctgaataataactcttggggaactaaaaatatcattgccaatagcaccataattcttttatcctgcagaacgtacttgggagtcggccat

SEQ ID NO: 406248 - DNA, 140 bp, Artificial Sequence
  Synthetic
atggccgactcccaagtacgttctgcaggataaaagaattatggtgctattggcaatgatatttttagttccccaagagttattattcagacctgatgtattgcaataaaaaaattctccggagacccagcatggcgtat

SEQ ID NO: 406249 - DNA, 140 bp, Artificial Sequence
  Synthetic
atacgccatgctgggtctccgaagaactgagccagcagcagaaggagtaggagcagcgtctcaagacttagatagacgtggagcacttacaagtaacaacacagataccactaatgctgacgtacttgggagtcggccat

SEQ ID NO: 406250 - DNA, 140 bp, Artificial Sequence
  Synthetic
atggccgactcccaagtacgtcagcattagtggtatctgtgttgttacttgtaagtgctccacgtctatctaagtcttgagacgctgctcctactccttctgctgctggctcagttcttcggagacccagcatggcgtat

SEQ ID NO: 406251 - DNA, 140 bp, Artificial Sequence
  Synthetic
atacgccatgctgggtctcctacaacaaattaatatgtggcagagagtagtacaaccaatgtataaccctcccatagaaggattaataatatgttaatcaactattacagcactattattcgtacttgggagtcggccat

SEQ ID NO: 406252 - DNA, 140 bp, Artificial Sequence
  Synthetic
atggccgactcccaagtacgaataatagtgctgtaatagttgattaacatattattaatccttctatgggagggttatacattggttgtactactctctgccacatattaatttgttgtaggagacccagcatggcgtat

SEQ ID NO: 406253 - DNA, 140 bp, Artificial Sequence
  Synthetic
atacgccatgctgggtctccttgctataaaatggggggcaagtggtcaaaaagtagcatagtagggtggcctgctgtaagggaaaaattaaaacaaacccctccagcagcagaaggggtgcgtacttgggagtcggccat

SEQ ID NO: 406254 - DNA, 140 bp, Artificial Sequence
  Synthetic
atggccgactcccaagtacgcaccccttctgctgctggaggggtttgttttaatttttcccttacagcaggccaccctactatgctactttttgaccacttgccccccattttatagcaaggagacccagcatggcgtat

SEQ ID NO: 406255 - DNA, 140 bp, Artificial Sequence
  Synthetic
aggccctggctgctgatatgacggtacaggccagacaattattgtctggtatagtgcaacagcaaagcaatttgctgaaggctatagaggctcaacaacatctgttgaaactcacagtctgaccttttgggacagcggtg

SEQ ID NO: 406256 - DNA, 140 bp, Artificial Sequence
  Synthetic
caccgctgtcccaaaaggtcagactgtgagtttcaacagatgttgttgagcctctatagccttcagcaaattgctttgctgttgcactataccagacaataattgtctggcctgtaccgtcatatcagcagccagggcct

SEQ ID NO: 406257 - DNA, 140 bp, Artificial Sequence
  Synthetic
atacgccatgctgggtctcccttatatccactttaatggtactgttatccacaataatagggatggaaaaataaagaattgcactttcaatgcaaccacagagataagagataagagtagcgtacttgggagtcggccat

SEQ ID NO: 406258 - DNA, 140 bp, Artificial Sequence
  Synthetic
atggccgactcccaagtacgctactcttatctcttatctctgtggttgcattgaaagtgcaattctttatttttccatccctattattgtggataacagtaccattaaagtggatataagggagacccagcatggcgtat

SEQ ID NO: 406259 - DNA, 140 bp, Artificial Sequence
  Synthetic
atacgccatgctgggtctccatatttgaagaaacatgacctagatgcaataggataaagaagttagcaagtacacaaacacaatatacatgctaattgaagaatcgcagcaacaacaggacgtacttgggagtcggccat

SEQ ID NO: 406260 - DNA, 140 bp, Artificial Sequence
  Synthetic
atggccgactcccaagtacgtcctgttgttgctgcgattcttcaattagcatgtatattgtgtttgtgtacttgctaacttctttatcctattgcatctaggtcatgtttcttcaaatatggagacccagcatggcgtat

SEQ ID NO: 406261 - DNA, 140 bp, Artificial Sequence
  Synthetic
aggccctggctgctgatatgacattattgtgctccagctggttatgcgattctaaagtgtaataataagacattcaatggaacaggaccatgcaataatgtcagcacagtacaatgtacagaccttttgggacagcggtg

SEQ ID NO: 406262 - DNA, 140 bp, Artificial Sequence
  Synthetic
caccgctgtcccaaaaggtctgtacattgtactgtgctgacattattgcatggtcctgttccattgaatgtcttattattacactttagaatcgcataaccagctggagcacaataatgtcatatcagcagccagggcct

SEQ ID NO: 406263 - DNA, 140 bp, Artificial Sequence
  Synthetic
atacgccatgctgggtctccgtggcgcccgaacagggacttgaaaacgaaagtaagaccagaggagatctctcgacgcaggactcggcttgctgaagaagtgcgcacggcaagaggcgagcgtacttgggagtcggccat

SEQ ID NO: 406264 - DNA, 140 bp, Artificial Sequence
  Synthetic
atggccgactcccaagtacgctcgcctcttgccgtgcgcacttcttcagcaagccgagtcctgcgtcgagagatctcctctggtcttactttcgttttcaagtccctgttcgggcgccacggagacccagcatggcgtat

SEQ ID NO: 406265 - DNA, 140 bp, Artificial Sequence
  Synthetic
aggccctggctgctgatatgcttctcccattgcaggaaacataacatgtaaatcgaatatcacaggaatactattgacacgtgatggagggaaggggaattatactgatagtagtcaagagaccttttgggacagcggtg

SEQ ID NO: 406266 - DNA, 140 bp, Artificial Sequence
  Synthetic
caccgctgtcccaaaaggtctcttgactactatcagtataattccccttccctccatcacgtgtcaatagtattcctgtgatattcgatttacatgttatgtttcctgcaatgggagaagcatatcagcagccagggcct

SEQ ID NO: 406267 - DNA, 140 bp, Artificial Sequence
  Synthetic
atacgccatgctgggtctccatggagcaattacaagcagtaacacagctgctactaactcagattgtgcttggctggaggcgcaagaggaaggggaggtaggctttccagtcaagccgcacgtacttgggagtcggccat

SEQ ID NO: 406268 - DNA, 140 bp, Artificial Sequence
  Synthetic
atggccgactcccaagtacgtgcggcttgactggaaagcctacctccccttcctcttgcgcctccagccaagcacaatctgagttagtagcagctgtgttactgcttgtaattgctccatggagacccagcatggcgtat

SEQ ID NO: 406269 - DNA, 140 bp, Artificial Sequence
  Synthetic
aggccctggctgctgatatgtggctggaggcgcaagaggaaggggaggtaggctttccagtcaagccgcaaggacctttaaggccaatggcctataaggcaccatttgatctgagccactgaccttttgggacagcggtg

SEQ ID NO: 406270 - DNA, 140 bp, Artificial Sequence
  Synthetic
caccgctgtcccaaaaggtcagtggctcagatcaaatggtgccttataggccattggccttaaaggtccttgcggcttgactggaaagcctacctccccttcctcttgcgcctccagccacatatcagcagccagggcct

SEQ ID NO: 406271 - DNA, 140 bp, Artificial Sequence
  Synthetic
aggccctggctgctgatatgaatacagtagcaaccctctattgtgtgcatcaaaggatagatgtaaaagacaccaaggaagctttagacaagatagaggaagagcaaaacaaaagtaagagaccttttgggacagcggtg

SEQ ID NO: 406272 - DNA, 140 bp, Artificial Sequence
  Synthetic
caccgctgtcccaaaaggtctcttacttttgttttgctcttcctctatcttgtctaaagcttccttggtgtcttttacatctatcctttgatgcacacaatagagggttgctactgtattcatatcagcagccagggcct

SEQ ID NO: 406273 - DNA, 140 bp, Artificial Sequence
  Synthetic
atacgccatgctgggtctcctgctagtggaatacactatgttactgtatattatggggttccagtttggagaaatgctgaagttaccttgttttgtgcagcagatgcatcgctaactagccgtacttgggagtcggccat

SEQ ID NO: 406274 - DNA, 140 bp, Artificial Sequence
  Synthetic
atggccgactcccaagtacggctagttagcgatgcatctgctgcacaaaacaaggtaacttcagcatttctccaaactggaaccccataatatacagtaacatagtgtattccactagcaggagacccagcatggcgtat

SEQ ID NO: 406275 - DNA, 140 bp, Artificial Sequence
  Synthetic
atacgccatgctgggtctccgtagcaaccctctattgcgtacatcagaagatagagataaaagacaccaaggaagccttagataaaatagaagaactgcaaaacaaaagccagcaaaagacgtacttgggagtcggccat

SEQ ID NO: 406276 - DNA, 140 bp, Artificial Sequence
  Synthetic
atggccgactcccaagtacgtcttttgctggcttttgttttgcagttcttctattttatctaaggcttccttggtgtcttttatctctatcttctgatgtacgcaatagagggttgctacggagacccagcatggcgtat

SEQ ID NO: 406277 - DNA, 140 bp, Artificial Sequence
  Synthetic
atacgccatgctgggtctccgaaataaaaaactgctctttccaagttaccacaagtagaagagataagacgcagaaaaaatatgcacttttttataaacttgatgtggtaccaatagagacgtacttgggagtcggccat

SEQ ID NO: 406278 - DNA, 140 bp, Artificial Sequence
  Synthetic
atggccgactcccaagtacgtctctattggtaccacatcaagtttataaaaaagtgcatattttttctgcgtcttatctcttctacttgtggtaacttggaaagagcagttttttatttcggagacccagcatggcgtat

SEQ ID NO: 406279 - DNA, 140 bp, Artificial Sequence
  Synthetic
aggccctggctgctgatatgcttaaatatctggcaagtcttgtacagtattggggtctagagttaaaaaagagtgctattagtttaattgataccatagcaatagtagtagctgaaggaagaccttttgggacagcggtg

SEQ ID NO: 406280 - DNA, 140 bp, Artificial Sequence
  Synthetic
caccgctgtcccaaaaggtcttccttcagctactactattgctatggtatcaattaaactaatagcactcttttttaactctagaccccaatactgtacaagacttgccagatatttaagcatatcagcagccagggcct

SEQ ID NO: 406281 - DNA, 140 bp, Artificial Sequence
  Synthetic
aggccctggctgctgatatgatgctgcttgtgcctgggtggaagcacaggaggagggaaaagaggtaagctttccagtcagacctcaagtacctttaagaccaatgacttataaggcagcgaccttttgggacagcggtg

SEQ ID NO: 406282 - DNA, 140 bp, Artificial Sequence
  Synthetic
caccgctgtcccaaaaggtcgctgccttataagtcattggtcttaaaggtacttgaggtctgactggaaagcttacctcttttccctcctcctgtgcttccacccaggcacaagcagcatcatatcagcagccagggcct

SEQ ID NO: 406283 - DNA, 140 bp, Artificial Sequence
  Synthetic
atacgccatgctgggtctccaaaattatatggtgacacaaatgcaggaagacatcattagcttatgggatcagagccttaaaccttgtgtaaaattgacaatcctatgtgtcactatgaacgtacttgggagtcggccat

SEQ ID NO: 406284 - DNA, 140 bp, Artificial Sequence
  Synthetic
atggccgactcccaagtacgttcatagtgacacataggattgtcaattttacacaaggtttaaggctctgatcccataagctaatgatgtcttcctgcatttgtgtcaccatataattttggagacccagcatggcgtat

SEQ ID NO: 406285 - DNA, 140 bp, Artificial Sequence
  Synthetic
atacgccatgctgggtctccttgaggggtaatagtagtgagacctacaaagatgaggaaatgaaaaattgctctttcaatgcaaccacaatactaagagacaagaagcaggaagtgtatgcgtacttgggagtcggccat

SEQ ID NO: 406286 - DNA, 140 bp, Artificial Sequence
  Synthetic
atggccgactcccaagtacgcatacacttcctgcttcttgtctcttagtattgtggttgcattgaaagagcaatttttcatttcctcatctttgtaggtctcactactattacccctcaaggagacccagcatggcgtat

SEQ ID NO: 406287 - DNA, 140 bp, Artificial Sequence
  Synthetic
atacgccatgctgggtctcctaataccatggatactgtaatgaaaaattgctctttcaatgtaaccacagaactgagagataaaagaaagcaagaacatgcacttttttatagacttgatcgtacttgggagtcggccat

SEQ ID NO: 406288 - DNA, 140 bp, Artificial Sequence
  Synthetic
atggccgactcccaagtacgatcaagtctataaaaaagtgcatgttcttgctttcttttatctctcagttctgtggttacattgaaagagcaatttttcattacagtatccatggtattaggagacccagcatggcgtat

SEQ ID NO: 406289 - DNA, 140 bp, Artificial Sequence
  Synthetic
aggccctggctgctgatatgaatcagatctgaaaatctcacaaacaatgccaaaaccataatagtgcaccttaataaatctgtagaaatcaattgtaccagaccctccaacaatacaagagaccttttgggacagcggtg

SEQ ID NO: 406290 - DNA, 140 bp, Artificial Sequence
  Synthetic
caccgctgtcccaaaaggtctcttgtattgttggagggtctggtacaattgatttctacagatttattaaggtgcactattatggttttggcattgtttgtgagattttcagatctgattcatatcagcagccagggcct

SEQ ID NO: 406291 - DNA, 140 bp, Artificial Sequence
  Synthetic
aggccctggctgctgatatgtgggagtttgtcaatacccctcctctagtaaaattatggtaccagttagaaaaagaccccatagtaggagcagaaactttctatgtagatggggcagctagaccttttgggacagcggtg

SEQ ID NO: 406292 - DNA, 140 bp, Artificial Sequence
  Synthetic
caccgctgtcccaaaaggtctagctgccccatctacatagaaagtttctgctcctactatggggtctttttctaactggtaccataattttactagaggaggggtattgacaaactcccacatatcagcagccagggcct

SEQ ID NO: 406293 - DNA, 140 bp, Artificial Sequence
  Synthetic
aggccctggctgctgatatgcaatagtaggagtaatagtagcaattttcttagcaatagttgtgtggaccatagtatatatagaatataagaggctggtaaggcaaaagaaaatagataggaccttttgggacagcggtg

SEQ ID NO: 406294 - DNA, 140 bp, Artificial Sequence
  Synthetic
caccgctgtcccaaaaggtcctatctattttcttttgccttaccagcctcttatattctatatatactatggtccacacaactattgctaagaaaattgctactattactcctactattgcatatcagcagccagggcct

SEQ ID NO: 406295 - DNA, 140 bp, Artificial Sequence
  Synthetic
atacgccatgctgggtctccactcatccacaggaggggacttagaaattacaacccatagctttaattgtggaggagagtttttctattgcaatacatcaaaactgtttaacagtacgttcgtacttgggagtcggccat

SEQ ID NO: 406296 - DNA, 140 bp, Artificial Sequence
  Synthetic
atggccgactcccaagtacgaacgtactgttaaacagttttgatgtattgcaatagaaaaactctcctccacaattaaagctatgggttgtaatttctaagtcccctcctgtggatgagtggagacccagcatggcgtat

SEQ ID NO: 406297 - DNA, 140 bp, Artificial Sequence
  Synthetic
aggccctggctgctgatatggacagcgacgaagcactcctccaagcagtgaggatcatcaaaatcctatatcaaagcagtaagtatatgtaatgttagatttactagcaagagtagattagaccttttgggacagcggtg

SEQ ID NO: 406298 - DNA, 140 bp, Artificial Sequence
  Synthetic
caccgctgtcccaaaaggtctaatctactcttgctagtaaatctaacattacatatacttactgctttgatataggattttgatgatcctcactgcttggaggagtgcttcgtcgctgtccatatcagcagccagggcct

SEQ ID NO: 406299 - DNA, 140 bp, Artificial Sequence
  Synthetic
atacgccatgctgggtctccatgtgtaaagttgaccccactctgtgtcactttagattgtagagactataatggtaccattaatgaaataaaaaactgctctttcaatgcaaccacagaacgtacttgggagtcggccat

SEQ ID NO: 406300 - DNA, 140 bp, Artificial Sequence
  Synthetic
atggccgactcccaagtacgttctgtggttgcattgaaagagcagttttttatttcattaatggtaccattatagtctctacaatctaaagtgacacagagtggggtcaactttacacatggagacccagcatggcgtat

SEQ ID NO: 406301 - DNA, 140 bp, Artificial Sequence
  Synthetic
aggccctggctgctgatatgtcaaaatgtgtcagacacaagatatgttatcatagtaaaattaaataagaatgtgtcaatcacctgtgtaagaccaggtaataacacaagaggacaagtggaccttttgggacagcggtg

SEQ ID NO: 406302 - DNA, 140 bp, Artificial Sequence
  Synthetic
caccgctgtcccaaaaggtccacttgtcctcttgtgttattacctggtcttacacaggtgattgacacattcttatttaattttactatgataacatatcttgtgtctgacacattttgacatatcagcagccagggcct

SEQ ID NO: 406303 - DNA, 140 bp, Artificial Sequence
  Synthetic
aggccctggctgctgatatgtgaaagcattagtaacaccaacaagagcaaagccacctttgcctagtgttaggaaattaacagaggatagatggaacaagccccagaagaccaggggccagaccttttgggacagcggtg

SEQ ID NO: 406304 - DNA, 140 bp, Artificial Sequence
  Synthetic
caccgctgtcccaaaaggtctggcccctggtcttctggggcttgttccatctatcctctgttaatttcctaacactaggcaaaggtggctttgctcttgttggtgttactaatgctttcacatatcagcagccagggcct

SEQ ID NO: 406305 - DNA, 140 bp, Artificial Sequence
  Synthetic
atacgccatgctgggtctccacatagcagaataggcattactccaagcagaggagtaaggaatggagccagtagatcctaacctagagccctgggagcatccgggaagtcagcctaaaaccgtacttgggagtcggccat

SEQ ID NO: 406306 - DNA, 140 bp, Artificial Sequence
  Synthetic
atggccgactcccaagtacggttttaggctgacttcccggatgctcccagggctctaggttaggatctactggctccattccttactcctctgcttggagtaatgcctattctgctatgtggagacccagcatggcgtat

SEQ ID NO: 406307 - DNA, 140 bp, Artificial Sequence
  Synthetic
atacgccatgctgggtctccgctttgtaaacaaaggcttaggcatctcatatggcaggaagaagcggaagctccgacgcagaactcctcgcagcaataaggatcatcaaaatcctatacccgtacttgggagtcggccat

SEQ ID NO: 406308 - DNA, 140 bp, Artificial Sequence
  Synthetic
atggccgactcccaagtacgggtataggattttgatgatccttattgctgcgaggagttctgcgtcggagcttccgcttcttcctgccatatgagatgcctaagcctttgtttacaaagcggagacccagcatggcgtat

SEQ ID NO: 406309 - DNA, 140 bp, Artificial Sequence
  Synthetic
aggccctggctgctgatatgctccgacgcagaactcctcgcagcaataaggatcatcaaaatcctataccaaagcagtaagtataattagttagcctatgtaatgaatcctttaatctgggaccttttgggacagcggtg

SEQ ID NO: 406310 - DNA, 140 bp, Artificial Sequence
  Synthetic
caccgctgtcccaaaaggtcccagattaaaggattcattacataggctaactaattatacttactgctttggtataggattttgatgatccttattgctgcgaggagttctgcgtcggagcatatcagcagccagggcct

SEQ ID NO: 406311 - DNA, 140 bp, Artificial Sequence
  Synthetic
atacgccatgctgggtctccataatgccactaatatcaatagtactagcaccaatagtagtagtttggaagagatgaaaaactgctctttcaatatcacctcaagcataagaaatgcagtcgtacttgggagtcggccat

SEQ ID NO: 406312 - DNA, 140 bp, Artificial Sequence
  Synthetic
atggccgactcccaagtacgactgcatttcttatgcttgaggtgatattgaaagagcagtttttcatctcttccaaactactactattggtgctagtactattgatattagtggcattatggagacccagcatggcgtat

SEQ ID NO: 406313 - DNA, 140 bp, Artificial Sequence
  Synthetic
atacgccatgctgggtctcctatagcatttatagaatataagaaattgagaaagcaaaggaaaatagattggttaattgaaagaataagagaaagagcagaagacagtggcaatgaaagtcgtacttgggagtcggccat

SEQ ID NO: 406314 - DNA, 140 bp, Artificial Sequence
  Synthetic
atggccgactcccaagtacgactttcattgccactgtcttctgctctttctcttattctttcaattaaccaatctattttcctttgctttctcaatttcttatattctataaatgctataggagacccagcatggcgtat

SEQ ID NO: 406315 - DNA, 140 bp, Artificial Sequence
  Synthetic
aggccctggctgctgatatgggttaattgaaagaataagagaaagagcagaagacagtggcaatgaaagtgagggggatacagaggaactctcaacacttatggagatggggaaccttgagaccttttgggacagcggtg

SEQ ID NO: 406316 - DNA, 140 bp, Artificial Sequence
  Synthetic
caccgctgtcccaaaaggtctcaaggttccccatctccataagtgttgagagttcctctgtatccccctcactttcattgccactgtcttctgctctttctcttattctttcaattaacccatatcagcagccagggcct

SEQ ID NO: 406317 - DNA, 140 bp, Artificial Sequence
  Synthetic
atacgccatgctgggtctccgtctactatggggtacccgtgtggaaagatgcagaaaccaccctgttttgtgcatcacatgctaatgcatatgagaaagaacaacatattgtctgggctacgtacttgggagtcggccat

SEQ ID NO: 406318 - DNA, 140 bp, Artificial Sequence
  Synthetic
atggccgactcccaagtacgtagcccagacaatatgttgttctttctcatatgcattagcatgtgatgcacaaaacagggtggtttctgcatctttccacacgggtaccccatagtagacggagacccagcatggcgtat

SEQ ID NO: 406319 - DNA, 140 bp, Artificial Sequence
  Synthetic
aggccctggctgctgatatgtgcatcacatgctaatgcatatgagaaagaacaacatattgtctgggctacccatgcctgtgttcccacagaccccaacccactcgaaatggatttagatgaccttttgggacagcggtg

SEQ ID NO: 406320 - DNA, 140 bp, Artificial Sequence
  Synthetic
caccgctgtcccaaaaggtcatctaaatccatttcgagtgggttggggtctgtgggaacacaggcatgggtagcccagacaatatgttgttctttctcatatgcattagcatgtgatgcacatatcagcagccagggcct

SEQ ID NO: 406321 - DNA, 140 bp, Artificial Sequence
  Synthetic
aggccctggctgctgatatgagtcaaaattatcctatagtgcagaatctccaagggcaaatggtacatcaggccatatcacctagaactttgaatgcatgggtaaaagtaatagaggaaagaccttttgggacagcggtg

SEQ ID NO: 406322 - DNA, 140 bp, Artificial Sequence
  Synthetic
caccgctgtcccaaaaggtctttcctctattacttttacccatgcattcaaagttctaggtgatatggcctgatgtaccatttgcccttggagattctgcactataggataattttgactcatatcagcagccagggcct

SEQ ID NO: 406323 - DNA, 140 bp, Artificial Sequence
  Synthetic
atacgccatgctgggtctcctcatgatgatataatccgtctatgggatcgcagcttacagccacgtgtaaaattaacccctctctgcgttactttagactgccagccagttaacagcacccgtacttgggagtcggccat

SEQ ID NO: 406324 - DNA, 140 bp, Artificial Sequence
  Synthetic
atggccgactcccaagtacgggtgctgttaactggctggcagtctaaagtaacgcagagaggggttaattttacacgtggctgtaagctgcgatcccatagacggattatatcatcatgaggagacccagcatggcgtat

SEQ ID NO: 406325 - DNA, 140 bp, Artificial Sequence
  Synthetic
atacgccatgctgggtctcctatgaccacagaactaagtgataagaaacagaaagtacggtctcttttttataggattgatttagtacagattggtaataatacaaatgacagtagtaatcgtacttgggagtcggccat

SEQ ID NO: 406326 - DNA, 140 bp, Artificial Sequence
  Synthetic
atggccgactcccaagtacgattactactgtcatttgtattattaccaatctgtactaaatcaatcctataaaaaagagaccgtactttctgtttcttatcacttagttctgtggtcataggagacccagcatggcgtat

SEQ ID NO: 406327 - DNA, 140 bp, Artificial Sequence
  Synthetic
aggccctggctgctgatatgataggattgatttagtacagattggtaataatacaaatgacagtagtaataggagtctacagtatagactaataaattgtaacacctcaaccattacccagaccttttgggacagcggtg

SEQ ID NO: 406328 - DNA, 140 bp, Artificial Sequence
  Synthetic
caccgctgtcccaaaaggtctgggtaatggttgaggtgttacaatttattagtctatactgtagactcctattactactgtcatttgtattattaccaatctgtactaaatcaatcctatcatatcagcagccagggcct

SEQ ID NO: 406329 - DNA, 140 bp, Artificial Sequence
  Synthetic
atacgccatgctgggtctccatgcagaataagacaaattgtaaacaagtggcaggaagtaggaaaagcaatgtatgcccctcccatccaaggacaaatcagaatcttagcgtatattacacgtacttgggagtcggccat

SEQ ID NO: 406330 - DNA, 140 bp, Artificial Sequence
  Synthetic
atggccgactcccaagtacgtgtaatatacgctaagattctgatttgtccttggatgggaggggcatacattgcttttcctacttcctgccacttgtttacaatttgtcttattctgcatggagacccagcatggcgtat

SEQ ID NO: 406331 - DNA, 140 bp, Artificial Sequence
  Synthetic
atacgccatgctgggtctcctgtagtatcaactcaactgctgttaaatggcagtttagcagaaggaggaataaagattagatctgcaaatatctcatacaatgccaaaaacataatagtacgtacttgggagtcggccat

SEQ ID NO: 406332 - DNA, 140 bp, Artificial Sequence
  Synthetic
atggccgactcccaagtacgtactattatgtttttggcattgtatgagatatttgcagatctaatctttattcctccttctgctaaactgccatttaacagcagttgagttgatactacaggagacccagcatggcgtat

SEQ ID NO: 406333 - DNA, 140 bp, Artificial Sequence
  Synthetic
atacgccatgctgggtctccaagaacaagtgtgcgtataggaccagggcaaacattttatgcaacaggtgatataatagggaatataagacaagcacactgcaaccttagtagaacagcacgtacttgggagtcggccat

SEQ ID NO: 406334 - DNA, 140 bp, Artificial Sequence
  Synthetic
atggccgactcccaagtacgtgctgttctactaaggttgcagtgtgcttgtcttatattccctattatatcacctgttgcataaaatgtttgccctggtcctatacgcacacttgttcttggagacccagcatggcgtat

SEQ ID NO: 406335 - DNA, 140 bp, Artificial Sequence
  Synthetic
aggccctggctgctgatatgatataatagggaatataagacaagcacactgcaaccttagtagaacagcatggaacgatactttatacaatgtatctaaagccttaagagaacacttcccgaccttttgggacagcggtg

SEQ ID NO: 406336 - DNA, 140 bp, Artificial Sequence
  Synthetic
caccgctgtcccaaaaggtcgggaagtgttctcttaaggctttagatacattgtataaagtatcgttccatgctgttctactaaggttgcagtgtgcttgtcttatattccctattatatcatatcagcagccagggcct

SEQ ID NO: 406337 - DNA, 140 bp, Artificial Sequence
  Synthetic
atacgccatgctgggtctcccacaacatatgtttatttgtggaggagaatttttctattgcaatacatcaggcctatttaatagcagttgggcgcccaacggcagttggatcaacaacatcgtacttgggagtcggccat

SEQ ID NO: 406338 - DNA, 140 bp, Artificial Sequence
  Synthetic
atggccgactcccaagtacgatgttgttgatccaactgccgttgggcgcccaactgctattaaataggcctgatgtattgcaatagaaaaattctcctccacaaataaacatatgttgtgggagacccagcatggcgtat

SEQ ID NO: 406339 - DNA, 140 bp, Artificial Sequence
  Synthetic
atacgccatgctgggtctcctggcagtagggaaaatgacactatgactctgccatgcagaataaaacaaattataaatatgtggcagagagtagaacaagcaatgtatgcccctcctatccgtacttgggagtcggccat

SEQ ID NO: 406340 - DNA, 140 bp, Artificial Sequence
  Synthetic
atggccgactcccaagtacggataggaggggcatacattgcttgttctactctctgccacatatttataatttgttttattctgcatggcagagtcatagtgtcattttccctactgccaggagacccagcatggcgtat

SEQ ID NO: 406341 - DNA, 140 bp, Artificial Sequence
  Synthetic
aggccctggctgctgatatgaaacacacaggtgagaacatgacaataacactgccttgtagactaaagcaagtagttaattcatggatgaaagtgggatcaggcttgtttgcgccacctagaccttttgggacagcggtg

SEQ ID NO: 406342 - DNA, 140 bp, Artificial Sequence
  Synthetic
caccgctgtcccaaaaggtctaggtggcgcaaacaagcctgatcccactttcatccatgaattaactacttgctttagtctacaaggcagtgttattgtcatgttctcacctgtgtgtttcatatcagcagccagggcct

SEQ ID NO: 406343 - DNA, 140 bp, Artificial Sequence
  Synthetic
aggccctggctgctgatatgggacagatagggttatagaagtagtacagagagcttggagagctcttatccacatacctagaagaatcagacagggcttagaaagggctttgctataacagaccttttgggacagcggtg

SEQ ID NO: 406344 - DNA, 140 bp, Artificial Sequence
  Synthetic
caccgctgtcccaaaaggtctgttatagcaaagccctttctaagccctgtctgattcttctaggtatgtggataagagctctccaagctctctgtactacttctataaccctatctgtcccatatcagcagccagggcct

SEQ ID NO: 406345 - DNA, 140 bp, Artificial Sequence
  Synthetic
atacgccatgctgggtctccagtagttaattcatggatgaaagtgggatcaggcttgtttgcgccacctatcgagggacaattgcagtgccactccaacattacaggtttaatattagaccgtacttgggagtcggccat

SEQ ID NO: 406346 - DNA, 140 bp, Artificial Sequence
  Synthetic
atggccgactcccaagtacggtctaatattaaacctgtaatgttggagtggcactgcaattgtccctcgataggtggcgcaaacaagcctgatcccactttcatccatgaattaactactggagacccagcatggcgtat

SEQ ID NO: 406347 - DNA, 140 bp, Artificial Sequence
  Synthetic
aggccctggctgctgatatgaaggatcaacagctcctaggaatttggggctgctctggaaaactcatctgcaccactactgtgccttggaactctagttggagtaataaatctcaggatggaccttttgggacagcggtg

SEQ ID NO: 406348 - DNA, 140 bp, Artificial Sequence
  Synthetic
caccgctgtcccaaaaggtccatcctgagatttattactccaactagagttccaaggcacagtagtggtgcagatgagttttccagagcagccccaaattcctaggagctgttgatccttcatatcagcagccagggcct

SEQ ID NO: 406349 - DNA, 140 bp, Artificial Sequence
  Synthetic
atacgccatgctgggtctccataatcctgattgtgcctggctggaagcgcaacaagaggaagaggaggtaggctttccagtcaaacctcaggtacctttaaggccaatgacttataaagccgtacttgggagtcggccat

SEQ ID NO: 406350 - DNA, 140 bp, Artificial Sequence
  Synthetic
atggccgactcccaagtacggctttataagtcattggccttaaaggtacctgaggtttgactggaaagcctacctcctcttcctcttgttgcgcttccagccaggcacaatcaggattatggagacccagcatggcgtat

SEQ ID NO: 406351 - DNA, 140 bp, Artificial Sequence
  Synthetic
aggccctggctgctgatatgtttgcttaatgccacagctgtagcagtagctgaggggacagataggattatagaattaggacaaagatttggtagggctatcctcaacgtacctgtacgagaccttttgggacagcggtg

SEQ ID NO: 406352 - DNA, 140 bp, Artificial Sequence
  Synthetic
caccgctgtcccaaaaggtctcgtacaggtacgttgaggatagccctaccaaatctttgtcctaattctataatcctatctgtcccctcagctactgctacagctgtggcattaagcaaacatatcagcagccagggcct

SEQ ID NO: 406353 - DNA, 140 bp, Artificial Sequence
  Synthetic
atacgccatgctgggtctcccaaaaagtagtgggggtaatggaggtggatggactgctgtaagggaaagaatgaggcgagctaagccagcagcgccagcagcagaaggggtgggagcggccgtacttgggagtcggccat

SEQ ID NO: 406354 - DNA, 140 bp, Artificial Sequence
  Synthetic
atggccgactcccaagtacggccgctcccaccccttctgctgctggcgctgctggcttagctcgcctcattctttcccttacagcagtccatccacctccattacccccactactttttgggagacccagcatggcgtat

SEQ ID NO: 406355 - DNA, 140 bp, Artificial Sequence
  Synthetic
aggccctggctgctgatatgactgcttgtactaattgctattgtaaaaagtgttgctttcattgccaagtttgcttcacaacaaaaggcttaggcatctcctatggcaggaagaagcggagaccttttgggacagcggtg

SEQ ID NO: 406356 - DNA, 140 bp, Artificial Sequence
  Synthetic
caccgctgtcccaaaaggtctccgcttcttcctgccataggagatgcctaagccttttgttgtgaagcaaacttggcaatgaaagcaacactttttacaatagcaattagtacaagcagtcatatcagcagccagggcct

SEQ ID NO: 406357 - DNA, 140 bp, Artificial Sequence
  Synthetic
atacgccatgctgggtctccgaagtaggacaaagaattggtagagcttttctcaacatacctagaagaatcagacagggcttcgaaagagctttgctataaaatgggtggcaagtggtcacgtacttgggagtcggccat

SEQ ID NO: 406358 - DNA, 140 bp, Artificial Sequence
  Synthetic
atggccgactcccaagtacgtgaccacttgccacccattttatagcaaagctctttcgaagccctgtctgattcttctaggtatgttgagaaaagctctaccaattctttgtcctacttcggagacccagcatggcgtat

SEQ ID NO: 406359 - DNA, 140 bp, Artificial Sequence
  Synthetic
aggccctggctgctgatatgagggggagaaatgagaaatatctggagaagtgagttatatccctacaaggtagttcaagtaaaggctctggctgtggcacctacaagagtctccagacctgaccttttgggacagcggtg

SEQ ID NO: 406360 - DNA, 140 bp, Artificial Sequence
  Synthetic
caccgctgtcccaaaaggtcaggtctggagactcttgtaggtgccacagccagagcctttacttgaactaccttgtagggatataactcacttctccagatatttctcatttctccccctcatatcagcagccagggcct

SEQ ID NO: 406361 - DNA, 140 bp, Artificial Sequence
  Synthetic
atacgccatgctgggtctccgccttacaatcgacccttcagacaggatcagaagaacttagatccttatataatacagtagcagtcctctattgtgtgcatcaaaaaatagatgtaagagcgtacttgggagtcggccat

SEQ ID NO: 406362 - DNA, 140 bp, Artificial Sequence
  Synthetic
atggccgactcccaagtacgctcttacatctattttttgatgcacacaatagaggactgctactgtattatataaggatctaagttcttctgatcctgtctgaagggtcgattgtaaggcggagacccagcatggcgtat

SEQ ID NO: 406363 - DNA, 140 bp, Artificial Sequence
  Synthetic
atacgccatgctgggtctccatggagcagtcacaagcaataatacagcagctactaatcctgattgcgcctggctggaagcacaagaggaagaggaggtaggcttcccagtcaggccacacgtacttgggagtcggccat

SEQ ID NO: 406364 - DNA, 140 bp, Artificial Sequence
  Synthetic
atggccgactcccaagtacgtgtggcctgactgggaagcctacctcctcttcctcttgtgcttccagccaggcgcaatcaggattagtagctgctgtattattgcttgtgactgctccatggagacccagcatggcgtat

SEQ ID NO: 406365 - DNA, 140 bp, Artificial Sequence
  Synthetic
aggccctggctgctgatatgtggctggaagcacaagaggaagaggaggtaggcttcccagtcaggccacaggtaccaacaagaccaatgacttataaggcagctgtggaccttagccactgaccttttgggacagcggtg

SEQ ID NO: 406366 - DNA, 140 bp, Artificial Sequence
  Synthetic
caccgctgtcccaaaaggtcagtggctaaggtccacagctgccttataagtcattggtcttgttggtacctgtggcctgactgggaagcctacctcctcttcctcttgtgcttccagccacatatcagcagccagggcct

SEQ ID NO: 406367 - DNA, 140 bp, Artificial Sequence
  Synthetic
aggccctggctgctgatatgcagcagccaggtcagccgaaattaccctatagtgcagaacctacaggggcaaatggtacatcaggccatatcacctagaactttaaatgcatgggtaaaagaccttttgggacagcggtg

SEQ ID NO: 406368 - DNA, 140 bp, Artificial Sequence
  Synthetic
caccgctgtcccaaaaggtcttttacccatgcatttaaagttctaggtgatatggcctgatgtaccatttgcccctgtaggttctgcactatagggtaatttcggctgacctggctgctgcatatcagcagccagggcct

SEQ ID NO: 406369 - DNA, 140 bp, Artificial Sequence
  Synthetic
aggccctggctgctgatatgccaataatgctgacgttgcctggctggaaccgcaagaggaggaaggggcggtaggctttccagtcagacctcaagtacctttaaaaccaatgacttataagaccttttgggacagcggtg

SEQ ID NO: 406370 - DNA, 140 bp, Artificial Sequence
  Synthetic
caccgctgtcccaaaaggtcttataagtcattggttttaaaggtacttgaggtctgactggaaagcctaccgccccttcctcctcttgcggttccagccaggcaacgtcagcattattggcatatcagcagccagggcct

SEQ ID NO: 406371 - DNA, 140 bp, Artificial Sequence
  Synthetic
aggccctggctgctgatatgggggcggtaggctttccagtcagacctcaagtacctttaaaaccaatgacttataagggagcggtggatctaggcttctttttaaaagaaaaggggggacgaccttttgggacagcggtg

SEQ ID NO: 406372 - DNA, 140 bp, Artificial Sequence
  Synthetic
caccgctgtcccaaaaggtcgtccccccttttcttttaaaaagaagcctagatccaccgctcccttataagtcattggttttaaaggtacttgaggtctgactggaaagcctaccgcccccatatcagcagccagggcct

SEQ ID NO: 406373 - DNA, 140 bp, Artificial Sequence
  Synthetic
atacgccatgctgggtctcctggtaattataccaataatggtagcgtgggagcaatggagaaaggagaaatgaaaaactgctcttttaaagttaccacacacatgagagataagatgcaacgtacttgggagtcggccat

SEQ ID NO: 406374 - DNA, 140 bp, Artificial Sequence
  Synthetic
atggccgactcccaagtacgttgcatcttatctctcatgtgtgtggtaactttaaaagagcagtttttcatttctcctttctccattgctcccacgctaccattattggtataattaccaggagacccagcatggcgtat

SEQ ID NO: 406375 - DNA, 140 bp, Artificial Sequence
  Synthetic
aggccctggctgctgatatggacaataatctttcaaccaccctcaggaggagatctagaagttacaatgcatcattttaattgtagaggggaatttttctattgcaatacatcaaaactggaccttttgggacagcggtg

SEQ ID NO: 406376 - DNA, 140 bp, Artificial Sequence
  Synthetic
caccgctgtcccaaaaggtccagttttgatgtattgcaatagaaaaattcccctctacaattaaaatgatgcattgtaacttctagatctcctcctgagggtggttgaaagattattgtccatatcagcagccagggcct

SEQ ID NO: 406377 - DNA, 140 bp, Artificial Sequence
  Synthetic
atacgccatgctgggtctccggcacaacaggcagcagctgccacaggaggcagcgtcagccaaaattatcctatagtacagaatgcacaagggcaaatgatacatcagtccatgtcaccccgtacttgggagtcggccat

SEQ ID NO: 406378 - DNA, 140 bp, Artificial Sequence
  Synthetic
atggccgactcccaagtacggggtgacatggactgatgtatcatttgcccttgtgcattctgtactataggataattttggctgacgctgcctcctgtggcagctgctgcctgttgtgccggagacccagcatggcgtat

SEQ ID NO: 406379 - DNA, 140 bp, Artificial Sequence
  Synthetic
atacgccatgctgggtctccgaagtgatatagcaggaactactagtaccctgcaggaacaaataacatggatgaccagcaacccacctatcccagtgggagacatttataaaagatggatcgtacttgggagtcggccat

SEQ ID NO: 406380 - DNA, 140 bp, Artificial Sequence
  Synthetic
atggccgactcccaagtacgatccatcttttataaatgtctcccactgggataggtgggttgctggtcatccatgttatttgttcctgcagggtactagtagttcctgctatatcacttcggagacccagcatggcgtat

SEQ ID NO: 406381 - DNA, 140 bp, Artificial Sequence
  Synthetic
atacgccatgctgggtctcccagcagcagaacaatatgctacgagctatagaggcacagcaagaattgctgagactctctgtgtggggcataagacagctccgagctcgcctgcttgccacgtacttgggagtcggccat

SEQ ID NO: 406382 - DNA, 140 bp, Artificial Sequence
  Synthetic
atggccgactcccaagtacgtggcaagcaggcgagctcggagctgtcttatgccccacacagagagtctcagcaattcttgctgtgcctctatagctcgtagcatattgttctgctgctgggagacccagcatggcgtat

SEQ ID NO: 406383 - DNA, 140 bp, Artificial Sequence
  Synthetic
aggccctggctgctgatatgtataacatttcaaccagcctcaggaggggacctagaaattacaacacatacctttaattgtagaggagaatttttttattgcaatacatcaaaactgtttgaccttttgggacagcggtg

SEQ ID NO: 406384 - DNA, 140 bp, Artificial Sequence
  Synthetic
caccgctgtcccaaaaggtcaaacagttttgatgtattgcaataaaaaaattctcctctacaattaaaggtatgtgttgtaatttctaggtcccctcctgaggctggttgaaatgttatacatatcagcagccagggcct

SEQ ID NO: 406385 - DNA, 140 bp, Artificial Sequence
  Synthetic
atacgccatgctgggtctccaatagcattaatcatagcaatagttgtgtggaccatagtatatatagaatataggaaattggtaagacaaagaaaaatagacaggttaattgaaaggattcgtacttgggagtcggccat

SEQ ID NO: 406386 - DNA, 140 bp, Artificial Sequence
  Synthetic
atggccgactcccaagtacgaatcctttcaattaacctgtctatttttctttgtcttaccaatttcctatattctatatatactatggtccacacaactattgctatgattaatgctattggagacccagcatggcgtat

SEQ ID NO: 406387 - DNA, 140 bp, Artificial Sequence
  Synthetic
atacgccatgctgggtctccctccactaatagcatggctggagaaataaaaaattgctctttcaatgcaaccacagaaataaaggataagaaacataaagtatatgcacttttttataaacgtacttgggagtcggccat

SEQ ID NO: 406388 - DNA, 140 bp, Artificial Sequence
  Synthetic
atggccgactcccaagtacgtttataaaaaagtgcatatactttatgtttcttatcctttatttctgtggttgcattgaaagagcaattttttatttctccagccatgctattagtggagggagacccagcatggcgtat

SEQ ID NO: 406389 - DNA, 140 bp, Artificial Sequence
  Synthetic
aggccctggctgctgatatgccacaccagacaaaaaacatcagaaagaacctccattcctttggatgggatatgagctccatcctgacaaatggacagtacagcctatacagctgccagagaccttttgggacagcggtg

SEQ ID NO: 406390 - DNA, 140 bp, Artificial Sequence
  Synthetic
caccgctgtcccaaaaggtctctggcagctgtataggctgtactgtccatttgtcaggatggagctcatatcccatccaaaggaatggaggttctttctgatgttttttgtctggtgtggcatatcagcagccagggcct

SEQ ID NO: 406391 - DNA, 140 bp, Artificial Sequence
  Synthetic
atacgccatgctgggtctccaaaatttacatcaccctcaggaggggacctagaaattatacaacatacctttaattgtggaggggagtttttctattgtaatacatcaaaactgtttaatcgtacttgggagtcggccat

SEQ ID NO: 406392 - DNA, 140 bp, Artificial Sequence
  Synthetic
atggccgactcccaagtacgattaaacagttttgatgtattacaatagaaaaactcccctccacaattaaaggtatgttgtataatttctaggtcccctcctgagggtgatgtaaattttggagacccagcatggcgtat

SEQ ID NO: 406393 - DNA, 140 bp, Artificial Sequence
  Synthetic
atacgccatgctgggtctcccatgcacatcaaatattacaggattgctattgacacgtgatgggggatatacaaataatactaatggaacagagattttcacacctacaggaagaaatatcgtacttgggagtcggccat

SEQ ID NO: 406394 - DNA, 140 bp, Artificial Sequence
  Synthetic
atggccgactcccaagtacgatatttcttcctgtaggtgtgaaaatctctgttccattagtattatttgtatatcccccatcacgtgtcaatagcaatcctgtaatatttgatgtgcatgggagacccagcatggcgtat

SEQ ID NO: 406395 - DNA, 140 bp, Artificial Sequence
  Synthetic
aggccctggctgctgatatggtggacagatagggttatagaagtagcacaaagagcttggagagcttttctccacatacctaggagaatcagacagggcttcgaaagggctttgctataagaccttttgggacagcggtg

SEQ ID NO: 406396 - DNA, 140 bp, Artificial Sequence
  Synthetic
caccgctgtcccaaaaggtcttatagcaaagccctttcgaagccctgtctgattctcctaggtatgtggagaaaagctctccaagctctttgtgctacttctataaccctatctgtccaccatatcagcagccagggcct

SEQ ID NO: 406397 - DNA, 140 bp, Artificial Sequence
  Synthetic
aggccctggctgctgatatggtgcaacagcaaaacaatttgctgagggctatagaggcgcaacagcatatgttgcaactcacagtctggggcattaagcagctccaggcaagagtcctgggaccttttgggacagcggtg

SEQ ID NO: 406398 - DNA, 140 bp, Artificial Sequence
  Synthetic
caccgctgtcccaaaaggtcccaggactcttgcctggagctgcttaatgccccagactgtgagttgcaacatatgctgttgcgcctctatagccctcagcaaattgttttgctgttgcaccatatcagcagccagggcct

SEQ ID NO: 406399 - DNA, 140 bp, Artificial Sequence
  Synthetic
atacgccatgctgggtctcctaaaaaattgctctttcaatacaaccacagtattaagagataggaagcagacagtgtatgcgcttttctatagacttgatatagtaccacttaatgagaacgtacttgggagtcggccat

SEQ ID NO: 406400 - DNA, 140 bp, Artificial Sequence
  Synthetic
atggccgactcccaagtacgttctcattaagtggtactatatcaagtctatagaaaagcgcatacactgtctgcttcctatctcttaatactgtggttgtattgaaagagcaattttttaggagacccagcatggcgtat

SEQ ID NO: 406401 - DNA, 140 bp, Artificial Sequence
  Synthetic
aggccctggctgctgatatgcatctcctatggcaggaagaagcggagacagcgacgaagatctcctcaggactatcaggctcatcaagattctctatcaaagcagtgagtagtacatgtagaccttttgggacagcggtg

SEQ ID NO: 406402 - DNA, 140 bp, Artificial Sequence
  Synthetic
caccgctgtcccaaaaggtctacatgtactactcactgctttgatagagaatcttgatgagcctgatagtcctgaggagatcttcgtcgctgtctccgcttcttcctgccataggagatgcatatcagcagccagggcct

SEQ ID NO: 406403 - DNA, 140 bp, Artificial Sequence
  Synthetic
atacgccatgctgggtctccagaaatgaaaaactgcacttttaatatcaccacaggcataggaggtaagatgaaaaaagaatatgcacttttttatacaggtgatatagtatcaatagagcgtacttgggagtcggccat

SEQ ID NO: 406404 - DNA, 140 bp, Artificial Sequence
  Synthetic
atggccgactcccaagtacgctctattgatactatatcacctgtataaaaaagtgcatattcttttttcatcttacctcctatgcctgtggtgatattaaaagtgcagtttttcatttctggagacccagcatggcgtat

SEQ ID NO: 406405 - DNA, 140 bp, Artificial Sequence
  Synthetic
atacgccatgctgggtctccggggagaaataaaaaactgctcttacaatataaccacagaattacaggataagaaacggaaagtatattcacttttttatagacttgatttagtaccactcgtacttgggagtcggccat

SEQ ID NO: 406406 - DNA, 140 bp, Artificial Sequence
  Synthetic
atggccgactcccaagtacgagtggtactaaatcaagtctataaaaaagtgaatatactttccgtttcttatcctgtaattctgtggttatattgtaagagcagttttttatttctccccggagacccagcatggcgtat

SEQ ID NO: 406407 - DNA, 140 bp, Artificial Sequence
  Synthetic
aggccctggctgctgatatgaagaaacggaaagtatattcacttttttatagacttgatttagtaccacttaatggggggaatgaaagttctaatgagagtattagctatagcttaataagaccttttgggacagcggtg

SEQ ID NO: 406408 - DNA, 140 bp, Artificial Sequence
  Synthetic
caccgctgtcccaaaaggtcttattaagctatagctaatactctcattagaactttcattccccccattaagtggtactaaatcaagtctataaaaaagtgaatatactttccgtttcttcatatcagcagccagggcct

SEQ ID NO: 406409 - DNA, 140 bp, Artificial Sequence
  Synthetic
atacgccatgctgggtctccaaacaatgccaaaaacataatagtacagttgaatgagtctgtacaaattaattgtaccagacccaacaacaatacaagaaaagatatacgtataggaccacgtacttgggagtcggccat

SEQ ID NO: 406410 - DNA, 140 bp, Artificial Sequence
  Synthetic
atggccgactcccaagtacgtggtcctatacgtatatcttttcttgtattgttgttgggtctggtacaattaatttgtacagactcattcaactgtactattatgtttttggcattgtttggagacccagcatggcgtat

SEQ ID NO: 406411 - DNA, 140 bp, Artificial Sequence
  Synthetic
atacgccatgctgggtctccatattgtaatgtcagtagatcagaatggaataaagctttacaaaaggtaggtgaacaattaagaaaatactttgtgaacaaaacaataaaatttaatggacgtacttgggagtcggccat

SEQ ID NO: 406412 - DNA, 140 bp, Artificial Sequence
  Synthetic
atggccgactcccaagtacgtccattaaattttattgttttgttcacaaagtattttcttaattgttcacctaccttttgtaaagctttattccattctgatctactgacattacaatatggagacccagcatggcgtat

SEQ ID NO: 406413 - DNA, 140 bp, Artificial Sequence
  Synthetic
atacgccatgctgggtctcctcctccccaggaggggatctagaaataacaacacatagttttaattgtgggggagagtttttctattgtaacacatcaggcttgtttaatagcacttggacgtacttgggagtcggccat

SEQ ID NO: 406414 - DNA, 140 bp, Artificial Sequence
  Synthetic
atggccgactcccaagtacgtccaagtgctattaaacaagcctgatgtgttacaatagaaaaactctcccccacaattaaaactatgtgttgttatttctagatcccctcctggggaggaggagacccagcatggcgtat

SEQ ID NO: 406415 - DNA, 140 bp, Artificial Sequence
  Synthetic
atacgccatgctgggtctccgagttaaatggcaatataactctcccatgcagaataaagcaaattgtaagaatgtggcagagagtaggacaagcaatgtatgcccctcccattgcaggagcgtacttgggagtcggccat

SEQ ID NO: 406416 - DNA, 140 bp, Artificial Sequence
  Synthetic
atggccgactcccaagtacgctcctgcaatgggaggggcatacattgcttgtcctactctctgccacattcttacaatttgctttattctgcatgggagagttatattgccatttaactcggagacccagcatggcgtat

SEQ ID NO: 406417 - DNA, 140 bp, Artificial Sequence
  Synthetic
atacgccatgctgggtctcccaatggaacaggaccatgtaaaaatgtcagcacagtacaatgtacacatggaattaggccagtagtatcaactcaactgctgttaaatggcagcctagcacgtacttgggagtcggccat

SEQ ID NO: 406418 - DNA, 140 bp, Artificial Sequence
  Synthetic
atggccgactcccaagtacgtgctaggctgccatttaacagcagttgagttgatactactggcctaattccatgtgtacattgtactgtgctgacatttttacatggtcctgttccattgggagacccagcatggcgtat

SEQ ID NO: 406419 - DNA, 140 bp, Artificial Sequence
  Synthetic
aggccctggctgctgatatgttagagacagcagaaggctgtaaacaaataataaaacagctacaaccagctcttcagacaggaacagaggaacttagatcattatacaacacagtagcaagaccttttgggacagcggtg

SEQ ID NO: 406420 - DNA, 140 bp, Artificial Sequence
  Synthetic
caccgctgtcccaaaaggtcttgctactgtgttgtataatgatctaagttcctctgttcctgtctgaagagctggttgtagctgttttattatttgtttacagccttctgctgtctctaacatatcagcagccagggcct

SEQ ID NO: 406421 - DNA, 140 bp, Artificial Sequence
  Synthetic
atacgccatgctgggtctcccacaatagctatagcagtagctgaggggacagatagaattatagaagtagggcaaagaattggtagagctatcattcacatacctagaagaataagacaacgtacttgggagtcggccat

SEQ ID NO: 406422 - DNA, 140 bp, Artificial Sequence
  Synthetic
atggccgactcccaagtacgttgtcttattcttctaggtatgtgaatgatagctctaccaattctttgccctacttctataattctatctgtcccctcagctactgctatagctattgtgggagacccagcatggcgtat

SEQ ID NO: 406423 - DNA, 140 bp, Artificial Sequence
  Synthetic
aggccctggctgctgatatgaatgaacaagacttattggcattggacaagtgggcaagcctgtggaattggtttagcatatcaaagtggctgtggtatataaaaatatttataatgataggaccttttgggacagcggtg

SEQ ID NO: 406424 - DNA, 140 bp, Artificial Sequence
  Synthetic
caccgctgtcccaaaaggtcctatcattataaatatttttatataccacagccactttgatatgctaaaccaattccacaggcttgcccacttgtccaatgccaataagtcttgttcattcatatcagcagccagggcct

SEQ ID NO: 406425 - DNA, 140 bp, Artificial Sequence
  Synthetic
aggccctggctgctgatatgaattcaaagaacaatgcagcattagccttcttagaagctcatgaagatgaagaagtaggattcccagtcaggcctcaagtacccgtaagacccatgacatgaccttttgggacagcggtg

SEQ ID NO: 406426 - DNA, 140 bp, Artificial Sequence
  Synthetic
caccgctgtcccaaaaggtcatgtcatgggtcttacgggtacttgaggcctgactgggaatcctacttcttcatcttcatgagcttctaagaaggctaatgctgcattgttctttgaattcatatcagcagccagggcct

SEQ ID NO: 406427 - DNA, 140 bp, Artificial Sequence
  Synthetic
atacgccatgctgggtctccagtagctaactggactgatagggttatagatatagcacaaagaggtattagggcttttattcacatacctagaagaatcagacagggtttcgaaagagctcgtacttgggagtcggccat

SEQ ID NO: 406428 - DNA, 140 bp, Artificial Sequence
  Synthetic
atggccgactcccaagtacgagctctttcgaaaccctgtctgattcttctaggtatgtgaataaaagccctaatacctctttgtgctatatctataaccctatcagtccagttagctactggagacccagcatggcgtat

SEQ ID NO: 406429 - DNA, 140 bp, Artificial Sequence
  Synthetic
atacgccatgctgggtctccctaagataagggatagaataagacaaacccctcccactccagcagcagaaggagtaggagcagcatctcgagatttagataggcatggagcaataacaagcgtacttgggagtcggccat

SEQ ID NO: 406430 - DNA, 140 bp, Artificial Sequence
  Synthetic
atggccgactcccaagtacgcttgttattgctccatgcctatctaaatctcgagatgctgctcctactccttctgctgctggagtgggaggggtttgtcttattctatcccttatcttagggagacccagcatggcgtat

SEQ ID NO: 406431 - DNA, 140 bp, Artificial Sequence
  Synthetic
atacgccatgctgggtctcctagtcctctattgtgtacatcaaagaatacaggtaaaagacaccaaagaagctttagagaaagtagaggaagagcaaaacaaaagcaagaaaaaagtacacgtacttgggagtcggccat

SEQ ID NO: 406432 - DNA, 140 bp, Artificial Sequence
  Synthetic
atggccgactcccaagtacgtgtacttttttcttgcttttgttttgctcttcctctactttctctaaagcttctttggtgtcttttacctgtattctttgatgtacacaatagaggactaggagacccagcatggcgtat

SEQ ID NO: 406433 - DNA, 140 bp, Artificial Sequence
  Synthetic
aggccctggctgctgatatgtgtggtccatagtattcatagaatataggaaaatattaagacaaagaaaaatagacagattaattgatagaataagagacagagcagaagacagtggcaagaccttttgggacagcggtg

SEQ ID NO: 406434 - DNA, 140 bp, Artificial Sequence
  Synthetic
caccgctgtcccaaaaggtcttgccactgtcttctgctctgtctcttattctatcaattaatctgtctatttttctttgtcttaatattttcctatattctatgaatactatggaccacacatatcagcagccagggcct

SEQ ID NO: 406435 - DNA, 140 bp, Artificial Sequence
  Synthetic
aggccctggctgctgatatgtggggatgctctggaaaactcatctgcaccactactgtaccttggaatgctagttggagtaataaaaatctaactacaatttggaataacatgacctggagaccttttgggacagcggtg

SEQ ID NO: 406436 - DNA, 140 bp, Artificial Sequence
  Synthetic
caccgctgtcccaaaaggtctccaggtcatgttattccaaattgtagttagatttttattactccaactagcattccaaggtacagtagtggtgcagatgagttttccagagcatccccacatatcagcagccagggcct

SEQ ID NO: 406437 - DNA, 140 bp, Artificial Sequence
  Synthetic
  misc_feature (85)..(85): n is a, c, g, or t
  misc_feature (91)..(91): n is a, c, g, or t
atacgccatgctgggtctccctaataccaatagtagtagcacgagattaacgacggaggcagaagaaatgaaaaactgctctttnaatatnaccacaagcataagagataagatacaaaacgtacttgggagtcggccat

SEQ ID NO: 406438 - DNA, 140 bp, Artificial Sequence
  Synthetic
  misc_feature (50)..(50): n is a, c, g, or t
  misc_feature (56)..(56): n is a, c, g, or t
atggccgactcccaagtacgttttgtatcttatctcttatgcttgtggtnatattnaaagagcagtttttcatttcttctgcctccgtcgttaatctcgtgctactactattggtattagggagacccagcatggcgtat

SEQ ID NO: 406439 - DNA, 140 bp, Artificial Sequence
  Synthetic
aggccctggctgctgatatgaaaagtgtacatataggaccagggagagcattttatgcaacaggagatataataggaaatataagacaagcacattgtaacattagtagaacaaaatggagaccttttgggacagcggtg

SEQ ID NO: 406440 - DNA, 140 bp, Artificial Sequence
  Synthetic
caccgctgtcccaaaaggtctccattttgttctactaatgttacaatgtgcttgtcttatatttcctattatatctcctgttgcataaaatgctctccctggtcctatatgtacacttttcatatcagcagccagggcct

SEQ ID NO: 406441 - DNA, 140 bp, Artificial Sequence
  Synthetic
atacgccatgctgggtctccatggtgaagttactagaaagagtagattatagattaggagtaggagctttagtactagcactgatcatagcaatagttgtgtggatcttagcatacatagcgtacttgggagtcggccat

SEQ ID NO: 406442 - DNA, 140 bp, Artificial Sequence
  Synthetic
atggccgactcccaagtacgctatgtatgctaagatccacacaactattgctatgatcagtgctagtactaaagctcctactcctaatctataatctactctttctagtaacttcaccatggagacccagcatggcgtat

SEQ ID NO: 406443 - DNA, 140 bp, Artificial Sequence
  Synthetic
aggccctggctgctgatatgatagtagctagctgtgataaatgtcagctaaaaggggaagccatgcatggacaagtagactgtagtccagggatatggcaattagattgtacacatttaggaccttttgggacagcggtg

SEQ ID NO: 406444 - DNA, 140 bp, Artificial Sequence
  Synthetic
caccgctgtcccaaaaggtcctaaatgtgtacaatctaattgccatatccctggactacagtctacttgtccatgcatggcttccccttttagctgacatttatcacagctagctactatcatatcagcagccagggcct

SEQ ID NO: 406445 - DNA, 140 bp, Artificial Sequence
  Synthetic
atacgccatgctgggtctccaaatgctactaaaaaaccaaatgaagaaataaaaaattgctctttcaatacaatcacagaggtaagagataagcaaaagaaagaatatgcactcttttatcgtacttgggagtcggccat

SEQ ID NO: 406446 - DNA, 140 bp, Artificial Sequence
  Synthetic
atggccgactcccaagtacgataaaagagtgcatattctttcttttgcttatctcttacctctgtgattgtattgaaagagcaattttttatttcttcatttggttttttagtagcatttggagacccagcatggcgtat

SEQ ID NO: 406447 - DNA, 140 bp, Artificial Sequence
  Synthetic
atacgccatgctgggtctccagtaaaggtaatggttgactggacaaaaaaaagtagattatagaatagcagtagtagcatttatagtagctctaatcatagcaatagttgtatggaccatcgtacttgggagtcggccat

SEQ ID NO: 406448 - DNA, 140 bp, Artificial Sequence
  Synthetic
atggccgactcccaagtacgatggtccatacaactattgctatgattagagctactataaatgctactactgctattctataatctacttttttttgtccagtcaaccattacctttactggagacccagcatggcgtat

SEQ ID NO: 406449 - DNA, 140 bp, Artificial Sequence
  Synthetic
aggccctggctgctgatatgtggaaaactcatctgcaccactaatgtgccttggaactccagttggagtaataaatctgaaaaggatatttgggataacatgacctggatgcagtgggatgaccttttgggacagcggtg

SEQ ID NO: 406450 - DNA, 140 bp, Artificial Sequence
  Synthetic
caccgctgtcccaaaaggtcatcccactgcatccaggtcatgttatcccaaatatccttttcagatttattactccaactggagttccaaggcacattagtggtgcagatgagttttccacatatcagcagccagggcct

SEQ ID NO: 406451 - DNA, 140 bp, Artificial Sequence
  Synthetic
atacgccatgctgggtctccaataaaacaatagacgaaggaatgggaaatgaaataaaaaattgctctttcaatacaaccacagaactgagggataagaaaaaacgtgaatatgcactttcgtacttgggagtcggccat

SEQ ID NO: 406452 - DNA, 140 bp, Artificial Sequence
  Synthetic
atggccgactcccaagtacgaaagtgcatattcacgttttttcttatccctcagttctgtggttgtattgaaagagcaattttttatttcatttcccattccttcgtctattgttttattggagacccagcatggcgtat

SEQ ID NO: 406453 - DNA, 140 bp, Artificial Sequence
  Synthetic
atacgccatgctgggtctccaatgcaaccatcacactcccatgcagaataaaacaaattataaacatgtggcaggaggtaggacgagcaatatatgcccctcccattgaaggaaacataacgtacttgggagtcggccat

SEQ ID NO: 406454 - DNA, 140 bp, Artificial Sequence
  Synthetic
atggccgactcccaagtacgttatgtttccttcaatgggaggggcatatattgctcgtcctacctcctgccacatgtttataatttgttttattctgcatgggagtgtgatggttgcattggagacccagcatggcgtat

SEQ ID NO: 406455 - DNA, 140 bp, Artificial Sequence
  Synthetic
aggccctggctgctgatatgggaggagatatgaggaacaattggagaagtgaattatataaatataaagtagtagaaattaaaccattaggaatagcacccactgaagcaaaaaggagaggaccttttgggacagcggtg

SEQ ID NO: 406456 - DNA, 140 bp, Artificial Sequence
  Synthetic
caccgctgtcccaaaaggtcctctcctttttgcttcagtgggtgctattcctaatggtttaatttctactactttatatttatataattcacttctccaattgttcctcatatctcctcccatatcagcagccagggcct

SEQ ID NO: 406457 - DNA, 140 bp, Artificial Sequence
  Synthetic
aggccctggctgctgatatgagaaggagagagatgggtgcgagagcgtcagtattaagcgggggagaattagatagatgggaaaaaattcggttaaggccagggggaaagaaaaaatatagaccttttgggacagcggtg

SEQ ID NO: 406458 - DNA, 140 bp, Artificial Sequence
  Synthetic
caccgctgtcccaaaaggtctatattttttctttccccctggccttaaccgaattttttcccatctatctaattctcccccgcttaatactgacgctctcgcacccatctctctccttctcatatcagcagccagggcct

SEQ ID NO: 406459 - DNA, 140 bp, Artificial Sequence
  Synthetic
atacgccatgctgggtctcctaataaagcaataaactttacccaacccaaaggaggggacttagaaattacaacacatagctttacttgtagaggagagtttttctattgcaatacatcacgtacttgggagtcggccat

SEQ ID NO: 406460 - DNA, 140 bp, Artificial Sequence
  Synthetic
atggccgactcccaagtacgtgatgtattgcaatagaaaaactctcctctacaagtaaagctatgtgttgtaatttctaagtcccctcctttgggttgggtaaagtttattgctttattaggagacccagcatggcgtat

SEQ ID NO: 406461 - DNA, 140 bp, Artificial Sequence
  Synthetic
aggccctggctgctgatatgttttaaaagcattaggaacaggagctacattagaagaaatgatgacagcatgccagggagtgggaggacctagccataaagcaagggttttggctgaggcgaccttttgggacagcggtg

SEQ ID NO: 406462 - DNA, 140 bp, Artificial Sequence
  Synthetic
caccgctgtcccaaaaggtcgcctcagccaaaacccttgctttatggctaggtcctcccactccctggcatgctgtcatcatttcttctaatgtagctcctgttcctaatgcttttaaaacatatcagcagccagggcct

SEQ ID NO: 406463 - DNA, 140 bp, Artificial Sequence
  Synthetic
aggccctggctgctgatatgagtaggaggcttgataggtttaagaataatttttgctgtgctctctatagtgaatagagttaggcagggatactcacctttgtcgtttcagacccttaccgaccttttgggacagcggtg

SEQ ID NO: 406464 - DNA, 140 bp, Artificial Sequence
  Synthetic
caccgctgtcccaaaaggtcggtaagggtctgaaacgacaaaggtgagtatccctgcctaactctattcactatagagagcacagcaaaaattattcttaaacctatcaagcctcctactcatatcagcagccagggcct

SEQ ID NO: 406465 - DNA, 140 bp, Artificial Sequence
  Synthetic
aggccctggctgctgatatgagcaataattgtgtggaccatagcatatatagaatataggaaattggtaaaacaaagaaaaatagactggttaattaaaagaattagggaaagagcagaagaccttttgggacagcggtg

SEQ ID NO: 406466 - DNA, 140 bp, Artificial Sequence
  Synthetic
caccgctgtcccaaaaggtcttctgctctttccctaattcttttaattaaccagtctatttttctttgttttaccaatttcctatattctatatatgctatggtccacacaattattgctcatatcagcagccagggcct

SEQ ID NO: 406467 - DNA, 140 bp, Artificial Sequence
  Synthetic
aggccctggctgctgatatgcttcaatttccctcaaatcactctttggcaacgaccccttgtcacagtaaaaataggaggacagctgaaagaagctctattagatacaggagcagatgatgaccttttgggacagcggtg

SEQ ID NO: 406468 - DNA, 140 bp, Artificial Sequence
  Synthetic
caccgctgtcccaaaaggtcatcatctgctcctgtatctaatagagcttctttcagctgtcctcctatttttactgtgacaaggggtcgttgccaaagagtgatttgagggaaattgaagcatatcagcagccagggcct

SEQ ID NO: 406469 - DNA, 140 bp, Artificial Sequence
  Synthetic
aggccctggctgctgatatgtagaaatttgtggaaaaaaggctataggtacagtattagtaggacctacacctgtcaacataattggacgaaatatgttgactcagattggttgtactttgaccttttgggacagcggtg

SEQ ID NO: 406470 - DNA, 140 bp, Artificial Sequence
  Synthetic
caccgctgtcccaaaaggtcaaagtacaaccaatctgagtcaacatatttcgtccaattatgttgacaggtgtaggtcctactaatactgtacctatagccttttttccacaaatttctacatatcagcagccagggcct

SEQ ID NO: 406471 - DNA, 140 bp, Artificial Sequence
  Synthetic
atacgccatgctgggtctcccatagcaaaataggcattaatctacagaggagagcaagaaatggagccagtaaaccctagtctagagccctgggagcacccagggagccggcctaggacccgtacttgggagtcggccat

SEQ ID NO: 406472 - DNA, 140 bp, Artificial Sequence
  Synthetic
atggccgactcccaagtacgggtcctaggccggctccctgggtgctcccagggctctagactagggtttactggctccatttcttgctctcctctgtagattaatgcctattttgctatgggagacccagcatggcgtat

SEQ ID NO: 406473 - DNA, 140 bp, Artificial Sequence
  Synthetic
aggccctggctgctgatatggaatatcaagcaggacataacaaggtaggatctctacaatatttggcactgaaagcattagtaacaccaacaaagataaagccacctttgcctagtgttagaccttttgggacagcggtg

SEQ ID NO: 406474 - DNA, 140 bp, Artificial Sequence
  Synthetic
caccgctgtcccaaaaggtctaacactaggcaaaggtggctttatctttgttggtgttactaatgctttcagtgccaaatattgtagagatcctaccttgttatgtcctgcttgatattccatatcagcagccagggcct

SEQ ID NO: 406475 - DNA, 140 bp, Artificial Sequence
  Synthetic
aggccctggctgctgatatgcaaaaatcttagagccctttagaacaaaaaatccagaaatagttatctatcaatacatggatgacttgtatgtaggatctgatttagaaatagggcagcagaccttttgggacagcggtg

SEQ ID NO: 406476 - DNA, 140 bp, Artificial Sequence
  Synthetic
caccgctgtcccaaaaggtctgctgccctatttctaaatcagatcctacatacaagtcatccatgtattgatagataactatttctggattttttgttctaaagggctctaagatttttgcatatcagcagccagggcct

SEQ ID NO: 406477 - DNA, 140 bp, Artificial Sequence
  Synthetic
aggccctggctgctgatatggatattaatgatctgtagtgctgcagaccagttgtgggtcacagtctattatggggtacctgtgtggaaagaagctaccaccactttattttgtgcatcagaccttttgggacagcggtg

SEQ ID NO: 406478 - DNA, 140 bp, Artificial Sequence
  Synthetic
caccgctgtcccaaaaggtctgatgcacaaaataaagtggtggtagcttctttccacacaggtaccccataatagactgtgacccacaactggtctgcagcactacagatcattaatatccatatcagcagccagggcct

SEQ ID NO: 406479 - DNA, 140 bp, Artificial Sequence
  Synthetic
atacgccatgctgggtctccgcacaaataccactagcgaatggggggaaaagatggaggaaggagaaataaaaaactgctctttcaagaccaacccagtcataaaagacaaggaacaggacgtacttgggagtcggccat

SEQ ID NO: 406480 - DNA, 140 bp, Artificial Sequence
  Synthetic
atggccgactcccaagtacgtcctgttccttgtcttttatgactgggttggtcttgaaagagcagttttttatttctccttcctccatcttttccccccattcgctagtggtatttgtgcggagacccagcatggcgtat

SEQ ID NO: 406481 - DNA, 140 bp, Artificial Sequence
  Synthetic
aggccctggctgctgatatgatatggggaaagacccctaaatttagactacccatacaaaaagaaacatgggaaacatggtggatggagtattggcaggctacctggattcctgaatggggaccttttgggacagcggtg

SEQ ID NO: 406482 - DNA, 140 bp, Artificial Sequence
  Synthetic
caccgctgtcccaaaaggtccccattcaggaatccaggtagcctgccaatactccatccaccatgtttcccatgtttctttttgtatgggtagtctaaatttaggggtctttccccatatcatatcagcagccagggcct

SEQ ID NO: 406483 - DNA, 140 bp, Artificial Sequence
  Synthetic
aggccctggctgctgatatgggtatacatatagggccagggagagcattttatacaacaggagaaataataggagatataagacaagcacattgtaacattagtagagaacaatggaatggaccttttgggacagcggtg

SEQ ID NO: 406484 - DNA, 140 bp, Artificial Sequence
  Synthetic
caccgctgtcccaaaaggtccattccattgttctctactaatgttacaatgtgcttgtcttatatctcctattatttctcctgttgtataaaatgctctccctggccctatatgtatacccatatcagcagccagggcct

SEQ ID NO: 406485 - DNA, 140 bp, Artificial Sequence
  Synthetic
atacgccatgctgggtctccaataatactcatgaaaacatcacactccaatgcagaataaaacaatttataaacctgtggcaagaagtaggaaaagcaatgtatgcccctcccatccaagcgtacttgggagtcggccat

SEQ ID NO: 406486 - DNA, 140 bp, Artificial Sequence
  Synthetic
atggccgactcccaagtacgcttggatgggaggggcatacattgcttttcctacttcttgccacaggtttataaattgttttattctgcattggagtgtgatgttttcatgagtattattggagacccagcatggcgtat

SEQ ID NO: 406487 - DNA, 140 bp, Artificial Sequence
  Synthetic
atacgccatgctgggtctccgtggcgcccgaacaggggcaagaaaaggaaaatgagacccgaggggatttcttgacgcaggactcggcttgctgaagtgcactcggcaagaggcgagaggcgtacttgggagtcggccat

SEQ ID NO: 406488 - DNA, 140 bp, Artificial Sequence
  Synthetic
atggccgactcccaagtacgcctctcgcctcttgccgagtgcacttcagcaagccgagtcctgcgtcaagaaatcccctcgggtctcattttccttttcttgcccctgttcgggcgccacggagacccagcatggcgtat

SEQ ID NO: 406489 - DNA, 140 bp, Artificial Sequence
  Synthetic
aggccctggctgctgatatgcagcaggcaaaaaaggatgatgagaaggttagtcaaaattatcctatagtgcagaatctccaagggcacatggtacatcagcctctatcacctagaacttgaccttttgggacagcggtg

SEQ ID NO: 406490 - DNA, 140 bp, Artificial Sequence
  Synthetic
caccgctgtcccaaaaggtcaagttctaggtgatagaggctgatgtaccatgtgcccttggagattctgcactataggataattttgactaaccttctcatcatccttttttgcctgctgcatatcagcagccagggcct

SEQ ID NO: 406491 - DNA, 140 bp, Artificial Sequence
  Synthetic
aggccctggctgctgatatggaagctgttagacattttcctaggccctggctccatggcttaggacagcatatctataacacttatggggatacttgggaaggagttgaagctataataagaccttttgggacagcggtg

SEQ ID NO: 406492 - DNA, 140 bp, Artificial Sequence
  Synthetic
caccgctgtcccaaaaggtcttattatagcttcaactccttcccaagtatccccataagtgttatagatatgctgtcctaagccatggagccagggcctaggaaaatgtctaacagcttccatatcagcagccagggcct

SEQ ID NO: 406493 - DNA, 140 bp, Artificial Sequence
  Synthetic
atacgccatgctgggtctcctacttcacatacctactagaataagacagggcttggaaagggctttactataaaatgggtggcaaatggtcaaaacctagcattagaggatggcaggctgcgtacttgggagtcggccat

SEQ ID NO: 406494 - DNA, 140 bp, Artificial Sequence
  Synthetic
atggccgactcccaagtacgcagcctgccatcctctaatgctaggttttgaccatttgccacccattttatagtaaagccctttccaagccctgtcttattctagtaggtatgtgaagtaggagacccagcatggcgtat

SEQ ID NO: 406495 - DNA, 140 bp, Artificial Sequence
  Synthetic
atacgccatgctgggtctccataaaacaagggccaatggaaccctttagagactatgttgaccagttcttttatacttttagagctgaacaagctacacaagatgtataacattggatgacgtacttgggagtcggccat

SEQ ID NO: 406496 - DNA, 140 bp, Artificial Sequence
  Synthetic
atggccgactcccaagtacgtcatccaatgttatacatcttgtgtagcttgttcagctctaaaagtataaaagaactggtcaacatagtctctaaagggttccattggcccttgttttatggagacccagcatggcgtat

SEQ ID NO: 406497 - DNA, 140 bp, Artificial Sequence
  Synthetic
atacgccatgctgggtctcctcccagaggatggcttcatggcttagggcaatatatctatgaaacttatggggatacttgggcaggagtaggagccataataagaattctgcaatacctgcgtacttgggagtcggccat

SEQ ID NO: 406498 - DNA, 140 bp, Artificial Sequence
  Synthetic
atggccgactcccaagtacgcaggtattgcagaattcttattatggctcctactcctgcccaagtatccccataagtttcatagatatattgccctaagccatgaagccatcctctgggaggagacccagcatggcgtat

SEQ ID NO: 406499 - DNA, 140 bp, Artificial Sequence
  Synthetic
aggccctggctgctgatatgttgtaaaaagtgttgccttcattgccaagtttgcttcataaaaaaaggcttaggcatctcctatggcaggaagaagcggagacagcgacgaagagcttctgaccttttgggacagcggtg

SEQ ID NO: 406500 - DNA, 140 bp, Artificial Sequence
  Synthetic
caccgctgtcccaaaaggtcagaagctcttcgtcgctgtctccgcttcttcctgccataggagatgcctaagcctttttttatgaagcaaacttggcaatgaaggcaacactttttacaacatatcagcagccagggcct

SEQ ID NO: 406501 - DNA, 140 bp, Artificial Sequence
  Synthetic
aggccctggctgctgatatgaatcatagcaatagttgtgtggaccatagtatatttagaatataggaaagtggtaagacaaagaaaaatagacaggttaattgaaagaattagggaaagagaccttttgggacagcggtg

SEQ ID NO: 406502 - DNA, 140 bp, Artificial Sequence
  Synthetic
caccgctgtcccaaaaggtctctttccctaattctttcaattaacctgtctatttttctttgtcttaccactttcctatattctaaatatactatggtccacacaactattgctatgattcatatcagcagccagggcct

SEQ ID NO: 406503 - DNA, 140 bp, Artificial Sequence
  Synthetic
atacgccatgctgggtctccacaacaataacaatgatgagaatagagagtataggttaataaattgcaatacttcagtcagtacacaggcttgtccaaagatatcctttgaccctattgccgtacttgggagtcggccat

SEQ ID NO: 406504 - DNA, 140 bp, Artificial Sequence
  Synthetic
atggccgactcccaagtacggcaatagggtcaaaggatatctttggacaagcctgtgtactgactgaagtattgcaatttattaacctatactctctattctcatcattgttattgttgtggagacccagcatggcgtat

SEQ ID NO: 406505 - DNA, 140 bp, Artificial Sequence
  Synthetic
aggccctggctgctgatatgggatgacaaataatccacctatcccagtaggagaaatctataaaagatggataatcctgggattaaataaaatagtaagaatgtatagccctaccagcatgaccttttgggacagcggtg

SEQ ID NO: 406506 - DNA, 140 bp, Artificial Sequence
  Synthetic
caccgctgtcccaaaaggtcatgctggtagggctatacattcttactattttatttaatcccaggattatccatcttttatagatttctcctactgggataggtggattatttgtcatcccatatcagcagccagggcct

SEQ ID NO: 406507 - DNA, 140 bp, Artificial Sequence
  Synthetic
atacgccatgctgggtctcctaacagtactagtaatagtacctacaatgataacatggatggagctggagaaataaaaaattgttctttcaatataaccacagaactaagagataagaaacgtacttgggagtcggccat

SEQ ID NO: 406508 - DNA, 140 bp, Artificial Sequence
  Synthetic
atggccgactcccaagtacgtttcttatctcttagttctgtggttatattgaaagaacaattttttatttctccagctccatccatgttatcattgtaggtactattactagtactgttaggagacccagcatggcgtat

SEQ ID NO: 406509 - DNA, 140 bp, Artificial Sequence
  Synthetic
atacgccatgctgggtctccaattaaaattatgcagctgggagcaggagcagcacatgctgctcctgccaccagcagaagtattagtgttgcatgtatttcaacaataatattaataacacgtacttgggagtcggccat

SEQ ID NO: 406510 - DNA, 140 bp, Artificial Sequence
  Synthetic
atggccgactcccaagtacgtgttattaatattattgttgaaatacatgcaacactaatacttctgctggtggcaggagcagcatgtgctgctcctgctcccagctgcataattttaattggagacccagcatggcgtat

SEQ ID NO: 406511 - DNA, 140 bp, Artificial Sequence
  Synthetic
atacgccatgctgggtctccccaataacaatacaagaaaaagtatacatatgggaccagggagatggtcattccatggaacagatataataggagatataagacgagcacattgtaacatcgtacttgggagtcggccat

SEQ ID NO: 406512 - DNA, 140 bp, Artificial Sequence
  Synthetic
atggccgactcccaagtacgatgttacaatgtgctcgtcttatatctcctattatatctgttccatggaatgaccatctccctggtcccatatgtatactttttcttgtattgttattggggagacccagcatggcgtat

SEQ ID NO: 406513 - DNA, 140 bp, Artificial Sequence
  Synthetic
atacgccatgctgggtctccgagaacaatttgggaataataaaacaatagcctttaatcgatcttcaggaggggacccagaaattgtaatgcacagttttaattgtagaggggaatttttcgtacttgggagtcggccat

SEQ ID NO: 406514 - DNA, 140 bp, Artificial Sequence
  Synthetic
atggccgactcccaagtacgaaaaattcccctctacaattaaaactgtgcattacaatttctgggtcccctcctgaagatcgattaaaggctattgttttattattcccaaattgttctcggagacccagcatggcgtat

SEQ ID NO: 406515 - DNA, 140 bp, Artificial Sequence
  Synthetic
atacgccatgctgggtctccaacaaacacaaagagcttggaaagccattcttcacatacctagcacaatcaaacagggcttcaaaagggctttgctatagcatgggaggcaaatggtcaacgtacttgggagtcggccat

SEQ ID NO: 406516 - DNA, 140 bp, Artificial Sequence
  Synthetic
atggccgactcccaagtacgttgaccatttgcctcccatgctatagcaaagcccttttgaagccctgtttgattgtgctaggtatgtgaagaatggctttccaagctctttgtgtttgttggagacccagcatggcgtat

SEQ ID NO: 406517 - DNA, 140 bp, Artificial Sequence
  Synthetic
aggccctggctgctgatatgatagcaatagcagcattagtagtagcactaataatagcaatagttgtgtggaccatagtattcatagaatataggagaataaaaaggcaaagaaaaataggaccttttgggacagcggtg

SEQ ID NO: 406518 - DNA, 140 bp, Artificial Sequence
  Synthetic
caccgctgtcccaaaaggtcctatttttctttgcctttttattctcctatattctatgaatactatggtccacacaactattgctattattagtgctactactaatgctgctattgctatcatatcagcagccagggcct

SEQ ID NO: 406519 - DNA, 140 bp, Artificial Sequence
  Synthetic
atacgccatgctgggtctccatgctacctccaatgctagcatggaaggagaaatagaaaattgctctttcaatataaccacagaactaagagataagagaaagcaagaatatgcacttttcgtacttgggagtcggccat

SEQ ID NO: 406520 - DNA, 140 bp, Artificial Sequence
  Synthetic
atggccgactcccaagtacgaaaagtgcatattcttgctttctcttatctcttagttctgtggttatattgaaagagcaattttctatttctccttccatgctagcattggaggtagcatggagacccagcatggcgtat

SEQ ID NO: 406521 - DNA, 140 bp, Artificial Sequence
  Synthetic
aggccctggctgctgatatgcttttagaaacagcagaaggatgtcaacaaataatggaacagttacaatcaactctcaagacaggatcagaagaacttagatcattatttaatacaataggaccttttgggacagcggtg

SEQ ID NO: 406522 - DNA, 140 bp, Artificial Sequence
  Synthetic
caccgctgtcccaaaaggtcctattgtattaaataatgatctaagttcttctgatcctgtcttgagagttgattgtaactgttccattatttgttgacatccttctgctgtttctaaaagcatatcagcagccagggcct

SEQ ID NO: 406523 - DNA, 140 bp, Artificial Sequence
  Synthetic
aggccctggctgctgatatgatggggtgggagcagcatctcgggacctggaaaaatatggagcaatcacaagtagcaatacagcaactaccaatgctgcttgtgcctggctagaagcacagaccttttgggacagcggtg

SEQ ID NO: 406524 - DNA, 140 bp, Artificial Sequence
  Synthetic
caccgctgtcccaaaaggtctgtgcttctagccaggcacaagcagcattggtagttgctgtattgctacttgtgattgctccatatttttccaggtcccgagatgctgctcccaccccatcatatcagcagccagggcct

SEQ ID NO: 406525 - DNA, 140 bp, Artificial Sequence
  Synthetic
aggccctggctgctgatatggagcattaggaccaggggctacattagaagaaatgatgacagcatgtcagggagtgggaggacctagccacaaagcaagggttttggctgaggcaatgaggaccttttgggacagcggtg

SEQ ID NO: 406526 - DNA, 140 bp, Artificial Sequence
  Synthetic
caccgctgtcccaaaaggtcctcattgcctcagccaaaacccttgctttgtggctaggtcctcccactccctgacatgctgtcatcatttcttctaatgtagcccctggtcctaatgctccatatcagcagccagggcct

SEQ ID NO: 406527 - DNA, 140 bp, Artificial Sequence
  Synthetic
atacgccatgctgggtctccatgagacctccagtgggataaaaaattgctctttcaatgcaaccacattattagaagataagaaagaggcagtgtatgcacttttttatagacttgatatcgtacttgggagtcggccat

SEQ ID NO: 406528 - DNA, 140 bp, Artificial Sequence
  Synthetic
atggccgactcccaagtacgatatcaagtctataaaaaagtgcatacactgcctctttcttatcttctaataatgtggttgcattgaaagagcaattttttatcccactggaggtctcatggagacccagcatggcgtat

SEQ ID NO: 406529 - DNA, 140 bp, Artificial Sequence
  Synthetic
aggccctggctgctgatatgttcagaagtacacatcccgctaggagaagctagactggtagtaaaaacatattggggtctgcatacaggagaaagagaatggcatttgggtcatggagtcgaccttttgggacagcggtg

SEQ ID NO: 406530 - DNA, 140 bp, Artificial Sequence
  Synthetic
caccgctgtcccaaaaggtcgactccatgacccaaatgccattctctttctcctgtatgcagaccccaatatgtttttactaccagtctagcttctcctagcgggatgtgtacttctgaacatatcagcagccagggcct

SEQ ID NO: 406531 - DNA, 140 bp, Artificial Sequence
  Synthetic
atacgccatgctgggtctcctacttttaattgtggaggagaattcttctattgtaatacatcaggattgtttaataaatcattattgaatgagactagtaatgagactacagatggtgcacgtacttgggagtcggccat

SEQ ID NO: 406532 - DNA, 140 bp, Artificial Sequence
  Synthetic
atggccgactcccaagtacgtgcaccatctgtagtctcattactagtctcattcaataatgatttattaaacaatcctgatgtattacaatagaagaattctcctccacaattaaaagtaggagacccagcatggcgtat

SEQ ID NO: 406533 - DNA, 140 bp, Artificial Sequence
  Synthetic
aggccctggctgctgatatgctggactgtcaatgatatacagaaattagtgggaaaactaaattgggcaagtcaaatttatgcagggattaaggtaaagcaactgtgtaaactcctcagggaccttttgggacagcggtg

SEQ ID NO: 406534 - DNA, 140 bp, Artificial Sequence
  Synthetic
caccgctgtcccaaaaggtccctgaggagtttacacagttgctttaccttaatccctgcataaatttgacttgcccaatttagttttcccactaatttctgtatatcattgacagtccagcatatcagcagccagggcct

SEQ ID NO: 406535 - DNA, 140 bp, Artificial Sequence
  Synthetic
aggccctggctgctgatatgcatgtggcaggaggtaggacgagcaatgtatgcccctcccattgcaggaaacataacatgtaaatcaaatatcacaggactactattggtacgtgatggagaccttttgggacagcggtg

SEQ ID NO: 406536 - DNA, 140 bp, Artificial Sequence
  Synthetic
caccgctgtcccaaaaggtctccatcacgtaccaatagtagtcctgtgatatttgatttacatgttatgtttcctgcaatgggaggggcatacattgctcgtcctacctcctgccacatgcatatcagcagccagggcct

SEQ ID NO: 406537 - DNA, 140 bp, Artificial Sequence
  Synthetic
aggccctggctgctgatatgatcagctcttcagacaggaacagaggaacttagatcattatataacacagtagcaactctctattgtgtacataaagagatagatgtacgagacaccaaggaccttttgggacagcggtg

SEQ ID NO: 406538 - DNA, 140 bp, Artificial Sequence
  Synthetic
caccgctgtcccaaaaggtccttggtgtctcgtacatctatctctttatgtacacaatagagagttgctactgtgttatataatgatctaagttcctctgttcctgtctgaagagctgatcatatcagcagccagggcct

SEQ ID NO: 406539 - DNA, 140 bp, Artificial Sequence
  Synthetic
aggccctggctgctgatatgtaagtattaaatattagtagttagtgtatgtaatgctgcctttacaaatctgggcaatagcaggactggtagtggcagcaatcctagcaatagttgtgtggaccttttgggacagcggtg

SEQ ID NO: 406540 - DNA, 140 bp, Artificial Sequence
  Synthetic
caccgctgtcccaaaaggtccacacaactattgctaggattgctgccactaccagtcctgctattgcccagatttgtaaaggcagcattacatacactaactactaatatttaatacttacatatcagcagccagggcct

SEQ ID NO: 406541 - DNA, 140 bp, Artificial Sequence
  Synthetic
aggccctggctgctgatatgaataaaaaactgctctttcaatgtcacctcaggcataagagataaggtacagaaagaatatgcacttttttataaagatgatgtagtaccaatagatattgaccttttgggacagcggtg

SEQ ID NO: 406542 - DNA, 140 bp, Artificial Sequence
  Synthetic
caccgctgtcccaaaaggtcaatatctattggtactacatcatctttataaaaaagtgcatattctttctgtaccttatctcttatgcctgaggtgacattgaaagagcagttttttattcatatcagcagccagggcct

SEQ ID NO: 406543 - DNA, 140 bp, Artificial Sequence
  Synthetic
atacgccatgctgggtctccaccaataaaagtaataagacggacaccgaggtggcaggagaaataaaaaactgctcttacaatatgactacaatgctaaaggataagaaacagcaagtatcgtacttgggagtcggccat

SEQ ID NO: 406544 - DNA, 140 bp, Artificial Sequence
  Synthetic
atggccgactcccaagtacgatacttgctgtttcttatcctttagcattgtagtcatattgtaagagcagttttttatttctcctgccacctcggtgtccgtcttattacttttattggtggagacccagcatggcgtat

SEQ ID NO: 406545 - DNA, 140 bp, Artificial Sequence
  Synthetic
atacgccatgctgggtctccaaggaaaagtatacatataggaccaggaagggcattttatacaacaggagacataataggagatataagaaaagcatattgtaacatcagtagcgtagaccgtacttgggagtcggccat

SEQ ID NO: 406546 - DNA, 140 bp, Artificial Sequence
  Synthetic
atggccgactcccaagtacggtctacgctactgatgttacaatatgcttttcttatatctcctattatgtctcctgttgtataaaatgcccttcctggtcctatatgtatacttttccttggagacccagcatggcgtat

SEQ ID NO: 406547 - DNA, 140 bp, Artificial Sequence
  Synthetic
aggccctggctgctgatatgtggttcatgccatagcactagcagtacctgaaggaacagataggcttataaacagagtacaagaaatttgtagagctttcctcaacgttcctagaagcatgaccttttgggacagcggtg

SEQ ID NO: 406548 - DNA, 140 bp, Artificial Sequence
  Synthetic
caccgctgtcccaaaaggtcatgcttctaggaacgttgaggaaagctctacaaatttcttgtactctgtttataagcctatctgttccttcaggtactgctagtgctatggcatgaaccacatatcagcagccagggcct

SEQ ID NO: 406549 - DNA, 140 bp, Artificial Sequence
  Synthetic
aggccctggctgctgatatgtaataggagatataagaaaagcacattgtaacattagtaaagtagcatggaataaagcgttacaaaaagtagctaaaaaattaagagaccgtcttaacaagaccttttgggacagcggtg

SEQ ID NO: 406550 - DNA, 140 bp, Artificial Sequence
  Synthetic
caccgctgtcccaaaaggtcttgttaagacggtctcttaattttttagctactttttgtaacgctttattccatgctactttactaatgttacaatgtgcttttcttatatctcctattacatatcagcagccagggcct

SEQ ID NO: 406551 - DNA, 140 bp, Artificial Sequence
  Synthetic
aggccctggctgctgatatgtcttcagacctggaggaggaaatatgagggacaattggagaagtgaattatataaatataaagtagtaaaaattgaaccactaggagtagcacccaccaagaccttttgggacagcggtg

SEQ ID NO: 406552 - DNA, 140 bp, Artificial Sequence
  Synthetic
caccgctgtcccaaaaggtcttggtgggtgctactcctagtggttcaatttttactactttatatttatataattcacttctccaattgtccctcatatttcctcctccaggtctgaagacatatcagcagccagggcct

SEQ ID NO: 406553 - DNA, 140 bp, Artificial Sequence
  Synthetic
atacgccatgctgggtctccaacacacctttaattgtggaggagaatttttctattgtaacacatcaggcctgtttaatagcacttggaatgagaatgacatgaatggcactacaaatagcgtacttgggagtcggccat

SEQ ID NO: 406554 - DNA, 140 bp, Artificial Sequence
  Synthetic
atggccgactcccaagtacgctatttgtagtgccattcatgtcattctcattccaagtgctattaaacaggcctgatgtgttacaatagaaaaattctcctccacaattaaaggtgtgttggagacccagcatggcgtat

SEQ ID NO: 406555 - DNA, 140 bp, Artificial Sequence
  Synthetic
aggccctggctgctgatatgaaagcgaaagtaagaccagaggagaactctcgacgcaggactcggcttgctgaagtgcactcggcaagaggcgaggggcggcgactggtgagtacgccgagaccttttgggacagcggtg

SEQ ID NO: 406556 - DNA, 140 bp, Artificial Sequence
  Synthetic
caccgctgtcccaaaaggtctcggcgtactcaccagtcgccgcccctcgcctcttgccgagtgcacttcagcaagccgagtcctgcgtcgagagttctcctctggtcttactttcgctttcatatcagcagccagggcct

SEQ ID NO: 406557 - DNA, 140 bp, Artificial Sequence
  Synthetic
atacgccatgctgggtctcccacagacgagaacataactctgacatgtagaataagacaaattataaatatgtggcagagaacaggacaagcaatatatgcccctcccattgaaggactacgtacttgggagtcggccat

SEQ ID NO: 406558 - DNA, 140 bp, Artificial Sequence
  Synthetic
atggccgactcccaagtacgtagtccttcaatgggaggggcatatattgcttgtcctgttctctgccacatatttataatttgtcttattctacatgtcagagttatgttctcgtctgtgggagacccagcatggcgtat

SEQ ID NO: 406559 - DNA, 140 bp, Artificial Sequence
  Synthetic
aggccctggctgctgatatggctgtaaacaaataataaaacagctacaaccagctcttaagacaggaacagaggaacttagatcattatacaacacagtagcaactctctattgtgtacagaccttttgggacagcggtg

SEQ ID NO: 406560 - DNA, 140 bp, Artificial Sequence
  Synthetic
caccgctgtcccaaaaggtctgtacacaatagagagttgctactgtgttgtataatgatctaagttcctctgttcctgtcttaagagctggttgtagctgttttattatttgtttacagccatatcagcagccagggcct

SEQ ID NO: 406561 - DNA, 140 bp, Artificial Sequence
  Synthetic
aggccctggctgctgatatgtactgtactttctatagtgaatagagttaggcagggatactcaccattgtcgtttcagacccacctcccagccaggaggggacccgacaggcccgaaggagaccttttgggacagcggtg

SEQ ID NO: 406562 - DNA, 140 bp, Artificial Sequence
  Synthetic
caccgctgtcccaaaaggtctccttcgggcctgtcgggtcccctcctggctgggaggtgggtctgaaacgacaatggtgagtatccctgcctaactctattcactatagaaagtacagtacatatcagcagccagggcct

SEQ ID NO: 406563 - DNA, 140 bp, Artificial Sequence
  Synthetic
atacgccatgctgggtctccagtgggtggcctgctgtaagggaaaaaatgagacgagctgaaccagcagagggaaggggagctgagccagcagcagaaggagtgggagcagcatctcgagcgtacttgggagtcggccat

SEQ ID NO: 406564 - DNA, 140 bp, Artificial Sequence
  Synthetic
atggccgactcccaagtacgctcgagatgctgctcccactccttctgctgctggctcagctccccttccctctgctggttcagctcgtctcattttttcccttacagcaggccacccactggagacccagcatggcgtat

SEQ ID NO: 406565 - DNA, 140 bp, Artificial Sequence
  Synthetic
atacgccatgctgggtctccatgcagagaggcaattttaaaggccctaaaagaattgttaaatgtttcaactgtggcaaggaagggcacatagccaaaaattgcagggcccctaggaaaacgtacttgggagtcggccat

SEQ ID NO: 406566 - DNA, 140 bp, Artificial Sequence
  Synthetic
atggccgactcccaagtacgttttcctaggggccctgcaatttttggctatgtgcccttccttgccacagttgaaacatttaacaattcttttagggcctttaaaattgcctctctgcatggagacccagcatggcgtat

SEQ ID NO: 406567 - DNA, 140 bp, Artificial Sequence
  Synthetic
aggccctggctgctgatatgctgtggcaaggaagggcacatagccaaaaattgcagggcccctaggaaaaaaggctgttggaaatgtggaaaggaaggacaccaaatgaaagactgtactgaccttttgggacagcggtg

SEQ ID NO: 406568 - DNA, 140 bp, Artificial Sequence
  Synthetic
caccgctgtcccaaaaggtcagtacagtctttcatttggtgtccttcctttccacatttccaacagccttttttcctaggggccctgcaatttttggctatgtgcccttccttgccacagcatatcagcagccagggcct

SEQ ID NO: 406569 - DNA, 140 bp, Artificial Sequence
  Synthetic
aggccctggctgctgatatgtgggtggcaaatggtcaaaaagtagtatagttggatggcctgctataagggaaagaataagaaaagctgatccagcagcagaaggggtgggagcagcatcgaccttttgggacagcggtg

SEQ ID NO: 406570 - DNA, 140 bp, Artificial Sequence
  Synthetic
caccgctgtcccaaaaggtcgatgctgctcccaccccttctgctgctggatcagcttttcttattctttcccttatagcaggccatccaactatactactttttgaccatttgccacccacatatcagcagccagggcct

SEQ ID NO: 406571 - DNA, 140 bp, Artificial Sequence
  Synthetic
atacgccatgctgggtctcccatttcctatggcaggaagaagcggagacagcgacgaagcactcctctgcgcagtgaggaccatcagactcctgtatcaaagcagtgagtaactgtaatgcgtacttgggagtcggccat

SEQ ID NO: 406572 - DNA, 140 bp, Artificial Sequence
  Synthetic
atggccgactcccaagtacgcattacagttactcactgctttgatacaggagtctgatggtcctcactgcgcagaggagtgcttcgtcgctgtctccgcttcttcctgccataggaaatgggagacccagcatggcgtat

SEQ ID NO: 406573 - DNA, 140 bp, Artificial Sequence
  Synthetic
atacgccatgctgggtctccatgggtgcgagagcgtcagtattgagcgggggaaaattagatgcgtgggagaaaattcggttaaggcgggggggaagaaaaatatataaacaaaacttgtcgtacttgggagtcggccat

SEQ ID NO: 406574 - DNA, 140 bp, Artificial Sequence
  Synthetic
atggccgactcccaagtacgacaagttttgtttatatatttttcttcccccccgccttaaccgaattttctcccacgcatctaattttcccccgctcaatactgacgctctcgcacccatggagacccagcatggcgtat

SEQ ID NO: 406575 - DNA, 140 bp, Artificial Sequence
  Synthetic
aggccctggctgctgatatggaaaattcggttaaggcgggggggaagaaaaatatataaacaaaacttgtgtatgggcaagcggggagctggaaagattccacttaaccctagccttttagaccttttgggacagcggtg

SEQ ID NO: 406576 - DNA, 140 bp, Artificial Sequence
  Synthetic
caccgctgtcccaaaaggtctaaaaggctagggttaagtggaatctttccagctccccgcttgcccatacacaagttttgtttatatatttttcttcccccccgccttaaccgaattttccatatcagcagccagggcct

SEQ ID NO: 406577 - DNA, 140 bp, Artificial Sequence
  Synthetic
aggccctggctgctgatatgttgtgctccagctggttttgcgattctaaaatgtaataacaaaacgttcaatgggacagggccatgcaataatgttagtacagtacaatgcacacatggagaccttttgggacagcggtg

SEQ ID NO: 406578 - DNA, 140 bp, Artificial Sequence
  Synthetic
caccgctgtcccaaaaggtctccatgtgtgcattgtactgtactaacattattgcatggccctgtcccattgaacgttttgttattacattttagaatcgcaaaaccagctggagcacaacatatcagcagccagggcct

SEQ ID NO: 406579 - DNA, 140 bp, Artificial Sequence
  Synthetic
atacgccatgctgggtctccaagataagaacaagtatgcggataggaccaggacaagtattctataaaacaggagacataataggaaatataagaaaagcatattgtgagattaatggaacgtacttgggagtcggccat

SEQ ID NO: 406580 - DNA, 140 bp, Artificial Sequence
  Synthetic
atggccgactcccaagtacgttccattaatctcacaatatgcttttcttatatttcctattatgtctcctgttttatagaatacttgtcctggtcctatccgcatacttgttcttatcttggagacccagcatggcgtat

SEQ ID NO: 406581 - DNA, 140 bp, Artificial Sequence
  Synthetic
atacgccatgctgggtctccaatgctactaataccactagtagtagcggggggatgatggaaaaaggagaaataaaaaattgctctttcaatatcaccacaagcataagagatagggtgccgtacttgggagtcggccat

SEQ ID NO: 406582 - DNA, 140 bp, Artificial Sequence
  Synthetic
atggccgactcccaagtacggcaccctatctcttatgcttgtggtgatattgaaagagcaattttttatttctcctttttccatcatccccccgctactactagtggtattagtagcattggagacccagcatggcgtat

SEQ ID NO: 406583 - DNA, 140 bp, Artificial Sequence
  Synthetic
atacgccatgctgggtctccgtaaccacagaaataagagatagggacagaaaggaatatgcactcttttataggcctgatatagtacaacttagtgataaaagcaattctagaaatgaaacgtacttgggagtcggccat

SEQ ID NO: 406584 - DNA, 140 bp, Artificial Sequence
  Synthetic
atggccgactcccaagtacgtttcatttctagaattgcttttatcactaagttgtactatatcaggcctataaaagagtgcatattcctttctgtccctatctcttatttctgtggttacggagacccagcatggcgtat

SEQ ID NO: 406585 - DNA, 140 bp, Artificial Sequence
  Synthetic
aggccctggctgctgatatgtccagaaatagtcatctatcaatatatggatgacttgtatgtaggatctgacttagaaatagggcaacatagagcaaaaatagaggagttaagagaacatgaccttttgggacagcggtg

SEQ ID NO: 406586 - DNA, 140 bp, Artificial Sequence
  Synthetic
caccgctgtcccaaaaggtcatgttctcttaactcctctatttttgctctatgttgccctatttctaagtcagatcctacatacaagtcatccatatattgatagatgactatttctggacatatcagcagccagggcct

SEQ ID NO: 406587 - DNA, 140 bp, Artificial Sequence
  Synthetic
aggccctggctgctgatatgaagtatacctatgggaccaggcaaagcattttacacaacaggacaaataataggggatataagacaagcacattgtaacattagtagagaaaaatggaatgaccttttgggacagcggtg

SEQ ID NO: 406588 - DNA, 140 bp, Artificial Sequence
  Synthetic
caccgctgtcccaaaaggtcattccatttttctctactaatgttacaatgtgcttgtcttatatcccctattatttgtcctgttgtgtaaaatgctttgcctggtcccataggtatacttcatatcagcagccagggcct

SEQ ID NO: 406589 - DNA, 140 bp, Artificial Sequence
  Synthetic
aggccctggctgctgatatgaggatcaacagctcctagggatttggggctgctctggaaaactcatctgcaccactaatgtaccttggaactatagttggagtcctaaaaaagaggacgagaccttttgggacagcggtg

SEQ ID NO: 406590 - DNA, 140 bp, Artificial Sequence
  Synthetic
caccgctgtcccaaaaggtctcgtcctcttttttaggactccaactatagttccaaggtacattagtggtgcagatgagttttccagagcagccccaaatccctaggagctgttgatcctcatatcagcagccagggcct

SEQ ID NO: 406591 - DNA, 140 bp, Artificial Sequence
  Synthetic
aggccctggctgctgatatgttatgggatcaaagcctaaagccatgtgtaaagttgaccccactctgtgtcactttaaactgtagcaataatgttaaaaatgctaccaacagtatgaagggaccttttgggacagcggtg

SEQ ID NO: 406592 - DNA, 140 bp, Artificial Sequence
  Synthetic
caccgctgtcccaaaaggtcccttcatactgttggtagcatttttaacattattgctacagtttaaagtgacacagagtggggtcaactttacacatggctttaggctttgatcccataacatatcagcagccagggcct

SEQ ID NO: 406593 - DNA, 140 bp, Artificial Sequence
  Synthetic
atacgccatgctgggtctccctgatagggttttagaactattacaaagaacctttagagctattatccacatacctacacgaatcagacagggcttggaaagggctttgctataagatggcgtacttgggagtcggccat

SEQ ID NO: 406594 - DNA, 140 bp, Artificial Sequence
  Synthetic
atggccgactcccaagtacgccatcttatagcaaagccctttccaagccctgtctgattcgtgtaggtatgtggataatagctctaaaggttctttgtaatagttctaaaaccctatcagggagacccagcatggcgtat

SEQ ID NO: 406595 - DNA, 140 bp, Artificial Sequence
  Synthetic
atacgccatgctgggtctcctaaggataggaccaggacaagcattctatacaacaaatgccatactaggaaacataagacaagcatattgtaacattagtacaaacaaatggaacacagccgtacttgggagtcggccat

SEQ ID NO: 406596 - DNA, 140 bp, Artificial Sequence
  Synthetic
atggccgactcccaagtacggctgtgttccatttgtttgtactaatgttacaatatgcttgtcttatgtttcctagtatggcatttgttgtatagaatgcttgtcctggtcctatccttaggagacccagcatggcgtat

SEQ ID NO: 406597 - DNA, 140 bp, Artificial Sequence
  Synthetic
aggccctggctgctgatatgtagcacacaaatagatcctgacctagcagaccgactgattcatctgcaatattttgactgtttttcagaatctgccataaggaaagccatattaggacaagaccttttgggacagcggtg

SEQ ID NO: 406598 - DNA, 140 bp, Artificial Sequence
  Synthetic
caccgctgtcccaaaaggtcttgtcctaatatggctttccttatggcagattctgaaaaacagtcaaaatattgcagatgaatcagtcggtctgctaggtcaggatctatttgtgtgctacatatcagcagccagggcct

SEQ ID NO: 406599 - DNA, 140 bp, Artificial Sequence
  Synthetic
aggccctggctgctgatatgacaagtagataaattagtcagttctggaatcaggaaggtactatttttagatgggatagataaggctcaagaagaacatgaaaaatatcacagcaattgggaccttttgggacagcggtg

SEQ ID NO: 406600 - DNA, 140 bp, Artificial Sequence
  Synthetic
caccgctgtcccaaaaggtcccaattgctgtgatatttttcatgttcttcttgagccttatctatcccatctaaaaatagtaccttcctgattccagaactgactaatttatctacttgtcatatcagcagccagggcct

SEQ ID NO: 406601 - DNA, 140 bp, Artificial Sequence
  Synthetic
atacgccatgctgggtctccgtagcaactctctattgtgtacatagcaaaatagaggtaagagacaccaaagaagccttagacaagatagaggaagaacaaaataaatgtctacaaaaaacgtacttgggagtcggccat

SEQ ID NO: 406602 - DNA, 140 bp, Artificial Sequence
  Synthetic
atggccgactcccaagtacgttttttgtagacatttattttgttcttcctctatcttgtctaaggcttctttggtgtctcttacctctattttgctatgtacacaatagagagttgctacggagacccagcatggcgtat

SEQ ID NO: 406603 - DNA, 140 bp, Artificial Sequence
  Synthetic
aggccctggctgctgatatgttgcaataaaatggggggcaagtggtcaaaaagcagtttagttgggtggcctgcagtaagagacagaatgaagagaactgatccaaaaagaaatgatccagaccttttgggacagcggtg

SEQ ID NO: 406604 - DNA, 140 bp, Artificial Sequence
  Synthetic
caccgctgtcccaaaaggtctggatcatttctttttggatcagttctcttcattctgtctcttactgcaggccacccaactaaactgctttttgaccacttgccccccattttattgcaacatatcagcagccagggcct

SEQ ID NO: 406605 - DNA, 140 bp, Artificial Sequence
  Synthetic
aggccctggctgctgatatggtgtggatcatagtatatatagaatataggaaattggtaaaacaaagaaaaatagaccagttaattaaaagaattagggaaagagcagaagacagtggcagaccttttgggacagcggtg

SEQ ID NO: 406606 - DNA, 140 bp, Artificial Sequence
  Synthetic
caccgctgtcccaaaaggtctgccactgtcttctgctctttccctaattcttttaattaactggtctatttttctttgttttaccaatttcctatattctatatatactatgatccacaccatatcagcagccagggcct

SEQ ID NO: 406607 - DNA, 140 bp, Artificial Sequence
  Synthetic
aggccctggctgctgatatgatagttggagtaataaatctcaagattatatttggggaaacatgacctggatgcaatgggataaagaaattagcaattacacagaaacaatatacaggttgaccttttgggacagcggtg

SEQ ID NO: 406608 - DNA, 140 bp, Artificial Sequence
  Synthetic
caccgctgtcccaaaaggtcaacctgtatattgtttctgtgtaattgctaatttctttatcccattgcatccaggtcatgtttccccaaatataatcttgagatttattactccaactatcatatcagcagccagggcct

SEQ ID NO: 406609 - DNA, 140 bp, Artificial Sequence
  Synthetic
atacgccatgctgggtctccataatgttactataaatagtacccgcattaaaaacagtgaggaaataaaaaattgctctttcaatacaaccacagaattaagagatagacggaagaaagacgtacttgggagtcggccat

SEQ ID NO: 406610 - DNA, 140 bp, Artificial Sequence
  Synthetic
atggccgactcccaagtacgtctttcttccgtctatctcttaattctgtggttgtattgaaagagcaattttttatttcctcactgtttttaatgcgggtactatttatagtaacattatggagacccagcatggcgtat

SEQ ID NO: 406611 - DNA, 140 bp, Artificial Sequence
  Synthetic
atacgccatgctgggtctccaatgttagtgttaccaatagtagtattcccaatgagaccatgagaaattgctctttcaatgtaaccacagaaataagagataagcaaaagcaagagtatgcgtacttgggagtcggccat

SEQ ID NO: 406612 - DNA, 140 bp, Artificial Sequence
  Synthetic
atggccgactcccaagtacgcatactcttgcttttgcttatctcttatttctgtggttacattgaaagagcaatttctcatggtctcattgggaatactactattggtaacactaacattggagacccagcatggcgtat

SEQ ID NO: 406613 - DNA, 140 bp, Artificial Sequence
  Synthetic
atacgccatgctgggtctcccagcagaaggagtaggagcagcgtctcaagacttggataaacgtggggcgcttacaatcaacaacacagccaacaataatcctgattgtgcctggctggacgtacttgggagtcggccat

SEQ ID NO: 406614 - DNA, 140 bp, Artificial Sequence
  Synthetic
atggccgactcccaagtacgtccagccaggcacaatcaggattattgttggctgtgttgttgattgtaagcgccccacgtttatccaagtcttgagacgctgctcctactccttctgctgggagacccagcatggcgtat

SEQ ID NO: 406615 - DNA, 140 bp, Artificial Sequence
  Synthetic
atacgccatgctgggtctccacaacaaatctacaacacctatgggaatacttggcaaggagctgcagttctaatgagaactttgcaacgactattgtttgttcatttcagaattgggtgccgtacttgggagtcggccat

SEQ ID NO: 406616 - DNA, 140 bp, Artificial Sequence
  Synthetic
atggccgactcccaagtacggcacccaattctgaaatgaacaaacaatagtcgttgcaaagttctcattagaactgcagctccttgccaagtattcccataggtgttgtagatttgttgtggagacccagcatggcgtat

SEQ ID NO: 406617 - DNA, 140 bp, Artificial Sequence
  Synthetic
atacgccatgctgggtctccaggttaggagtaggagcattaataatagcactaatcttagcaataattgtgtggaccatagcatatttagaatataggaaattgcaaaagcaaaaaagaacgtacttgggagtcggccat

SEQ ID NO: 406618 - DNA, 140 bp, Artificial Sequence
  Synthetic
atggccgactcccaagtacgttcttttttgcttttgcaatttcctatattctaaatatgctatggtccacacaattattgctaagattagtgctattattaatgctcctactcctaacctggagacccagcatggcgtat

SEQ ID NO: 406619 - DNA, 140 bp, Artificial Sequence
  Synthetic
aggccctggctgctgatatgtctttaatcaatcctcaggaggggacccagagattgtaatgcacagttttaattgtggaggggaatttttctactgtaatacatcacaactgtttaataggaccttttgggacagcggtg

SEQ ID NO: 406620 - DNA, 140 bp, Artificial Sequence
  Synthetic
caccgctgtcccaaaaggtcctattaaacagttgtgatgtattacagtagaaaaattcccctccacaattaaaactgtgcattacaatctctgggtcccctcctgaggattgattaaagacatatcagcagccagggcct

SEQ ID NO: 406621 - DNA, 140 bp, Artificial Sequence
  Synthetic
atacgccatgctgggtctccactaaaaataatagtagtagtactaccacttctgcccctaacaccactgctcaaggggaactgatgggagatggaataaaaaactgctctttcaatgttacgtacttgggagtcggccat

SEQ ID NO: 406622 - DNA, 140 bp, Artificial Sequence
  Synthetic
atggccgactcccaagtacgtaacattgaaagagcagttttttattccatctcccatcagttccccttgagcagtggtgttaggggcagaagtggtagtactactactattatttttagtggagacccagcatggcgtat

SEQ ID NO: 406623 - DNA, 140 bp, Artificial Sequence
  Synthetic
atacgccatgctgggtctcccagtaccgctgtaaaggaaatgacagatgacataaaaaactgctcttacaatatgaccacagaattaagggataaacaacaggaagtacgttcactttttcgtacttgggagtcggccat

SEQ ID NO: 406624 - DNA, 140 bp, Artificial Sequence
  Synthetic
atggccgactcccaagtacgaaaaagtgaacgtacttcctgttgtttatcccttaattctgtggtcatattgtaagagcagttttttatgtcatctgtcatttcctttacagcggtactgggagacccagcatggcgtat

SEQ ID NO: 406625 - DNA, 140 bp, Artificial Sequence
  Synthetic
atacgccatgctgggtctccacaaattaattgtaccagacctaataacaatacaagaaagagtgtacgcataggaccaggacaagcattctatgcaacaggtgcaataacaggggatatacgtacttgggagtcggccat

SEQ ID NO: 406626 - DNA, 140 bp, Artificial Sequence
  Synthetic
atggccgactcccaagtacgtatatcccctgttattgcacctgttgcatagaatgcttgtcctggtcctatgcgtacactctttcttgtattgttattaggtctggtacaattaatttgtggagacccagcatggcgtat

SEQ ID NO: 406627 - DNA, 140 bp, Artificial Sequence
  Synthetic
aggccctggctgctgatatgtaggaccaggacaagcattctatgcaacaggtgcaataacaggggatataagacgagcatattgtaatatcagtagaaaagaatggaatgacactctgcagaccttttgggacagcggtg

SEQ ID NO: 406628 - DNA, 140 bp, Artificial Sequence
  Synthetic
caccgctgtcccaaaaggtctgcagagtgtcattccattcttttctactgatattacaatatgctcgtcttatatcccctgttattgcacctgttgcatagaatgcttgtcctggtcctacatatcagcagccagggcct

SEQ ID NO: 406629 - DNA, 140 bp, Artificial Sequence
  Synthetic
atacgccatgctgggtctccttaccaactcctcaggaggggatctagaaataacaacacacatgtttaattgtggaggagaatttttctattgtaacacaacagacttgtttaatagcagcgtacttgggagtcggccat

SEQ ID NO: 406630 - DNA, 140 bp, Artificial Sequence
  Synthetic
atggccgactcccaagtacgctgctattaaacaagtctgttgtgttacaatagaaaaattctcctccacaattaaacatgtgtgttgttatttctagatcccctcctgaggagttggtaaggagacccagcatggcgtat

SEQ ID NO: 406631 - DNA, 140 bp, Artificial Sequence
  Synthetic
aggccctggctgctgatatgtgtcaatgctaccaatgtcagtaacacaaccgaagccccaaacatagtaggaacagatgaagtaaagaactgttcttttaatgtgaccacagaactaagagaccttttgggacagcggtg

SEQ ID NO: 406632 - DNA, 140 bp, Artificial Sequence
  Synthetic
caccgctgtcccaaaaggtctcttagttctgtggtcacattaaaagaacagttctttacttcatctgttcctactatgtttggggcttcggttgtgttactgacattggtagcattgacacatatcagcagccagggcct

SEQ ID NO: 406633 - DNA, 140 bp, Artificial Sequence
  Synthetic
aggccctggctgctgatatgtggtatataagaatatttataatgatagtaggaggcttaataggcttaagaatagtttttgctgtgctttctatagtaaatagagttaggcagggatactgaccttttgggacagcggtg

SEQ ID NO: 406634 - DNA, 140 bp, Artificial Sequence
  Synthetic
caccgctgtcccaaaaggtcagtatccctgcctaactctatttactatagaaagcacagcaaaaactattcttaagcctattaagcctcctactatcattataaatattcttatataccacatatcagcagccagggcct

SEQ ID NO: 406635 - DNA, 140 bp, Artificial Sequence
  Synthetic
atacgccatgctgggtctccaaggcttttgctataagatgggtggcaagtggtcaaaatgcagtatgggtggatggcctgatgtaagagaaagaatgagacgagaaccagcagcagagggcgtacttgggagtcggccat

SEQ ID NO: 406636 - DNA, 140 bp, Artificial Sequence
  Synthetic
atggccgactcccaagtacgccctctgctgctggttctcgtctcattctttctcttacatcaggccatccacccatactgcattttgaccacttgccacccatcttatagcaaaagccttggagacccagcatggcgtat

SEQ ID NO: 406637 - DNA, 140 bp, Artificial Sequence
  Synthetic
atacgccatgctgggtctccgaaaggagaaataaaaaactgctctttcaatatcaccacaagcccaagagataagatacagaaagaatatgcactttttaattcacttgatgtaacaccacgtacttgggagtcggccat

SEQ ID NO: 406638 - DNA, 140 bp, Artificial Sequence
  Synthetic
atggccgactcccaagtacgtggtgttacatcaagtgaattaaaaagtgcatattctttctgtatcttatctcttgggcttgtggtgatattgaaagagcagttttttatttctcctttcggagacccagcatggcgtat

SEQ ID NO: 406639 - DNA, 140 bp, Artificial Sequence
  Synthetic
aggccctggctgctgatatgagagacttcatcttgattgcagcgaggactgtggaacttctgggacacagcagtctcaagggactgagacgggggtgggaaggcctcaaatatctgtggagaccttttgggacagcggtg

SEQ ID NO: 406640 - DNA, 140 bp, Artificial Sequence
  Synthetic
caccgctgtcccaaaaggtctccacagatatttgaggccttcccacccccgtctcagtcccttgagactgctgtgtcccagaagttccacagtcctcgctgcaatcaagatgaagtctctcatatcagcagccagggcct

SEQ ID NO: 406641 - DNA, 140 bp, Artificial Sequence
  Synthetic
atacgccatgctgggtctcctgctactaatgctactgctattaatgctacagggggggaagaaataaaaaattgcactttcaatacaaccacagaattaagagataggatacagaaagtgcgtacttgggagtcggccat

SEQ ID NO: 406642 - DNA, 140 bp, Artificial Sequence
  Synthetic
atggccgactcccaagtacgcactttctgtatcctatctcttaattctgtggttgtattgaaagtgcaattttttatttcttccccccctgtagcattaatagcagtagcattagtagcaggagacccagcatggcgtat

SEQ ID NO: 406643 - DNA, 140 bp, Artificial Sequence
  Synthetic
aggccctggctgctgatatgtagcagaagaagaggtagtaattagatctgacaatttcacaaacaatgctaaaatcataatagtacatctgaacgaatctgtagaaattaattgtacaaggaccttttgggacagcggtg

SEQ ID NO: 406644 - DNA, 140 bp, Artificial Sequence
  Synthetic
caccgctgtcccaaaaggtccttgtacaattaatttctacagattcgttcagatgtactattatgattttagcattgtttgtgaaattgtcagatctaattactacctcttcttctgctacatatcagcagccagggcct

SEQ ID NO: 406645 - DNA, 140 bp, Artificial Sequence
  Synthetic
atacgccatgctgggtctccgtataaggataggaccaggacaagcattctttgcaaatgccataataggagacataaggcaagcacattgtaacattagcagagaacaatggaacagagccgtacttgggagtcggccat

SEQ ID NO: 406646 - DNA, 140 bp, Artificial Sequence
  Synthetic
atggccgactcccaagtacggctctgttccattgttctctgctaatgttacaatgtgcttgccttatgtctcctattatggcatttgcaaagaatgcttgtcctggtcctatccttatacggagacccagcatggcgtat

SEQ ID NO: 406647 - DNA, 140 bp, Artificial Sequence
  Synthetic
aggccctggctgctgatatgaatttgaaccacactcaggaggggatctagaagttacaacacatagttttaattgtagaggagaatttttctattgcaatacatcaaaactgtttaatacgaccttttgggacagcggtg

SEQ ID NO: 406648 - DNA, 140 bp, Artificial Sequence
  Synthetic
caccgctgtcccaaaaggtcgtattaaacagttttgatgtattgcaatagaaaaattctcctctacaattaaaactatgtgttgtaacttctagatcccctcctgagtgtggttcaaattcatatcagcagccagggcct

SEQ ID NO: 406649 - DNA, 140 bp, Artificial Sequence
  Synthetic
aggccctggctgctgatatgtgttccttgggttcttgggagcagcaggaagcactatgggcgcagcgtcagtgacgctgacggtacaggccagacaattattgtctggtatagtgcaacagaccttttgggacagcggtg

SEQ ID NO: 406650 - DNA, 140 bp, Artificial Sequence
  Synthetic
caccgctgtcccaaaaggtctgttgcactataccagacaataattgtctggcctgtaccgtcagcgtcactgacgctgcgcccatagtgcttcctgctgctcccaagaacccaaggaacacatatcagcagccagggcct

SEQ ID NO: 406651 - DNA, 140 bp, Artificial Sequence
  Synthetic
atacgccatgctgggtctcctagtagatgtaatgatagagttaatagctgcagtagattatagaataggagtagcagcacttataatagcactaatcatagcaatagttgtgtggaccatcgtacttgggagtcggccat

SEQ ID NO: 406652 - DNA, 140 bp, Artificial Sequence
  Synthetic
atggccgactcccaagtacgatggtccacacaactattgctatgattagtgctattataagtgctgctactcctattctataatctactgcagctattaactctatcattacatctactaggagacccagcatggcgtat

SEQ ID NO: 406653 - DNA, 140 bp, Artificial Sequence
  Synthetic
atacgccatgctgggtctccagagaaattggtaattactcaaacacaatatacaggttgcttgaaaattcgcaaacccagcaggagcagaatgaaaaagatttattggcattggacagctcgtacttgggagtcggccat

SEQ ID NO: 406654 - DNA, 140 bp, Artificial Sequence
  Synthetic
atggccgactcccaagtacgagctgtccaatgccaataaatctttttcattctgctcctgctgggtttgcgaattttcaagcaacctgtatattgtgtttgagtaattaccaatttctctggagacccagcatggcgtat

SEQ ID NO: 406655 - DNA, 140 bp, Artificial Sequence
  Synthetic
atacgccatgctgggtctcctgaccccactctgtgtcactttaaactgtattaatgttactaatgctaccaatgttactaatgctgactataaaaattgctctttcaatataaccacagacgtacttgggagtcggccat

SEQ ID NO: 406656 - DNA, 140 bp, Artificial Sequence
  Synthetic
atggccgactcccaagtacgtctgtggttatattgaaagagcaatttttatagtcagcattagtaacattggtagcattagtaacattaatacagtttaaagtgacacagagtggggtcaggagacccagcatggcgtat

SEQ ID NO: 406657 - DNA, 140 bp, Artificial Sequence
  Synthetic
atacgccatgctgggtctccgcatagttagatggcctgctgtaagagaaagaataaggcgcactgagccagtagcagagggagtaagaacagcatctcgagacttagagaaacatggagccgtacttgggagtcggccat

SEQ ID NO: 406658 - DNA, 140 bp, Artificial Sequence
  Synthetic
atggccgactcccaagtacggctccatgtttctctaagtctcgagatgctgttcttactccctctgctactggctcagtgcgccttattctttctcttacagcaggccatctaactatgcggagacccagcatggcgtat

SEQ ID NO: 406659 - DNA, 140 bp, Artificial Sequence
  Synthetic
aggccctggctgctgatatgttaattaaaagaattagggaaagagcagaagacagtggcaatgagagtgagggggatactgaggaattatcaacaatggtggatatggggcatcttaggcgaccttttgggacagcggtg

SEQ ID NO: 406660 - DNA, 140 bp, Artificial Sequence
  Synthetic
caccgctgtcccaaaaggtcgcctaagatgccccatatccaccattgttgataattcctcagtatccccctcactctcattgccactgtcttctgctctttccctaattcttttaattaacatatcagcagccagggcct

SEQ ID NO: 406661 - DNA, 140 bp, Artificial Sequence
  Synthetic
atacgccatgctgggtctccctagtaatggggaagaaatacaacagtgttttttcaatgtaaccacagaaatgagagataagaagcagagggtgcatgcacttttttatagacttgatctcgtacttgggagtcggccat

SEQ ID NO: 406662 - DNA, 140 bp, Artificial Sequence
  Synthetic
atggccgactcccaagtacgagatcaagtctataaaaaagtgcatgcaccctctgcttcttatctctcatttctgtggttacattgaaaaaacactgttgtatttcttccccattactagggagacccagcatggcgtat

SEQ ID NO: 406663 - DNA, 140 bp, Artificial Sequence
  Synthetic
atacgccatgctgggtctccgtctgctcacactaatgatgtaagacaattaacagaagtggtgcaaaaaatagccacagaaagcatagtaatatggggaaagacccctaaatttagactacgtacttgggagtcggccat

SEQ ID NO: 406664 - DNA, 140 bp, Artificial Sequence
  Synthetic
atggccgactcccaagtacgtagtctaaatttaggggtctttccccatattactatgctttctgtggctattttttgcaccacttctgttaattgtcttacatcattagtgtgagcagacggagacccagcatggcgtat

SEQ ID NO: 406665 - DNA, 140 bp, Artificial Sequence
  Synthetic
aggccctggctgctgatatgaaattagtaactacacaaacacaatatacaggttgcttgaaaactcgcaaatccagcaggaacaaaatgaaaaggatttactagcattggacagttggaagaccttttgggacagcggtg

SEQ ID NO: 406666 - DNA, 140 bp, Artificial Sequence
  Synthetic
caccgctgtcccaaaaggtcttccaactgtccaatgctagtaaatccttttcattttgttcctgctggatttgcgagttttcaagcaacctgtatattgtgtttgtgtagttactaatttcatatcagcagccagggcct

SEQ ID NO: 406667 - DNA, 140 bp, Artificial Sequence
  Synthetic
aggccctggctgctgatatgacaatcccatgcagaataaaacaaattataaacatgtggcaggaggtaggacgagcaatgtatgcccctcccattgcaggaaacataacatgtaaatcaagaccttttgggacagcggtg

SEQ ID NO: 406668 - DNA, 140 bp, Artificial Sequence
  Synthetic
caccgctgtcccaaaaggtcttgatttacatgttatgtttcctgcaatgggaggggcatacattgctcgtcctacctcctgccacatgtttataatttgttttattctgcatgggattgtcatatcagcagccagggcct

SEQ ID NO: 406669 - DNA, 140 bp, Artificial Sequence
  Synthetic
atacgccatgctgggtctcctctccatagaatggagacagaaaaggtatagcacacaaatagaccctgacctggcagaccaactaattcatttgcattattttgactgtttttcagaatccgtacttgggagtcggccat

SEQ ID NO: 406670 - DNA, 140 bp, Artificial Sequence
  Synthetic
atggccgactcccaagtacggattctgaaaaacagtcaaaataatgcaaatgaattagttggtctgccaggtcagggtctatttgtgtgctataccttttctgtctccattctatggagaggagacccagcatggcgtat

SEQ ID NO: 406671 - DNA, 140 bp, Artificial Sequence
  Synthetic
aggccctggctgctgatatgactgcttgcacctcttgctattgtaaaaagtgttgctttcattgccaagtttgtttcacaacaaaaggcttaggcatctcctatggcaggaagaagcggagaccttttgggacagcggtg

SEQ ID NO: 406672 - DNA, 140 bp, Artificial Sequence
  Synthetic
caccgctgtcccaaaaggtctccgcttcttcctgccataggagatgcctaagccttttgttgtgaaacaaacttggcaatgaaagcaacactttttacaatagcaagaggtgcaagcagtcatatcagcagccagggcct

SEQ ID NO: 406673 - DNA, 140 bp, Artificial Sequence
  Synthetic
aggccctggctgctgatatgagtagcattagtagtagcagcaatattagcaatagttgtgtggaccatagtatacatagaatataggaaaatagtaagacaaaggaaaatagacagattagaccttttgggacagcggtg

SEQ ID NO: 406674 - DNA, 140 bp, Artificial Sequence
  Synthetic
caccgctgtcccaaaaggtctaatctgtctattttcctttgtcttactattttcctatattctatgtatactatggtccacacaactattgctaatattgctgctactactaatgctactcatatcagcagccagggcct

SEQ ID NO: 406675 - DNA, 140 bp, Artificial Sequence
  Synthetic
aggccctggctgctgatatggtagcaaatgttactgtaaaaagtgttgctggcattgccaagtttgctttctgaacaaaggcttaggcatctcctatggcaggaagaagcggagacgcaggaccttttgggacagcggtg

SEQ ID NO: 406676 - DNA, 140 bp, Artificial Sequence
  Synthetic
caccgctgtcccaaaaggtcctgcgtctccgcttcttcctgccataggagatgcctaagcctttgttcagaaagcaaacttggcaatgccagcaacactttttacagtaacatttgctaccatatcagcagccagggcct

SEQ ID NO: 406677 - DNA, 140 bp, Artificial Sequence
  Synthetic
aggccctggctgctgatatgtggggtacctgtgtggagagatgcagagaccaccctattttgtgcatcagatgctaaagcatatgatacagaagtacataatgtctgggctacacatgccgaccttttgggacagcggtg

SEQ ID NO: 406678 - DNA, 140 bp, Artificial Sequence
  Synthetic
caccgctgtcccaaaaggtcggcatgtgtagcccagacattatgtacttctgtatcatatgctttagcatctgatgcacaaaatagggtggtctctgcatctctccacacaggtaccccacatatcagcagccagggcct

SEQ ID NO: 406679 - DNA, 140 bp, Artificial Sequence
  Synthetic
atacgccatgctgggtctcccattgctaatagtagcagcagtgaggcggtgaaagaaatgaaaaactgctcttttaatattaccacaagcataagagataagttgcaaaaagaatatgcacgtacttgggagtcggccat

SEQ ID NO: 406680 - DNA, 140 bp, Artificial Sequence
  Synthetic
atggccgactcccaagtacgtgcatattctttttgcaacttatctcttatgcttgtggtaatattaaaagagcagtttttcatttctttcaccgcctcactgctgctactattagcaatgggagacccagcatggcgtat

SEQ ID NO: 406681 - DNA, 140 bp, Artificial Sequence
  Synthetic
aggccctggctgctgatatgcaaaggtatcctttgagccaattcccatacattattgtgccccggctggttttgcgatcctaaaatgtaaagataaaaagttcaatggaacagggccatggaccttttgggacagcggtg

SEQ ID NO: 406682 - DNA, 140 bp, Artificial Sequence
  Synthetic
caccgctgtcccaaaaggtccatggccctgttccattgaactttttatctttacattttaggatcgcaaaaccagccggggcacaataatgtatgggaattggctcaaaggatacctttgcatatcagcagccagggcct

SEQ ID NO: 406683 - DNA, 140 bp, Artificial Sequence
  Synthetic
aggccctggctgctgatatgcaacacagacaccactaatgctgattgtgcctggctgagagcgcaagaggaggaagaagaagtaggctttccagtcagacctcaggtgcctttaagaccagaccttttgggacagcggtg

SEQ ID NO: 406684 - DNA, 140 bp, Artificial Sequence
  Synthetic
caccgctgtcccaaaaggtctggtcttaaaggcacctgaggtctgactggaaagcctacttcttcttcctcctcttgcgctctcagccaggcacaatcagcattagtggtgtctgtgttgcatatcagcagccagggcct

SEQ ID NO: 406685 - DNA, 140 bp, Artificial Sequence
  Synthetic
atacgccatgctgggtctcccacatctgtagtaatcaaatgtatgagacccggcaataatacaagcaaaagtatacatatgggagcattgagagcttttcatgcaacatcaagaataatacgtacttgggagtcggccat

SEQ ID NO: 406686 - DNA, 140 bp, Artificial Sequence
  Synthetic
atggccgactcccaagtacgtattattcttgatgttgcatgaaaagctctcaatgctcccatatgtatacttttgcttgtattattgccgggtctcatacatttgattactacagatgtgggagacccagcatggcgtat

SEQ ID NO: 406687 - DNA, 140 bp, Artificial Sequence
  Synthetic
  misc_feature (110)..(110): n is a, c, g, or t
atacgccatgctgggtctccgtattaggcctaataacaatacgagaaaaagcatccgtataggaccaggacaaacattctatgcaacagatataataggggacataaganaagcatattgcgtacttgggagtcggccat

SEQ ID NO: 406688 - DNA, 140 bp, Artificial Sequence
  Synthetic
  misc_feature (31)..(31): n is a, c, g, or t
atggccgactcccaagtacgcaatatgcttntcttatgtcccctattatatctgttgcatagaatgtttgtcctggtcctatacggatgctttttctcgtattgttattaggcctaatacggagacccagcatggcgtat

SEQ ID NO: 406689 - DNA, 140 bp, Artificial Sequence
  Synthetic
  misc_feature (60)..(60): n is a, c, g, or t
aggccctggctgctgatatgcaaacattctatgcaacagatataataggggacataaganaagcatattgttttgtcaatagaacagaatggaataacactttacaaaagataagtaaaagaccttttgggacagcggtg

SEQ ID NO: 406690 - DNA, 140 bp, Artificial Sequence
  Synthetic
  misc_feature (81)..(81): n is a, c, g, or t
caccgctgtcccaaaaggtcttttacttatcttttgtaaagtgttattccattctgttctattgacaaaacaatatgcttntcttatgtcccctattatatctgttgcatagaatgtttgcatatcagcagccagggcct

SEQ ID NO: 406691 - DNA, 140 bp, Artificial Sequence
  Synthetic
  misc_feature (87)..(87): n is a, c, g, or t
  misc_feature (99)..(99): n is a, c, g, or t
atacgccatgctgggtctccataaagcaaattataaatatgtggcagagagtaggacaagcaatatatgctcctcctattgcagganaaatagagtgtnaatcaaacattacaggactgccgtacttgggagtcggccat

SEQ ID NO: 406692 - DNA, 140 bp, Artificial Sequence
  Synthetic
  misc_feature (42)..(42): n is a, c, g, or t
  misc_feature (54)..(54): n is a, c, g, or t
atggccgactcccaagtacggcagtcctgtaatgtttgattnacactctatttntcctgcaataggaggagcatatattgcttgtcctactctctgccacatatttataatttgctttatggagacccagcatggcgtat

SEQ ID NO: 406693 - DNA, 140 bp, Artificial Sequence
  Synthetic
aggccctggctgctgatatggctcagtacaatgcacacatggaattaagccagtggtgtcaactcaattgctgttaaatggcagtctagcagaagaagagataataatcagatctgaaaagaccttttgggacagcggtg

SEQ ID NO: 406694 - DNA, 140 bp, Artificial Sequence
  Synthetic
caccgctgtcccaaaaggtcttttcagatctgattattatctcttcttctgctagactgccatttaacagcaattgagttgacaccactggcttaattccatgtgtgcattgtactgagccatatcagcagccagggcct

SEQ ID NO: 406695 - DNA, 140 bp, Artificial Sequence
  Synthetic
aggccctggctgctgatatgggaccaggaaaagtattctatagcacaggaaaaataacaggagatataaggaaagcatattgtgtgattaatggaacaaaatggaatgaaactttaaaacgaccttttgggacagcggtg

SEQ ID NO: 406696 - DNA, 140 bp, Artificial Sequence
  Synthetic
caccgctgtcccaaaaggtcgttttaaagtttcattccattttgttccattaatcacacaatatgctttccttatatctcctgttatttttcctgtgctatagaatacttttcctggtcccatatcagcagccagggcct

SEQ ID NO: 406697 - DNA, 140 bp, Artificial Sequence
  Synthetic
aggccctggctgctgatatgcaaccaccctcaggaggagatttagaaattacaatgcatcattttaattgtagaggggaatttttctattgcaatacaacaaaactgtttaatagtacttgaccttttgggacagcggtg

SEQ ID NO: 406698 - DNA, 140 bp, Artificial Sequence
  Synthetic
caccgctgtcccaaaaggtcaagtactattaaacagttttgttgtattgcaatagaaaaattcccctctacaattaaaatgatgcattgtaatttctaaatctcctcctgagggtggttgcatatcagcagccagggcct

SEQ ID NO: 406699 - DNA, 140 bp, Artificial Sequence
  Synthetic
  misc_feature (47)..(47): n is a, c, g, or t
  misc_feature (110)..(110): n is a, c, g, or t
aggccctggctgctgatatgtcatctgcaccactagtgtgccctggnactctagttggagcaataaatctcatgatgatatatggaataacctgacctggatgcaatggnacaaagaaatgaccttttgggacagcggtg

SEQ ID NO: 406700 - DNA, 140 bp, Artificial Sequence
  Synthetic
  misc_feature (31)..(31): n is a, c, g, or t
  misc_feature (94)..(94): n is a, c, g, or t
caccgctgtcccaaaaggtcatttctttgtnccattgcatccaggtcaggttattccatatatcatcatgagatttattgctccaactagagtnccagggcacactagtggtgcagatgacatatcagcagccagggcct

SEQ ID NO: 406701 - DNA, 140 bp, Artificial Sequence
  Synthetic
atacgccatgctgggtctccaagggaaagaaggagaagagatgagccagcagcagtgggggtgggaccagcatctcaagacctagcaaaacatggagcaatcacaagtagcaatacagtacgtacttgggagtcggccat

SEQ ID NO: 406702 - DNA, 140 bp, Artificial Sequence
  Synthetic
atggccgactcccaagtacgtactgtattgctacttgtgattgctccatgttttgctaggtcttgagatgctggtcccacccccactgctgctggctcatctcttctccttctttcccttggagacccagcatggcgtat

SEQ ID NO: 406703 - DNA, 140 bp, Artificial Sequence
  Synthetic
aggccctggctgctgatatgaccagcaatattccaaagtagcatgacaaaaatcttagagccttttagaaaacaaaatccagacatagttatctatcaatacatggatgacttgtatgtagaccttttgggacagcggtg

SEQ ID NO: 406704 - DNA, 140 bp, Artificial Sequence
  Synthetic
caccgctgtcccaaaaggtctacatacaagtcatccatgtattgatagataactatgtctggattttgttttctaaaaggctctaagatttttgtcatgctactttggaatattgctggtcatatcagcagccagggcct

SEQ ID NO: 406705 - DNA, 140 bp, Artificial Sequence
  Synthetic
aggccctggctgctgatatgtggaaccatccaggaagtcagcctaaaactgcttgtaattcttgttattgtaaaaaatgtagctaccactgtctagtttgctttcagacaaaaggcttaggaccttttgggacagcggtg

SEQ ID NO: 406706 - DNA, 140 bp, Artificial Sequence
  Synthetic
caccgctgtcccaaaaggtcctaagccttttgtctgaaagcaaactagacagtggtagctacattttttacaataacaagaattacaagcagttttaggctgacttcctggatggttccacatatcagcagccagggcct

SEQ ID NO: 406707 - DNA, 140 bp, Artificial Sequence
  Synthetic
aggccctggctgctgatatggcatttcatatggcaggaagaagcggagacagcgacgaagcgctccttctcgcagtgaaactcatcaagatcctatatcaaagcagtaagtatatgtaatgaccttttgggacagcggtg

SEQ ID NO: 406708 - DNA, 140 bp, Artificial Sequence
  Synthetic
caccgctgtcccaaaaggtcattacatatacttactgctttgatataggatcttgatgagtttcactgcgagaaggagcgcttcgtcgctgtctccgcttcttcctgccatatgaaatgccatatcagcagccagggcct

SEQ ID NO: 406709 - DNA, 140 bp, Artificial Sequence
  Synthetic
aggccctggctgctgatatgcggttaaggccagggggaaggaaacaatatagactaaaacacctagtatgggcaagcagggagctggaaagattcgcgcttaacccgagccttttagaaagaccttttgggacagcggtg

SEQ ID NO: 406710 - DNA, 140 bp, Artificial Sequence
  Synthetic
caccgctgtcccaaaaggtctttctaaaaggctcgggttaagcgcgaatctttccagctccctgcttgcccatactaggtgttttagtctatattgtttccttccccctggccttaaccgcatatcagcagccagggcct

SEQ ID NO: 406711 - DNA, 140 bp, Artificial Sequence
  Synthetic
aggccctggctgctgatatgcaacaattcaagaaaaagtatatacataggaccagggagaagatttcatgtaacaagagccgtaacaggagatataagacaagcacattgtaacattagtgaccttttgggacagcggtg

SEQ ID NO: 406712 - DNA, 140 bp, Artificial Sequence
  Synthetic
caccgctgtcccaaaaggtcactaatgttacaatgtgcttgtcttatatctcctgttacggctcttgttacatgaaatcttctccctggtcctatgtatatactttttcttgaattgttgcatatcagcagccagggcct

SEQ ID NO: 406713 - DNA, 140 bp, Artificial Sequence
  Synthetic
atacgccatgctgggtctccagtgatacctccattgaaagcataaaggaagagacaggtagcataaaaaattgctctttcaatacaaccacagaaataagagataagaaacagcaagcatcgtacttgggagtcggccat

SEQ ID NO: 406714 - DNA, 140 bp, Artificial Sequence
  Synthetic
atggccgactcccaagtacgatgcttgctgtttcttatctcttatttctgtggttgtattgaaagagcaattttttatgctacctgtctcttcctttatgctttcaatggaggtatcactggagacccagcatggcgtat

SEQ ID NO: 406715 - DNA, 140 bp, Artificial Sequence
  Synthetic
atacgccatgctgggtctcctaaaaatataacctttgcaccacattcagggggggacctagaaattacaacacatagttttaattgtagaggagaatttttctattgcagtacatcagatcgtacttgggagtcggccat

SEQ ID NO: 406716 - DNA, 140 bp, Artificial Sequence
  Synthetic
atggccgactcccaagtacgatctgatgtactgcaatagaaaaattctcctctacaattaaaactatgtgttgtaatttctaggtccccccctgaatgtggtgcaaaggttatatttttaggagacccagcatggcgtat

SEQ ID NO: 406717 - DNA, 140 bp, Artificial Sequence
  Synthetic
aggccctggctgctgatatgaaaaagaaaaaatcagtaacagtactagatgtaggggatgcatatttttcagttcctttagatgaaaactttagaaagtatactgcattcactatacctagaccttttgggacagcggtg

SEQ ID NO: 406718 - DNA, 140 bp, Artificial Sequence
  Synthetic
caccgctgtcccaaaaggtctaggtatagtgaatgcagtatactttctaaagttttcatctaaaggaactgaaaaatatgcatcccctacatctagtactgttactgattttttctttttcatatcagcagccagggcct

SEQ ID NO: 406719 - DNA, 140 bp, Artificial Sequence
  Synthetic
atacgccatgctgggtctccgtgcaaagagttggtagagctattctccacatacctgttagaataagacagggcttagaaagagctttgctataaaatgggtggcaagtggtcaaaaagtcgtacttgggagtcggccat

SEQ ID NO: 406720 - DNA, 140 bp, Artificial Sequence
  Synthetic
atggccgactcccaagtacgactttttgaccacttgccacccattttatagcaaagctctttctaagccctgtcttattctaacaggtatgtggagaatagctctaccaactctttgcacggagacccagcatggcgtat

SEQ ID NO: 406721 - DNA, 140 bp, Artificial Sequence
  Synthetic
aggccctggctgctgatatggggcagtaaggatcatcaaaatcctgtaccaaagcagtaagtaataatcaatatatgtaatgcaggctttagaaatatctgcaatagtagggctaatagtgaccttttgggacagcggtg

SEQ ID NO: 406722 - DNA, 140 bp, Artificial Sequence
  Synthetic
caccgctgtcccaaaaggtcactattagccctactattgcagatatttctaaagcctgcattacatatattgattattacttactgctttggtacaggattttgatgatccttactgccccatatcagcagccagggcct

SEQ ID NO: 406723 - DNA, 140 bp, Artificial Sequence
  Synthetic
atacgccatgctgggtctccagagataagagaaagcatgaatatgcacttttttatagacttgatatagtaccacttaataataagaatgagagtaacagtgaatatagattaataaattcgtacttgggagtcggccat

SEQ ID NO: 406724 - DNA, 140 bp, Artificial Sequence
  Synthetic
atggccgactcccaagtacgaatttattaatctatattcactgttactctcattcttattattaagtggtactatatcaagtctataaaaaagtgcatattcatgctttctcttatctctggagacccagcatggcgtat

SEQ ID NO: 406725 - DNA, 140 bp, Artificial Sequence
  Synthetic
aggccctggctgctgatatgacagcagctactaatgctgattgtgcctggctagaagcacaagaggaggaggaggtgggttttccagtcagacctcaggtacctttaagaccaatgacttgaccttttgggacagcggtg

SEQ ID NO: 406726 - DNA, 140 bp, Artificial Sequence
  Synthetic
caccgctgtcccaaaaggtcaagtcattggtcttaaaggtacctgaggtctgactggaaaacccacctcctcctcctcttgtgcttctagccaggcacaatcagcattagtagctgctgtcatatcagcagccagggcct

SEQ ID NO: 406727 - DNA, 140 bp, Artificial Sequence
  Synthetic
aggccctggctgctgatatggtataaggcctaacaataatacaagaaaaagtgtgaggataggaccaggacaaacattctatgcaacagaagcaataataggaaatataagcgaagcacagaccttttgggacagcggtg

SEQ ID NO: 406728 - DNA, 140 bp, Artificial Sequence
  Synthetic
caccgctgtcccaaaaggtctgtgcttcgcttatatttcctattattgcttctgttgcatagaatgtttgtcctggtcctatcctcacactttttcttgtattattgttaggccttataccatatcagcagccagggcct

SEQ ID NO: 406729 - DNA, 140 bp, Artificial Sequence
  Synthetic
atacgccatgctgggtctccagaataagacgagctgagccagcaacagagggagtaggagcagcgtctggagtaggagcagcgtctcgagacttagataaacatggggcacttaccagcacgtacttgggagtcggccat

SEQ ID NO: 406730 - DNA, 140 bp, Artificial Sequence
  Synthetic
atggccgactcccaagtacgtgctggtaagtgccccatgtttatctaagtctcgagacgctgctcctactccagacgctgctcctactccctctgttgctggctcagctcgtcttattctggagacccagcatggcgtat

SEQ ID NO: 406731 - DNA, 140 bp, Artificial Sequence
  Synthetic
atacgccatgctgggtctccaaaaattaaaagaacacttccctaataaaacaataaaatttaaccaacccgcaggaggggacttagaaattacaacacatagctttaattgtggaggagacgtacttgggagtcggccat

SEQ ID NO: 406732 - DNA, 140 bp, Artificial Sequence
  Synthetic
atggccgactcccaagtacgtctcctccacaattaaagctatgtgttgtaatttctaagtcccctcctgcgggttggttaaattttattgttttattagggaagtgttcttttaatttttggagacccagcatggcgtat

SEQ ID NO: 406733 - DNA, 140 bp, Artificial Sequence
  Synthetic
aggccctggctgctgatatgtgtaaaaaatgtagctaccattgtcaagtttgctttctgacaaaaggcttaggcatttcctatggcaggaagaagcggagacagcgacgaagcgctcctcgaccttttgggacagcggtg

SEQ ID NO: 406734 - DNA, 140 bp, Artificial Sequence
  Synthetic
caccgctgtcccaaaaggtcgaggagcgcttcgtcgctgtctccgcttcttcctgccataggaaatgcctaagccttttgtcagaaagcaaacttgacaatggtagctacattttttacacatatcagcagccagggcct

SEQ ID NO: 406735 - DNA, 140 bp, Artificial Sequence
  Synthetic
aggccctggctgctgatatgggtagaaattaaaccattaggactagcacccactaaggcaaaaaggagagtggtggagagagaaaaaagagcagtgggaataggagctgtgttccttggggaccttttgggacagcggtg

SEQ ID NO: 406736 - DNA, 140 bp, Artificial Sequence
  Synthetic
caccgctgtcccaaaaggtccccaaggaacacagctcctattcccactgctcttttttctctctccaccactctcctttttgccttagtgggtgctagtcctaatggtttaatttctacccatatcagcagccagggcct

SEQ ID NO: 406737 - DNA, 140 bp, Artificial Sequence
  Synthetic
aggccctggctgctgatatgagacattcagacctggaggaggagatatgagagacaattggagaagtgaattatataaatataaagtggtagaaattaagccattgggagtagcacccacgaccttttgggacagcggtg

SEQ ID NO: 406738 - DNA, 140 bp, Artificial Sequence
  Synthetic
caccgctgtcccaaaaggtcgtgggtgctactcccaatggcttaatttctaccactttatatttatataattcacttctccaattgtctctcatatctcctcctccaggtctgaatgtctcatatcagcagccagggcct

SEQ ID NO: 406739 - DNA, 140 bp, Artificial Sequence
  Synthetic
aggccctggctgctgatatgatgttgaatttactagcaagagtagattatagaataggagtagcagctttgataatagcactaatcatagcaatagttgtgtggaccatagtatacataggaccttttgggacagcggtg

SEQ ID NO: 406740 - DNA, 140 bp, Artificial Sequence
  Synthetic
caccgctgtcccaaaaggtcctatgtatactatggtccacacaactattgctatgattagtgctattatcaaagctgctactcctattctataatctactcttgctagtaaattcaacatcatatcagcagccagggcct

SEQ ID NO: 406741 - DNA, 140 bp, Artificial Sequence
  Synthetic
aggccctggctgctgatatgcaataatgctgattgtgcctggctggaagcacaagaggaggaagaagtaggctttccagtcagacctcaggtgcctttaagaccaatgacttataaggcagaccttttgggacagcggtg

SEQ ID NO: 406742 - DNA, 140 bp, Artificial Sequence
  Synthetic
caccgctgtcccaaaaggtctgccttataagtcattggtcttaaaggcacctgaggtctgactggaaagcctacttcttcctcctcttgtgcttccagccaggcacaatcagcattattgcatatcagcagccagggcct

SEQ ID NO: 406743 - DNA, 140 bp, Artificial Sequence
  Synthetic
atacgccatgctgggtctccatataacactccaatatttgccataaaaaagaaggacagtactaaatggagaaaattagtagatttcagggaactcaataaaagaactcaagacttttggcgtacttgggagtcggccat

SEQ ID NO: 406744 - DNA, 140 bp, Artificial Sequence
  Synthetic
atggccgactcccaagtacgccaaaagtcttgagttcttttattgagttccctgaaatctactaattttctccatttagtactgtccttcttttttatggcaaatattggagtgttatatggagacccagcatggcgtat

SEQ ID NO: 406745 - DNA, 140 bp, Artificial Sequence
  Synthetic
aggccctggctgctgatatgaatataggaaattgctaaaacaaaggaaaatagacaggttaattgagagaataagagaaagagcagaagacagtggcaatgaaagcgagggggatgcagagaccttttgggacagcggtg

SEQ ID NO: 406746 - DNA, 140 bp, Artificial Sequence
  Synthetic
caccgctgtcccaaaaggtctctgcatccccctcgctttcattgccactgtcttctgctctttctcttattctctcaattaacctgtctattttcctttgttttagcaatttcctatattcatatcagcagccagggcct

SEQ ID NO: 406747 - DNA, 140 bp, Artificial Sequence
  Synthetic
aggccctggctgctgatatgtgcgttactttaaattgtcaagagatcagcaatgtcactaactataacagtagcatgtctaacagcagcaggtatggagaaatgaaaaactgctctttcagaccttttgggacagcggtg

SEQ ID NO: 406748 - DNA, 140 bp, Artificial Sequence
  Synthetic
caccgctgtcccaaaaggtctgaaagagcagtttttcatttctccatacctgctgctgttagacatgctactgttatagttagtgacattgctgatctcttgacaatttaaagtaacgcacatatcagcagccagggcct

SEQ ID NO: 406749 - DNA, 140 bp, Artificial Sequence
  Synthetic
atacgccatgctgggtctcccctacaagaataagacagggcttagaaagggctttgctataagatgggtggcaagtggtcaaaatttgctggatggcctgccgtaagggaaagaatgagacgtacttgggagtcggccat

SEQ ID NO: 406750 - DNA, 140 bp, Artificial Sequence
  Synthetic
atggccgactcccaagtacgtctcattctttcccttacggcaggccatccagcaaattttgaccacttgccacccatcttatagcaaagccctttctaagccctgtcttattcttgtaggggagacccagcatggcgtat

SEQ ID NO: 406751 - DNA, 140 bp, Artificial Sequence
  Synthetic
atacgccatgctgggtctccactaattgggaaagagccttacaacaaacagctgaacggtatctagaacttgtaaaccatacaggacctagtaacataacttttgctacaagctctggtgcgtacttgggagtcggccat

SEQ ID NO: 406752 - DNA, 140 bp, Artificial Sequence
  Synthetic
atggccgactcccaagtacgcaccagagcttgtagcaaaagttatgttactaggtcctgtatggtttacaagttctagataccgttcagctgtttgttgtaaggctctttcccaattagtggagacccagcatggcgtat

SEQ ID NO: 406753 - DNA, 140 bp, Artificial Sequence
  Synthetic
aggccctggctgctgatatgtaggaccaggacaaacattctatgcaacaggtgatataataggggacacaagaaaagcacattgtaatgtcagtagaacagaatggggaaacgctacagagaccttttgggacagcggtg

SEQ ID NO: 406754 - DNA, 140 bp, Artificial Sequence
  Synthetic
caccgctgtcccaaaaggtctctgtagcgtttccccattctgttctactgacattacaatgtgcttttcttgtgtcccctattatatcacctgttgcatagaatgtttgtcctggtcctacatatcagcagccagggcct

SEQ ID NO: 406755 - DNA, 140 bp, Artificial Sequence
  Synthetic
atacgccatgctgggtctcctaaagcagattataaatatgtggcaaagagtagggcaggcaatgtatgctcctcctatcaaaggaatcataaggtgtgaatcaaacattacaggactactcgtacttgggagtcggccat

SEQ ID NO: 406756 - DNA, 140 bp, Artificial Sequence
  Synthetic
atggccgactcccaagtacgagtagtcctgtaatgtttgattcacaccttatgattcctttgataggaggagcatacattgcctgccctactctttgccacatatttataatctgctttaggagacccagcatggcgtat

SEQ ID NO: 406757 - DNA, 140 bp, Artificial Sequence
  Synthetic
aggccctggctgctgatatgaaagatcattagggattatggaaaacagatggcaggtgatgattgtgtggcaagtagacaggatgaggattagagcatggaaaagcttagtaaaacaccagaccttttgggacagcggtg

SEQ ID NO: 406758 - DNA, 140 bp, Artificial Sequence
  Synthetic
caccgctgtcccaaaaggtctggtgttttactaagcttttccatgctctaatcctcatcctgtctacttgccacacaatcatcacctgccatctgttttccataatccctaatgatctttcatatcagcagccagggcct

SEQ ID NO: 406759 - DNA, 140 bp, Artificial Sequence
  Synthetic
aggccctggctgctgatatgtcacggtctggggcattaaacagctccaggcaagagtcctggctgtggaaagatacctaaaggatcaacagctcctaggaatttggggttgctctggaaagaccttttgggacagcggtg

SEQ ID NO: 406760 - DNA, 140 bp, Artificial Sequence
  Synthetic
caccgctgtcccaaaaggtctttccagagcaaccccaaattcctaggagctgttgatcctttaggtatctttccacagccaggactcttgcctggagctgtttaatgccccagaccgtgacatatcagcagccagggcct

SEQ ID NO: 406761 - DNA, 140 bp, Artificial Sequence
  Synthetic
aggccctggctgctgatatgcatcattatgaaagcagaaacccaaaagtaagttcagaagtacacatcccattaggggatgcaaggttagtaataaaaacatattggggtttgcagacaggaccttttgggacagcggtg

SEQ ID NO: 406762 - DNA, 140 bp, Artificial Sequence
  Synthetic
caccgctgtcccaaaaggtcctgtctgcaaaccccaatatgtttttattactaaccttgcatcccctaatgggatgtgtacttctgaacttacttttgggtttctgctttcataatgatgcatatcagcagccagggcct

SEQ ID NO: 406763 - DNA, 140 bp, Artificial Sequence
  Synthetic
aggccctggctgctgatatggcagtagcggggtggacagatagggttatagaagtagcacaaagagcttggagagccattctccacatacctagaagaatcagacagggcttagaaaggggaccttttgggacagcggtg

SEQ ID NO: 406764 - DNA, 140 bp, Artificial Sequence
  Synthetic
caccgctgtcccaaaaggtcccctttctaagccctgtctgattcttctaggtatgtggagaatggctctccaagctctttgtgctacttctataaccctatctgtccaccccgctactgccatatcagcagccagggcct

SEQ ID NO: 406765 - DNA, 140 bp, Artificial Sequence
  Synthetic
aggccctggctgctgatatgggaaagaataaggcaaactcctccagcagcagaaaggcgaactcctccagcagcagaaggagtaggagcagtatctcaagatctagataaacatggagcagaccttttgggacagcggtg

SEQ ID NO: 406766 - DNA, 140 bp, Artificial Sequence
  Synthetic
caccgctgtcccaaaaggtctgctccatgtttatctagatcttgagatactgctcctactccttctgctgctggaggagttcgcctttctgctgctggaggagtttgccttattctttcccatatcagcagccagggcct

SEQ ID NO: 406767 - DNA, 140 bp, Artificial Sequence
  Synthetic
aggccctggctgctgatatgttcctatggcaggaagaagcggagacagcgacgaagcgctcctccaagcagtcaggatcatcaaaatcctctaccaaagcagtaagtacttaaaagtagagaccttttgggacagcggtg

SEQ ID NO: 406768 - DNA, 140 bp, Artificial Sequence
  Synthetic
caccgctgtcccaaaaggtctctacttttaagtacttactgctttggtagaggattttgatgatcctgactgcttggaggagcgcttcgtcgctgtctccgcttcttcctgccataggaacatatcagcagccagggcct

SEQ ID NO: 406769 - DNA, 140 bp, Artificial Sequence
  Synthetic
atacgccatgctgggtctccagctggggaaagatggagggaggagaaataaaaaattgctctttcaatatcaccacaaacataagagataaggtaaagaaagaatatgcactttttaatacgtacttgggagtcggccat

SEQ ID NO: 406770 - DNA, 140 bp, Artificial Sequence
  Synthetic
atggccgactcccaagtacgtattaaaaagtgcatattctttctttaccttatctcttatgtttgtggtgatattgaaagagcaattttttatttctcctccctccatctttccccagctggagacccagcatggcgtat

SEQ ID NO: 406771 - DNA, 140 bp, Artificial Sequence
  Synthetic
aggccctggctgctgatatgtcaaaattaccccatagtgcaaaatgcacaagggcaaatggtacaccagtccatatcacctaggactttgaatgcatgggtgaaggtaatagaagaaaaggaccttttgggacagcggtg

SEQ ID NO: 406772 - DNA, 140 bp, Artificial Sequence
  Synthetic
caccgctgtcccaaaaggtccttttcttctattaccttcacccatgcattcaaagtcctaggtgatatggactggtgtaccatttgcccttgtgcattttgcactatggggtaattttgacatatcagcagccagggcct

SEQ ID NO: 406773 - DNA, 140 bp, Artificial Sequence
  Synthetic
aggccctggctgctgatatgagaactttgaatgcatgggtaaaagtaatagaagaaaaggggtttaacccagaagtaatacccatgttctcagcattatcagagggagccaccccacaaggaccttttgggacagcggtg

SEQ ID NO: 406774 - DNA, 140 bp, Artificial Sequence
  Synthetic
caccgctgtcccaaaaggtccttgtggggtggctccctctgataatgctgagaacatgggtattacttctgggttaaaccccttttcttctattacttttacccatgcattcaaagttctcatatcagcagccagggcct

SEQ ID NO: 406775 - DNA, 140 bp, Artificial Sequence
  Synthetic
aggccctggctgctgatatggtaggatctctacaatacttggcactgacagcactgataaaaccaaaaaagataaagccacctctgcctagtattaagaaattagtagaggatagatggagaccttttgggacagcggtg

SEQ ID NO: 406776 - DNA, 140 bp, Artificial Sequence
  Synthetic
caccgctgtcccaaaaggtctccatctatcctctactaatttcttaatactaggcagaggtggctttatcttttttggttttatcagtgctgtcagtgccaagtattgtagagatcctaccatatcagcagccagggcct

SEQ ID NO: 406777 - DNA, 140 bp, Artificial Sequence
  Synthetic
atacgccatgctgggtctccactctgtgtcactttaaactgtacaaaggttaccaataataatactgacatggagaaagaaatgagaaattgctctttcaatgcaaccacagaaataagacgtacttgggagtcggccat

SEQ ID NO: 406778 - DNA, 140 bp, Artificial Sequence
  Synthetic
atggccgactcccaagtacgtcttatttctgtggttgcattgaaagagcaatttctcatttctttctccatgtcagtattattattggtaacctttgtacagtttaaagtgacacagagtggagacccagcatggcgtat

SEQ ID NO: 406779 - DNA, 140 bp, Artificial Sequence
  Synthetic
  misc_feature (84)..(84): n is a, c, g, or t
aggccctggctgctgatatgtctatgcaacaggtgccataataggagatataagacaagcacattgtaatgttagtgaagaccnatggactaagacattacaagaagtagttacacaattgaccttttgggacagcggtg

SEQ ID NO: 406780 - DNA, 140 bp, Artificial Sequence
  Synthetic
  misc_feature (57)..(57): n is a, c, g, or t
caccgctgtcccaaaaggtcaattgtgtaactacttcttgtaatgtcttagtccatnggtcttcactaacattacaatgtgcttgtcttatatctcctattatggcacctgttgcatagacatatcagcagccagggcct

SEQ ID NO: 406781 - DNA, 140 bp, Artificial Sequence
  Synthetic
atacgccatgctgggtctccgaagaagagataataattagatctgaaaatctgacagacaatggcaaaacaataatagtacacctcaatgaaactacaaaatcgtgtgtacaagacctgccgtacttgggagtcggccat

SEQ ID NO: 406782 - DNA, 140 bp, Artificial Sequence
  Synthetic
atggccgactcccaagtacggcaggtcttgtacacacgattttgtagtttcattgaggtgtactattattgttttgccattgtctgtcagattttcagatctaattattatctcttcttcggagacccagcatggcgtat

SEQ ID NO: 406783 - DNA, 140 bp, Artificial Sequence
  Synthetic
atacgccatgctgggtctcccacatgatataataggggacataagacaagcacattgtaacattagtagaacagaatggaacaaaactttagaaagggtaaaaaagaaattaggagaacacgtacttgggagtcggccat

SEQ ID NO: 406784 - DNA, 140 bp, Artificial Sequence
  Synthetic
atggccgactcccaagtacgtgttctcctaatttcttttttaccctttctaaagttttgttccattctgttctactaatgttacaatgtgcttgtcttatgtcccctattatatcatgtgggagacccagcatggcgtat

SEQ ID NO: 406785 - DNA, 140 bp, Artificial Sequence
  Synthetic
aggccctggctgctgatatgcttccctaataaaacaataaagtttaaaccacactcaggaggggacctagaagttacaacacatagttttaattgcagaggagaatttttctattgcaatgaccttttgggacagcggtg

SEQ ID NO: 406786 - DNA, 140 bp, Artificial Sequence
  Synthetic
caccgctgtcccaaaaggtcattgcaatagaaaaattctcctctgcaattaaaactatgtgttgtaacttctaggtcccctcctgagtgtggtttaaactttattgttttattagggaagcatatcagcagccagggcct

SEQ ID NO: 406787 - DNA, 140 bp, Artificial Sequence
  Synthetic
aggccctggctgctgatatgttggcaacgaccccttgtcacagtaaaaataggaggacagctaaaagaagctctattagatacaggagcagatgatacagtattagaagatataaatttggaccttttgggacagcggtg

SEQ ID NO: 406788 - DNA, 140 bp, Artificial Sequence
  Synthetic
caccgctgtcccaaaaggtccaaatttatatcttctaatactgtatcatctgctcctgtatctaatagagcttcttttagctgtcctcctatttttactgtgacaaggggtcgttgccaacatatcagcagccagggcct

SEQ ID NO: 406789 - DNA, 140 bp, Artificial Sequence
  Synthetic
atacgccatgctgggtctccgaggagatatagaaattacaacacacagttttgtttgtgcaggagaatttttctattgcaatacaacaggcttatttaatagtagttggacaagaaataacgtacttgggagtcggccat

SEQ ID NO: 406790 - DNA, 140 bp, Artificial Sequence
  Synthetic
atggccgactcccaagtacgttatttcttgtccaactactattaaataagcctgttgtattgcaatagaaaaattctcctgcacaaacaaaactgtgtgttgtaatttctatatctcctcggagacccagcatggcgtat

SEQ ID NO: 406791 - DNA, 140 bp, Artificial Sequence
  Synthetic
aggccctggctgctgatatggaggaagtgggttttccagtcagacctcaggtacctttaagaccaatgacttacaaggcagctgtagatcttagccactttttaaaagaaaaggggggacgaccttttgggacagcggtg

SEQ ID NO: 406792 - DNA, 140 bp, Artificial Sequence
  Synthetic
caccgctgtcccaaaaggtcgtccccccttttcttttaaaaagtggctaagatctacagctgccttgtaagtcattggtcttaaaggtacctgaggtctgactggaaaacccacttcctccatatcagcagccagggcct

SEQ ID NO: 406793 - DNA, 140 bp, Artificial Sequence
  Synthetic
atacgccatgctgggtctccatggcactataactctcccgtgcagaataaaacaaattataaacatgtggcagagagtaggacgagcaatgtataaccctcccataccaggagtaataaacgtacttgggagtcggccat

SEQ ID NO: 406794 - DNA, 140 bp, Artificial Sequence
  Synthetic
atggccgactcccaagtacgtttattactcctggtatgggagggttatacattgctcgtcctactctctgccacatgtttataatttgttttattctgcacgggagagttatagtgccatggagacccagcatggcgtat

SEQ ID NO: 406795 - DNA, 140 bp, Artificial Sequence
  Synthetic
atacgccatgctgggtctccacagggctgggaagcagctttgctataaaatgggaggcaagtggtcaaaaagcaagagatggcctgaaataagagaaagaatgagacaaactaggccagacgtacttgggagtcggccat

SEQ ID NO: 406796 - DNA, 140 bp, Artificial Sequence
  Synthetic
atggccgactcccaagtacgtctggcctagtttgtctcattctttctcttatttcaggccatctcttgctttttgaccacttgcctcccattttatagcaaagctgcttcccagccctgtggagacccagcatggcgtat

SEQ ID NO: 406797 - DNA, 140 bp, Artificial Sequence
  Synthetic
atacgccatgctgggtctcctggcactataactctcccatgcagaataaagcaaattataaatatgtggcagagagtaggacaagcaatgtatgcccctcccatccaaggagtaataaagcgtacttgggagtcggccat

SEQ ID NO: 406798 - DNA, 140 bp, Artificial Sequence
  Synthetic
atggccgactcccaagtacgctttattactccttggatgggaggggcatacattgcttgtcctactctctgccacatatttataatttgctttattctgcatgggagagttatagtgccaggagacccagcatggcgtat

SEQ ID NO: 406799 - DNA, 140 bp, Artificial Sequence
  Synthetic
aggccctggctgctgatatggcacaagaggaggcggaggtgggttttccagtacctttaagaccaatgacttataagggagcatttgatctcagcttctttttaaaagaaaaggggggacgaccttttgggacagcggtg

SEQ ID NO: 406800 - DNA, 140 bp, Artificial Sequence
  Synthetic
caccgctgtcccaaaaggtcgtccccccttttcttttaaaaagaagctgagatcaaatgctcccttataagtcattggtcttaaaggtactggaaaacccacctccgcctcctcttgtgccatatcagcagccagggcct

SEQ ID NO: 406801 - DNA, 140 bp, Artificial Sequence
  Synthetic
aggccctggctgctgatatgagacaccttgttggtccaaaatgcaaacccagattgtaaaaccattttaagagcattaggaccaggggccacattagaagaaatgatgacagcatgtcaggaccttttgggacagcggtg

SEQ ID NO: 406802 - DNA, 140 bp, Artificial Sequence
  Synthetic
caccgctgtcccaaaaggtcctgacatgctgtcatcatttcttctaatgtggcccctggtcctaatgctcttaaaatggttttacaatctgggtttgcattttggaccaacaaggtgtctcatatcagcagccagggcct

SEQ ID NO: 406803 - DNA, 140 bp, Artificial Sequence
  Synthetic
atacgccatgctgggtctccatacattaagaataagacagggttttgcagcagctttgctataaaatggggggcaactggtcaaaaagcagtgcagtgggatggcctaatgtaagagaaacgtacttgggagtcggccat

SEQ ID NO: 406804 - DNA, 140 bp, Artificial Sequence
  Synthetic
atggccgactcccaagtacgtttctcttacattaggccatcccactgcactgctttttgaccagttgccccccattttatagcaaagctgctgcaaaaccctgtcttattcttaatgtatggagacccagcatggcgtat

SEQ ID NO: 406805 - DNA, 140 bp, Artificial Sequence
  Synthetic
atacgccatgctgggtctccctatggcaggaagaagcggagacacagacgcggaactcctcacagcagtaaggatcatcaaaatcctatatcaaagcagtaagtactaaattaatgtaatcgtacttgggagtcggccat

SEQ ID NO: 406806 - DNA, 140 bp, Artificial Sequence
  Synthetic
atggccgactcccaagtacgattacattaatttagtacttactgctttgatataggattttgatgatccttactgctgtgaggagttccgcgtctgtgtctccgcttcttcctgccatagggagacccagcatggcgtat

SEQ ID NO: 406807 - DNA, 140 bp, Artificial Sequence
  Synthetic
aggccctggctgctgatatgaggatcatcaaaatcctatatcaaagcagtaagtactaaattaatgtaatgttacctttagtaatttgtgcaatagtagcattagtaatagtgtttatcagaccttttgggacagcggtg

SEQ ID NO: 406808 - DNA, 140 bp, Artificial Sequence
  Synthetic
caccgctgtcccaaaaggtctgataaacactattactaatgctactattgcacaaattactaaaggtaacattacattaatttagtacttactgctttgatataggattttgatgatcctcatatcagcagccagggcct

SEQ ID NO: 406809 - DNA, 140 bp, Artificial Sequence
  Synthetic
atacgccatgctgggtctccactgatagtacttgcaaaaatgaaagcttggaagacatgaaagaaatgaaaaactgctctttcaatgtcactgcaggtataagagataaggtacagaaagcgtacttgggagtcggccat

SEQ ID NO: 406810 - DNA, 140 bp, Artificial Sequence
  Synthetic
atggccgactcccaagtacgctttctgtaccttatctcttatacctgcagtgacattgaaagagcagtttttcatttctttcatgtcttccaagctttcatttttgcaagtactatcagtggagacccagcatggcgtat

SEQ ID NO: 406811 - DNA, 140 bp, Artificial Sequence
  Synthetic
aggccctggctgctgatatgtggattcctgagtgggagtttgtcaatacccctcccttagtaaaattatggtaccagttagagaaagaacccatagtaggagcagaaactttctatgtaggaccttttgggacagcggtg

SEQ ID NO: 406812 - DNA, 140 bp, Artificial Sequence
  Synthetic
caccgctgtcccaaaaggtcctacatagaaagtttctgctcctactatgggttctttctctaactggtaccataattttactaagggaggggtattgacaaactcccactcaggaatccacatatcagcagccagggcct

SEQ ID NO: 406813 - DNA, 140 bp, Artificial Sequence
  Synthetic
aggccctggctgctgatatgatgacatggtagaacaaatgcaaacagatataatcaatctctgggaccagagcctaaagccatgtgtaaagttaacccctctctgcgttactttaaattggaccttttgggacagcggtg

SEQ ID NO: 406814 - DNA, 140 bp, Artificial Sequence
  Synthetic
caccgctgtcccaaaaggtccaatttaaagtaacgcagagaggggttaactttacacatggctttaggctctggtcccagagattgattatatctgtttgcatttgttctaccatgtcatcatatcagcagccagggcct

SEQ ID NO: 406815 - DNA, 140 bp, Artificial Sequence
  Synthetic
aggccctggctgctgatatgacaaggtatacatataggaccagggagagcattttatgcaacaacagacatagtgggaaatataagaaaagcacattgtaacattaatagaacaaaatgggaccttttgggacagcggtg

SEQ ID NO: 406816 - DNA, 140 bp, Artificial Sequence
  Synthetic
caccgctgtcccaaaaggtcccattttgttctattaatgttacaatgtgcttttcttatatttcccactatgtctgttgttgcataaaatgctctccctggtcctatatgtataccttgtcatatcagcagccagggcct

SEQ ID NO: 406817 - DNA, 140 bp, Artificial Sequence
  Synthetic
atacgccatgctgggtctccttctgaccccactgaattcaacagcactagctatagcaacattagcagtagcagaatcagaaatgatactgatatgaaaaactgctctttccaaatgacccgtacttgggagtcggccat

SEQ ID NO: 406818 - DNA, 140 bp, Artificial Sequence
  Synthetic
atggccgactcccaagtacgggtcatttggaaagagcagtttttcatatcagtatcatttctgattctgctactgctaatgttgctatagctagtgctgttgaattcagtggggtcagaaggagacccagcatggcgtat

SEQ ID NO: 406819 - DNA, 140 bp, Artificial Sequence
  Synthetic
aggccctggctgctgatatggcagaatcagaaatgatactgatatgaaaaactgctctttccaaatgaccacagaactaagagatagaacaaaaactgtacattcacttttttatagactgaccttttgggacagcggtg

SEQ ID NO: 406820 - DNA, 140 bp, Artificial Sequence
  Synthetic
caccgctgtcccaaaaggtcagtctataaaaaagtgaatgtacagtttttgttctatctcttagttctgtggtcatttggaaagagcagtttttcatatcagtatcatttctgattctgccatatcagcagccagggcct

SEQ ID NO: 406821 - DNA, 140 bp, Artificial Sequence
  Synthetic
aggccctggctgctgatatgaatggcagtctagcagagaaagagataatgattagatctaaaaatctctcaaacaatgccaaaaacataatagtacagcttaatgagcctgtaaacatcagaccttttgggacagcggtg

SEQ ID NO: 406822 - DNA, 140 bp, Artificial Sequence
  Synthetic
caccgctgtcccaaaaggtctgatgtttacaggctcattaagctgtactattatgtttttggcattgtttgagagatttttagatctaatcattatctctttctctgctagactgccattcatatcagcagccagggcct

SEQ ID NO: 406823 - DNA, 140 bp, Artificial Sequence
  Synthetic
atacgccatgctgggtctccacaggaccaggacaagccatctatgtaacaggtgctgtaacaggggacataagaaaagcacattgtaatgtcagcagagcaaaatggaatacaacgttaccgtacttgggagtcggccat

SEQ ID NO: 406824 - DNA, 140 bp, Artificial Sequence
  Synthetic
atggccgactcccaagtacggtaacgttgtattccattttgctctgctgacattacaatgtgcttttcttatgtcccctgttacagcacctgttacatagatggcttgtcctggtcctgtggagacccagcatggcgtat

SEQ ID NO: 406825 - DNA, 140 bp, Artificial Sequence
  Synthetic
  misc_feature (72)..(72): n is a, c, g, or t
  misc_feature (90)..(90): n is a, c, g, or t
  misc_feature (101)..(101): n is a, c, g, or t
aggccctggctgctgatatgatgtgccttggaatactagttggagtaataaatcttatgaggagatttgggncaacatgacctggatagnatgggaaaggnaaattgacaattacacgctgaccttttgggacagcggtg

SEQ ID NO: 406826 - DNA, 140 bp, Artificial Sequence
  Synthetic
  misc_feature (40)..(40): n is a, c, g, or t
  misc_feature (51)..(51): n is a, c, g, or t
  misc_feature (69)..(69): n is a, c, g, or t
caccgctgtcccaaaaggtcagcgtgtaattgtcaatttncctttcccatnctatccaggtcatgttgncccaaatctcctcataagatttattactccaactagtattccaaggcacatcatatcagcagccagggcct

SEQ ID NO: 406827 - DNA, 140 bp, Artificial Sequence
  Synthetic
atacgccatgctgggtctccttgtggaggagaatttttctattgtaatacaacagaactgttcaatagcacttggtacaaaaatggcactaacacaactagcacacagaccagtgaaaaccgtacttgggagtcggccat

SEQ ID NO: 406828 - DNA, 140 bp, Artificial Sequence
  Synthetic
atggccgactcccaagtacggttttcactggtctgtgtgctagttgtgttagtgccatttttgtaccaagtgctattgaacagttctgttgtattacaatagaaaaattctcctccacaaggagacccagcatggcgtat

SEQ ID NO: 406829 - DNA, 140 bp, Artificial Sequence
  Synthetic
aggccctggctgctgatatgcttggtacaaaaatggcactaacacaactagcacacagaccagtgaaaacataactctgccatgcagaataaagcaaattgtaaggatgtggcagagagtgaccttttgggacagcggtg

SEQ ID NO: 406830 - DNA, 140 bp, Artificial Sequence
  Synthetic
caccgctgtcccaaaaggtcactctctgccacatccttacaatttgctttattctgcatggcagagttatgttttcactggtctgtgtgctagttgtgttagtgccatttttgtaccaagcatatcagcagccagggcct

SEQ ID NO: 406831 - DNA, 140 bp, Artificial Sequence
  Synthetic
atacgccatgctgggtctcccaaacattacaggattaatactaacaagagatggtggagataatagtagcagcaatgagaccttcagacctgaaggaggagacataagggacaattggagcgtacttgggagtcggccat

SEQ ID NO: 406832 - DNA, 140 bp, Artificial Sequence
  Synthetic
atggccgactcccaagtacgctccaattgtcccttatgtctcctccttcaggtctgaaggtctcattgctgctactattatctccaccatctcttgttagtattaatcctgtaatgtttgggagacccagcatggcgtat

SEQ ID NO: 406833 - DNA, 140 bp, Artificial Sequence
  Synthetic
aggccctggctgctgatatgtctgaaaatctcacaaacaatgccaaaaccataatagtgcaccttaataaatcagtagaaatcaattgtaccagaccctccaacaatacaagaacaagtagaccttttgggacagcggtg

SEQ ID NO: 406834 - DNA, 140 bp, Artificial Sequence
  Synthetic
caccgctgtcccaaaaggtctacttgttcttgtattgttggagggtctggtacaattgatttctactgatttattaaggtgcactattatggttttggcattgtttgtgagattttcagacatatcagcagccagggcct

SEQ ID NO: 406835 - DNA, 140 bp, Artificial Sequence
  Synthetic
aggccctggctgctgatatgaactgagtggatggcctaaagtaagagaaagaatgagacgagctgagccagcagcagagggggtaggagaggtatctcgagacctggaaagacatggagcgaccttttgggacagcggtg

SEQ ID NO: 406836 - DNA, 140 bp, Artificial Sequence
  Synthetic
caccgctgtcccaaaaggtcgctccatgtctttccaggtctcgagatacctctcctaccccctctgctgctggctcagctcgtctcattctttctcttactttaggccatccactcagttcatatcagcagccagggcct

SEQ ID NO: 406837 - DNA, 140 bp, Artificial Sequence
  Synthetic
atacgccatgctgggtctcctagtttttactgtgctttctataataaatagagtcaggcagggatactcacccttgtcattgcagacccttaccccacacccagagggaccagacaggctcgtacttgggagtcggccat

SEQ ID NO: 406838 - DNA, 140 bp, Artificial Sequence
  Synthetic
atggccgactcccaagtacgagcctgtctggtccctctgggtgtggggtaagggtctgcaatgacaagggtgagtatccctgcctgactctatttattatagaaagcacagtaaaaactaggagacccagcatggcgtat

SEQ ID NO: 406839 - DNA, 140 bp, Artificial Sequence
  Synthetic
aggccctggctgctgatatgcagcagtctcaagggactgagacgggggtgggaaggcctcaaatatctggggaatcttctgatatattggggccaggaactaaaaactagtgctatttctgaccttttgggacagcggtg

SEQ ID NO: 406840 - DNA, 140 bp, Artificial Sequence
  Synthetic
caccgctgtcccaaaaggtcagaaatagcactagtttttagttcctggccccaatatatcagaagattccccagatatttgaggccttcccacccccgtctcagtcccttgagactgctgcatatcagcagccagggcct

SEQ ID NO: 406841 - DNA, 140 bp, Artificial Sequence
  Synthetic
aggccctggctgctgatatgtgcaaaaaatgcagctatcattgtctagtttgctttcagacaaaaggcttaggcatttcctatggcaggaagaagcggagacagcgacgaagcgctcctcgaccttttgggacagcggtg

SEQ ID NO: 406842 - DNA, 140 bp, Artificial Sequence
  Synthetic
caccgctgtcccaaaaggtcgaggagcgcttcgtcgctgtctccgcttcttcctgccataggaaatgcctaagccttttgtctgaaagcaaactagacaatgatagctgcattttttgcacatatcagcagccagggcct

SEQ ID NO: 406843 - DNA, 140 bp, Artificial Sequence
  Synthetic
aggccctggctgctgatatgaggcatttcctatggcaggaagaagcggagacagcgacgaagcgctcctccaagcagtaaggatcatcaaaatcctctaccaaagcagtaagtactcaatgaccttttgggacagcggtg

SEQ ID NO: 406844 - DNA, 140 bp, Artificial Sequence
  Synthetic
caccgctgtcccaaaaggtcattgagtacttactgctttggtagaggattttgatgatccttactgcttggaggagcgcttcgtcgctgtctccgcttcttcctgccataggaaatgcctcatatcagcagccagggcct

SEQ ID NO: 406845 - DNA, 140 bp, Artificial Sequence
  Synthetic
atacgccatgctgggtctcccggcgactggtgagtacgccaaaatttttgactagcggaggctagaaggagagagatgggtgcgagagcgtcagtattaagcgggggaaaattagataaacgtacttgggagtcggccat

SEQ ID NO: 406846 - DNA, 140 bp, Artificial Sequence
  Synthetic
atggccgactcccaagtacgtttatctaattttcccccgcttaatactgacgctctcgcacccatctctctccttctagcctccgctagtcaaaaattttggcgtactcaccagtcgccgggagacccagcatggcgtat

SEQ ID NO: 406847 - DNA, 140 bp, Artificial Sequence
  Synthetic
aggccctggctgctgatatgaattaaaagaattagggaaagagcagaagacagtggcaatgagagtgatggggatacagaggaattgtcaacaatggtggatatggggcatcttgggcttgaccttttgggacagcggtg

SEQ ID NO: 406848 - DNA, 140 bp, Artificial Sequence
  Synthetic
caccgctgtcccaaaaggtcaagcccaagatgccccatatccaccattgttgacaattcctctgtatccccatcactctcattgccactgtcttctgctctttccctaattcttttaattcatatcagcagccagggcct

SEQ ID NO: 406849 - DNA, 140 bp, Artificial Sequence
  Synthetic
aggccctggctgctgatatgagtattgggggctagagctaaaaaagagtgctattagtctgcttgataccacagcaatagcagtagctgagggaacagatagaattatagaattgatacagaccttttgggacagcggtg

SEQ ID NO: 406850 - DNA, 140 bp, Artificial Sequence
  Synthetic
caccgctgtcccaaaaggtctgtatcaattctataattctatctgttccctcagctactgctattgctgtggtatcaagcagactaatagcactcttttttagctctagcccccaatactcatatcagcagccagggcct

SEQ ID NO: 406851 - DNA, 140 bp, Artificial Sequence
  Synthetic
atacgccatgctgggtctccccgccaacgtcaatatcagcatgggtggtgaaggaataaaaaattgctctttcaatacaaccacagaaataagggacaagaaacagaaagtctatgcgctcgtacttgggagtcggccat

SEQ ID NO: 406852 - DNA, 140 bp, Artificial Sequence
  Synthetic
atggccgactcccaagtacgagcgcatagactttctgtttcttgtcccttatttctgtggttgtattgaaagagcaattttttattccttcaccacccatgctgatattgacgttggcggggagacccagcatggcgtat

SEQ ID NO: 406853 - DNA, 140 bp, Artificial Sequence
  Synthetic
aggccctggctgctgatatgtcagcacagtacaatgtacacatggaattaagccagtggtatcaactcaactactgttaaatggtagcctagcagaagaagagataataattagatctgagaccttttgggacagcggtg

SEQ ID NO: 406854 - DNA, 140 bp, Artificial Sequence
  Synthetic
caccgctgtcccaaaaggtctcagatctaattattatctcttcttctgctaggctaccatttaacagtagttgagttgataccactggcttaattccatgtgtacattgtactgtgctgacatatcagcagccagggcct

SEQ ID NO: 406855 - DNA, 140 bp, Artificial Sequence
  Synthetic
aggccctggctgctgatatgatctacctatcatgggtaccagcacataaagggattggaggaaatgaacaagtagataaattagtcagtgctggaatcagaaaaatactgtttttagatggaccttttgggacagcggtg

SEQ ID NO: 406856 - DNA, 140 bp, Artificial Sequence
  Synthetic
caccgctgtcccaaaaggtccatctaaaaacagtatttttctgattccagcactgactaatttatctacttgttcatttcctccaatccctttatgtgctggtacccatgataggtagatcatatcagcagccagggcct

SEQ ID NO: 406857 - DNA, 140 bp, Artificial Sequence
  Synthetic
atacgccatgctgggtctcctagagattgagtgtataagagccggcaataagacaagaaaaagtgtaagaataggaccaggacaagtattctatgcaacaggagaagtaacagaagatatcgtacttgggagtcggccat

SEQ ID NO: 406858 - DNA, 140 bp, Artificial Sequence
  Synthetic
atggccgactcccaagtacgatatcttctgttacttctcctgttgcatagaatacttgtcctggtcctattcttacactttttcttgtcttattgccggctcttatacactcaatctctaggagacccagcatggcgtat

SEQ ID NO: 406859 - DNA, 140 bp, Artificial Sequence
  Synthetic
atacgccatgctgggtctccgtggcgcccgaacagggacttgaaagtgaaaccaaggaagaaaacctccgacgcaacaggctcggcttagcggagtgcacccgctaagaggcgagaggaacgtacttgggagtcggccat

SEQ ID NO: 406860 - DNA, 140 bp, Artificial Sequence
  Synthetic
atggccgactcccaagtacgttcctctcgcctcttagcgggtgcactccgctaagccgagcctgttgcgtcggaggttttcttccttggtttcactttcaagtccctgttcgggcgccacggagacccagcatggcgtat

SEQ ID NO: 406861 - DNA, 140 bp, Artificial Sequence
  Synthetic
aggccctggctgctgatatgtgcagaataaaacaaattataaacatgtggcagaaggtaggacgagcaatatatgcccctcccattgcaggaaacataacatgtaaatcaaatatcacaggaccttttgggacagcggtg

SEQ ID NO: 406862 - DNA, 140 bp, Artificial Sequence
  Synthetic
caccgctgtcccaaaaggtcctgtgatatttgatttacatgttatgtttcctgcaatgggaggggcatatattgctcgtcctaccttctgccacatgtttataatttgttttattctgcacatatcagcagccagggcct

SEQ ID NO: 406863 - DNA, 140 bp, Artificial Sequence
  Synthetic
aggccctggctgctgatatgatataaatacaaggtggtagaaattaagccattaggagtagcacccaccaaggcaaaaaggagagtggtggagagaggaaaaagagcagtaggaataggagaccttttgggacagcggtg

SEQ ID NO: 406864 - DNA, 140 bp, Artificial Sequence
  Synthetic
caccgctgtcccaaaaggtctcctattcctactgctctttttcctctctccaccactctcctttttgccttggtgggtgctactcctaatggcttaatttctaccaccttgtatttatatcatatcagcagccagggcct

SEQ ID NO: 406865 - DNA, 140 bp, Artificial Sequence
  Synthetic
atacgccatgctgggtctccctcacgagaaggtgagtaaatttgctggcggtggccagacctaggggaagggcgaagtccctagaggaagaagataggtgcgagagcgtctgtattgacacgtacttgggagtcggccat

SEQ ID NO: 406866 - DNA, 140 bp, Artificial Sequence
  Synthetic
atggccgactcccaagtacgtgtcaatacagacgctctcgcacctatcttcttcctctagggacttcgcccttcccctaggtctggccaccgccagcaaatttactcaccttctcgtgagggagacccagcatggcgtat

SEQ ID NO: 406867 - DNA, 140 bp, Artificial Sequence
  Synthetic
aggccctggctgctgatatgcgaagaagaaggtggagagcaagacagagacagatccattcgattagtgagcggattcttgtcacttgcctgggacgacctacggagcctgtgcctcttcgaccttttgggacagcggtg

SEQ ID NO: 406868 - DNA, 140 bp, Artificial Sequence
  Synthetic
caccgctgtcccaaaaggtcgaagaggcacaggctccgtaggtcgtcccaggcaagtgacaagaatccgctcactaatcgaatggatctgtctctgtcttgctctccaccttcttcttcgcatatcagcagccagggcct

SEQ ID NO: 406869 - DNA, 140 bp, Artificial Sequence
  Synthetic
aggccctggctgctgatatggcggattcttgtcacttgcctgggacgacctacggagcctgtgcctcttcagttaccaccgattgagagacttcatattgattgcagtgagagcagtggagaccttttgggacagcggtg

SEQ ID NO: 406870 - DNA, 140 bp, Artificial Sequence
  Synthetic
caccgctgtcccaaaaggtctccactgctctcactgcaatcaatatgaagtctctcaatcggtggtaactgaagaggcacaggctccgtaggtcgtcccaggcaagtgacaagaatccgccatatcagcagccagggcct

SEQ ID NO: 406871 - DNA, 140 bp, Artificial Sequence
  Synthetic
atacgccatgctgggtctccaaagggctttgctataagataagggctttgctataagatgggtggcaagtggtcaataatggttggatgggctactgtaagggaaagaatgagacgagctcgtacttgggagtcggccat

SEQ ID NO: 406872 - DNA, 140 bp, Artificial Sequence
  Synthetic
atggccgactcccaagtacgagctcgtctcattctttcccttacagtagcccatccaaccattattgaccacttgccacccatcttatagcaaagcccttatcttatagcaaagccctttggagacccagcatggcgtat

SEQ ID NO: 406873 - DNA, 140 bp, Artificial Sequence
  Synthetic
  misc_feature (77)..(77): n is a, c, g, or t
atacgccatgctgggtctccgcttagaaagagctttgctataaaatgggaggcaagtggtcaaagagtagcatagtnggatggcctgaagtaagggaaagaataaatcaaacccctccagcgtacttgggagtcggccat

SEQ ID NO: 406874 - DNA, 140 bp, Artificial Sequence
  Synthetic
  misc_feature (64)..(64): n is a, c, g, or t
atggccgactcccaagtacgctggaggggtttgatttattctttcccttacttcaggccatccnactatgctactctttgaccacttgcctcccattttatagcaaagctctttctaagcggagacccagcatggcgtat

SEQ ID NO: 406875 - DNA, 140 bp, Artificial Sequence
  Synthetic
aggccctggctgctgatatggggcaagtggtcaaaaagcagtataattggatggcctgaagtaagagaaagaatgagacgagctaggccagtaacagcagcagaaggagtaggaacagcggaccttttgggacagcggtg

SEQ ID NO: 406876 - DNA, 140 bp, Artificial Sequence
  Synthetic
caccgctgtcccaaaaggtccgctgttcctactccttctgctgctgttactggcctagctcgtctcattctttctcttacttcaggccatccaattatactgctttttgaccacttgccccatatcagcagccagggcct

SEQ ID NO: 406877 - DNA, 140 bp, Artificial Sequence
  Synthetic
aggccctggctgctgatatgtattatgacccatcaaaagacttagtagcagaagtacagaaacaagggcaggaccaatggacatatcaaatttatcaagagccatttaagaatctaaaaagaccttttgggacagcggtg

SEQ ID NO: 406878 - DNA, 140 bp, Artificial Sequence
  Synthetic
caccgctgtcccaaaaggtctttttagattcttaaatggctcttgataaatttgatatgtccattggtcctgcccttgtttctgtacttctgctactaagtcttttgatgggtcataatacatatcagcagccagggcct

SEQ ID NO: 406879 - DNA, 140 bp, Artificial Sequence
  Synthetic
aggccctggctgctgatatgtaatcatagcaataatagtgtggaccatagtatatatagaatataggaaattggtaaaacaaagaaaaatagactggttaattaaaagaattagggaaaggaccttttgggacagcggtg

SEQ ID NO: 406880 - DNA, 140 bp, Artificial Sequence
  Synthetic
caccgctgtcccaaaaggtcctttccctaattcttttaattaaccagtctatttttctttgttttaccaatttcctatattctatatatactatggtccacactattattgctatgattacatatcagcagccagggcct

SEQ ID NO: 406881 - DNA, 140 bp, Artificial Sequence
  Synthetic
aggccctggctgctgatatgtttcagttcctttagatgaagatttcaggaaatatactgcattcaccatacctagtataaacaatgaaacaccagggattagatatcaatataatgtgctgaccttttgggacagcggtg

SEQ ID NO: 406882 - DNA, 140 bp, Artificial Sequence
  Synthetic
caccgctgtcccaaaaggtcagcacattatattgatatctaatccctggtgtttcattgtttatactaggtatggtgaatgcagtatatttcctgaaatcttcatctaaaggaactgaaacatatcagcagccagggcct

SEQ ID NO: 406883 - DNA, 140 bp, Artificial Sequence
  Synthetic
aggccctggctgctgatatgcaatagtagcattagtagtagcagcaataatagcaatagttgtgtggaccatagtattcatagaatataggaaaatattaagacaaagaaaaatagacaggaccttttgggacagcggtg

SEQ ID NO: 406884 - DNA, 140 bp, Artificial Sequence
  Synthetic
caccgctgtcccaaaaggtcctgtctatttttctttgtcttaatattttcctatattctatgaatactatggtccacacaactattgctattattgctgctactactaatgctactattgcatatcagcagccagggcct

SEQ ID NO: 406885 - DNA, 140 bp, Artificial Sequence
  Synthetic
atacgccatgctgggtctccgaaaaaggagagataaaaaactgctctttcaatgtcaccacatcaataagagatagggtgcggaaagaatacgcactttttaataaacttgatgtagtaccgtacttgggagtcggccat

SEQ ID NO: 406886 - DNA, 140 bp, Artificial Sequence
  Synthetic
atggccgactcccaagtacggtactacatcaagtttattaaaaagtgcgtattctttccgcaccctatctcttattgatgtggtgacattgaaagagcagttttttatctctcctttttcggagacccagcatggcgtat

SEQ ID NO: 406887 - DNA, 140 bp, Artificial Sequence
  Synthetic
aggccctggctgctgatatgtaagagaaagagcagaagacagtggaaatgagagtgaaggagacacagatgaattggccaaacttgtggaaatgggggactttgatccttgggttggtgagaccttttgggacagcggtg

SEQ ID NO: 406888 - DNA, 140 bp, Artificial Sequence
  Synthetic
caccgctgtcccaaaaggtctcaccaacccaaggatcaaagtcccccatttccacaagtttggccaattcatctgtgtctccttcactctcatttccactgtcttctgctctttctcttacatatcagcagccagggcct

SEQ ID NO: 406889 - DNA, 140 bp, Artificial Sequence
  Synthetic
aggccctggctgctgatatggctgttaaatggcagtctagcagaagaagaggtagtacttagatcaaaaaatttcacagataatgctgaaaccataatagtacagctgaacgaatctgtagaccttttgggacagcggtg

SEQ ID NO: 406890 - DNA, 140 bp, Artificial Sequence
  Synthetic
caccgctgtcccaaaaggtctacagattcgttcagctgtactattatggtttcagcattatctgtgaaattttttgatctaagtactacctcttcttctgctagactgccatttaacagccatatcagcagccagggcct

SEQ ID NO: 406891 - DNA, 140 bp, Artificial Sequence
  Synthetic
atacgccatgctgggtctccaggaccagggaaagcattctttacagtaggagatataagacaagcacattgtaacattagtagaaaagactggaataacactttaaaacttgtagctacacgtacttgggagtcggccat

SEQ ID NO: 406892 - DNA, 140 bp, Artificial Sequence
  Synthetic
atggccgactcccaagtacgtgtagctacaagttttaaagtgttattccagtcttttctactaatgttacaatgtgcttgtcttatatctcctactgtaaagaatgctttccctggtcctggagacccagcatggcgtat

SEQ ID NO: 406893 - DNA, 140 bp, Artificial Sequence
  Synthetic
aggccctggctgctgatatggtaacattagtagaaaagactggaataacactttaaaacttgtagctacaaaattagaagaaaaatttaatacaacaacaatagtctttcagccacctgcgaccttttgggacagcggtg

SEQ ID NO: 406894 - DNA, 140 bp, Artificial Sequence
  Synthetic
caccgctgtcccaaaaggtcgcaggtggctgaaagactattgttgttgtattaaatttttcttctaattttgtagctacaagttttaaagtgttattccagtcttttctactaatgttaccatatcagcagccagggcct

SEQ ID NO: 406895 - DNA, 140 bp, Artificial Sequence
  Synthetic
aggccctggctgctgatatgatagactaataaattgtaatacatcagccatgacacaggcctgtcctaaggtaacctttgagccaattcctatacattattgtgccccagctggttttgcgaccttttgggacagcggtg

SEQ ID NO: 406896 - DNA, 140 bp, Artificial Sequence
  Synthetic
caccgctgtcccaaaaggtcgcaaaaccagctggggcacaataatgtataggaattggctcaaaggttaccttaggacaggcctgtgtcatggctgatgtattacaatttattagtctatcatatcagcagccagggcct

SEQ ID NO: 406897 - DNA, 140 bp, Artificial Sequence
  Synthetic
atacgccatgctgggtctccaatttttctactgcaatacatcacaactgtttaatagtatttggattaatggtactgggaataatacttggaatagtactaagggtcatgaaaggtcagacgtacttgggagtcggccat

SEQ ID NO: 406898 - DNA, 140 bp, Artificial Sequence
  Synthetic
atggccgactcccaagtacgtctgacctttcatgacccttagtactattccaagtattattcccagtaccattaatccaaatactattaaacagttgtgatgtattgcagtagaaaaattggagacccagcatggcgtat

SEQ ID NO: 406899 - DNA, 140 bp, Artificial Sequence
  Synthetic
aggccctggctgctgatatgcagtctcaaggggttgagactggggtgggaaggcctcaagtatctgtggaatctcctattgtattggggtcaggaactaaaaactagtgctactaatttggaccttttgggacagcggtg

SEQ ID NO: 406900 - DNA, 140 bp, Artificial Sequence
  Synthetic
caccgctgtcccaaaaggtccaaattagtagcactagtttttagttcctgaccccaatacaataggagattccacagatacttgaggccttcccaccccagtctcaaccccttgagactgcatatcagcagccagggcct

SEQ ID NO: 406901 - DNA, 140 bp, Artificial Sequence
  Synthetic
aggccctggctgctgatatgcgtataggaccaggacaaaccttctatgcaacaggtgatgtaataggggacataagaaaagcatattgtaatgtcagcagagcagcatggaatagcacttgaccttttgggacagcggtg

SEQ ID NO: 406902 - DNA, 140 bp, Artificial Sequence
  Synthetic
caccgctgtcccaaaaggtcaagtgctattccatgctgctctgctgacattacaatatgcttttcttatgtcccctattacatcacctgttgcatagaaggtttgtcctggtcctatacgcatatcagcagccagggcct

SEQ ID NO: 406903 - DNA, 140 bp, Artificial Sequence
  Synthetic
atacgccatgctgggtctccatctttaagaactcctcaggaggggatttagaagttacaacacatagtttcaattgtggaggagaatttttctattgcaatacaacagacctgttcaatacgtacttgggagtcggccat

SEQ ID NO: 406904 - DNA, 140 bp, Artificial Sequence
  Synthetic
atggccgactcccaagtacgtattgaacaggtctgttgtattgcaatagaaaaattctcctccacaattgaaactatgtgttgtaacttctaaatcccctcctgaggagttcttaaagatggagacccagcatggcgtat

SEQ ID NO: 406905 - DNA, 140 bp, Artificial Sequence
  Synthetic
atacgccatgctgggtctccgaggatataatcagttatgggaccaaagcctaaagccctgtgtaaagttgaccccactctgtgtcactttaaactgcactgatattaatgttaatgttaccgtacttgggagtcggccat

SEQ ID NO: 406906 - DNA, 140 bp, Artificial Sequence
  Synthetic
atggccgactcccaagtacggtaacattaacattaatatcagtgcagtttaaagtgacacagagtggggtcaactttacacagggctttaggctttggtcccataactgattatatcctcggagacccagcatggcgtat

SEQ ID NO: 406907 - DNA, 140 bp, Artificial Sequence
  Synthetic
aggccctggctgctgatatgtttaattgtaggggagagtttttctattgtgatacatcagaactgtggaattcaacaagactgtggaacgattcagcactgtggaacgagacagcaagaagaccttttgggacagcggtg

SEQ ID NO: 406908 - DNA, 140 bp, Artificial Sequence
  Synthetic
caccgctgtcccaaaaggtcttcttgctgtctcgttccacagtgctgaatcgttccacagtcttgttgaattccacagttctgatgtatcacaatagaaaaactctcccctacaattaaacatatcagcagccagggcct

SEQ ID NO: 406909 - DNA, 140 bp, Artificial Sequence
  Synthetic
aggccctggctgctgatatgggctagattagtaataaaaacatattgggggttgcaaacaggagaaagagattggcatttgggtcatggagtctccatagaatggagattgagaagctatgaccttttgggacagcggtg

SEQ ID NO: 406910 - DNA, 140 bp, Artificial Sequence
  Synthetic
caccgctgtcccaaaaggtcatagcttctcaatctccattctatggagactccatgacccaaatgccaatctctttctcctgtttgcaacccccaatatgtttttattactaatctagcccatatcagcagccagggcct

SEQ ID NO: 406911 - DNA, 140 bp, Artificial Sequence
  Synthetic
atacgccatgctgggtctccgtggcgcccgaacagggacttgaaagcgaaagttccagagaagttctctcgacgcagggctcggcttgctgaggtgcacacggcaagaggcggagcgcggcgtacttgggagtcggccat

SEQ ID NO: 406912 - DNA, 140 bp, Artificial Sequence
  Synthetic
atggccgactcccaagtacgccgcgctccgcctcttgccgtgtgcacctcagcaagccgagccctgcgtcgagagaacttctctggaactttcgctttcaagtccctgttcgggcgccacggagacccagcatggcgtat

SEQ ID NO: 406913 - DNA, 140 bp, Artificial Sequence
  Synthetic
aggccctggctgctgatatgactagaaaaagtagattatagaataggagtaggagcattgataatagcatttatcatagcaatagttgtgtggatcatagcatatatagaatatagaaaagaccttttgggacagcggtg

SEQ ID NO: 406914 - DNA, 140 bp, Artificial Sequence
  Synthetic
caccgctgtcccaaaaggtcttttctatattctatatatgctatgatccacacaactattgctatgataaatgctattatcaatgctcctactcctattctataatctactttttctagtcatatcagcagccagggcct

SEQ ID NO: 406915 - DNA, 140 bp, Artificial Sequence
  Synthetic
aggccctggctgctgatatgttatcatagcaatagttgtgtggatcatagcatatatagaatatagaaaattgttaagacaaagaaaaatagactggttaattaaaagaattagggaaaggaccttttgggacagcggtg

SEQ ID NO: 406916 - DNA, 140 bp, Artificial Sequence
  Synthetic
caccgctgtcccaaaaggtcctttccctaattcttttaattaaccagtctatttttctttgtcttaacaattttctatattctatatatgctatgatccacacaactattgctatgataacatatcagcagccagggcct

SEQ ID NO: 406917 - DNA, 140 bp, Artificial Sequence
  Synthetic
aggccctggctgctgatatgagagacttcatattggtgacagcgagagcagtggaacttctgggacacagcagtctcaggggacttcagaaggggtggcaaatccttaagtatctgggaggaccttttgggacagcggtg

SEQ ID NO: 406918 - DNA, 140 bp, Artificial Sequence
  Synthetic
caccgctgtcccaaaaggtcctcccagatacttaaggatttgccaccccttctgaagtcccctgagactgctgtgtcccagaagttccactgctctcgctgtcaccaatatgaagtctctcatatcagcagccagggcct

SEQ ID NO: 406919 - DNA, 140 bp, Artificial Sequence
  Synthetic
aggccctggctgctgatatgatttcagaattgggtgccagcatagcagaataggcattataagacagagaagagcaagaaatggagccagtagatcctaacctagagccctggaaccatcgaccttttgggacagcggtg

SEQ ID NO: 406920 - DNA, 140 bp, Artificial Sequence
  Synthetic
caccgctgtcccaaaaggtcgatggttccagggctctaggttaggatctactggctccatttcttgctcttctctgtcttataatgcctattctgctatgctggcacccaattctgaaatcatatcagcagccagggcct

SEQ ID NO: 406921 - DNA, 140 bp, Artificial Sequence
  Synthetic
atacgccatgctgggtctccatactaccactgactacaatggtaccagaagtgaagaagtaaaaaattgctctttcaatacaaccgcagagatcagagataagaaacagagagtgcatgccgtacttgggagtcggccat

SEQ ID NO: 406922 - DNA, 140 bp, Artificial Sequence
  Synthetic
atggccgactcccaagtacggcatgcactctctgtttcttatctctgatctctgcggttgtattgaaagagcaattttttacttcttcacttctggtaccattgtagtcagtggtagtatggagacccagcatggcgtat

SEQ ID NO: 406923 - DNA, 140 bp, Artificial Sequence
  Synthetic
aggccctggctgctgatatgaataatacaagaaaaagcataaggataggaccaggacaaacattctttgcaacaggagacataataggagatataagaaaagcacattgtaacattagcagaccttttgggacagcggtg

SEQ ID NO: 406924 - DNA, 140 bp, Artificial Sequence
  Synthetic
caccgctgtcccaaaaggtctgctaatgttacaatgtgcttttcttatatctcctattatgtctcctgttgcaaagaatgtttgtcctggtcctatccttatgctttttcttgtattattcatatcagcagccagggcct

SEQ ID NO: 406925 - DNA, 140 bp, Artificial Sequence
  Synthetic
aggccctggctgctgatatgagaacacttccctaataaaacaataaactttacatcatcctcaggaggggacctagaaattacaacacatagctttaattgtagaggagaatttttctatgaccttttgggacagcggtg

SEQ ID NO: 406926 - DNA, 140 bp, Artificial Sequence
  Synthetic
caccgctgtcccaaaaggtcatagaaaaattctcctctacaattaaagctatgtgttgtaatttctaggtcccctcctgaggatgatgtaaagtttattgttttattagggaagtgttctcatatcagcagccagggcct

SEQ ID NO: 406927 - DNA, 140 bp, Artificial Sequence
  Synthetic
atacgccatgctgggtctccaacctgtagaaattaggtgtataaggccaggcaataatacaagaaaaagtatgagaataggaccaggacaaacattctatgcaacaggagagataataggcgtacttgggagtcggccat

SEQ ID NO: 406928 - DNA, 140 bp, Artificial Sequence
  Synthetic
atggccgactcccaagtacgcctattatctctcctgttgcatagaatgtttgtcctggtcctattctcatactttttcttgtattattgcctggccttatacacctaatttctacaggttggagacccagcatggcgtat

SEQ ID NO: 406929 - DNA, 140 bp, Artificial Sequence
  Synthetic
aggccctggctgctgatatgccttatcccaaacccgagggaacccgacaggctcggaagaatcgaagaagaaggtggagagcaagacagagacagatccattcgattagtgagcggattcgaccttttgggacagcggtg

SEQ ID NO: 406930 - DNA, 140 bp, Artificial Sequence
  Synthetic
caccgctgtcccaaaaggtcgaatccgctcactaatcgaatggatctgtctctgtcttgctctccaccttcttcttcgattcttccgagcctgtcgggttccctcgggtttgggataaggcatatcagcagccagggcct

SEQ ID NO: 406931 - DNA, 140 bp, Artificial Sequence
  Synthetic
aggccctggctgctgatatgatttagtgggtggtctactgtaagggaaagaatgagacgagctgagccaaaagctgagccagcagcagttggggtgggaaaagcatctcgagacctggaagaccttttgggacagcggtg

SEQ ID NO: 406932 - DNA, 140 bp, Artificial Sequence
  Synthetic
caccgctgtcccaaaaggtcttccaggtctcgagatgcttttcccaccccaactgctgctggctcagcttttggctcagctcgtctcattctttcccttacagtagaccacccactaaatcatatcagcagccagggcct

SEQ ID NO: 406933 - DNA, 140 bp, Artificial Sequence
  Synthetic
atacgccatgctgggtctccctaacctagagccctggaatcatccgggaagtcagcctaaaactgcttgtagcaattgttactgtaaaaagtgttgctggcattgtcaagtttgctttctcgtacttgggagtcggccat

SEQ ID NO: 406934 - DNA, 140 bp, Artificial Sequence
  Synthetic
atggccgactcccaagtacgagaaagcaaacttgacaatgccagcaacactttttacagtaacaattgctacaagcagttttaggctgacttcccggatgattccagggctctaggttagggagacccagcatggcgtat

SEQ ID NO: 406935 - DNA, 140 bp, Artificial Sequence
  Synthetic
atacgccatgctgggtctccaactgcactttcaacatgaccacagaactaagagataaaaggaaaactgtacattcacttttttataaacttgatatagtatcaactggtagtaatggtacgtacttgggagtcggccat

SEQ ID NO: 406936 - DNA, 140 bp, Artificial Sequence
  Synthetic
atggccgactcccaagtacgtaccattactaccagttgatactatatcaagtttataaaaaagtgaatgtacagttttccttttatctcttagttctgtggtcatgttgaaagtgcagttggagacccagcatggcgtat

SEQ ID NO: 406937 - DNA, 140 bp, Artificial Sequence
  Synthetic
aggccctggctgctgatatgacattcacttttttataaacttgatatagtatcaactggtagtaatggtagtgggcagtatagactaataaattgcaatacatcagccatgacacaggccgaccttttgggacagcggtg

SEQ ID NO: 406938 - DNA, 140 bp, Artificial Sequence
  Synthetic
caccgctgtcccaaaaggtcggcctgtgtcatggctgatgtattgcaatttattagtctatactgcccactaccattactaccagttgatactatatcaagtttataaaaaagtgaatgtcatatcagcagccagggcct

SEQ ID NO: 406939 - DNA, 140 bp, Artificial Sequence
  Synthetic
  misc_feature (115)..(115): n is a, c, g, or t
atacgccatgctgggtctccttactgagcctgtaaacatcacttgtatcagacctggcaacaatacaagaacaagtatacgtataggaccaggacaaaccttctatgcaacaggngatgtcgtacttgggagtcggccat

SEQ ID NO: 406940 - DNA, 140 bp, Artificial Sequence
  Synthetic
  misc_feature (26)..(26): n is a, c, g, or t
atggccgactcccaagtacgacatcncctgttgcatagaaggtttgtcctggtcctatacgtatacttgttcttgtattgttgccaggtctgatacaagtgatgtttacaggctcagtaaggagacccagcatggcgtat

SEQ ID NO: 406941 - DNA, 140 bp, Artificial Sequence
  Synthetic
  misc_feature (51)..(51): n is a, c, g, or t
aggccctggctgctgatatgtcagtacaatgtgcttccacagggatggaanggatcaccagcaatattccaaagtagcatgacaaaaatcttagagccctttagaaaacaaaatccagacgaccttttgggacagcggtg

SEQ ID NO: 406942 - DNA, 140 bp, Artificial Sequence
  Synthetic
  misc_feature (90)..(90): n is a, c, g, or t
caccgctgtcccaaaaggtcgtctggattttgttttctaaagggctctaagatttttgtcatgctactttggaatattgctggtgatccnttccatccctgtggaagcacattgtactgacatatcagcagccagggcct

SEQ ID NO: 406943 - DNA, 140 bp, Artificial Sequence
  Synthetic
aggccctggctgctgatatggtgccctggaactccacttggagtaataaatcttatgaagagatttggaacaacatgacatggacagaatgggagagagaaattagcaattacacaaaccgaccttttgggacagcggtg

SEQ ID NO: 406944 - DNA, 140 bp, Artificial Sequence
  Synthetic
caccgctgtcccaaaaggtcggtttgtgtaattgctaatttctctctcccattctgtccatgtcatgttgttccaaatctcttcataagatttattactccaagtggagttccagggcaccatatcagcagccagggcct

SEQ ID NO: 406945 - DNA, 140 bp, Artificial Sequence
  Synthetic
atacgccatgctgggtctccaaggagataaaaaattgctctttcaatgcaaccacattattaaaagataggaagaagacagtgtatgcacttttttatagacttgatatagtaccacttacgtacttgggagtcggccat

SEQ ID NO: 406946 - DNA, 140 bp, Artificial Sequence
  Synthetic
atggccgactcccaagtacgtaagtggtactatatcaagtctataaaaaagtgcatacactgtcttcttcctatcttttaataatgtggttgcattgaaagagcaattttttatctccttggagacccagcatggcgtat

SEQ ID NO: 406947 - DNA, 140 bp, Artificial Sequence
  Synthetic
atacgccatgctgggtctccccaattctcaaaacagcaccctaaaggaagagaaaggggcaataaaaaactgttctttcaatatgaccacagaactaagagataagaagctgaaagtaaacgtacttgggagtcggccat

SEQ ID NO: 406948 - DNA, 140 bp, Artificial Sequence
  Synthetic
atggccgactcccaagtacgtttactttcagcttcttatctcttagttctgtggtcatattgaaagaacagttttttattgcccctttctcttcctttagggtgctgttttgagaattggggagacccagcatggcgtat

SEQ ID NO: 406949 - DNA, 140 bp, Artificial Sequence
  Synthetic
atacgccatgctgggtctccaggagagtgttggggatgatgagtggttggccattcttctgtctcctgataagctcgataattgggtctgaacaacattgggtaacagtgtactatggggcgtacttgggagtcggccat

SEQ ID NO: 406950 - DNA, 140 bp, Artificial Sequence
  Synthetic
atggccgactcccaagtacgccccatagtacactgttacccaatgttgttcagacccaattatcgagcttatcaggagacagaagaatggccaaccactcatcatccccaacactctcctggagacccagcatggcgtat

SEQ ID NO: 406951 - DNA, 140 bp, Artificial Sequence
  Synthetic
aggccctggctgctgatatggcaaccctctattgtgtacatcaaaggatagatgtaaaagacaccaaggaagctttagataaaatagaggaaatacaaaataagagcaagcaaaagacacgaccttttgggacagcggtg

SEQ ID NO: 406952 - DNA, 140 bp, Artificial Sequence
  Synthetic
caccgctgtcccaaaaggtcgtgtcttttgcttgctcttattttgtatttcctctattttatctaaagcttccttggtgtcttttacatctatcctttgatgtacacaatagagggttgccatatcagcagccagggcct

SEQ ID NO: 406953 - DNA, 140 bp, Artificial Sequence
  Synthetic
aggccctggctgctgatatgagctttagataaaatagaggaaatacaaaataagagcaagcaaaagacacagcaggcagccgcagcccaggcagcagctaacacaggaaacagcagccaggaccttttgggacagcggtg

SEQ ID NO: 406954 - DNA, 140 bp, Artificial Sequence
  Synthetic
caccgctgtcccaaaaggtcctggctgctgtttcctgtgttagctgctgcctgggctgcggctgcctgctgtgtcttttgcttgctcttattttgtatttcctctattttatctaaagctcatatcagcagccagggcct

SEQ ID NO: 406955 - DNA, 140 bp, Artificial Sequence
  Synthetic
atacgccatgctgggtctcccggagacgaagcactcctccaagcagtgaggataatcaaaatcctgtatcaaagcagtaagtatcatttatgtaatgataagtttattagcagaagtagacgtacttgggagtcggccat

SEQ ID NO: 406956 - DNA, 140 bp, Artificial Sequence
  Synthetic
atggccgactcccaagtacgtctacttctgctaataaacttatcattacataaatgatacttactgctttgatacaggattttgattatcctcactgcttggaggagtgcttcgtctccgggagacccagcatggcgtat

SEQ ID NO: 406957 - DNA, 140 bp, Artificial Sequence
  Synthetic
atacgccatgctgggtctcctaatagtacaacagctaatagtacaacagctaatagtactttctacaataacacagagaatgaacaactaaaaaattgctctttcaatataaccacagaacgtacttgggagtcggccat

SEQ ID NO: 406958 - DNA, 140 bp, Artificial Sequence
  Synthetic
atggccgactcccaagtacgttctgtggttatattgaaagagcaattttttagttgttcattctctgtgttattgtagaaagtactattagctgttgtactattagctgttgtactattaggagacccagcatggcgtat

SEQ ID NO: 406959 - DNA, 140 bp, Artificial Sequence
  Synthetic
aggccctggctgctgatatgttctatgcaacaggagatataataggagacataagacaagcacactgtgacgttaatagaacaaaatggaaggaaactttacaatgggtaaagaataaatgaccttttgggacagcggtg

SEQ ID NO: 406960 - DNA, 140 bp, Artificial Sequence
  Synthetic
caccgctgtcccaaaaggtcatttattctttacccattgtaaagtttccttccattttgttctattaacgtcacagtgtgcttgtcttatgtctcctattatatctcctgttgcatagaacatatcagcagccagggcct

SEQ ID NO: 406961 - DNA, 140 bp, Artificial Sequence
  Synthetic
atacgccatgctgggtctccggggatctggaaattacaacacatacctttaattgtagaggagaatttttctattgcaacacatcaggcctgtttaatactacagacctgtttaataatacgtacttgggagtcggccat

SEQ ID NO: 406962 - DNA, 140 bp, Artificial Sequence
  Synthetic
atggccgactcccaagtacgtattattaaacaggtctgtagtattaaacaggcctgatgtgttgcaatagaaaaattctcctctacaattaaaggtatgtgttgtaatttccagatccccggagacccagcatggcgtat

SEQ ID NO: 406963 - DNA, 140 bp, Artificial Sequence
  Synthetic
atacgccatgctgggtctccagaataaaacaatttgtgaatatgtggcaggaggtagggcgagcaatgtatgcccctcccattcaaggaatcataaattgtatatcaaatatcacaggaacgtacttgggagtcggccat

SEQ ID NO: 406964 - DNA, 140 bp, Artificial Sequence
  Synthetic
atggccgactcccaagtacgttcctgtgatatttgatatacaatttatgattccttgaatgggaggggcatacattgctcgccctacctcctgccacatattcacaaattgttttattctggagacccagcatggcgtat

SEQ ID NO: 406965 - DNA, 140 bp, Artificial Sequence
  Synthetic
aggccctggctgctgatatgtgtttttcagaatctgctataagaaatgccctattaggacatagagttagtcctaggtgtgaatatcaagcaggacataacaaggtaggatctctacagtgaccttttgggacagcggtg

SEQ ID NO: 406966 - DNA, 140 bp, Artificial Sequence
  Synthetic
caccgctgtcccaaaaggtcactgtagagatcctaccttgttatgtcctgcttgatattcacacctaggactaactctatgtcctaatagggcatttcttatagcagattctgaaaaacacatatcagcagccagggcct

SEQ ID NO: 406967 - DNA, 140 bp, Artificial Sequence
  Synthetic
aggccctggctgctgatatgatggcctgctgtaagagaaagaataagacaaactgatccaagggagagaataagacaaactgagccagcagcagagggagtaggagcagcatctcgagacgaccttttgggacagcggtg

SEQ ID NO: 406968 - DNA, 140 bp, Artificial Sequence
  Synthetic
caccgctgtcccaaaaggtcgtctcgagatgctgctcctactccctctgctgctggctcagtttgtcttattctctcccttggatcagtttgtcttattctttctcttacagcaggccatcatatcagcagccagggcct

SEQ ID NO: 406969 - DNA, 140 bp, Artificial Sequence
  Synthetic
aggccctggctgctgatatgagcagaaatacagaaacaagggcaagaccaatggacatatcaaatttatcaagagccatttaaaaatctaaaaacaggaaaatatgcaaaaaagaggtctgaccttttgggacagcggtg

SEQ ID NO: 406970 - DNA, 140 bp, Artificial Sequence
  Synthetic
caccgctgtcccaaaaggtcagacctcttttttgcatattttcctgtttttagatttttaaatggctcttgataaatttgatatgtccattggtcttgcccttgtttctgtatttctgctcatatcagcagccagggcct

SEQ ID NO: 406971 - DNA, 140 bp, Artificial Sequence
  Synthetic
aggccctggctgctgatatggcttttctcaacatacctagaagaataagacagggcttcgaaagggctttgctataaaatgggtggcaagtggtcaaaaagtagtatagttggatggcctgaccttttgggacagcggtg

SEQ ID NO: 406972 - DNA, 140 bp, Artificial Sequence
  Synthetic
caccgctgtcccaaaaggtcaggccatccaactatactactttttgaccacttgccacccattttatagcaaagccctttcgaagccctgtcttattcttctaggtatgttgagaaaagccatatcagcagccagggcct

SEQ ID NO: 406973 - DNA, 140 bp, Artificial Sequence
  Synthetic
aggccctggctgctgatatgatggtagaccagatgcatgaggatataatcagtttatgggatcaaagcctaaagccatgtgtaaaattaaccccactctgtgttactttaaattgcactggaccttttgggacagcggtg

SEQ ID NO: 406974 - DNA, 140 bp, Artificial Sequence
  Synthetic
caccgctgtcccaaaaggtccagtgcaatttaaagtaacacagagtggggttaattttacacatggctttaggctttgatcccataaactgattatatcctcatgcatctggtctaccatcatatcagcagccagggcct

SEQ ID NO: 406975 - DNA, 140 bp, Artificial Sequence
  Synthetic
atacgccatgctgggtctccaccatatacatatctcaaggaaagctaagagatggatgtataaacatcattatgaaagcactaatccaagagtaagctcggaagtacacatcccactaggcgtacttgggagtcggccat

SEQ ID NO: 406976 - DNA, 140 bp, Artificial Sequence
  Synthetic
atggccgactcccaagtacgcctagtgggatgtgtacttccgagcttactcttggattagtgctttcataatgatgtttatacatccatctcttagctttccttgagatatgtatatggtggagacccagcatggcgtat

SEQ ID NO: 406977 - DNA, 140 bp, Artificial Sequence
  Synthetic
atacgccatgctgggtctcctagagcttttagaggagcttaagagtgaagccatgagacattttcctaggccgtggcttcatggcttaggacaacatatctatgaaacatatggggataccgtacttgggagtcggccat

SEQ ID NO: 406978 - DNA, 140 bp, Artificial Sequence
  Synthetic
atggccgactcccaagtacggtatccccatatgtttcatagatatgttgtcctaagccatgaagccacggcctaggaaaatgtctcatggcttcactcttaagctcctctaaaagctctaggagacccagcatggcgtat

SEQ ID NO: 406979 - DNA, 140 bp, Artificial Sequence
  Synthetic
aggccctggctgctgatatgcagcaggcaaaagaggctgacgagaaggtcagtcaaaattatcctatagtgcagaatctccaagggcaaatggtacaccaggccctatcacctagaacttgaccttttgggacagcggtg

SEQ ID NO: 406980 - DNA, 140 bp, Artificial Sequence
  Synthetic
caccgctgtcccaaaaggtcaagttctaggtgatagggcctggtgtaccatttgcccttggagattctgcactataggataattttgactgaccttctcgtcagcctcttttgcctgctgcatatcagcagccagggcct

SEQ ID NO: 406981 - DNA, 140 bp, Artificial Sequence
  Synthetic
atacgccatgctgggtctccaatgagagtgatggagacacagaggaattatccacgctggtggatatggggaattatgatcttggggatgataataattggtaggtcagacaacctgtggcgtacttgggagtcggccat

SEQ ID NO: 406982 - DNA, 140 bp, Artificial Sequence
  Synthetic
atggccgactcccaagtacgccacaggttgtctgacctaccaattattatcatccccaagatcataattccccatatccaccagcgtggataattcctctgtgtctccatcactctcattggagacccagcatggcgtat

SEQ ID NO: 406983 - DNA, 140 bp, Artificial Sequence
  Synthetic
atacgccatgctgggtctccttcactaggaatagcaacctcactgatgatactgataacaaccccaataatactattaatatggaaaatgaaataaaaaattgctctttcaatgtgactacgtacttgggagtcggccat

SEQ ID NO: 406984 - DNA, 140 bp, Artificial Sequence
  Synthetic
atggccgactcccaagtacgtagtcacattgaaagagcaattttttatttcattttccatattaatagtattattggggttgttatcagtatcatcagtgaggttgctattcctagtgaaggagacccagcatggcgtat

SEQ ID NO: 406985 - DNA, 140 bp, Artificial Sequence
  Synthetic
aggccctggctgctgatatggcagtctagcagaggaagacataatgattagatctgaaaatatcacagacaataccaaaaacataatagtacagtttaatgagtctgtaagcattaattggaccttttgggacagcggtg

SEQ ID NO: 406986 - DNA, 140 bp, Artificial Sequence
  Synthetic
caccgctgtcccaaaaggtccaattaatgcttacagactcattaaactgtactattatgtttttggtattgtctgtgatattttcagatctaatcattatgtcttcctctgctagactgccatatcagcagccagggcct

SEQ ID NO: 406987 - DNA, 140 bp, Artificial Sequence
  Synthetic
aggccctggctgctgatatgaataccaaaaacataatagtacagtttaatgagtctgtaagcattaattgtaccagacctggcaacaatacaagaaaaagtatacgtatagggccaggacgaccttttgggacagcggtg

SEQ ID NO: 406988 - DNA, 140 bp, Artificial Sequence
  Synthetic
caccgctgtcccaaaaggtcgtcctggccctatacgtatactttttcttgtattgttgccaggtctggtacaattaatgcttacagactcattaaactgtactattatgtttttggtattcatatcagcagccagggcct

SEQ ID NO: 406989 - DNA, 140 bp, Artificial Sequence
  Synthetic
aggccctggctgctgatatgattgtaatgcacagctttaattgtggaggggaatttttatactgcaatacaacagagctgtttaatagtacttggattaatggtactagggaaaccaacagaccttttgggacagcggtg

SEQ ID NO: 406990 - DNA, 140 bp, Artificial Sequence
  Synthetic
caccgctgtcccaaaaggtctgttggtttccctagtaccattaatccaagtactattaaacagctctgttgtattgcagtataaaaattcccctccacaattaaagctgtgcattacaatcatatcagcagccagggcct

SEQ ID NO: 406991 - DNA, 140 bp, Artificial Sequence
  Synthetic
atacgccatgctgggtctcctgtaatgtcagcaaaaggaatggatgaaagttctgcaacaggtagttagaaaattaagaaaggaatttgaaaacaaaacaatagtctttgataatccctccgtacttgggagtcggccat

SEQ ID NO: 406992 - DNA, 140 bp, Artificial Sequence
  Synthetic
atggccgactcccaagtacggagggattatcaaagactattgttttgttttcaaattcctttcttaattttctaactacctgttgcagaactttcatccattccttttgctgacattacaggagacccagcatggcgtat

SEQ ID NO: 406993 - DNA, 140 bp, Artificial Sequence
  Synthetic
atacgccatgctgggtctccctacgtcaaatggcactatcacactccgatgtagaataaaacaaattataaacatgtggcagagagtaggaagagcaatgtataaccctcccatcgcaggcgtacttgggagtcggccat

SEQ ID NO: 406994 - DNA, 140 bp, Artificial Sequence
  Synthetic
atggccgactcccaagtacgcctgcgatgggagggttatacattgctcttcctactctctgccacatgtttataatttgttttattctacatcggagtgtgatagtgccatttgacgtagggagacccagcatggcgtat

SEQ ID NO: 406995 - DNA, 140 bp, Artificial Sequence
  Synthetic
atacgccatgctgggtctccaggaggggatttagaaattacaatgcatagttttaattgtaaaggagagtttttctattgcaatacatcaggcctgtttaacagaacttggaatgacacccgtacttgggagtcggccat

SEQ ID NO: 406996 - DNA, 140 bp, Artificial Sequence
  Synthetic
atggccgactcccaagtacgggtgtcattccaagttctgttaaacaggcctgatgtattgcaatagaaaaactctcctttacaattaaaactatgcattgtaatttctaaatcccctcctggagacccagcatggcgtat

SEQ ID NO: 406997 - DNA, 140 bp, Artificial Sequence
  Synthetic
atacgccatgctgggtctccgaaatgttagcagtaatggtactggtacctacaatgagacctacaatgagataaaaaattgctctttcaatacaaccacagaattaagagataggcagaacgtacttgggagtcggccat

SEQ ID NO: 406998 - DNA, 140 bp, Artificial Sequence
  Synthetic
atggccgactcccaagtacgttctgcctatctcttaattctgtggttgtattgaaagagcaattttttatctcattgtaggtctcattgtaggtaccagtaccattactgctaacatttcggagacccagcatggcgtat

SEQ ID NO: 406999 - DNA, 140 bp, Artificial Sequence
  Synthetic
atacgccatgctgggtctcctgccttggaatactagttggagtaataaatctctagatgaaatttgggataacatgacctggatacagtgggaaagagaaataggcaattacacaaacttcgtacttgggagtcggccat

SEQ ID NO: 407000 - DNA, 140 bp, Artificial Sequence
  Synthetic
atggccgactcccaagtacgaagtttgtgtaattgcctatttctctttcccactgtatccaggtcatgttatcccaaatttcatctagagatttattactccaactagtattccaaggcaggagacccagcatggcgtat

SEQ ID NO: 407001 - DNA, 140 bp, Artificial Sequence
  Synthetic
aggccctggctgctgatatggtgcctcttcagctaccaccgcttgagagacttcatcttgattgtagcgaggactgtggaactgggactgagactggggtggaagggcattcaatacttggaccttttgggacagcggtg

SEQ ID NO: 407002 - DNA, 140 bp, Artificial Sequence
  Synthetic
caccgctgtcccaaaaggtccaagtattgaatgcccttccaccccagtctcagtcccagttccacagtcctcgctacaatcaagatgaagtctctcaagcggtggtagctgaagaggcaccatatcagcagccagggcct

SEQ ID NO: 407003 - DNA, 140 bp, Artificial Sequence
  Synthetic
atacgccatgctgggtctccactcctacagcagcagcagcagaaggagtaggagcagtttctcgagatctagaaagacatggagcaatcacaagcagtaatacagaagctaataatgaaacgtacttgggagtcggccat

SEQ ID NO: 407004 - DNA, 140 bp, Artificial Sequence
  Synthetic
atggccgactcccaagtacgtttcattattagcttctgtattactgcttgtgattgctccatgtctttctagatctcgagaaactgctcctactccttctgctgctgctgctgtaggagtggagacccagcatggcgtat

SEQ ID NO: 407005 - DNA, 140 bp, Artificial Sequence
  Synthetic
  misc_feature (35)..(35): n is a, c, g, or t
atacgccatgctgggtctccaacaattacaaccanctctcaggacaggaacagaagaacttagatcattatataatacagtagcaaccctctggtgcgtacatcgacagatagatgtaaacgtacttgggagtcggccat

SEQ ID NO: 407006 - DNA, 140 bp, Artificial Sequence
  Synthetic
  misc_feature (106)..(106): n is a, c, g, or t
atggccgactcccaagtacgtttacatctatctgtcgatgtacgcaccagagggttgctactgtattatataatgatctaagttcttctgttcctgtcctgagagntggttgtaattgttggagacccagcatggcgtat

SEQ ID NO: 407007 - DNA, 140 bp, Artificial Sequence
  Synthetic
atacgccatgctgggtctcctcttttaatataaccacagagttaagagataagagaagaaatgaatatgcacttttttatagactagatatagtaccacttaaggatgagagtcacggtgcgtacttgggagtcggccat

SEQ ID NO: 407008 - DNA, 140 bp, Artificial Sequence
  Synthetic
atggccgactcccaagtacgcaccgtgactctcatccttaagtggtactatatctagtctataaaaaagtgcatattcatttcttctcttatctcttaactctgtggttatattaaaagaggagacccagcatggcgtat

SEQ ID NO: 407009 - DNA, 140 bp, Artificial Sequence
  Synthetic
atacgccatgctgggtctccggtaatgctacctacaatgatcccagttctgaaataaaaaattgctctttcaatgtaaccacagaattaagagataagaaaaagaaagtacatgcactgtcgtacttgggagtcggccat

SEQ ID NO: 407010 - DNA, 140 bp, Artificial Sequence
  Synthetic
atggccgactcccaagtacgacagtgcatgtactttctttttcttatctcttaattctgtggttacattgaaagagcaattttttatttcagaactgggatcattgtaggtagcattaccggagacccagcatggcgtat

SEQ ID NO: 407011 - DNA, 140 bp, Artificial Sequence
  Synthetic
aggccctggctgctgatatgtaataaaacaataaaatttgcaccatcctcaggaggggacctagaaattacaacacatagctttaattgtagaggagaatttttctattgcaatacatcagaccttttgggacagcggtg

SEQ ID NO: 407012 - DNA, 140 bp, Artificial Sequence
  Synthetic
caccgctgtcccaaaaggtctgatgtattgcaatagaaaaattctcctctacaattaaagctatgtgttgtaatttctaggtcccctcctgaggatggtgcaaattttattgttttattacatatcagcagccagggcct

SEQ ID NO: 407013 - DNA, 140 bp, Artificial Sequence
  Synthetic
aggccctggctgctgatatggcatatttttcagttcccttagatgaagactttagaaaatatactgcattcaccatacctagtataaacaatgagacaccaggaattagatatcagtacagaccttttgggacagcggtg

SEQ ID NO: 407014 - DNA, 140 bp, Artificial Sequence
  Synthetic
caccgctgtcccaaaaggtctgtactgatatctaattcctggtgtctcattgtttatactaggtatggtgaatgcagtatattttctaaagtcttcatctaagggaactgaaaaatatgccatatcagcagccagggcct

SEQ ID NO: 407015 - DNA, 140 bp, Artificial Sequence
  Synthetic
aggccctggctgctgatatggaagtgatatagcaggaactactagtacccttcaggaacaaatacaatggatgacaagcaacccacctgtcccagtgggagaaatctataaaagatggatgaccttttgggacagcggtg

SEQ ID NO: 407016 - DNA, 140 bp, Artificial Sequence
  Synthetic
caccgctgtcccaaaaggtcatccatcttttatagatttctcccactgggacaggtgggttgcttgtcatccattgtatttgttcctgaagggtactagtagttcctgctatatcacttccatatcagcagccagggcct

SEQ ID NO: 407017 - DNA, 140 bp, Artificial Sequence
  Synthetic
aggccctggctgctgatatgaaaagatttattagcattggacagttggaataatctgtggaattggtttgacataacaaagtggctgtggtatataagaatattcataatgatagtaggagaccttttgggacagcggtg

SEQ ID NO: 407018 - DNA, 140 bp, Artificial Sequence
  Synthetic
caccgctgtcccaaaaggtctcctactatcattatgaatattcttatataccacagccactttgttatgtcaaaccaattccacagattattccaactgtccaatgctaataaatcttttcatatcagcagccagggcct

SEQ ID NO: 407019 - DNA, 140 bp, Artificial Sequence
  Synthetic
atacgccatgctgggtctccaagtatacatataggattcggaagagcaatttatgcaacaggagaaataataggaaatccaagacaagcacattgtaaccttagtagagcaaaatgggaacgtacttgggagtcggccat

SEQ ID NO: 407020 - DNA, 140 bp, Artificial Sequence
  Synthetic
atggccgactcccaagtacgttcccattttgctctactaaggttacaatgtgcttgtcttggatttcctattatttctcctgttgcataaattgctcttccgaatcctatatgtatacttggagacccagcatggcgtat

SEQ ID NO: 407021 - DNA, 140 bp, Artificial Sequence
  Synthetic
aggccctggctgctgatatgtcccatacattattgtgccccagctggttttgcgattctaaactgtaacgataaaaagttcaatggaacaggaccatgtaaaaatgtcagcacagtacaagaccttttgggacagcggtg

SEQ ID NO: 407022 - DNA, 140 bp, Artificial Sequence
  Synthetic
caccgctgtcccaaaaggtcttgtactgtgctgacatttttacatggtcctgttccattgaactttttatcgttacagtttagaatcgcaaaaccagctggggcacaataatgtatgggacatatcagcagccagggcct

SEQ ID NO: 407023 - DNA, 140 bp, Artificial Sequence
  Synthetic
aggccctggctgctgatatgatttacatcatcctcaggaggggacctagaaattacaacacatagctttaattgtagaggagaatttttctattgtaatacatcaggcctgtttaatagtgaccttttgggacagcggtg

SEQ ID NO: 407024 - DNA, 140 bp, Artificial Sequence
  Synthetic
caccgctgtcccaaaaggtcactattaaacaggcctgatgtattacaatagaaaaattctcctctacaattaaagctatgtgttgtaatttctaggtcccctcctgaggatgatgtaaatcatatcagcagccagggcct

SEQ ID NO: 407025 - DNA, 140 bp, Artificial Sequence
  Synthetic
atacgccatgctgggtctccgtcaacagcacagaaaacatggaagaaatgaaaaactgctcgttcaatatgaccacagaattaagggataagaaacagaaagcatattcacttttttatacgtacttgggagtcggccat

SEQ ID NO: 407026 - DNA, 140 bp, Artificial Sequence
  Synthetic
atggccgactcccaagtacgtataaaaaagtgaatatgctttctgtttcttatcccttaattctgtggtcatattgaacgagcagtttttcatttcttccatgttttctgtgctgttgacggagacccagcatggcgtat

SEQ ID NO: 407027 - DNA, 140 bp, Artificial Sequence
  Synthetic
aggccctggctgctgatatggtacaatgcacacatggaatcaagccagtagtatcaactcaactgctgttaaatggcagtctagcagaagaacaggtaatgattagatctgaaaatatcagaccttttgggacagcggtg

SEQ ID NO: 407028 - DNA, 140 bp, Artificial Sequence
  Synthetic
caccgctgtcccaaaaggtctgatattttcagatctaatcattacctgttcttctgctagactgccatttaacagcagttgagttgatactactggcttgattccatgtgtgcattgtaccatatcagcagccagggcct

SEQ ID NO: 407029 - DNA, 140 bp, Artificial Sequence
  Synthetic
aggccctggctgctgatatggaaccccataggaggggatctagaaatcacaacacatagttttaattgtggaggagaatttttctattgtaacacatcaggcctgtttaatagcacctgggaccttttgggacagcggtg

SEQ ID NO: 407030 - DNA, 140 bp, Artificial Sequence
  Synthetic
caccgctgtcccaaaaggtcccaggtgctattaaacaggcctgatgtgttacaatagaaaaattctcctccacaattaaaactatgtgttgtgatttctagatcccctcctatggggttccatatcagcagccagggcct

SEQ ID NO: 407031 - DNA, 140 bp, Artificial Sequence
  Synthetic
aggccctggctgctgatatgtgacattataactctcccatgcagaataaaacaaattataaatatgtggcagagagtaggacaagcaatgtatgcccctcctatccaaggaataataagggaccttttgggacagcggtg

SEQ ID NO: 407032 - DNA, 140 bp, Artificial Sequence
  Synthetic
caccgctgtcccaaaaggtcccttattattccttggataggaggggcatacattgcttgtcctactctctgccacatatttataatttgttttattctgcatgggagagttataatgtcacatatcagcagccagggcct

SEQ ID NO: 407033 - DNA, 140 bp, Artificial Sequence
  Synthetic
aggccctggctgctgatatgctaattgaagaatcgcagaaccagcaggaaaagaatgaacaagacttattggcattggacaagtgggcaaatctgtggaattggtttgacatatcaagatgaccttttgggacagcggtg

SEQ ID NO: 407034 - DNA, 140 bp, Artificial Sequence
  Synthetic
caccgctgtcccaaaaggtcatcttgatatgtcaaaccaattccacagatttgcccacttgtccaatgccaataagtcttgttcattcttttcctgctggttctgcgattcttcaattagcatatcagcagccagggcct

SEQ ID NO: 407035 - DNA, 140 bp, Artificial Sequence
  Synthetic
aggccctggctgctgatatgagagctattctccacatacctagaagaatcagacagggcttcgaaagggctttgctataacatgggtggcaagtggtcaaaaagtagcatagtgggatgggaccttttgggacagcggtg

SEQ ID NO: 407036 - DNA, 140 bp, Artificial Sequence
  Synthetic
caccgctgtcccaaaaggtcccatcccactatgctactttttgaccacttgccacccatgttatagcaaagccctttcgaagccctgtctgattcttctaggtatgtggagaatagctctcatatcagcagccagggcct

SEQ ID NO: 407037 - DNA, 140 bp, Artificial Sequence
  Synthetic
atacgccatgctgggtctccaacacggagcaatcacaagtagcaatacaaataatgctgattgtgtctggctagaagcacaagaggatgaggaagtgggttttccagtcagacctcaggtcgtacttgggagtcggccat

SEQ ID NO: 407038 - DNA, 140 bp, Artificial Sequence
  Synthetic
atggccgactcccaagtacgacctgaggtctgactggaaaacccacttcctcatcctcttgtgcttctagccagacacaatcagcattatttgtattgctacttgtgattgctccgtgttggagacccagcatggcgtat

SEQ ID NO: 407039 - DNA, 140 bp, Artificial Sequence
  Synthetic
  misc_feature (22)..(22): n is a, c, g, or t
  misc_feature (78)..(78): n is a, c, g, or t
  misc_feature (87)..(87): n is a, c, g, or t
  misc_feature (90)..(90): n is a, c, g, or t
atacgccatgctgggtctccantttgcttgataccatagcaataacagtagctggctggacagatagggttatagaantaggactangantttgtagagctattctccacatacctagaacgtacttgggagtcggccat

SEQ ID NO: 407040 - DNA, 140 bp, Artificial Sequence
  Synthetic
  misc_feature (51)..(51): n is a, c, g, or t
  misc_feature (54)..(54): n is a, c, g, or t
  misc_feature (63)..(63): n is a, c, g, or t
  misc_feature (119)..(119): n is a, c, g, or t
atggccgactcccaagtacgttctaggtatgtggagaatagctctacaaantcntagtcctanttctataaccctatctgtccagccagctactgttattgctatggtatcaagcaaantggagacccagcatggcgtat

SEQ ID NO: 407041 - DNA, 140 bp, Artificial Sequence
  Synthetic
aggccctggctgctgatatgaagacagagacagatccattcgattagtgagcggattcttagcacttgcctgggacgacctgcggaacctgtgccttttcagctaccaccgattgagagagaccttttgggacagcggtg

SEQ ID NO: 407042 - DNA, 140 bp, Artificial Sequence
  Synthetic
caccgctgtcccaaaaggtctctctcaatcggtggtagctgaaaaggcacaggttccgcaggtcgtcccaggcaagtgctaagaatccgctcactaatcgaatggatctgtctctgtcttcatatcagcagccagggcct

SEQ ID NO: 407043 - DNA, 140 bp, Artificial Sequence
  Synthetic
atacgccatgctgggtctccttaagtttactagacaaagtagactatagattaggagtagcagcactggtaatagcattcattttagcaataattgtgtggatcatagcatatctagaatcgtacttgggagtcggccat

SEQ ID NO: 407044 - DNA, 140 bp, Artificial Sequence
  Synthetic
atggccgactcccaagtacgattctagatatgctatgatccacacaattattgctaaaatgaatgctattaccagtgctgctactcctaatctatagtctactttgtctagtaaacttaaggagacccagcatggcgtat

SEQ ID NO: 407045 - DNA, 140 bp, Artificial Sequence
  Synthetic
aggccctggctgctgatatgaggagacataacaggagatataaggaaagcatattgtgagattagtggaacaaaatggaataaagttttaaaacaggtaactgaaaaattaaaagagcacgaccttttgggacagcggtg

SEQ ID NO: 407046 - DNA, 140 bp, Artificial Sequence
  Synthetic
caccgctgtcccaaaaggtcgtgctcttttaatttttcagttacctgttttaaaactttattccattttgttccactaatctcacaatatgctttccttatatctcctgttatgtctcctcatatcagcagccagggcct

SEQ ID NO: 407047 - DNA, 140 bp, Artificial Sequence
  Synthetic
aggccctggctgctgatatgctcagatattggtggaatctcctgcagtattggagccaggaattaaagaatagtgctataagcttgcttaacgccaaagcaatagcagtagctgaaggaagaccttttgggacagcggtg

SEQ ID NO: 407048 - DNA, 140 bp, Artificial Sequence
  Synthetic
caccgctgtcccaaaaggtcttccttcagctactgctattgctttggcgttaagcaagcttatagcactattctttaattcctggctccaatactgcaggagattccaccaatatctgagcatatcagcagccagggcct

SEQ ID NO: 407049 - DNA, 140 bp, Artificial Sequence
  Synthetic
aggccctggctgctgatatgaattaattgtacaagacccagcaataatacaagaagaagtgtaaggataggaccaggacaagtattctatacaaatgacataataggagacataaggcaagaccttttgggacagcggtg

SEQ ID NO: 407050 - DNA, 140 bp, Artificial Sequence
  Synthetic
caccgctgtcccaaaaggtcttgccttatgtctcctattatgtcatttgtatagaatacttgtcctggtcctatccttacacttcttcttgtattattgctgggtcttgtacaattaattcatatcagcagccagggcct

SEQ ID NO: 407051 - DNA, 140 bp, Artificial Sequence
  Synthetic
atacgccatgctgggtctccaaagaggaaattagaaaaacatttccctaatacaacaatacgctttaattcatcctcaggaggggatctagaaattacaacacatagttttaattgtggacgtacttgggagtcggccat

SEQ ID NO: 407052 - DNA, 140 bp, Artificial Sequence
  Synthetic
atggccgactcccaagtacgtccacaattaaaactatgtgttgtaatttctagatcccctcctgaggatgaattaaagcgtattgttgtattagggaaatgtttttctaatttcctctttggagacccagcatggcgtat

SEQ ID NO: 407053 - DNA, 140 bp, Artificial Sequence
  Synthetic
aggccctggctgctgatatgaccagctcttaagacaggaacagaggaacttagatcattatataacacagtggcaactctctactgtgtacataacaacatagagatacgggataccaaggaccttttgggacagcggtg

SEQ ID NO: 407054 - DNA, 140 bp, Artificial Sequence
  Synthetic
caccgctgtcccaaaaggtccttggtatcccgtatctctatgttgttatgtacacagtagagagttgccactgtgttatataatgatctaagttcctctgttcctgtcttaagagctggtcatatcagcagccagggcct

SEQ ID NO: 407055 - DNA, 140 bp, Artificial Sequence
  Synthetic
aggccctggctgctgatatgggatataatcagtttatgggatcaaagcctaaagccatgtgtaaaattaaccccactctgtgttactttaaattgcactgatttgaggaatgttactaatgaccttttgggacagcggtg

SEQ ID NO: 407056 - DNA, 140 bp, Artificial Sequence
  Synthetic
caccgctgtcccaaaaggtcattagtaacattcctcaaatcagtgcaatttaaagtaacacagagtggggttaattttacacatggctttaggctttgatcccataaactgattatatcccatatcagcagccagggcct

SEQ ID NO: 407057 - DNA, 140 bp, Artificial Sequence
  Synthetic
atacgccatgctgggtctccattaggagcagcaacgagacgcactgagccagcagcagagggagtaggagcagcatctcgagacttagataaatatggggcacttacaaccagcaatacgcgtacttgggagtcggccat

SEQ ID NO: 407058 - DNA, 140 bp, Artificial Sequence
  Synthetic
atggccgactcccaagtacgcgtattgctggttgtaagtgccccatatttatctaagtctcgagatgctgctcctactccctctgctgctggctcagtgcgtctcgttgctgctcctaatggagacccagcatggcgtat

SEQ ID NO: 407059 - DNA, 140 bp, Artificial Sequence
  Synthetic
atacgccatgctgggtctccaagacagggcttcgaaagggctatgctataaaatgggtggcaagtggttagaaagtagtatggatagatgctcctctgtaagggaaaaaatcacacaagccgtacttgggagtcggccat

SEQ ID NO: 407060 - DNA, 140 bp, Artificial Sequence
  Synthetic
atggccgactcccaagtacggcttgtgtgattttttcccttacagaggagcatctatccatactactttctaaccacttgccacccattttatagcatagccctttcgaagccctgtcttggagacccagcatggcgtat

SEQ ID NO: 407061 - DNA, 140 bp, Artificial Sequence
  Synthetic
aggccctggctgctgatatgagtcttgtgcagtattggggtctggagctaaaaaagagtgctattagtctgtttgataccatagcaatagcagtagctgaaggaacagataggattataggaccttttgggacagcggtg

SEQ ID NO: 407062 - DNA, 140 bp, Artificial Sequence
  Synthetic
caccgctgtcccaaaaggtcctataatcctatctgttccttcagctactgctattgctatggtatcaaacagactaatagcactcttttttagctccagaccccaatactgcacaagactcatatcagcagccagggcct

SEQ ID NO: 407063 - DNA, 140 bp, Artificial Sequence
  Synthetic
aggccctggctgctgatatggagccagcagcagatggggtgggagcagtatctcgagacctggaaaaacatggagcaatcacaagtagcaacacagcagctactaatgctgattgtgcctgaccttttgggacagcggtg

SEQ ID NO: 407064 - DNA, 140 bp, Artificial Sequence
  Synthetic
caccgctgtcccaaaaggtcaggcacaatcagcattagtagctgctgtgttgctacttgtgattgctccatgtttttccaggtctcgagatactgctcccaccccatctgctgctggctccatatcagcagccagggcct

SEQ ID NO: 407065 - DNA, 140 bp, Artificial Sequence
  Synthetic
aggccctggctgctgatatgggctagaagcacaagaggaggaggaggtgggttttccagtcaaacctcaggtacctttaagaccaatgacttataagggagcatttgatctcagcttcttgaccttttgggacagcggtg

SEQ ID NO: 407066 - DNA, 140 bp, Artificial Sequence
  Synthetic
caccgctgtcccaaaaggtcaagaagctgagatcaaatgctcccttataagtcattggtcttaaaggtacctgaggtttgactggaaaacccacctcctcctcctcttgtgcttctagcccatatcagcagccagggcct

SEQ ID NO: 407067 - DNA, 140 bp, Artificial Sequence
  Synthetic
aggccctggctgctgatatgtaacttttgagcccattcccatacactattgtgctccagcaggatatgctatctttaaatgcaatgaaacagggtttaatggaacaggcccatgtaaaaagaccttttgggacagcggtg

SEQ ID NO: 407068 - DNA, 140 bp, Artificial Sequence
  Synthetic
caccgctgtcccaaaaggtctttttacatgggcctgttccattaaaccctgtttcattgcatttaaagatagcatatcctgctggagcacaatagtgtatgggaatgggctcaaaagttacatatcagcagccagggcct

SEQ ID NO: 407069 - DNA, 140 bp, Artificial Sequence
  Synthetic
aggccctggctgctgatatgctaacctagagccctggaaccacccgggaagtcagcctacaactgcttgtagcaattgttattgtaaagtgtgttgctggcattgccaactttgctttatgaccttttgggacagcggtg

SEQ ID NO: 407070 - DNA, 140 bp, Artificial Sequence
  Synthetic
caccgctgtcccaaaaggtcataaagcaaagttggcaatgccagcaacacactttacaataacaattgctacaagcagttgtaggctgacttcccgggtggttccagggctctaggttagcatatcagcagccagggcct

SEQ ID NO: 407071 - DNA, 140 bp, Artificial Sequence
  Synthetic
  misc_feature (101)..(101): n is a, c, g, or t
atacgccatgctgggtctccacacaagaaaaggtgtacatttaggaccagggcaagcaatatatacaacaggagccataataggagatataagacaagcanattgtaacattagtgaagacgtacttgggagtcggccat

SEQ ID NO: 407072 - DNA, 140 bp, Artificial Sequence
  Synthetic
  misc_feature (40)..(40): n is a, c, g, or t
atggccgactcccaagtacgtcttcactaatgttacaatntgcttgtcttatatctcctattatggctcctgttgtatatattgcttgccctggtcctaaatgtacaccttttcttgtgtggagacccagcatggcgtat

SEQ ID NO: 407073 - DNA, 140 bp, Artificial Sequence
  Synthetic
  misc_feature (61)..(61): n is a, c, g, or t
atacgccatgctgggtctccgaggaactcctcacggtagtgaagatcatcaaaatcttatntcaaagcagtaagtaatattaattaatgtatgtaataaatcctttagaaatctgggcaacgtacttgggagtcggccat

SEQ ID NO: 407074 - DNA, 140 bp, Artificial Sequence
  Synthetic
  misc_feature (80)..(80): n is a, c, g, or t
atggccgactcccaagtacgttgcccagatttctaaaggatttattacatacattaattaatattacttactgctttganataagattttgatgatcttcactaccgtgaggagttcctcggagacccagcatggcgtat

SEQ ID NO: 407075 - DNA, 140 bp, Artificial Sequence
  Synthetic
atacgccatgctgggtctccgtattcatagagtgtagaaaattaaaaaggcaaaggaaaatagactggttgattgatagaataagagaaagagaagaagacagtggcaatgagagtgaagcgtacttgggagtcggccat

SEQ ID NO: 407076 - DNA, 140 bp, Artificial Sequence
  Synthetic
atggccgactcccaagtacgcttcactctcattgccactgtcttcttctctttctcttattctatcaatcaaccagtctattttcctttgcctttttaattttctacactctatgaatacggagacccagcatggcgtat

SEQ ID NO: 407077 - DNA, 140 bp, Artificial Sequence
  Synthetic
atacgccatgctgggtctcccaagtagtgaagatcatcaagatcctgtatcaaagcagtaagtattaattagtagatgtaatgatagattgggaagcaaggatagattatagaataggaacgtacttgggagtcggccat

SEQ ID NO: 407078 - DNA, 140 bp, Artificial Sequence
  Synthetic
atggccgactcccaagtacgttcctattctataatctatccttgcttcccaatctatcattacatctactaattaatacttactgctttgatacaggatcttgatgatcttcactacttgggagacccagcatggcgtat

SEQ ID NO: 407079 - DNA, 140 bp, Artificial Sequence
  Synthetic
atacgccatgctgggtctcccaaatggcactattggaaatggcactattagggacatgagaaactgctctttcaatataaccacagaaataagagataagaagaagcaagtatatgcactcgtacttgggagtcggccat

SEQ ID NO: 407080 - DNA, 140 bp, Artificial Sequence
  Synthetic
atggccgactcccaagtacgagtgcatatacttgcttcttcttatctcttatttctgtggttatattgaaagagcagtttctcatgtccctaatagtgccatttccaatagtgccatttgggagacccagcatggcgtat

SEQ ID NO: 407081 - DNA, 140 bp, Artificial Sequence
  Synthetic
aggccctggctgctgatatgtcaactcaactgttgttgaatggcagtctagcagaagaagaaatagtaattagatctgaaaatctcacaaataatgctaaaatcataatagtacagcttagaccttttgggacagcggtg

SEQ ID NO: 407082 - DNA, 140 bp, Artificial Sequence
  Synthetic
caccgctgtcccaaaaggtctaagctgtactattatgattttagcattatttgtgagattttcagatctaattactatttcttcttctgctagactgccattcaacaacagttgagttgacatatcagcagccagggcct

SEQ ID NO: 407083 - DNA, 140 bp, Artificial Sequence
  Synthetic
aggccctggctgctgatatgcctgacaaatggacagtacagcctatacagctgccagaaaaagaaagctggactgtcaatgatatacagaagttagtgggaaaattaaattgggcaagtcgaccttttgggacagcggtg

SEQ ID NO: 407084 - DNA, 140 bp, Artificial Sequence
  Synthetic
caccgctgtcccaaaaggtcgacttgcccaatttaattttcccactaacttctgtatatcattgacagtccagctttctttttctggcagctgtataggctgtactgtccatttgtcaggcatatcagcagccagggcct

SEQ ID NO: 407085 - DNA, 140 bp, Artificial Sequence
  Synthetic
atacgccatgctgggtctcccaaaggacacctataggacgagggcaagcactctttacaacaagaaaaaaaggaataaaaggacaagcacattgtaatattagtagagaaggatggaatacgtacttgggagtcggccat

SEQ ID NO: 407086 - DNA, 140 bp, Artificial Sequence
  Synthetic
atggccgactcccaagtacgtattccatccttctctactaatattacaatgtgcttgtccttttattcctttttttcttgttgtaaagagtgcttgccctcgtcctataggtgtcctttgggagacccagcatggcgtat

SEQ ID NO: 407087 - DNA, 140 bp, Artificial Sequence
  Synthetic
aggccctggctgctgatatgcctggaaagacatggggcactcacaagcagcaatacagcaactaataatgctgattgtgcctggctagaagcacaagaaggagcaggagatgtgggttttgaccttttgggacagcggtg

SEQ ID NO: 407088 - DNA, 140 bp, Artificial Sequence
  Synthetic
caccgctgtcccaaaaggtcaaaacccacatctcctgctccttcttgtgcttctagccaggcacaatcagcattattagttgctgtattgctgcttgtgagtgccccatgtctttccaggcatatcagcagccagggcct

SEQ ID NO: 407089 - DNA, 140 bp, Artificial Sequence
  Synthetic
atacgccatgctgggtctccacaataatttttaaaccatcctcgggaggggacccagaaattacaacacacagctttaattgtggaggggaatttttctactgcaatacatcaggactgtcgtacttgggagtcggccat

SEQ ID NO: 407090 - DNA, 140 bp, Artificial Sequence
  Synthetic
atggccgactcccaagtacgacagtcctgatgtattgcagtagaaaaattcccctccacaattaaagctgtgtgttgtaatttctgggtcccctcccgaggatggtttaaaaattattgtggagacccagcatggcgtat

SEQ ID NO: 407091 - DNA, 140 bp, Artificial Sequence
  Synthetic
  misc_feature (114)..(114): n is a, c, g, or t
aggccctggctgctgatatgaactaaagaatagtgctgttagcttgctaaatgccacagctatagcagtagctgaggggacagataggattatagaagcagtacaaagagcttntagagcgaccttttgggacagcggtg

SEQ ID NO: 407092 - DNA, 140 bp, Artificial Sequence
  Synthetic
  misc_feature (27)..(27): n is a, c, g, or t
caccgctgtcccaaaaggtcgctctanaagctctttgtactgcttctataatcctatctgtcccctcagctactgctatagctgtggcatttagcaagctaacagcactattctttagttcatatcagcagccagggcct

SEQ ID NO: 407093 - DNA, 140 bp, Artificial Sequence
  Synthetic
aggccctggctgctgatatgcagaaaattttaacatgtggaaaaataacatggtagagcagatgcaggaggatgtaatcagtttatgggatcaaagtctaaagccatgtgtaaagttaacgaccttttgggacagcggtg

SEQ ID NO: 407094 - DNA, 140 bp, Artificial Sequence
  Synthetic
caccgctgtcccaaaaggtcgttaactttacacatggctttagactttgatcccataaactgattacatcctcctgcatctgctctaccatgttatttttccacatgttaaaattttctgcatatcagcagccagggcct

SEQ ID NO: 407095 - DNA, 140 bp, Artificial Sequence
  Synthetic
aggccctggctgctgatatgagacagcgacgaagcgctcctccaagcagtgaggatcatcaagatcttgtatcaaagcagtaagtactacatagtagatgtaatgattgactggacagcagaccttttgggacagcggtg

SEQ ID NO: 407096 - DNA, 140 bp, Artificial Sequence
  Synthetic
caccgctgtcccaaaaggtctgctgtccagtcaatcattacatctactatgtagtacttactgctttgatacaagatcttgatgatcctcactgcttggaggagcgcttcgtcgctgtctcatatcagcagccagggcct

SEQ ID NO: 407097 - DNA, 140 bp, Artificial Sequence
  Synthetic
atacgccatgctgggtctcctaggaatttggggttgctctggaaaacacatttgcaccactagtgtgccctggaactctagctggagtaataaatctctagaagagatttggaataacatcgtacttgggagtcggccat

SEQ ID NO: 407098 - DNA, 140 bp, Artificial Sequence
  Synthetic
atggccgactcccaagtacgatgttattccaaatctcttctagagatttattactccagctagagttccagggcacactagtggtgcaaatgtgttttccagagcaaccccaaattcctaggagacccagcatggcgtat

SEQ ID NO: 407099 - DNA, 140 bp, Artificial Sequence
  Synthetic
aggccctggctgctgatatggataaggccatgggtgaaggaataaaatattgctctttcaacatgaccacagaactaatagacaagaaaaaacaaatgtatgcacttttttataaacttggaccttttgggacagcggtg

SEQ ID NO: 407100 - DNA, 140 bp, Artificial Sequence
  Synthetic
caccgctgtcccaaaaggtccaagtttataaaaaagtgcatacatttgttttttcttgtctattagttctgtggtcatgttgaaagagcaatattttattccttcacccatggccttatccatatcagcagccagggcct

SEQ ID NO: 407101 - DNA, 140 bp, Artificial Sequence
  Synthetic
aggccctggctgctgatatgtgacatggtggatcagatgcatgaggatataatcagtttatgggatcaaagcctaaagccatgtgtaaagttgaccccactctgtgtcactttaaactgtgaccttttgggacagcggtg

SEQ ID NO: 407102 - DNA, 140 bp, Artificial Sequence
  Synthetic
caccgctgtcccaaaaggtcacagtttaaagtgacacagagtggggtcaactttacacatggctttaggctttgatcccataaactgattatatcctcatgcatctgatccaccatgtcacatatcagcagccagggcct

SEQ ID NO: 407103 - DNA, 140 bp, Artificial Sequence
  Synthetic
aggccctggctgctgatatggcagatccattcgattagtgagcggattcttagcacttgcctgggacgacctgcggagcctgtgcctcttcagctaccaccgcttgagagacttactcttgaccttttgggacagcggtg

SEQ ID NO: 407104 - DNA, 140 bp, Artificial Sequence
  Synthetic
caccgctgtcccaaaaggtcaagagtaagtctctcaagcggtggtagctgaagaggcacaggctccgcaggtcgtcccaggcaagtgctaagaatccgctcactaatcgaatggatctgccatatcagcagccagggcct

SEQ ID NO: 407105 - DNA, 140 bp, Artificial Sequence
  Synthetic
atacgccatgctgggtctccagcagaaatgaaaaattgctctttcaatataaccacagaactaagagataagaaaaagcaggaatatgcacttttttataaacttgatatagtaccacttcgtacttgggagtcggccat

SEQ ID NO: 407106 - DNA, 140 bp, Artificial Sequence
  Synthetic
atggccgactcccaagtacgaagtggtactatatcaagtttataaaaaagtgcatattcctgctttttcttatctcttagttctgtggttatattgaaagagcaatttttcatttctgctggagacccagcatggcgtat

SEQ ID NO: 407107 - DNA, 140 bp, Artificial Sequence
  Synthetic
atacgccatgctgggtctccaatgtcaaaacaataatagtacatcttaatgaatctgtagagattgagtgtacaaggcctggcaataatacaagaagaagtgtgaggataggaccaggaccgtacttgggagtcggccat

SEQ ID NO: 407108 - DNA, 140 bp, Artificial Sequence
  Synthetic
atggccgactcccaagtacggtcctggtcctatcctcacacttcttcttgtattattgccaggccttgtacactcaatctctacagattcattaagatgtactattattgttttgacattggagacccagcatggcgtat

SEQ ID NO: 407109 - DNA, 140 bp, Artificial Sequence
  Synthetic
atacgccatgctgggtctcccaggaactaaaaattattgctatttctttgcttgaggctacagcaatgtcactagcggggtggacagatagggttatccaagtaatacaaagagcttggacgtacttgggagtcggccat

SEQ ID NO: 407110 - DNA, 140 bp, Artificial Sequence
  Synthetic
atggccgactcccaagtacgtccaagctctttgtattacttggataaccctatctgtccaccccgctagtgacattgctgtagcctcaagcaaagaaatagcaataatttttagttcctgggagacccagcatggcgtat

SEQ ID NO: 407111 - DNA, 140 bp, Artificial Sequence
  Synthetic
aggccctggctgctgatatgactagcggggtggacagatagggttatccaagtaatacaaagagcttggaaagcctttctccacatacccacactaatgaaacagggattagaaagggttgaccttttgggacagcggtg

SEQ ID NO: 407112 - DNA, 140 bp, Artificial Sequence
  Synthetic
caccgctgtcccaaaaggtcaaccctttctaatccctgtttcattagtgtgggtatgtggagaaaggctttccaagctctttgtattacttggataaccctatctgtccaccccgctagtcatatcagcagccagggcct

SEQ ID NO: 407113 - DNA, 140 bp, Artificial Sequence
  Synthetic
aggccctggctgctgatatgtcacctaggactttgaatgcatgggtgaaagtaatagaagaaaaggctttcagcccagaagtaatacccatgttttcagcattatcagaaggagccacccgaccttttgggacagcggtg

SEQ ID NO: 407114 - DNA, 140 bp, Artificial Sequence
  Synthetic
caccgctgtcccaaaaggtcgggtggctccttctgataatgctgaaaacatgggtattacttctgggctgaaagccttttcttctattactttcacccatgcattcaaagtcctaggtgacatatcagcagccagggcct

SEQ ID NO: 407115 - DNA, 140 bp, Artificial Sequence
  Synthetic
aggccctggctgctgatatgctgggacacaacagtctcaagggactgagactggggtgggagggccttaaatatctgtggaatattctggtatactgggggagggagataaaagaaagtggaccttttgggacagcggtg

SEQ ID NO: 407116 - DNA, 140 bp, Artificial Sequence
  Synthetic
caccgctgtcccaaaaggtccactttcttttatctccctcccccagtataccagaatattccacagatatttaaggccctcccaccccagtctcagtcccttgagactgttgtgtcccagcatatcagcagccagggcct

SEQ ID NO: 407117 - DNA, 140 bp, Artificial Sequence
  Synthetic
aggccctggctgctgatatgcctccaagcagtaaggatcatcaaaatcttatatcaaagcagtaagtattgtaatgttaagtttactagcaaaaatagattatagaataggagtaggagcgaccttttgggacagcggtg

SEQ ID NO: 407118 - DNA, 140 bp, Artificial Sequence
  Synthetic
caccgctgtcccaaaaggtcgctcctactcctattctataatctatttttgctagtaaacttaacattacaatacttactgctttgatataagattttgatgatccttactgcttggaggcatatcagcagccagggcct

SEQ ID NO: 407119 - DNA, 140 bp, Artificial Sequence
  Synthetic
aggccctggctgctgatatgcaaccctctggtgcgtacaccaaaggatagaggtaaaagacaccaaggaagctttagataaaatagaggaagtacaaaataagagcaagcaaaagacacagaccttttgggacagcggtg

SEQ ID NO: 407120 - DNA, 140 bp, Artificial Sequence
  Synthetic
caccgctgtcccaaaaggtctgtgtcttttgcttgctcttattttgtacttcctctattttatctaaagcttccttggtgtcttttacctctatcctttggtgtacgcaccagagggttgcatatcagcagccagggcct

SEQ ID NO: 407121 - DNA, 140 bp, Artificial Sequence
  Synthetic
aggccctggctgctgatatgaaactatcttaaaagcattgggaccaggggctacattagaagaaatgatgacagcatgtcagggagtggggggacccggtcataaagcaagagttttggcgaccttttgggacagcggtg

SEQ ID NO: 407122 - DNA, 140 bp, Artificial Sequence
  Synthetic
caccgctgtcccaaaaggtcgccaaaactcttgctttatgaccgggtccccccactccctgacatgctgtcatcatttcttctaatgtagcccctggtcccaatgcttttaagatagtttcatatcagcagccagggcct

SEQ ID NO: 407123 - DNA, 140 bp, Artificial Sequence
  Synthetic
aggccctggctgctgatatgaaattttaacatgtgggaaaatgacatggtagatcagatgcatgaggacataatcagtttatgggatgaagcctaaagccatgtgtaaagttgaccccacgaccttttgggacagcggtg

SEQ ID NO: 407124 - DNA, 140 bp, Artificial Sequence
  Synthetic
caccgctgtcccaaaaggtcgtggggtcaactttacacatggctttaggcttcatcccataaactgattatgtcctcatgcatctgatctaccatgtcattttcccacatgttaaaatttcatatcagcagccagggcct

SEQ ID NO: 407125 - DNA, 140 bp, Artificial Sequence
  Synthetic
atacgccatgctgggtctcctaatattgataagacaagagtggaaaaaggagaaataaaaaactgctctttcaatatcaccacaacaataagagataaggcgcggagagaaagcgcacttcgtacttgggagtcggccat

SEQ ID NO: 407126 - DNA, 140 bp, Artificial Sequence
  Synthetic
atggccgactcccaagtacgaagtgcgctttctctccgcgccttatctcttattgttgtggtgatattgaaagagcagttttttatttctcctttttccactcttgtcttatcaatattaggagacccagcatggcgtat

SEQ ID NO: 407127 - DNA, 140 bp, Artificial Sequence
  Synthetic
atacgccatgctgggtctccgctaatgctaatgctactgtggataatagcgcagttggacaaataaaaaattgctctttcaaaacaaccacagaactaagggataagcaacagaaagtgacgtacttgggagtcggccat

SEQ ID NO: 407128 - DNA, 140 bp, Artificial Sequence
  Synthetic
atggccgactcccaagtacgtcactttctgttgcttatcccttagttctgtggttgttttgaaagagcaattttttatttgtccaactgcgctattatccacagtagcattagcattagcggagacccagcatggcgtat

SEQ ID NO: 407129 - DNA, 140 bp, Artificial Sequence
  Synthetic
atacgccatgctgggtctccagtataattggatggcctgctgtaagagaaagaataagaaaaactgagccaagaaaaactgagccagcagcagagggagtaggagcagtgtctcaagactcgtacttgggagtcggccat

SEQ ID NO: 407130 - DNA, 140 bp, Artificial Sequence
  Synthetic
atggccgactcccaagtacgagtcttgagacactgctcctactccctctgctgctggctcagtttttcttggctcagtttttcttattctttctcttacagcaggccatccaattatactggagacccagcatggcgtat

SEQ ID NO: 407131 - DNA, 140 bp, Artificial Sequence
  Synthetic
  misc_feature (74)..(74): n is a, c, g, or t
aggccctggctgctgatatggctggttatgcgattctaaagtgcagggataaaaagttcaatggaacaggactntgtaaaaatgtcagtacagtgcaatgcacacatggaatcaggccaggaccttttgggacagcggtg

SEQ ID NO: 407132 - DNA, 140 bp, Artificial Sequence
  Synthetic
  misc_feature (67)..(67): n is a, c, g, or t
caccgctgtcccaaaaggtcctggcctgattccatgtgtgcattgcactgtactgacatttttacanagtcctgttccattgaactttttatccctgcactttagaatcgcataaccagccatatcagcagccagggcct

SEQ ID NO: 407133 - DNA, 140 bp, Artificial Sequence
  Synthetic
atacgccatgctgggtctcctgtgcctgcctggaagcacaagaggaggaagcagaattaggtttcccagtcagacctcaaatgcctttaaaaccagtgacttataaggcagcattcgatccgtacttgggagtcggccat

SEQ ID NO: 407134 - DNA, 140 bp, Artificial Sequence
  Synthetic
atggccgactcccaagtacggatcgaatgctgccttataagtcactggttttaaaggcatttgaggtctgactgggaaacctaattctgcttcctcctcttgtgcttccaggcaggcacaggagacccagcatggcgtat

SEQ ID NO: 407135 - DNA, 140 bp, Artificial Sequence
  Synthetic
atacgccatgctgggtctccacataagacaagcatattgtagcatcaataaaacacaatggaacacaactttagtaagggtaataaagaaattaaaagaacacttccctaataagacaatcgtacttgggagtcggccat

SEQ ID NO: 407136 - DNA, 140 bp, Artificial Sequence
  Synthetic
atggccgactcccaagtacgattgtcttattagggaagtgttcttttaatttctttattacccttactaaagttgtgttccattgtgttttattgatgctacaatatgcttgtcttatgtggagacccagcatggcgtat

SEQ ID NO: 407137 - DNA, 140 bp, Artificial Sequence
  Synthetic
atacgccatgctgggtctccaaatttctcaacaccctcaggaggggacctagaagttacaacacatagttttaattgtagaggagaatttttctactgcaatacaacaaatctgtttaatcgtacttgggagtcggccat

SEQ ID NO: 407138 - DNA, 140 bp, Artificial Sequence
  Synthetic
atggccgactcccaagtacgattaaacagatttgttgtattgcagtagaaaaattctcctctacaattaaaactatgtgttgtaacttctaggtcccctcctgagggtgttgagaaatttggagacccagcatggcgtat

SEQ ID NO: 407139 - DNA, 140 bp, Artificial Sequence
  Synthetic
aggccctggctgctgatatgcacacttccatgcagaataaaacaaattataaacatgtggcaggaggtaggacgagcaatgtatgcccctcccattgaaggaaacataacatgtaaatcagaccttttgggacagcggtg

SEQ ID NO: 407140 - DNA, 140 bp, Artificial Sequence
  Synthetic
caccgctgtcccaaaaggtctgatttacatgttatgtttccttcaatgggaggggcatacattgctcgtcctacctcctgccacatgtttataatttgttttattctgcatggaagtgtgcatatcagcagccagggcct

SEQ ID NO: 407141 - DNA, 140 bp, Artificial Sequence
  Synthetic
aggccctggctgctgatatgagacagctggactgtcaatgatatacagaaattagtgggaaaactaaattgggcaagtcaaatttatgcagggattaaggtaaagcaactgtgtaaactcgaccttttgggacagcggtg

SEQ ID NO: 407142 - DNA, 140 bp, Artificial Sequence
  Synthetic
caccgctgtcccaaaaggtcgagtttacacagttgctttaccttaatccctgcataaatttgacttgcccaatttagttttcccactaatttctgtatatcattgacagtccagctgtctcatatcagcagccagggcct

SEQ ID NO: 407143 - DNA, 140 bp, Artificial Sequence
  Synthetic
aggccctggctgctgatatgataataggggatataagaagtgcacattgtaatgtcagtggaacacaatggaataagactttaaaagcagtagctaacaaattaagagaatactttaagagaccttttgggacagcggtg

SEQ ID NO: 407144 - DNA, 140 bp, Artificial Sequence
  Synthetic
caccgctgtcccaaaaggtctcttaaagtattctcttaatttgttagctactgcttttaaagtcttattccattgtgttccactgacattacaatgtgcacttcttatatcccctattatcatatcagcagccagggcct

SEQ ID NO: 407145 - DNA, 140 bp, Artificial Sequence
  Synthetic
aggccctggctgctgatatgaccctattttgtgcatcagatgctaaagcatatgatacagaagtgcataatgtctgggctacacatgcctgtgtacccacagaccccaacccacaagaaggaccttttgggacagcggtg

SEQ ID NO: 407146 - DNA, 140 bp, Artificial Sequence
  Synthetic
caccgctgtcccaaaaggtccttcttgtgggttggggtctgtgggtacacaggcatgtgtagcccagacattatgcacttctgtatcatatgctttagcatctgatgcacaaaatagggtcatatcagcagccagggcct

SEQ ID NO: 407147 - DNA, 140 bp, Artificial Sequence
  Synthetic
atacgccatgctgggtctcctcactatcactaccaatgccactgacagtaacaatgccagtctccaagacatggcaaaagaaatgacaaactgctctttcaatatgaccacagaactaagcgtacttgggagtcggccat

SEQ ID NO: 407148 - DNA, 140 bp, Artificial Sequence
  Synthetic
atggccgactcccaagtacgcttagttctgtggtcatattgaaagagcagtttgtcatttcttttgccatgtcttggagactggcattgttactgtcagtggcattggtagtgatagtgaggagacccagcatggcgtat

SEQ ID NO: 407149 - DNA, 140 bp, Artificial Sequence
  Synthetic
aggccctggctgctgatatgaccagacctaacaacaatacaaggaacagtatacgtataggaccaggacaagcattctatgcaacaggtgccataacaggggatataagacaagcacattgaccttttgggacagcggtg

SEQ ID NO: 407150 - DNA, 140 bp, Artificial Sequence
  Synthetic
caccgctgtcccaaaaggtcaatgtgcttgtcttatatcccctgttatggcacctgttgcatagaatgcttgtcctggtcctatacgtatactgttccttgtattgttgttaggtctggtcatatcagcagccagggcct

SEQ ID NO: 407151 - DNA, 140 bp, Artificial Sequence
  Synthetic
atacgccatgctgggtctccaattagcagaacacttccctaataaaacaataacatttgcaccatcctcaggaggggacctagaaattacaacacatagctttaattgtagaggagaattcgtacttgggagtcggccat

SEQ ID NO: 407152 - DNA, 140 bp, Artificial Sequence
  Synthetic
atggccgactcccaagtacgaattctcctctacaattaaagctatgtgttgtaatttctaggtcccctcctgaggatggtgcaaatgttattgttttattagggaagtgttctgctaattggagacccagcatggcgtat

SEQ ID NO: 407153 - DNA, 140 bp, Artificial Sequence
  Synthetic
aggccctggctgctgatatgggaggggacctagaaattacaacacatagctttaattgtagaggagaatttttctattgcaatacatcaggcctgtttaatagtacatacatgtttaatggaccttttgggacagcggtg

SEQ ID NO: 407154 - DNA, 140 bp, Artificial Sequence
  Synthetic
caccgctgtcccaaaaggtccattaaacatgtatgtactattaaacaggcctgatgtattgcaatagaaaaattctcctctacaattaaagctatgtgttgtaatttctaggtcccctcccatatcagcagccagggcct

SEQ ID NO: 407155 - DNA, 140 bp, Artificial Sequence
  Synthetic
aggccctggctgctgatatgcagattaattgtacaagacccaacaacaatacaaggaaaggtatacgaataggaccaggacgagcatttttggcaacagaaaaaataataggagacatcagaccttttgggacagcggtg

SEQ ID NO: 407156 - DNA, 140 bp, Artificial Sequence
  Synthetic
caccgctgtcccaaaaggtctgatgtctcctattattttttctgttgccaaaaatgctcgtcctggtcctattcgtatacctttccttgtattgttgttgggtcttgtacaattaatctgcatatcagcagccagggcct

SEQ ID NO: 407157 - DNA, 140 bp, Artificial Sequence
  Synthetic
aggccctggctgctgatatgaattaaaagaattagagaaagggcagaagacagtggcaatgagagtgatggggatcacgaggaattgtcaacaatggtggatatggggcatcttaggcttgaccttttgggacagcggtg

SEQ ID NO: 407158 - DNA, 140 bp, Artificial Sequence
  Synthetic
caccgctgtcccaaaaggtcaagcctaagatgccccatatccaccattgttgacaattcctcgtgatccccatcactctcattgccactgtcttctgccctttctctaattcttttaattcatatcagcagccagggcct

SEQ ID NO: 407159 - DNA, 140 bp, Artificial Sequence
  Synthetic
aggccctggctgctgatatggctctggaaaactcatctgcactactgctgtaccttggaactccagttggagtaacaaatctcaacaagagatttgggataacatgacctggatgcagtggaccttttgggacagcggtg

SEQ ID NO: 407160 - DNA, 140 bp, Artificial Sequence
  Synthetic
caccgctgtcccaaaaggtccactgcatccaggtcatgttatcccaaatctcttgttgagatttgttactccaactggagttccaaggtacagcagtagtgcagatgagttttccagagccatatcagcagccagggcct

SEQ ID NO: 407161 - DNA, 140 bp, Artificial Sequence
  Synthetic
aggccctggctgctgatatggaccccactctgtgtcactttaaactgtactaactacattaatgacacaacgggagaaacaaaagattgctctttcaatatgaccacagaactaagagatgaccttttgggacagcggtg

SEQ ID NO: 407162 - DNA, 140 bp, Artificial Sequence
  Synthetic
caccgctgtcccaaaaggtcatctcttagttctgtggtcatattgaaagagcaatcttttgtttctcccgttgtgtcattaatgtagttagtacagtttaaagtgacacagagtggggtccatatcagcagccagggcct

SEQ ID NO: 407163 - DNA, 140 bp, Artificial Sequence
  Synthetic
atacgccatgctgggtctccaatttaagccaccctcaggaggggacccagaaattgtaatgcatacttttaattgtggaggggaatttttctactgtaattcatcaaaactgtttaatagcgtacttgggagtcggccat

SEQ ID NO: 407164 - DNA, 140 bp, Artificial Sequence
  Synthetic
atggccgactcccaagtacgctattaaacagttttgatgaattacagtagaaaaattcccctccacaattaaaagtatgcattacaatttctgggtcccctcctgagggtggcttaaattggagacccagcatggcgtat

SEQ ID NO: 407165 - DNA, 140 bp, Artificial Sequence
  Synthetic
aggccctggctgctgatatggcaacatacctagaagaataagacagggctttgaagcagctttgcaataaaatggggggcaagtggtcaaaaagtagcatagttggatggcctgctataagaccttttgggacagcggtg

SEQ ID NO: 407166 - DNA, 140 bp, Artificial Sequence
  Synthetic
caccgctgtcccaaaaggtcttatagcaggccatccaactatgctactttttgaccacttgccccccattttattgcaaagctgcttcaaagccctgtcttattcttctaggtatgttgccatatcagcagccagggcct

SEQ ID NO: 407167 - DNA, 140 bp, Artificial Sequence
  Synthetic
aggccctggctgctgatatggatggcctgctgtaagagaaagaataagacgaactgagccagcagcagagggagtaggagcagcgtctcaagacttagataaatatggggcactgacaaggaccttttgggacagcggtg

SEQ ID NO: 407168 - DNA, 140 bp, Artificial Sequence
  Synthetic
caccgctgtcccaaaaggtccttgtcagtgccccatatttatctaagtcttgagacgctgctcctactccctctgctgctggctcagttcgtcttattctttctcttacagcaggccatccatatcagcagccagggcct

SEQ ID NO: 407169 - DNA, 140 bp, Artificial Sequence
  Synthetic
atacgccatgctgggtctccgatgggtgcgagagcgtcaatattacgagggaaaaaattagatacgtgggagggaattcggctaaggccagggggaaagaaaaaatatcaattgaaacatcgtacttgggagtcggccat

SEQ ID NO: 407170 - DNA, 140 bp, Artificial Sequence
  Synthetic
atggccgactcccaagtacgatgtttcaattgatattttttctttccccctggccttagccgaattccctcccacgtatctaattttttccctcgtaatattgacgctctcgcacccatcggagacccagcatggcgtat

SEQ ID NO: 407171 - DNA, 140 bp, Artificial Sequence
  Synthetic
aggccctggctgctgatatgtcatctgcaccactgccgtgccttggaacgctagttggagtaataaatctcaagaggatatttggggaaacatgacctggatgcagtgggatagagaaatgaccttttgggacagcggtg

SEQ ID NO: 407172 - DNA, 140 bp, Artificial Sequence
  Synthetic
caccgctgtcccaaaaggtcatttctctatcccactgcatccaggtcatgtttccccaaatatcctcttgagatttattactccaactagcgttccaaggcacggcagtggtgcagatgacatatcagcagccagggcct

SEQ ID NO: 407173 - DNA, 140 bp, Artificial Sequence
  Synthetic
aggccctggctgctgatatgttgtaaacactgtagctaccattgtctagtttgctttcagacaaaaggcttaggcatttcctatggcaggaagaagcggagacagcgacgaagcactcctgaccttttgggacagcggtg

SEQ ID NO: 407174 - DNA, 140 bp, Artificial Sequence
  Synthetic
caccgctgtcccaaaaggtcaggagtgcttcgtcgctgtctccgcttcttcctgccataggaaatgcctaagccttttgtctgaaagcaaactagacaatggtagctacagtgtttacaacatatcagcagccagggcct

SEQ ID NO: 407175 - DNA, 140 bp, Artificial Sequence
  Synthetic
atacgccatgctgggtctccatagtactactacccccactactagcacgactggagaaatgaaaaattgctcctttaatgcaaccacagtaataaaggataagaaaaagaaagagtatgccgtacttgggagtcggccat

SEQ ID NO: 407176 - DNA, 140 bp, Artificial Sequence
  Synthetic
atggccgactcccaagtacggcatactctttctttttcttatcctttattactgtggttgcattaaaggagcaatttttcatttctccagtcgtgctagtagtgggggtagtagtactatggagacccagcatggcgtat

SEQ ID NO: 407177 - DNA, 140 bp, Artificial Sequence
  Synthetic
aggccctggctgctgatatgttgtgcctggctggaagcgcaagaggaggaaggagatgtaggctttccagtcagacctcaggtacctttaagaccaatgacttataagggagcattcgatgaccttttgggacagcggtg

SEQ ID NO: 407178 - DNA, 140 bp, Artificial Sequence
  Synthetic
caccgctgtcccaaaaggtcatcgaatgctcccttataagtcattggtcttaaaggtacctgaggtctgactggaaagcctacatctccttcctcctcttgcgcttccagccaggcacaacatatcagcagccagggcct

SEQ ID NO: 407179 - DNA, 140 bp, Artificial Sequence
  Synthetic
atacgccatgctgggtctccgccccaccctcagtttccctcaaatcactctttggcaacgaccccttgtcacagtaaaaataggaggacagctaagagaagctctattagatacaggagccgtacttgggagtcggccat

SEQ ID NO: 407180 - DNA, 140 bp, Artificial Sequence
  Synthetic
atggccgactcccaagtacggctcctgtatctaatagagcttctcttagctgtcctcctatttttactgtgacaaggggtcgttgccaaagagtgatttgagggaaactgagggtggggcggagacccagcatggcgtat

SEQ ID NO: 407181 - DNA, 140 bp, Artificial Sequence
  Synthetic
atacgccatgctgggtctccgaaccagccgcaggaggggatctagaaattacaacacatagctttaattgtggaggggaattcttctattgcaatacaacacaactgtttaatgatagtgcgtacttgggagtcggccat

SEQ ID NO: 407182 - DNA, 140 bp, Artificial Sequence
  Synthetic
atggccgactcccaagtacgcactatcattaaacagttgtgttgtattgcaatagaagaattcccctccacaattaaagctatgtgttgtaatttctagatcccctcctgcggctggttcggagacccagcatggcgtat

SEQ ID NO: 407183 - DNA, 140 bp, Artificial Sequence
  Synthetic
atacgccatgctgggtctcccgtgcgcttagtgagcggattcttaccactcttctgggaggacctccggaacctgtgcattttcagctaccaccgcttgagagacttcatcttgattgcacgtacttgggagtcggccat

SEQ ID NO: 407184 - DNA, 140 bp, Artificial Sequence
  Synthetic
atggccgactcccaagtacgtgcaatcaagatgaagtctctcaagcggtggtagctgaaaatgcacaggttccggaggtcctcccagaagagtggtaagaatccgctcactaagcgcacgggagacccagcatggcgtat

SEQ ID NO: 407185 - DNA, 140 bp, Artificial Sequence
  Synthetic
atacgccatgctgggtctccaccaatggtagtaatagtactggtaccaatggtagtgataattccttaaaaggagaaatgaaaaactgctctttcaatatcaccacaacaataagagatacgtacttgggagtcggccat

SEQ ID NO: 407186 - DNA, 140 bp, Artificial Sequence
  Synthetic
atggccgactcccaagtacgtatctcttattgttgtggtgatattgaaagagcagtttttcatttctccttttaaggaattatcactaccattggtaccagtactattactaccattggtggagacccagcatggcgtat

SEQ ID NO: 407187 - DNA, 140 bp, Artificial Sequence
  Synthetic
atacgccatgctgggtctcccatctataacacttatggggatacttgggaaggggttgaagctataataagaactttgcaacaactactgtttgttcatttcagaattgggtgccaacatcgtacttgggagtcggccat

SEQ ID NO: 407188 - DNA, 140 bp, Artificial Sequence
  Synthetic
atggccgactcccaagtacgatgttggcacccaattctgaaatgaacaaacagtagttgttgcaaagttcttattatagcttcaaccccttcccaagtatccccataagtgttatagatgggagacccagcatggcgtat

SEQ ID NO: 407189 - DNA, 140 bp, Artificial Sequence
  Synthetic
aggccctggctgctgatatgctcttcagctaccaccgattgagagacttcatattgattgcagcgaggggactacagagggggtgggaagcccttaagtatctaggaagtcttgcgcagtgaccttttgggacagcggtg

SEQ ID NO: 407190 - DNA, 140 bp, Artificial Sequence
  Synthetic
caccgctgtcccaaaaggtcactgcgcaagacttcctagatacttaagggcttcccaccccctctgtagtcccctcgctgcaatcaatatgaagtctctcaatcggtggtagctgaagagcatatcagcagccagggcct

SEQ ID NO: 407191 - DNA, 140 bp, Artificial Sequence
  Synthetic
atacgccatgctgggtctccgtagctaactggacagataggggcatagaagtagtacaaagaattggtagagctatttacaatatacctagaaggataagacagggtgcagaaagagcttcgtacttgggagtcggccat

SEQ ID NO: 407192 - DNA, 140 bp, Artificial Sequence
  Synthetic
atggccgactcccaagtacgaagctctttctgcaccctgtcttatccttctaggtatattgtaaatagctctaccaattctttgtactacttctatgcccctatctgtccagttagctacggagacccagcatggcgtat

SEQ ID NO: 407193 - DNA, 140 bp, Artificial Sequence
  Synthetic
aggccctggctgctgatatgcattcaagcacaaccagataagagtgaatcagagttagttaatcaaataatagaacagttaataaaaaaggaaagggtctacctgtcatgggtaccagcagaccttttgggacagcggtg

SEQ ID NO: 407194 - DNA, 140 bp, Artificial Sequence
  Synthetic
caccgctgtcccaaaaggtctgctggtacccatgacaggtagaccctttccttttttattaactgttctattatttgattaactaactctgattcactcttatctggttgtgcttgaatgcatatcagcagccagggcct

SEQ ID NO: 407195 - DNA, 140 bp, Artificial Sequence
  Synthetic
aggccctggctgctgatatgacagggaacccttaacttccctcaaatcactctttggcagcgaccccttgtctcaataaaagtagggggtcaggtaaaggaggctctcttagacacaggagaccttttgggacagcggtg

SEQ ID NO: 407196 - DNA, 140 bp, Artificial Sequence
  Synthetic
caccgctgtcccaaaaggtctcctgtgtctaagagagcctcctttacctgaccccctacttttattgagacaaggggtcgctgccaaagagtgatttgagggaagttaagggttccctgtcatatcagcagccagggcct

SEQ ID NO: 407197 - DNA, 140 bp, Artificial Sequence
  Synthetic
aggccctggctgctgatatgctgtgtacccacagaccccaacccacaagaaatacacctaaaaaatgtaacagaaaattttaacatgtggaaaaataacatggtagaacagatgcatgaggaccttttgggacagcggtg

SEQ ID NO: 407198 - DNA, 140 bp, Artificial Sequence
  Synthetic
caccgctgtcccaaaaggtcctcatgcatctgttctaccatgttatttttccacatgttaaaattttctgttacattttttaggtgtatttcttgtgggttggggtctgtgggtacacagcatatcagcagccagggcct

SEQ ID NO: 407199 - DNA, 140 bp, Artificial Sequence
  Synthetic
aggccctggctgctgatatgaattataaacatgtggcaggaagtaggacaagcaatgtatgctcctcccatcaggggaagaattaattgtgtatcaaatattacaggaatactattgacagaccttttgggacagcggtg

SEQ ID NO: 407200 - DNA, 140 bp, Artificial Sequence
  Synthetic
caccgctgtcccaaaaggtctgtcaatagtattcctgtaatatttgatacacaattaattcttcccctgatgggaggagcatacattgcttgtcctacttcctgccacatgtttataattcatatcagcagccagggcct

SEQ ID NO: 407201 - DNA, 140 bp, Artificial Sequence
  Synthetic
aggccctggctgctgatatggcctgggacgacctgcggaacctgtgcctcttcagctaccaccgcttgagagacttcatattagtgacagcgagagtggtggaacttctgggacgcagcagaccttttgggacagcggtg

SEQ ID NO: 407202 - DNA, 140 bp, Artificial Sequence
  Synthetic
caccgctgtcccaaaaggtctgctgcgtcccagaagttccaccactctcgctgtcactaatatgaagtctctcaagcggtggtagctgaagaggcacaggttccgcaggtcgtcccaggccatatcagcagccagggcct

SEQ ID NO: 407203 - DNA, 140 bp, Artificial Sequence
  Synthetic
aggccctggctgctgatatgagacttcatattagtgacagcgagagtggtggaacttctgggacgcagcagtctcaagggactacagagggggtgggaagcccttaaatatctgggaagtgaccttttgggacagcggtg

SEQ ID NO: 407204 - DNA, 140 bp, Artificial Sequence
  Synthetic
caccgctgtcccaaaaggtcacttcccagatatttaagggcttcccaccccctctgtagtcccttgagactgctgcgtcccagaagttccaccactctcgctgtcactaatatgaagtctcatatcagcagccagggcct

SEQ ID NO: 407205 - DNA, 140 bp, Artificial Sequence
  Synthetic
atacgccatgctgggtctccgtcaccaataatataactgatggcataacaggagaaataaaaaactgctctttcaatatgaccacagagctaagggataaaaagaggagagtatattcaccgtacttgggagtcggccat

SEQ ID NO: 407206 - DNA, 140 bp, Artificial Sequence
  Synthetic
atggccgactcccaagtacggtgaatatactctcctctttttatcccttagctctgtggtcatattgaaagagcagttttttatttctcctgttatgccatcagttatattattggtgacggagacccagcatggcgtat

SEQ ID NO: 407207 - DNA, 140 bp, Artificial Sequence
  Synthetic
aggccctggctgctgatatgtgtacacatggaattaggccagtagtatcaactcaactactgttaaatggcagtctagcagaagaagaagtagtaattagatctagcaatttcacggacagaccttttgggacagcggtg

SEQ ID NO: 407208 - DNA, 140 bp, Artificial Sequence
  Synthetic
caccgctgtcccaaaaggtctgtccgtgaaattgctagatctaattactacttcttcttctgctagactgccatttaacagtagttgagttgatactactggcctaattccatgtgtacacatatcagcagccagggcct

SEQ ID NO: 407209 - DNA, 140 bp, Artificial Sequence
  Synthetic
atacgccatgctgggtctccagtggatggcctgctataagggaaagaatgaaacgagctgagccagcagcagaaggggtgggagcagtatctcgagacttggcaaaacatggagcaatcacgtacttgggagtcggccat

SEQ ID NO: 407210 - DNA, 140 bp, Artificial Sequence
  Synthetic
atggccgactcccaagtacgtgattgctccatgttttgccaagtctcgagatactgctcccaccccttctgctgctggctcagctcgtttcattctttcccttatagcaggccatccactggagacccagcatggcgtat

SEQ ID NO: 407211 - DNA, 140 bp, Artificial Sequence
  Synthetic
atacgccatgctgggtctccaagaaaaggtgtacacataggaccagggcaagcattctatgcaataggtgacataataggggatataagacgagcacattgtactgtcaatggaacaacacgtacttgggagtcggccat

SEQ ID NO: 407212 - DNA, 140 bp, Artificial Sequence
  Synthetic
atggccgactcccaagtacgtgttgttccattgacagtacaatgtgctcgtcttatatcccctattatgtcacctattgcatagaatgcttgccctggtcctatgtgtacaccttttcttggagacccagcatggcgtat

SEQ ID NO: 407213 - DNA, 140 bp, Artificial Sequence
  Synthetic
aggccctggctgctgatatgtacttggacgggagttgaagctataataagaattctgcaacaactactgtttattcatttcagaattgggtgccagcatagcagaataggcattatacgagaccttttgggacagcggtg

SEQ ID NO: 407214 - DNA, 140 bp, Artificial Sequence
  Synthetic
caccgctgtcccaaaaggtctcgtataatgcctattctgctatgctggcacccaattctgaaatgaataaacagtagttgttgcagaattcttattatagcttcaactcccgtccaagtacatatcagcagccagggcct

SEQ ID NO: 407215 - DNA, 140 bp, Artificial Sequence
  Synthetic
atacgccatgctgggtctccgaacaaaacaatagtctttgctaacgccgtaggaggggatccggaaataacaacacatagtttcaattgtaggggagaatttttctattgtgacacatcacgtacttgggagtcggccat

SEQ ID NO: 407216 - DNA, 140 bp, Artificial Sequence
  Synthetic
atggccgactcccaagtacgtgatgtgtcacaatagaaaaattctcccctacaattgaaactatgtgttgttatttccggatcccctcctacggcgttagcaaagactattgttttgttcggagacccagcatggcgtat

SEQ ID NO: 407217 - DNA, 140 bp, Artificial Sequence
  Synthetic
atacgccatgctgggtctccttcatatggcaggaagaagtggagacaacgacgcggacgcagcgctccttcaagcagtaaagatcatcaagatcttatatcaaagcagtaagtattgcatcgtacttgggagtcggccat

SEQ ID NO: 407218 - DNA, 140 bp, Artificial Sequence
  Synthetic
atggccgactcccaagtacgatgcaatacttactgctttgatataagatcttgatgatctttactgcttgaaggagcgctgcgtccgcgtcgttgtctccacttcttcctgccatatgaaggagacccagcatggcgtat

SEQ ID NO: 407219 - DNA, 140 bp, Artificial Sequence
  Synthetic
aggccctggctgctgatatgcaagcagtaaagatcatcaagatcttatatcaaagcagtaagtattgcataatataggtaatgattgactggacagaacaagtagattatagaatagcaagaccttttgggacagcggtg

SEQ ID NO: 407220 - DNA, 140 bp, Artificial Sequence
  Synthetic
caccgctgtcccaaaaggtcttgctattctataatctacttgttctgtccagtcaatcattacctatattatgcaatacttactgctttgatataagatcttgatgatctttactgcttgcatatcagcagccagggcct

SEQ ID NO: 407221 - DNA, 140 bp, Artificial Sequence
  Synthetic
atacgccatgctgggtctccagtaatacctaccaaaatgtgaccactcccactcctcctgacatcatgaaaaattgctctttcaatatacccacagaactaagagataagagcaagaaggcgtacttgggagtcggccat

SEQ ID NO: 407222 - DNA, 140 bp, Artificial Sequence
  Synthetic
atggccgactcccaagtacgccttcttgctcttatctcttagttctgtgggtatattgaaagagcaatttttcatgatgtcaggaggagtgggagtggtcacattttggtaggtattactggagacccagcatggcgtat

SEQ ID NO: 407223 - DNA, 140 bp, Artificial Sequence
  Synthetic
atacgccatgctgggtctccactctggtaagaactctagtgagtattatagattaataaattgtaatacctcagccataacacaagcctgtccaaaggtcacttttgatccaattcctatcgtacttgggagtcggccat

SEQ ID NO: 407224 - DNA, 140 bp, Artificial Sequence
  Synthetic
atggccgactcccaagtacgataggaattggatcaaaagtgacctttggacaggcttgtgttatggctgaggtattacaatttattaatctataatactcactagagttcttaccagagtggagacccagcatggcgtat

SEQ ID NO: 407225 - DNA, 140 bp, Artificial Sequence
  Synthetic
aggccctggctgctgatatgtacaagaaaaagtgtaaggataggaccaggacaaacattctatgcaacaggagaagtaataggagatataagagaagcacattgtaacattagtgaagaagaccttttgggacagcggtg

SEQ ID NO: 407226 - DNA, 140 bp, Artificial Sequence
  Synthetic
caccgctgtcccaaaaggtcttcttcactaatgttacaatgtgcttctcttatatctcctattacttctcctgttgcatagaatgtttgtcctggtcctatccttacactttttcttgtacatatcagcagccagggcct

SEQ ID NO: 407227 - DNA, 140 bp, Artificial Sequence
  Synthetic
atacgccatgctgggtctcctagcaatagcagcagctgagtggacagataggattatagaactaatacaaagaatttgtagagctattctcaacgtacctgtaagaatcagacagggcttcgtacttgggagtcggccat

SEQ ID NO: 407228 - DNA, 140 bp, Artificial Sequence
  Synthetic
atggccgactcccaagtacgaagccctgtctgattcttacaggtacgttgagaatagctctacaaattctttgtattagttctataatcctatctgtccactcagctgctgctattgctaggagacccagcatggcgtat

SEQ ID NO: 407229 - DNA, 140 bp, Artificial Sequence
  Synthetic
  misc_feature (63)..(63): n is a, c, g, or t
  misc_feature (112)..(112): n is a, c, g, or t
atacgccatgctgggtctccgacgaggaggtaggctttccagtaaggcctcaggtgcctctangaccaatgacttacaagggagctgtggacctcagccactttttaaaagnaaagggggcgtacttgggagtcggccat

SEQ ID NO: 407230 - DNA, 140 bp, Artificial Sequence
  Synthetic
  misc_feature (29)..(29): n is a, c, g, or t
  misc_feature (78)..(78): n is a, c, g, or t
atggccgactcccaagtacgccccctttncttttaaaaagtggctgaggtccacagctcccttgtaagtcattggtcntagaggcacctgaggccttactggaaagcctacctcctcgtcggagacccagcatggcgtat

SEQ ID NO: 407231 - DNA, 140 bp, Artificial Sequence
  Synthetic
aggccctggctgctgatatgatgggagaaaattcggttaaggccagggggaaagaaaaaatatagactaaaacatatagtatgggcaagcagggagctggaaagatttgcacttaaccctgaccttttgggacagcggtg

SEQ ID NO: 407232 - DNA, 140 bp, Artificial Sequence
  Synthetic
caccgctgtcccaaaaggtcagggttaagtgcaaatctttccagctccctgcttgcccatactatatgttttagtctatattttttctttccccctggccttaaccgaattttctcccatcatatcagcagccagggcct

SEQ ID NO: 407233 - DNA, 140 bp, Artificial Sequence
  Synthetic
  misc_feature (108)..(108): n is a, c, g, or t
atacgccatgctgggtctccggtcttttagacacagcagaaggatgccaacagataatggaacagatacaaccagctcttaagacaggatcagaagaacttagatcantatataatacagcgtacttgggagtcggccat

SEQ ID NO: 407234 - DNA, 140 bp, Artificial Sequence
  Synthetic
  misc_feature (33)..(33): n is a, c, g, or t
atggccgactcccaagtacgctgtattatatantgatctaagttcttctgatcctgtcttaagagctggttgtatctgttccattatctgttggcatccttctgctgtgtctaaaagaccggagacccagcatggcgtat

SEQ ID NO: 407235 - DNA, 140 bp, Artificial Sequence
  Synthetic
aggccctggctgctgatatgctcaagcaggaagctgtcagacactttcctagaccatggctccatagtttaggacagcatatctatgaaacctatggggatacttgggcaggagttgaaggaccttttgggacagcggtg

SEQ ID NO: 407236 - DNA, 140 bp, Artificial Sequence
  Synthetic
caccgctgtcccaaaaggtccttcaactcctgcccaagtatccccataggtttcatagatatgctgtcctaaactatggagccatggtctaggaaagtgtctgacagcttcctgcttgagcatatcagcagccagggcct

SEQ ID NO: 407237 - DNA, 140 bp, Artificial Sequence
  Synthetic
aggccctggctgctgatatgtctatagaaagtagatagtaataagactaaacaaaatggtgaaaatgtacagtccagtgagcatcttagatattaagcaaagaccaaaagaaccatttaggaccttttgggacagcggtg

SEQ ID NO: 407238 - DNA, 140 bp, Artificial Sequence
  Synthetic
caccgctgtcccaaaaggtcctaaatggttcttttggtctttgcttaatatctaagatgctcactggactgtacattttcaccattttgtttagtcttattactatctactttctatagacatatcagcagccagggcct

SEQ ID NO: 407239 - DNA, 140 bp, Artificial Sequence
  Synthetic
aggccctggctgctgatatggcctcaggggactacagagggggtgggaagcccttaaatatctgggaagtcttgtgcagtattggggtctggagctaaaaaagagtactattagtctgttgaccttttgggacagcggtg

SEQ ID NO: 407240 - DNA, 140 bp, Artificial Sequence
  Synthetic
caccgctgtcccaaaaggtcaacagactaatagtactcttttttagctccagaccccaatactgcacaagacttcccagatatttaagggcttcccaccccctctgtagtcccctgaggccatatcagcagccagggcct

SEQ ID NO: 407241 - DNA, 140 bp, Artificial Sequence
  Synthetic
aggccctggctgctgatatgctctattctgtgcatcagatgctaaagcatatgatacagaagtgcataatgtctgggctacacatgcctgtgtacccacagaccccaacccacaagaaatgaccttttgggacagcggtg

SEQ ID NO: 407242 - DNA, 140 bp, Artificial Sequence
  Synthetic
caccgctgtcccaaaaggtcatttcttgtgggttggggtctgtgggtacacaggcatgtgtagcccagacattatgcacttctgtatcatatgctttagcatctgatgcacagaatagagcatatcagcagccagggcct

SEQ ID NO: 407243 - DNA, 140 bp, Artificial Sequence
  Synthetic
aggccctggctgctgatatgattggtagagctatctgcaacatacctagaagagtaagacagggctttgaaacagctttgctataaaatggggggcaagtggtcaaaaagcagtataattgaccttttgggacagcggtg

SEQ ID NO: 407244 - DNA, 140 bp, Artificial Sequence
  Synthetic
caccgctgtcccaaaaggtcaattatactgctttttgaccacttgccccccattttatagcaaagctgtttcaaagccctgtcttactcttctaggtatgttgcagatagctctaccaatcatatcagcagccagggcct

SEQ ID NO: 407245 - DNA, 140 bp, Artificial Sequence
  Synthetic
aggccctggctgctgatatgaaataaaaaattgctctttcaatacaaccacagaaataagagataagaaacagaaagcgtatgcacttttttatagacctgatgtagtaccacttaatgggaccttttgggacagcggtg

SEQ ID NO: 407246 - DNA, 140 bp, Artificial Sequence
  Synthetic
caccgctgtcccaaaaggtcccattaagtggtactacatcaggtctataaaaaagtgcatacgctttctgtttcttatctcttatttctgtggttgtattgaaagagcaattttttatttcatatcagcagccagggcct

SEQ ID NO: 407247 - DNA, 140 bp, Artificial Sequence
  Synthetic
aggccctggctgctgatatggaggaagtgggttttccagtcagacctcaggtacctttaagaccaatgacttacaagggagctctagatcttagccactttttaaaagaaaaggggggacgaccttttgggacagcggtg

SEQ ID NO: 407248 - DNA, 140 bp, Artificial Sequence
  Synthetic
caccgctgtcccaaaaggtcgtccccccttttcttttaaaaagtggctaagatctagagctcccttgtaagtcattggtcttaaaggtacctgaggtctgactggaaaacccacttcctccatatcagcagccagggcct

SEQ ID NO: 407249 - DNA, 140 bp, Artificial Sequence
  Synthetic
aggccctggctgctgatatgagacccaacaacaatacaagaagacgcataactatgggaccaggcagagcatattatacaacaggagacataataggaaatataagacaagcacattgtagaccttttgggacagcggtg

SEQ ID NO: 407250 - DNA, 140 bp, Artificial Sequence
  Synthetic
caccgctgtcccaaaaggtctacaatgtgcttgtcttatatttcctattatgtctcctgttgtataatatgctctgcctggtcccatagttatgcgtcttcttgtattgttgttgggtctcatatcagcagccagggcct

SEQ ID NO: 407251 - DNA, 140 bp, Artificial Sequence
  Synthetic
aggccctggctgctgatatgccctgacctagcagaccaactaattcacctgtattattttgattgtttttcagaatctgctataagaaatgccttattaggacgtagagttagtcctagtgaccttttgggacagcggtg

SEQ ID NO: 407252 - DNA, 140 bp, Artificial Sequence
  Synthetic
caccgctgtcccaaaaggtcactaggactaactctacgtcctaataaggcatttcttatagcagattctgaaaaacaatcaaaataatacaggtgaattagttggtctgctaggtcagggcatatcagcagccagggcct

SEQ ID NO: 407253 - DNA, 140 bp, Artificial Sequence
  Synthetic
atacgccatgctgggtctcctctctaatagaacaatacaatttgcaccacactcaggaggagacctagaagttacaacacacagttttaattgtagaggagaatttttctattgtgataccgtacttgggagtcggccat

SEQ ID NO: 407254 - DNA, 140 bp, Artificial Sequence
  Synthetic
atggccgactcccaagtacggtatcacaatagaaaaattctcctctacaattaaaactgtgtgttgtaacttctaggtctcctcctgagtgtggtgcaaattgtattgttctattagagaggagacccagcatggcgtat

SEQ ID NO: 407255 - DNA, 140 bp, Artificial Sequence
  Synthetic
aggccctggctgctgatatgagaagtgaattatataaatataaagtggtagaaattaagccattgggagtagcacccactgaggcaaaaaggagagtggtggagagagaaaaaagagcaggaccttttgggacagcggtg

SEQ ID NO: 407256 - DNA, 140 bp, Artificial Sequence
  Synthetic
caccgctgtcccaaaaggtcctgctcttttttctctctccaccactctcctttttgcctcagtgggtgctactcccaatggcttaatttctaccactttatatttatataattcacttctcatatcagcagccagggcct

SEQ ID NO: 407257 - DNA, 140 bp, Artificial Sequence
  Synthetic
aggccctggctgctgatatgtaagactgcttgtaccaattgctattgtaaaaagtgctgccttcattgccaagtttgtttcataaaaaaaggcttaggcatcttctatggcaggaagaaggaccttttgggacagcggtg

SEQ ID NO: 407258 - DNA, 140 bp, Artificial Sequence
  Synthetic
caccgctgtcccaaaaggtccttcttcctgccatagaagatgcctaagcctttttttatgaaacaaacttggcaatgaaggcagcactttttacaatagcaattggtacaagcagtcttacatatcagcagccagggcct

SEQ ID NO: 407259 - DNA, 140 bp, Artificial Sequence
  Synthetic
atacgccatgctgggtctccactggatgacagaaaccttgctggtccaaaatgcgaatccagactgtaagtccattctaaaagcattaggatcaggggctacattagaagaaatgatgaccgtacttgggagtcggccat

SEQ ID NO: 407260 - DNA, 140 bp, Artificial Sequence
  Synthetic
atggccgactcccaagtacggtcatcatttcttctaatgtagcccctgatcctaatgcttttagaatggacttacagtctggattcgcattttggaccagcaaggtttctgtcatccagtggagacccagcatggcgtat

SEQ ID NO: 407261 - DNA, 140 bp, Artificial Sequence
  Synthetic
atacgccatgctgggtctccataggcattattcctgggagaaggggcaggaatggatttggtagaccctgacctagatccctggaaccacccgggaagtcaacctaaaacgccttgtacccgtacttgggagtcggccat

SEQ ID NO: 407262 - DNA, 140 bp, Artificial Sequence
  Synthetic
atggccgactcccaagtacgggtacaaggcgttttaggttgacttcccgggtggttccagggatctaggtcagggtctaccaaatccattcctgccccttctcccaggaataatgcctatggagacccagcatggcgtat

SEQ ID NO: 407263 - DNA, 140 bp, Artificial Sequence
  Synthetic
aggccctggctgctgatatgaatcgcagaaccagcaagaaaagaatgaacaagaattattggaattagataaatgggcaagtttgtggaattggtttaacataacaaattggctgtggtagaccttttgggacagcggtg

SEQ ID NO: 407264 - DNA, 140 bp, Artificial Sequence
  Synthetic
caccgctgtcccaaaaggtctaccacagccaatttgttatgttaaaccaattccacaaacttgcccatttatctaattccaataattcttgttcattcttttcttgctggttctgcgattcatatcagcagccagggcct

SEQ ID NO: 407265 - DNA, 140 bp, Artificial Sequence
  Synthetic
aggccctggctgctgatatggagaaagagattggcatttgggtcatggagtctccatagaatggagattgagaaaatatagcacacaagtagaccctggcctggcagaccagctaattcagaccttttgggacagcggtg

SEQ ID NO: 407266 - DNA, 140 bp, Artificial Sequence
  Synthetic
caccgctgtcccaaaaggtctgaattagctggtctgccaggccagggtctacttgtgtgctatattttctcaatctccattctatggagactccatgacccaaatgccaatctctttctccatatcagcagccagggcct

SEQ ID NO: 407267 - DNA, 140 bp, Artificial Sequence
  Synthetic
atacgccatgctgggtctccgtaataatagtgattatagattaataaattgtaatacctcagccattacacaagcttgtccaaaggtaacctttgagccaattcccatacattactgtgccgtacttgggagtcggccat

SEQ ID NO: 407268 - DNA, 140 bp, Artificial Sequence
  Synthetic
atggccgactcccaagtacggcacagtaatgtatgggaattggctcaaaggttacctttggacaagcttgtgtaatggctgaggtattacaatttattaatctataatcactattattacggagacccagcatggcgtat

SEQ ID NO: 407269 - DNA, 140 bp, Artificial Sequence
  Synthetic
aggccctggctgctgatatgccagtggtatcaactcaactactgttgaatggcagtctagcaaaagaagagataataattagatctgaaaatatctcaaacaatgctaaaaccataataggaccttttgggacagcggtg

SEQ ID NO: 407270 - DNA, 140 bp, Artificial Sequence
  Synthetic
caccgctgtcccaaaaggtcctattatggttttagcattgtttgagatattttcagatctaattattatctcttcttttgctagactgccattcaacagtagttgagttgataccactggcatatcagcagccagggcct

SEQ ID NO: 407271 - DNA, 140 bp, Artificial Sequence
  Synthetic
atacgccatgctgggtctccacaagaagaagtatacatataggaccaggacaagcattctatgcagcaacaaatataataggggatataagacaagcacattgtaatgtcagtaggtcagcgtacttgggagtcggccat

SEQ ID NO: 407272 - DNA, 140 bp, Artificial Sequence
  Synthetic
atggccgactcccaagtacgctgacctactgacattacaatgtgcttgtcttatatcccctattatatttgttgctgcatagaatgcttgtcctggtcctatatgtatacttcttcttgtggagacccagcatggcgtat

SEQ ID NO: 407273 - DNA, 140 bp, Artificial Sequence
  Synthetic
atacgccatgctgggtctccacaagtggcaatataactctccaatgcagaataaagcaaattataaatatgtggcagagaacaggacaagcaatatatgcccctcccatccgaggagaaacgtacttgggagtcggccat

SEQ ID NO: 407274 - DNA, 140 bp, Artificial Sequence
  Synthetic
atggccgactcccaagtacgtttctcctcggatgggaggggcatatattgcttgtcctgttctctgccacatatttataatttgctttattctgcattggagagttatattgccacttgtggagacccagcatggcgtat

SEQ ID NO: 407275 - DNA, 140 bp, Artificial Sequence
  Synthetic
atacgccatgctgggtctccacaatgctaacgccaatagtactatagatggagaaaccatagataaagaaatgaaaaattgctctttcaatataaccacagaactaagagataagaaaaacgtacttgggagtcggccat

SEQ ID NO: 407276 - DNA, 140 bp, Artificial Sequence
  Synthetic
atggccgactcccaagtacgtttttcttatctcttagttctgtggttatattgaaagagcaatttttcatttctttatctatggtttctccatctatagtactattggcgttagcattgtggagacccagcatggcgtat

SEQ ID NO: 407277 - DNA, 140 bp, Artificial Sequence
  Synthetic
atacgccatgctgggtctccgaatacttcaatacaacaatagaatttcaacaacccgcaggaggggacttagaaattacaacacatagctttaattgtagaggagagtttttctattgcacgtacttgggagtcggccat

SEQ ID NO: 407278 - DNA, 140 bp, Artificial Sequence
  Synthetic
atggccgactcccaagtacgtgcaatagaaaaactctcctctacaattaaagctatgtgttgtaatttctaagtcccctcctgcgggttgttgaaattctattgttgtattgaagtattcggagacccagcatggcgtat

SEQ ID NO: 407279 - DNA, 140 bp, Artificial Sequence
  Synthetic
atacgccatgctgggtctccgctttggtagagctattttcaacataaattaaataaggcttcgaaagagctctgctataacatgggtggcaaatggtcaaaaagcagcaaagggggatggcgtacttgggagtcggccat

SEQ ID NO: 407280 - DNA, 140 bp, Artificial Sequence
  Synthetic
atggccgactcccaagtacgccatccccctttgctgctttttgaccatttgccacccatgttatagcagagctctttcgaagccttatttaatttatgttgaaaatagctctaccaaagcggagacccagcatggcgtat

SEQ ID NO: 407281 - DNA, 140 bp, Artificial Sequence
  Synthetic
atacgccatgctgggtctccgaggagataggctttccagtcaggccacaagtgccactaaggccaatgaattacaaagacgctgtcgatctcagccactttttaagaaaagaggggggaccgtacttgggagtcggccat

SEQ ID NO: 407282 - DNA, 140 bp, Artificial Sequence
  Synthetic
atggccgactcccaagtacggtcccccctcttttcttaaaaagtggctgagatcgacagcgtctttgtaattcattggccttagtggcacttgtggcctgactggaaagcctatctcctcggagacccagcatggcgtat

SEQ ID NO: 407283 - DNA, 140 bp, Artificial Sequence
  Synthetic
aggccctggctgctgatatgtgtaaacactgtagctaccattgtttagtttgctttcagaaaaaaggcttaggcatttcctatggcaggaagaagcggagacaacgacgcagcactcctcgaccttttgggacagcggtg

SEQ ID NO: 407284 - DNA, 140 bp, Artificial Sequence
  Synthetic
caccgctgtcccaaaaggtcgaggagtgctgcgtcgttgtctccgcttcttcctgccataggaaatgcctaagccttttttctgaaagcaaactaaacaatggtagctacagtgtttacacatatcagcagccagggcct

SEQ ID NO: 407285 - DNA, 140 bp, Artificial Sequence
  Synthetic
aggccctggctgctgatatgaatggtcaaaaagtagcatagttggatggcctgctataagagaaagaataagacgaactgagccagcagcagatggggtgggagcagtatctcgagacctgaccttttgggacagcggtg

SEQ ID NO: 407286 - DNA, 140 bp, Artificial Sequence
  Synthetic
caccgctgtcccaaaaggtcaggtctcgagatactgctcccaccccatctgctgctggctcagttcgtcttattctttctcttatagcaggccatccaactatgctactttttgaccattcatatcagcagccagggcct

SEQ ID NO: 407287 - DNA, 140 bp, Artificial Sequence
  Synthetic
aggccctggctgctgatatgtgtgtcactttacattgtagcactgttaatgctaccgctaatagcaatgctaccattaatggtactgaagaaatgaaaaactgctcttttaatgcaaccagaccttttgggacagcggtg

SEQ ID NO: 407288 - DNA, 140 bp, Artificial Sequence
  Synthetic
caccgctgtcccaaaaggtctggttgcattaaaagagcagtttttcatttcttcagtaccattaatggtagcattgctattagcggtagcattaacagtgctacaatgtaaagtgacacacatatcagcagccagggcct

SEQ ID NO: 407289 - DNA, 140 bp, Artificial Sequence
  Synthetic
atacgccatgctgggtctccaataagacattcaatgggacaggaccatgcaataatgtcagcacagtacaatgtacacatggaattaagccagtagtatcaactcaactactgttaaatgcgtacttgggagtcggccat

SEQ ID NO: 407290 - DNA, 140 bp, Artificial Sequence
  Synthetic
atggccgactcccaagtacgcatttaacagtagttgagttgatactactggcttaattccatgtgtacattgtactgtgctgacattattgcatggtcctgtcccattgaatgtcttattggagacccagcatggcgtat

SEQ ID NO: 407291 - DNA, 140 bp, Artificial Sequence
  Synthetic
aggccctggctgctgatatggtccttaagtatctaggaaatcttgtgctgtatgggggtctggaactaaaaaggggggctattaatctgcttgataccatagcaatagcagtggctgaaggaccttttgggacagcggtg

SEQ ID NO: 407292 - DNA, 140 bp, Artificial Sequence
  Synthetic
caccgctgtcccaaaaggtccttcagccactgctattgctatggtatcaagcagattaatagcccccctttttagttccagacccccatacagcacaagatttcctagatacttaaggaccatatcagcagccagggcct

SEQ ID NO: 407293 - DNA, 140 bp, Artificial Sequence
  Synthetic
aggccctggctgctgatatgcatagcagaataggcattattcgacagaggagagcaagaaatggagccagtagatcctagactagagccctggaagcatccaggaagtcagcctaagactgaccttttgggacagcggtg

SEQ ID NO: 407294 - DNA, 140 bp, Artificial Sequence
  Synthetic
caccgctgtcccaaaaggtcagtcttaggctgacttcctggatgcttccagggctctagtctaggatctactggctccatttcttgctctcctctgtcgaataatgcctattctgctatgcatatcagcagccagggcct

SEQ ID NO: 407295 - DNA, 140 bp, Artificial Sequence
  Synthetic
  misc_feature (79)..(79): n is a, c, g, or t
  misc_feature (83)..(83): n is a, c, g, or t
aggccctggctgctgatatgatttgtaatgtgggggggaacatgtgggtcacagtctattatggggtacctgtgtgganagangcaaaaactactctattttgtgcatcagatgctaaaggaccttttgggacagcggtg

SEQ ID NO: 407296 - DNA, 140 bp, Artificial Sequence
  Synthetic
  misc_feature (58)..(58): n is a, c, g, or t
  misc_feature (62)..(62): n is a, c, g, or t
caccgctgtcccaaaaggtcctttagcatctgatgcacaaaatagagtagtttttgcntctntccacacaggtaccccataatagactgtgacccacatgttcccccccacattacaaatcatatcagcagccagggcct

SEQ ID NO: 407297 - DNA, 140 bp, Artificial Sequence
  Synthetic
atacgccatgctgggtctcctaataccactagcagcagcgagaaaccgaaggggacaggggaaataaaaaactgctctttcaatatcaccacaagcataagagataaggtgcagaaacaacgtacttgggagtcggccat

SEQ ID NO: 407298 - DNA, 140 bp, Artificial Sequence
  Synthetic
atggccgactcccaagtacgttgtttctgcaccttatctcttatgcttgtggtgatattgaaagagcagttttttatttcccctgtccccttcggtttctcgctgctgctagtggtattaggagacccagcatggcgtat

SEQ ID NO: 407299 - DNA, 140 bp, Artificial Sequence
  Synthetic
aggccctggctgctgatatgtgggtcacagtctattatggggtacctgtgtggaaagaagcaactaccactttattttgtgcatcagatgctaaagcatatgacacagaggcacataatggaccttttgggacagcggtg

SEQ ID NO: 407300 - DNA, 140 bp, Artificial Sequence
  Synthetic
caccgctgtcccaaaaggtccattatgtgcctctgtgtcatatgctttagcatctgatgcacaaaataaagtggtagttgcttctttccacacaggtaccccataatagactgtgacccacatatcagcagccagggcct

SEQ ID NO: 407301 - DNA, 140 bp, Artificial Sequence
  Synthetic
aggccctggctgctgatatgcatgtgtaaaattaaccccactctgtgttactttaaattgcattgattggaagtcaaattgcactaataataatgatacccagaataatagtaataataggaccttttgggacagcggtg

SEQ ID NO: 407302 - DNA, 140 bp, Artificial Sequence
  Synthetic
caccgctgtcccaaaaggtcctattattactattattctgggtatcattattattagtgcaatttgacttccaatcaatgcaatttaaagtaacacagagtggggttaattttacacatgcatatcagcagccagggcct

SEQ ID NO: 407303 - DNA, 140 bp, Artificial Sequence
  Synthetic
atacgccatgctgggtctccgtataactatgggaccagggagagcattttatacaacagaaataataggagatataagacaagcatattgtaacattagtaaagcaaactggactgacaccgtacttgggagtcggccat

SEQ ID NO: 407304 - DNA, 140 bp, Artificial Sequence
  Synthetic
atggccgactcccaagtacggtgtcagtccagtttgctttactaatgttacaatatgcttgtcttatatctcctattatttctgttgtataaaatgctctccctggtcccatagttatacggagacccagcatggcgtat

SEQ ID NO: 407305 - DNA, 140 bp, Artificial Sequence
  Synthetic
atacgccatgctgggtctccgtagtttgggaagaatagatgcaggagaagtaaaaaactgttctttcaatgtcaccacaggcataagagataagataaagaaagaatatgcacttttctacgtacttgggagtcggccat

SEQ ID NO: 407306 - DNA, 140 bp, Artificial Sequence
  Synthetic
atggccgactcccaagtacgtagaaaagtgcatattctttctttatcttatctcttatgcctgtggtgacattgaaagaacagttttttacttctcctgcatctattcttcccaaactacggagacccagcatggcgtat

SEQ ID NO: 407307 - DNA, 140 bp, Artificial Sequence
  Synthetic
atacgccatgctgggtctcccaatgctaaaaacataatagtacagctgaatgaatctataccaattaattgtacaagaccccacaacaatacaagaagaagtatatcttttacaccagggcgtacttgggagtcggccat

SEQ ID NO: 407308 - DNA, 140 bp, Artificial Sequence
  Synthetic
atggccgactcccaagtacgccctggtgtaaaagatatacttcttcttgtattgttgtggggtcttgtacaattaattggtatagattcattcagctgtactattatgtttttagcattgggagacccagcatggcgtat

SEQ ID NO: 407309 - DNA, 140 bp, Artificial Sequence
  Synthetic
atacgccatgctgggtctccttgtaacattagtagagaaagatggaataacaccttaggaaagatagttacaaaattaagagaacaatttaggaataaaacaatagcctttaggccaccccgtacttgggagtcggccat

SEQ ID NO: 407310 - DNA, 140 bp, Artificial Sequence
  Synthetic
atggccgactcccaagtacggggtggcctaaaggctattgttttattcctaaattgttctcttaattttgtaactatctttcctaaggtgttattccatctttctctactaatgttacaaggagacccagcatggcgtat

SEQ ID NO: 407311 - DNA, 140 bp, Artificial Sequence
  Synthetic
atacgccatgctgggtctcccagtaagtagtagcacttagtatatgtaatgcttcctttgcatatctgggcaatagtaggactggtagtggcactaatcctagcagtagttgtgtggactcgtacttgggagtcggccat

SEQ ID NO: 407312 - DNA, 140 bp, Artificial Sequence
  Synthetic
atggccgactcccaagtacgagtccacacaactactgctaggattagtgccactaccagtcctactattgcccagatatgcaaaggaagcattacatatactaagtgctactacttactgggagacccagcatggcgtat

SEQ ID NO: 407313 - DNA, 140 bp, Artificial Sequence
  Synthetic
atacgccatgctgggtctccataggaggggacccagaaattgtaatgcacagctttaattgtggaggggaattcttctactgtaatacaacacagctgtttgatagtacttggctgtctacgtacttgggagtcggccat

SEQ ID NO: 407314 - DNA, 140 bp, Artificial Sequence
  Synthetic
atggccgactcccaagtacgtagacagccaagtactatcaaacagctgtgttgtattacagtagaagaattcccctccacaattaaagctgtgcattacaatttctgggtcccctcctatggagacccagcatggcgtat

SEQ ID NO: 407315 - DNA, 140 bp, Artificial Sequence
  Synthetic
atacgccatgctgggtctccgcaatgtcaacataacaggggacaacatgaatggagaaataaaaaactgctctttcaatatgaccacagaactaagggataaacaaaagaaagaatcttccgtacttgggagtcggccat

SEQ ID NO: 407316 - DNA, 140 bp, Artificial Sequence
  Synthetic
atggccgactcccaagtacggaagattctttcttttgtttatcccttagttctgtggtcatattgaaagagcagttttttatttctccattcatgttgtcccctgttatgttgacattgcggagacccagcatggcgtat

SEQ ID NO: 407317 - DNA, 140 bp, Artificial Sequence
  Synthetic
aggccctggctgctgatatgctttgctataaaatgggtggcaagtggtcagaaagtagtgtggttagaaggcatgtacctttaagacaaggcagctatagatcttagccgctttttaaaagaccttttgggacagcggtg

SEQ ID NO: 407318 - DNA, 140 bp, Artificial Sequence
  Synthetic
caccgctgtcccaaaaggtcttttaaaaagcggctaagatctatagctgccttgtcttaaaggtacatgccttctaaccacactactttctgaccacttgccacccattttatagcaaagcatatcagcagccagggcct

SEQ ID NO: 407319 - DNA, 140 bp, Artificial Sequence
  Synthetic
atacgccatgctgggtctccataggaccaggacaagcaatctatacaacaaatataataggggatataagacaagcacattgtaatgtcagtagatcagcctggaataacaccttaagaccgtacttgggagtcggccat

SEQ ID NO: 407320 - DNA, 140 bp, Artificial Sequence
  Synthetic
atggccgactcccaagtacggtcttaaggtgttattccaggctgatctactgacattacaatgtgcttgtcttatatcccctattatatttgttgtatagattgcttgtcctggtcctatggagacccagcatggcgtat

SEQ ID NO: 407321 - DNA, 140 bp, Artificial Sequence
  Synthetic
aggccctggctgctgatatgaatcagatgcatgaggatgtaatcagtttatgggatcaaagcctaaagccatgtgtaaagttgaccccactctgtgtcactttagaatgtagaaatgttagaccttttgggacagcggtg

SEQ ID NO: 407322 - DNA, 140 bp, Artificial Sequence
  Synthetic
caccgctgtcccaaaaggtctaacatttctacattctaaagtgacacagagtggggtcaactttacacatggctttaggctttgatcccataaactgattacatcctcatgcatctgattcatatcagcagccagggcct

SEQ ID NO: 407323 - DNA, 140 bp, Artificial Sequence
  Synthetic
aggccctggctgctgatatggagataaaaaattgctctttcaatgcaaccacattattaagagataggaagaagacagtgtatgcacttttttatagacttgatatagtaccccttaatggaccttttgggacagcggtg

SEQ ID NO: 407324 - DNA, 140 bp, Artificial Sequence
  Synthetic
caccgctgtcccaaaaggtccattaaggggtactatatcaagtctataaaaaagtgcatacactgtcttcttcctatctcttaataatgtggttgcattgaaagagcaattttttatctccatatcagcagccagggcct

SEQ ID NO: 407325 - DNA, 140 bp, Artificial Sequence
  Synthetic
aggccctggctgctgatatgacaagacccaacaataatacaagaaaaagtataaggataggaccaggacaaacattctatgcaacaggagacatcataggagacataagacaagcacattgaccttttgggacagcggtg

SEQ ID NO: 407326 - DNA, 140 bp, Artificial Sequence
  Synthetic
caccgctgtcccaaaaggtcaatgtgcttgtcttatgtctcctatgatgtctcctgttgcatagaatgtttgtcctggtcctatccttatactttttcttgtattattgttgggtcttgtcatatcagcagccagggcct

SEQ ID NO: 407327 - DNA, 140 bp, Artificial Sequence
  Synthetic
aggccctggctgctgatatggtattaagcgggggagaattagatagatgggaaaaaattcggttaaggccaggaggaaagaaaaaatataaattaaaacatatagtatgggcaagcaggggaccttttgggacagcggtg

SEQ ID NO: 407328 - DNA, 140 bp, Artificial Sequence
  Synthetic
caccgctgtcccaaaaggtcccctgcttgcccatactatatgttttaatttatattttttctttcctcctggccttaaccgaattttttcccatctatctaattctcccccgcttaataccatatcagcagccagggcct

SEQ ID NO: 407329 - DNA, 140 bp, Artificial Sequence
  Synthetic
atacgccatgctgggtctccgctgtgccatggaactctagttggagcagtaaaaaccagagtgagatatgggataacatgacctggctgcaatgggataaagaaattagcaattacacaacgtacttgggagtcggccat

SEQ ID NO: 407330 - DNA, 140 bp, Artificial Sequence
  Synthetic
atggccgactcccaagtacgttgtgtaattgctaatttctttatcccattgcagccaggtcatgttatcccatatctcactctggtttttactgctccaactagagttccatggcacagcggagacccagcatggcgtat

SEQ ID NO: 407331 - DNA, 140 bp, Artificial Sequence
  Synthetic
aggccctggctgctgatatgtgtagacaaatactagaacagctacaaccatcccttcagacaggatcagaagaacttagatcattatataatacagtagcaaccctctattgtgtgcatcgaccttttgggacagcggtg

SEQ ID NO: 407332 - DNA, 140 bp, Artificial Sequence
  Synthetic
caccgctgtcccaaaaggtcgatgcacacaatagagggttgctactgtattatataatgatctaagttcttctgatcctgtctgaagggatggttgtagctgttctagtatttgtctacacatatcagcagccagggcct

SEQ ID NO: 407333 - DNA, 140 bp, Artificial Sequence
  Synthetic
aggccctggctgctgatatgtcaaggggttgagactggggtgggaaggcctcaagtatctatggaatctcctgttgtattggggtcaggagttaaaaactagtgctactagtttggttgagaccttttgggacagcggtg

SEQ ID NO: 407334 - DNA, 140 bp, Artificial Sequence
  Synthetic
caccgctgtcccaaaaggtctcaaccaaactagtagcactagtttttaactcctgaccccaatacaacaggagattccatagatacttgaggccttcccaccccagtctcaaccccttgacatatcagcagccagggcct

SEQ ID NO: 407335 - DNA, 140 bp, Artificial Sequence
  Synthetic
atacgccatgctgggtctcctaccatagcaatagcagtagctggctggacagatagggttatagaaataggacaaagatttggtagagctattctcaacatacctagaagaattagacagcgtacttgggagtcggccat

SEQ ID NO: 407336 - DNA, 140 bp, Artificial Sequence
  Synthetic
atggccgactcccaagtacgctgtctaattcttctaggtatgttgagaatagctctaccaaatctttgtcctatttctataaccctatctgtccagccagctactgctattgctatggtaggagacccagcatggcgtat

SEQ ID NO: 407337 - DNA, 140 bp, Artificial Sequence
  Synthetic
aggccctggctgctgatatggacaaagatttggtagagctattctcaacatacctagaagaattagacagggtcttgaaggagcattgctataacatgggtggcaagtggtcaaaaagtagaccttttgggacagcggtg

SEQ ID NO: 407338 - DNA, 140 bp, Artificial Sequence
  Synthetic
caccgctgtcccaaaaggtctactttttgaccacttgccacccatgttatagcaatgctccttcaagaccctgtctaattcttctaggtatgttgagaatagctctaccaaatctttgtccatatcagcagccagggcct

SEQ ID NO: 407339 - DNA, 140 bp, Artificial Sequence
  Synthetic
aggccctggctgctgatatggaatcgaagaaggaggtggcgagcaaggcagagacagatccgtgcgattagtgagcggattcttagcacttgcctgggacgatctacggagcctgtgcctgaccttttgggacagcggtg

SEQ ID NO: 407340 - DNA, 140 bp, Artificial Sequence
  Synthetic
caccgctgtcccaaaaggtcaggcacaggctccgtagatcgtcccaggcaagtgctaagaatccgctcactaatcgcacggatctgtctctgccttgctcgccacctccttcttcgattccatatcagcagccagggcct

SEQ ID NO: 407341 - DNA, 140 bp, Artificial Sequence
  Synthetic
aggccctggctgctgatatgagcagatccattcgattagtgagcggattcttgacacttgcctgggacgacctacgaagcctgtgcctcttctgctaccaccgattgagagacttcatatgaccttttgggacagcggtg

SEQ ID NO: 407342 - DNA, 140 bp, Artificial Sequence
  Synthetic
caccgctgtcccaaaaggtcatatgaagtctctcaatcggtggtagcagaagaggcacaggcttcgtaggtcgtcccaggcaagtgtcaagaatccgctcactaatcgaatggatctgctcatatcagcagccagggcct

SEQ ID NO: 407343 - DNA, 140 bp, Artificial Sequence
  Synthetic
aggccctggctgctgatatgttgcagcgaggactgtggaacttctgggacacagcagtctcaaggggctgagacaggggtgggagggcctcaagtatctggggaacactctgctatattggaccttttgggacagcggtg

SEQ ID NO: 407344 - DNA, 140 bp, Artificial Sequence
  Synthetic
caccgctgtcccaaaaggtccaatatagcagagtgttccccagatacttgaggccctcccacccctgtctcagccccttgagactgctgtgtcccagaagttccacagtcctcgctgcaacatatcagcagccagggcct

SEQ ID NO: 407345 - DNA, 140 bp, Artificial Sequence
  Synthetic
atacgccatgctgggtctccgctactactagccccactgagagcacaggtgaagaagtaaaaaattgctcttttaatgcaaccacagaaataagggataagaaacagaaagcgtatgcaccgtacttgggagtcggccat

SEQ ID NO: 407346 - DNA, 140 bp, Artificial Sequence
  Synthetic
atggccgactcccaagtacggtgcatacgctttctgtttcttatcccttatttctgtggttgcattaaaagagcaattttttacttcttcacctgtgctctcagtggggctagtagtagcggagacccagcatggcgtat

SEQ ID NO: 407347 - DNA, 140 bp, Artificial Sequence
  Synthetic
aggccctggctgctgatatgaccaaagcactaacagaagtagtaccactaacagaagaagcagagctagaactggcagaaaacagggagattctaaaagaaccagtacatggagtgtattgaccttttgggacagcggtg

SEQ ID NO: 407348 - DNA, 140 bp, Artificial Sequence
  Synthetic
caccgctgtcccaaaaggtcaatacactccatgtactggttcttttagaatctccctgttttctgccagttctagctctgcttcttctgttagtggtactacttctgttagtgctttggtcatatcagcagccagggcct

SEQ ID NO: 407349 - DNA, 140 bp, Artificial Sequence
  Synthetic
aggccctggctgctgatatggaagtgacatagcaggaactactagtacccttcaagaacaaataggatggatgacaaacaatccacctatcccagtgggagacatctataaaagatggatgaccttttgggacagcggtg

SEQ ID NO: 407350 - DNA, 140 bp, Artificial Sequence
  Synthetic
caccgctgtcccaaaaggtcatccatcttttatagatgtctcccactgggataggtggattgtttgtcatccatcctatttgttcttgaagggtactagtagttcctgctatgtcacttccatatcagcagccagggcct

SEQ ID NO: 407351 - DNA, 140 bp, Artificial Sequence
  Synthetic
aggccctggctgctgatatgcaaaaccagcaggaaagaaatgaaaaagatttattagcattggacagttggaaaaatctatggagttggtttgacataacaaattggctgtggtatataagaccttttgggacagcggtg

SEQ ID NO: 407352 - DNA, 140 bp, Artificial Sequence
  Synthetic
caccgctgtcccaaaaggtcttatataccacagccaatttgttatgtcaaaccaactccatagatttttccaactgtccaatgctaataaatctttttcatttctttcctgctggttttgcatatcagcagccagggcct

SEQ ID NO: 407353 - DNA, 140 bp, Artificial Sequence
  Synthetic
aggccctggctgctgatatgaaattagtaattacacagacacaatatacaggttgcttgaagaatcgcaaagccagcaggagaaaaatgaaaaagatttattagcattggacagctggaagaccttttgggacagcggtg

SEQ ID NO: 407354 - DNA, 140 bp, Artificial Sequence
  Synthetic
caccgctgtcccaaaaggtcttccagctgtccaatgctaataaatctttttcatttttctcctgctggctttgcgattcttcaagcaacctgtatattgtgtctgtgtaattactaatttcatatcagcagccagggcct

SEQ ID NO: 407355 - DNA, 140 bp, Artificial Sequence
  Synthetic
aggccctggctgctgatatgtcgaagaagaaggtggagagcaagacaaaaccagctccattcgattagtgaacggattcttagcgcttgcctgggacgacctacggaacctgtgcctcttgaccttttgggacagcggtg

SEQ ID NO: 407356 - DNA, 140 bp, Artificial Sequence
  Synthetic
caccgctgtcccaaaaggtcaagaggcacaggttccgtaggtcgtcccaggcaagcgctaagaatccgttcactaatcgaatggagctggttttgtcttgctctccaccttcttcttcgacatatcagcagccagggcct

SEQ ID NO: 407357 - DNA, 140 bp, Artificial Sequence
  Synthetic
aggccctggctgctgatatgtaaattagtcagcaatggaatcaggaaggtactatttttagatggaatagataaggctcaagaagaacatgaaaaatatcacagtaattggagagcaatggaccttttgggacagcggtg

SEQ ID NO: 407358 - DNA, 140 bp, Artificial Sequence
  Synthetic
caccgctgtcccaaaaggtccattgctctccaattactgtgatatttttcatgttcttcttgagccttatctattccatctaaaaatagtaccttcctgattccattgctgactaatttacatatcagcagccagggcct

SEQ ID NO: 407359 - DNA, 140 bp, Artificial Sequence
  Synthetic
atacgccatgctgggtctccgcagtaccaatagtagcagcttggaacaggggaaggcaggggaaataaaaaactgctctttcaatatcaccacaaatatgagagataaggtgcagaaacacgtacttgggagtcggccat

SEQ ID NO: 407360 - DNA, 140 bp, Artificial Sequence
  Synthetic
atggccgactcccaagtacgtgtttctgcaccttatctctcatatttgtggtgatattgaaagagcagttttttatttcccctgccttcccctgttccaagctgctactattggtactgcggagacccagcatggcgtat

SEQ ID NO: 407361 - DNA, 140 bp, Artificial Sequence
  Synthetic
aggccctggctgctgatatgatgataccagctataggttaataagttgtaacacctcagtcattacacaggcctgtccaaagatatcctttgagccaattcccatacattattgtgccccgaccttttgggacagcggtg

SEQ ID NO: 407362 - DNA, 140 bp, Artificial Sequence
  Synthetic
caccgctgtcccaaaaggtcggggcacaataatgtatgggaattggctcaaaggatatctttggacaggcctgtgtaatgactgaggtgttacaacttattaacctatagctggtatcatcatatcagcagccagggcct

SEQ ID NO: 407363 - DNA, 140 bp, Artificial Sequence
  Synthetic
aggccctggctgctgatatgggatgacaggtaacccacctattccagtgggagaaatctataaaagatggataattctggggttaaataaaatagtaagaatgtatagccctgtcagcatgaccttttgggacagcggtg

SEQ ID NO: 407364 - DNA, 140 bp, Artificial Sequence
  Synthetic
caccgctgtcccaaaaggtcatgctgacagggctatacattcttactattttatttaaccccagaattatccatcttttatagatttctcccactggaataggtgggttacctgtcatcccatatcagcagccagggcct

SEQ ID NO: 407365 - DNA, 140 bp, Artificial Sequence
  Synthetic
atacgccatgctgggtctccaaccagcaccctgaaggaagagccaggggcaatactaaactgttcctttaatatgaccacagcagtaagagataagcagctgacagtacatgcactttttcgtacttgggagtcggccat

SEQ ID NO: 407366 - DNA, 140 bp, Artificial Sequence
  Synthetic
atggccgactcccaagtacgaaaaagtgcatgtactgtcagctgcttatctcttactgctgtggtcatattaaaggaacagtttagtattgcccctggctcttccttcagggtgctggttggagacccagcatggcgtat

SEQ ID NO: 407367 - DNA, 140 bp, Artificial Sequence
  Synthetic
atacgccatgctgggtctccacttgaccaatggcaataacataaccgaagaagtaagatcctgttatattaatatgaccctagaacatcaaaataagaagcagaaggctcatgcactttacgtacttgggagtcggccat

SEQ ID NO: 407368 - DNA, 140 bp, Artificial Sequence
  Synthetic
atggccgactcccaagtacgtaaagtgcatgagccttctgcttcttattttgatgttctagggtcatattaatataacaggatcttacttcttcggttatgttattgccattggtcaagtggagacccagcatggcgtat

SEQ ID NO: 407369 - DNA, 140 bp, Artificial Sequence
  Synthetic
atacgccatgctgggtctcctcaatgcaacgaatgccaacataacgaatgctacagacttagtgaagacagaagaaataaaaaactgctctttcaatatgaccacagaaataagggataacgtacttgggagtcggccat

SEQ ID NO: 407370 - DNA, 140 bp, Artificial Sequence
  Synthetic
atggccgactcccaagtacgttatcccttatttctgtggtcatattgaaagagcagttttttatttcttctgtcttcactaagtctgtagcattcgttatgttggcattcgttgcattgaggagacccagcatggcgtat

SEQ ID NO: 407371 - DNA, 140 bp, Artificial Sequence
  Synthetic
aggccctggctgctgatatgggaccaggacaagtattctatagaacaggagacataacaggagatataagaaaagcatattgtgagattaatggaacaaaatggaataaagttttaaaacgaccttttgggacagcggtg

SEQ ID NO: 407372 - DNA, 140 bp, Artificial Sequence
  Synthetic
caccgctgtcccaaaaggtcgttttaaaactttattccattttgttccattaatctcacaatatgcttttcttatatctcctgttatgtctcctgttctatagaatacttgtcctggtcccatatcagcagccagggcct

SEQ ID NO: 407373 - DNA, 140 bp, Artificial Sequence
  Synthetic
aggccctggctgctgatatgaggagaaagagaggagcagttaggacatggagttagtatagaatggcagtgcaggaagtatataacacagattgaccctgaaacagcagacaagctaatagaccttttgggacagcggtg

SEQ ID NO: 407374 - DNA, 140 bp, Artificial Sequence
  Synthetic
caccgctgtcccaaaaggtctattagcttgtctgctgtttcagggtcaatctgtgttatatacttcctgcactgccattctatactaactccatgtcctaactgctcctctctttctcctcatatcagcagccagggcct

SEQ ID NO: 407375 - DNA, 140 bp, Artificial Sequence
  Synthetic
atacgccatgctgggtctccatagagctattctccacatacctagaagaataagacagggcttagaaagggctttgctgtaaaatgaggtcttagccactttttaaaagaaaaggggggacgtacttgggagtcggccat

SEQ ID NO: 407376 - DNA, 140 bp, Artificial Sequence
  Synthetic
atggccgactcccaagtacgtccccccttttcttttaaaaagtggctaagacctcattttacagcaaagccctttctaagccctgtcttattcttctaggtatgtggagaatagctctatggagacccagcatggcgtat

SEQ ID NO: 407377 - DNA, 140 bp, Artificial Sequence
  Synthetic
atacgccatgctgggtctccatggcactatcatacttccatgcaagataaagcaaattataaacatgtggcagggagcaggacaagcaatgtatgctcctcccatcaggggaagaattagcgtacttgggagtcggccat

SEQ ID NO: 407378 - DNA, 140 bp, Artificial Sequence
  Synthetic
atggccgactcccaagtacgctaattcttcccctgatgggaggagcatacattgcttgtcctgctccctgccacatgtttataatttgctttatcttgcatggaagtatgatagtgccatggagacccagcatggcgtat

SEQ ID NO: 407379 - DNA, 140 bp, Artificial Sequence
  Synthetic
atacgccatgctgggtctccaaacactggaacaacaaaacaataatctttaatagctcctcaggaggggatatagaaattacaacacatagttttaattgtggaggagagtttttctattcgtacttgggagtcggccat

SEQ ID NO: 407380 - DNA, 140 bp, Artificial Sequence
  Synthetic
atggccgactcccaagtacgaatagaaaaactctcctccacaattaaaactatgtgttgtaatttctatatcccctcctgaggagctattaaagattattgttttgttgttccagtgtttggagacccagcatggcgtat

SEQ ID NO: 407381 - DNA, 140 bp, Artificial Sequence
  Synthetic
aggccctggctgctgatatggattaggagtaggagcattgatagtagcactaatcatagcaatagttgtgtggaccatagtatatatagaatataggaaattgttaagacaaagaaaaatgaccttttgggacagcggtg

SEQ ID NO: 407382 - DNA, 140 bp, Artificial Sequence
  Synthetic
caccgctgtcccaaaaggtcatttttctttgtcttaacaatttcctatattctatatatactatggtccacacaactattgctatgattagtgctactatcaatgctcctactcctaatccatatcagcagccagggcct

SEQ ID NO: 407383 - DNA, 140 bp, Artificial Sequence
  Synthetic
atacgccatgctgggtctccgtggcgcccgaacagggacgtgaaagcgaaagtagaaccagagaagctctctcgacgcgaggactcggcttgctgaagcgcgcacagcaagaggcgagggcgtacttgggagtcggccat

SEQ ID NO: 407384 - DNA, 140 bp, Artificial Sequence
  Synthetic
atggccgactcccaagtacgccctcgcctcttgctgtgcgcgcttcagcaagccgagtcctcgcgtcgagagagcttctctggttctactttcgctttcacgtccctgttcgggcgccacggagacccagcatggcgtat

SEQ ID NO: 407385 - DNA, 140 bp, Artificial Sequence
  Synthetic
aggccctggctgctgatatgcacggtctggggcattaaacagctccaggcaagagtcctggctgtggaaagatacctaagggatcaacagctcctaggaatttggggctgctctggaaaagaccttttgggacagcggtg

SEQ ID NO: 407386 - DNA, 140 bp, Artificial Sequence
  Synthetic
caccgctgtcccaaaaggtcttttccagagcagccccaaattcctaggagctgttgatcccttaggtatctttccacagccaggactcttgcctggagctgtttaatgccccagaccgtgcatatcagcagccagggcct

SEQ ID NO: 407387 - DNA, 140 bp, Artificial Sequence
  Synthetic
atacgccatgctgggtctccgtactacccataataatgctacctataatgataccatagctggagaaatgaaaaattgctctttcaatgtaaccacagaactaagagataggaaaaagaacgtacttgggagtcggccat

SEQ ID NO: 407388 - DNA, 140 bp, Artificial Sequence
  Synthetic
atggccgactcccaagtacgttctttttcctatctcttagttctgtggttacattgaaagagcaatttttcatttctccagctatggtatcattataggtagcattattatgggtagtacggagacccagcatggcgtat

SEQ ID NO: 407389 - DNA, 140 bp, Artificial Sequence
  Synthetic
aggccctggctgctgatatgcatcccttcagacaggatcagaagaacttagatcattatataatacaatagcaaccctctattgtgtgcatcaaaggatagatgtaaaagacaccaaggagaccttttgggacagcggtg

SEQ ID NO: 407390 - DNA, 140 bp, Artificial Sequence
  Synthetic
caccgctgtcccaaaaggtctccttggtgtcttttacatctatcctttgatgcacacaatagagggttgctattgtattatataatgatctaagttcttctgatcctgtctgaagggatgcatatcagcagccagggcct

SEQ ID NO: 407391 - DNA, 140 bp, Artificial Sequence
  Synthetic
aggccctggctgctgatatgtcaatgggacaggaccatgcaataatgtcagcacagtacaatgtacacatggaattaagccagtggtatcaactcaactactgttaaatggtagcctagcgaccttttgggacagcggtg

SEQ ID NO: 407392 - DNA, 140 bp, Artificial Sequence
  Synthetic
caccgctgtcccaaaaggtcgctaggctaccatttaacagtagttgagttgataccactggcttaattccatgtgtacattgtactgtgctgacattattgcatggtcctgtcccattgacatatcagcagccagggcct

SEQ ID NO: 407393 - DNA, 140 bp, Artificial Sequence
  Synthetic
atacgccatgctgggtctccggcaataatacaataaaaaggataagaataggaccaagatacgcattctatgcaaaagaaactataataggagacataagacaagcacattgtaacattacgtacttgggagtcggccat

SEQ ID NO: 407394 - DNA, 140 bp, Artificial Sequence
  Synthetic
atggccgactcccaagtacgtaatgttacaatgtgcttgtcttatgtctcctattatagtttcttttgcatagaatgcgtatcttggtcctattcttatcctttttattgtattattgccggagacccagcatggcgtat

SEQ ID NO: 407395 - DNA, 140 bp, Artificial Sequence
  Synthetic
aggccctggctgctgatatgatcatagcaataattgtgtggaccatagtatatatagaatataggaaattagtaaaacaaagaaaaatagactggttaattgaaagaattagggaaagaggaccttttgggacagcggtg

SEQ ID NO: 407396 - DNA, 140 bp, Artificial Sequence
  Synthetic
caccgctgtcccaaaaggtcctctttccctaattctttcaattaaccagtctatttttctttgttttactaatttcctatattctatatatactatggtccacacaattattgctatgatcatatcagcagccagggcct

SEQ ID NO: 407397 - DNA, 140 bp, Artificial Sequence
  Synthetic
aggccctggctgctgatatgagccccagaagaccaagggccacagagggaaccatacaatgaatggacactagagcttttagaagaacttaagagagaagctgttaggcattttcctagggaccttttgggacagcggtg

SEQ ID NO: 407398 - DNA, 140 bp, Artificial Sequence
  Synthetic
caccgctgtcccaaaaggtccctaggaaaatgcctaacagcttctctcttaagttcttctaaaagctctagtgtccattcattgtatggttccctctgtggcccttggtcttctggggctcatatcagcagccagggcct

SEQ ID NO: 407399 - DNA, 140 bp, Artificial Sequence
  Synthetic
aggccctggctgctgatatgtggaatggcctgaggttagggaaagaatgagacaagctcctgcagcagcaaaaggagtaggagcagtatctcaagatttagaaaaacatggagcaatcacgaccttttgggacagcggtg

SEQ ID NO: 407400 - DNA, 140 bp, Artificial Sequence
  Synthetic
caccgctgtcccaaaaggtcgtgattgctccatgtttttctaaatcttgagatactgctcctactccttttgctgctgcaggagcttgtctcattctttccctaacctcaggccattccacatatcagcagccagggcct

SEQ ID NO: 407401 - DNA, 140 bp, Artificial Sequence
  Synthetic
aggccctggctgctgatatgaaaggagtaggagcagtatctcaagatttagaaaaacatggagcaatcacaagcagtaatataaatcatcctagctgcgtctggctggacgcgcaagaaggaccttttgggacagcggtg

SEQ ID NO: 407402 - DNA, 140 bp, Artificial Sequence
  Synthetic
caccgctgtcccaaaaggtccttcttgcgcgtccagccagacgcagctaggatgatttatattactgcttgtgattgctccatgtttttctaaatcttgagatactgctcctactcctttcatatcagcagccagggcct

SEQ ID NO: 407403 - DNA, 140 bp, Artificial Sequence
  Synthetic
aggccctggctgctgatatgtggcaaagaaggacacatagccaaaaattgcagggcccctagaaaaaagggctgttggaaatgtggaaaggaaggacaccaaatgaaagattgtaatgaggaccttttgggacagcggtg

SEQ ID NO: 407404 - DNA, 140 bp, Artificial Sequence
  Synthetic
caccgctgtcccaaaaggtcctcattacaatctttcatttggtgtccttcctttccacatttccaacagcccttttttctaggggccctgcaatttttggctatgtgtccttctttgccacatatcagcagccagggcct

SEQ ID NO: 407405 - DNA, 140 bp, Artificial Sequence
  Synthetic
aggccctggctgctgatatgtcctgcaatattggattcaggaactaaagaatagtgctattaacttgtttgataccgtagcaatagcagtagctggggggacagatagggctatagaaatgaccttttgggacagcggtg

SEQ ID NO: 407406 - DNA, 140 bp, Artificial Sequence
  Synthetic
caccgctgtcccaaaaggtcatttctatagccctatctgtccccccagctactgctattgctacggtatcaaacaagttaatagcactattctttagttcctgaatccaatattgcaggacatatcagcagccagggcct

SEQ ID NO: 407407 - DNA, 140 bp, Artificial Sequence
  Synthetic
aggccctggctgctgatatgcaaggctttgaagtagctttgcaataaaatggggggcaagtggtcaaaaagcagtatagttggatggcctgctataagacaggctatgagacgtactgatgaccttttgggacagcggtg

SEQ ID NO: 407408 - DNA, 140 bp, Artificial Sequence
  Synthetic
caccgctgtcccaaaaggtcatcagtacgtctcatagcctgtcttatagcaggccatccaactatactgctttttgaccacttgccccccattttattgcaaagctacttcaaagccttgcatatcagcagccagggcct

SEQ ID NO: 407409 - DNA, 140 bp, Artificial Sequence
  Synthetic
aggccctggctgctgatatgccatgtgtaaagttgaccccactctgtgtcactttaaattgtacaattgttaaggctaccaatgctaccaatgctaacaagactaccagtaataacaagagaccttttgggacagcggtg

SEQ ID NO: 407410 - DNA, 140 bp, Artificial Sequence
  Synthetic
caccgctgtcccaaaaggtctcttgttattactggtagtcttgttagcattggtagcattggtagccttaacaattgtacaatttaaagtgacacagagtggggtcaactttacacatggcatatcagcagccagggcct

SEQ ID NO: 407411 - DNA, 140 bp, Artificial Sequence
  Synthetic
atacgccatgctgggtctccctacggtcaataatgatagtagtactaatgaagtaaaaaattgctctttcaatgcaaccacagaactgagagataagaaaaagaaagagtttgcacttttcgtacttgggagtcggccat

SEQ ID NO: 407412 - DNA, 140 bp, Artificial Sequence
  Synthetic
atggccgactcccaagtacgaaaagtgcaaactctttctttttcttatctctcagttctgtggttgcattgaaagagcaattttttacttcattagtactactatcattattgaccgtagggagacccagcatggcgtat

SEQ ID NO: 407413 - DNA, 140 bp, Artificial Sequence
  Synthetic
aggccctggctgctgatatgccttagcctccctcaaatcactctttggcaacgacccctcgtcacagtaaaaatagggggacagcaaagggaagctctattagatacaggagcagatgatgaccttttgggacagcggtg

SEQ ID NO: 407414 - DNA, 140 bp, Artificial Sequence
  Synthetic
caccgctgtcccaaaaggtcatcatctgctcctgtatctaatagagcttccctttgctgtccccctatttttactgtgacgaggggtcgttgccaaagagtgatttgagggaggctaaggcatatcagcagccagggcct

SEQ ID NO: 407415 - DNA, 140 bp, Artificial Sequence
  Synthetic
aggccctggctgctgatatgaaaacaataatatttacaaattcctcaggaggggacctagaaattacaacacatagctttaattgtagaggagaatttttctattgcaatacatcaagacgaccttttgggacagcggtg

SEQ ID NO: 407416 - DNA, 140 bp, Artificial Sequence
  Synthetic
caccgctgtcccaaaaggtcgtcttgatgtattgcaatagaaaaattctcctctacaattaaagctatgtgttgtaatttctaggtcccctcctgaggaatttgtaaatattattgttttcatatcagcagccagggcct

SEQ ID NO: 407417 - DNA, 140 bp, Artificial Sequence
  Synthetic
aggccctggctgctgatatgcgctgatgcatcatcaaggcctgctagtattaatagtcattattgctttgcttcttataaatgtacttctatagatgtttaaacttagaacatatttagagaccttttgggacagcggtg

SEQ ID NO: 407418 - DNA, 140 bp, Artificial Sequence
  Synthetic
caccgctgtcccaaaaggtctctaaatatgttctaagtttaaacatctatagaagtacatttataagaagcaaagcaataatgactattaatactagcaggccttgatgatgcatcagcgcatatcagcagccagggcct

SEQ ID NO: 407419 - DNA, 140 bp, Artificial Sequence
  Synthetic
atacgccatgctgggtctcctaacacaagaaaaagtataaggataggacccggacaaacattttatgcaacaaacggaataataggagaaataagacaagcacattgtaacattagtaaacgtacttgggagtcggccat

SEQ ID NO: 407420 - DNA, 140 bp, Artificial Sequence
  Synthetic
atggccgactcccaagtacgtttactaatgttacaatgtgcttgtcttatttctcctattattccgtttgttgcataaaatgtttgtccgggtcctatccttatactttttcttgtgttaggagacccagcatggcgtat

SEQ ID NO: 407421 - DNA, 140 bp, Artificial Sequence
  Synthetic
atacgccatgctgggtctcctgaagaatgagactaataccaatagtagtagtggaggggaaaagatggaggagggagaaatgaaaaactgctctttcaatgtcaccacactcataagaaacgtacttgggagtcggccat

SEQ ID NO: 407422 - DNA, 140 bp, Artificial Sequence
  Synthetic
atggccgactcccaagtacgtttcttatgagtgtggtgacattgaaagagcagtttttcatttctccctcctccatcttttcccctccactactactattggtattagtctcattcttcaggagacccagcatggcgtat

SEQ ID NO: 407423 - DNA, 140 bp, Artificial Sequence
  Synthetic
aggccctggctgctgatatgaacaatacaagaaaaaagataactttaggaccagggagagtactttatacaacaggagaaataataggagatataagacgagcacattgtaaccttagtagaccttttgggacagcggtg

SEQ ID NO: 407424 - DNA, 140 bp, Artificial Sequence
  Synthetic
caccgctgtcccaaaaggtctactaaggttacaatgtgctcgtcttatatctcctattatttctcctgttgtataaagtactctccctggtcctaaagttatcttttttcttgtattgttcatatcagcagccagggcct

SEQ ID NO: 407425 - DNA, 140 bp, Artificial Sequence
  Synthetic
atacgccatgctgggtctccgatggcctcaggtcagggaaagaataaggcaaactcctccagcagcagaaggagtaggagcagtatctcaagatctagataaacatggagcagtaacaagcgtacttgggagtcggccat

SEQ ID NO: 407426 - DNA, 140 bp, Artificial Sequence
  Synthetic
atggccgactcccaagtacgcttgttactgctccatgtttatctagatcttgagatactgctcctactccttctgctgctggaggagtttgccttattctttccctgacctgaggccatcggagacccagcatggcgtat

SEQ ID NO: 407427 - DNA, 140 bp, Artificial Sequence
  Synthetic
aggccctggctgctgatatgaataagaaaacagaaaaagatagaacagttacttgagaaaatagcagcaagagcagaagacagtggtaatgagagtgagggagatacagaggaattatccgaccttttgggacagcggtg

SEQ ID NO: 407428 - DNA, 140 bp, Artificial Sequence
  Synthetic
caccgctgtcccaaaaggtcggataattcctctgtatctccctcactctcattaccactgtcttctgctcttgctgctattttctcaagtaactgttctatctttttctgttttcttattcatatcagcagccagggcct

SEQ ID NO: 407429 - DNA, 140 bp, Artificial Sequence
  Synthetic
atacgccatgctgggtctccacgatggagaaaggagaaataaaaaactgctctttcaatatcaccacaaacataagagataagatacagaaagaatatgcattgtttaatagacttgatgcgtacttgggagtcggccat

SEQ ID NO: 407430 - DNA, 140 bp, Artificial Sequence
  Synthetic
atggccgactcccaagtacgcatcaagtctattaaacaatgcatattctttctgtatcttatctcttatgtttgtggtgatattgaaagagcagttttttatttctcctttctccatcgtggagacccagcatggcgtat

SEQ ID NO: 407431 - DNA, 140 bp, Artificial Sequence
  Synthetic
  misc_feature (67)..(67): n is a, c, g, or t
  misc_feature (69)..(69): n is a, c, g, or t
atacgccatgctgggtctcccagtaagtagtagcaattagtatagtatatgtaatgcttcctccttngnatatctgggcaatagcaggactggtagtggcactaatcctagcaatagttgcgtacttgggagtcggccat

SEQ ID NO: 407432 - DNA, 140 bp, Artificial Sequence
  Synthetic
  misc_feature (72)..(72): n is a, c, g, or t
  misc_feature (74)..(74): n is a, c, g, or t
atggccgactcccaagtacgcaactattgctaggattagtgccactaccagtcctgctattgcccagatatncnaaggaggaagcattacatatactatactaattgctactacttactgggagacccagcatggcgtat

SEQ ID NO: 407433 - DNA, 140 bp, Artificial Sequence
  Synthetic
aggccctggctgctgatatgttaacaattacacaggcttaatatacaacttaattgaagaatcgcagaaccaacaagaaaaaaatgagcaagaattattggaattggataaatgggcaaggaccttttgggacagcggtg

SEQ ID NO: 407434 - DNA, 140 bp, Artificial Sequence
  Synthetic
caccgctgtcccaaaaggtccttgcccatttatccaattccaataattcttgctcatttttttcttgttggttctgcgattcttcaattaagttgtatattaagcctgtgtaattgttaacatatcagcagccagggcct

SEQ ID NO: 407435 - DNA, 140 bp, Artificial Sequence
  Synthetic
aggccctggctgctgatatgaggagggggcccagaaattgtaatgcacagttttaattgtggaggagaatttttctactgtaatacaactagactgttcaatagtacttggaatgttagtgaccttttgggacagcggtg

SEQ ID NO: 407436 - DNA, 140 bp, Artificial Sequence
  Synthetic
caccgctgtcccaaaaggtcactaacattccaagtactattgaacagtctagttgtattacagtagaaaaattctcctccacaattaaaactgtgcattacaatttctgggccccctcctcatatcagcagccagggcct

SEQ ID NO: 407437 - DNA, 140 bp, Artificial Sequence
  Synthetic
aggccctggctgctgatatgtttttcagaatctgccataaggaaagccatattaggacatagagttagccctaggtgtaactatcaagcaggacataacaaggtaggatctctacaatatgaccttttgggacagcggtg

SEQ ID NO: 407438 - DNA, 140 bp, Artificial Sequence
  Synthetic
caccgctgtcccaaaaggtcatattgtagagatcctaccttgttatgtcctgcttgatagttacacctagggctaactctatgtcctaatatggctttccttatggcagattctgaaaaacatatcagcagccagggcct

SEQ ID NO: 407439 - DNA, 140 bp, Artificial Sequence
  Synthetic
atacgccatgctgggtctccaacgaacaatacaggagtaaaaccaggagaagtaaaaaactgcactttcaatatgaccacagaaataagggataaaaaacagaaagtatattcactttttcgtacttgggagtcggccat

SEQ ID NO: 407440 - DNA, 140 bp, Artificial Sequence
  Synthetic
atggccgactcccaagtacgaaaaagtgaatatactttctgttttttatcccttatttctgtggtcatattgaaagtgcagttttttacttctcctggttttactcctgtattgttcgttggagacccagcatggcgtat

SEQ ID NO: 407441 - DNA, 140 bp, Artificial Sequence
  Synthetic
aggccctggctgctgatatggaaggaaaaattacaaaaattgggcctgaaaatccatataacactccaatatttgccataaaaaagaaggacagtactaagtggagaaaattagtagattgaccttttgggacagcggtg

SEQ ID NO: 407442 - DNA, 140 bp, Artificial Sequence
  Synthetic
caccgctgtcccaaaaggtcaatctactaattttctccacttagtactgtccttcttttttatggcaaatattggagtgttatatggattttcaggcccaatttttgtaatttttccttccatatcagcagccagggcct

SEQ ID NO: 407443 - DNA, 140 bp, Artificial Sequence
  Synthetic
atacgccatgctgggtctccaagtagcaatgagaataatgctgattgcgtctggttaaaagcacaagaggatgaggaggtgggttttccagttagacctcaggtacctttaagaccaatgcgtacttgggagtcggccat

SEQ ID NO: 407444 - DNA, 140 bp, Artificial Sequence
  Synthetic
atggccgactcccaagtacgcattggtcttaaaggtacctgaggtctaactggaaaacccacctcctcatcctcttgtgcttttaaccagacgcaatcagcattattctcattgctacttggagacccagcatggcgtat

SEQ ID NO: 407445 - DNA, 140 bp, Artificial Sequence
  Synthetic
aggccctggctgctgatatgatgaggaggtgggttttccagttagacctcaggtacctttaagaccaatgacttacaaggcagcgcatgatcttagcccctttttaaaagaaaagggggggaccttttgggacagcggtg

SEQ ID NO: 407446 - DNA, 140 bp, Artificial Sequence
  Synthetic
caccgctgtcccaaaaggtcccccccttttcttttaaaaaggggctaagatcatgcgctgccttgtaagtcattggtcttaaaggtacctgaggtctaactggaaaacccacctcctcatcatatcagcagccagggcct

SEQ ID NO: 407447 - DNA, 140 bp, Artificial Sequence
  Synthetic
atacgccatgctgggtctcccagatggtaatataactctcccatgcagaataaagcaaattgtaagaatgtggcagagaacaggacaagcaatgtatgctcctcccattcaaggaagcatcgtacttgggagtcggccat

SEQ ID NO: 407448 - DNA, 140 bp, Artificial Sequence
  Synthetic
atggccgactcccaagtacgatgcttccttgaatgggaggagcatacattgcttgtcctgttctctgccacattcttacaatttgctttattctgcatgggagagttatattaccatctgggagacccagcatggcgtat

SEQ ID NO: 407449 - DNA, 140 bp, Artificial Sequence
  Synthetic
aggccctggctgctgatatgaaaagaaccagtacatggagtatattatgacccatcaaaagacttaatagctgaaatacagaaacaggggcatgaccaatggacatatcaaatttaccaagaccttttgggacagcggtg

SEQ ID NO: 407450 - DNA, 140 bp, Artificial Sequence
  Synthetic
caccgctgtcccaaaaggtcttggtaaatttgatatgtccattggtcatgcccctgtttctgtatttcagctattaagtcttttgatgggtcataatatactccatgtactggttcttttcatatcagcagccagggcct

SEQ ID NO: 407451 - DNA, 140 bp, Artificial Sequence
  Synthetic
aggccctggctgctgatatgcctgtgcctcttcagctaccaccgcttgagagacttactcttgcttgcagcgaggattgtggaacttctgggacgcagggggtgggaaatcctcaaatatgaccttttgggacagcggtg

SEQ ID NO: 407452 - DNA, 140 bp, Artificial Sequence
  Synthetic
caccgctgtcccaaaaggtcatatttgaggatttcccaccccctgcgtcccagaagttccacaatcctcgctgcaagcaagagtaagtctctcaagcggtggtagctgaagaggcacaggcatatcagcagccagggcct

SEQ ID NO: 407453 - DNA, 140 bp, Artificial Sequence
  Synthetic
aggccctggctgctgatatgatggggatacagaggaattgtcaacaatggtggatatggggcatcttaggcttttggatgatatatagtgggatggggcaattgtgggtcacagtctattgaccttttgggacagcggtg

SEQ ID NO: 407454 - DNA, 140 bp, Artificial Sequence
  Synthetic
caccgctgtcccaaaaggtcaatagactgtgacccacaattgccccatcccactatatatcatccaaaagcctaagatgccccatatccaccattgttgacaattcctctgtatccccatcatatcagcagccagggcct

SEQ ID NO: 407455 - DNA, 140 bp, Artificial Sequence
  Synthetic
aggccctggctgctgatatggagctatccttcacatacccagaagaataagacagggcttagaaagggctttgctataagatgggtggcaagtggtcaaaacgtagtgtgggtggatggcgaccttttgggacagcggtg

SEQ ID NO: 407456 - DNA, 140 bp, Artificial Sequence
  Synthetic
caccgctgtcccaaaaggtcgccatccacccacactacgttttgaccacttgccacccatcttatagcaaagccctttctaagccctgtcttattcttctgggtatgtgaaggatagctccatatcagcagccagggcct

SEQ ID NO: 407457 - DNA, 140 bp, Artificial Sequence
  Synthetic
  misc_feature (108)..(108): n is a, c, g, or t
aggccctggctgctgatatgcaagtagcaatacagcagctaacaatcctgattgtgcctggctagaagcacaagaggaaggggatgaagtgggttttccagtcagacntcaggtacctttgaccttttgggacagcggtg

SEQ ID NO: 407458 - DNA, 140 bp, Artificial Sequence
  Synthetic
  misc_feature (33)..(33): n is a, c, g, or t
caccgctgtcccaaaaggtcaaaggtacctgangtctgactggaaaacccacttcatccccttcctcttgtgcttctagccaggcacaatcaggattgttagctgctgtattgctacttgcatatcagcagccagggcct

SEQ ID NO: 407459 - DNA, 140 bp, Artificial Sequence
  Synthetic
atacgccatgctgggtctccaatatgaccacagaactaaaagataaaaagaaggaagagagggcattgtttcatagacttgatctagtaccacttaatgagaatagtagcaagtatgagacgtacttgggagtcggccat

SEQ ID NO: 407460 - DNA, 140 bp, Artificial Sequence
  Synthetic
atggccgactcccaagtacgtctcatacttgctactattctcattaagtggtactagatcaagtctatgaaacaatgccctctcttccttctttttatcttttagttctgtggtcatattggagacccagcatggcgtat

SEQ ID NO: 407461 - DNA, 140 bp, Artificial Sequence
  Synthetic
atacgccatgctgggtctccctcgacaggcccggaggaatcgaagaaggaggtggagagcaaggcagaaccagatcgattcgattagtcagcggattcttagcacttgcctgggacgacccgtacttgggagtcggccat

SEQ ID NO: 407462 - DNA, 140 bp, Artificial Sequence
  Synthetic
atggccgactcccaagtacgggtcgtcccaggcaagtgctaagaatccgctgactaatcgaatcgatctggttctgccttgctctccacctccttcttcgattcctccgggcctgtcgagggagacccagcatggcgtat

SEQ ID NO: 407463 - DNA, 140 bp, Artificial Sequence
  Synthetic
aggccctggctgctgatatgattgttgcgaggactgtggaacttctgggacacagcagtctcaaggggttgagactggggtgggaaggcctcaagcatctgtggaatctcctgttgtattgaccttttgggacagcggtg

SEQ ID NO: 407464 - DNA, 140 bp, Artificial Sequence
  Synthetic
caccgctgtcccaaaaggtcaatacaacaggagattccacagatgcttgaggccttcccaccccagtctcaaccccttgagactgctgtgtcccagaagttccacagtcctcgcaacaatcatatcagcagccagggcct

SEQ ID NO: 407465 - DNA, 140 bp, Artificial Sequence
  Synthetic
aggccctggctgctgatatgacaaccaacaatagtactgtggatagtgtagaagatatgaaaaattgctctttcaatacgactacagaactaagagataagaaaaggggagaatatgcgtgaccttttgggacagcggtg

SEQ ID NO: 407466 - DNA, 140 bp, Artificial Sequence
  Synthetic
caccgctgtcccaaaaggtcacgcatattctccccttttcttatctcttagttctgtagtcgtattgaaagagcaatttttcatatcttctacactatccacagtactattgttggttgtcatatcagcagccagggcct

SEQ ID NO: 407467 - DNA, 140 bp, Artificial Sequence
  Synthetic
atacgccatgctgggtctccaaaacaatacaatttcaaagcgcctcaggaggggacctagaaattacaacacatagctttaattgtggaggagaatttttctattgcaacacatcaagatcgtacttgggagtcggccat

SEQ ID NO: 407468 - DNA, 140 bp, Artificial Sequence
  Synthetic
atggccgactcccaagtacgatcttgatgtgttgcaatagaaaaattctcctccacaattaaagctatgtgttgtaatttctaggtcccctcctgaggcgctttgaaattgtattgttttggagacccagcatggcgtat

SEQ ID NO: 407469 - DNA, 140 bp, Artificial Sequence
  Synthetic
aggccctggctgctgatatggaggatgtaggctttccagtcaggccacaagtaccactgaggccaatgacttacaaaggagctttagatctcagccactttttaaaagaaaaggggggacgaccttttgggacagcggtg

SEQ ID NO: 407470 - DNA, 140 bp, Artificial Sequence
  Synthetic
caccgctgtcccaaaaggtcgtccccccttttcttttaaaaagtggctgagatctaaagctcctttgtaagtcattggcctcagtggtacttgtggcctgactggaaagcctacatcctccatatcagcagccagggcct

SEQ ID NO: 407471 - DNA, 140 bp, Artificial Sequence
  Synthetic
  misc_feature (53)..(53): n is a, c, g, or t
aggccctggctgctgatatggaagctctagataaaatagaggaaatacaaaanaaaagcaagcaaaaagcacaacaggcagcagctgacacaggaagcagcaaggtcagccaaaattaccgaccttttgggacagcggtg

SEQ ID NO: 407472 - DNA, 140 bp, Artificial Sequence
  Synthetic
  misc_feature (88)..(88): n is a, c, g, or t
caccgctgtcccaaaaggtcggtaattttggctgaccttgctgcttcctgtgtcagctgctgcctgttgtgctttttgcttgcttttnttttgtatttcctctattttatctagagcttccatatcagcagccagggcct

SEQ ID NO: 407473 - DNA, 140 bp, Artificial Sequence
  Synthetic
aggccctggctgctgatatgagaaagatacctaaaggatcaacagctcctaggaatttggggctgctctggaaaactcatctgcaccactaatgtgccttggaactctagttggagtaatgaccttttgggacagcggtg

SEQ ID NO: 407474 - DNA, 140 bp, Artificial Sequence
  Synthetic
caccgctgtcccaaaaggtcattactccaactagagttccaaggcacattagtggtgcagatgagttttccagagcagccccaaattcctaggagctgttgatcctttaggtatctttctcatatcagcagccagggcct

SEQ ID NO: 407475 - DNA, 140 bp, Artificial Sequence
  Synthetic
aggccctggctgctgatatgcgaagaagaaggtggagagcaagacagagacagatccattcgattagtgaacggattcttagcacttgcctgggacgacctacggagcctgtgccttttcgaccttttgggacagcggtg

SEQ ID NO: 407476 - DNA, 140 bp, Artificial Sequence
  Synthetic
caccgctgtcccaaaaggtcgaaaaggcacaggctccgtaggtcgtcccaggcaagtgctaagaatccgttcactaatcgaatggatctgtctctgtcttgctctccaccttcttcttcgcatatcagcagccagggcct

SEQ ID NO: 407477 - DNA, 140 bp, Artificial Sequence
  Synthetic
aggccctggctgctgatatgaatagttgtgtggaccatagtatatatagaatataggaaattgttaagacaaaaaagaatagactggttaattaaaagaattagggaaagagcagaagacgaccttttgggacagcggtg

SEQ ID NO: 407478 - DNA, 140 bp, Artificial Sequence
  Synthetic
caccgctgtcccaaaaggtcgtcttctgctctttccctaattcttttaattaaccagtctattcttttttgtcttaacaatttcctatattctatatatactatggtccacacaactattcatatcagcagccagggcct

SEQ ID NO: 407479 - DNA, 140 bp, Artificial Sequence
  Synthetic
atacgccatgctgggtctccattagtttatgggacgaaagcctaaagccatgtgtacagctgaccccactctgtgtcaccttagactgtaaacctgctaatattagtaataagaataactcgtacttgggagtcggccat

SEQ ID NO: 407480 - DNA, 140 bp, Artificial Sequence
  Synthetic
atggccgactcccaagtacgagttattcttattactaatattagcaggtttacagtctaaggtgacacagagtggggtcagctgtacacatggctttaggctttcgtcccataaactaatggagacccagcatggcgtat

SEQ ID NO: 407481 - DNA, 140 bp, Artificial Sequence
  Synthetic
aggccctggctgctgatatgagaaggacaccaaatgaaagactgcactgagagacaggctaattttttagggagaatttggccttccaacaaggggaggccaggaaattttcctcagagcgaccttttgggacagcggtg

SEQ ID NO: 407482 - DNA, 140 bp, Artificial Sequence
  Synthetic
caccgctgtcccaaaaggtcgctctgaggaaaatttcctggcctccccttgttggaaggccaaattctccctaaaaaattagcctgtctctcagtgcagtctttcatttggtgtccttctcatatcagcagccagggcct

SEQ ID NO: 407483 - DNA, 140 bp, Artificial Sequence
  Synthetic
atacgccatgctgggtctcctagagttaggcagggatactcacctttgtcgtttcagacccttaccccgaaccccgggggacccgacaggctcggaagaatcgaagaagaaggtggagagcgtacttgggagtcggccat

SEQ ID NO: 407484 - DNA, 140 bp, Artificial Sequence
  Synthetic
atggccgactcccaagtacgctctccaccttcttcttcgattcttccgagcctgtcgggtcccccggggttcggggtaagggtctgaaacgacaaaggtgagtatccctgcctaactctaggagacccagcatggcgtat

SEQ ID NO: 407485 - DNA, 140 bp, Artificial Sequence
  Synthetic
aggccctggctgctgatatggcggcggctggtgagtacgccaaattttatttgactagcggaggctagaaggagagagatgggtgcgagagcgtcaatattaagagggggaaaattagatgaccttttgggacagcggtg

SEQ ID NO: 407486 - DNA, 140 bp, Artificial Sequence
  Synthetic
caccgctgtcccaaaaggtcatctaattttccccctcttaatattgacgctctcgcacccatctctctccttctagcctccgctagtcaaataaaatttggcgtactcaccagccgccgccatatcagcagccagggcct

SEQ ID NO: 407487 - DNA, 140 bp, Artificial Sequence
  Synthetic
aggccctggctgctgatatggtacaaagaatttgtagagctatccgcaacatacctagaagaataagacagggctttgaagcagctttgcaataaaatggggggcaagtggtcaaaatgcgaccttttgggacagcggtg

SEQ ID NO: 407488 - DNA, 140 bp, Artificial Sequence
  Synthetic
caccgctgtcccaaaaggtcgcattttgaccacttgccccccattttattgcaaagctgcttcaaagccctgtcttattcttctaggtatgttgcggatagctctacaaattctttgtaccatatcagcagccagggcct

SEQ ID NO: 407489 - DNA, 140 bp, Artificial Sequence
  Synthetic
atacgccatgctgggtctccgatttggctaagcatggggcaattacaagcagcaacactgcctctactaatcctgactgtgcctggctggaagcacaagaagacgaggatgtagggtttccgtacttgggagtcggccat

SEQ ID NO: 407490 - DNA, 140 bp, Artificial Sequence
  Synthetic
atggccgactcccaagtacggaaaccctacatcctcgtcttcttgtgcttccagccaggcacagtcaggattagtagaggcagtgttgctgcttgtaattgccccatgcttagccaaatcggagacccagcatggcgtat

SEQ ID NO: 407491 - DNA, 140 bp, Artificial Sequence
  Synthetic
atacgccatgctgggtctcctaattagatctgaaaatattacagacaatgccaaaaacataatagttcaatttaacaaggctgtagtaattaattgtaccagacctgccaacaatacaagcgtacttgggagtcggccat

SEQ ID NO: 407492 - DNA, 140 bp, Artificial Sequence
  Synthetic
atggccgactcccaagtacgcttgtattgttggcaggtctggtacaattaattactacagccttgttaaattgaactattatgtttttggcattgtctgtaatattttcagatctaattaggagacccagcatggcgtat

SEQ ID NO: 407493 - DNA, 140 bp, Artificial Sequence
  Synthetic
aggccctggctgctgatatgtaataaaacaatagaatttaaaccatcctcaggaggggacctagaaattacaacacatagctttaattgtagaggagaatttttctattgcaatacatcagaccttttgggacagcggtg

SEQ ID NO: 407494 - DNA, 140 bp, Artificial Sequence
  Synthetic
caccgctgtcccaaaaggtctgatgtattgcaatagaaaaattctcctctacaattaaagctatgtgttgtaatttctaggtcccctcctgaggatggtttaaattctattgttttattacatatcagcagccagggcct

SEQ ID NO: 407495 - DNA, 140 bp, Artificial Sequence
  Synthetic
aggccctggctgctgatatgtttaacaaggctgtagtaattaattgtaccagacctgccaacaatacaagaaaaagtgtacgtatagggccaggacaaacattctatgcaacaggtgatggaccttttgggacagcggtg

SEQ ID NO: 407496 - DNA, 140 bp, Artificial Sequence
  Synthetic
caccgctgtcccaaaaggtccatcacctgttgcatagaatgtttgtcctggccctatacgtacactttttcttgtattgttggcaggtctggtacaattaattactacagccttgttaaacatatcagcagccagggcct

SEQ ID NO: 407497 - DNA, 140 bp, Artificial Sequence
  Synthetic
aggccctggctgctgatatgaaagactgtactgagaggcaggctaattttttagggaaaatttggccttcccacaaggggaggccagggaatttcctccagagcagaccagagccaacaggaccttttgggacagcggtg

SEQ ID NO: 407498 - DNA, 140 bp, Artificial Sequence
  Synthetic
caccgctgtcccaaaaggtcctgttggctctggtctgctctggaggaaattccctggcctccccttgtgggaaggccaaattttccctaaaaaattagcctgcctctcagtacagtctttcatatcagcagccagggcct

SEQ ID NO: 407499 - DNA, 140 bp, Artificial Sequence
  Synthetic
aggccctggctgctgatatgaacaataaactttactcagtcctcagggggagatttagaacttacaacacacagctttaattgtggaggagaatttttctactgcaatacatcacacttggaccttttgggacagcggtg

SEQ ID NO: 407500 - DNA, 140 bp, Artificial Sequence
  Synthetic
caccgctgtcccaaaaggtccaagtgtgatgtattgcagtagaaaaattctcctccacaattaaagctgtgtgttgtaagttctaaatctccccctgaggactgagtaaagtttattgttcatatcagcagccagggcct

SEQ ID NO: 407501 - DNA, 140 bp, Artificial Sequence
  Synthetic
aggccctggctgctgatatgcagaaggagtaggagcagtatctcaagatctagataaacatggagcagtaacaagtagtaatatgaataatgctgattgtgtctggctgagagcacaagagaccttttgggacagcggtg

SEQ ID NO: 407502 - DNA, 140 bp, Artificial Sequence
  Synthetic
caccgctgtcccaaaaggtctcttgtgctctcagccagacacaatcagcattattcatattactacttgttactgctccatgtttatctagatcttgagatactgctcctactccttctgcatatcagcagccagggcct

SEQ ID NO: 407503 - DNA, 140 bp, Artificial Sequence
  Synthetic
aggccctggctgctgatatgcgaaagttccagagaagttctctcgacgcgaggactcggcttgctgaggtgcacacagcaagaggcgagagcggcgactggtgagtacgccaatttttgagaccttttgggacagcggtg

SEQ ID NO: 407504 - DNA, 140 bp, Artificial Sequence
  Synthetic
caccgctgtcccaaaaggtctcaaaaattggcgtactcaccagtcgccgctctcgcctcttgctgtgtgcacctcagcaagccgagtcctcgcgtcgagagaacttctctggaactttcgcatatcagcagccagggcct

SEQ ID NO: 407505 - DNA, 140 bp, Artificial Sequence
  Synthetic
aggccctggctgctgatatgaagaaaaagtataaggataggaccaggacaagtattctttacagccacagacataataggaaatataagagaagcacattgtaacattagtgagaaagcagaccttttgggacagcggtg

SEQ ID NO: 407506 - DNA, 140 bp, Artificial Sequence
  Synthetic
caccgctgtcccaaaaggtctgctttctcactaatgttacaatgtgcttctcttatatttcctattatgtctgtggctgtaaagaatacttgtcctggtcctatccttatactttttcttcatatcagcagccagggcct

SEQ ID NO: 407507 - DNA, 140 bp, Artificial Sequence
  Synthetic
aggccctggctgctgatatgatgggtaccagcacacaaaggaattggaggaaatgaacaagtagataaattagtcagtgctggaatcaggaaagtactatttttagatggaatagataaggaccttttgggacagcggtg

SEQ ID NO: 407508 - DNA, 140 bp, Artificial Sequence
  Synthetic
caccgctgtcccaaaaggtccttatctattccatctaaaaatagtactttcctgattccagcactgactaatttatctacttgttcatttcctccaattcctttgtgtgctggtacccatcatatcagcagccagggcct

SEQ ID NO: 407509 - DNA, 140 bp, Artificial Sequence
  Synthetic
atacgccatgctgggtctccggaaggacatcaaatgaaagactgcactgagagacaggctaattttttagggaaaatttggccttccaagggaaggccaggaaattttcctcagagcagacgtacttgggagtcggccat

SEQ ID NO: 407510 - DNA, 140 bp, Artificial Sequence
  Synthetic
atggccgactcccaagtacgtctgctctgaggaaaatttcctggccttcccttggaaggccaaattttccctaaaaaattagcctgtctctcagtgcagtctttcatttgatgtccttccggagacccagcatggcgtat

SEQ ID NO: 407511 - DNA, 140 bp, Artificial Sequence
  Synthetic
atacgccatgctgggtctcccgggctctatcaacataacggaagtaaaaaactgctctttcaatatgaccacagaactaagggataaaagacagaaggtatattcacttttttataaactcgtacttgggagtcggccat

SEQ ID NO: 407512 - DNA, 140 bp, Artificial Sequence
  Synthetic
atggccgactcccaagtacgagtttataaaaaagtgaatataccttctgtcttttatcccttagttctgtggtcatattgaaagagcagttttttacttccgttatgttgatagagcccgggagacccagcatggcgtat

SEQ ID NO: 407513 - DNA, 140 bp, Artificial Sequence
  Synthetic
aggccctggctgctgatatgaacacttgctgaagctatctgtataaagtattagacaactccaagctcgcctgctagccttaaaaacctttatacaaaatcagcaactccataacctgtagaccttttgggacagcggtg

SEQ ID NO: 407514 - DNA, 140 bp, Artificial Sequence
  Synthetic
caccgctgtcccaaaaggtctacaggttatggagttgctgattttgtataaaggtttttaaggctagcaggcgagcttggagttgtctaatactttatacagatagcttcagcaagtgttcatatcagcagccagggcct

SEQ ID NO: 407515 - DNA, 140 bp, Artificial Sequence
  Synthetic
  misc_feature (37)..(37): n is a, c, g, or t
  misc_feature (41)..(41): n is a, c, g, or t
  misc_feature (43)..(43): n is a, c, g, or t
  misc_feature (58)..(58): n is a, c, g, or t
  misc_feature (81)..(81): n is a, c, g, or t
atacgccatgctgggtctccgtattctatgcaacagntatnanaggggatataagacnagcacattgtaatgtcagtagancaaactggactaaaactttaaaacaggtagctacacaatcgtacttgggagtcggccat

SEQ ID NO: 407516 - DNA, 140 bp, Artificial Sequence
  Synthetic
  misc_feature (60)..(60): n is a, c, g, or t
  misc_feature (83)..(83): n is a, c, g, or t
  misc_feature (98)..(98): n is a, c, g, or t
  misc_feature (100)..(100): n is a, c, g, or t
  misc_feature (104)..(104): n is a, c, g, or t
atggccgactcccaagtacgattgtgtagctacctgttttaaagttttagtccagtttgntctactgacattacaatgtgctngtcttatatcccctntnatanctgttgcatagaatacggagacccagcatggcgtat

SEQ ID NO: 407517 - DNA, 140 bp, Artificial Sequence
  Synthetic
  misc_feature (73)..(73): n is a, c, g, or t
aggccctggctgctgatatgaatcgactggcttcttaaaataataaataatacagcagacagcagcaacaatnagagtgatggcaccacagaggagttgtctgcagtggagaaaaggggtgaccttttgggacagcggtg

SEQ ID NO: 407518 - DNA, 140 bp, Artificial Sequence
  Synthetic
  misc_feature (68)..(68): n is a, c, g, or t
caccgctgtcccaaaaggtcaccccttttctccactgcagacaactcctctgtggtgccatcactctnattgttgctgctgtctgctgtattatttattattttaagaagccagtcgattcatatcagcagccagggcct

SEQ ID NO: 407519 - DNA, 140 bp, Artificial Sequence
  Synthetic
  misc_feature (78)..(78): n is a, c, g, or t
  misc_feature (90)..(90): n is a, c, g, or t
  misc_feature (98)..(98): n is a, c, g, or t
  misc_feature (109)..(109): n is a, c, g, or t
atacgccatgctgggtctccaagtacacatcccattaggggaggctagattggtaataacaacatattggggtctgcntacaggggaganagaatggnacttgggtcanggagtctccatcgtacttgggagtcggccat

SEQ ID NO: 407520 - DNA, 140 bp, Artificial Sequence
  Synthetic
  misc_feature (32)..(32): n is a, c, g, or t
  misc_feature (43)..(43): n is a, c, g, or t
  misc_feature (51)..(51): n is a, c, g, or t
  misc_feature (63)..(63): n is a, c, g, or t
atggccgactcccaagtacgatggagactccntgacccaagtnccattctntctcccctgtangcagaccccaatatgttgttattaccaatctagcctcccctaatgggatgtgtacttggagacccagcatggcgtat

SEQ ID NO: 407521 - DNA, 140 bp, Artificial Sequence
  Synthetic
  misc_feature (66)..(66): n is a, c, g, or t
  misc_feature (72)..(72): n is a, c, g, or t
atacgccatgctgggtctccaccaactaattcacctgcattactttaattgtttttcagactctgntataanaaatgccctattaggacatagcagtgtagtccttaggtgtgaatatcacgtacttgggagtcggccat

SEQ ID NO: 407522 - DNA, 140 bp, Artificial Sequence
  Synthetic
  misc_feature (69)..(69): n is a, c, g, or t
  misc_feature (75)..(75): n is a, c, g, or t
atggccgactcccaagtacgtgatattcacacctaaggactacactgctatgtcctaatagggcatttnttatancagagtctgaaaaacaattaaagtaatgcaggtgaattagttggtggagacccagcatggcgtat

SEQ ID NO: 407523 - DNA, 140 bp, Artificial Sequence
  Synthetic
aggccctggctgctgatatgcaaattataaatatgtggcagagaacaggacaagcaatgtatgcccctcccatcaaaggagaaatcaggtgtgtatcaaacattacaggactattgttgagaccttttgggacagcggtg

SEQ ID NO: 407524 - DNA, 140 bp, Artificial Sequence
  Synthetic
caccgctgtcccaaaaggtctcaacaatagtcctgtaatgtttgatacacacctgatttctcctttgatgggaggggcatacattgcttgtcctgttctctgccacatatttataatttgcatatcagcagccagggcct

SEQ ID NO: 407525 - DNA, 140 bp, Artificial Sequence
  Synthetic
aggccctggctgctgatatgaagaactcaagcaggaagctgtcagacactttcctagaccatggctccatagcttaggacaatatatctatgaaacctatggggatacttggacaggagtgaccttttgggacagcggtg

SEQ ID NO: 407526 - DNA, 140 bp, Artificial Sequence
  Synthetic
caccgctgtcccaaaaggtcactcctgtccaagtatccccataggtttcatagatatattgtcctaagctatggagccatggtctaggaaagtgtctgacagcttcctgcttgagttcttcatatcagcagccagggcct

SEQ ID NO: 407527 - DNA, 140 bp, Artificial Sequence
  Synthetic
atacgccatgctgggtctcccaactgggcaaatgaaaccaccctacttaatattaccacagggatgagaaattgctctttcaatataaccacaatgctaaaagataagaaaaagaaacagcgtacttgggagtcggccat

SEQ ID NO: 407528 - DNA, 140 bp, Artificial Sequence
  Synthetic
atggccgactcccaagtacgctgtttctttttcttatcttttagcattgtggttatattgaaagagcaatttctcatccctgtggtaatattaagtagggtggtttcatttgcccagttgggagacccagcatggcgtat

SEQ ID NO: 407529 - DNA, 140 bp, Artificial Sequence
  Synthetic
aggccctggctgctgatatgaatagcaagagtagattatagattaggagtaggagcattgatagtagccttaatcatagcaataatagtgtggaccatagtatatatagaatataggaaagaccttttgggacagcggtg

SEQ ID NO: 407530 - DNA, 140 bp, Artificial Sequence
  Synthetic
caccgctgtcccaaaaggtctttcctatattctatatatactatggtccacactattattgctatgattaaggctactatcaatgctcctactcctaatctataatctactcttgctattcatatcagcagccagggcct

SEQ ID NO: 407531 - DNA, 140 bp, Artificial Sequence
  Synthetic
  misc_feature (66)..(66): n is a, c, g, or t
atacgccatgctgggtctccccactactgtgccctggaactctagttggagcaataaatcccaggnagagatatgggacaatatgacctggctgcaatgggataaggaaattagcaattacgtacttgggagtcggccat

SEQ ID NO: 407532 - DNA, 140 bp, Artificial Sequence
  Synthetic
  misc_feature (75)..(75): n is a, c, g, or t
atggccgactcccaagtacgtaattgctaatttccttatcccattgcagccaggtcatattgtcccatatctctncctgggatttattgctccaactagagttccagggcacagtagtggggagacccagcatggcgtat

SEQ ID NO: 407533 - DNA, 140 bp, Artificial Sequence
  Synthetic
  misc_feature (48)..(48): n is a, c, g, or t
  misc_feature (50)..(50): n is a, c, g, or t
  misc_feature (53)..(53): n is a, c, g, or t
atacgccatgctgggtctcctagtagcaataataatagcaatagttgngnggnctatagtagccatagaatataggagaatatcaagacaaaagaaaatagacaggttaattgatagaatcgtacttgggagtcggccat

SEQ ID NO: 407534 - DNA, 140 bp, Artificial Sequence
  Synthetic
  misc_feature (88)..(88): n is a, c, g, or t
  misc_feature (91)..(91): n is a, c, g, or t
  misc_feature (93)..(93): n is a, c, g, or t
atggccgactcccaagtacgattctatcaattaacctgtctattttcttttgtcttgatattctcctatattctatggctactatagnccncncaactattgctattattattgctactaggagacccagcatggcgtat

SEQ ID NO: 407535 - DNA, 140 bp, Artificial Sequence
  Synthetic
atacgccatgctgggtctccaaaatggtacctacaatgatgagagcaataaggaaataacaaattgcactttcaatacaaccacagaaataagaggtaggaagcagaaagtgtatgcactcgtacttgggagtcggccat

SEQ ID NO: 407536 - DNA, 140 bp, Artificial Sequence
  Synthetic
atggccgactcccaagtacgagtgcatacactttctgcttcctacctcttatttctgtggttgtattgaaagtgcaatttgttatttccttattgctctcatcattgtaggtaccattttggagacccagcatggcgtat

SEQ ID NO: 407537 - DNA, 140 bp, Artificial Sequence
  Synthetic
atacgccatgctgggtctcccctacaatattgaagaaatgaggaattgctctttcaatataaccacagaaataagagataagagaaggcaagaaagtgcacttttttataagcttgatatcgtacttgggagtcggccat

SEQ ID NO: 407538 - DNA, 140 bp, Artificial Sequence
  Synthetic
atggccgactcccaagtacgatatcaagcttataaaaaagtgcactttcttgccttctcttatctcttatttctgtggttatattgaaagagcaattcctcatttcttcaatattgtaggggagacccagcatggcgtat

SEQ ID NO: 407539 - DNA, 140 bp, Artificial Sequence
  Synthetic
atacgccatgctgggtctcccctggctatagaaagatacctaaaagatcaacagctcctagggctttggggatgcgctggaaaaaccatttgcaccactgctgtaccgtggaactccagtcgtacttgggagtcggccat

SEQ ID NO: 407540 - DNA, 140 bp, Artificial Sequence
  Synthetic
atggccgactcccaagtacgactggagttccacggtacagcagtggtgcaaatggtttttccagcgcatccccaaagccctaggagctgttgatcttttaggtatctttctatagccaggggagacccagcatggcgtat

SEQ ID NO: 407541 - DNA, 140 bp, Artificial Sequence
  Synthetic
aggccctggctgctgatatgtttgcaccatcctcaggaggggacctagaaattacaacacatagctttaattgtagaggagaatttttctattgtaatacatcaggcctgtttaatagtagaccttttgggacagcggtg

SEQ ID NO: 407542 - DNA, 140 bp, Artificial Sequence
  Synthetic
caccgctgtcccaaaaggtctactattaaacaggcctgatgtattacaatagaaaaattctcctctacaattaaagctatgtgttgtaatttctaggtcccctcctgaggatggtgcaaacatatcagcagccagggcct

SEQ ID NO: 407543 - DNA, 140 bp, Artificial Sequence
  Synthetic
aggccctggctgctgatatgtagttatcattgtccagcttgctttctgaacaaaggcttaggaatctcctatggcaggaagaagcggagacagcgacgaagaactcctcagagcaatcaggaccttttgggacagcggtg

SEQ ID NO: 407544 - DNA, 140 bp, Artificial Sequence
  Synthetic
caccgctgtcccaaaaggtcctgattgctctgaggagttcttcgtcgctgtctccgcttcttcctgccataggagattcctaagcctttgttcagaaagcaagctggacaatgataactacatatcagcagccagggcct

SEQ ID NO: 407545 - DNA, 140 bp, Artificial Sequence
  Synthetic
atacgccatgctgggtctccacaagaaggagtatatctatgggaccagggagagcaatttatgcaacaggagaaataataggagatataagacaagcatattgtaaccttagtggagcagcgtacttgggagtcggccat

SEQ ID NO: 407546 - DNA, 140 bp, Artificial Sequence
  Synthetic
atggccgactcccaagtacgctgctccactaaggttacaatatgcttgtcttatatctcctattatttctcctgttgcataaattgctctccctggtcccatagatatactccttcttgtggagacccagcatggcgtat

SEQ ID NO: 407547 - DNA, 140 bp, Artificial Sequence
  Synthetic
aggccctggctgctgatatgactagtagtggttggaaaaggatggacaaaggagagataaaaaactgctctttcaagatcacatcaggcataagagataaagttcaggaaacatttgcatgaccttttgggacagcggtg

SEQ ID NO: 407548 - DNA, 140 bp, Artificial Sequence
  Synthetic
caccgctgtcccaaaaggtcatgcaaatgtttcctgaactttatctcttatgcctgatgtgatcttgaaagagcagttttttatctctcctttgtccatccttttccaaccactactagtcatatcagcagccagggcct

SEQ ID NO: 407549 - DNA, 140 bp, Artificial Sequence
  Synthetic
aggccctggctgctgatatgtactagcattggacagttggaacaatctgtggaattggtttaacatatcaaattggctgtggtatataaaaatattcataatgatagtaggaggcttgatgaccttttgggacagcggtg

SEQ ID NO: 407550 - DNA, 140 bp, Artificial Sequence
  Synthetic
caccgctgtcccaaaaggtcatcaagcctcctactatcattatgaatatttttatataccacagccaatttgatatgttaaaccaattccacagattgttccaactgtccaatgctagtacatatcagcagccagggcct

SEQ ID NO: 407551 - DNA, 140 bp, Artificial Sequence
  Synthetic
aggccctggctgctgatatgcagatcaattcgattagtgagcggattcttagcacttgcctgggacgacctgcggagcctgtgccttttcagttaccaccgattgagagacttcatattggaccttttgggacagcggtg

SEQ ID NO: 407552 - DNA, 140 bp, Artificial Sequence
  Synthetic
caccgctgtcccaaaaggtccaatatgaagtctctcaatcggtggtaactgaaaaggcacaggctccgcaggtcgtcccaggcaagtgctaagaatccgctcactaatcgaattgatctgcatatcagcagccagggcct

SEQ ID NO: 407553 - DNA, 140 bp, Artificial Sequence
  Synthetic
atacgccatgctgggtctccagctgaggggacagataggattatagaaatagtacaaagaactggtagaggtatcctaaatatacctagaagaataagacagggcttagaaaggcttttgcgtacttgggagtcggccat

SEQ ID NO: 407554 - DNA, 140 bp, Artificial Sequence
  Synthetic
atggccgactcccaagtacgcaaaagcctttctaagccctgtcttattcttctaggtatatttaggatacctctaccagttctttgtactatttctataatcctatctgtcccctcagctggagacccagcatggcgtat

SEQ ID NO: 407555 - DNA, 140 bp, Artificial Sequence
  Synthetic
aggccctggctgctgatatggagaaagaatgagacgaactgagccagcagcagagggggtgggagcagcatctcgagacctggaaagacatggagcaatcacaagtagcaatacagcagcgaccttttgggacagcggtg

SEQ ID NO: 407556 - DNA, 140 bp, Artificial Sequence
  Synthetic
caccgctgtcccaaaaggtcgctgctgtattgctacttgtgattgctccatgtctttccaggtctcgagatgctgctcccaccccctctgctgctggctcagttcgtctcattctttctccatatcagcagccagggcct

SEQ ID NO: 407557 - DNA, 140 bp, Artificial Sequence
  Synthetic
atacgccatgctgggtctccaaattttttgactagcagaggctagaaggagagagatgggtgcgagagcgtcagtattgactccgggagaattagataaatttgaaaaaattcgattaagcgtacttgggagtcggccat

SEQ ID NO: 407558 - DNA, 140 bp, Artificial Sequence
  Synthetic
atggccgactcccaagtacgcttaatcgaattttttcaaatttatctaattctcccggagtcaatactgacgctctcgcacccatctctctccttctagcctctgctagtcaaaaaatttggagacccagcatggcgtat

SEQ ID NO: 407559 - DNA, 140 bp, Artificial Sequence
  Synthetic
atacgccatgctgggtctccatgttaccattaagggtaatgataccattgaagaaatgaaaagttgctctttcaatacaaccacagaaataatagataagaaaaacaaagagtatgcactcgtacttgggagtcggccat

SEQ ID NO: 407560 - DNA, 140 bp, Artificial Sequence
  Synthetic
atggccgactcccaagtacgagtgcatactctttgtttttcttatctattatttctgtggttgtattgaaagagcaacttttcatttcttcaatggtatcattacccttaatggtaacatggagacccagcatggcgtat

SEQ ID NO: 407561 - DNA, 140 bp, Artificial Sequence
  Synthetic
aggccctggctgctgatatgatgtcagcacagtacaatgtacacatggaattaagccagtagtatcaactcaactactgttaaatggtagcctagcagaaggagagataataattagatcgaccttttgggacagcggtg

SEQ ID NO: 407562 - DNA, 140 bp, Artificial Sequence
  Synthetic
caccgctgtcccaaaaggtcgatctaattattatctctccttctgctaggctaccatttaacagtagttgagttgatactactggcttaattccatgtgtacattgtactgtgctgacatcatatcagcagccagggcct

SEQ ID NO: 407563 - DNA, 140 bp, Artificial Sequence
  Synthetic
aggccctggctgctgatatgtattgattgcagcgaggacagtggaacttctgggacacagcagtctcaagggactgagactggggtgggagggcctcaaatatctgtggaatcttctgttgaccttttgggacagcggtg

SEQ ID NO: 407564 - DNA, 140 bp, Artificial Sequence
  Synthetic
caccgctgtcccaaaaggtcaacagaagattccacagatatttgaggccctcccaccccagtctcagtcccttgagactgctgtgtcccagaagttccactgtcctcgctgcaatcaatacatatcagcagccagggcct

SEQ ID NO: 407565 - DNA, 140 bp, Artificial Sequence
  Synthetic
atacgccatgctgggtctccgtggcgcccgaacagggacttgaaagcgaaagtaagaccagagaagatcctctagacgcaggactcggcttgctgaagtgcactcggcaagaggcgagagcgtacttgggagtcggccat

SEQ ID NO: 407566 - DNA, 140 bp, Artificial Sequence
  Synthetic
atggccgactcccaagtacgctctcgcctcttgccgagtgcacttcagcaagccgagtcctgcgtctagaggatcttctctggtcttactttcgctttcaagtccctgttcgggcgccacggagacccagcatggcgtat

SEQ ID NO: 407567 - DNA, 140 bp, Artificial Sequence
  Synthetic
aggccctggctgctgatatggctgctctggaaaactcatctgcaccactactgtgccttggaactccagttggagtaataaatctgaagaagagatttggggtaacatgacctggatgcagaccttttgggacagcggtg

SEQ ID NO: 407568 - DNA, 140 bp, Artificial Sequence
  Synthetic
caccgctgtcccaaaaggtctgcatccaggtcatgttaccccaaatctcttcttcagatttattactccaactggagttccaaggcacagtagtggtgcagatgagttttccagagcagccatatcagcagccagggcct

SEQ ID NO: 407569 - DNA, 140 bp, Artificial Sequence
  Synthetic
aggccctggctgctgatatgtaaattttccaattagtcccattgaaactgtaccagtaaaattaaagccaggaatggatggcccaaaggttaaacaatggccattgacagaagaaaaaatgaccttttgggacagcggtg

SEQ ID NO: 407570 - DNA, 140 bp, Artificial Sequence
  Synthetic
caccgctgtcccaaaaggtcattttttcttctgtcaatggccattgtttaacctttgggccatccattcctggctttaattttactggtacagtttcaatgggactaattggaaaatttacatatcagcagccagggcct

SEQ ID NO: 407571 - DNA, 140 bp, Artificial Sequence
  Synthetic
aggccctggctgctgatatgacagcaggcaaaagcagctgacggaaagatcagtcaaaattatcctatagtgcagaacctccaagggcaaatggtacatcaagccctgtcacctagaaccgaccttttgggacagcggtg

SEQ ID NO: 407572 - DNA, 140 bp, Artificial Sequence
  Synthetic
caccgctgtcccaaaaggtcggttctaggtgacagggcttgatgtaccatttgcccttggaggttctgcactataggataattttgactgatctttccgtcagctgcttttgcctgctgtcatatcagcagccagggcct

SEQ ID NO: 407573 - DNA, 140 bp, Artificial Sequence
  Synthetic
aggccctggctgctgatatgacgaagacctcctcaaggcagtcagaatcatcaagtttctctaccaaagcagtgagtagtatatgtaatgcaatctttacaaatagcagcaatagtagcagaccttttgggacagcggtg

SEQ ID NO: 407574 - DNA, 140 bp, Artificial Sequence
  Synthetic
caccgctgtcccaaaaggtctgctactattgctgctatttgtaaagattgcattacatatactactcactgctttggtagagaaacttgatgattctgactgccttgaggaggtcttcgtcatatcagcagccagggcct

SEQ ID NO: 407575 - DNA, 140 bp, Artificial Sequence
  Synthetic
aggccctggctgctgatatgatgcctgtgtacccacagaccccaacccacaagaagtagtattggaaaatgtgacagaaaattttaacatgtggaaaaataacatggtagaacagatgcagaccttttgggacagcggtg

SEQ ID NO: 407576 - DNA, 140 bp, Artificial Sequence
  Synthetic
caccgctgtcccaaaaggtctgcatctgttctaccatgttatttttccacatgttaaaattttctgtcacattttccaatactacttcttgtgggttggggtctgtgggtacacaggcatcatatcagcagccagggcct

SEQ ID NO: 407577 - DNA, 140 bp, Artificial Sequence
  Synthetic
atacgccatgctgggtctccacaaaagaaccataatggaggacatgaaaggagaaataaaaaactgctctttcaatacaaccacagaactaaaggataaaaaacagaaagtatattcactcgtacttgggagtcggccat

SEQ ID NO: 407578 - DNA, 140 bp, Artificial Sequence
  Synthetic
atggccgactcccaagtacgagtgaatatactttctgttttttatcctttagttctgtggttgtattgaaagagcagttttttatttctcctttcatgtcctccattatggttcttttgtggagacccagcatggcgtat

SEQ ID NO: 407579 - DNA, 140 bp, Artificial Sequence
  Synthetic
aggccctggctgctgatatgggggaaacttgtgggtcacagtctattatggggtacctgtgtggaaagaagcaaaaactactctattctgtgcatcagatgctaaagcatatgagaaagagaccttttgggacagcggtg

SEQ ID NO: 407580 - DNA, 140 bp, Artificial Sequence
  Synthetic
caccgctgtcccaaaaggtctctttctcatatgctttagcatctgatgcacagaatagagtagtttttgcttctttccacacaggtaccccataatagactgtgacccacaagtttcccccatatcagcagccagggcct

SEQ ID NO: 407581 - DNA, 140 bp, Artificial Sequence
  Synthetic
aggccctggctgctgatatgaaaacaacaataatctttaataactccgcaggaggggatatagaaattacaacacatagttttaattgtggaggagagtttttctattgtaatacatcaggaccttttgggacagcggtg

SEQ ID NO: 407582 - DNA, 140 bp, Artificial Sequence
  Synthetic
caccgctgtcccaaaaggtcctgatgtattacaatagaaaaactctcctccacaattaaaactatgtgttgtaatttctatatcccctcctgcggagttattaaagattattgttgttttcatatcagcagccagggcct

SEQ ID NO: 407583 - DNA, 140 bp, Artificial Sequence
  Synthetic
aggccctggctgctgatatgtgtacaagacccaacaataatacaagaaaaagtataaggataggaccaggacaaacattctatgcaacaggagaaataataggagacataagacaagcacgaccttttgggacagcggtg

SEQ ID NO: 407584 - DNA, 140 bp, Artificial Sequence
  Synthetic
caccgctgtcccaaaaggtcgtgcttgtcttatgtctcctattatttctcctgttgcatagaatgtttgtcctggtcctatccttatactttttcttgtattattgttgggtcttgtacacatatcagcagccagggcct

SEQ ID NO: 407585 - DNA, 140 bp, Artificial Sequence
  Synthetic
aggccctggctgctgatatgcagctatagcagtagctgaggggacagatagggttatagaaatagtgcaaagaacttgtagagctattctccacatacctagaagaataagacagggcttgaccttttgggacagcggtg

SEQ ID NO: 407586 - DNA, 140 bp, Artificial Sequence
  Synthetic
caccgctgtcccaaaaggtcaagccctgtcttattcttctaggtatgtggagaatagctctacaagttctttgcactatttctataaccctatctgtcccctcagctactgctatagctgcatatcagcagccagggcct

SEQ ID NO: 407587 - DNA, 140 bp, Artificial Sequence
  Synthetic
atacgccatgctgggtctccctctgtgtcactttaaattgtacaaatgctagtgatagtactgatcataataaaactgttaacatgaagggagaaatgaaaaattgcactttcaatgtaacgtacttgggagtcggccat

SEQ ID NO: 407588 - DNA, 140 bp, Artificial Sequence
  Synthetic
atggccgactcccaagtacgttacattgaaagtgcaatttttcatttctcccttcatgttaacagttttattatgatcagtactatcactagcatttgtacaatttaaagtgacacagagggagacccagcatggcgtat

SEQ ID NO: 407589 - DNA, 140 bp, Artificial Sequence
  Synthetic
atacgccatgctgggtctccagaatagtactaataccagtagtactaataccactagctggggagggatagtcagaggagagataaaaaactgctctttcaatatctccacaagtatgggcgtacttgggagtcggccat

SEQ ID NO: 407590 - DNA, 140 bp, Artificial Sequence
  Synthetic
atggccgactcccaagtacgcccatacttgtggagatattgaaagagcagttttttatctctcctctgactatccctccccagctagtggtattagtactactggtattagtactattctggagacccagcatggcgtat

SEQ ID NO: 407591 - DNA, 140 bp, Artificial Sequence
  Synthetic
atacgccatgctgggtctcccagaaaattaagaaaacacttccctaacaagacaatagaatttgcaccatcctcaggaggggacctagaaattacaacacatagttttaactgcggaggacgtacttgggagtcggccat

SEQ ID NO: 407592 - DNA, 140 bp, Artificial Sequence
  Synthetic
atggccgactcccaagtacgtcctccgcagttaaaactatgtgttgtaatttctaggtcccctcctgaggatggtgcaaattctattgtcttgttagggaagtgttttcttaattttctgggagacccagcatggcgtat

SEQ ID NO: 407593 - DNA, 140 bp, Artificial Sequence
  Synthetic
atacgccatgctgggtctcctagcagtcctctattgcgtacatcaacagatagcgataaaagacaccaaggaagctctagataaaatagaggaaatacaaaataaaagcaagcaaaaggccgtacttgggagtcggccat

SEQ ID NO: 407594 - DNA, 140 bp, Artificial Sequence
  Synthetic
atggccgactcccaagtacggccttttgcttgcttttattttgtatttcctctattttatctagagcttccttggtgtcttttatcgctatctgttgatgtacgcaatagaggactgctaggagacccagcatggcgtat

SEQ ID NO: 407595 - DNA, 140 bp, Artificial Sequence
  Synthetic
atacgccatgctgggtctccgaagtgatatagcaggaactactagcacccctcaagaacagatagcatggatgacaaacaacccacctattccagtgggagacatctacagaagatggatcgtacttgggagtcggccat

SEQ ID NO: 407596 - DNA, 140 bp, Artificial Sequence
  Synthetic
atggccgactcccaagtacgatccatcttctgtagatgtctcccactggaataggtgggttgtttgtcatccatgctatctgttcttgaggggtgctagtagttcctgctatatcacttcggagacccagcatggcgtat

SEQ ID NO: 407597 - DNA, 140 bp, Artificial Sequence
  Synthetic
aggccctggctgctgatatgtggaaaactcatctgcaccactaatgtgccttggaacaaaaattggagtgcaaaaactcaagatgaaatttgggaaaacatgacctggatgcagtgggatgaccttttgggacagcggtg

SEQ ID NO: 407598 - DNA, 140 bp, Artificial Sequence
  Synthetic
caccgctgtcccaaaaggtcatcccactgcatccaggtcatgttttcccaaatttcatcttgagtttttgcactccaatttttgttccaaggcacattagtggtgcagatgagttttccacatatcagcagccagggcct

SEQ ID NO: 407599 - DNA, 140 bp, Artificial Sequence
  Synthetic
aggccctggctgctgatatgggaacaatctgtggagttggtttgacataacaaattggctgtggtatataaaaatatttataatgatagtaggaggcttgataggtttaagaataattttgaccttttgggacagcggtg

SEQ ID NO: 407600 - DNA, 140 bp, Artificial Sequence
  Synthetic
caccgctgtcccaaaaggtcaaaattattcttaaacctatcaagcctcctactatcattataaatatttttatataccacagccaatttgttatgtcaaaccaactccacagattgttcccatatcagcagccagggcct

SEQ ID NO: 407601 - DNA, 140 bp, Artificial Sequence
  Synthetic
aggccctggctgctgatatggaaaagaatgaacaagaattattggaattggataaatgggcaaatttgtggagttggtttgacataacaaactggctgtggtatataaaaatattcataagaccttttgggacagcggtg

SEQ ID NO: 407602 - DNA, 140 bp, Artificial Sequence
  Synthetic
caccgctgtcccaaaaggtcttatgaatatttttatataccacagccagtttgttatgtcaaaccaactccacaaatttgcccatttatccaattccaataattcttgttcattcttttccatatcagcagccagggcct

SEQ ID NO: 407603 - DNA, 140 bp, Artificial Sequence
  Synthetic
atacgccatgctgggtctccagccacctggattcctgagggggagtttgtcaacacccctcccctagggaaattatggacccagttagaaaaagaacccatagtaggggcagaatctttccgtacttgggagtcggccat

SEQ ID NO: 407604 - DNA, 140 bp, Artificial Sequence
  Synthetic
atggccgactcccaagtacggaaagattctgcccctactatgggttctttttctaactgggtccataatttccctaggggaggggtgttgacaaactccccctcaggaatccaggtggctggagacccagcatggcgtat

SEQ ID NO: 407605 - DNA, 140 bp, Artificial Sequence
  Synthetic
aggccctggctgctgatatggcaatcatctgggacgacctgcggagcctgtgcctcttcagctaccaccgcttgagagacttactcttgattgtgacaaggattgtggaacttctgggacgaccttttgggacagcggtg

SEQ ID NO: 407606 - DNA, 140 bp, Artificial Sequence
  Synthetic
caccgctgtcccaaaaggtcgtcccagaagttccacaatccttgtcacaatcaagagtaagtctctcaagcggtggtagctgaagaggcacaggctccgcaggtcgtcccagatgattgccatatcagcagccagggcct

SEQ ID NO: 407607 - DNA, 140 bp, Artificial Sequence
  Synthetic
aggccctggctgctgatatgacagataggattatagaaatagtacagagaactggtagagctatctacaacatacctactagaataagacagggctttgaagcagctttgcaataaaatggaccttttgggacagcggtg

SEQ ID NO: 407608 - DNA, 140 bp, Artificial Sequence
  Synthetic
caccgctgtcccaaaaggtccattttattgcaaagctgcttcaaagccctgtcttattctagtaggtatgttgtagatagctctaccagttctctgtactatttctataatcctatctgtcatatcagcagccagggcct

SEQ ID NO: 407609 - DNA, 140 bp, Artificial Sequence
  Synthetic
aggccctggctgctgatatgcctagtacaaacaatgagacaccaggaattagatatcagtacaatgtgcttccacaaggatggaaaggatcaccggcaatattccaaagtagcatgacaagaccttttgggacagcggtg

SEQ ID NO: 407610 - DNA, 140 bp, Artificial Sequence
  Synthetic
caccgctgtcccaaaaggtcttgtcatgctactttggaatattgccggtgatcctttccatccttgtggaagcacattgtactgatatctaattcctggtgtctcattgtttgtactaggcatatcagcagccagggcct

SEQ ID NO: 407611 - DNA, 140 bp, Artificial Sequence
  Synthetic
atacgccatgctgggtctcctgcggccccgaacagggaccttgaaagcgaaagagaaaccagaggagatctctcggcgcaggactcggcttgctgcagcgcgcgtggcaagaggcgagggcgtacttgggagtcggccat

SEQ ID NO: 407612 - DNA, 140 bp, Artificial Sequence
  Synthetic
atggccgactcccaagtacgccctcgcctcttgccacgcgcgctgcagcaagccgagtcctgcgccgagagatctcctctggtttctctttcgctttcaaggtccctgttcggggccgcaggagacccagcatggcgtat

SEQ ID NO: 407613 - DNA, 140 bp, Artificial Sequence
  Synthetic
atacgccatgctgggtctccaacatgacatggatagaatgggagagagaaattagcaattacacaaaccaaatatatgagatacttacagaatcgcagaaccagcaggacagaaatgaaacgtacttgggagtcggccat

SEQ ID NO: 407614 - DNA, 140 bp, Artificial Sequence
  Synthetic
atggccgactcccaagtacgtttcatttctgtcctgctggttctgcgattctgtaagtatctcatatatttggtttgtgtaattgctaatttctctctcccattctatccatgtcatgttggagacccagcatggcgtat

SEQ ID NO: 407615 - DNA, 140 bp, Artificial Sequence
  Synthetic
atacgccatgctgggtctcctaaaaaagtgctctttcaataccaccacagtaataagagataagaaaaagacagtgtctgcacttttttatagaactgatatagtaccacttaacgagaacgtacttgggagtcggccat

SEQ ID NO: 407616 - DNA, 140 bp, Artificial Sequence
  Synthetic
atggccgactcccaagtacgttctcgttaagtggtactatatcagttctataaaaaagtgcagacactgtctttttcttatctcttattactgtggtggtattgaaagagcacttttttaggagacccagcatggcgtat

SEQ ID NO: 407617 - DNA, 140 bp, Artificial Sequence
  Synthetic
aggccctggctgctgatatgacaacaataaaatttgcaccatcctcaggaggggatccagaagttacaacacatagttttaattgtagaggagaatttttctattgcaatacaacaagacgaccttttgggacagcggtg

SEQ ID NO: 407618 - DNA, 140 bp, Artificial Sequence
  Synthetic
caccgctgtcccaaaaggtcgtcttgttgtattgcaatagaaaaattctcctctacaattaaaactatgtgttgtaacttctggatcccctcctgaggatggtgcaaattttattgttgtcatatcagcagccagggcct

SEQ ID NO: 407619 - DNA, 140 bp, Artificial Sequence
  Synthetic
aggccctggctgctgatatggaaaaaatataagataaaacatttagtatgggcaagcagagagttggaaagatttgcacttaaccctggccttttagaaacagcagaaggatgtcaacaagaccttttgggacagcggtg

SEQ ID NO: 407620 - DNA, 140 bp, Artificial Sequence
  Synthetic
caccgctgtcccaaaaggtcttgttgacatccttctgctgtttctaaaaggccagggttaagtgcaaatctttccaactctctgcttgcccatactaaatgttttatcttatattttttccatatcagcagccagggcct

SEQ ID NO: 407621 - DNA, 140 bp, Artificial Sequence
  Synthetic
atacgccatgctgggtctccggacagtacagcctatagtgctgccagaaaaagacagctggactgtcaatgacatacagaagttagtgggaaaattgaattgggcaagtcagatttatgccgtacttgggagtcggccat

SEQ ID NO: 407622 - DNA, 140 bp, Artificial Sequence
  Synthetic
atggccgactcccaagtacggcataaatctgacttgcccaattcaattttcccactaacttctgtatgtcattgacagtccagctgtctttttctggcagcactataggctgtactgtccggagacccagcatggcgtat

SEQ ID NO: 407623 - DNA, 140 bp, Artificial Sequence
  Synthetic
aggccctggctgctgatatgcatggtagaacagatgcatgaggatataatcagtttatgggatcagagcctaaaaccatgtgtaaaattaaccccactctgtgtcactttaaattgcactgaccttttgggacagcggtg

SEQ ID NO: 407624 - DNA, 140 bp, Artificial Sequence
  Synthetic
caccgctgtcccaaaaggtcagtgcaatttaaagtgacacagagtggggttaattttacacatggttttaggctctgatcccataaactgattatatcctcatgcatctgttctaccatgcatatcagcagccagggcct

SEQ ID NO: 407625 - DNA, 140 bp, Artificial Sequence
  Synthetic
atacgccatgctgggtctccgtaaaaatgttacctacaatgagagtatgcaggaaataaaaaattgctctttcaatgcaaccacagatttaagagataggaagcagacagtgcaggcactcgtacttgggagtcggccat

SEQ ID NO: 407626 - DNA, 140 bp, Artificial Sequence
  Synthetic
atggccgactcccaagtacgagtgcctgcactgtctgcttcctatctcttaaatctgtggttgcattgaaagagcaattttttatttcctgcatactctcattgtaggtaacatttttacggagacccagcatggcgtat

SEQ ID NO: 407627 - DNA, 140 bp, Artificial Sequence
  Synthetic
atacgccatgctgggtctccaattaagagaataagtgaaagagcagaagatagtggcaatgagagtgatggggacacggatgaattggcaaaacttgtggagatggggaactatgatcttcgtacttgggagtcggccat

SEQ ID NO: 407628 - DNA, 140 bp, Artificial Sequence
  Synthetic
atggccgactcccaagtacgaagatcatagttccccatctccacaagttttgccaattcatccgtgtccccatcactctcattgccactatcttctgctctttcacttattctcttaattggagacccagcatggcgtat

SEQ ID NO: 407629 - DNA, 140 bp, Artificial Sequence
  Synthetic
atacgccatgctgggtctccgagaaataaacataacggaaactgaagaaataaaaaactgctctttcaatacgaccacagaactaagagataaaagacagaatgtatattcacttttttacgtacttgggagtcggccat

SEQ ID NO: 407630 - DNA, 140 bp, Artificial Sequence
  Synthetic
atggccgactcccaagtacgtaaaaaagtgaatatacattctgtcttttatctcttagttctgtggtcgtattgaaagagcagttttttatttcttcagtttccgttatgtttatttctcggagacccagcatggcgtat

SEQ ID NO: 407631 - DNA, 140 bp, Artificial Sequence
  Synthetic
aggccctggctgctgatatgtccaggcaaggatcctggctgtagaaagatacctaaaggatcaacagctcctaggaatttggggctgctctggaaaactcatctgcaccactaatgtgccgaccttttgggacagcggtg

SEQ ID NO: 407632 - DNA, 140 bp, Artificial Sequence
  Synthetic
caccgctgtcccaaaaggtcggcacattagtggtgcagatgagttttccagagcagccccaaattcctaggagctgttgatcctttaggtatctttctacagccaggatccttgcctggacatatcagcagccagggcct

SEQ ID NO: 407633 - DNA, 140 bp, Artificial Sequence
  Synthetic
atacgccatgctgggtctccttaattgtaccagacctagcaacaatacaagaaaaggtatacatataggaccaggacaagcattctatgcaacagatgctataataggggacataagacgcgtacttgggagtcggccat

SEQ ID NO: 407634 - DNA, 140 bp, Artificial Sequence
  Synthetic
atggccgactcccaagtacgcgtcttatgtcccctattatagcatctgttgcatagaatgcttgtcctggtcctatatgtataccttttcttgtattgttgctaggtctggtacaattaaggagacccagcatggcgtat

SEQ ID NO: 407635 - DNA, 140 bp, Artificial Sequence
  Synthetic
aggccctggctgctgatatgtcctcaggaggggatgtagaaattacaacacatagttttaattgtggaggagagtttttctattgtaatacatcaggcctgtttaacagtacttggaatagaccttttgggacagcggtg

SEQ ID NO: 407636 - DNA, 140 bp, Artificial Sequence
  Synthetic
caccgctgtcccaaaaggtctattccaagtactgttaaacaggcctgatgtattacaatagaaaaactctcctccacaattaaaactatgtgttgtaatttctacatcccctcctgaggacatatcagcagccagggcct

SEQ ID NO: 407637 - DNA, 140 bp, Artificial Sequence
  Synthetic
aggccctggctgctgatatgttcagacctggaggaggagatatgagagacaattggagaagtgaattatacaaatataaagtagtaaaaattgaaccaataggagtagcacccaccaagggaccttttgggacagcggtg

SEQ ID NO: 407638 - DNA, 140 bp, Artificial Sequence
  Synthetic
caccgctgtcccaaaaggtcccttggtgggtgctactcctattggttcaatttttactactttatatttgtataattcacttctccaattgtctctcatatctcctcctccaggtctgaacatatcagcagccagggcct

SEQ ID NO: 407639 - DNA, 140 bp, Artificial Sequence
  Synthetic
atacgccatgctgggtctcctggcaaatagacaggatgaggattagaacatggcatagtttagtaaaacaccataagtatatttcaaagaaagccaagaactggatttatagacctcactcgtacttgggagtcggccat

SEQ ID NO: 407640 - DNA, 140 bp, Artificial Sequence
  Synthetic
atggccgactcccaagtacgagtgaggtctataaatccagttcttggctttctttgaaatatacttatggtgttttactaaactatgccatgttctaatcctcatcctgtctatttgccaggagacccagcatggcgtat

SEQ ID NO: 407641 - DNA, 140 bp, Artificial Sequence
  Synthetic
atacgccatgctgggtctccagcagcagagggagtaggggcagcttctcaagacttagaaaaacatggggcacttacaaccagcaacacagccaccaacaatgctgcttgtgcctggctgcgtacttgggagtcggccat

SEQ ID NO: 407642 - DNA, 140 bp, Artificial Sequence
  Synthetic
atggccgactcccaagtacgcagccaggcacaagcagcattgttggtggctgtgttgctggttgtaagtgccccatgtttttctaagtcttgagaagctgcccctactccctctgctgctggagacccagcatggcgtat

SEQ ID NO: 407643 - DNA, 140 bp, Artificial Sequence
  Synthetic
atacgccatgctgggtctcccacttacaaccagcaacacagccaccaacaatgctgcttgtgcctggctggaagcacaagaggaggaagaagaagtaggctttccagtcagacctcaggtcgtacttgggagtcggccat

SEQ ID NO: 407644 - DNA, 140 bp, Artificial Sequence
  Synthetic
atggccgactcccaagtacgacctgaggtctgactggaaagcctacttcttcttcctcctcttgtgcttccagccaggcacaagcagcattgttggtggctgtgttgctggttgtaagtgggagacccagcatggcgtat

SEQ ID NO: 407645 - DNA, 140 bp, Artificial Sequence
  Synthetic
aggccctggctgctgatatgaggttgataagttgtaacacctcaactattacccaagcctgtccaaaggtatcctttgaaccaattcccatacattattgtaccccggctggttttgcgcgaccttttgggacagcggtg

SEQ ID NO: 407646 - DNA, 140 bp, Artificial Sequence
  Synthetic
caccgctgtcccaaaaggtcgcgcaaaaccagccggggtacaataatgtatgggaattggttcaaaggatacctttggacaggcttgggtaatagttgaggtgttacaacttatcaacctcatatcagcagccagggcct

SEQ ID NO: 407647 - DNA, 140 bp, Artificial Sequence
  Synthetic
aggccctggctgctgatatgtataggaccagggagaacattttatgcaacaggaaaaataataggagatataagacaagcacattgtaacattagtagagcagaatggaataccactttagaccttttgggacagcggtg

SEQ ID NO: 407648 - DNA, 140 bp, Artificial Sequence
  Synthetic
caccgctgtcccaaaaggtctaaagtggtattccattctgctctactaatgttacaatgtgcttgtcttatatctcctattatttttcctgttgcataaaatgttctccctggtcctatacatatcagcagccagggcct

SEQ ID NO: 407649 - DNA, 140 bp, Artificial Sequence
  Synthetic
aggccctggctgctgatatgagaatataagaaaatagtaaggcaaagaagaataaatagcttatatgaaagactaatagaaagagcagaagacagtggcaatgagagtgagggggatgcagaccttttgggacagcggtg

SEQ ID NO: 407650 - DNA, 140 bp, Artificial Sequence
  Synthetic
caccgctgtcccaaaaggtctgcatccccctcactctcattgccactgtcttctgctctttctattagtctttcatataagctatttattcttctttgccttactattttcttatattctcatatcagcagccagggcct

SEQ ID NO: 407651 - DNA, 140 bp, Artificial Sequence
  Synthetic
  misc_feature (31)..(31): n is a, c, g, or t
atacgccatgctgggtctcccgcatggctgnaagcgcaagaagaagggggggtaggctttccagtcatgccacaagtaccactgaggcccatgacttataagggagctttcgatctcagccgtacttgggagtcggccat

SEQ ID NO: 407652 - DNA, 140 bp, Artificial Sequence
  Synthetic
  misc_feature (110)..(110): n is a, c, g, or t
atggccgactcccaagtacggctgagatcgaaagctcccttataagtcatgggcctcagtggtacttgtggcatgactggaaagcctacccccccttcttcttgcgcttncagccatgcgggagacccagcatggcgtat

SEQ ID NO: 407653 - DNA, 140 bp, Artificial Sequence
  Synthetic
aggccctggctgctgatatgagtctaaagccatgtgtaaaattaaccccactctgtgttactttaaattgcagtaattacatcccaccctgtgttaatagcactaagagtactaattgcagaccttttgggacagcggtg

SEQ ID NO: 407654 - DNA, 140 bp, Artificial Sequence
  Synthetic
caccgctgtcccaaaaggtctgcaattagtactcttagtgctattaacacagggtgggatgtaattactgcaatttaaagtaacacagagtggggttaattttacacatggctttagactcatatcagcagccagggcct

SEQ ID NO: 407655 - DNA, 140 bp, Artificial Sequence
  Synthetic
aggccctggctgctgatatgtgacctggatgcagtgggaaaaagaaattagcaattacacaagcttaatatacaccttaattgaagaatcacacatccaacaagaaaagaatgaaaaagagaccttttgggacagcggtg

SEQ ID NO: 407656 - DNA, 140 bp, Artificial Sequence
  Synthetic
caccgctgtcccaaaaggtctctttttcattcttttcttgttggatgtgtgattcttcaattaaggtgtatattaagcttgtgtaattgctaatttctttttcccactgcatccaggtcacatatcagcagccagggcct

SEQ ID NO: 407657 - DNA, 140 bp, Artificial Sequence
  Synthetic
atacgccatgctgggtctccaggaagagcattttatgcaacaggaaatataataggaaatataagacaagcacattgcaatattagtaaagcaggatggaataaagtgttaagacaggtacgtacttgggagtcggccat

SEQ ID NO: 407658 - DNA, 140 bp, Artificial Sequence
  Synthetic
atggccgactcccaagtacgtacctgtcttaacactttattccatcctgctttactaatattgcaatgtgcttgtcttatatttcctattatatttcctgttgcataaaatgctcttcctggagacccagcatggcgtat

SEQ ID NO: 407659 - DNA, 140 bp, Artificial Sequence
  Synthetic
atacgccatgctgggtctccacactctggaggggatccagaaattgtaatgcacagttttaattgtggaggggaatttttttactgtaatacgtcaaaactgtttgatagtacctggaatcgtacttgggagtcggccat

SEQ ID NO: 407660 - DNA, 140 bp, Artificial Sequence
  Synthetic
atggccgactcccaagtacgattccaggtactatcaaacagttttgacgtattacagtaaaaaaattcccctccacaattaaaactgtgcattacaatttctggatcccctccagagtgtggagacccagcatggcgtat

SEQ ID NO: 407661 - DNA, 140 bp, Artificial Sequence
  Synthetic
aggccctggctgctgatatggagacaggctaattttttagggaaaatttggccttccaagggaaggccggggaattttcctcagagcagaccagaaccaacagccccaccagcagaaaacgaccttttgggacagcggtg

SEQ ID NO: 407662 - DNA, 140 bp, Artificial Sequence
  Synthetic
caccgctgtcccaaaaggtcgttttctgctggtggggctgttggttctggtctgctctgaggaaaattccccggccttcccttggaaggccaaattttccctaaaaaattagcctgtctccatatcagcagccagggcct

SEQ ID NO: 407663 - DNA, 140 bp, Artificial Sequence
  Synthetic
aggccctggctgctgatatgttggaatagtagttggaataataaaactcagaaggagatttgggataacatgacctggatgcagtgggataaagaaattaacaattacacaaacttaatagaccttttgggacagcggtg

SEQ ID NO: 407664 - DNA, 140 bp, Artificial Sequence
  Synthetic
caccgctgtcccaaaaggtctattaagtttgtgtaattgttaatttctttatcccactgcatccaggtcatgttatcccaaatctccttctgagttttattattccaactactattccaacatatcagcagccagggcct

SEQ ID NO: 407665 - DNA, 140 bp, Artificial Sequence
  Synthetic
aggccctggctgctgatatgcagataggattatagaagtagtacaaagaatttgcagagcttttcgccacgtacctagaagaataagacagggcttggaaaggattttgctataagatgggaccttttgggacagcggtg

SEQ ID NO: 407666 - DNA, 140 bp, Artificial Sequence
  Synthetic
caccgctgtcccaaaaggtcccatcttatagcaaaatcctttccaagccctgtcttattcttctaggtacgtggcgaaaagctctgcaaattctttgtactacttctataatcctatctgcatatcagcagccagggcct

SEQ ID NO: 407667 - DNA, 140 bp, Artificial Sequence
  Synthetic
atacgccatgctgggtctccaaaattgctctttcaacacaaccacagaattaagagataaggaacagaaagcgtatgcacttttttatagatctgatgtagtaccaattaataatgataacgtacttgggagtcggccat

SEQ ID NO: 407668 - DNA, 140 bp, Artificial Sequence
  Synthetic
atggccgactcccaagtacgttatcattattaattggtactacatcagatctataaaaaagtgcatacgctttctgttccttatctcttaattctgtggttgtgttgaaagagcaattttggagacccagcatggcgtat

SEQ ID NO: 407669 - DNA, 140 bp, Artificial Sequence
  Synthetic
aggccctggctgctgatatggtggcgcccgaacagggacctgaaagcgaaagagaaaccagaggagctctctcgacgcaggactcggcttgctgaagcgcgcacagcaagaggcgagggggaccttttgggacagcggtg

SEQ ID NO: 407670 - DNA, 140 bp, Artificial Sequence
  Synthetic
caccgctgtcccaaaaggtccccctcgcctcttgctgtgcgcgcttcagcaagccgagtcctgcgtcgagagagctcctctggtttctctttcgctttcaggtccctgttcgggcgccaccatatcagcagccagggcct

SEQ ID NO: 407671 - DNA, 140 bp, Artificial Sequence
  Synthetic
aggccctggctgctgatatgctcgacgcaggactcggcttgctgaagcgcgcacagcaagaggcgaggggcggcggctggtgagtacgccaaatttttgactagcggaggctagaaggaggaccttttgggacagcggtg

SEQ ID NO: 407672 - DNA, 140 bp, Artificial Sequence
  Synthetic
caccgctgtcccaaaaggtcctccttctagcctccgctagtcaaaaatttggcgtactcaccagccgccgcccctcgcctcttgctgtgcgcgcttcagcaagccgagtcctgcgtcgagcatatcagcagccagggcct

SEQ ID NO: 407673 - DNA, 140 bp, Artificial Sequence
  Synthetic
atacgccatgctgggtctccaataattagctctaaaaatctgacagacaatggcaaaacaataatagtacgccttaatcagtctgtagagattgagtgtacaagagtcagcaataatacacgtacttgggagtcggccat

SEQ ID NO: 407674 - DNA, 140 bp, Artificial Sequence
  Synthetic
atggccgactcccaagtacgtgtattattgctgactcttgtacactcaatctctacagactgattaaggcgtactattattgttttgccattgtctgtcagatttttagagctaattattggagacccagcatggcgtat

SEQ ID NO: 407675 - DNA, 140 bp, Artificial Sequence
  Synthetic
atacgccatgctgggtctcctataataggagacataaggaaagcacattgtaacatcaaaggatggaacgaaactttagagagggtaaggaaaaaattacaagaaaaagtcaatagaacacgtacttgggagtcggccat

SEQ ID NO: 407676 - DNA, 140 bp, Artificial Sequence
  Synthetic
atggccgactcccaagtacgtgttctattgactttttcttgtaattttttccttaccctctctaaagtttcgttccatcctttgatgttacaatgtgctttccttatgtctcctattataggagacccagcatggcgtat

SEQ ID NO: 407677 - DNA, 140 bp, Artificial Sequence
  Synthetic
atacgccatgctgggtctccataaaatttaattcattaccaggaggggacccagaagttacaatgcatagttttaattgtggaggagaatttttctattgcgatacatcactactgtttacgtacttgggagtcggccat

SEQ ID NO: 407678 - DNA, 140 bp, Artificial Sequence
  Synthetic
atggccgactcccaagtacgtaaacagtagtgatgtatcgcaatagaaaaattctcctccacaattaaaactatgcattgtaacttctgggtcccctcctggtaatgaattaaattttatggagacccagcatggcgtat

SEQ ID NO: 407679 - DNA, 140 bp, Artificial Sequence
  Synthetic
aggccctggctgctgatatgtgtttattcatttcagaattgggtgccagcatagcagaataggcattttgcgacagagaagagcaagaaatggagccagtagatcctaacctagagccctgaccttttgggacagcggtg

SEQ ID NO: 407680 - DNA, 140 bp, Artificial Sequence
  Synthetic
caccgctgtcccaaaaggtcagggctctaggttaggatctactggctccatttcttgctcttctctgtcgcaaaatgcctattctgctatgctggcacccaattctgaaatgaataaacacatatcagcagccagggcct

SEQ ID NO: 407681 - DNA, 140 bp, Artificial Sequence
  Synthetic
aggccctggctgctgatatggttgtggtatataaaaatattcatcataatagtagtaagcttaataggtttaagaataatttttgttgtgctctctatagtaaaaagagttaggcagggagaccttttgggacagcggtg

SEQ ID NO: 407682 - DNA, 140 bp, Artificial Sequence
  Synthetic
caccgctgtcccaaaaggtctccctgcctaactctttttactatagagagcacaacaaaaattattcttaaacctattaagcttactactattatgatgaatatttttatataccacaaccatatcagcagccagggcct

SEQ ID NO: 407683 - DNA, 140 bp, Artificial Sequence
  Synthetic
aggccctggctgctgatatgtaaattgtacaaatactactcaaaatgctaatgttaccatgaatggagaaatgaaaaattgctctttcaatgtaaccacagaactaagagataaaaaacagaccttttgggacagcggtg

SEQ ID NO: 407684 - DNA, 140 bp, Artificial Sequence
  Synthetic
caccgctgtcccaaaaggtctgttttttatctcttagttctgtggttacattgaaagagcaatttttcatttctccattcatggtaacattagcattttgagtagtatttgtacaatttacatatcagcagccagggcct

SEQ ID NO: 407685 - DNA, 140 bp, Artificial Sequence
  Synthetic
aggccctggctgctgatatgtgtagaaatgttagcagaaatgttagcagttataatacctacaatgggagcgtggaggaaataaaaaattgctctttcaatgcaaccccagaagtaagaggaccttttgggacagcggtg

SEQ ID NO: 407686 - DNA, 140 bp, Artificial Sequence
  Synthetic
caccgctgtcccaaaaggtcctcttacttctggggttgcattgaaagagcaattttttatttcctccacgctcccattgtaggtattataactgctaacatttctgctaacatttctacacatatcagcagccagggcct

SEQ ID NO: 407687 - DNA, 140 bp, Artificial Sequence
  Synthetic
aggccctggctgctgatatgccctattttgtgcatcagatgccaaagcacatgtgacagaagtgcacaatgtctgggccacacatgcctgtgtacccacagaccccaacccacaagaaatgaccttttgggacagcggtg

SEQ ID NO: 407688 - DNA, 140 bp, Artificial Sequence
  Synthetic
caccgctgtcccaaaaggtcatttcttgtgggttggggtctgtgggtacacaggcatgtgtggcccagacattgtgcacttctgtcacatgtgctttggcatctgatgcacaaaatagggcatatcagcagccagggcct

SEQ ID NO: 407689 - DNA, 140 bp, Artificial Sequence
  Synthetic
  misc_feature (61)..(61): n is a, c, g, or t
  misc_feature (74)..(74): n is a, c, g, or t
atacgccatgctgggtctccccctctctgcgttactttaaattgcaccaacataaccaatnccaacataacggnggacatgaaagaagaaataaaaaactgctcttacaatgtgaccacacgtacttgggagtcggccat

SEQ ID NO: 407690 - DNA, 140 bp, Artificial Sequence
  Synthetic
  misc_feature (67)..(67): n is a, c, g, or t
  misc_feature (80)..(80): n is a, c, g, or t
atggccgactcccaagtacgtgtggtcacattgtaagagcagttttttatttcttctttcatgtccnccgttatgttggnattggttatgttggtgcaatttaaagtaacgcagagagggggagacccagcatggcgtat

SEQ ID NO: 407691 - DNA, 140 bp, Artificial Sequence
  Synthetic
atacgccatgctgggtctcccaaaaccataatagtgcaccttaataaatctgtagaaatcaattgtaccagaccctccaacaatacaagaacaagtataactataggaccaggacaagtacgtacttgggagtcggccat

SEQ ID NO: 407692 - DNA, 140 bp, Artificial Sequence
  Synthetic
atggccgactcccaagtacgtacttgtcctggtcctatagttatacttgttcttgtattgttggagggtctggtacaattgatttctacagatttattaaggtgcactattatggttttgggagacccagcatggcgtat

SEQ ID NO: 407693 - DNA, 140 bp, Artificial Sequence
  Synthetic
aggccctggctgctgatatgctttaatcactcctcaggaggggacccagaaattgtaatgcacagttttaattgtggaggggaatttttctactgtaattcaacacaactgtttaatagtgaccttttgggacagcggtg

SEQ ID NO: 407694 - DNA, 140 bp, Artificial Sequence
  Synthetic
caccgctgtcccaaaaggtcactattaaacagttgtgttgaattacagtagaaaaattcccctccacaattaaaactgtgcattacaatttctgggtcccctcctgaggagtgattaaagcatatcagcagccagggcct

SEQ ID NO: 407695 - DNA, 140 bp, Artificial Sequence
  Synthetic
atacgccatgctgggtctccaagcattttatgcagcaggagaaataataggagacatcagaaaagcatattgtactattaatggaacacaatggaatgacactttagaacaggtaaaggccgtacttgggagtcggccat

SEQ ID NO: 407696 - DNA, 140 bp, Artificial Sequence
  Synthetic
atggccgactcccaagtacggcctttacctgttctaaagtgtcattccattgtgttccattaatagtacaatatgcttttctgatgtctcctattatttctcctgctgcataaaatgcttggagacccagcatggcgtat

SEQ ID NO: 407697 - DNA, 140 bp, Artificial Sequence
  Synthetic
  misc_feature (84)..(84): n is a, c, g, or t
atacgccatgctgggtctccaaacaatgctaaaaccataatagtacagcttaatgagtctgtaacaattaattgtaccagaccnagcaacaatacaagaaaaagtatacgtataggaccacgtacttgggagtcggccat

SEQ ID NO: 407698 - DNA, 140 bp, Artificial Sequence
  Synthetic
  misc_feature (57)..(57): n is a, c, g, or t
atggccgactcccaagtacgtggtcctatacgtatactttttcttgtattgttgctnggtctggtacaattaattgttacagactcattaagctgtactattatggttttagcattgtttggagacccagcatggcgtat

SEQ ID NO: 407699 - DNA, 140 bp, Artificial Sequence
  Synthetic
  misc_feature (104)..(104): n is a, c, g, or t
atacgccatgctgggtctccggacaagcattttatgcaacagatataatagggaatataagacaagcacattgtaatgtcagtaaatcaaaatggcatgaaacnttaagacaggtagctgcgtacttgggagtcggccat

SEQ ID NO: 407700 - DNA, 140 bp, Artificial Sequence
  Synthetic
  misc_feature (37)..(37): n is a, c, g, or t
atggccgactcccaagtacgcagctacctgtcttaangtttcatgccattttgatttactgacattacaatgtgcttgtcttatattccctattatatctgttgcataaaatgcttgtccggagacccagcatggcgtat

SEQ ID NO: 407701 - DNA, 140 bp, Artificial Sequence
  Synthetic
aggccctggctgctgatatgctatctacaacatacctagaagaataagacagggctttgaagcagctttgcaataaaatggggggcaagtggtcaaaaagcagcatagttggatggcctggaccttttgggacagcggtg

SEQ ID NO: 407702 - DNA, 140 bp, Artificial Sequence
  Synthetic
caccgctgtcccaaaaggtccaggccatccaactatgctgctttttgaccacttgccccccattttattgcaaagctgcttcaaagccctgtcttattcttctaggtatgttgtagatagcatatcagcagccagggcct

SEQ ID NO: 407703 - DNA, 140 bp, Artificial Sequence
  Synthetic
atacgccatgctgggtctcccaggaggggacctagaaattacaacacatatttttaattgtagaggagaatttttttactgcaatacatcagaactgtttaataacacaaaaaacaatggcgtacttgggagtcggccat

SEQ ID NO: 407704 - DNA, 140 bp, Artificial Sequence
  Synthetic
atggccgactcccaagtacgccattgttttttgtgttattaaacagttctgatgtattgcagtaaaaaaattctcctctacaattaaaaatatgtgttgtaatttctaggtcccctcctgggagacccagcatggcgtat

SEQ ID NO: 407705 - DNA, 140 bp, Artificial Sequence
  Synthetic
aggccctggctgctgatatgaaggatgtcagcaaataatagaacagttacaaccagctctcaagacaggatcagaagaacttaaatcattatttaatacagtagcaaccctctggtgtgtgaccttttgggacagcggtg

SEQ ID NO: 407706 - DNA, 140 bp, Artificial Sequence
  Synthetic
caccgctgtcccaaaaggtcacacaccagagggttgctactgtattaaataatgatttaagttcttctgatcctgtcttgagagctggttgtaactgttctattatttgctgacatccttcatatcagcagccagggcct

SEQ ID NO: 407707 - DNA, 140 bp, Artificial Sequence
  Synthetic
aggccctggctgctgatatgcatgcctgtgtacccacagaccccaacccacaagaaatggtattgggaaatgtaacagaaaattttaacatgtggaaaaataacatggtagaacagatgcgaccttttgggacagcggtg

SEQ ID NO: 407708 - DNA, 140 bp, Artificial Sequence
  Synthetic
caccgctgtcccaaaaggtcgcatctgttctaccatgttatttttccacatgttaaaattttctgttacatttcccaataccatttcttgtgggttggggtctgtgggtacacaggcatgcatatcagcagccagggcct

SEQ ID NO: 407709 - DNA, 140 bp, Artificial Sequence
  Synthetic
aggccctggctgctgatatgtacctagaagaattagacagggcttagaaggagctttgctgtaacatgggtggcaagtggtcaaaaagtagcatagtgggatggcctgaggttagggaaagaccttttgggacagcggtg

SEQ ID NO: 407710 - DNA, 140 bp, Artificial Sequence
  Synthetic
caccgctgtcccaaaaggtctttccctaacctcaggccatcccactatgctactttttgaccacttgccacccatgttacagcaaagctccttctaagccctgtctaattcttctaggtacatatcagcagccagggcct
